United States Patent 12,624,385 (RIBOREGULATORS AND METHODS OF USE THEREOF) - sequence listing, part 8

SEQ ID NO: 119361 - DNA, 103 bp, Artificial Sequence
  Synthetic Polynucleotide
taatacgactcactatagggtggaggtgtatatgaaattcgttcctgcttaacagaggagaaagcagatgcgaatttcaaacctggcggcagcgcaaaagatg

SEQ ID NO: 119362 - DNA, 103 bp, Artificial Sequence
  Synthetic Polynucleotide
taatacgactcactatagggtatagagtttccagggtggaagaatggtgaaacagaggagatcaccaatgttccaccctaacctggcggcagcgcaaaagatg

SEQ ID NO: 119363 - DNA, 103 bp, Artificial Sequence
  Synthetic Polynucleotide
taatacgactcactataggggctgtgtgtgtatagagtttccagggtggaaacagaggagatccaccatggaaactctaaacctggcggcagcgcaaaagatg

SEQ ID NO: 119364 - DNA, 103 bp, Artificial Sequence
  Synthetic Polynucleotide
taatacgactcactatagggatgacctccggctgtgtgtgtatagagtttaacagaggagaaaactcatgacacacacaaacctggcggcagcgcaaaagatg

SEQ ID NO: 119365 - DNA, 103 bp, Artificial Sequence
  Synthetic Polynucleotide
taatacgactcactatagggctgatgcagtatgacctccggctgtgtgtgaacagaggagacacacaatgccggaggtcaacctggcggcagcgcaaaagatg

SEQ ID NO: 119366 - DNA, 103 bp, Artificial Sequence
  Synthetic Polynucleotide
taatacgactcactatagggcttcatggttctgatgcagtatgacctccgaacagaggagacggaggatgtactgcatcaacctggcggcagcgcaaaagatg

SEQ ID NO: 119367 - DNA, 103 bp, Artificial Sequence
  Synthetic Polynucleotide
taatacgactcactatagggcagttatcttcttcatggttctgatgcagtaacagaggagaactgcaatggaaccatgaaacctggcggcagcgcaaaagatg

SEQ ID NO: 119368 - DNA, 103 bp, Artificial Sequence
  Synthetic Polynucleotide
taatacgactcactatagggcctctggacacagttatcttcttcatggttaacagaggagaaaccatatggaagataacaacctggcggcagcgcaaaagatg

SEQ ID NO: 119369 - DNA, 103 bp, Artificial Sequence
  Synthetic Polynucleotide
taatacgactcactataggggcctgggggtcctctggacacagttatcttaacagaggagaaagataatggtgtccagaaacctggcggcagcgcaaaagatg

SEQ ID NO: 119370 - DNA, 103 bp, Artificial Sequence
  Synthetic Polynucleotide
taatacgactcactatagggtccacggatggcctgggggtcctctggacaaacagaggagatgtccaatggacccccagaacctggcggcagcgcaaaagatg

SEQ ID NO: 119371 - DNA, 103 bp, Artificial Sequence
  Synthetic Polynucleotide
taatacgactcactataggggtgcacattatccacggatggcctgggggtaacagaggagaacccccatgccatccgtgaacctggcggcagcgcaaaagatg

SEQ ID NO: 119372 - DNA, 103 bp, Artificial Sequence
  Synthetic Polynucleotide
taatacgactcactatagggctgggctctctggaggtgtatatgaaattcaacagaggagagaatttatgatacacctcaacctggcggcagcgcaaaagatg

SEQ ID NO: 119373 - DNA, 103 bp, Artificial Sequence
  Synthetic Polynucleotide
taatacgactcactataggggagggttatggtgcacattatccacggatgaacagaggagacatccgatgataatgtgcaacctggcggcagcgcaaaagatg

SEQ ID NO: 119374 - DNA, 103 bp, Artificial Sequence
  Synthetic Polynucleotide
taatacgactcactatagggtcaatggtgggagggttatggtgcacattaaacagaggagataatgtatgccataacccaacctggcggcagcgcaaaagatg

SEQ ID NO: 119375 - DNA, 103 bp, Artificial Sequence
  Synthetic Polynucleotide
taatacgactcactataggggtgcaacagttcaatggtgggagggttatgaacagaggagacataacatgcccaccattaacctggcggcagcgcaaaagatg

SEQ ID NO: 119376 - DNA, 103 bp, Artificial Sequence
  Synthetic Polynucleotide
taatacgactcactatagggacctggagcggtgcaacagttcaatggtggaacagaggagaccaccaatgaactgttgcaacctggcggcagcgcaaaagatg

SEQ ID NO: 119377 - DNA, 103 bp, Artificial Sequence
  Synthetic Polynucleotide
taatacgactcactataggggtgataggtgacctggagcggtgcaacagtaacagaggagaactgttatgccgctccagaacctggcggcagcgcaaaagatg

SEQ ID NO: 119378 - DNA, 103 bp, Artificial Sequence
  Synthetic Polynucleotide
taatacgactcactataggggtgatttgtcgtgataggtgacctggagcgaacagaggagacgctccatgtcacctatcaacctggcggcagcgcaaaagatg

SEQ ID NO: 119379 - DNA, 103 bp, Artificial Sequence
  Synthetic Polynucleotide
taatacgactcactataggggagaaggccggtgatttgtcgtgataggtgaacagaggagacacctaatgcgacaaatcaacctggcggcagcgcaaaagatg

SEQ ID NO: 119380 - DNA, 103 bp, Artificial Sequence
  Synthetic Polynucleotide
taatacgactcactatagggtcggggtcaggagaaggccggtgatttgtcaacagaggagagacaaaatgccggccttcaacctggcggcagcgcaaaagatg

SEQ ID NO: 119381 - DNA, 103 bp, Artificial Sequence
  Synthetic Polynucleotide
taatacgactcactataggggggccgctgctcggggtcaggagaaggccgaacagaggagacggcctatgcctgaccccaacctggcggcagcgcaaaagatg

SEQ ID NO: 119382 - DNA, 103 bp, Artificial Sequence
  Synthetic Polynucleotide
taatacgactcactataggggggaccggaggggccgctgctcggggtcagaacagaggagactgaccatgagcagcggcaacctggcggcagcgcaaaagatg

SEQ ID NO: 119383 - DNA, 103 bp, Artificial Sequence
  Synthetic Polynucleotide
taatacgactcactatagggtaactcggcactgggctctctggaggtgtaaacagaggagatacaccatgagagagcccaacctggcggcagcgcaaaagatg

SEQ ID NO: 119384 - DNA, 103 bp, Artificial Sequence
  Synthetic Polynucleotide
taatacgactcactatagggttgtccaggggggaccggaggggccgctgcaacagaggagagcagcgatgcctccggtcaacctggcggcagcgcaaaagatg

SEQ ID NO: 119385 - DNA, 103 bp, Artificial Sequence
  Synthetic Polynucleotide
taatacgactcactataggggcggatcatgttgtccaggggggaccggagaacagaggagactccggatgcccctggacaacctggcggcagcgcaaaagatg

SEQ ID NO: 119386 - DNA, 103 bp, Artificial Sequence
  Synthetic Polynucleotide
taatacgactcactataggggggagaggcggcggatcatgttgtccagggaacagaggagaccctggatgacatgatccaacctggcggcagcgcaaaagatg

SEQ ID NO: 119387 - DNA, 103 bp, Artificial Sequence
  Synthetic Polynucleotide
taatacgactcactatagggctctcagccggggagaggcggcggatcatgaacagaggagacatgatatgccgcctctcaacctggcggcagcgcaaaagatg

SEQ ID NO: 119388 - DNA, 103 bp, Artificial Sequence
  Synthetic Polynucleotide
taatacgactcactatagggtccctgagctctctcagccggggagaggcgaacagaggagacgcctcatgccggctgagaacctggcggcagcgcaaaagatg

SEQ ID NO: 119389 - DNA, 103 bp, Artificial Sequence
  Synthetic Polynucleotide
taatacgactcactataggggcggcctgggtccctgagctctctcagccgaacagaggagacggctgatggagctcaggaacctggcggcagcgcaaaagatg

SEQ ID NO: 119390 - DNA, 103 bp, Artificial Sequence
  Synthetic Polynucleotide
taatacgactcactatagggttctcctggtgcggcctgggtccctgagctaacagaggagaagctcaatgacccaggccaacctggcggcagcgcaaaagatg

SEQ ID NO: 119391 - DNA, 103 bp, Artificial Sequence
  Synthetic Polynucleotide
taatacgactcactatagggctggtggttgttctcctggtgcggcctgggaacagaggagacccaggatgcaccaggagaacctggcggcagcgcaaaagatg

SEQ ID NO: 119392 - DNA, 103 bp, Artificial Sequence
  Synthetic Polynucleotide
taatacgactcactatagggggtaggactcctggtggttgttctcctggtaacagaggagaaccaggatgacaaccaccaacctggcggcagcgcaaaagatg

SEQ ID NO: 119393 - DNA, 103 bp, Artificial Sequence
  Synthetic Polynucleotide
taatacgactcactatagggactgacagagggtaggactcctggtggttgaacagaggagacaaccaatgggagtcctaaacctggcggcagcgcaaaagatg

SEQ ID NO: 119394 - DNA, 103 bp, Artificial Sequence
  Synthetic Polynucleotide
taatacgactcactatagggcgaggaagcgtaactcggcactgggctctcaacagaggagagagagcatggtgccgagtaacctggcggcagcgcaaaagatg

SEQ ID NO: 119395 - DNA, 103 bp, Artificial Sequence
  Synthetic Polynucleotide
taatacgactcactatagggcatgggagacactgacagagggtaggactcaacagaggagagagtccatgcctctgtcaaacctggcggcagcgcaaaagatg

SEQ ID NO: 119396 - DNA, 103 bp, Artificial Sequence
  Synthetic Polynucleotide
taatacgactcactataggggattattctccatgggagacactgacagagaacagaggagactctgtatgtgtctcccaaacctggcggcagcgcaaaagatg

SEQ ID NO: 119397 - DNA, 103 bp, Artificial Sequence
  Synthetic Polynucleotide
taatacgactcactataggggctgggcagtgattattctccatgggagacaacagaggagagtctccatgggagaataaaacctggcggcagcgcaaaagatg

SEQ ID NO: 119398 - DNA, 103 bp, Artificial Sequence
  Synthetic Polynucleotide
taatacgactcactatagggctcggaggacgctgggcagtgattattctcaacagaggagagagaatatgcactgcccaaacctggcggcagcgcaaaagatg

SEQ ID NO: 119399 - DNA, 103 bp, Artificial Sequence
  Synthetic Polynucleotide
taatacgactcactatagggtcgggtgggactcggaggacgctgggcagtaacagaggagaactgccatgcgtcctccgaacctggcggcagcgcaaaagatg

SEQ ID NO: 119400 - DNA, 103 bp, Artificial Sequence
  Synthetic Polynucleotide
taatacgactcactatagggctggatggcttcgggtgggactcggaggacaacagaggagagtcctcatggtcccacccaacctggcggcagcgcaaaagatg

SEQ ID NO: 119401 - DNA, 103 bp, Artificial Sequence
  Synthetic Polynucleotide
taatacgactcactatagggctgccgggggctggatggcttcgggtgggaaacagaggagatcccacatgaagccatccaacctggcggcagcgcaaaagatg

SEQ ID NO: 119402 - DNA, 103 bp, Artificial Sequence
  Synthetic Polynucleotide
taatacgactcactataggggtgtgctctcctgccgggggctggatggctaacagaggagaagccatatggcccccggcaacctggcggcagcgcaaaagatg

SEQ ID NO: 119403 - DNA, 103 bp, Artificial Sequence
  Synthetic Polynucleotide
taatacgactcactatagggtggatcacgcgtgtgctctcctgccgggggaacagaggagacccccgatgggagagcacaacctggcggcagcgcaaaagatg

SEQ ID NO: 119404 - DNA, 103 bp, Artificial Sequence
  Synthetic Polynucleotide
taatacgactcactataggggggcatcagctggatcacgcgtgtgctctcaacagaggagagagagcatgcgcgtgatcaacctggcggcagcgcaaaagatg

SEQ ID NO: 119405 - DNA, 103 bp, Artificial Sequence
  Synthetic Polynucleotide
taatacgactcactataggggaagtggcgtcgaggaagcgtaactcggcaaacagaggagatgccgaatgacgcttcctaacctggcggcagcgcaaaagatg

SEQ ID NO: 119406 - DNA, 103 bp, Artificial Sequence
  Synthetic Polynucleotide
taatacgactcactatagggtgatggggctgggcatcagctggatcacgcaacagaggagagcgtgaatgagctgatgcaacctggcggcagcgcaaaagatg

SEQ ID NO: 119407 - DNA, 103 bp, Artificial Sequence
  Synthetic Polynucleotide
taatacgactcactatagggagagggtgcatgatggggctgggcatcagcaacagaggagagctgatatgcagccccataacctggcggcagcgcaaaagatg

SEQ ID NO: 119408 - DNA, 103 bp, Artificial Sequence
  Synthetic Polynucleotide
taatacgactcactataggggttcaggatcagagggtgcatgatggggctaacagaggagaagccccatgatgcaccctaacctggcggcagcgcaaaagatg

SEQ ID NO: 119409 - DNA, 103 bp, Artificial Sequence
  Synthetic Polynucleotide
taatacgactcactatagggagtgccgggggttcaggatcagagggtgcaaacagaggagatgcaccatgtgatcctgaaacctggcggcagcgcaaaagatg

SEQ ID NO: 119410 - DNA, 103 bp, Artificial Sequence
  Synthetic Polynucleotide
taatacgactcactatagggaaatccacggagtgccgggggttcaggatcaacagaggagagatcctatgcccccggcaaacctggcggcagcgcaaaagatg

SEQ ID NO: 119411 - DNA, 103 bp, Artificial Sequence
  Synthetic Polynucleotide
taatacgactcactatagggggactgtttgaaatccacggagtgccggggaacagaggagaccccggatgtccgtggataacctggcggcagcgcaaaagatg

SEQ ID NO: 119412 - DNA, 103 bp, Artificial Sequence
  Synthetic Polynucleotide
taatacgactcactatagggcggagagcctggactgtttgaaatccacggaacagaggagaccgtggatgtcaaacagtaacctggcggcagcgcaaaagatg

SEQ ID NO: 119413 - DNA, 103 bp, Artificial Sequence
  Synthetic Polynucleotide
taatacgactcactatagggagcccgtcctcggagagcctggactgtttgaacagaggagacaaacaatgcaggctctcaacctggcggcagcgcaaaagatg

SEQ ID NO: 119414 - DNA, 103 bp, Artificial Sequence
  Synthetic Polynucleotide
taatacgactcactatagggttccctatgcagcccgtcctcggagagcctaacagaggagaaggctcatggaggacgggaacctggcggcagcgcaaaagatg

SEQ ID NO: 119415 - DNA, 103 bp, Artificial Sequence
  Synthetic Polynucleotide
taatacgactcactatagggtgggcttcccttccctatgcagcccgtcctaacagaggagaaggacgatgtgcatagggaacctggcggcagcgcaaaagatg

SEQ ID NO: 119416 - DNA, 103 bp, Artificial Sequence
  Synthetic Polynucleotide
taatacgactcactatagggactggaacatgaagtggcgtcgaggaagcgaacagaggagacgcttcatggacgccactaacctggcggcagcgcaaaagatg

SEQ ID NO: 119417 - DNA, 103 bp, Artificial Sequence
  Synthetic Polynucleotide
taatacgactcactataggggagaggttgatgggcttcccttccctatgcaacagaggagagcatagatgagggaagccaacctggcggcagcgcaaaagatg

SEQ ID NO: 119418 - DNA, 103 bp, Artificial Sequence
  Synthetic Polynucleotide
taatacgactcactatagggttcccgatgagagaggttgatgggcttcccaacagaggagagggaagatgatcaacctcaacctggcggcagcgcaaaagatg

SEQ ID NO: 119419 - DNA, 103 bp, Artificial Sequence
  Synthetic Polynucleotide
taatacgactcactatagggaagccaggtcttcccgatgagagaggttgaaacagaggagatcaaccatgctcatcgggaacctggcggcagcgcaaaagatg

SEQ ID NO: 119420 - DNA, 103 bp, Artificial Sequence
  Synthetic Polynucleotide
taatacgactcactatagggtggttcatgtaagccaggtcttcccgatgaaacagaggagatcatcgatgagacctggcaacctggcggcagcgcaaaagatg

SEQ ID NO: 119421 - DNA, 103 bp, Artificial Sequence
  Synthetic Polynucleotide
taatacgactcactataggggaccatgatgtggttcatgtaagccaggtcaacagaggagagacctgatgtacatgaacaacctggcggcagcgcaaaagatg

SEQ ID NO: 119422 - DNA, 103 bp, Artificial Sequence
  Synthetic Polynucleotide
taatacgactcactataggggggagacagagaccatgatgtggttcatgtaacagaggagaacatgaatgacatcatggaacctggcggcagcgcaaaagatg

SEQ ID NO: 119423 - DNA, 103 bp, Artificial Sequence
  Synthetic Polynucleotide
taatacgactcactatagggtcttcaggcggggagacagagaccatgatgaacagaggagacatcatatgctctgtctcaacctggcggcagcgcaaaagatg

SEQ ID NO: 119424 - DNA, 103 bp, Artificial Sequence
  Synthetic Polynucleotide
taatacgactcactatagggcatggcgtgctcttcaggcggggagacagaaacagaggagatctgtcatgccgcctgaaaacctggcggcagcgcaaaagatg

SEQ ID NO: 119425 - DNA, 103 bp, Artificial Sequence
  Synthetic Polynucleotide
taatacgactcactatagggtcccaatgggcatggcgtgctcttcaggcgaacagaggagacgcctgatgagcacgccaaacctggcggcagcgcaaaagatg

SEQ ID NO: 119426 - DNA, 103 bp, Artificial Sequence
  Synthetic Polynucleotide
taatacgactcactatagggtctgctattctcccaatgggcatggcgtgcaacagaggagagcacgcatggcccattggaacctggcggcagcgcaaaagatg

SEQ ID NO: 119427 - DNA, 103 bp, Artificial Sequence
  Synthetic Polynucleotide
taatacgactcactatagggaggagaaatagccaattctccctcctgcataacagaggagaatgcagatgggagaattgaacctggcggcagcgcaaaagatg

SEQ ID NO: 119428 - DNA, 103 bp, Artificial Sequence
  Synthetic Polynucleotide
taatacgactcactataggggatccccccttcacccagcaggttaatttgaacagaggagacaaattatgctgctgggtaacctggcggcagcgcaaaagatg

SEQ ID NO: 119429 - DNA, 103 bp, Artificial Sequence
  Synthetic Polynucleotide
taatacgactcactatagggagagatttctggcctcttgtccttgaactcaacagaggagagagttcatggacaagaggaacctggcggcagcgcaaaagatg

SEQ ID NO: 119430 - DNA, 103 bp, Artificial Sequence
  Synthetic Polynucleotide
taatacgactcactataggggcagcttgcagatccccccttcacccagcaaacagaggagatgctggatgaaggggggaaacctggcggcagcgcaaaagatg

SEQ ID NO: 119431 - DNA, 103 bp, Artificial Sequence
  Synthetic Polynucleotide
taatacgactcactatagggagtcttcctggcagcttgcagatcccccctaacagaggagaagggggatgctgcaagctaacctggcggcagcgcaaaagatg

SEQ ID NO: 119432 - DNA, 103 bp, Artificial Sequence
  Synthetic Polynucleotide
taatacgactcactatagggctggatgcggagtcttcctggcagcttgcaaacagaggagatgcaagatgccaggaagaaacctggcggcagcgcaaaagatg

SEQ ID NO: 119433 - DNA, 103 bp, Artificial Sequence
  Synthetic Polynucleotide
taatacgactcactatagggacagtgcgggctggatgcggagtcttcctgaacagaggagacaggaaatgtccgcatccaacctggcggcagcgcaaaagatg

SEQ ID NO: 119434 - DNA, 103 bp, Artificial Sequence
  Synthetic Polynucleotide
taatacgactcactatagggtccctgctccacagtgcgggctggatgcggaacagaggagaccgcatatggcccgcactaacctggcggcagcgcaaaagatg

SEQ ID NO: 119435 - DNA, 103 bp, Artificial Sequence
  Synthetic Polynucleotide
taatacgactcactatagggcagcacgtcctccctgctccacagtgcgggaacagaggagacccgcaatgtggagcaggaacctggcggcagcgcaaaagatg

SEQ ID NO: 119436 - DNA, 103 bp, Artificial Sequence
  Synthetic Polynucleotide
taatacgactcactataggggcagccagtgcagcacgtcctccctgctccaacagaggagaggagcaatgaggacgtgcaacctggcggcagcgcaaaagatg

SEQ ID NO: 119437 - DNA, 103 bp, Artificial Sequence
  Synthetic Polynucleotide
taatacgactcactatagggtctgcccagcgcagccagtgcagcacgtccaacagaggagaggacgtatggcactggctaacctggcggcagcgcaaaagatg

SEQ ID NO: 119438 - DNA, 103 bp, Artificial Sequence
  Synthetic Polynucleotide
taatacgactcactataggggtactcctgctctgcccagcgcagccagtgaacagaggagacactggatgcgctgggcaaacctggcggcagcgcaaaagatg

SEQ ID NO: 119439 - DNA, 103 bp, Artificial Sequence
  Synthetic Polynucleotide
taatacgactcactatagggcagggcttataggagaaatagccaattctcaacagaggagagagaatatgctatttctcaacctggcggcagcgcaaaagatg

SEQ ID NO: 119440 - DNA, 103 bp, Artificial Sequence
  Synthetic Polynucleotide
taatacgactcactatagggatggcagagagtactcctgctctgcccagcaacagaggagagctgggatgagcaggagtaacctggcggcagcgcaaaagatg

SEQ ID NO: 119441 - DNA, 103 bp, Artificial Sequence
  Synthetic Polynucleotide
taatacgactcactatagggtccgcggtgcatggcagagagtactcctgcaacagaggagagcaggaatgctctctgccaacctggcggcagcgcaaaagatg

SEQ ID NO: 119442 - DNA, 103 bp, Artificial Sequence
  Synthetic Polynucleotide
taatacgactcactataggggaacccgtgctccgcggtgcatggcagagaaacagaggagatctctgatgtgcaccgcgaacctggcggcagcgcaaaagatg

SEQ ID NO: 119443 - DNA, 103 bp, Artificial Sequence
  Synthetic Polynucleotide
taatacgactcactatagggcgttcatctcgaacccgtgctccgcggtgcaacagaggagagcaccgatgagcacgggtaacctggcggcagcgcaaaagatg

SEQ ID NO: 119444 - DNA, 103 bp, Artificial Sequence
  Synthetic Polynucleotide
taatacgactcactatagggagggcgcgtccgttcatctcgaacccgtgcaacagaggagagcacggatgcgagatgaaaacctggcggcagcgcaaaagatg

SEQ ID NO: 119445 - DNA, 103 bp, Artificial Sequence
  Synthetic Polynucleotide
taatacgactcactataggggaggatgcagagggcgcgtccgttcatctcaacagaggagagagatgatgggacgcgccaacctggcggcagcgcaaaagatg

SEQ ID NO: 119446 - DNA, 103 bp, Artificial Sequence
  Synthetic Polynucleotide
taatacgactcactatagggcgtccttggtgaggatgcagagggcgcgtcaacagaggagagacgcgatgtctgcatccaacctggcggcagcgcaaaagatg

SEQ ID NO: 119447 - DNA, 103 bp, Artificial Sequence
  Synthetic Polynucleotide
taatacgactcactatagggtgccggaagtcgtccttggtgaggatgcagaacagaggagactgcatatgcaccaaggaaacctggcggcagcgcaaaagatg

SEQ ID NO: 119448 - DNA, 103 bp, Artificial Sequence
  Synthetic Polynucleotide
taatacgactcactataggggggcgcacggtgccggaagtcgtccttggtaacagaggagaaccaagatggacttccggaacctggcggcagcgcaaaagatg

SEQ ID NO: 119449 - DNA, 103 bp, Artificial Sequence
  Synthetic Polynucleotide
taatacgactcactatagggcacctgagctgggcgcacggtgccggaagtaacagaggagaacttccatgaccgtgcgcaacctggcggcagcgcaaaagatg

SEQ ID NO: 119450 - DNA, 103 bp, Artificial Sequence
  Synthetic Polynucleotide
taatacgactcactatagggatggctgccacagggcttataggagaaataaacagaggagatatttcatgtataagcccaacctggcggcagcgcaaaagatg

SEQ ID NO: 119451 - DNA, 103 bp, Artificial Sequence
  Synthetic Polynucleotide
taatacgactcactatagggtacaggacgtcacctgagctgggcgcacggaacagaggagaccgtgcatgcagctcaggaacctggcggcagcgcaaaagatg

SEQ ID NO: 119452 - DNA, 103 bp, Artificial Sequence
  Synthetic Polynucleotide
taatacgactcactataggggagcagctcatacaggacgtcacctgagctaacagaggagaagctcaatggacgtcctgaacctggcggcagcgcaaaagatg

SEQ ID NO: 119453 - DNA, 103 bp, Artificial Sequence
  Synthetic Polynucleotide
taatacgactcactatagggtgatgtactggagcagctcatacaggacgtaacagaggagaacgtccatgatgagctgcaacctggcggcagcgcaaaagatg

SEQ ID NO: 119454 - DNA, 103 bp, Artificial Sequence
  Synthetic Polynucleotide
taatacgactcactatagggcgctgggtcttgatgtactggagcagctcaaacagaggagatgagctatgccagtacataacctggcggcagcgcaaaagatg

SEQ ID NO: 119455 - DNA, 103 bp, Artificial Sequence
  Synthetic Polynucleotide
taatacgactcactatagggcagggctcgccgctgggtcttgatgtactgaacagaggagacagtacatgaagacccagaacctggcggcagcgcaaaagatg

SEQ ID NO: 119456 - DNA, 103 bp, Artificial Sequence
  Synthetic Polynucleotide
taatacgactcactataggggcccacacaccagggctcgccgctgggtctaacagaggagaagacccatgggcgagcccaacctggcggcagcgcaaaagatg

SEQ ID NO: 119457 - DNA, 103 bp, Artificial Sequence
  Synthetic Polynucleotide
taatacgactcactatagggccaaaaaagggcccacacaccagggctcgcaacagaggagagcgagcatgggtgtgtggaacctggcggcagcgcaaaagatg

SEQ ID NO: 119458 - DNA, 103 bp, Artificial Sequence
  Synthetic Polynucleotide
taatacgactcactataggggaagatccctccaaaaaagggcccacacacaacagaggagagtgtgtatgcccttttttaacctggcggcagcgcaaaagatg

SEQ ID NO: 119459 - DNA, 103 bp, Artificial Sequence
  Synthetic Polynucleotide
taatacgactcactatagggtcttcagcctgaagatccctccaaaaaaggaacagaggagaccttttatggagggatctaacctggcggcagcgcaaaagatg

SEQ ID NO: 119460 - DNA, 103 bp, Artificial Sequence
  Synthetic Polynucleotide
taatacgactcactatagggtgggtgggcgtcttcagcctgaagatccctaacagaggagaagggatatgcaggctgaaaacctggcggcagcgcaaaagatg

SEQ ID NO: 119461 - DNA, 103 bp, Artificial Sequence
  Synthetic Polynucleotide
taatacgactcactatagggtaggggaggcatggctgccacagggcttataacagaggagaataagcatggtggcagccaacctggcggcagcgcaaaagatg

SEQ ID NO: 119462 - DNA, 103 bp, Artificial Sequence
  Synthetic Polynucleotide
taatacgactcactatagggtggagagtgctgggtgggcgtcttcagcctaacagaggagaaggctgatgacgcccaccaacctggcggcagcgcaaaagatg

SEQ ID NO: 119463 - DNA, 103 bp, Artificial Sequence
  Synthetic Polynucleotide
taatacgactcactatagggccggggggactggagagtgctgggtgggcgaacagaggagacgcccaatgagcactctcaacctggcggcagcgcaaaagatg

SEQ ID NO: 119464 - DNA, 103 bp, Artificial Sequence
  Synthetic Polynucleotide
taatacgactcactataggggtcacctcttccggggggactggagagtgcaacagaggagagcactcatgagtccccccaacctggcggcagcgcaaaagatg

SEQ ID NO: 119465 - DNA, 103 bp, Artificial Sequence
  Synthetic Polynucleotide
taatacgactcactatagggagaggggccagtcacctcttccggggggacaacagaggagagtccccatggaagaggtgaacctggcggcagcgcaaaagatg

SEQ ID NO: 119466 - DNA, 103 bp, Artificial Sequence
  Synthetic Polynucleotide
taatacgactcactatagggtgtccatctgagaggggccagtcacctcttaacagaggagaaagaggatgctggcccctaacctggcggcagcgcaaaagatg

SEQ ID NO: 119467 - DNA, 103 bp, Artificial Sequence
  Synthetic Polynucleotide
taatacgactcactatagggccccttcgggtgtccatctgagaggggccaaacagaggagatggcccatgtcagatggaaacctggcggcagcgcaaaagatg

SEQ ID NO: 119468 - DNA, 103 bp, Artificial Sequence
  Synthetic Polynucleotide
taatacgactcactatagggcagcaggtggccccttcgggtgtccatctgaacagaggagacagatgatgacccgaaggaacctggcggcagcgcaaaagatg

SEQ ID NO: 119469 - DNA, 103 bp, Artificial Sequence
  Synthetic Polynucleotide
taatacgactcactatagggctggtggctgcagcaggtggccccttcgggaacagaggagacccgaaatggccacctgcaacctggcggcagcgcaaaagatg

SEQ ID NO: 119470 - DNA, 103 bp, Artificial Sequence
  Synthetic Polynucleotide
taatacgactcactatagggagccctgggtctggtggctgcagcaggtggaacagaggagaccacctatggcagccaccaacctggcggcagcgcaaaagatg

SEQ ID NO: 119471 - DNA, 103 bp, Artificial Sequence
  Synthetic Polynucleotide
taatacgactcactataggggttgctggtaagccctgggtctggtggctgaacagaggagacagccaatggacccagggaacctggcggcagcgcaaaagatg

SEQ ID NO: 119472 - DNA, 103 bp, Artificial Sequence
  Synthetic Polynucleotide
taatacgactcactatagggcgtgggtgcctaggggaggcatggctgccaaacagaggagatggcagatgtgcctccccaacctggcggcagcgcaaaagatg

SEQ ID NO: 119473 - DNA, 103 bp, Artificial Sequence
  Synthetic Polynucleotide
taatacgactcactatagggggtggccgaagttgctggtaagccctgggtaacagaggagaacccagatgttaccagcaaacctggcggcagcgcaaaagatg

SEQ ID NO: 119474 - DNA, 103 bp, Artificial Sequence
  Synthetic Polynucleotide
taatacgactcactataggggggtcatccaggtggccgaagttgctggtaaacagaggagataccagatgcttcggccaaacctggcggcagcgcaaaagatg

SEQ ID NO: 119475 - DNA, 103 bp, Artificial Sequence
  Synthetic Polynucleotide
taatacgactcactatagggtgccaggccagggtcatccaggtggccgaaaacagaggagattcggcatgctggatgacaacctggcggcagcgcaaaagatg

SEQ ID NO: 119476 - DNA, 103 bp, Artificial Sequence
  Synthetic Polynucleotide
taatacgactcactataggggggtccaccttgccaggccagggtcatccaaacagaggagatggatgatgctggcctggaacctggcggcagcgcaaaagatg

SEQ ID NO: 119477 - DNA, 103 bp, Artificial Sequence
  Synthetic Polynucleotide
taatacgactcactatagggtccttgccaggggtccaccttgccaggccaaacagaggagatggcctatgaaggtggacaacctggcggcagcgcaaaagatg

SEQ ID NO: 119478 - DNA, 103 bp, Artificial Sequence
  Synthetic Polynucleotide
taatacgactcactataggggagggactcctccttgccaggggtccacctaacagaggagaaggtggatgcctggcaagaacctggcggcagcgcaaaagatg

SEQ ID NO: 119479 - DNA, 103 bp, Artificial Sequence
  Synthetic Polynucleotide
taatacgactcactataggggacataagttgagggactcctccttgccagaacagaggagactggcaatgaggagtcccaacctggcggcagcgcaaaagatg

SEQ ID NO: 119480 - DNA, 103 bp, Artificial Sequence
  Synthetic Polynucleotide
taatacgactcactatagggtctgcacagtgacataagttgagggactccaacagaggagaggagtcatgcaacttatgaacctggcggcagcgcaaaagatg

SEQ ID NO: 119481 - DNA, 103 bp, Artificial Sequence
  Synthetic Polynucleotide
taatacgactcactataggggcagccgagctctgcacagtgacataagttaacagaggagaaacttaatgcactgtgcaaacctggcggcagcgcaaaagatg

SEQ ID NO: 119482 - DNA, 103 bp, Artificial Sequence
  Synthetic Polynucleotide
taatacgactcactatagggcctgggtcctgcagccgagctctgcacagtaacagaggagaactgtgatgagctcggctaacctggcggcagcgcaaaagatg

SEQ ID NO: 119483 - DNA, 103 bp, Artificial Sequence
  Synthetic Polynucleotide
taatacgactcactatagggctggcttgcacgtgggtgcctaggggaggcaacagaggagagcctccatgaggcacccaaacctggcggcagcgcaaaagatg

SEQ ID NO: 119484 - DNA, 103 bp, Artificial Sequence
  Synthetic Polynucleotide
taatacgactcactataggggaacagaccccctgggtcctgcagccgagcaacagaggagagctcggatgcaggacccaaacctggcggcagcgcaaaagatg

SEQ ID NO: 119485 - DNA, 103 bp, Artificial Sequence
  Synthetic Polynucleotide
taatacgactcactatagggcgcggggaaggaacagaccccctgggtcctaacagaggagaaggaccatgggggtctgtaacctggcggcagcgcaaaagatg

SEQ ID NO: 119486 - DNA, 103 bp, Artificial Sequence
  Synthetic Polynucleotide
taatacgactcactatagggcctgcggcatcgcggggaaggaacagacccaacagaggagagggtctatgccttccccgaacctggcggcagcgcaaaagatg

SEQ ID NO: 119487 - DNA, 103 bp, Artificial Sequence
  Synthetic Polynucleotide
taatacgactcactatagggtcaatgggggcctgcggcatcgcggggaagaacagaggagacttcccatggatgccgcaaacctggcggcagcgcaaaagatg

SEQ ID NO: 119488 - DNA, 103 bp, Artificial Sequence
  Synthetic Polynucleotide
taatacgactcactataggggatcctgccgtcaatgggggcctgcggcataacagaggagaatgccgatggcccccattaacctggcggcagcgcaaaagatg

SEQ ID NO: 119489 - DNA, 103 bp, Artificial Sequence
  Synthetic Polynucleotide
taatacgactcactatagggggcagtcagcgatcctgccgtcaatgggggaacagaggagacccccaatgacggcaggaaacctggcggcagcgcaaaagatg

SEQ ID NO: 119490 - DNA, 103 bp, Artificial Sequence
  Synthetic Polynucleotide
taatacgactcactatagggcacagcaggcggcagtcagcgatcctgccgaacagaggagacggcagatgcgctgactgaacctggcggcagcgcaaaagatg

SEQ ID NO: 119491 - DNA, 103 bp, Artificial Sequence
  Synthetic Polynucleotide
taatacgactcactatagggcacgtaatcccacagcaggcggcagtcagcaacagaggagagctgacatgcgcctgctgaacctggcggcagcgcaaaagatg

SEQ ID NO: 119492 - DNA, 103 bp, Artificial Sequence
  Synthetic Polynucleotide
taatacgactcactataggggcagctgatacacgtaatcccacagcaggcaacagaggagagcctgcatggggattacgaacctggcggcagcgcaaaagatg

SEQ ID NO: 119493 - DNA, 103 bp, Artificial Sequence
  Synthetic Polynucleotide
taatacgactcactataggggtatcaaggagcagctgatacacgtaatccaacagaggagaggattaatggtatcagctaacctggcggcagcgcaaaagatg

SEQ ID NO: 119494 - DNA, 103 bp, Artificial Sequence
  Synthetic Polynucleotide
taatacgactcactatagggagcttcacatctggcttgcacgtgggtgccaacagaggagaggcaccatggtgcaagccaacctggcggcagcgcaaaagatg

SEQ ID NO: 119495 - DNA, 103 bp, Artificial Sequence
  Synthetic Polynucleotide
taatacgactcactatagggctcatatcgggtatcaaggagcagctgataaacagaggagatatcagatgctccttgataacctggcggcagcgcaaaagatg

SEQ ID NO: 119496 - DNA, 103 bp, Artificial Sequence
  Synthetic Polynucleotide
taatacgactcactatagggtgatgtagggctcatatcgggtatcaaggaaacagaggagatccttgatgcccgatatgaacctggcggcagcgcaaaagatg

SEQ ID NO: 119497 - DNA, 103 bp, Artificial Sequence
  Synthetic Polynucleotide
taatacgactcactatagggtcttcccacttgatgtagggctcatatcggaacagaggagaccgataatggccctacataacctggcggcagcgcaaaagatg

SEQ ID NO: 119498 - DNA, 103 bp, Artificial Sequence
  Synthetic Polynucleotide
taatacgactcactatagggggcgtccttgtcttcccacttgatgtagggaacagaggagaccctacatgaagtgggaaaacctggcggcagcgcaaaagatg

SEQ ID NO: 119499 - DNA, 103 bp, Artificial Sequence
  Synthetic Polynucleotide
taatacgactcactatagggggaagatcttggcgtccttgtcttcccactaacagaggagaagtgggatgacaaggacgaacctggcggcagcgcaaaagatg

SEQ ID NO: 119500 - DNA, 103 bp, Artificial Sequence
  Synthetic Polynucleotide
taatacgactcactatagggtccacaactcggaagatcttggcgtccttgaacagaggagacaaggaatgcaagatcttaacctggcggcagcgcaaaagatg

SEQ ID NO: 119501 - DNA, 103 bp, Artificial Sequence
  Synthetic Polynucleotide
taatacgactcactatagggcccatttggatccacaactcggaagatcttaacagaggagaaagatcatgcgagttgtgaacctggcggcagcgcaaaagatg

SEQ ID NO: 119502 - DNA, 103 bp, Artificial Sequence
  Synthetic Polynucleotide
taatacgactcactataggggtctggcgagcccatttggatccacaactcaacagaggagagagttgatgatccaaatgaacctggcggcagcgcaaaagatg

SEQ ID NO: 119503 - DNA, 103 bp, Artificial Sequence
  Synthetic Polynucleotide
taatacgactcactatagggtttccccagagtctggcgagcccatttggaaacagaggagatccaaaatggctcgccagaacctggcggcagcgcaaaagatg

SEQ ID NO: 119504 - DNA, 103 bp, Artificial Sequence
  Synthetic Polynucleotide
taatacgactcactataggggttcttgtgatttccccagagtctggcgagaacagaggagactcgccatgctctggggaaacctggcggcagcgcaaaagatg

SEQ ID NO: 119505 - DNA, 103 bp, Artificial Sequence
  Synthetic Polynucleotide
taatacgactcactatagggggttaatttgagcttcacatctggcttgcaaacagaggagatgcaagatggatgtgaagaacctggcggcagcgcaaaagatg

SEQ ID NO: 119506 - DNA, 103 bp, Artificial Sequence
  Synthetic Polynucleotide
taatacgactcactatagggtgttcacccggttcttgtgatttccccagaaacagaggagatctgggatgatcacaagaaacctggcggcagcgcaaaagatg

SEQ ID NO: 119507 - DNA, 103 bp, Artificial Sequence
  Synthetic Polynucleotide
taatacgactcactatagggtcgtaggtcatgttcacccggttcttgtgaaacagaggagatcacaaatgccgggtgaaaacctggcggcagcgcaaaagatg

SEQ ID NO: 119508 - DNA, 103 bp, Artificial Sequence
  Synthetic Polynucleotide
taatacgactcactatagggagacatcttctcgtaggtcatgttcacccgaacagaggagacgggtgatgatgacctacaacctggcggcagcgcaaaagatg

SEQ ID NO: 119509 - DNA, 103 bp, Artificial Sequence
  Synthetic Polynucleotide
taatacgactcactataggggcagggcacgagacatcttctcgtaggtcaaacagaggagatgacctatgagaagatgtaacctggcggcagcgcaaaagatg

SEQ ID NO: 119510 - DNA, 103 bp, Artificial Sequence
  Synthetic Polynucleotide
taatacgactcactatagggtaatagtggcgcagggcacgagacatcttcaacagaggagagaagatatgtcgtgccctaacctggcggcagcgcaaaagatg

SEQ ID NO: 119511 - DNA, 103 bp, Artificial Sequence
  Synthetic Polynucleotide
taatacgactcactatagggattaagcttataatagtggcgcagggcacgaacagaggagacgtgccatgcgccactataacctggcggcagcgcaaaagatg

SEQ ID NO: 119512 - DNA, 103 bp, Artificial Sequence
  Synthetic Polynucleotide
taatacgactcactatagggtcttaatgatattaagcttataatagtggcaacagaggagagccactatgataagcttaaacctggcggcagcgcaaaagatg

SEQ ID NO: 119513 - DNA, 103 bp, Artificial Sequence
  Synthetic Polynucleotide
taatacgactcactatagggcccggttccttcttaatgatattaagcttaaacagaggagataagctatgtatcattaaaacctggcggcagcgcaaaagatg

SEQ ID NO: 119514 - DNA, 103 bp, Artificial Sequence
  Synthetic Polynucleotide
taatacgactcactataggggagtttctgccccggttccttcttaatgataacagaggagaatcattatgaaggaaccgaacctggcggcagcgcaaaagatg

SEQ ID NO: 119515 - DNA, 103 bp, Artificial Sequence
  Synthetic Polynucleotide
taatacgactcactatagggatctgaacaggagtttctgccccggttcctaacagaggagaaggaacatgggcagaaacaacctggcggcagcgcaaaagatg

SEQ ID NO: 119516 - DNA, 103 bp, Artificial Sequence
  Synthetic Polynucleotide
taatacgactcactatagggtcacccagcaggttaatttgagcttcacataacagaggagaatgtgaatgtcaaattaaaacctggcggcagcgcaaaagatg

SEQ ID NO: 119517 - DNA, 103 bp, Artificial Sequence
  Synthetic Polynucleotide
taatacgactcactataggggtctttagaaatctgaacaggagtttctgcaacagaggagagcagaaatgcctgttcagaacctggcggcagcgcaaaagatg

SEQ ID NO: 119518 - DNA, 103 bp, Artificial Sequence
  Synthetic Polynucleotide
taatacgactcactatagggctttcccggagtctttagaaatctgaacagaacagaggagactgttcatgtttctaaagaacctggcggcagcgcaaaagatg

SEQ ID NO: 119519 - DNA, 103 bp, Artificial Sequence
  Synthetic Polynucleotide
taatacgactcactatagggcctggaccatctttcccggagtctttagaaaacagaggagattctaaatgctccgggaaaacctggcggcagcgcaaaagatg

SEQ ID NO: 119520 - DNA, 103 bp, Artificial Sequence
  Synthetic Polynucleotide
taatacgactcactatagggctgtgcttgtcctggaccatctttcccggaaacagaggagatccgggatggatggtccaaacctggcggcagcgcaaaagatg

SEQ ID NO: 119521 - DNA, 103 bp, Artificial Sequence
  Synthetic Polynucleotide
taatacgactcactatagggctccaggtggctgtgcttgtcctggaccataacagaggagaatggtcatggacaagcacaacctggcggcagcgcaaaagatg

SEQ ID NO: 119522 - DNA, 103 bp, Artificial Sequence
  Synthetic Polynucleotide
taatacgactcactatagggtctccagcggctccaggtggctgtgcttgtaacagaggagaacaagcatggccacctggaacctggcggcagcgcaaaagatg

SEQ ID NO: 119523 - DNA, 103 bp, Artificial Sequence
  Synthetic Polynucleotide
taatacgactcactatagggtgctcctggctctccagcggctccaggtggaacagaggagaccacctatggccgctggaaacctggcggcagcgcaaaagatg

SEQ ID NO: 119524 - DNA, 103 bp, Artificial Sequence
  Synthetic Polynucleotide
taatacgactcactatagggtattctgtcctgctcctggctctccagcggaacagaggagaccgctgatgagccaggagaacctggcggcagcgcaaaagatg

SEQ ID NO: 119525 - DNA, 103 bp, Artificial Sequence
  Synthetic Polynucleotide
taatacgactcactatagggccttgaactctattctgtcctgctcctggcaacagaggagagccaggatgaggacagaaaacctggcggcagcgcaaaagatg

SEQ ID NO: 119526 - DNA, 103 bp, Artificial Sequence
  Synthetic Polynucleotide
taatacgactcactatagggggcctcttgtccttgaactctattctgtccaacagaggagaggacagatgagagttcaaaacctggcggcagcgcaaaagatg

SEQ ID NO: 119527 - DNA, 103 bp, Artificial Sequence
  Synthetic Polynucleotide
taatacgactcactatagggcttctcagatttcttcccagtctggcccataacagaggagaatgggcatgactgggaagaacctggcggcagcgcaaaagatg

SEQ ID NO: 119528 - DNA, 103 bp, Artificial Sequence
  Synthetic Polynucleotide
taatacgactcactatagggactctttacttcatcagctcgtctgaacctaacagaggagaaggttcatgcgagctgataacctggcggcagcgcaaaagatg

SEQ ID NO: 119529 - DNA, 103 bp, Artificial Sequence
  Synthetic Polynucleotide
taatacgactcactatagggagcaaactcctttgctccctccaaatgctgaacagaggagacagcatatggagggagcaaacctggcggcagcgcaaaagatg

SEQ ID NO: 119530 - DNA, 103 bp, Artificial Sequence
  Synthetic Polynucleotide
taatacgactcactatagggtgagagcagcagcaaactcctttgctccctaacagaggagaagggagatgaggagtttgaacctggcggcagcgcaaaagatg

SEQ ID NO: 119531 - DNA, 103 bp, Artificial Sequence
  Synthetic Polynucleotide
taatacgactcactatagggcgctcagcggtgagagcagcagcaaactccaacagaggagaggagttatgtgctgctctaacctggcggcagcgcaaaagatg

SEQ ID NO: 119532 - DNA, 103 bp, Artificial Sequence
  Synthetic Polynucleotide
taatacgactcactatagggggtctttatccgctcagcggtgagagcagcaacagaggagagctgctatgaccgctgagaacctggcggcagcgcaaaagatg

SEQ ID NO: 119533 - DNA, 103 bp, Artificial Sequence
  Synthetic Polynucleotide
taatacgactcactataggggttttggtggggtctttatccgctcagcggaacagaggagaccgctgatgggataaagaaacctggcggcagcgcaaaagatg

SEQ ID NO: 119534 - DNA, 103 bp, Artificial Sequence
  Synthetic Polynucleotide
taatacgactcactatagggcctcctggacgttttggtggggtctttatcaacagaggagagataaaatgcccaccaaaaacctggcggcagcgcaaaagatg

SEQ ID NO: 119535 - DNA, 103 bp, Artificial Sequence
  Synthetic Polynucleotide
taatacgactcactatagggtcttctgcggcctcctggacgttttggtggaacagaggagaccaccaatgcgtccaggaaacctggcggcagcgcaaaagatg

SEQ ID NO: 119536 - DNA, 103 bp, Artificial Sequence
  Synthetic Polynucleotide
taatacgactcactataggggaagccgtcctcttctgcggcctcctggacaacagaggagagtccagatggccgcagaaaacctggcggcagcgcaaaagatg

SEQ ID NO: 119537 - DNA, 103 bp, Artificial Sequence
  Synthetic Polynucleotide
taatacgactcactatagggctgttattgggaagccgtcctcttctgcggaacagaggagaccgcagatgaggacggctaacctggcggcagcgcaaaagatg

SEQ ID NO: 119538 - DNA, 103 bp, Artificial Sequence
  Synthetic Polynucleotide
taatacgactcactataggggggcctgctactgttattgggaagccgtccaacagaggagaggacggatgcccaataacaacctggcggcagcgcaaaagatg

SEQ ID NO: 119539 - DNA, 103 bp, Artificial Sequence
  Synthetic Polynucleotide
taatacgactcactatagggaactaaacatactctttacttcatcagctcaacagaggagagagctgatgaagtaaagaaacctggcggcagcgcaaaagatg

SEQ ID NO: 119540 - DNA, 103 bp, Artificial Sequence
  Synthetic Polynucleotide
taatacgactcactatagggtgggggtgctgggcctgctactgttattggaacagaggagaccaataatggtagcaggcaacctggcggcagcgcaaaagatg

SEQ ID NO: 119541 - DNA, 103 bp, Artificial Sequence
  Synthetic Polynucleotide
taatacgactcactatagggacattaatggtgggggtgctgggcctgctaaacagaggagatagcagatgcagcaccccaacctggcggcagcgcaaaagatg

SEQ ID NO: 119542 - DNA, 103 bp, Artificial Sequence
  Synthetic Polynucleotide
taatacgactcactatagggtgattccagcacattaatggtgggggtgctaacagaggagaagcaccatgaccattaataacctggcggcagcgcaaaagatg

SEQ ID NO: 119543 - DNA, 103 bp, Artificial Sequence
  Synthetic Polynucleotide
taatacgactcactatagggctgtatcctttgattccagcacattaatggaacagaggagaccattaatgtgctggaataacctggcggcagcgcaaaagatg

SEQ ID NO: 119544 - DNA, 103 bp, Artificial Sequence
  Synthetic Polynucleotide
taatacgactcactatagggctatcactgtctgtatcctttgattccagcaacagaggagagctggaatgaaaggatacaacctggcggcagcgcaaaagatg

SEQ ID NO: 119545 - DNA, 103 bp, Artificial Sequence
  Synthetic Polynucleotide
taatacgactcactatagggccctgcttccctatcactgtctgtatccttaacagaggagaaaggatatggacagtgataacctggcggcagcgcaaaagatg

SEQ ID NO: 119546 - DNA, 103 bp, Artificial Sequence
  Synthetic Polynucleotide
taatacgactcactatagggccgtttcagtccctgcttccctatcactgtaacagaggagaacagtgatggggaagcagaacctggcggcagcgcaaaagatg

SEQ ID NO: 119547 - DNA, 103 bp, Artificial Sequence
  Synthetic Polynucleotide
taatacgactcactatagggttctctccccccgtttcagtccctgcttccaacagaggagaggaagcatggactgaaacaacctggcggcagcgcaaaagatg

SEQ ID NO: 119548 - DNA, 103 bp, Artificial Sequence
  Synthetic Polynucleotide
taatacgactcactatagggtttatcattgttctctccccccgtttcagtaacagaggagaactgaaatggggggagagaacctggcggcagcgcaaaagatg

SEQ ID NO: 119549 - DNA, 103 bp, Artificial Sequence
  Synthetic Polynucleotide
taatacgactcactatagggcttcttcttctttatcattgttctctccccaacagaggagaggggagatgacaatgataaacctggcggcagcgcaaaagatg

SEQ ID NO: 119550 - DNA, 103 bp, Artificial Sequence
  Synthetic Polynucleotide
taatacgactcactatagggtgacgattggaactaaacatactctttactaacagaggagaagtaaaatgtatgtttagaacctggcggcagcgcaaaagatg

SEQ ID NO: 119551 - DNA, 103 bp, Artificial Sequence
  Synthetic Polynucleotide
taatacgactcactatagggtctttcttctcttcttcttctttatcattgaacagaggagacaatgaatgagaagaagaaacctggcggcagcgcaaaagatg

SEQ ID NO: 119552 - DNA, 103 bp, Artificial Sequence
  Synthetic Polynucleotide
taatacgactcactatagggcgaagtttcatctttcttctcttcttcttcaacagaggagagaagaaatggagaagaaaaacctggcggcagcgcaaaagatg

SEQ ID NO: 119553 - DNA, 103 bp, Artificial Sequence
  Synthetic Polynucleotide
taatacgactcactatagggcagaggagctcgaagtttcatctttcttctaacagaggagaagaagaatgatgaaacttaacctggcggcagcgcaaaagatg

SEQ ID NO: 119554 - DNA, 103 bp, Artificial Sequence
  Synthetic Polynucleotide
taatacgactcactataggggaatttgcttcagaggagctcgaagtttcaaacagaggagatgaaacatggagctcctcaacctggcggcagcgcaaaagatg

SEQ ID NO: 119555 - DNA, 103 bp, Artificial Sequence
  Synthetic Polynucleotide
taatacgactcactatagggttgacaccgagaatttgcttcagaggagctaacagaggagaagctccatggaagcaaataacctggcggcagcgcaaaagatg

SEQ ID NO: 119556 - DNA, 103 bp, Artificial Sequence
  Synthetic Polynucleotide
taatacgactcactatagggttattggtgtttgacaccgagaatttgcttaacagaggagaaagcaaatgctcggtgtcaacctggcggcagcgcaaaagatg

SEQ ID NO: 119557 - DNA, 103 bp, Artificial Sequence
  Synthetic Polynucleotide
taatacgactcactatagggggcttcatctttattggtgtttgacaccgaaacagaggagatcggtgatgaacaccaataacctggcggcagcgcaaaagatg

SEQ ID NO: 119558 - DNA, 103 bp, Artificial Sequence
  Synthetic Polynucleotide
taatacgactcactatagggttcaatatttggcttcatctttattggtgtaacagaggagaacaccaatgaagatgaagaacctggcggcagcgcaaaagatg

SEQ ID NO: 119559 - DNA, 103 bp, Artificial Sequence
  Synthetic Polynucleotide
taatacgactcactatagggtctcaggaggttcaatatttggcttcatctaacagaggagaagatgaatgcaaatattgaacctggcggcagcgcaaaagatg

SEQ ID NO: 119560 - DNA, 103 bp, Artificial Sequence
  Synthetic Polynucleotide
taatacgactcactatagggcactccacattctcaggaggttcaatatttaacagaggagaaaatatatgacctcctgaaacctggcggcagcgcaaaagatg

SEQ ID NO: 119561 - DNA, 103 bp, Artificial Sequence
  Synthetic Polynucleotide
taatacgactcactatagggcaaaattttctgacgattggaactaaacataacagaggagaatgtttatgtccaatcgtaacctggcggcagcgcaaaagatg

SEQ ID NO: 119562 - DNA, 103 bp, Artificial Sequence
  Synthetic Polynucleotide
taatacgactcactatagggagcaccactccactccacattctcaggaggaacagaggagacctcctatgaatgtggagaacctggcggcagcgcaaaagatg

SEQ ID NO: 119563 - DNA, 103 bp, Artificial Sequence
  Synthetic Polynucleotide
taatacgactcactatagggttgaggcttcagcaccactccactccacataacagaggagaatgtggatgggagtggtgaacctggcggcagcgcaaaagatg

SEQ ID NO: 119564 - DNA, 103 bp, Artificial Sequence
  Synthetic Polynucleotide
taatacgactcactatagggactctaaacattgaggcttcagcaccactcaacagaggagagagtggatgtgaagcctcaacctggcggcagcgcaaaagatg

SEQ ID NO: 119565 - DNA, 103 bp, Artificial Sequence
  Synthetic Polynucleotide
taatacgactcactataggggccaatgaggactctaaacattgaggcttcaacagaggagagaagccatgatgtttagaaacctggcggcagcgcaaaagatg

SEQ ID NO: 119566 - DNA, 103 bp, Artificial Sequence
  Synthetic Polynucleotide
taatacgactcactatagggcatagtaagtgccaatgaggactctaaacaaacagaggagatgtttaatgtcctcattgaacctggcggcagcgcaaaagatg

SEQ ID NO: 119567 - DNA, 103 bp, Artificial Sequence
  Synthetic Polynucleotide
taatacgactcactatagggcagaaattgtcatagtaagtgccaatgaggaacagaggagacctcatatgcacttactaaacctggcggcagcgcaaaagatg

SEQ ID NO: 119568 - DNA, 103 bp, Artificial Sequence
  Synthetic Polynucleotide
taatacgactcactatagggagcaatggcacagaaattgtcatagtaagtaacagaggagaacttacatggacaatttcaacctggcggcagcgcaaaagatg

SEQ ID NO: 119569 - DNA, 103 bp, Artificial Sequence
  Synthetic Polynucleotide
taatacgactcactatagggcaattaacctagcaatggcacagaaattgtaacagaggagaacaattatggtgccattgaacctggcggcagcgcaaaagatg

SEQ ID NO: 119570 - DNA, 103 bp, Artificial Sequence
  Synthetic Polynucleotide
taatacgactcactataggggttttggtcccaattaacctagcaatggcaaacagaggagatgccatatgtaggttaataacctggcggcagcgcaaaagatg

SEQ ID NO: 119571 - DNA, 103 bp, Artificial Sequence
  Synthetic Polynucleotide
taatacgactcactatagggctgtctacatgttttggtcccaattaacctaacagaggagaaggttaatggggaccaaaaacctggcggcagcgcaaaagatg

SEQ ID NO: 119572 - DNA, 103 bp, Artificial Sequence
  Synthetic Polynucleotide
taatacgactcactatagggccgttctttccaaaattttctgacgattggaacagaggagaccaatcatgagaaaatttaacctggcggcagcgcaaaagatg

SEQ ID NO: 119573 - DNA, 103 bp, Artificial Sequence
  Synthetic Polynucleotide
taatacgactcactatagggactcatacacctgtctacatgttttggtccaacagaggagaggaccaatgcatgtagacaacctggcggcagcgcaaaagatg

SEQ ID NO: 119574 - DNA, 103 bp, Artificial Sequence
  Synthetic Polynucleotide
taatacgactcactatagggttgactctaaactcatacacctgtctacataacagaggagaatgtagatgggtgtatgaaacctggcggcagcgcaaaagatg

SEQ ID NO: 119575 - DNA, 103 bp, Artificial Sequence
  Synthetic Polynucleotide
taatacgactcactataggggctagattctttgactctaaactcatacacaacagaggagagtgtatatgtttagagtcaacctggcggcagcgcaaaagatg

SEQ ID NO: 119576 - DNA, 103 bp, Artificial Sequence
  Synthetic Polynucleotide
taatacgactcactataggggagctatgatgctagattctttgactctaaaacagaggagattagagatgaagaatctaaacctggcggcagcgcaaaagatg

SEQ ID NO: 119577 - DNA, 103 bp, Artificial Sequence
  Synthetic Polynucleotide
taatacgactcactataggggcgggagctggagctatgatgctagattctaacagaggagaagaatcatgcatcatagcaacctggcggcagcgcaaaagatg

SEQ ID NO: 119578 - DNA, 103 bp, Artificial Sequence
  Synthetic Polynucleotide
taatacgactcactatagggcacatcctcagcgggagctggagctatgataacagaggagaatcataatgccagctcccaacctggcggcagcgcaaaagatg

SEQ ID NO: 119579 - DNA, 103 bp, Artificial Sequence
  Synthetic Polynucleotide
taatacgactcactataggggaggagtatccacatcctcagcgggagctgaacagaggagacagctcatgctgaggatgaacctggcggcagcgcaaaagatg

SEQ ID NO: 119580 - DNA, 103 bp, Artificial Sequence
  Synthetic Polynucleotide
taatacgactcactatagggtttttccttggaggagtatccacatcctcaaacagaggagatgaggaatgggatactccaacctggcggcagcgcaaaagatg

SEQ ID NO: 119581 - DNA, 103 bp, Artificial Sequence
  Synthetic Polynucleotide
taatacgactcactatagggtttcctcttctttttccttggaggagtatcaacagaggagagatactatgccaaggaaaaacctggcggcagcgcaaaagatg

SEQ ID NO: 119582 - DNA, 103 bp, Artificial Sequence
  Synthetic Polynucleotide
taatacgactcactatagggacaaccggtgtttcctcttctttttccttgaacagaggagacaaggaatgagaagaggaaacctggcggcagcgcaaaagatg

SEQ ID NO: 119583 - DNA, 103 bp, Artificial Sequence
  Synthetic Polynucleotide
taatacgactcactatagggtttaagatttccgttctttccaaaattttcaacagaggagagaaaatatgggaaagaacaacctggcggcagcgcaaaagatg

SEQ ID NO: 119584 - DNA, 103 bp, Artificial Sequence
  Synthetic Polynucleotide
taatacgactcactatagggtgtgcagcccacaaccggtgtttcctcttcaacagaggagagaagagatgacaccggttaacctggcggcagcgcaaaagatg

SEQ ID NO: 119585 - DNA, 103 bp, Artificial Sequence
  Synthetic Polynucleotide
taatacgactcactatagggctttctgcagtgtgcagcccacaaccggtgaacagaggagacaccggatgtgggctgcaaacctggcggcagcgcaaaagatg

SEQ ID NO: 119586 - DNA, 103 bp, Artificial Sequence
  Synthetic Polynucleotide
taatacgactcactatagggtcagctgtatctttctgcagtgtgcagcccaacagaggagagggctgatgactgcagaaaacctggcggcagcgcaaaagatg

SEQ ID NO: 119587 - DNA, 103 bp, Artificial Sequence
  Synthetic Polynucleotide
taatacgactcactatagggccgtcctttttcagctgtatctttctgcagaacagaggagactgcagatggatacagctaacctggcggcagcgcaaaagatg

SEQ ID NO: 119588 - DNA, 103 bp, Artificial Sequence
  Synthetic Polynucleotide
taatacgactcactataggggttagaggagccgtcctttttcagctgtataacagaggagaatacagatgaaaaaggacaacctggcggcagcgcaaaagatg

SEQ ID NO: 119589 - DNA, 103 bp, Artificial Sequence
  Synthetic Polynucleotide
taatacgactcactatagggtgtaaacatggttagaggagccgtccttttaacagaggagaaaaaggatggctcctctaaacctggcggcagcgcaaaagatg

SEQ ID NO: 119590 - DNA, 103 bp, Artificial Sequence
  Synthetic Polynucleotide
taatacgactcactatagggggttgatagttgtaaacatggttagaggagaacagaggagactcctcatgccatgtttaaacctggcggcagcgcaaaagatg

SEQ ID NO: 119591 - DNA, 103 bp, Artificial Sequence
  Synthetic Polynucleotide
taatacgactcactatagggatgatcacagggttgatagttgtaaacatgaacagaggagacatgttatgaactatcaaaacctggcggcagcgcaaaagatg

SEQ ID NO: 119592 - DNA, 103 bp, Artificial Sequence
  Synthetic Polynucleotide
taatacgactcactataggggctgccgtggatgatcacagggttgatagtaacagaggagaactatcatgcctgtgatcaacctggcggcagcgcaaaagatg

SEQ ID NO: 119593 - DNA, 103 bp, Artificial Sequence
  Synthetic Polynucleotide
taatacgactcactatagggctgtcacaaggctgccgtggatgatcacagaacagaggagactgtgaatgtccacggcaaacctggcggcagcgcaaaagatg

SEQ ID NO: 119594 - DNA, 103 bp, Artificial Sequence
  Synthetic Polynucleotide
taatacgactcactatagggccattcttggtttaagatttccgttctttcaacagaggagagaaagaatggaaatcttaaacctggcggcagcgcaaaagatg

SEQ ID NO: 119595 - DNA, 103 bp, Artificial Sequence
  Synthetic Polynucleotide
taatacgactcactatagggagggcacgaactgtcacaaggctgccgtggaacagaggagaccacggatgccttgtgacaacctggcggcagcgcaaaagatg

SEQ ID NO: 119596 - DNA, 103 bp, Artificial Sequence
  Synthetic Polynucleotide
taatacgactcactatagggctatcacacaagggcacgaactgtcacaagaacagaggagacttgtgatggttcgtgccaacctggcggcagcgcaaaagatg

SEQ ID NO: 119597 - DNA, 103 bp, Artificial Sequence
  Synthetic Polynucleotide
taatacgactcactatagggaaattttgtgctatcacacaagggcacgaaaacagaggagattcgtgatgttgtgtgataacctggcggcagcgcaaaagatg

SEQ ID NO: 119598 - DNA, 103 bp, Artificial Sequence
  Synthetic Polynucleotide
taatacgactcactatagggcttttcacaaaaattttgtgctatcacacaaacagaggagatgtgtgatggcacaaaataacctggcggcagcgcaaaagatg

SEQ ID NO: 119599 - DNA, 103 bp, Artificial Sequence
  Synthetic Polynucleotide
taatacgactcactatagggattgacaaaacttttcacaaaaattttgtgaacagaggagacacaaaatgtttgtgaaaaacctggcggcagcgcaaaagatg

SEQ ID NO: 119600 - DNA, 103 bp, Artificial Sequence
  Synthetic Polynucleotide
taatacgactcactatagggtctgaactacattgacaaaacttttcacaaaacagaggagattgtgaatggttttgtcaaacctggcggcagcgcaaaagatg

SEQ ID NO: 119601 - DNA, 103 bp, Artificial Sequence
  Synthetic Polynucleotide
taatacgactcactataggggttttgacactctgaactacattgacaaaaaacagaggagattttgtatgtgtagttcaaacctggcggcagcgcaaaagatg

SEQ ID NO: 119602 - DNA, 103 bp, Artificial Sequence
  Synthetic Polynucleotide
taatacgactcactatagggccggaaagcggttttgacactctgaactacaacagaggagagtagttatgagtgtcaaaaacctggcggcagcgcaaaagatg

SEQ ID NO: 119603 - DNA, 103 bp, Artificial Sequence
  Synthetic Polynucleotide
taatacgactcactatagggcagcggcatcccggaaagcggttttgacacaacagaggagagtgtcaatgccgctttccaacctggcggcagcgcaaaagatg

SEQ ID NO: 119604 - DNA, 103 bp, Artificial Sequence
  Synthetic Polynucleotide
taatacgactcactatagggctgtgctttgcagcggcatcccggaaagcgaacagaggagacgctttatgggatgccgcaacctggcggcagcgcaaaagatg

SEQ ID NO: 119605 - DNA, 103 bp, Artificial Sequence
  Synthetic Polynucleotide
taatacgactcactatagggttcgctgtttccattcttggtttaagatttaacagaggagaaaatctatgaccaagaataacctggcggcagcgcaaaagatg

SEQ ID NO: 119606 - DNA, 103 bp, Artificial Sequence
  Synthetic Polynucleotide
taatacgactcactatagggtggtgttgcactgtgctttgcagcggcatcaacagaggagagatgccatggcaaagcacaacctggcggcagcgcaaaagatg

SEQ ID NO: 119607 - DNA, 103 bp, Artificial Sequence
  Synthetic Polynucleotide
taatacgactcactataggggggcactgcttggtgttgcactgtgctttgaacagaggagacaaagcatggtgcaacacaacctggcggcagcgcaaaagatg

SEQ ID NO: 119608 - DNA, 103 bp, Artificial Sequence
  Synthetic Polynucleotide
taatacgactcactatagggcaggtagcacgggcactgcttggtgttgcaaacagaggagatgcaacatgaagcagtgcaacctggcggcagcgcaaaagatg

SEQ ID NO: 119609 - DNA, 103 bp, Artificial Sequence
  Synthetic Polynucleotide
taatacgactcactatagggctcggacagccaggtagcacgggcactgctaacagaggagaagcagtatgcgtgctaccaacctggcggcagcgcaaaagatg

SEQ ID NO: 119610 - DNA, 103 bp, Artificial Sequence
  Synthetic Polynucleotide
taatacgactcactataggggggtcacactctcggacagccaggtagcacaacagaggagagtgctaatgggctgtccgaacctggcggcagcgcaaaagatg

SEQ ID NO: 119611 - DNA, 103 bp, Artificial Sequence
  Synthetic Polynucleotide
taatacgactcactatagggacagaggtcagggtcacactctcggacagcaacagaggagagctgtcatggagtgtgacaacctggcggcagcgcaaaagatg

SEQ ID NO: 119612 - DNA, 103 bp, Artificial Sequence
  Synthetic Polynucleotide
taatacgactcactatagggcacaagtaagacagaggtcagggtcacactaacagaggagaagtgtgatgctgacctctaacctggcggcagcgcaaaagatg

SEQ ID NO: 119613 - DNA, 103 bp, Artificial Sequence
  Synthetic Polynucleotide
taatacgactcactatagggtcagcggctccacaagtaagacagaggtcaaacagaggagatgacctatgtcttacttgaacctggcggcagcgcaaaagatg

SEQ ID NO: 119614 - DNA, 103 bp, Artificial Sequence
  Synthetic Polynucleotide
taatacgactcactataggggtcccaatggtcagcggctccacaagtaagaacagaggagacttactatgggagccgctaacctggcggcagcgcaaaagatg

SEQ ID NO: 119615 - DNA, 103 bp, Artificial Sequence
  Synthetic Polynucleotide
taatacgactcactatagggcatttttactgtcccaatggtcagcggctcaacagaggagagagccgatgaccattgggaacctggcggcagcgcaaaagatg

SEQ ID NO: 119616 - DNA, 103 bp, Artificial Sequence
  Synthetic Polynucleotide
taatacgactcactatagggggctgtatccttcgctgtttccattcttggaacagaggagaccaagaatggaaacagcgaacctggcggcagcgcaaaagatg

SEQ ID NO: 119617 - DNA, 103 bp, Artificial Sequence
  Synthetic Polynucleotide
taatacgactcactatagggttgcaggacacatttttactgtcccaatggaacagaggagaccattgatgcagtaaaaaaacctggcggcagcgcaaaagatg

SEQ ID NO: 119618 - DNA, 103 bp, Artificial Sequence
  Synthetic Polynucleotide
taatacgactcactatagggactgcagttcttgcaggacacatttttactaacagaggagaagtaaaatggtgtcctgcaacctggcggcagcgcaaaagatg

SEQ ID NO: 119619 - DNA, 103 bp, Artificial Sequence
  Synthetic Polynucleotide
taatacgactcactatagggcccgctgaatactgcagttcttgcaggacaaacagaggagatgtcctatgagaactgcaaacctggcggcagcgcaaaagatg

SEQ ID NO: 119620 - DNA, 103 bp, Artificial Sequence
  Synthetic Polynucleotide
taatacgactcactatagggtttttggagccccgctgaatactgcagttcaacagaggagagaactgatgtattcagcgaacctggcggcagcgcaaaagatg

SEQ ID NO: 119621 - DNA, 103 bp, Artificial Sequence
  Synthetic Polynucleotide
taatacgactcactatagggcaatagatgctttttggagccccgctgaataacagaggagaattcagatgggctccaaaaacctggcggcagcgcaaaagatg

SEQ ID NO: 119622 - DNA, 103 bp, Artificial Sequence
  Synthetic Polynucleotide
taatacgactcactatagggatggtgccagcaatagatgctttttggagcaacagaggagagctccaatgagcatctataacctggcggcagcgcaaaagatg

SEQ ID NO: 119623 - DNA, 103 bp, Artificial Sequence
  Synthetic Polynucleotide
taatacgactcactataggggccacgtcagatggtgccagcaatagatgcaacagaggagagcatctatggctggcaccaacctggcggcagcgcaaaagatg

SEQ ID NO: 119624 - DNA, 103 bp, Artificial Sequence
  Synthetic Polynucleotide
taatacgactcactatagggcccccagcctgccacgtcagatggtgccagaacagaggagactggcaatgtctgacgtgaacctggcggcagcgcaaaagatg

SEQ ID NO: 119625 - DNA, 103 bp, Artificial Sequence
  Synthetic Polynucleotide
taatacgactcactatagggtgataaaaatcccccagcctgccacgtcagaacagaggagactgacgatgcaggctgggaacctggcggcagcgcaaaagatg

SEQ ID NO: 119626 - DNA, 103 bp, Artificial Sequence
  Synthetic Polynucleotide
taatacgactcactatagggacaggatctttgataaaaatcccccagcctaacagaggagaaggctgatggatttttataacctggcggcagcgcaaaagatg

SEQ ID NO: 119627 - DNA, 103 bp, Artificial Sequence
  Synthetic Polynucleotide
taatacgactcactataggggatgtgcacaggctgtatccttcgctgtttaacagaggagaaaacagatgaggatacagaacctggcggcagcgcaaaagatg

SEQ ID NO: 119628 - DNA, 103 bp, Artificial Sequence
  Synthetic Polynucleotide
taatacgactcactatagggatttttctgcacaggatctttgataaaaataacagaggagaatttttatgaaagatcctaacctggcggcagcgcaaaagatg

SEQ ID NO: 119629 - DNA, 103 bp, Artificial Sequence
  Synthetic Polynucleotide
taatacgactcactatagggagatgaattcatttttctgcacaggatcttaacagaggagaaagatcatgtgcagaaaaaacctggcggcagcgcaaaagatg

SEQ ID NO: 119630 - DNA, 103 bp, Artificial Sequence
  Synthetic Polynucleotide
taatacgactcactatagggcagtattctgagatgaattcatttttctgcaacagaggagagcagaaatgtgaattcataacctggcggcagcgcaaaagatg

SEQ ID NO: 119631 - DNA, 103 bp, Artificial Sequence
  Synthetic Polynucleotide
taatacgactcactatagggaatctctccacagtattctgagatgaattcaacagaggagagaattcatgtcagaatacaacctggcggcagcgcaaaagatg

SEQ ID NO: 119632 - DNA, 103 bp, Artificial Sequence
  Synthetic Polynucleotide
taatacgactcactatagggcttgagaaataatctctccacagtattctgaacagaggagacagaatatggtggagagaaacctggcggcagcgcaaaagatg

SEQ ID NO: 119633 - DNA, 103 bp, Artificial Sequence
  Synthetic Polynucleotide
taatacgactcactatagggtcagcttcatcttgagaaataatctctccaaacagaggagatggagaatgtatttctcaaacctggcggcagcgcaaaagatg

SEQ ID NO: 119634 - DNA, 103 bp, Artificial Sequence
  Synthetic Polynucleotide
taatacgactcactatagggccctcttctgtcagcttcatcttgagaaataacagaggagaatttctatggatgaagctaacctggcggcagcgcaaaagatg

SEQ ID NO: 119635 - DNA, 103 bp, Artificial Sequence
  Synthetic Polynucleotide
taatacgactcactatagggcatacactttccctcttctgtcagcttcataacagaggagaatgaagatgacagaagagaacctggcggcagcgcaaaagatg

SEQ ID NO: 119636 - DNA, 103 bp, Artificial Sequence
  Synthetic Polynucleotide
taatacgactcactatagggatgtatttatcatacactttccctcttctgaacagaggagacagaagatggaaagtgtaaacctggcggcagcgcaaaagatg

SEQ ID NO: 119637 - DNA, 103 bp, Artificial Sequence
  Synthetic Polynucleotide
taatacgactcactatagggaaagctgcacatgtatttatcatacactttaacagaggagaaaagtgatggataaatacaacctggcggcagcgcaaaagatg

SEQ ID NO: 119638 - DNA, 103 bp, Artificial Sequence
  Synthetic Polynucleotide
taatacgactcactatagggaaactggtcccttctcagatttcttcccagaacagaggagactgggaatgaatctgagaaacctggcggcagcgcaaaagatg

SEQ ID NO: 119639 - DNA, 103 bp, Artificial Sequence
  Synthetic Polynucleotide
taatacgactcactatagggcagaagtcaggatgtgcacaggctgtatccaacagaggagaggatacatgctgtgcacaaacctggcggcagcgcaaaagatg

SEQ ID NO: 119640 - DNA, 103 bp, Artificial Sequence
  Synthetic Polynucleotide
taatacgactcactatagggagttgaacagaaagctgcacatgtatttataacagaggagaataaatatgtgtgcagctaacctggcggcagcgcaaaagatg

SEQ ID NO: 119641 - DNA, 103 bp, Artificial Sequence
  Synthetic Polynucleotide
taatacgactcactatagggtcattgttcaagttgaacagaaagctgcacaacagaggagagtgcagatgtctgttcaaaacctggcggcagcgcaaaagatg

SEQ ID NO: 119642 - DNA, 103 bp, Artificial Sequence
  Synthetic Polynucleotide
taatacgactcactatagggcaccacaaaatcattgttcaagttgaacagaacagaggagactgttcatgttgaacaataacctggcggcagcgcaaaagatg

SEQ ID NO: 119643 - DNA, 103 bp, Artificial Sequence
  Synthetic Polynucleotide
taatacgactcactataggggggttgcatccaccacaaaatcattgttcaaacagaggagatgaacaatgattttgtggaacctggcggcagcgcaaaagatg

SEQ ID NO: 119644 - DNA, 103 bp, Artificial Sequence
  Synthetic Polynucleotide
taatacgactcactatagggttacccttgcgggttgcatccaccacaaaaaacagaggagattttgtatgggatgcaacaacctggcggcagcgcaaaagatg

SEQ ID NO: 119645 - DNA, 103 bp, Artificial Sequence
  Synthetic Polynucleotide
taatacgactcactatagggacgaattttgttacccttgcgggttgcatcaacagaggagagatgcaatgcgcaagggtaacctggcggcagcgcaaaagatg

SEQ ID NO: 119646 - DNA, 103 bp, Artificial Sequence
  Synthetic Polynucleotide
taatacgactcactataggggatttgcaaaacgaattttgttacccttgcaacagaggagagcaaggatgacaaaattcaacctggcggcagcgcaaaagatg

SEQ ID NO: 119647 - DNA, 103 bp, Artificial Sequence
  Synthetic Polynucleotide
taatacgactcactatagggtttaccgaatgatttgcaaaacgaattttgaacagaggagacaaaatatgttttgcaaaaacctggcggcagcgcaaaagatg

SEQ ID NO: 119648 - DNA, 103 bp, Artificial Sequence
  Synthetic Polynucleotide
taatacgactcactataggggcagtttggatttaccgaatgatttgcaaaaacagaggagatttgcaatgcattcggtaaacctggcggcagcgcaaaagatg

SEQ ID NO: 119649 - DNA, 103 bp, Artificial Sequence
  Synthetic Polynucleotide
taatacgactcactatagggcttttgcatagcagtttggatttaccgaataacagaggagaattcggatgatccaaactaacctggcggcagcgcaaaagatg

SEQ ID NO: 119650 - DNA, 103 bp, Artificial Sequence
  Synthetic Polynucleotide
taatacgactcactatagggaatgagctcacagaagtcaggatgtgcacaaacagaggagatgtgcaatgcctgacttcaacctggcggcagcgcaaaagatg

SEQ ID NO: 119651 - DNA, 103 bp, Artificial Sequence
  Synthetic Polynucleotide
taatacgactcactatagggaccatcataacttttgcatagcagtttggaaacagaggagatccaaaatgctatgcaaaaacctggcggcagcgcaaaagatg

SEQ ID NO: 119652 - DNA, 103 bp, Artificial Sequence
  Synthetic Polynucleotide
taatacgactcactatagggatcaccgttaaccatcataacttttgcataaacagaggagatatgcaatggttatgatgaacctggcggcagcgcaaaagatg

SEQ ID NO: 119653 - DNA, 103 bp, Artificial Sequence
  Synthetic Polynucleotide
taatacgactcactatagggctatcctgtgatcaccgttaaccatcataaaacagaggagattatgaatgttaacggtgaacctggcggcagcgcaaaagatg

SEQ ID NO: 119654 - DNA, 103 bp, Artificial Sequence
  Synthetic Polynucleotide
taatacgactcactataggggcaaaaatacctatcctgtgatcaccgttaaacagaggagataacggatgtcacaggataacctggcggcagcgcaaaagatg

SEQ ID NO: 119655 - DNA, 103 bp, Artificial Sequence
  Synthetic Polynucleotide
taatacgactcactatagggggctctcttggcaaaaatacctatcctgtgaacagaggagacacaggatgggtatttttaacctggcggcagcgcaaaagatg

SEQ ID NO: 119656 - DNA, 103 bp, Artificial Sequence
  Synthetic Polynucleotide
taatacgactcactatagggcagtctggatggctctcttggcaaaaatacaacagaggagagtatttatgccaagagagaacctggcggcagcgcaaaagatg

SEQ ID NO: 119657 - DNA, 103 bp, Artificial Sequence
  Synthetic Polynucleotide
taatacgactcactatagggagctcttcgccagtctggatggctctcttgaacagaggagacaagagatgcatccagacaacctggcggcagcgcaaaagatg

SEQ ID NO: 119658 - DNA, 103 bp, Artificial Sequence
  Synthetic Polynucleotide
taatacgactcactatagggatcaaaaaacagctcttcgccagtctggataacagaggagaatccagatgggcgaagagaacctggcggcagcgcaaaagatg

SEQ ID NO: 119659 - DNA, 103 bp, Artificial Sequence
  Synthetic Polynucleotide
taatacgactcactatagggtgtatctgtaatcaaaaaacagctcttcgcaacagaggagagcgaagatgtgttttttgaacctggcggcagcgcaaaagatg

SEQ ID NO: 119660 - DNA, 103 bp, Artificial Sequence
  Synthetic Polynucleotide
taatacgactcactatagggtcagcctggctgtatctgtaatcaaaaaacaacagaggagagtttttatgttacagataaacctggcggcagcgcaaaagatg

SEQ ID NO: 119661 - DNA, 103 bp, Artificial Sequence
  Synthetic Polynucleotide
taatacgactcactatagggagtcccgcgcaatgagctcacagaagtcagaacagaggagactgactatggtgagctcaaacctggcggcagcgcaaaagatg

SEQ ID NO: 119662 - DNA, 103 bp, Artificial Sequence
  Synthetic Polynucleotide
taatacgactcactatagggcttcagggcatcagcctggctgtatctgtaaacagaggagatacagaatgagccaggctaacctggcggcagcgcaaaagatg

SEQ ID NO: 119663 - DNA, 103 bp, Artificial Sequence
  Synthetic Polynucleotide
taatacgactcactatagggtgccgacatacttcagggcatcagcctggcaacagaggagagccaggatgatgccctgaaacctggcggcagcgcaaaagatg

SEQ ID NO: 119664 - DNA, 103 bp, Artificial Sequence
  Synthetic Polynucleotide
taatacgactcactatagggtctctttcgatgccgacatacttcagggcaaacagaggagatgccctatggtatgtcggaacctggcggcagcgcaaaagatg

SEQ ID NO: 119665 - DNA, 103 bp, Artificial Sequence
  Synthetic Polynucleotide
taatacgactcactataggggatttccatttctctttcgatgccgacataaacagaggagatatgtcatgatcgaaagaaacctggcggcagcgcaaaagatg

SEQ ID NO: 119666 - DNA, 103 bp, Artificial Sequence
  Synthetic Polynucleotide
taatacgactcactatagggaacactccctagtcccgcgcaatgagctcaaacagaggagatgagctatgtgcgcgggaaacctggcggcagcgcaaaagatg

SEQ ID NO: 119667 - DNA, 103 bp, Artificial Sequence
  Synthetic Polynucleotide
taatacgactcactatagggctggtcaccgaacactccctagtcccgcgcaacagaggagagcgcggatgtagggagtgaacctggcggcagcgcaaaagatg

SEQ ID NO: 119668 - DNA, 103 bp, Artificial Sequence
  Synthetic Polynucleotide
taatacgactcactatagggatccaagtcactggtcaccgaacactccctaacagaggagaagggagatgtcggtgaccaacctggcggcagcgcaaaagatg

SEQ ID NO: 119669 - DNA, 103 bp, Artificial Sequence
  Synthetic Polynucleotide
taatacgactcactataggggtgttggaaaatccaagtcactggtcaccgaacagaggagacggtgaatggtgacttggaacctggcggcagcgcaaaagatg

SEQ ID NO: 119670 - DNA, 103 bp, Artificial Sequence
  Synthetic Polynucleotide
taatacgactcactataggggggatgacttgtgttggaaaatccaagtcaaacagaggagatgacttatgttttccaacaacctggcggcagcgcaaaagatg

SEQ ID NO: 119671 - DNA, 103 bp, Artificial Sequence
  Synthetic Polynucleotide
taatacgactcactatagggagtctttaatgggatgacttgtgttggaaaaacagaggagatttccaatgcaagtcatcaacctggcggcagcgcaaaagatg

SEQ ID NO: 119672 - DNA, 103 bp, Artificial Sequence
  Synthetic Polynucleotide
taatacgactcactatagggctgcattcagagtctttaatgggatgacttaacagaggagaaagtcaatgcattaaagaaacctggcggcagcgcaaaagatg

SEQ ID NO: 119673 - DNA, 103 bp, Artificial Sequence
  Synthetic Polynucleotide
taatacgactcactatagggttccgccaacaaactggtcccttctcagataacagaggagaatctgaatggggaccagtaacctggcggcagcgcaaaagatg

SEQ ID NO: 119674 - DNA, 103 bp, Artificial Sequence
  Synthetic Polynucleotide
taatacgactcactatagggactgaagcaactgcattcagagtctttaataacagaggagaattaaaatgtctgaatgcaacctggcggcagcgcaaaagatg

SEQ ID NO: 119675 - DNA, 103 bp, Artificial Sequence
  Synthetic Polynucleotide
taatacgactcactatagggcattatgggtactgaagcaactgcattcagaacagaggagactgaatatggttgcttcaaacctggcggcagcgcaaaagatg

SEQ ID NO: 119676 - DNA, 103 bp, Artificial Sequence
  Synthetic Polynucleotide
taatacgactcactatagggaccaagaatacattatgggtactgaagcaaaacagaggagattgcttatgtacccataaaacctggcggcagcgcaaaagatg

SEQ ID NO: 119677 - DNA, 103 bp, Artificial Sequence
  Synthetic Polynucleotide
taatacgactcactatagggtgtaggggagaccaagaatacattatgggtaacagaggagaacccatatggtattcttgaacctggcggcagcgcaaaagatg

SEQ ID NO: 119678 - DNA, 103 bp, Artificial Sequence
  Synthetic Polynucleotide
taatacgactcactatagggaaaattctgctgtaggggagaccaagaataaacagaggagatattctatgtctcccctaaacctggcggcagcgcaaaagatg

SEQ ID NO: 119679 - DNA, 103 bp, Artificial Sequence
  Synthetic Polynucleotide
taatacgactcactatagggcttccaccataaaattctgctgtaggggagaacagaggagactccccatgagcagaattaacctggcggcagcgcaaaagatg

SEQ ID NO: 119680 - DNA, 103 bp, Artificial Sequence
  Synthetic Polynucleotide
taatacgactcactatagggacagtttcatcttccaccataaaattctgcaacagaggagagcagaaatgtatggtggaaacctggcggcagcgcaaaagatg

SEQ ID NO: 119681 - DNA, 103 bp, Artificial Sequence
  Synthetic Polynucleotide
taatacgactcactataggggttatgtaaaacagtttcatcttccaccataacagaggagaatggtgatggatgaaactaacctggcggcagcgcaaaagatg

SEQ ID NO: 119682 - DNA, 103 bp, Artificial Sequence
  Synthetic Polynucleotide
taatacgactcactatagggtataaggaatgttatgtaaaacagtttcataacagaggagaatgaaaatgttttacataaacctggcggcagcgcaaaagatg

SEQ ID NO: 119683 - DNA, 103 bp, Artificial Sequence
  Synthetic Polynucleotide
taatacgactcactatagggtcatctcccatataaggaatgttatgtaaaaacagaggagatttacaatgcattccttaaacctggcggcagcgcaaaagatg

SEQ ID NO: 119684 - DNA, 103 bp, Artificial Sequence
  Synthetic Polynucleotide
taatacgactcactatagggttttacacgcttccgccaacaaactggtccaacagaggagaggaccaatgtgttggcggaacctggcggcagcgcaaaagatg

SEQ ID NO: 119685 - DNA, 103 bp, Artificial Sequence
  Synthetic Polynucleotide
taatacgactcactatagggatctaaaacttcatctcccatataaggaataacagaggagaattcctatgatgggagataacctggcggcagcgcaaaagatg

SEQ ID NO: 119686 - DNA, 103 bp, Artificial Sequence
  Synthetic Polynucleotide
taatacgactcactatagggtaccatcctgatctaaaacttcatctcccaaacagaggagatgggagatgaagttttagaacctggcggcagcgcaaaagatg

SEQ ID NO: 119687 - DNA, 103 bp, Artificial Sequence
  Synthetic Polynucleotide
taatacgactcactatagggtcaatgaaagtaccatcctgatctaaaactaacagaggagaagttttatgtcaggatggaacctggcggcagcgcaaaagatg

SEQ ID NO: 119688 - DNA, 103 bp, Artificial Sequence
  Synthetic Polynucleotide
taatacgactcactatagggtattagttcttcaatgaaagtaccatcctgaacagaggagacaggatatgactttcattaacctggcggcagcgcaaaagatg

SEQ ID NO: 119689 - DNA, 103 bp, Artificial Sequence
  Synthetic Polynucleotide
taatacgactcactatagggcataattttttattagttcttcaatgaaagaacagaggagactttcaatgaagaactaaaacctggcggcagcgcaaaagatg

SEQ ID NO: 119690 - DNA, 103 bp, Artificial Sequence
  Synthetic Polynucleotide
taatacgactcactatagggactttcccatcataattttttattagttctaacagaggagaagaactatgaaaaaattaaacctggcggcagcgcaaaagatg

SEQ ID NO: 119691 - DNA, 103 bp, Artificial Sequence
  Synthetic Polynucleotide
taatacgactcactatagggatccccgtgtactttcccatcataatttttaacagaggagaaaaaatatggatgggaaaaacctggcggcagcgcaaaagatg

SEQ ID NO: 119692 - DNA, 103 bp, Artificial Sequence
  Synthetic Polynucleotide
taatacgactcactatagggcacattctctatccccgtgtactttcccataacagaggagaatgggaatgtacacggggaacctggcggcagcgcaaaagatg

SEQ ID NO: 119693 - DNA, 103 bp, Artificial Sequence
  Synthetic Polynucleotide
taatacgactcactatagggtttataaacccacattctctatccccgtgtaacagaggagaacacggatgtagagaatgaacctggcggcagcgcaaaagatg

SEQ ID NO: 119694 - DNA, 103 bp, Artificial Sequence
  Synthetic Polynucleotide
taatacgactcactatagggaatttcatcatttataaacccacattctctaacagaggagaagagaaatggggtttataaacctggcggcagcgcaaaagatg

SEQ ID NO: 119695 - DNA, 103 bp, Artificial Sequence
  Synthetic Polynucleotide
taatacgactcactatagggtgtactctgattttacacgcttccgccaacaacagaggagagttggcatgagcgtgtaaaacctggcggcagcgcaaaagatg

SEQ ID NO: 119696 - DNA, 103 bp, Artificial Sequence
  Synthetic Polynucleotide
taatacgactcactatagggactccacaaaaatttcatcatttataaaccaacagaggagaggtttaatgatgatgaaaaacctggcggcagcgcaaaagatg

SEQ ID NO: 119697 - DNA, 103 bp, Artificial Sequence
  Synthetic Polynucleotide
taatacgactcactataggggcattcaccaactccacaaaaatttcatcaaacagaggagatgatgaatgttttgtggaaacctggcggcagcgcaaaagatg

SEQ ID NO: 119698 - DNA, 103 bp, Artificial Sequence
  Synthetic Polynucleotide
taatacgactcactatagggttgaccaagggcattcaccaactccacaaaaacagaggagatttgtgatgttggtgaataacctggcggcagcgcaaaagatg

SEQ ID NO: 119699 - DNA, 103 bp, Artificial Sequence
  Synthetic Polynucleotide
taatacgactcactatagggcatcattatattgaccaagggcattcaccaaacagaggagatggtgaatgcccttggtcaacctggcggcagcgcaaaagatg

SEQ ID NO: 119700 - DNA, 103 bp, Artificial Sequence
  Synthetic Polynucleotide
taatacgactcactatagggtcatcgtcatcatcattatattgaccaaggaacagaggagaccttggatgatataatgaaacctggcggcagcgcaaaagatg

SEQ ID NO: 119701 - DNA, 103 bp, Artificial Sequence
  Synthetic Polynucleotide
taatacgactcactatagggtccatcatcatcatcgtcatcatcattataaacagaggagatataatatggatgacgataacctggcggcagcgcaaaagatg

SEQ ID NO: 119702 - DNA, 103 bp, Artificial Sequence
  Synthetic Polynucleotide
taatacgactcactatagggcaggatcgtctccatcatcatcatcgtcataacagaggagaatgacgatgatgatgatgaacctggcggcagcgcaaaagatg

SEQ ID NO: 119703 - DNA, 103 bp, Artificial Sequence
  Synthetic Polynucleotide
taatacgactcactatagggtctctttcttcaggatcgtctccatcatcaaacagaggagatgatgaatgagacgatccaacctggcggcagcgcaaaagatg

SEQ ID NO: 119704 - DNA, 103 bp, Artificial Sequence
  Synthetic Polynucleotide
taatacgactcactatagggctgcttttcttctctttcttcaggatcgtcaacagaggagagacgatatggaagaaagaaacctggcggcagcgcaaaagatg

SEQ ID NO: 119705 - DNA, 103 bp, Artificial Sequence
  Synthetic Polynucleotide
taatacgactcactatagggccagatctttctgcttttcttctctttcttaacagaggagaaagaaaatgaagaaaagcaacctggcggcagcgcaaaagatg

SEQ ID NO: 119706 - DNA, 103 bp, Artificial Sequence
  Synthetic Polynucleotide
taatacgactcactatagggctcagtcgcatgtactctgattttacacgcaacagaggagagcgtgtatgatcagagtaaacctggcggcagcgcaaaagatg

SEQ ID NO: 119707 - DNA, 103 bp, Artificial Sequence
  Synthetic Polynucleotide
taatacgactcactatagggcggtgatcctccagatctttctgcttttctaacagaggagaagaaaaatggaaagatctaacctggcggcagcgcaaaagatg

SEQ ID NO: 119708 - DNA, 103 bp, Artificial Sequence
  Synthetic Polynucleotide
taatacgactcactatagggtttatcatctcggtgatcctccagatctttaacagaggagaaaagatatggaggatcacaacctggcggcagcgcaaaagatg

SEQ ID NO: 119709 - DNA, 103 bp, Artificial Sequence
  Synthetic Polynucleotide
taatacgactcactatagggggcggctttctttatcatctcggtgatcctaacagaggagaaggatcatggagatgataaacctggcggcagcgcaaaagatg

SEQ ID NO: 119710 - DNA, 103 bp, Artificial Sequence
  Synthetic Polynucleotide
taatacgactcactatagggttccgaggtgggcggctttctttatcatctaacagaggagaagatgaatgagaaagccgaacctggcggcagcgcaaaagatg

SEQ ID NO: 119711 - DNA, 103 bp, Artificial Sequence
  Synthetic Polynucleotide
taatacgactcactatagggagaaggaaatttccgaggtgggcggctttcaacagaggagagaaagcatgccacctcggaacctggcggcagcgcaaaagatg

SEQ ID NO: 119712 - DNA, 103 bp, Artificial Sequence
  Synthetic Polynucleotide
taatacgactcactatagggaaattttatcagaaggaaatttccgaggtgaacagaggagacacctcatgaatttccttaacctggcggcagcgcaaaagatg

SEQ ID NO: 119713 - DNA, 103 bp, Artificial Sequence
  Synthetic Polynucleotide
taatacgactcactatagggatggcttcaaaaattttatcagaaggaaataacagaggagaatttccatgtgataaaataacctggcggcagcgcaaaagatg

SEQ ID NO: 119714 - DNA, 103 bp, Artificial Sequence
  Synthetic Polynucleotide
taatacgactcactatagggcattgaggaaatggcttcaaaaattttatcaacagaggagagataaaatgtttgaagccaacctggcggcagcgcaaaagatg

SEQ ID NO: 119715 - DNA, 103 bp, Artificial Sequence
  Synthetic Polynucleotide
taatacgactcactatagggtatctggaaacattgaggaaatggcttcaaaacagaggagattgaagatgtttcctcaaaacctggcggcagcgcaaaagatg

SEQ ID NO: 119716 - DNA, 103 bp, Artificial Sequence
  Synthetic Polynucleotide
taatacgactcactataggggctgtgcccttatctggaaacattgaggaaaacagaggagattcctcatggtttccagaaacctggcggcagcgcaaaagatg

SEQ ID NO: 119717 - DNA, 103 bp, Artificial Sequence
  Synthetic Polynucleotide
taatacgactcactatagggcttgagctgtctcagtcgcatgtactctgaaacagaggagatcagagatgatgcgactgaacctggcggcagcgcaaaagatg

SEQ ID NO: 119718 - DNA, 103 bp, Artificial Sequence
  Synthetic Polynucleotide
taatacgactcactatagggtagttcttctgctgtgcccttatctggaaaaacagaggagatttccaatgaagggcacaaacctggcggcagcgcaaaagatg

SEQ ID NO: 119719 - DNA, 103 bp, Artificial Sequence
  Synthetic Polynucleotide
taatacgactcactatagggatttttcctttagttcttctgctgtgccctaacagaggagaagggcaatgcagaagaacaacctggcggcagcgcaaaagatg

SEQ ID NO: 119720 - DNA, 103 bp, Artificial Sequence
  Synthetic Polynucleotide
taatacgactcactatagggagttctttatatttttcctttagttcttctaacagaggagaagaagaatgaaaggaaaaaacctggcggcagcgcaaaagatg

SEQ ID NO: 119721 - DNA, 103 bp, Artificial Sequence
  Synthetic Polynucleotide
taatacgactcactatagggctgttcggtgagttctttatatttttccttaacagaggagaaaggaaatgtataaagaaaacctggcggcagcgcaaaagatg

SEQ ID NO: 119722 - DNA, 103 bp, Artificial Sequence
  Synthetic Polynucleotide
taatacgactcactatagggctgggagctgctgttcggtgagttctttataacagaggagaataaagatgtcaccgaacaacctggcggcagcgcaaaagatg

SEQ ID NO: 119723 - DNA, 103 bp, Artificial Sequence
  Synthetic Polynucleotide
taatacgactcactatagggggaagtgcgcctgggagctgctgttcggtgaacagaggagacaccgaatggcagctcccaacctggcggcagcgcaaaagatg

SEQ ID NO: 119724 - DNA, 103 bp, Artificial Sequence
  Synthetic Polynucleotide
taatacgactcactatagggacattcaggaggaagtgcgcctgggagctgaacagaggagacagctcatgggcgcacttaacctggcggcagcgcaaaagatg

SEQ ID NO: 119725 - DNA, 103 bp, Artificial Sequence
  Synthetic Polynucleotide
taatacgactcactatagggtgttgggggtacattcaggaggaagtgcgcaacagaggagagcgcacatgctcctgaataacctggcggcagcgcaaaagatg

SEQ ID NO: 119726 - DNA, 103 bp, Artificial Sequence
  Synthetic Polynucleotide
taatacgactcactatagggggtccatctatgttgggggtacattcaggaaacagaggagatcctgaatgtacccccaaaacctggcggcagcgcaaaagatg

SEQ ID NO: 119727 - DNA, 103 bp, Artificial Sequence
  Synthetic Polynucleotide
taatacgactcactatagggtttagcatttggtccatctatgttgggggtaacagaggagaacccccatgatagatggaaacctggcggcagcgcaaaagatg

SEQ ID NO: 119728 - DNA, 103 bp, Artificial Sequence
  Synthetic Polynucleotide
taatacgactcactataggggtctgaacctcttgagctgtctcagtcgcaaacagaggagatgcgacatggacagctcaaacctggcggcagcgcaaaagatg

SEQ ID NO: 119729 - DNA, 103 bp, Artificial Sequence
  Synthetic Polynucleotide
taatacgactcactatagggtctgaacagatttagcatttggtccatctaaacagaggagatagatgatgcaaatgctaaacctggcggcagcgcaaaagatg

SEQ ID NO: 119730 - DNA, 103 bp, Artificial Sequence
  Synthetic Polynucleotide
taatacgactcactatagggctttgctctctctgaacagatttagcatttaacagaggagaaaatgcatgatctgttcaaacctggcggcagcgcaaaagatg

SEQ ID NO: 119731 - DNA, 103 bp, Artificial Sequence
  Synthetic Polynucleotide
taatacgactcactatagggggagtgtaagctttgctctctctgaacagaaacagaggagatctgttatgagagagcaaaacctggcggcagcgcaaaagatg

SEQ ID NO: 119732 - DNA, 103 bp, Artificial Sequence
  Synthetic Polynucleotide
taatacgactcactataggggcgtatgaaaggagtgtaagctttgctctcaacagaggagagagagcatggcttacactaacctggcggcagcgcaaaagatg

SEQ ID NO: 119733 - DNA, 103 bp, Artificial Sequence
  Synthetic Polynucleotide
taatacgactcactatagggctacagaaaagcgtatgaaaggagtgtaagaacagaggagacttacaatgctttcatacaacctggcggcagcgcaaaagatg

SEQ ID NO: 119734 - DNA, 103 bp, Artificial Sequence
  Synthetic Polynucleotide
taatacgactcactatagggaaaacatcgcctacagaaaagcgtatgaaaaacagaggagatttcatatgcttttctgtaacctggcggcagcgcaaaagatg

SEQ ID NO: 119735 - DNA, 103 bp, Artificial Sequence
  Synthetic Polynucleotide
taatacgactcactatagggagtcatatttaaaacatcgcctacagaaaaaacagaggagattttctatgggcgatgttaacctggcggcagcgcaaaagatg

SEQ ID NO: 119736 - DNA, 103 bp, Artificial Sequence
  Synthetic Polynucleotide
taatacgactcactatagggtgtaggaagcagtcatatttaaaacatcgcaacagaggagagcgatgatgtaaatatgaaacctggcggcagcgcaaaagatg

SEQ ID NO: 119737 - DNA, 103 bp, Artificial Sequence
  Synthetic Polynucleotide
taatacgactcactataggggcacttacgatgtaggaagcagtcatatttaacagaggagaaaatatatgtgcttcctaaacctggcggcagcgcaaaagatg

SEQ ID NO: 119738 - DNA, 103 bp, Artificial Sequence
  Synthetic Polynucleotide
taatacgactcactatagggaagaataattgcacttacgatgtaggaagcaacagaggagagcttccatgatcgtaagtaacctggcggcagcgcaaaagatg

SEQ ID NO: 119739 - DNA, 103 bp, Artificial Sequence
  Synthetic Polynucleotide
taatacgactcactatagggtcatcagctcgtctgaacctcttgagctgtaacagaggagaacagctatggaggttcagaacctggcggcagcgcaaaagatg

SEQ ID NO: 119740 - DNA, 103 bp, Artificial Sequence
  Synthetic Polynucleotide
taatacgactcactataggggttgcatgaaaagaataattgcacttacgaaacagaggagatcgtaaatgcaattattcaacctggcggcagcgcaaaagatg

SEQ ID NO: 119741 - DNA, 103 bp, Artificial Sequence
  Synthetic Polynucleotide
taatacgactcactatagggagtgttgggtgttgcatgaaaagaataattaacagaggagaaattatatgtttcatgcaaacctggcggcagcgcaaaagatg

SEQ ID NO: 119742 - DNA, 103 bp, Artificial Sequence
  Synthetic Polynucleotide
taatacgactcactatagggtccgcttataagtgttgggtgttgcatgaaaacagaggagattcatgatgcacccaacaaacctggcggcagcgcaaaagatg

SEQ ID NO: 119743 - DNA, 103 bp, Artificial Sequence
  Synthetic Polynucleotide
taatacgactcactatagggtctgtgttcttccgcttataagtgttgggtaacagaggagaacccaaatgttataagcgaacctggcggcagcgcaaaagatg

SEQ ID NO: 119744 - DNA, 103 bp, Artificial Sequence
  Synthetic Polynucleotide
taatacgactcactatagggtagagctgtttctgtgttcttccgcttataaacagaggagatataagatgaagaacacaaacctggcggcagcgcaaaagatg

SEQ ID NO: 119745 - DNA, 103 bp, Artificial Sequence
  Synthetic Polynucleotide
taatacgactcactataggggtttgttgtctagagctgtttctgtgttctaacagaggagaagaacaatgaaacagctcaacctggcggcagcgcaaaagatg

SEQ ID NO: 119746 - DNA, 103 bp, Artificial Sequence
  Synthetic Polynucleotide
taatacgactcactatagggggtccacaaggtttgttgtctagagctgttaacagaggagaaacagcatgagacaacaaaacctggcggcagcgcaaaagatg

SEQ ID NO: 119747 - DNA, 103 bp, Artificial Sequence
  Synthetic Polynucleotide
taatacgactcactataggggtaacactgtggtccacaaggtttgttgtcaacagaggagagacaacatgccttgtggaaacctggcggcagcgcaaaagatg

SEQ ID NO: 119748 - DNA, 103 bp, Artificial Sequence
  Synthetic Polynucleotide
taatacgactcactatagggccaaatgctggtaacactgtggtccacaagaacagaggagacttgtgatgcacagtgttaacctggcggcagcgcaaaagatg

SEQ ID NO: 119749 - DNA, 103 bp, Artificial Sequence
  Synthetic Polynucleotide
taatacgactcactatagggtttgctccctccaaatgctggtaacactgtaacagaggagaacagtgatgccagcatttaacctggcggcagcgcaaaagatg

SEQ ID NO: 119750 - DNA, 103 bp, Artificial Sequence
  Synthetic Polynucleotide
taatacgactcactataggggtccacgcagctctccggataggccgccataacagaggagaatggcgatgtatccggagaacctggcggcagcgcaaaagatg

SEQ ID NO: 119751 - DNA, 103 bp, Artificial Sequence
  Synthetic Polynucleotide
taatacgactcactatagggccccaaggagaccccgggtgcgaagtcgcaaacagaggagatgcgacatggcacccgggaacctggcggcagcgcaaaagatg

SEQ ID NO: 119752 - DNA, 103 bp, Artificial Sequence
  Synthetic Polynucleotide
taatacgactcactataggggggctgggtcccccaaggagaccccgggtgaacagaggagacacccgatgtctccttggaacctggcggcagcgcaaaagatg

SEQ ID NO: 119753 - DNA, 103 bp, Artificial Sequence
  Synthetic Polynucleotide
taatacgactcactatagggcggagcgcaagggctgggtcccccaaggagaacagaggagactccttatgggacccagcaacctggcggcagcgcaaaagatg

SEQ ID NO: 119754 - DNA, 103 bp, Artificial Sequence
  Synthetic Polynucleotide
taatacgactcactatagggtcttccctctcggagcgcaagggctgggtcaacagaggagagacccaatgcttgcgctcaacctggcggcagcgcaaaagatg

SEQ ID NO: 119755 - DNA, 103 bp, Artificial Sequence
  Synthetic Polynucleotide
taatacgactcactatagggtcctcctgggtcttccctctcggagcgcaaaacagaggagattgcgcatggagagggaaaacctggcggcagcgcaaaagatg

SEQ ID NO: 119756 - DNA, 103 bp, Artificial Sequence
  Synthetic Polynucleotide
taatacgactcactatagggaaccgcgccatcctcctgggtcttccctctaacagaggagaagagggatgacccaggagaacctggcggcagcgcaaaagatg

SEQ ID NO: 119757 - DNA, 103 bp, Artificial Sequence
  Synthetic Polynucleotide
taatacgactcactatagggcccctcttcaaaccgcgccatcctcctgggaacagaggagacccaggatgatggcgcggaacctggcggcagcgcaaaagatg

SEQ ID NO: 119758 - DNA, 103 bp, Artificial Sequence
  Synthetic Polynucleotide
taatacgactcactatagggcttctgggtccccctcttcaaaccgcgccaaacagaggagatggcgcatgttgaagaggaacctggcggcagcgcaaaagatg

SEQ ID NO: 119759 - DNA, 103 bp, Artificial Sequence
  Synthetic Polynucleotide
taatacgactcactatagggcactcctcttcttctgggtccccctcttcaaacagaggagatgaagaatgggacccagaaacctggcggcagcgcaaaagatg

SEQ ID NO: 119760 - DNA, 103 bp, Artificial Sequence
  Synthetic Polynucleotide
taatacgactcactataggggtccacttcgcactcctcttcttctgggtcaacagaggagagacccaatggaagaggagaacctggcggcagcgcaaaagatg

SEQ ID NO: 119761 - DNA, 103 bp, Artificial Sequence
  Synthetic Polynucleotide
taatacgactcactataggggcaccgtagtgtccacgcagctctccggataacagaggagaatccggatggctgcgtggaacctggcggcagcgcaaaagatg

SEQ ID NO: 119762 - DNA, 103 bp, Artificial Sequence
  Synthetic Polynucleotide
taatacgactcactatagggcgtccccctggtccacttcgcactcctcttaacagaggagaaagaggatggcgaagtggaacctggcggcagcgcaaaagatg

SEQ ID NO: 119763 - DNA, 103 bp, Artificial Sequence
  Synthetic Polynucleotide
taatacgactcactatagggtcctcttctccgtccccctggtccacttcgaacagaggagacgaagtatgccagggggaaacctggcggcagcgcaaaagatg

SEQ ID NO: 119764 - DNA, 103 bp, Artificial Sequence
  Synthetic Polynucleotide
taatacgactcactatagggctcttcctcctcctcttctccgtccccctgaacagaggagacaggggatgggagaagagaacctggcggcagcgcaaaagatg

SEQ ID NO: 119765 - DNA, 103 bp, Artificial Sequence
  Synthetic Polynucleotide
taatacgactcactatagggttccgcgctcctcttcctcctcctcttctcaacagaggagagagaagatgaggaggaagaacctggcggcagcgcaaaagatg

SEQ ID NO: 119766 - DNA, 103 bp, Artificial Sequence
  Synthetic Polynucleotide
taatacgactcactataggggagacacctcttccgcgctcctcttcctccaacagaggagaggaggaatgggagcgcggaacctggcggcagcgcaaaagatg

SEQ ID NO: 119767 - DNA, 103 bp, Artificial Sequence
  Synthetic Polynucleotide
taatacgactcactataggggcctaatagggagacacctcttccgcgctcaacagaggagagagcgcatgagaggtgtcaacctggcggcagcgcaaaagatg

SEQ ID NO: 119768 - DNA, 103 bp, Artificial Sequence
  Synthetic Polynucleotide
taatacgactcactatagggtcttggggcggcctaatagggagacacctcaacagaggagagaggtgatgccctattagaacctggcggcagcgcaaaagatg

SEQ ID NO: 119769 - DNA, 103 bp, Artificial Sequence
  Synthetic Polynucleotide
taatacgactcactatagggacccttttcctcttggggcggcctaataggaacagaggagacctattatgccgccccaaaacctggcggcagcgcaaaagatg

SEQ ID NO: 119770 - DNA, 103 bp, Artificial Sequence
  Synthetic Polynucleotide
taatacgactcactataggggtaggtgatcacccttttcctcttggggcgaacagaggagacgccccatgaggaaaaggaacctggcggcagcgcaaaagatg

SEQ ID NO: 119771 - DNA, 103 bp, Artificial Sequence
  Synthetic Polynucleotide
taatacgactcactatagggggcgctgggcgtaggtgatcacccttttccaacagaggagaggaaaaatgtgatcacctaacctggcggcagcgcaaaagatg

SEQ ID NO: 119772 - DNA, 103 bp, Artificial Sequence
  Synthetic Polynucleotide
taatacgactcactatagggacgaagtccagcaccgtagtgtccacgcagaacagaggagactgcgtatgcactacggtaacctggcggcagcgcaaaagatg

SEQ ID NO: 119773 - DNA, 103 bp, Artificial Sequence
  Synthetic Polynucleotide
taatacgactcactatagggttggcggcctggcgctgggcgtaggtgatcaacagaggagagatcacatgcgcccagcgaacctggcggcagcgcaaaagatg

SEQ ID NO: 119774 - DNA, 103 bp, Artificial Sequence
  Synthetic Polynucleotide
taatacgactcactatagggttcgcggatgttggcggcctggcgctgggcaacagaggagagcccagatgcaggccgccaacctggcggcagcgcaaaagatg

SEQ ID NO: 119775 - DNA, 103 bp, Artificial Sequence
  Synthetic Polynucleotide
taatacgactcactatagggtccgcttcctttcgcggatgttggcggcctaacagaggagaaggccgatgacatccgcgaacctggcggcagcgcaaaagatg

SEQ ID NO: 119776 - DNA, 103 bp, Artificial Sequence
  Synthetic Polynucleotide
taatacgactcactatagggaggttgaacatccgcttcctttcgcggatgaacagaggagacatccgatgaaggaagcgaacctggcggcagcgcaaaagatg

SEQ ID NO: 119777 - DNA, 103 bp, Artificial Sequence
  Synthetic Polynucleotide
taatacgactcactatagggggcctcgttgaggttgaacatccgcttcctaacagaggagaaggaagatgatgttcaacaacctggcggcagcgcaaaagatg

SEQ ID NO: 119778 - DNA, 103 bp, Artificial Sequence
  Synthetic Polynucleotide
taatacgactcactataggggctggtcaaaggcctcgttgaggttgaacaaacagaggagatgttcaatgtcaacgaggaacctggcggcagcgcaaaagatg

SEQ ID NO: 119779 - DNA, 103 bp, Artificial Sequence
  Synthetic Polynucleotide
taatacgactcactatagggttcctccgcagctggtcaaaggcctcgttgaacagaggagacaacgaatgctttgaccaaacctggcggcagcgcaaaagatg

SEQ ID NO: 119780 - DNA, 103 bp, Artificial Sequence
  Synthetic Polynucleotide
taatacgactcactatagggcgtgggcaccttcctccgcagctggtcaaaaacagaggagatttgacatgctgcggaggaacctggcggcagcgcaaaagatg

SEQ ID NO: 119781 - DNA, 103 bp, Artificial Sequence
  Synthetic Polynucleotide
taatacgactcactatagggcgtaagcaaacgtgggcaccttcctccgcaaacagaggagatgcggaatgaggtgcccaaacctggcggcagcgcaaaagatg

SEQ ID NO: 119782 - DNA, 103 bp, Artificial Sequence
  Synthetic Polynucleotide
taatacgactcactatagggagccttttctcgtaagcaaacgtgggcaccaacagaggagaggtgccatggtttgcttaaacctggcggcagcgcaaaagatg

SEQ ID NO: 119783 - DNA, 103 bp, Artificial Sequence
  Synthetic Polynucleotide
taatacgactcactatagggcaggtctgcgacgaagtccagcaccgtagtaacagaggagaactacgatgctggacttcaacctggcggcagcgcaaaagatg

SEQ ID NO: 119784 - DNA, 103 bp, Artificial Sequence
  Synthetic Polynucleotide
taatacgactcactataggggatccgggacagccttttctcgtaagcaaaaacagaggagatttgctatggagaaaaggaacctggcggcagcgcaaaagatg

SEQ ID NO: 119785 - DNA, 103 bp, Artificial Sequence
  Synthetic Polynucleotide
taatacgactcactatagggggagggtctcgatccgggacagccttttctaacagaggagaagaaaaatgtgtcccggaaacctggcggcagcgcaaaagatg

SEQ ID NO: 119786 - DNA, 103 bp, Artificial Sequence
  Synthetic Polynucleotide
taatacgactcactatagggatggccaggcggagggtctcgatccgggacaacagaggagagtcccgatgcgagaccctaacctggcggcagcgcaaaagatg

SEQ ID NO: 119787 - DNA, 103 bp, Artificial Sequence
  Synthetic Polynucleotide
taatacgactcactataggggatatagacgatggccaggcggagggtctcaacagaggagagagaccatgcgcctggccaacctggcggcagcgcaaaagatg

SEQ ID NO: 119788 - DNA, 103 bp, Artificial Sequence
  Synthetic Polynucleotide
taatacgactcactatagggtcatgaaggagatatagacgatggccaggcaacagaggagagcctggatgtcgtctataaacctggcggcagcgcaaaagatg

SEQ ID NO: 119789 - DNA, 103 bp, Artificial Sequence
  Synthetic Polynucleotide
taatacgactcactatagggaagagctcggtcatgaaggagatatagacgaacagaggagacgtctaatgctccttcataacctggcggcagcgcaaaagatg

SEQ ID NO: 119790 - DNA, 103 bp, Artificial Sequence
  Synthetic Polynucleotide
taatacgactcactatagggacagctctccaagagctcggtcatgaaggaaacagaggagatccttcatgaccgagctcaacctggcggcagcgcaaaagatg

SEQ ID NO: 119791 - DNA, 103 bp, Artificial Sequence
  Synthetic Polynucleotide
taatacgactcactatagggccttcttctcacagctctccaagagctcggaacagaggagaccgagcatgtggagagctaacctggcggcagcgcaaaagatg

SEQ ID NO: 119792 - DNA, 103 bp, Artificial Sequence
  Synthetic Polynucleotide
taatacgactcactatagggcagccgctttccttcttctcacagctctccaacagaggagaggagagatgtgagaagaaaacctggcggcagcgcaaaagatg

SEQ ID NO: 119793 - DNA, 103 bp, Artificial Sequence
  Synthetic Polynucleotide
taatacgactcactatagggaggccagggacaggtctgcgacgaagtccaaacagaggagatggactatgtcgcagaccaacctggcggcagcgcaaaagatg

SEQ ID NO: 119794 - DNA, 103 bp, Artificial Sequence
  Synthetic Polynucleotide
taatacgactcactatagggcgtctcggggaggccagggacaggtctgcgaacagaggagacgcagaatggtccctggcaacctggcggcagcgcaaaagatg

SEQ ID NO: 119795 - DNA, 103 bp, Artificial Sequence
  Synthetic Polynucleotide
taatacgactcactataggggaggagagggcgtctcggggaggccagggaaacagaggagatccctgatgtccccgagaaacctggcggcagcgcaaaagatg

SEQ ID NO: 119796 - DNA, 103 bp, Artificial Sequence
  Synthetic Polynucleotide
taatacgactcactatagggcgaagtcgcagaggagagggcgtctcggggaacagaggagaccccgaatggccctctccaacctggcggcagcgcaaaagatg

SEQ ID NO: 119797 - DNA, 103 bp, Artificial Sequence
  Synthetic Polynucleotide
taatacgactcactatagggaccccgggtgcgaagtcgcagaggagagggaacagaggagaccctctatgctgcgacttaacctggcggcagcgcaaaagatg

SEQ ID NO: 119798 - DNA, 103 bp, Artificial Sequence
  Synthetic Polynucleotide
taatacgactcactatagggggtagtcgcgttgtggcagctactgtccataacagaggagaatggacatgagctgccacaacctggcggcagcgcaaaagatg

SEQ ID NO: 119799 - DNA, 103 bp, Artificial Sequence
  Synthetic Polynucleotide
taatacgactcactatagggggtgcgcgccatgattcgttcaatggagaaaacagaggagattctccatggaacgaatcaacctggcggcagcgcaaaagatg

SEQ ID NO: 119800 - DNA, 103 bp, Artificial Sequence
  Synthetic Polynucleotide
taatacgactcactataggggcccgcgtgtattcgggtatgagtgtttaaaacagaggagattaaacatgcatacccgaaacctggcggcagcgcaaaagatg

SEQ ID NO: 119801 - DNA, 103 bp, Artificial Sequence
  Synthetic Polynucleotide
taatacgactcactatagggacggtttgtagcccgcgtgtattcgggtataacagaggagaatacccatgtacacgcggaacctggcggcagcgcaaaagatg

SEQ ID NO: 119802 - DNA, 103 bp, Artificial Sequence
  Synthetic Polynucleotide
taatacgactcactatagggtcacacacaaacggtttgtagcccgcgtgtaacagaggagaacacgcatgctacaaaccaacctggcggcagcgcaaaagatg

SEQ ID NO: 119803 - DNA, 103 bp, Artificial Sequence
  Synthetic Polynucleotide
taatacgactcactataggggccacagaattcacacacaaacggtttgtaaacagaggagatacaaaatgtttgtgtgtaacctggcggcagcgcaaaagatg

SEQ ID NO: 119804 - DNA, 103 bp, Artificial Sequence
  Synthetic Polynucleotide
taatacgactcactataggggaaaccctttgccacagaattcacacacaaaacagaggagattgtgtatgaattctgtgaacctggcggcagcgcaaaagatg

SEQ ID NO: 119805 - DNA, 103 bp, Artificial Sequence
  Synthetic Polynucleotide
taatacgactcactatagggcctttttgatgaaaccctttgccacagaataacagaggagaattctgatgcaaagggttaacctggcggcagcgcaaaagatg

SEQ ID NO: 119806 - DNA, 103 bp, Artificial Sequence
  Synthetic Polynucleotide
taatacgactcactatagggtttgtaattccctttttgatgaaaccctttaacagaggagaaaagggatgcatcaaaaaaacctggcggcagcgcaaaagatg

SEQ ID NO: 119807 - DNA, 103 bp, Artificial Sequence
  Synthetic Polynucleotide
taatacgactcactatagggacttgtggtttttgtaattccctttttgataacagaggagaatcaaaatgggaattacaaacctggcggcagcgcaaaagatg

SEQ ID NO: 119808 - DNA, 103 bp, Artificial Sequence
  Synthetic Polynucleotide
taatacgactcactatagggctgtgggtcaacttgtggtttttgtaattcaacagaggagagaattaatgaaaccacaaaacctggcggcagcgcaaaagatg

SEQ ID NO: 119809 - DNA, 103 bp, Artificial Sequence
  Synthetic Polynucleotide
taatacgactcactatagggcttctccccgctgtgggtcaacttgtggttaacagaggagaaaccacatgttgacccacaacctggcggcagcgcaaaagatg

SEQ ID NO: 119810 - DNA, 103 bp, Artificial Sequence
  Synthetic Polynucleotide
taatacgactcactatagggtgggctctggggtgcgcgccatgattcgttaacagaggagaaacgaaatgtggcgcgcaaacctggcggcagcgcaaaagatg

SEQ ID NO: 119811 - DNA, 103 bp, Artificial Sequence
  Synthetic Polynucleotide
taatacgactcactatagggacttgaactgcttctccccgctgtgggtcaaacagaggagatgacccatggcggggagaaacctggcggcagcgcaaaagatg

SEQ ID NO: 119812 - DNA, 103 bp, Artificial Sequence
  Synthetic Polynucleotide
taatacgactcactatagggcagatattgcacttgaactgcttctccccgaacagaggagacggggaatggcagttcaaaacctggcggcagcgcaaaagatg

SEQ ID NO: 119813 - DNA, 103 bp, Artificial Sequence
  Synthetic Polynucleotide
taatacgactcactatagggagccttgttgcagatattgcacttgaactgaacagaggagacagttcatgtgcaatatcaacctggcggcagcgcaaaagatg

SEQ ID NO: 119814 - DNA, 103 bp, Artificial Sequence
  Synthetic Polynucleotide
taatacgactcactatagggcctggtggaaagccttgttgcagatattgcaacagaggagagcaataatggcaacaaggaacctggcggcagcgcaaaagatg

SEQ ID NO: 119815 - DNA, 103 bp, Artificial Sequence
  Synthetic Polynucleotide
taatacgactcactatagggaggttgtaaacctggtggaaagccttgttgaacagaggagacaacaaatgtttccaccaaacctggcggcagcgcaaaagatg

SEQ ID NO: 119816 - DNA, 103 bp, Artificial Sequence
  Synthetic Polynucleotide
taatacgactcactataggggtggaaggtgaggttgtaaacctggtggaaaacagaggagattccacatggtttacaacaacctggcggcagcgcaaaagatg

SEQ ID NO: 119817 - DNA, 103 bp, Artificial Sequence
  Synthetic Polynucleotide
taatacgactcactataggggggtgtgcatgtggaaggtgaggttgtaaaaacagaggagatttacaatgtcaccttccaacctggcggcagcgcaaaagatg

SEQ ID NO: 119818 - DNA, 103 bp, Artificial Sequence
  Synthetic Polynucleotide
taatacgactcactatagggttgtcgttgtgggtgtgcatgtggaaggtgaacagaggagacaccttatgcatgcacacaacctggcggcagcgcaaaagatg

SEQ ID NO: 119819 - DNA, 103 bp, Artificial Sequence
  Synthetic Polynucleotide
taatacgactcactataggggaaaggcttcttgtcgttgtgggtgtgcataacagaggagaatgcacatgcacaacgacaacctggcggcagcgcaaaagatg

SEQ ID NO: 119820 - DNA, 103 bp, Artificial Sequence
  Synthetic Polynucleotide
taatacgactcactatagggtggggcaggtgaaaggcttcttgtcgttgtaacagaggagaacaacgatgagaagccttaacctggcggcagcgcaaaagatg

SEQ ID NO: 119821 - DNA, 103 bp, Artificial Sequence
  Synthetic Polynucleotide
taatacgactcactatagggggcagggccttgggctctggggtgcgcgccaacagaggagaggcgcgatgcccagagccaacctggcggcagcgcaaaagatg

SEQ ID NO: 119822 - DNA, 103 bp, Artificial Sequence
  Synthetic Polynucleotide
taatacgactcactatagggttgccgcacgtggggcaggtgaaaggcttcaacagaggagagaagccatgcacctgcccaacctggcggcagcgcaaaagatg

SEQ ID NO: 119823 - DNA, 103 bp, Artificial Sequence
  Synthetic Polynucleotide
taatacgactcactataggggcagaaacccttgccgcacgtggggcaggtaacagaggagaacctgcatgacgtgcggcaacctggcggcagcgcaaaagatg

SEQ ID NO: 119824 - DNA, 103 bp, Artificial Sequence
  Synthetic Polynucleotide
taatacgactcactatagggcaaagttcctgcagaaacccttgccgcacgaacagaggagacgtgcgatgagggtttctaacctggcggcagcgcaaaagatg

SEQ ID NO: 119825 - DNA, 103 bp, Artificial Sequence
  Synthetic Polynucleotide
taatacgactcactatagggttcttgaggtcaaagttcctgcagaaacccaacagaggagagggtttatgcaggaacttaacctggcggcagcgcaaaagatg

SEQ ID NO: 119826 - DNA, 103 bp, Artificial Sequence
  Synthetic Polynucleotide
taatacgactcactataggggcggacatgcttcttgaggtcaaagttcctaacagaggagaaggaacatggacctcaagaacctggcggcagcgcaaaagatg

SEQ ID NO: 119827 - DNA, 103 bp, Artificial Sequence
  Synthetic Polynucleotide
taatacgactcactatagggcgtgcagcttgcggacatgcttcttgaggtaacagaggagaacctcaatgagcatgtccaacctggcggcagcgcaaaagatg

SEQ ID NO: 119828 - DNA, 103 bp, Artificial Sequence
  Synthetic Polynucleotide
taatacgactcactatagggaggctgctgtcgtgcagcttgcggacatgcaacagaggagagcatgtatgcaagctgcaaacctggcggcagcgcaaaagatg

SEQ ID NO: 119829 - DNA, 103 bp, Artificial Sequence
  Synthetic Polynucleotide
taatacgactcactatagggggccagccccaggctgctgtcgtgcagcttaacagaggagaaagctgatggacagcagcaacctggcggcagcgcaaaagatg

SEQ ID NO: 119830 - DNA, 103 bp, Artificial Sequence
  Synthetic Polynucleotide
taatacgactcactatagggctggcgtgcgggccagccccaggctgctgtaacagaggagaacagcaatgtggggctggaacctggcggcagcgcaaaagatg

SEQ ID NO: 119831 - DNA, 103 bp, Artificial Sequence
  Synthetic Polynucleotide
taatacgactcactatagggggttcgccagctggcgtgcgggccagccccaacagaggagaggggctatgccgcacgccaacctggcggcagcgcaaaagatg

SEQ ID NO: 119832 - DNA, 103 bp, Artificial Sequence
  Synthetic Polynucleotide
taatacgactcactataggggtgggggactggcagggccttgggctctggaacagaggagaccagagatgaaggccctgaacctggcggcagcgcaaaagatg

SEQ ID NO: 119833 - DNA, 103 bp, Artificial Sequence
  Synthetic Polynucleotide
taatacgactcactatagggttcagtgcctggttcgccagctggcgtgcgaacagaggagacgcacgatggctggcgaaaacctggcggcagcgcaaaagatg

SEQ ID NO: 119834 - DNA, 103 bp, Artificial Sequence
  Synthetic Polynucleotide
taatacgactcactatagggggggcggcggttcagtgcctggttcgccagaacagaggagactggcgatgcaggcactgaacctggcggcagcgcaaaagatg

SEQ ID NO: 119835 - DNA, 103 bp, Artificial Sequence
  Synthetic Polynucleotide
taatacgactcactatagggtgcggtagcgggggcggcggttcagtgcctaacagaggagaaggcacatgaccgccgccaacctggcggcagcgcaaaagatg

SEQ ID NO: 119836 - DNA, 103 bp, Artificial Sequence
  Synthetic Polynucleotide
taatacgactcactatagggcggcggctgctgcggtagcgggggcggcggaacagaggagaccgccgatgccgctaccgaacctggcggcagcgcaaaagatg

SEQ ID NO: 119837 - DNA, 103 bp, Artificial Sequence
  Synthetic Polynucleotide
taatacgactcactataggggcagcgtcatcggcggctgctgcggtagcgaacagaggagacgctacatgagcagccgcaacctggcggcagcgcaaaagatg

SEQ ID NO: 119838 - DNA, 103 bp, Artificial Sequence
  Synthetic Polynucleotide
taatacgactcactatagggtgcagaggaggcagcgtcatcggcggctgcaacagaggagagcagccatggatgacgctaacctggcggcagcgcaaaagatg

SEQ ID NO: 119839 - DNA, 103 bp, Artificial Sequence
  Synthetic Polynucleotide
taatacgactcactatagggcagcggcggctgcagaggaggcagcgtcataacagaggagaatgacgatgcctcctctgaacctggcggcagcgcaaaagatg

SEQ ID NO: 119840 - DNA, 103 bp, Artificial Sequence
  Synthetic Polynucleotide
taatacgactcactatagggccggggttggcagcggcggctgcagaggagaacagaggagactcctcatgagccgccgcaacctggcggcagcgcaaaagatg

SEQ ID NO: 119841 - DNA, 103 bp, Artificial Sequence
  Synthetic Polynucleotide
taatacgactcactatagggtgcaggggccccggggttggcagcggcggcaacagaggagagccgccatggccaaccccaacctggcggcagcgcaaaagatg

SEQ ID NO: 119842 - DNA, 103 bp, Artificial Sequence
  Synthetic Polynucleotide
taatacgactcactataggggagcccgggctgcaggggccccggggttggaacagaggagaccaaccatggggcccctgaacctggcggcagcgcaaaagatg

SEQ ID NO: 119843 - DNA, 103 bp, Artificial Sequence
  Synthetic Polynucleotide
taatacgactcactatagggcctgcaggaagtgggggactggcagggcctaacagaggagaaggcccatgcagtcccccaacctggcggcagcgcaaaagatg

SEQ ID NO: 119844 - DNA, 103 bp, Artificial Sequence
  Synthetic Polynucleotide
taatacgactcactatagggggccctggtggagcccgggctgcaggggccaacagaggagaggccccatgagcccgggcaacctggcggcagcgcaaaagatg

SEQ ID NO: 119845 - DNA, 103 bp, Artificial Sequence
  Synthetic Polynucleotide
taatacgactcactatagggggtaaggctccctgcaggaagtgggggactaacagaggagaagtcccatgcttcctgcaaacctggcggcagcgcaaaagatg

SEQ ID NO: 119846 - DNA, 103 bp, Artificial Sequence
  Synthetic Polynucleotide
taatacgactcactatagggttcccccttgggtaaggctccctgcaggaaaacagaggagattcctgatgggagccttaaacctggcggcagcgcaaaagatg

SEQ ID NO: 119847 - DNA, 103 bp, Artificial Sequence
  Synthetic Polynucleotide
taatacgactcactatagggagtgcttgggttcccccttgggtaaggctcaacagaggagagagcctatgccaagggggaacctggcggcagcgcaaaagatg

SEQ ID NO: 119848 - DNA, 103 bp, Artificial Sequence
  Synthetic Polynucleotide
taatacgactcactatagggagatgcagagagtgcttgggttcccccttgaacagaggagacaagggatgacccaagcaaacctggcggcagcgcaaaagatg

SEQ ID NO: 119849 - DNA, 103 bp, Artificial Sequence
  Synthetic Polynucleotide
taatacgactcactatagggcgacgagttgagatgcagagagtgcttgggaacagaggagacccaagatgtctctgcataacctggcggcagcgcaaaagatg

SEQ ID NO: 119850 - DNA, 103 bp, Artificial Sequence
  Synthetic Polynucleotide
taatacgactcactatagggctaacattttggtagtcgcgttgtggcagcaacagaggagagctgccatgacgcgactaaacctggcggcagcgcaaaagatg

SEQ ID NO: 119851 - DNA, 103 bp, Artificial Sequence
  Synthetic Polynucleotide
taatacgactcactatagggtgcaggggatcgacgagttgagatgcagagaacagaggagactctgcatgtcaactcgtaacctggcggcagcgcaaaagatg

SEQ ID NO: 119852 - DNA, 103 bp, Artificial Sequence
  Synthetic Polynucleotide
taatacgactcactatagggaaggggatcatgcaggggatcgacgagttgaacagaggagacaactcatggatcccctgaacctggcggcagcgcaaaagatg

SEQ ID NO: 119853 - DNA, 103 bp, Artificial Sequence
  Synthetic Polynucleotide
taatacgactcactatagggcacaggcacgaaggggatcatgcaggggataacagaggagaatccccatgatgatccccaacctggcggcagcgcaaaagatg

SEQ ID NO: 119854 - DNA, 103 bp, Artificial Sequence
  Synthetic Polynucleotide
taatacgactcactatagggtgtcgtaggccacaggcacgaaggggatcaaacagaggagatgatccatgtcgtgcctgaacctggcggcagcgcaaaagatg

SEQ ID NO: 119855 - DNA, 103 bp, Artificial Sequence
  Synthetic Polynucleotide
taatacgactcactatagggttggggctcgtgtcgtaggccacaggcacgaacagaggagacgtgccatgggcctacgaaacctggcggcagcgcaaaagatg

SEQ ID NO: 119856 - DNA, 103 bp, Artificial Sequence
  Synthetic Polynucleotide
taatacgactcactatagggcactcctgccttggggctcgtgtcgtaggcaacagaggagagcctacatgacgagccccaacctggcggcagcgcaaaagatg

SEQ ID NO: 119857 - DNA, 103 bp, Artificial Sequence
  Synthetic Polynucleotide
taatacgactcactatagggcggagcccgtcactcctgccttggggctcgaacagaggagacgagccatgaggcaggagaacctggcggcagcgcaaaagatg

SEQ ID NO: 119858 - DNA, 103 bp, Artificial Sequence
  Synthetic Polynucleotide
taatacgactcactatagggttccgcggctcggagcccgtcactcctgccaacagaggagaggcaggatggacgggctcaacctggcggcagcgcaaaagatg

SEQ ID NO: 119859 - DNA, 103 bp, Artificial Sequence
  Synthetic Polynucleotide
taatacgactcactatagggcagactggccttccgcggctcggagcccgtaacagaggagaacgggcatggagccgcggaacctggcggcagcgcaaaagatg

SEQ ID NO: 119860 - DNA, 103 bp, Artificial Sequence
  Synthetic Polynucleotide
taatacgactcactatagggccggggcctccagactggccttccgcggctaacagaggagaagccgcatgaggccagtcaacctggcggcagcgcaaaagatg

SEQ ID NO: 119861 - DNA, 103 bp, Artificial Sequence
  Synthetic Polynucleotide
taatacgactcactatagggggagcagtcgctaacattttggtagtcgcgaacagaggagacgcgacatgcaaaatgttaacctggcggcagcgcaaaagatg

SEQ ID NO: 119862 - DNA, 103 bp, Artificial Sequence
  Synthetic Polynucleotide
taatacgactcactataggggcgggcgccgccggggcctccagactggccaacagaggagaggccagatgggaggccccaacctggcggcagcgcaaaagatg

SEQ ID NO: 119863 - DNA, 103 bp, Artificial Sequence
  Synthetic Polynucleotide
taatacgactcactataggggggcaccgccgcgggcgccgccggggcctcaacagaggagagaggccatggcggcgcccaacctggcggcagcgcaaaagatg

SEQ ID NO: 119864 - DNA, 103 bp, Artificial Sequence
  Synthetic Polynucleotide
taatacgactcactatagggcgggagccgagggcaccgccgcgggcgccgaacagaggagacggcgcatgcggcggtgcaacctggcggcagcgcaaaagatg

SEQ ID NO: 119865 - DNA, 103 bp, Artificial Sequence
  Synthetic Polynucleotide
taatacgactcactatagggcagctgaatgcgggagccgagggcaccgccaacagaggagaggcggtatgctcggctccaacctggcggcagcgcaaaagatg

SEQ ID NO: 119866 - DNA, 103 bp, Artificial Sequence
  Synthetic Polynucleotide
taatacgactcactatagggcaggtcgctgcagctgaatgcgggagccgaaacagaggagatcggctatggcattcagcaacctggcggcagcgcaaaagatg

SEQ ID NO: 119867 - DNA, 103 bp, Artificial Sequence
  Synthetic Polynucleotide
taatacgactcactatagggcgcagttgagcaggtcgctgcagctgaatgaacagaggagacattcaatggcagcgaccaacctggcggcagcgcaaaagatg

SEQ ID NO: 119868 - DNA, 103 bp, Artificial Sequence
  Synthetic Polynucleotide
taatacgactcactatagggagactcagtgcgcagttgagcaggtcgctgaacagaggagacagcgaatggctcaactgaacctggcggcagcgcaaaagatg

SEQ ID NO: 119869 - DNA, 103 bp, Artificial Sequence
  Synthetic Polynucleotide
taatacgactcactataggggtcgcccttgagactcagtgcgcagttgagaacagaggagactcaacatggcactgagtaacctggcggcagcgcaaaagatg

SEQ ID NO: 119870 - DNA, 103 bp, Artificial Sequence
  Synthetic Polynucleotide
taatacgactcactatagggcgcgggccaggtcgcccttgagactcagtgaacagaggagacactgaatgtcaagggcgaacctggcggcagcgcaaaagatg

SEQ ID NO: 119871 - DNA, 103 bp, Artificial Sequence
  Synthetic Polynucleotide
taatacgactcactatagggggcagcgcgtcgcgggccaggtcgcccttgaacagaggagacaagggatgcctggcccgaacctggcggcagcgcaaaagatg

SEQ ID NO: 119872 - DNA, 103 bp, Artificial Sequence
  Synthetic Polynucleotide
taatacgactcactataggggccccgagctggagcagtcgctaacattttaacagaggagaaaaatgatggcgactgctaacctggcggcagcgcaaaagatg

SEQ ID NO: 119873 - DNA, 103 bp, Artificial Sequence
  Synthetic Polynucleotide
taatacgactcactatagggctgctgcagcggcagcgcgtcgcgggccagaacagaggagactggccatggacgcgctgaacctggcggcagcgcaaaagatg

SEQ ID NO: 119874 - DNA, 103 bp, Artificial Sequence
  Synthetic Polynucleotide
taatacgactcactatagggccagcttgtactgctgcagcggcagcgcgtaacagaggagaacgcgcatgcgctgcagcaacctggcggcagcgcaaaagatg

SEQ ID NO: 119875 - DNA, 103 bp, Artificial Sequence
  Synthetic Polynucleotide
taatacgactcactatagggcgcggccttaccagcttgtactgctgcagcaacagaggagagctgcaatggtacaagctaacctggcggcagcgcaaaagatg

SEQ ID NO: 119876 - DNA, 103 bp, Artificial Sequence
  Synthetic Polynucleotide
taatacgactcactataggggttgaccacacgcggccttaccagcttgtaaacagaggagatacaagatggtaaggccgaacctggcggcagcgcaaaagatg

SEQ ID NO: 119877 - DNA, 103 bp, Artificial Sequence
  Synthetic Polynucleotide
taatacgactcactatagggatgaagagtggttgaccacacgcggccttaaacagaggagataaggcatggtgtggtcaaacctggcggcagcgcaaaagatg

SEQ ID NO: 119878 - DNA, 103 bp, Artificial Sequence
  Synthetic Polynucleotide
taatacgactcactatagggatggcgtggaatgaagagtggttgaccacaaacagaggagatgtggtatgccactcttcaacctggcggcagcgcaaaagatg

SEQ ID NO: 119879 - DNA, 103 bp, Artificial Sequence
  Synthetic Polynucleotide
taatacgactcactatagggcaaggcgcccatggcgtggaatgaagagtgaacagaggagacactctatgttccacgccaacctggcggcagcgcaaaagatg

SEQ ID NO: 119880 - DNA, 103 bp, Artificial Sequence
  Synthetic Polynucleotide
taatacgactcactatagggtcaggtagcacaaggcgcccatggcgtggaaacagaggagatccacgatgtgggcgcctaacctggcggcagcgcaaaagatg

SEQ ID NO: 119881 - DNA, 103 bp, Artificial Sequence
  Synthetic Polynucleotide
taatacgactcactatagggtcacctcggttcaggtagcacaaggcgcccaacagaggagagggcgcatggtgctacctaacctggcggcagcgcaaaagatg

SEQ ID NO: 119882 - DNA, 103 bp, Artificial Sequence
  Synthetic Polynucleotide
taatacgactcactataggggcatgggccgtcacctcggttcaggtagcaaacagaggagatgctacatgaaccgaggtaacctggcggcagcgcaaaagatg

SEQ ID NO: 119883 - DNA, 103 bp, Artificial Sequence
  Synthetic Polynucleotide
taatacgactcactatagggtcatcatgttgccccgagctggagcagtcgaacagaggagacgactgatgcagctcgggaacctggcggcagcgcaaaagatg

SEQ ID NO: 119884 - DNA, 103 bp, Artificial Sequence
  Synthetic Polynucleotide
taatacgactcactatagggctgccgggtggcatgggccgtcacctcggtaacagaggagaaccgagatgacggcccataacctggcggcagcgcaaaagatg

SEQ ID NO: 119885 - DNA, 103 bp, Artificial Sequence
  Synthetic Polynucleotide
taatacgactcactatagggttcacgccggctgccgggtggcatgggccgaacagaggagacggcccatgccacccggcaacctggcggcagcgcaaaagatg

SEQ ID NO: 119886 - DNA, 103 bp, Artificial Sequence
  Synthetic Polynucleotide
taatacgactcactatagggcgggtggatgttcacgccggctgccgggtgaacagaggagacacccgatggccggcgtgaacctggcggcagcgcaaaagatg

SEQ ID NO: 119887 - DNA, 103 bp, Artificial Sequence
  Synthetic Polynucleotide
taatacgactcactatagggaggaggccaccgggtggatgttcacgccggaacagaggagaccggcgatgacatccaccaacctggcggcagcgcaaaagatg

SEQ ID NO: 119888 - DNA, 103 bp, Artificial Sequence
  Synthetic Polynucleotide
taatacgactcactatagggctgaggaagtaggaggccaccgggtggatgaacagaggagacatccaatgggtggcctcaacctggcggcagcgcaaaagatg

SEQ ID NO: 119889 - DNA, 103 bp, Artificial Sequence
  Synthetic Polynucleotide
taatacgactcactatagggcaaaggggaactgaggaagtaggaggccacaacagaggagagtggccatgtacttcctcaacctggcggcagcgcaaaagatg

SEQ ID NO: 119890 - DNA, 103 bp, Artificial Sequence
  Synthetic Polynucleotide
taatacgactcactataggggctgcgggtgcaaaggggaactgaggaagtaacagaggagaacttccatggttccccttaacctggcggcagcgcaaaagatg

SEQ ID NO: 119891 - DNA, 103 bp, Artificial Sequence
  Synthetic Polynucleotide
taatacgactcactatagggtacgtttttggctgcgggtgcaaaggggaaaacagaggagattccccatggcacccgcaaacctggcggcagcgcaaaagatg

SEQ ID NO: 119892 - DNA, 103 bp, Artificial Sequence
  Synthetic Polynucleotide
taatacgactcactatagggttcggctaaatacgtttttggctgcgggtgaacagaggagacacccgatgccaaaaacgaacctggcggcagcgcaaaagatg

SEQ ID NO: 119893 - DNA, 103 bp, Artificial Sequence
  Synthetic Polynucleotide
taatacgactcactataggggtttattcctttcggctaaatacgtttttgaacagaggagacaaaaaatgatttagccgaacctggcggcagcgcaaaagatg

SEQ ID NO: 119894 - DNA, 103 bp, Artificial Sequence
  Synthetic Polynucleotide
taatacgactcactatagggttggacgtgctcatcatgttgccccgagctaacagaggagaagctcgatgcaacatgataacctggcggcagcgcaaaagatg

SEQ ID NO: 119895 - DNA, 103 bp, Artificial Sequence
  Synthetic Polynucleotide
taatacgactcactataggggggaccaccagtttattcctttcggctaaaaacagaggagatttagcatgaaggaataaaacctggcggcagcgcaaaagatg

SEQ ID NO: 119896 - DNA, 103 bp, Artificial Sequence
  Synthetic Polynucleotide
taatacgactcactatagggctccaccgccgggaccaccagtttattcctaacagaggagaaggaatatgctggtggtcaacctggcggcagcgcaaaagatg

SEQ ID NO: 119897 - DNA, 103 bp, Artificial Sequence
  Synthetic Polynucleotide
taatacgactcactatagggaagggtatttctccaccgccgggaccaccaaacagaggagatggtggatgcggcggtggaacctggcggcagcgcaaaagatg

SEQ ID NO: 119898 - DNA, 103 bp, Artificial Sequence
  Synthetic Polynucleotide
taatacgactcactataggggctactccagaagggtatttctccaccgccaacagaggagaggcggtatggaaatacccaacctggcggcagcgcaaaagatg

SEQ ID NO: 119899 - DNA, 103 bp, Artificial Sequence
  Synthetic Polynucleotide
taatacgactcactataggggtctttgaaagctactccagaagggtatttaacagaggagaaaatacatgtctggagtaaacctggcggcagcgcaaaagatg

SEQ ID NO: 119900 - DNA, 103 bp, Artificial Sequence
  Synthetic Polynucleotide
taatacgactcactatagggcctgggacaggtctttgaaagctactccagaacagaggagactggagatgctttcaaagaacctggcggcagcgcaaaagatg

SEQ ID NO: 119901 - DNA, 103 bp, Artificial Sequence
  Synthetic Polynucleotide
taatacgactcactatagggtgcagctgagcctgggacaggtctttgaaaaacagaggagatttcaaatgcctgtcccaaacctggcggcagcgcaaaagatg

SEQ ID NO: 119902 - DNA, 103 bp, Artificial Sequence
  Synthetic Polynucleotide
taatacgactcactatagggcatgtaatgctgcagctgagcctgggacagaacagaggagactgtccatggctcagctgaacctggcggcagcgcaaaagatg

SEQ ID NO: 119903 - DNA, 103 bp, Artificial Sequence
  Synthetic Polynucleotide
taatacgactcactatagggcgctttctttcatgtaatgctgcagctgagaacagaggagactcagcatgagcattacaaacctggcggcagcgcaaaagatg

SEQ ID NO: 119904 - DNA, 103 bp, Artificial Sequence
  Synthetic Polynucleotide
taatacgactcactatagggagaagctgggcgctttctttcatgtaatgcaacagaggagagcattaatggaaagaaagaacctggcggcagcgcaaaagatg

SEQ ID NO: 119905 - DNA, 103 bp, Artificial Sequence
  Synthetic Polynucleotide
taatacgactcactatagggagccaagggtttggacgtgctcatcatgttaacagaggagaaacatgatgagcacgtccaacctggcggcagcgcaaaagatg

SEQ ID NO: 119906 - DNA, 103 bp, Artificial Sequence
  Synthetic Polynucleotide
taatacgactcactatagggtttttccgacagaagctgggcgctttctttaacagaggagaaaagaaatggcccagcttaacctggcggcagcgcaaaagatg

SEQ ID NO: 119907 - DNA, 103 bp, Artificial Sequence
  Synthetic Polynucleotide
taatacgactcactatagggtgaacgcgattttttccgacagaagctgggaacagaggagacccagcatgtgtcggaaaaacctggcggcagcgcaaaagatg

SEQ ID NO: 119908 - DNA, 103 bp, Artificial Sequence
  Synthetic Polynucleotide
taatacgactcactatagggtccgaggttttgaacgcgattttttccgacaacagaggagagtcggaatgaatcgcgttaacctggcggcagcgcaaaagatg

SEQ ID NO: 119909 - DNA, 103 bp, Artificial Sequence
  Synthetic Polynucleotide
taatacgactcactatagggtcggctgaaatccgaggttttgaacgcgataacagaggagaatcgcgatgaaaacctcgaacctggcggcagcgcaaaagatg

SEQ ID NO: 119910 - DNA, 103 bp, Artificial Sequence
  Synthetic Polynucleotide
taatacgactcactatagggtaggagagcctcggctgaaatccgaggtttaacagaggagaaaacctatgatttcagccaacctggcggcagcgcaaaagatg

SEQ ID NO: 119911 - DNA, 103 bp, Artificial Sequence
  Synthetic Polynucleotide
taatacgactcactatagggggcttggcattaggagagcctcggctgaaaaacagaggagatttcagatgaggctctccaacctggcggcagcgcaaaagatg

SEQ ID NO: 119912 - DNA, 103 bp, Artificial Sequence
  Synthetic Polynucleotide
taatacgactcactataggggaaaactttgggcttggcattaggagagccaacagaggagaggctctatgaatgccaagaacctggcggcagcgcaaaagatg

SEQ ID NO: 119913 - DNA, 103 bp, Artificial Sequence
  Synthetic Polynucleotide
taatacgactcactatagggcttcgcaagtgaaaactttgggcttggcataacagaggagaatgccaatgccaaagtttaacctggcggcagcgcaaaagatg

SEQ ID NO: 119914 - DNA, 103 bp, Artificial Sequence
  Synthetic Polynucleotide
taatacgactcactatagggtttccacacacttcgcaagtgaaaactttgaacagaggagacaaagtatgcacttgcgaaacctggcggcagcgcaaaagatg

SEQ ID NO: 119915 - DNA, 103 bp, Artificial Sequence
  Synthetic Polynucleotide
taatacgactcactatagggattaaagacctttccacacacttcgcaagtaacagaggagaacttgcatggtgtgtggaaacctggcggcagcgcaaaagatg

SEQ ID NO: 119916 - DNA, 103 bp, Artificial Sequence
  Synthetic Polynucleotide
taatacgactcactatagggcaatggagaaagccaagggtttggacgtgcaacagaggagagcacgtatgaacccttggaacctggcggcagcgcaaaagatg

SEQ ID NO: 119917 - DNA, 103 bp, Artificial Sequence
  Synthetic Polynucleotide
taatacgactcactatagggtatagtgcgcattaaagacctttccacacaaacagaggagatgtgtgatgaggtctttaaacctggcggcagcgcaaaagatg

SEQ ID NO: 119918 - DNA, 103 bp, Artificial Sequence
  Synthetic Polynucleotide
taatacgactcactatagggcgggttaagttatagtgcgcattaaagaccaacagaggagaggtcttatgtgcgcactaaacctggcggcagcgcaaaagatg

SEQ ID NO: 119919 - DNA, 103 bp, Artificial Sequence
  Synthetic Polynucleotide
taatacgactcactatagggtggcatgtgacgggttaagttatagtgcgcaacagaggagagcgcacatgaacttaaccaacctggcggcagcgcaaaagatg

SEQ ID NO: 119920 - DNA, 103 bp, Artificial Sequence
  Synthetic Polynucleotide
taatacgactcactatagggctgtgtgcactggcatgtgacgggttaagtaacagaggagaacttaaatggtcacatgcaacctggcggcagcgcaaaagatg

SEQ ID NO: 119921 - DNA, 103 bp, Artificial Sequence
  Synthetic Polynucleotide
taatacgactcactatagggggtctggctcctgtgtgcactggcatgtgaaacagaggagatcacatatgagtgcacacaacctggcggcagcgcaaaagatg

SEQ ID NO: 119922 - DNA, 103 bp, Artificial Sequence
  Synthetic Polynucleotide
taatacgactcactataggggcaaacgaagggtctggctcctgtgtgcacaacagaggagagtgcacatgggagccagaaacctggcggcagcgcaaaagatg

SEQ ID NO: 119923 - DNA, 103 bp, Artificial Sequence
  Synthetic Polynucleotide
taatacgactcactatagggcgcacactttgcaaacgaagggtctggctcaacagaggagagagccaatgccttcgtttaacctggcggcagcgcaaaagatg

SEQ ID NO: 119924 - DNA, 103 bp, Artificial Sequence
  Synthetic Polynucleotide
taatacgactcactatagggaaaccttttccgcacactttgcaaacgaagaacagaggagacttcgtatgcaaagtgtgaacctggcggcagcgcaaaagatg

SEQ ID NO: 119925 - DNA, 103 bp, Artificial Sequence
  Synthetic Polynucleotide
taatacgactcactatagggtgcttgcctgaaaccttttccgcacactttaacagaggagaaaagtgatgggaaaaggtaacctggcggcagcgcaaaagatg

SEQ ID NO: 119926 - DNA, 103 bp, Artificial Sequence
  Synthetic Polynucleotide
taatacgactcactatagggacagggtgcttgcttgcctgaaaccttttcaacagaggagagaaaagatgtcaggcaagaacctggcggcagcgcaaaagatg

SEQ ID NO: 119927 - DNA, 103 bp, Artificial Sequence
  Synthetic Polynucleotide
taatacgactcactatagggatgattcgttcaatggagaaagccaagggtaacagaggagaacccttatgtttctccataacctggcggcagcgcaaaagatg

SEQ ID NO: 119928 - DNA, 103 bp, Artificial Sequence
  Synthetic Polynucleotide
taatacgactcactatagggttgtgcctgcacagggtgcttgcttgcctgaacagaggagacaggcaatgaagcaccctaacctggcggcagcgcaaaagatg

SEQ ID NO: 119929 - DNA, 103 bp, Artificial Sequence
  Synthetic Polynucleotide
taatacgactcactataggggtgaatgatcttgtgcctgcacagggtgctaacagaggagaagcaccatgtgcaggcacaacctggcggcagcgcaaaagatg

SEQ ID NO: 119930 - DNA, 103 bp, Artificial Sequence
  Synthetic Polynucleotide
taatacgactcactatagggtttcctgcgtgtgaatgatcttgtgcctgcaacagaggagagcaggcatgagatcattcaacctggcggcagcgcaaaagatg

SEQ ID NO: 119931 - DNA, 103 bp, Artificial Sequence
  Synthetic Polynucleotide
taatacgactcactatagggttgtgaggtttttcctgcgtgtgaatgatcaacagaggagagatcatatgcacgcaggaaacctggcggcagcgcaaaagatg

SEQ ID NO: 119932 - DNA, 103 bp, Artificial Sequence
  Synthetic Polynucleotide
taatacgactcactatagggctggttacatttgtgaggtttttcctgcgtaacagaggagaacgcagatgaaacctcacaacctggcggcagcgcaaaagatg

SEQ ID NO: 119933 - DNA, 103 bp, Artificial Sequence
  Synthetic Polynucleotide
taatacgactcactatagggctttgccacactggttacatttgtgaggttaacagaggagaaacctcatgaatgtaaccaacctggcggcagcgcaaaagatg

SEQ ID NO: 119934 - DNA, 103 bp, Artificial Sequence
  Synthetic Polynucleotide
taatacgactcactatagggctattaaatgctttgccacactggttacataacagaggagaatgtaaatggtgtggcaaaacctggcggcagcgcaaaagatg

SEQ ID NO: 119935 - DNA, 103 bp, Artificial Sequence
  Synthetic Polynucleotide
taatacgactcactatagggagtggaacttctattaaatgctttgccacaaacagaggagatgtggcatggcatttaataacctggcggcagcgcaaaagatg

SEQ ID NO: 119936 - DNA, 103 bp, Artificial Sequence
  Synthetic Polynucleotide
taatacgactcactataggggagtgtttaaagtggaacttctattaaatgaacagaggagacatttaatggaagttccaaacctggcggcagcgcaaaagatg

SEQ ID NO: 119937 - DNA, 103 bp, Artificial Sequence
  Synthetic Polynucleotide
taatacgactcactatagggattcgggtatgagtgtttaaagtggaacttaacagaggagaaagttcatgtttaaacacaacctggcggcagcgcaaaagatg

SEQ ID NO: 119938 - DNA, 103 bp, Artificial Sequence
  Synthetic Polynucleotide
taatacgactcactatagggcatggtctccagggaagccgagcttgccataacagaggagaatggcaatgtcggcttccaacctggcggcagcgcaaaagatg

SEQ ID NO: 119939 - DNA, 103 bp, Artificial Sequence
  Synthetic Polynucleotide
taatacgactcactatagggcgacgtcttggccatgatgcgctcgatggaaacagaggagatccatcatgcgcatcatgaacctggcggcagcgcaaaagatg

SEQ ID NO: 119940 - DNA, 103 bp, Artificial Sequence
  Synthetic Polynucleotide
taatacgactcactatagggtttgccgcactggttgcatttatgtggcttaacagaggagaaagccaatgaaatgcaacaacctggcggcagcgcaaaagatg

SEQ ID NO: 119941 - DNA, 103 bp, Artificial Sequence
  Synthetic Polynucleotide
taatacgactcactatagggggttgaacgctttgccgcactggttgcattaacagaggagaaatgcaatgagtgcggcaaacctggcggcagcgcaaaagatg

SEQ ID NO: 119942 - DNA, 103 bp, Artificial Sequence
  Synthetic Polynucleotide
taatacgactcactataggggtggagctgcggttgaacgctttgccgcacaacagaggagagtgcggatgagcgttcaaaacctggcggcagcgcaaaagatg

SEQ ID NO: 119943 - DNA, 103 bp, Artificial Sequence
  Synthetic Polynucleotide
taatacgactcactatagggcgtgttgagcgtggagctgcggttgaacgcaacagaggagagcgttcatgcgcagctccaacctggcggcagcgcaaaagatg

SEQ ID NO: 119944 - DNA, 103 bp, Artificial Sequence
  Synthetic Polynucleotide
taatacgactcactatagggtgcggatatgcgtgttgagcgtggagctgcaacagaggagagcagctatgcgctcaacaaacctggcggcagcgcaaaagatg

SEQ ID NO: 119945 - DNA, 103 bp, Artificial Sequence
  Synthetic Polynucleotide
taatacgactcactatagggcccgcgtggatgcggatatgcgtgttgagcaacagaggagagctcaaatggcatatccgaacctggcggcagcgcaaaagatg

SEQ ID NO: 119946 - DNA, 103 bp, Artificial Sequence
  Synthetic Polynucleotide
taatacgactcactataggggggcttgtagcccgcgtggatgcggatatgaacagaggagacatatcatgatccacgcgaacctggcggcagcgcaaaagatg

SEQ ID NO: 119947 - DNA, 103 bp, Artificial Sequence
  Synthetic Polynucleotide
taatacgactcactatagggcgcagacgaagggcttgtagcccgcgtggaaacagaggagatccacgatggctacaagcaacctggcggcagcgcaaaagatg

SEQ ID NO: 119948 - DNA, 103 bp, Artificial Sequence
  Synthetic Polynucleotide
taatacgactcactatagggccgcaaaattcgcagacgaagggcttgtagaacagaggagactacaaatgcttcgtctgaacctggcggcagcgcaaaagatg

SEQ ID NO: 119949 - DNA, 103 bp, Artificial Sequence
  Synthetic Polynucleotide
taatacgactcactatagggaaagcctttgccgcaaaattcgcagacgaaaacagaggagattcgtcatggaattttgcaacctggcggcagcgcaaaagatg

SEQ ID NO: 119950 - DNA, 103 bp, Artificial Sequence
  Synthetic Polynucleotide
taatacgactcactatagggcacggggctccgacgtcttggccatgatgcaacagaggagagcatcaatgccaagacgtaacctggcggcagcgcaaaagatg

SEQ ID NO: 119951 - DNA, 103 bp, Artificial Sequence
  Synthetic Polynucleotide
taatacgactcactatagggctttttggtgaaagcctttgccgcaaaattaacagaggagaaattttatggcaaaggctaacctggcggcagcgcaaaagatg

SEQ ID NO: 119952 - DNA, 103 bp, Artificial Sequence
  Synthetic Polynucleotide
taatacgactcactatagggttgtagttccctttttggtgaaagcctttgaacagaggagacaaaggatgtcaccaaaaaacctggcggcagcgcaaaagatg

SEQ ID NO: 119953 - DNA, 103 bp, Artificial Sequence
  Synthetic Polynucleotide
taatacgactcactatagggcttgtggttcttgtagttccctttttggtgaacagaggagacaccaaatggggaactacaacctggcggcagcgcaaaagatg

SEQ ID NO: 119954 - DNA, 103 bp, Artificial Sequence
  Synthetic Polynucleotide
taatacgactcactatagggtgtgggtcagcttgtggttcttgtagttccaacagaggagaggaactatgagaaccacaaacctggcggcagcgcaaaagatg

SEQ ID NO: 119955 - DNA, 103 bp, Artificial Sequence
  Synthetic Polynucleotide
taatacgactcactatagggttctcgccgctgtgggtcagcttgtggttcaacagaggagagaaccaatggctgacccaaacctggcggcagcgcaaaagatg

SEQ ID NO: 119956 - DNA, 103 bp, Artificial Sequence
  Synthetic Polynucleotide
taatacgactcactatagggtttgtactgcttctcgccgctgtgggtcagaacagaggagactgaccatgagcggcgagaacctggcggcagcgcaaaagatg

SEQ ID NO: 119957 - DNA, 103 bp, Artificial Sequence
  Synthetic Polynucleotide
taatacgactcactatagggagatggtacatttgtactgcttctcgccgcaacagaggagagcggcgatgagcagtacaaacctggcggcagcgcaaaagatg

SEQ ID NO: 119958 - DNA, 103 bp, Artificial Sequence
  Synthetic Polynucleotide
taatacgactcactataggggccttgttgcagatggtacatttgtactgcaacagaggagagcagtaatgatgtaccataacctggcggcagcgcaaaagatg

SEQ ID NO: 119959 - DNA, 103 bp, Artificial Sequence
  Synthetic Polynucleotide
taatacgactcactatagggctggtggaaggccttgttgcagatggtacaaacagaggagatgtaccatgtgcaacaagaacctggcggcagcgcaaaagatg

SEQ ID NO: 119960 - DNA, 103 bp, Artificial Sequence
  Synthetic Polynucleotide
taatacgactcactatagggggttgtagacctggtggaaggccttgttgcaacagaggagagcaacaatgccttccaccaacctggcggcagcgcaaaagatg

SEQ ID NO: 119961 - DNA, 103 bp, Artificial Sequence
  Synthetic Polynucleotide
taatacgactcactatagggtcaaagggcgcacggggctccgacgtcttgaacagaggagacaagacatgggagccccgaacctggcggcagcgcaaaagatg

SEQ ID NO: 119962 - DNA, 103 bp, Artificial Sequence
  Synthetic Polynucleotide
taatacgactcactatagggtggaaggttaggttgtagacctggtggaagaacagaggagacttccaatgggtctacaaaacctggcggcagcgcaaaagatg

SEQ ID NO: 119963 - DNA, 103 bp, Artificial Sequence
  Synthetic Polynucleotide
taatacgactcactatagggggtgtgcatatggaaggttaggttgtagacaacagaggagagtctacatgctaaccttcaacctggcggcagcgcaaaagatg

SEQ ID NO: 119964 - DNA, 103 bp, Artificial Sequence
  Synthetic Polynucleotide
taatacgactcactatagggtgtcgttgtgggtgtgcatatggaaggttaaacagaggagataacctatgatatgcacaaacctggcggcagcgcaaaagatg

SEQ ID NO: 119965 - DNA, 103 bp, Artificial Sequence
  Synthetic Polynucleotide
taatacgactcactatagggaaaggcttcttgtcgttgtgggtgtgcataaacagaggagatatgcaatgccacaacgaaacctggcggcagcgcaaaagatg

SEQ ID NO: 119966 - DNA, 103 bp, Artificial Sequence
  Synthetic Polynucleotide
taatacgactcactatagggggcgcacgtgaaaggcttcttgtcgttgtgaacagaggagacacaacatgaagaagcctaacctggcggcagcgcaaaagatg

SEQ ID NO: 119967 - DNA, 103 bp, Artificial Sequence
  Synthetic Polynucleotide
taatacgactcactatagggtgccgcaagtggcgcacgtgaaaggcttctaacagaggagaagaagcatgtcacgtgcgaacctggcggcagcgcaaaagatg

SEQ ID NO: 119968 - DNA, 103 bp, Artificial Sequence
  Synthetic Polynucleotide
taatacgactcactatagggcaaaaccctttgccgcaagtggcgcacgtgaacagaggagacacgtgatgcacttgcggaacctggcggcagcgcaaaagatg

SEQ ID NO: 119969 - DNA, 103 bp, Artificial Sequence
  Synthetic Polynucleotide
taatacgactcactatagggaaagtttctgcaaaaccctttgccgcaagtaacagaggagaacttgcatgaaagggtttaacctggcggcagcgcaaaagatg

SEQ ID NO: 119970 - DNA, 103 bp, Artificial Sequence
  Synthetic Polynucleotide
taatacgactcactatagggtctttaagtcaaagtttctgcaaaacccttaacagaggagaaagggtatggcagaaactaacctggcggcagcgcaaaagatg

SEQ ID NO: 119971 - DNA, 103 bp, Artificial Sequence
  Synthetic Polynucleotide
taatacgactcactatagggcgcacatgtttctttaagtcaaagtttctgaacagaggagacagaaaatgtgacttaaaaacctggcggcagcgcaaaagatg

SEQ ID NO: 119972 - DNA, 103 bp, Artificial Sequence
  Synthetic Polynucleotide
taatacgactcactatagggaggccggggctcaaagggcgcacggggctcaacagaggagagagcccatggcgccctttaacctggcggcagcgcaaaagatg

SEQ ID NO: 119973 - DNA, 103 bp, Artificial Sequence
  Synthetic Polynucleotide
taatacgactcactataggggtggagtttgcgcacatgtttctttaagtcaacagaggagagacttaatgaaacatgtgaacctggcggcagcgcaaaagatg

SEQ ID NO: 119974 - DNA, 103 bp, Artificial Sequence
  Synthetic Polynucleotide
taatacgactcactatagggccacgctgtcgtggagtttgcgcacatgttaacagaggagaaacatgatggcaaactccaacctggcggcagcgcaaaagatg

SEQ ID NO: 119975 - DNA, 103 bp, Artificial Sequence
  Synthetic Polynucleotide
taatacgactcactataggggcagcagggcccacgctgtcgtggagtttgaacagaggagacaaactatgcgacagcgtaacctggcggcagcgcaaaagatg

SEQ ID NO: 119976 - DNA, 103 bp, Artificial Sequence
  Synthetic Polynucleotide
taatacgactcactatagggtgcggagggggcagcagggcccacgctgtcaacagaggagagacagcatgggccctgctaacctggcggcagcgcaaaagatg

SEQ ID NO: 119977 - DNA, 103 bp, Artificial Sequence
  Synthetic Polynucleotide
taatacgactcactatagggtcaggtcctttgcggagggggcagcagggcaacagaggagagccctgatgccccctccgaacctggcggcagcgcaaaagatg

SEQ ID NO: 119978 - DNA, 103 bp, Artificial Sequence
  Synthetic Polynucleotide
taatacgactcactatagggactgtcctagtcaggtcctttgcggaggggaacagaggagacccctcatgaaaggacctaacctggcggcagcgcaaaagatg

SEQ ID NO: 119979 - DNA, 103 bp, Artificial Sequence
  Synthetic Polynucleotide
taatacgactcactatagggtcagctctgcactgtcctagtcaggtccttaacagaggagaaaggacatgactaggacaaacctggcggcagcgcaaaagatg

SEQ ID NO: 119980 - DNA, 103 bp, Artificial Sequence
  Synthetic Polynucleotide
taatacgactcactatagggctagcgctccaggccggggctcaaagggcgaacagaggagacgccctatgagccccggcaacctggcggcagcgcaaaagatg

SEQ ID NO: 119981 - DNA, 103 bp, Artificial Sequence
  Synthetic Polynucleotide
taatacgactcactatagggccgtccgcctctagcgctccaggccggggcaacagaggagagccccgatgtggagcgctaacctggcggcagcgcaaaagatg

SEQ ID NO: 119982 - DNA, 103 bp, Artificial Sequence
  Synthetic Polynucleotide
taatacgactcactataggggccctggctgccgtccgcctctagcgctccaacagaggagaggagcgatggaggcggacaacctggcggcagcgcaaaagatg

SEQ ID NO: 119983 - DNA, 103 bp, Artificial Sequence
  Synthetic Polynucleotide
taatacgactcactataggggcagtttcttgccctggctgccgtccgcctaacagaggagaaggcggatggcagccaggaacctggcggcagcgcaaaagatg

SEQ ID NO: 119984 - DNA, 103 bp, Artificial Sequence
  Synthetic Polynucleotide
taatacgactcactatagggcagaggttgagcagtttcttgccctggctgaacagaggagacagccaatgcaagaaactaacctggcggcagcgcaaaagatg

SEQ ID NO: 119985 - DNA, 103 bp, Artificial Sequence
  Synthetic Polynucleotide
taatacgactcactatagggcagcggcgagcagaggttgagcagtttcttaacagaggagaaagaaaatgctcaacctcaacctggcggcagcgcaaaagatg

SEQ ID NO: 119986 - DNA, 103 bp, Artificial Sequence
  Synthetic Polynucleotide
taatacgactcactatagggccgggggcaccatggtctccagggaagccgaacagaggagacggcttatgtggagaccaaacctggcggcagcgcaaaagatg

SEQ ID NO: 119987 - DNA, 103 bp, Artificial Sequence
  Synthetic Polynucleotide
taatacgactcactatagggtcatacagggcagcggcgagcagaggttgaaacagaggagatcaaccatggctcgccgcaacctggcggcagcgcaaaagatg

SEQ ID NO: 119988 - DNA, 103 bp, Artificial Sequence
  Synthetic Polynucleotide
taatacgactcactatagggtggagggggatcatacagggcagcggcgagaacagaggagactcgccatggccctgtataacctggcggcagcgcaaaagatg

SEQ ID NO: 119989 - DNA, 103 bp, Artificial Sequence
  Synthetic Polynucleotide
taatacgactcactataggggcctaggggctggagggggatcatacagggaacagaggagaccctgtatgatccccctcaacctggcggcagcgcaaaagatg

SEQ ID NO: 119990 - DNA, 103 bp, Artificial Sequence
  Synthetic Polynucleotide
taatacgactcactataggggcacctcgtagcctaggggctggagggggaaacagaggagatcccccatgagcccctagaacctggcggcagcgcaaaagatg

SEQ ID NO: 119991 - DNA, 103 bp, Artificial Sequence
  Synthetic Polynucleotide
taatacgactcactataggggtctttgacggcacctcgtagcctaggggcaacagaggagagcccctatgctacgaggtaacctggcggcagcgcaaaagatg

SEQ ID NO: 119992 - DNA, 103 bp, Artificial Sequence
  Synthetic Polynucleotide
taatacgactcactatagggactgagcagtgtctttgacggcacctcgtaaacagaggagatacgagatgccgtcaaagaacctggcggcagcgcaaaagatg

SEQ ID NO: 119993 - DNA, 103 bp, Artificial Sequence
  Synthetic Polynucleotide
taatacgactcactataggggctccgagtaactgagcagtgtctttgacgaacagaggagacgtcaaatgcactgctcaaacctggcggcagcgcaaaagatg

SEQ ID NO: 119994 - DNA, 103 bp, Artificial Sequence
  Synthetic Polynucleotide
taatacgactcactatagggcttttccagagctccgagtaactgagcagtaacagaggagaactgctatgttactcggaaacctggcggcagcgcaaaagatg

SEQ ID NO: 119995 - DNA, 103 bp, Artificial Sequence
  Synthetic Polynucleotide
taatacgactcactatagggccggaggctgcttttccagagctccgagtaaacagaggagatactcgatgctctggaaaaacctggcggcagcgcaaaagatg

SEQ ID NO: 119996 - DNA, 103 bp, Artificial Sequence
  Synthetic Polynucleotide
taatacgactcactatagggcgccgcccgcccggaggctgcttttccagaaacagaggagatctggaatggcagcctccaacctggcggcagcgcaaaagatg

SEQ ID NO: 119997 - DNA, 103 bp, Artificial Sequence
  Synthetic Polynucleotide
taatacgactcactatagggcgcgggcaggccgggggcaccatggtctccaacagaggagaggagacatgggtgcccccaacctggcggcagcgcaaaagatg

SEQ ID NO: 119998 - DNA, 103 bp, Artificial Sequence
  Synthetic Polynucleotide
taatacgactcactatagggccgcctccgccgccgcccgcccggaggctgaacagaggagacagcctatgggcgggcggaacctggcggcagcgcaaaagatg

SEQ ID NO: 119999 - DNA, 103 bp, Artificial Sequence
  Synthetic Polynucleotide
taatacgactcactatagggaccgccgccgccgcctccgccgccgcccgcaacagaggagagcgggcatgggcggaggcaacctggcggcagcgcaaaagatg

SEQ ID NO: 120000 - DNA, 103 bp, Artificial Sequence
  Synthetic Polynucleotide
taatacgactcactatagggcgccgccgccaccgccgccgccgcctccgcaacagaggagagcggagatggcggcggcgaacctggcggcagcgcaaaagatg

SEQ ID NO: 120001 - DNA, 103 bp, Artificial Sequence
  Synthetic Polynucleotide
taatacgactcactatagggcccccgccgccgccgccgccaccgccgccgaacagaggagacggcggatgtggcggcggaacctggcggcagcgcaaaagatg

SEQ ID NO: 120002 - DNA, 103 bp, Artificial Sequence
  Synthetic Polynucleotide
taatacgactcactatagggcactggggcccccccgccgccgccgccgccaacagaggagaggcggcatgggcggcgggaacctggcggcagcgcaaaagatg

SEQ ID NO: 120003 - DNA, 103 bp, Artificial Sequence
  Synthetic Polynucleotide
taatacgactcactatagggtggcgccgcacactggggcccccccgccgcaacagaggagagcggcgatggggccccagaacctggcggcagcgcaaaagatg

SEQ ID NO: 120004 - DNA, 103 bp, Artificial Sequence
  Synthetic Polynucleotide
taatacgactcactatagggcacaagccgctggcgccgcacactggggccaacagaggagaggccccatggtgcggcgcaacctggcggcagcgcaaaagatg

SEQ ID NO: 120005 - DNA, 103 bp, Artificial Sequence
  Synthetic Polynucleotide
taatacgactcactataggggttggttttgcacaagccgctggcgccgcaaacagaggagatgcggcatgagcggcttgaacctggcggcagcgcaaaagatg

SEQ ID NO: 120006 - DNA, 103 bp, Artificial Sequence
  Synthetic Polynucleotide
taatacgactcactatagggacacgccacagttggttttgcacaagccgcaacagaggagagcggctatggcaaaaccaaacctggcggcagcgcaaaagatg

SEQ ID NO: 120007 - DNA, 103 bp, Artificial Sequence
  Synthetic Polynucleotide
taatacgactcactataggggccttgcagcacacgccacagttggttttgaacagaggagacaaaacatgctgtggcgtaacctggcggcagcgcaaaagatg

SEQ ID NO: 120008 - DNA, 103 bp, Artificial Sequence
  Synthetic Polynucleotide
taatacgactcactatagggcgctccggcgcgcgggcaggccgggggcacaacagaggagagtgcccatggcctgcccgaacctggcggcagcgcaaaagatg

SEQ ID NO: 120009 - DNA, 103 bp, Artificial Sequence
  Synthetic Polynucleotide
taatacgactcactataggggcccagctcggccttgcagcacacgccacaaacagaggagatgtggcatgtgctgcaagaacctggcggcagcgcaaaagatg

SEQ ID NO: 120010 - DNA, 103 bp, Artificial Sequence
  Synthetic Polynucleotide
taatacgactcactatagggacggcgccaggcccagctcggccttgcagcaacagaggagagctgcaatgccgagctggaacctggcggcagcgcaaaagatg

SEQ ID NO: 120011 - DNA, 103 bp, Artificial Sequence
  Synthetic Polynucleotide
taatacgactcactatagggggcagcgcggacggcgccaggcccagctcgaacagaggagacgagctatgcctggcgccaacctggcggcagcgcaaaagatg

SEQ ID NO: 120012 - DNA, 103 bp, Artificial Sequence
  Synthetic Polynucleotide
taatacgactcactatagggcctgcccgcgggcagcgcggacggcgccagaacagaggagactggcgatgtccgcgctgaacctggcggcagcgcaaaagatg

SEQ ID NO: 120013 - DNA, 103 bp, Artificial Sequence
  Synthetic Polynucleotide
taatacgactcactataggggcttgatgaccctgcccgcgggcagcgcggaacagaggagaccgcgcatgccgcgggcaaacctggcggcagcgcaaaagatg

SEQ ID NO: 120014 - DNA, 103 bp, Artificial Sequence
  Synthetic Polynucleotide
taatacgactcactatagggatgacctgcggcttgatgaccctgcccgcgaacagaggagacgcgggatgggtcatcaaaacctggcggcagcgcaaaagatg

SEQ ID NO: 120015 - DNA, 103 bp, Artificial Sequence
  Synthetic Polynucleotide
taatacgactcactatagggagcctggttgatgacctgcggcttgatgacaacagaggagagtcatcatgccgcaggtcaacctggcggcagcgcaaaagatg

SEQ ID NO: 120016 - DNA, 103 bp, Artificial Sequence
  Synthetic Polynucleotide
taatacgactcactataggggcagccccacagcctggttgatgacctgcgaacagaggagacgcaggatgtcaaccaggaacctggcggcagcgcaaaagatg

SEQ ID NO: 120017 - DNA, 103 bp, Artificial Sequence
  Synthetic Polynucleotide
taatacgactcactatagggccgctggccggcagccccacagcctggttgaacagaggagacaaccaatgtgtggggctaacctggcggcagcgcaaaagatg

SEQ ID NO: 120018 - DNA, 103 bp, Artificial Sequence
  Synthetic Polynucleotide
taatacgactcactataggggtagagcgagccgctggccggcagccccacaacagaggagagtggggatgccggccagcaacctggcggcagcgcaaaagatg

SEQ ID NO: 120019 - DNA, 103 bp, Artificial Sequence
  Synthetic Polynucleotide
taatacgactcactatagggtggccggcgacgctccggcgcgcgggcaggaacagaggagacctgccatggcgccggagaacctggcggcagcgcaaaagatg

SEQ ID NO: 120020 - DNA, 103 bp, Artificial Sequence
  Synthetic Polynucleotide
taatacgactcactatagggagttgaagtagtagagcgagccgctggccgaacagaggagacggccaatggctcgctctaacctggcggcagcgcaaaagatg

SEQ ID NO: 120021 - DNA, 103 bp, Artificial Sequence
  Synthetic Polynucleotide
taatacgactcactataggggagtccaggtagttgaagtagtagagcgagaacagaggagactcgctatgctacttcaaaacctggcggcagcgcaaaagatg

SEQ ID NO: 120022 - DNA, 103 bp, Artificial Sequence
  Synthetic Polynucleotide
taatacgactcactataggggtacgcggtcgagtccaggtagttgaagtaaacagaggagatacttcatgtacctggacaacctggcggcagcgcaaaagatg

SEQ ID NO: 120023 - DNA, 103 bp, Artificial Sequence
  Synthetic Polynucleotide
taatacgactcactatagggcagacggcgggtacgcggtcgagtccaggtaacagaggagaacctggatgcgaccgcgtaacctggcggcagcgcaaaagatg

SEQ ID NO: 120024 - DNA, 103 bp, Artificial Sequence
  Synthetic Polynucleotide
taatacgactcactatagggctgaggagctcagacggcgggtacgcggtcaacagaggagagaccgcatgcccgccgtcaacctggcggcagcgcaaaagatg

SEQ ID NO: 120025 - DNA, 103 bp, Artificial Sequence
  Synthetic Polynucleotide
taatacgactcactataggggaggtggccgctgaggagctcagacggcggaacagaggagaccgccgatggagctcctcaacctggcggcagcgcaaaagatg

SEQ ID NO: 120026 - DNA, 103 bp, Artificial Sequence
  Synthetic Polynucleotide
taatacgactcactatagggcagacgggaagaggtggccgctgaggagctaacagaggagaagctccatggcggccaccaacctggcggcagcgcaaaagatg

SEQ ID NO: 120027 - DNA, 103 bp, Artificial Sequence
  Synthetic Polynucleotide
taatacgactcactatagggttgaggaggccagacgggaagaggtggccgaacagaggagacggccaatgcttcccgtcaacctggcggcagcgcaaaagatg

SEQ ID NO: 120028 - DNA, 103 bp, Artificial Sequence
  Synthetic Polynucleotide
taatacgactcactatagggggcctgcgcattgaggaggccagacgggaaaacagaggagattcccgatgggcctcctcaacctggcggcagcgcaaaagatg

SEQ ID NO: 120029 - DNA, 103 bp, Artificial Sequence
  Synthetic Polynucleotide
taatacgactcactataggggggcggcgggggcctgcgcattgaggaggcaacagaggagagcctccatgatgcgcaggaacctggcggcagcgcaaaagatg

SEQ ID NO: 120030 - DNA, 103 bp, Artificial Sequence
  Synthetic Polynucleotide
taatacgactcactataggggtcttggaagtggccggcgacgctccggcgaacagaggagacgccggatggtcgccggcaacctggcggcagcgcaaaagatg

SEQ ID NO: 120031 - DNA, 103 bp, Artificial Sequence
  Synthetic Polynucleotide
taatacgactcactatagggtgagcagccagggcggcgggggcctgcgcaaacagaggagatgcgcaatgccccgccgcaacctggcggcagcgcaaaagatg

SEQ ID NO: 120032 - DNA, 103 bp, Artificial Sequence
  Synthetic Polynucleotide
taatacgactcactataggggagcttggggtgagcagccagggcggcgggaacagaggagacccgccatgctggctgctaacctggcggcagcgcaaaagatg

SEQ ID NO: 120033 - DNA, 103 bp, Artificial Sequence
  Synthetic Polynucleotide
taatacgactcactatagggccagcagaaagagcttggggtgagcagccaaacagaggagatggctgatgaccccaagcaacctggcggcagcgcaaaagatg

SEQ ID NO: 120034 - DNA, 103 bp, Artificial Sequence
  Synthetic Polynucleotide
taatacgactcactatagggttggcgttctccagcagaaagagcttggggaacagaggagaccccaaatgctttctgctaacctggcggcagcgcaaaagatg

SEQ ID NO: 120035 - DNA, 103 bp, Artificial Sequence
  Synthetic Polynucleotide
taatacgactcactataggggccggccagcttggcgttctccagcagaaaaacagaggagatttctgatggagaacgccaacctggcggcagcgcaaaagatg

SEQ ID NO: 120036 - DNA, 103 bp, Artificial Sequence
  Synthetic Polynucleotide
taatacgactcactatagggccgcagccaggccggccagcttggcgttctaacagaggagaagaacgatgagctggccgaacctggcggcagcgcaaaagatg

SEQ ID NO: 120037 - DNA, 103 bp, Artificial Sequence
  Synthetic Polynucleotide
taatacgactcactataggggggaacttgtccgcagccaggccggccagcaacagaggagagctggcatgcctggctgcaacctggcggcagcgcaaaagatg

SEQ ID NO: 120038 - DNA, 103 bp, Artificial Sequence
  Synthetic Polynucleotide
taatacgactcactatagggagccgggtgggggaacttgtccgcagccagaacagaggagactggctatggacaagttcaacctggcggcagcgcaaaagatg

SEQ ID NO: 120039 - DNA, 103 bp, Artificial Sequence
  Synthetic Polynucleotide
taatacgactcactatagggggggatagggagccgggtgggggaacttgtaacagaggagaacaagtatgcccacccggaacctggcggcagcgcaaaagatg

SEQ ID NO: 120040 - DNA, 103 bp, Artificial Sequence
  Synthetic Polynucleotide
taatacgactcactatagggcgctccttatggggatagggagccgggtggaacagaggagaccacccatgtccctatccaacctggcggcagcgcaaaagatg

SEQ ID NO: 120041 - DNA, 103 bp, Artificial Sequence
  Synthetic Polynucleotide
taatacgactcactatagggaaaggccagtgtcttggaagtggccggcgaaacagaggagatcgccgatgacttccaagaacctggcggcagcgcaaaagatg

SEQ ID NO: 120042 - DNA, 103 bp, Artificial Sequence
  Synthetic Polynucleotide
taatacgactcactatagggcgccggcaagcgctccttatggggatagggaacagaggagaccctatatgcataaggagaacctggcggcagcgcaaaagatg

SEQ ID NO: 120043 - DNA, 103 bp, Artificial Sequence
  Synthetic Polynucleotide
taatacgactcactataggggctccagcggcgccggcaagcgctccttataacagaggagaataaggatggcttgccggaacctggcggcagcgcaaaagatg

SEQ ID NO: 120044 - DNA, 103 bp, Artificial Sequence
  Synthetic Polynucleotide
taatacgactcactatagggttcagtacctgctccagcggcgccggcaagaacagaggagacttgccatggccgctggaaacctggcggcagcgcaaaagatg

SEQ ID NO: 120045 - DNA, 103 bp, Artificial Sequence
  Synthetic Polynucleotide
taatacgactcactatagggcgagttttccttcagtacctgctccagcggaacagaggagaccgctgatgcaggtactgaacctggcggcagcgcaaaagatg

SEQ ID NO: 120046 - DNA, 103 bp, Artificial Sequence
  Synthetic Polynucleotide
taatacgactcactatagggcagtcagggccgagttttccttcagtacctaacagaggagaaggtacatgaggaaaactaacctggcggcagcgcaaaagatg

SEQ ID NO: 120047 - DNA, 103 bp, Artificial Sequence
  Synthetic Polynucleotide
taatacgactcactatagggccgcgctcggcagtcagggccgagttttccaacagaggagaggaaaaatgggccctgacaacctggcggcagcgcaaaagatg

SEQ ID NO: 120048 - DNA, 103 bp, Artificial Sequence
  Synthetic Polynucleotide
taatacgactcactatagggcttgacgcctccgcgctcggcagtcagggcaacagaggagagccctgatggccgagcgcaacctggcggcagcgcaaaagatg

SEQ ID NO: 120049 - DNA, 103 bp, Artificial Sequence
  Synthetic Polynucleotide
taatacgactcactatagggtgctgtggcccttgacgcctccgcgctcggaacagaggagaccgagcatggaggcgtcaaacctggcggcagcgcaaaagatg

SEQ ID NO: 120050 - DNA, 103 bp, Artificial Sequence
  Synthetic Polynucleotide
taatacgactcactatagggcctggcagcttgctgtggcccttgacgcctaacagaggagaaggcgtatggggccacagaacctggcggcagcgcaaaagatg

SEQ ID NO: 120051 - DNA, 103 bp, Artificial Sequence
  Synthetic Polynucleotide
taatacgactcactatagggtgcggagcctcctggcagcttgctgtggccaacagaggagaggccacatgaagctgccaaacctggcggcagcgcaaaagatg

SEQ ID NO: 120052 - DNA, 103 bp, Artificial Sequence
  Synthetic Polynucleotide
taatacgactcactataggggctcgatggaaaaggccagtgtcttggaagaacagaggagacttccaatgcactggcctaacctggcggcagcgcaaaagatg

SEQ ID NO: 120053 - DNA, 103 bp, Artificial Sequence
  Synthetic Polynucleotide
taatacgactcactataggggcttgccatctgcggagcctcctggcagctaacagaggagaagctgcatggaggctccgaacctggcggcagcgcaaaagatg

SEQ ID NO: 120054 - DNA, 103 bp, Artificial Sequence
  Synthetic Polynucleotide
taatacgactcactatagggaagtttttgggcttgccatctgcggagcctaacagaggagaaggctcatgagatggcaaaacctggcggcagcgcaaaagatg

SEQ ID NO: 120055 - DNA, 103 bp, Artificial Sequence
  Synthetic Polynucleotide
taatacgactcactatagggctcgcaggtgaagtttttgggcttgccatcaacagaggagagatggcatgcccaaaaacaacctggcggcagcgcaaaagatg

SEQ ID NO: 120056 - DNA, 103 bp, Artificial Sequence
  Synthetic Polynucleotide
taatacgactcactatagggtgccgcacacctcgcaggtgaagtttttggaacagaggagaccaaaaatgtcacctgcgaacctggcggcagcgcaaaagatg

SEQ ID NO: 120057 - DNA, 103 bp, Artificial Sequence
  Synthetic Polynucleotide
taatacgactcactatagggttaaacaccttgccgcacacctcgcaggtgaacagaggagacacctgatgggtgtgcggaacctggcggcagcgcaaaagatg

SEQ ID NO: 120058 - DNA, 103 bp, Artificial Sequence
  Synthetic Polynucleotide
taatacgactcactatagggatagtgagcgttaaacaccttgccgcacacaacagaggagagtgtgcatgaaggtgtttaacctggcggcagcgcaaaagatg

SEQ ID NO: 120059 - DNA, 103 bp, Artificial Sequence
  Synthetic Polynucleotide
taatacgactcactataggggggtgagattatagtgagcgttaaacacctaacagaggagaaggtgtatgacgctcactaacctggcggcagcgcaaaagatg

SEQ ID NO: 120060 - DNA, 103 bp, Artificial Sequence
  Synthetic Polynucleotide
taatacgactcactatagggggcatgtggcgggtgagattatagtgagcgaacagaggagacgctcaatgtaatctcacaacctggcggcagcgcaaaagatg

SEQ ID NO: 120061 - DNA, 103 bp, Artificial Sequence
  Synthetic Polynucleotide
taatacgactcactatagggggtgtggaccggcatgtggcgggtgagattaacagaggagaaatctcatgcgccacatgaacctggcggcagcgcaaaagatg

SEQ ID NO: 120062 - DNA, 103 bp, Artificial Sequence
  Synthetic Polynucleotide
taatacgactcactataggggtctggctccggtgtggaccggcatgtggcaacagaggagagccacaatgcggtccacaaacctggcggcagcgcaaaagatg

SEQ ID NO: 120063 - DNA, 103 bp, Artificial Sequence
  Synthetic Polynucleotide
taatacgactcactataggggccatgatgcgctcgatggaaaaggccagtaacagaggagaactggcatgttccatcgaaacctggcggcagcgcaaaagatg

SEQ ID NO: 120064 - DNA, 103 bp, Artificial Sequence
  Synthetic Polynucleotide
taatacgactcactatagggcacacgaacggtctggctccggtgtggaccaacagaggagaggtccaatgcggagccagaacctggcggcagcgcaaaagatg

SEQ ID NO: 120065 - DNA, 103 bp, Artificial Sequence
  Synthetic Polynucleotide
taatacgactcactataggggcagactttgcacacgaacggtctggctccaacagaggagaggagccatgccgttcgtgaacctggcggcagcgcaaaagatg

SEQ ID NO: 120066 - DNA, 103 bp, Artificial Sequence
  Synthetic Polynucleotide
taatacgactcactatagggagcctttgccgcagactttgcacacgaacgaacagaggagacgttcgatggcaaagtctaacctggcggcagcgcaaaagatg

SEQ ID NO: 120067 - DNA, 103 bp, Artificial Sequence
  Synthetic Polynucleotide
taatacgactcactataggggcctggcgaaagcctttgccgcagactttgaacagaggagacaaagtatgcggcaaaggaacctggcggcagcgcaaaagatg

SEQ ID NO: 120068 - DNA, 103 bp, Artificial Sequence
  Synthetic Polynucleotide
taatacgactcactataggggagcgtgctggcctggcgaaagcctttgccaacagaggagaggcaaaatgtttcgccagaacctggcggcagcgcaaaagatg

SEQ ID NO: 120069 - DNA, 103 bp, Artificial Sequence
  Synthetic Polynucleotide
taatacgactcactatagggtgtgcctgcagagcgtgctggcctggcgaaaacagaggagattcgccatgccagcacgcaacctggcggcagcgcaaaagatg

SEQ ID NO: 120070 - DNA, 103 bp, Artificial Sequence
  Synthetic Polynucleotide
taatacgactcactatagggtggataattttgtgcctgcagagcgtgctgaacagaggagacagcacatgctgcaggcaaacctggcggcagcgcaaaagatg

SEQ ID NO: 120071 - DNA, 103 bp, Artificial Sequence
  Synthetic Polynucleotide
taatacgactcactatagggttcctgggtgtggataattttgtgcctgcaaacagaggagatgcaggatgaaaattatcaacctggcggcagcgcaaaagatg

SEQ ID NO: 120072 - DNA, 103 bp, Artificial Sequence
  Synthetic Polynucleotide
taatacgactcactatagggtatgtggcttttcctgggtgtggataatttaacagaggagaaaattaatgacacccaggaacctggcggcagcgcaaaagatg

SEQ ID NO: 120073 - DNA, 103 bp, Artificial Sequence
  Synthetic Polynucleotide
taatacgactcactatagggtggttgcatttatgtggcttttcctgggtgaacagaggagacacccaatgaaagccacaaacctggcggcagcgcaaaagatg

SEQ ID NO: 120074 - DNA, 103 bp, Artificial Sequence
  Synthetic Polynucleotide
taatacgactcactataggggggatctaggacgccgggcgcggggtccataacagaggagaatggacatggcgcccggcaacctggcggcagcgcaaaagatg

SEQ ID NO: 120075 - DNA, 103 bp, Artificial Sequence
  Synthetic Polynucleotide
taatacgactcactatagggcagctggggcagcggcccgaactgctcccgaacagaggagacgggagatgttcgggccgaacctggcggcagcgcaaaagatg

SEQ ID NO: 120076 - DNA, 103 bp, Artificial Sequence
  Synthetic Polynucleotide
taatacgactcactatagggagacagcggccagctggggcagcggcccgaaacagaggagatcgggcatgtgccccagcaacctggcggcagcgcaaaagatg

SEQ ID NO: 120077 - DNA, 103 bp, Artificial Sequence
  Synthetic Polynucleotide
taatacgactcactatagggttgagccggcagacagcggccagctggggcaacagaggagagccccaatgggccgctgtaacctggcggcagcgcaaaagatg

SEQ ID NO: 120078 - DNA, 103 bp, Artificial Sequence
  Synthetic Polynucleotide
taatacgactcactataggggggcagccgcttgagccggcagacagcggcaacagaggagagccgctatgtgccggctcaacctggcggcagcgcaaaagatg

SEQ ID NO: 120079 - DNA, 103 bp, Artificial Sequence
  Synthetic Polynucleotide
taatacgactcactatagggagccgcccgagggcagccgcttgagccggcaacagaggagagccggcatgagcggctgcaacctggcggcagcgcaaaagatg

SEQ ID NO: 120080 - DNA, 103 bp, Artificial Sequence
  Synthetic Polynucleotide
taatacgactcactataggggtggacgagtagccgcccgagggcagccgcaacagaggagagcggctatgctcgggcggaacctggcggcagcgcaaaagatg

SEQ ID NO: 120081 - DNA, 103 bp, Artificial Sequence
  Synthetic Polynucleotide
taatacgactcactataggggaggttttcagtggacgagtagccgcccgaaacagaggagatcgggcatgtactcgtccaacctggcggcagcgcaaaagatg

SEQ ID NO: 120082 - DNA, 103 bp, Artificial Sequence
  Synthetic Polynucleotide
taatacgactcactataggggcaccaactggaggttttcagtggacgagtaacagaggagaactcgtatgctgaaaaccaacctggcggcagcgcaaaagatg

SEQ ID NO: 120083 - DNA, 103 bp, Artificial Sequence
  Synthetic Polynucleotide
taatacgactcactatagggcgccgctccagcaccaactggaggttttcaaacagaggagatgaaaaatgccagttggtaacctggcggcagcgcaaaagatg

SEQ ID NO: 120084 - DNA, 103 bp, Artificial Sequence
  Synthetic Polynucleotide
taatacgactcactatagggggccacacgccgccgctccagcaccaactgaacagaggagacagttgatgctggagcggaacctggcggcagcgcaaaagatg

SEQ ID NO: 120085 - DNA, 103 bp, Artificial Sequence
  Synthetic Polynucleotide
taatacgactcactataggggcgcggcgcggggatctaggacgccgggcgaacagaggagacgcccgatgtcctagatcaacctggcggcagcgcaaaagatg

SEQ ID NO: 120086 - DNA, 103 bp, Artificial Sequence
  Synthetic Polynucleotide
taatacgactcactatagggccttggcgttggccacacgccgccgctccaaacagaggagatggagcatgggcgtgtggaacctggcggcagcgcaaaagatg

SEQ ID NO: 120087 - DNA, 103 bp, Artificial Sequence
  Synthetic Polynucleotide
taatacgactcactatagggcgctcacgctccttggcgttggccacacgcaacagaggagagcgtgtatgcaacgccaaaacctggcggcagcgcaaaagatg

SEQ ID NO: 120088 - DNA, 103 bp, Artificial Sequence
  Synthetic Polynucleotide
taatacgactcactatagggattttttatccgctcacgctccttggcgttaacagaggagaaacgccatggagcgtgagaacctggcggcagcgcaaaagatg

SEQ ID NO: 120089 - DNA, 103 bp, Artificial Sequence
  Synthetic Polynucleotide
taatacgactcactatagggcacggttgagattttttatccgctcacgctaacagaggagaagcgtgatgggataaaaaaacctggcggcagcgcaaaagatg

SEQ ID NO: 120090 - DNA, 103 bp, Artificial Sequence
  Synthetic Polynucleotide
taatacgactcactatagggctggcaaaaccacggttgagattttttatcaacagaggagagataaaatgtctcaaccgaacctggcggcagcgcaaaagatg

SEQ ID NO: 120091 - DNA, 103 bp, Artificial Sequence
  Synthetic Polynucleotide
taatacgactcactatagggtgccttcaatctggcaaaaccacggttgagaacagaggagactcaacatgggttttgccaacctggcggcagcgcaaaagatg

SEQ ID NO: 120092 - DNA, 103 bp, Artificial Sequence
  Synthetic Polynucleotide
taatacgactcactatagggatggcacaagtgccttcaatctggcaaaacaacagaggagagttttgatggattgaaggaacctggcggcagcgcaaaagatg

SEQ ID NO: 120093 - DNA, 103 bp, Artificial Sequence
  Synthetic Polynucleotide
taatacgactcactatagggtggggaagaaatggcacaagtgccttcaataacagaggagaattgaaatgacttgtgccaacctggcggcagcgcaaaagatg

SEQ ID NO: 120094 - DNA, 103 bp, Artificial Sequence
  Synthetic Polynucleotide
taatacgactcactatagggcttcctgctttggggaagaaatggcacaagaacagaggagacttgtgatgtttcttcccaacctggcggcagcgcaaaagatg

SEQ ID NO: 120095 - DNA, 103 bp, Artificial Sequence
  Synthetic Polynucleotide
taatacgactcactatagggctttgctgggcttcctgctttggggaagaaaacagaggagattcttcatgaaagcaggaaacctggcggcagcgcaaaagatg

SEQ ID NO: 120096 - DNA, 103 bp, Artificial Sequence
  Synthetic Polynucleotide
taatacgactcactatagggagcgcgggcggcgcggcgcggggatctaggaacagaggagacctagaatgccgcgccgcaacctggcggcagcgcaaaagatg

SEQ ID NO: 120097 - DNA, 103 bp, Artificial Sequence
  Synthetic Polynucleotide
taatacgactcactatagggaggatatcaactttgctgggcttcctgcttaacagaggagaaagcagatggcccagcaaaacctggcggcagcgcaaaagatg

SEQ ID NO: 120098 - DNA, 103 bp, Artificial Sequence
  Synthetic Polynucleotide
taatacgactcactatagggcgcacctttaaggatatcaactttgctgggaacagaggagacccagcatggttgatatcaacctggcggcagcgcaaaagatg

SEQ ID NO: 120099 - DNA, 103 bp, Artificial Sequence
  Synthetic Polynucleotide
taatacgactcactatagggtatattcagtcgcacctttaaggatatcaaaacagaggagattgataatgttaaaggtgaacctggcggcagcgcaaaagatg

SEQ ID NO: 120100 - DNA, 103 bp, Artificial Sequence
  Synthetic Polynucleotide
taatacgactcactatagggagaacctgtatatattcagtcgcacctttaaacagaggagataaaggatggactgaataaacctggcggcagcgcaaaagatg

SEQ ID NO: 120101 - DNA, 103 bp, Artificial Sequence
  Synthetic Polynucleotide
taatacgactcactatagggaagatcactgagaacctgtatatattcagtaacagaggagaactgaaatgatacaggttaacctggcggcagcgcaaaagatg

SEQ ID NO: 120102 - DNA, 103 bp, Artificial Sequence
  Synthetic Polynucleotide
taatacgactcactatagggctccttccaaaagatcactgagaacctgtaaacagaggagatacaggatgtcagtgatcaacctggcggcagcgcaaaagatg

SEQ ID NO: 120103 - DNA, 103 bp, Artificial Sequence
  Synthetic Polynucleotide
taatacgactcactataggggagtctttggctccttccaaaagatcactgaacagaggagacagtgaatgtttggaaggaacctggcggcagcgcaaaagatg

SEQ ID NO: 120104 - DNA, 103 bp, Artificial Sequence
  Synthetic Polynucleotide
taatacgactcactatagggttgtttctttgagtctttggctccttccaaaacagaggagattggaaatggccaaagacaacctggcggcagcgcaaaagatg

SEQ ID NO: 120105 - DNA, 103 bp, Artificial Sequence
  Synthetic Polynucleotide
taatacgactcactatagggcatctgggtcttgtttctttgagtctttggaacagaggagaccaaagatgcaaagaaacaacctggcggcagcgcaaaagatg

SEQ ID NO: 120106 - DNA, 103 bp, Artificial Sequence
  Synthetic Polynucleotide
taatacgactcactatagggtagctctgctcatctgggtcttgtttctttaacagaggagaaaagaaatgagacccagaaacctggcggcagcgcaaaagatg

SEQ ID NO: 120107 - DNA, 103 bp, Artificial Sequence
  Synthetic Polynucleotide
taatacgactcactatagggggtgcccaggagcgcgggcggcgcggcgcgaacagaggagacgcgccatgccgcccgcgaacctggcggcagcgcaaaagatg

SEQ ID NO: 120108 - DNA, 103 bp, Artificial Sequence
  Synthetic Polynucleotide
taatacgactcactataggggttgttactatagctctgctcatctgggtcaacagaggagagacccaatggagcagagcaacctggcggcagcgcaaaagatg

SEQ ID NO: 120109 - DNA, 103 bp, Artificial Sequence
  Synthetic Polynucleotide
taatacgactcactatagggattcagaactgttgttactatagctctgctaacagaggagaagcagaatgatagtaacaaacctggcggcagcgcaaaagatg

SEQ ID NO: 120110 - DNA, 103 bp, Artificial Sequence
  Synthetic Polynucleotide
taatacgactcactataggggatgtatgtgattcagaactgttgttactaaacagaggagatagtaaatgcagttctgaaacctggcggcagcgcaaaagatg

SEQ ID NO: 120111 - DNA, 103 bp, Artificial Sequence
  Synthetic Polynucleotide
taatacgactcactatagggtcttgccgaggatgtatgtgattcagaactaacagaggagaagttctatgtcacatacaaacctggcggcagcgcaaaagatg

SEQ ID NO: 120112 - DNA, 103 bp, Artificial Sequence
  Synthetic Polynucleotide
taatacgactcactatagggttgacagctgtcttgccgaggatgtatgtgaacagaggagacacataatgcctcggcaaaacctggcggcagcgcaaaagatg

SEQ ID NO: 120113 - DNA, 103 bp, Artificial Sequence
  Synthetic Polynucleotide
taatacgactcactataggggtgatgtttcttgacagctgtcttgccgagaacagaggagactcggcatgacagctgtcaacctggcggcagcgcaaaagatg

SEQ ID NO: 120114 - DNA, 103 bp, Artificial Sequence
  Synthetic Polynucleotide
taatacgactcactataggggatatgttgggtgatgtttcttgacagctgaacagaggagacagctgatgagaaacatcaacctggcggcagcgcaaaagatg

SEQ ID NO: 120115 - DNA, 103 bp, Artificial Sequence
  Synthetic Polynucleotide
taatacgactcactatagggaagcacagctgatatgttgggtgatgtttcaacagaggagagaaacaatgcccaacataaacctggcggcagcgcaaaagatg

SEQ ID NO: 120116 - DNA, 103 bp, Artificial Sequence
  Synthetic Polynucleotide
taatacgactcactatagggttcaagccgaaagcacagctgatatgttggaacagaggagaccaacaatgcagctgtgcaacctggcggcagcgcaaaagatg

SEQ ID NO: 120117 - DNA, 103 bp, Artificial Sequence
  Synthetic Polynucleotide
taatacgactcactatagggctcttcattcttcaagccgaaagcacagctaacagaggagaagctgtatgttcggcttgaacctggcggcagcgcaaaagatg

SEQ ID NO: 120118 - DNA, 103 bp, Artificial Sequence
  Synthetic Polynucleotide
taatacgactcactatagggcggcttgcggggtgcccaggagcgcgggcgaacagaggagacgcccgatgtcctgggcaaacctggcggcagcgcaaaagatg

SEQ ID NO: 120119 - DNA, 103 bp, Artificial Sequence
  Synthetic Polynucleotide
taatacgactcactatagggaaggcccttcctcttcattcttcaagccgaaacagaggagatcggctatgagaatgaagaacctggcggcagcgcaaaagatg

SEQ ID NO: 120120 - DNA, 103 bp, Artificial Sequence
  Synthetic Polynucleotide
taatacgactcactatagggccatctgcccaaggcccttcctcttcattcaacagaggagagaatgaatgggaagggccaacctggcggcagcgcaaaagatg

SEQ ID NO: 120121 - DNA, 103 bp, Artificial Sequence
  Synthetic Polynucleotide
taatacgactcactatagggaccactgccaccatctgcccaaggcccttcaacagaggagagaagggatgtgggcagataacctggcggcagcgcaaaagatg

SEQ ID NO: 120122 - DNA, 103 bp, Artificial Sequence
  Synthetic Polynucleotide
taatacgactcactataggggtgctggctcaccactgccaccatctgcccaacagaggagagggcagatggtggcagtgaacctggcggcagcgcaaaagatg

SEQ ID NO: 120123 - DNA, 103 bp, Artificial Sequence
  Synthetic Polynucleotide
taatacgactcactatagggcgacaagcgtgtgctggctcaccactgccaaacagaggagatggcagatgtgagccagcaacctggcggcagcgcaaaagatg

SEQ ID NO: 120124 - DNA, 103 bp, Artificial Sequence
  Synthetic Polynucleotide
taatacgactcactatagggcacactgtggcgacaagcgtgtgctggctcaacagaggagagagccaatgcacgcttgtaacctggcggcagcgcaaaagatg

SEQ ID NO: 120125 - DNA, 103 bp, Artificial Sequence
  Synthetic Polynucleotide
taatacgactcactatagggtcgtagacatcacactgtggcgacaagcgtaacagaggagaacgcttatggccacagtgaacctggcggcagcgcaaaagatg

SEQ ID NO: 120126 - DNA, 103 bp, Artificial Sequence
  Synthetic Polynucleotide
taatacgactcactatagggataatttcagtcgtagacatcacactgtggaacagaggagaccacagatggatgtctacaacctggcggcagcgcaaaagatg

SEQ ID NO: 120127 - DNA, 103 bp, Artificial Sequence
  Synthetic Polynucleotide
taatacgactcactatagggggttggggagataatttcagtcgtagacataacagaggagaatgtctatgactgaaattaacctggcggcagcgcaaaagatg

SEQ ID NO: 120128 - DNA, 103 bp, Artificial Sequence
  Synthetic Polynucleotide
taatacgactcactatagggccagacttctggttggggagataatttcagaacagaggagactgaaaatgtctccccaaaacctggcggcagcgcaaaagatg

SEQ ID NO: 120129 - DNA, 103 bp, Artificial Sequence
  Synthetic Polynucleotide
taatacgactcactatagggtccagcacctcggcttgcggggtgcccaggaacagaggagacctgggatgcccgcaagcaacctggcggcagcgcaaaagatg

SEQ ID NO: 120130 - DNA, 103 bp, Artificial Sequence
  Synthetic Polynucleotide
taatacgactcactataggggggaatctatccagacttctggttggggagaacagaggagactccccatgcagaagtctaacctggcggcagcgcaaaagatg

SEQ ID NO: 120131 - DNA, 103 bp, Artificial Sequence
  Synthetic Polynucleotide
taatacgactcactatagggttctacttctgggaatctatccagacttctaacagaggagaagaagtatggatagattcaacctggcggcagcgcaaaagatg

SEQ ID NO: 120132 - DNA, 103 bp, Artificial Sequence
  Synthetic Polynucleotide
taatacgactcactataggggactcagcagttctacttctgggaatctataacagaggagaatagatatgcagaagtagaacctggcggcagcgcaaaagatg

SEQ ID NO: 120133 - DNA, 103 bp, Artificial Sequence
  Synthetic Polynucleotide
taatacgactcactatagggggaagtctgtgactcagcagttctacttctaacagaggagaagaagtatgactgctgagaacctggcggcagcgcaaaagatg

SEQ ID NO: 120134 - DNA, 103 bp, Artificial Sequence
  Synthetic Polynucleotide
taatacgactcactatagggtcatacttgtggaagtctgtgactcagcagaacagaggagactgctgatgcacagacttaacctggcggcagcgcaaaagatg

SEQ ID NO: 120135 - DNA, 103 bp, Artificial Sequence
  Synthetic Polynucleotide
taatacgactcactatagggcaacacgtcctccagcacctcggcttgcggaacagaggagaccgcaaatggaggtgctgaacctggcggcagcgcaaaagatg

SEQ ID NO: 120136 - DNA, 103 bp, Artificial Sequence
  Synthetic Polynucleotide
taatacgactcactatagggactgctcccgcaacacgtcctccagcacctaacagaggagaaggtgcatgaggacgtgtaacctggcggcagcgcaaaagatg

SEQ ID NO: 120137 - DNA, 103 bp, Artificial Sequence
  Synthetic Polynucleotide
taatacgactcactatagggagcggcccgaactgctcccgcaacacgtccaacagaggagaggacgtatggcgggagcaaacctggcggcagcgcaaaagatg

SEQ ID NO: 120138 - DNA, 103 bp, Artificial Sequence
  Synthetic Polynucleotide
taatacgactcactatagggcgacagagcctccttaatagtcccgtccataacagaggagaatggacatgactattaagaacctggcggcagcgcaaaagatg

SEQ ID NO: 120139 - DNA, 103 bp, Artificial Sequence
  Synthetic Polynucleotide
taatacgactcactatagggaggactccccgaggcagtcatgtcggccttaacagaggagaaaggccatgatgactgccaacctggcggcagcgcaaaagatg

SEQ ID NO: 120140 - DNA, 103 bp, Artificial Sequence
  Synthetic Polynucleotide
taatacgactcactatagggacggagggcccggctcagcttgtcgtaattaacagaggagaaattacatgaagctgagcaacctggcggcagcgcaaaagatg

SEQ ID NO: 120141 - DNA, 103 bp, Artificial Sequence
  Synthetic Polynucleotide
taatacgactcactatagggcatagtaataacggagggcccggctcagctaacagaggagaagctgaatggggccctccaacctggcggcagcgcaaaagatg

SEQ ID NO: 120142 - DNA, 103 bp, Artificial Sequence
  Synthetic Polynucleotide
taatacgactcactatagggatgtttttatcatagtaataacggagggccaacagaggagaggccctatgttattactaaacctggcggcagcgcaaaagatg

SEQ ID NO: 120143 - DNA, 103 bp, Artificial Sequence
  Synthetic Polynucleotide
taatacgactcactatagggtttggtcataatgtttttatcatagtaataaacagaggagatattacatggataaaaacaacctggcggcagcgcaaaagatg

SEQ ID NO: 120144 - DNA, 103 bp, Artificial Sequence
  Synthetic Polynucleotide
taatacgactcactatagggtgccgtgcactttggtcataatgtttttataacagaggagaataaaaatgttatgaccaaacctggcggcagcgcaaaagatg

SEQ ID NO: 120145 - DNA, 103 bp, Artificial Sequence
  Synthetic Polynucleotide
taatacgactcactataggggcatatcttttgccgtgcactttggtcataaacagaggagatatgacatgagtgcacggaacctggcggcagcgcaaaagatg

SEQ ID NO: 120146 - DNA, 103 bp, Artificial Sequence
  Synthetic Polynucleotide
taatacgactcactatagggaaatttgtaagcatatcttttgccgtgcacaacagaggagagtgcacatgaaaagatataacctggcggcagcgcaaaagatg

SEQ ID NO: 120147 - DNA, 103 bp, Artificial Sequence
  Synthetic Polynucleotide
taatacgactcactatagggcgtggaagtcaaatttgtaagcatatctttaacagaggagaaaagatatgcttacaaataacctggcggcagcgcaaaagatg

SEQ ID NO: 120148 - DNA, 103 bp, Artificial Sequence
  Synthetic Polynucleotide
taatacgactcactatagggtgggcaatgccgtggaagtcaaatttgtaaaacagaggagattacaaatgtgacttccaaacctggcggcagcgcaaaagatg

SEQ ID NO: 120149 - DNA, 103 bp, Artificial Sequence
  Synthetic Polynucleotide
taatacgactcactatagggctgcagagcctgggcaatgccgtggaagtcaacagaggagagacttcatgggcattgccaacctggcggcagcgcaaaagatg

SEQ ID NO: 120150 - DNA, 103 bp, Artificial Sequence
  Synthetic Polynucleotide
taatacgactcactataggggcccgtagtcaggactccccgaggcagtcaaacagaggagatgactgatgcggggagtcaacctggcggcagcgcaaaagatg

SEQ ID NO: 120151 - DNA, 103 bp, Artificial Sequence
  Synthetic Polynucleotide
taatacgactcactatagggtcggatgtggctgcagagcctgggcaatgcaacagaggagagcattgatgaggctctgcaacctggcggcagcgcaaaagatg

SEQ ID NO: 120152 - DNA, 103 bp, Artificial Sequence
  Synthetic Polynucleotide
taatacgactcactataggggacgactcggtcggatgtggctgcagagccaacagaggagaggctctatggccacatccaacctggcggcagcgcaaaagatg

SEQ ID NO: 120153 - DNA, 103 bp, Artificial Sequence
  Synthetic Polynucleotide
taatacgactcactatagggcttgtacatggacgactcggtcggatgtggaacagaggagaccacatatgaccgagtcgaacctggcggcagcgcaaaagatg

SEQ ID NO: 120154 - DNA, 103 bp, Artificial Sequence
  Synthetic Polynucleotide
taatacgactcactatagggcagaagggtacttgtacatggacgactcggaacagaggagaccgagtatgccatgtacaaacctggcggcagcgcaaaagatg

SEQ ID NO: 120155 - DNA, 103 bp, Artificial Sequence
  Synthetic Polynucleotide
taatacgactcactatagggtaggagatgtcagaagggtacttgtacatgaacagaggagacatgtaatggtacccttcaacctggcggcagcgcaaaagatg

SEQ ID NO: 120156 - DNA, 103 bp, Artificial Sequence
  Synthetic Polynucleotide
taatacgactcactatagggggaaggcatgtaggagatgtcagaagggtaaacagaggagataccctatggacatctccaacctggcggcagcgcaaaagatg

SEQ ID NO: 120157 - DNA, 103 bp, Artificial Sequence
  Synthetic Polynucleotide
taatacgactcactataggggggcatggtaggaaggcatgtaggagatgtaacagaggagaacatctatgacatgccttaacctggcggcagcgcaaaagatg

SEQ ID NO: 120158 - DNA, 103 bp, Artificial Sequence
  Synthetic Polynucleotide
taatacgactcactatagggttctgctggtgggcatggtaggaaggcatgaacagaggagacatgccatgctaccatgcaacctggcggcagcgcaaaagatg

SEQ ID NO: 120159 - DNA, 103 bp, Artificial Sequence
  Synthetic Polynucleotide
taatacgactcactatagggaaagttcaccttctgctggtgggcatggtaaacagaggagataccatatgcaccagcagaacctggcggcagcgcaaaagatg

SEQ ID NO: 120160 - DNA, 103 bp, Artificial Sequence
  Synthetic Polynucleotide
taatacgactcactatagggggggagggacaaagttcaccttctgctggtaacagaggagaaccagcatgaggtgaactaacctggcggcagcgcaaaagatg

SEQ ID NO: 120161 - DNA, 103 bp, Artificial Sequence
  Synthetic Polynucleotide
taatacgactcactatagggttgtggggctgcccgtagtcaggactccccaacagaggagaggggagatgtgactacggaacctggcggcagcgcaaaagatg

SEQ ID NO: 120162 - DNA, 103 bp, Artificial Sequence
  Synthetic Polynucleotide
taatacgactcactataggggaggatggatggggagggacaaagttcaccaacagaggagaggtgaaatgtgtccctccaacctggcggcagcgcaaaagatg

SEQ ID NO: 120163 - DNA, 103 bp, Artificial Sequence
  Synthetic Polynucleotide
taatacgactcactataggggacaggcatggaggatggatggggagggacaacagaggagagtccctatgcatccatccaacctggcggcagcgcaaaagatg

SEQ ID NO: 120164 - DNA, 103 bp, Artificial Sequence
  Synthetic Polynucleotide
taatacgactcactatagggtggaggaagtgacaggcatggaggatggataacagaggagaatccatatgccatgcctgaacctggcggcagcgcaaaagatg

SEQ ID NO: 120165 - DNA, 103 bp, Artificial Sequence
  Synthetic Polynucleotide
taatacgactcactatagggccaaagaagctggaggaagtgacaggcatgaacagaggagacatgccatgcacttcctcaacctggcggcagcgcaaaagatg

SEQ ID NO: 120166 - DNA, 103 bp, Artificial Sequence
  Synthetic Polynucleotide
taatacgactcactatagggtgatgcggctccaaagaagctggaggaagtaacagaggagaacttccatgagcttctttaacctggcggcagcgcaaaagatg

SEQ ID NO: 120167 - DNA, 103 bp, Artificial Sequence
  Synthetic Polynucleotide
taatacgactcactatagggtccagtattgtgatgcggctccaaagaagcaacagaggagagcttctatggagccgcataacctggcggcagcgcaaaagatg

SEQ ID NO: 120168 - DNA, 103 bp, Artificial Sequence
  Synthetic Polynucleotide
taatacgactcactataggggtgggggaggtccagtattgtgatgcggctaacagaggagaagccgcatgacaatactgaacctggcggcagcgcaaaagatg

SEQ ID NO: 120169 - DNA, 103 bp, Artificial Sequence
  Synthetic Polynucleotide
taatacgactcactataggggattccccccgtgggggaggtccagtattgaacagaggagacaatacatgacctcccccaacctggcggcagcgcaaaagatg

SEQ ID NO: 120170 - DNA, 103 bp, Artificial Sequence
  Synthetic Polynucleotide
taatacgactcactatagggggttggggtagattccccccgtgggggaggaacagaggagacctcccatgcggggggaaaacctggcggcagcgcaaaagatg

SEQ ID NO: 120171 - DNA, 103 bp, Artificial Sequence
  Synthetic Polynucleotide
taatacgactcactataggggggacgttggggttggggtagattccccccaacagaggagaggggggatgctaccccaaaacctggcggcagcgcaaaagatg

SEQ ID NO: 120172 - DNA, 103 bp, Artificial Sequence
  Synthetic Polynucleotide
taatacgactcactatagggggggttgatcttgtggggctgcccgtagtcaacagaggagagactacatgcagccccacaacctggcggcagcgcaaaagatg

SEQ ID NO: 120173 - DNA, 103 bp, Artificial Sequence
  Synthetic Polynucleotide
taatacgactcactatagggaggatggcgggggacgttggggttggggtaaacagaggagataccccatgcccaacgtcaacctggcggcagcgcaaaagatg

SEQ ID NO: 120174 - DNA, 103 bp, Artificial Sequence
  Synthetic Polynucleotide
taatacgactcactatagggcgtgggtgttaggatggcgggggacgttggaacagaggagaccaacgatgcccgccatcaacctggcggcagcgcaaaagatg

SEQ ID NO: 120175 - DNA, 103 bp, Artificial Sequence
  Synthetic Polynucleotide
taatacgactcactatagggtgtgaaggcacgtgggtgttaggatggcggaacagaggagaccgccaatgtaacacccaaacctggcggcagcgcaaaagatg

SEQ ID NO: 120176 - DNA, 103 bp, Artificial Sequence
  Synthetic Polynucleotide
taatacgactcactataggggctgcctaagtgtgaaggcacgtgggtgttaacagaggagaaacaccatggtgccttcaaacctggcggcagcgcaaaagatg

SEQ ID NO: 120177 - DNA, 103 bp, Artificial Sequence
  Synthetic Polynucleotide
taatacgactcactataggggtggtgggagggggttgatcttgtggggctaacagaggagaagccccatgagatcaaccaacctggcggcagcgcaaaagatg

SEQ ID NO: 120178 - DNA, 103 bp, Artificial Sequence
  Synthetic Polynucleotide
taatacgactcactatagggcactcctgctgtggtgggagggggttgatcaacagaggagagatcaaatgcctcccaccaacctggcggcagcgcaaaagatg

SEQ ID NO: 120179 - DNA, 103 bp, Artificial Sequence
  Synthetic Polynucleotide
taatacgactcactatagggctgattgatccactcctgctgtggtgggagaacagaggagactcccaatgcagcaggagaacctggcggcagcgcaaaagatg

SEQ ID NO: 120180 - DNA, 103 bp, Artificial Sequence
  Synthetic Polynucleotide
taatacgactcactatagggccctcactggctgattgatccactcctgctaacagaggagaagcaggatgggatcaatcaacctggcggcagcgcaaaagatg

SEQ ID NO: 120181 - DNA, 103 bp, Artificial Sequence
  Synthetic Polynucleotide
taatacgactcactatagggttgacgttgaccctcactggctgattgatcaacagaggagagatcaaatggccagtgagaacctggcggcagcgcaaaagatg

SEQ ID NO: 120182 - DNA, 103 bp, Artificial Sequence
  Synthetic Polynucleotide
taatacgactcactatagggatactcccgcttgacgttgaccctcactggaacagaggagaccagtgatggtcaacgtcaacctggcggcagcgcaaaagatg

SEQ ID NO: 120183 - DNA, 103 bp, Artificial Sequence
  Synthetic Polynucleotide
taatacgactcactatagggcgctcaccaccgacagagcctccttaatagaacagaggagactattaatgaggctctgtaacctggcggcagcgcaaaagatg

SEQ ID NO: 120184 - DNA, 103 bp, Artificial Sequence
  Synthetic Polynucleotide
taatacgactcactatagggtcatgtggtcatactcccgcttgacgttgaaacagaggagatcaacgatgagcgggagtaacctggcggcagcgcaaaagatg

SEQ ID NO: 120185 - DNA, 103 bp, Artificial Sequence
  Synthetic Polynucleotide
taatacgactcactatagggctggatccattcatgtggtcatactcccgcaacagaggagagcgggaatgtgaccacataacctggcggcagcgcaaaagatg

SEQ ID NO: 120186 - DNA, 103 bp, Artificial Sequence
  Synthetic Polynucleotide
taatacgactcactatagggcggagactccctggatccattcatgtggtcaacagaggagagaccacatgaatggatccaacctggcggcagcgcaaaagatg

SEQ ID NO: 120187 - DNA, 103 bp, Artificial Sequence
  Synthetic Polynucleotide
taatacgactcactatagggtgcagtccaccggagactccctggatccataacagaggagaatggatatggggagtctcaacctggcggcagcgcaaaagatg

SEQ ID NO: 120188 - DNA, 103 bp, Artificial Sequence
  Synthetic Polynucleotide
taatacgactcactatagggttgctaacgctgcagtccaccggagactccaacagaggagaggagtcatgggtggactgaacctggcggcagcgcaaaagatg

SEQ ID NO: 120189 - DNA, 103 bp, Artificial Sequence
  Synthetic Polynucleotide
taatacgactcactatagggcttgctgcatttgctaacgctgcagtccacaacagaggagagtggacatgagcgttagcaacctggcggcagcgcaaaagatg

SEQ ID NO: 120190 - DNA, 103 bp, Artificial Sequence
  Synthetic Polynucleotide
taatacgactcactatagggcgcccaccagcttgctgcatttgctaacgcaacagaggagagcgttaatgaatgcagcaaacctggcggcagcgcaaaagatg

SEQ ID NO: 120191 - DNA, 103 bp, Artificial Sequence
  Synthetic Polynucleotide
taatacgactcactataggggactcgcctccgcccaccagcttgctgcataacagaggagaatgcagatggctggtgggaacctggcggcagcgcaaaagatg

SEQ ID NO: 120192 - DNA, 103 bp, Artificial Sequence
  Synthetic Polynucleotide
taatacgactcactatagggcatggggttggactcgcctccgcccaccagaacagaggagactggtgatgggaggcgagaacctggcggcagcgcaaaagatg

SEQ ID NO: 120193 - DNA, 103 bp, Artificial Sequence
  Synthetic Polynucleotide
taatacgactcactatagggtgttgtagttcatggggttggactcgcctcaacagaggagagaggcgatgccaaccccaaacctggcggcagcgcaaaagatg

SEQ ID NO: 120194 - DNA, 103 bp, Artificial Sequence
  Synthetic Polynucleotide
taatacgactcactataggggactggtcgtcgctcaccaccgacagagccaacagaggagaggctctatgggtggtgagaacctggcggcagcgcaaaagatg

SEQ ID NO: 120195 - DNA, 103 bp, Artificial Sequence
  Synthetic Polynucleotide
taatacgactcactatagggtccatatagctgttgtagttcatggggttgaacagaggagacaacccatggaactacaaaacctggcggcagcgcaaaagatg

SEQ ID NO: 120196 - DNA, 103 bp, Artificial Sequence
  Synthetic Polynucleotide
taatacgactcactatagggattcttctcgtccatatagctgttgtagttaacagaggagaaactacatgagctatatgaacctggcggcagcgcaaaagatg

SEQ ID NO: 120197 - DNA, 103 bp, Artificial Sequence
  Synthetic Polynucleotide
taatacgactcactataggggaggggggccattcttctcgtccatatagcaacagaggagagctataatgacgagaagaaacctggcggcagcgcaaaagatg

SEQ ID NO: 120198 - DNA, 103 bp, Artificial Sequence
  Synthetic Polynucleotide
taatacgactcactatagggatgttgggaggaggggggccattcttctcgaacagaggagacgagaaatgtggccccccaacctggcggcagcgcaaaagatg

SEQ ID NO: 120199 - DNA, 103 bp, Artificial Sequence
  Synthetic Polynucleotide
taatacgactcactataggggttggtggtcatgttgggaggaggggggccaacagaggagaggccccatgcctcccaacaacctggcggcagcgcaaaagatg

SEQ ID NO: 120200 - DNA, 103 bp, Artificial Sequence
  Synthetic Polynucleotide
taatacgactcactatagggctctcctctcgttggtggtcatgttgggagaacagaggagactcccaatgtgaccaccaaacctggcggcagcgcaaaagatg

SEQ ID NO: 120201 - DNA, 103 bp, Artificial Sequence
  Synthetic Polynucleotide
taatacgactcactataggggggacgatgactctcctctcgttggtggtcaacagaggagagaccacatgcgagaggagaacctggcggcagcgcaaaagatg

SEQ ID NO: 120202 - DNA, 103 bp, Artificial Sequence
  Synthetic Polynucleotide
taatacgactcactatagggggggtctgcggggacgatgactctcctctcaacagaggagagagaggatggtcatcgtcaacctggcggcagcgcaaaagatg

SEQ ID NO: 120203 - DNA, 103 bp, Artificial Sequence
  Synthetic Polynucleotide
taatacgactcactatagggtccacagtgtggggtctgcggggacgatgaaacagaggagatcatcgatgccgcagaccaacctggcggcagcgcaaaagatg

SEQ ID NO: 120204 - DNA, 103 bp, Artificial Sequence
  Synthetic Polynucleotide
taatacgactcactatagggtgctcctgtgtccacagtgtggggtctgcgaacagaggagacgcagaatgcacactgtgaacctggcggcagcgcaaaagatg

SEQ ID NO: 120205 - DNA, 103 bp, Artificial Sequence
  Synthetic Polynucleotide
taatacgactcactataggggtcaaagagggactggtcgtcgctcaccacaacagaggagagtggtgatggacgaccagaacctggcggcagcgcaaaagatg

SEQ ID NO: 120206 - DNA, 103 bp, Artificial Sequence
  Synthetic Polynucleotide
taatacgactcactatagggttgcctcacatgctcctgtgtccacagtgtaacagaggagaacactgatgacacaggagaacctggcggcagcgcaaaagatg

SEQ ID NO: 120207 - DNA, 103 bp, Artificial Sequence
  Synthetic Polynucleotide
taatacgactcactatagggactccagccattgcctcacatgctcctgtgaacagaggagacacaggatgatgtgaggcaacctggcggcagcgcaaaagatg

SEQ ID NO: 120208 - DNA, 103 bp, Artificial Sequence
  Synthetic Polynucleotide
taatacgactcactatagggtttatggcccactccagccattgcctcacaaacagaggagatgtgagatgatggctggaaacctggcggcagcgcaaaagatg

SEQ ID NO: 120209 - DNA, 103 bp, Artificial Sequence
  Synthetic Polynucleotide
taatacgactcactataggggctgtactcctttatggcccactccagccaaacagaggagatggctgatgtgggccataaacctggcggcagcgcaaaagatg

SEQ ID NO: 120210 - DNA, 103 bp, Artificial Sequence
  Synthetic Polynucleotide
taatacgactcactatagggtctccatcaagctgtactcctttatggcccaacagaggagagggccaatgaggagtacaaacctggcggcagcgcaaaagatg

SEQ ID NO: 120211 - DNA, 103 bp, Artificial Sequence
  Synthetic Polynucleotide
taatacgactcactataggggatgtgtcgatctccatcaagctgtactccaacagaggagaggagtaatgcttgatggaaacctggcggcagcgcaaaagatg

SEQ ID NO: 120212 - DNA, 103 bp, Artificial Sequence
  Synthetic Polynucleotide
taatacgactcactatagggctggaaaaaggatgtgtcgatctccatcaaaacagaggagattgatgatgatcgacacaaacctggcggcagcgcaaaagatg

SEQ ID NO: 120213 - DNA, 103 bp, Artificial Sequence
  Synthetic Polynucleotide
taatacgactcactatagggcatccatgttctggaaaaaggatgtgtcgaaacagaggagatcgacaatgcctttttccaacctggcggcagcgcaaaagatg

SEQ ID NO: 120214 - DNA, 103 bp, Artificial Sequence
  Synthetic Polynucleotide
taatacgactcactatagggagttccttgccatccatgttctggaaaaagaacagaggagactttttatggaacatggaaacctggcggcagcgcaaaagatg

SEQ ID NO: 120215 - DNA, 103 bp, Artificial Sequence
  Synthetic Polynucleotide
taatacgactcactatagggcattttacacagttccttgccatccatgttaacagaggagaaacatgatgggcaaggaaaacctggcggcagcgcaaaagatg

SEQ ID NO: 120216 - DNA, 103 bp, Artificial Sequence
  Synthetic Polynucleotide
taatacgactcactatagggcgtacgctgagtcaaagagggactggtcgtaacagaggagaacgaccatgccctctttgaacctggcggcagcgcaaaagatg

SEQ ID NO: 120217 - DNA, 103 bp, Artificial Sequence
  Synthetic Polynucleotide
taatacgactcactatagggcctccttgttcattttacacagttccttgcaacagaggagagcaaggatgtgtgtaaaaaacctggcggcagcgcaaaagatg

SEQ ID NO: 120218 - DNA, 103 bp, Artificial Sequence
  Synthetic Polynucleotide
taatacgactcactatagggcggaggaagtcctccttgttcattttacacaacagaggagagtgtaaatggaacaaggaaacctggcggcagcgcaaaagatg

SEQ ID NO: 120219 - DNA, 103 bp, Artificial Sequence
  Synthetic Polynucleotide
taatacgactcactatagggggtggtggcgcggaggaagtcctccttgttaacagaggagaaacaagatggacttcctcaacctggcggcagcgcaaaagatg

SEQ ID NO: 120220 - DNA, 103 bp, Artificial Sequence
  Synthetic Polynucleotide
taatacgactcactatagggtgttgtagagggtggtggcgcggaggaagtaacagaggagaacttccatggcgccaccaaacctggcggcagcgcaaaagatg

SEQ ID NO: 120221 - DNA, 103 bp, Artificial Sequence
  Synthetic Polynucleotide
taatacgactcactatagggagcacttccgtgttgtagagggtggtggcgaacagaggagacgccacatgcctctacaaaacctggcggcagcgcaaaagatg

SEQ ID NO: 120222 - DNA, 103 bp, Artificial Sequence
  Synthetic Polynucleotide
taatacgactcactataggggtgtgacaacagcacttccgtgttgtagagaacagaggagactctacatgacggaagtgaacctggcggcagcgcaaaagatg

SEQ ID NO: 120223 - DNA, 103 bp, Artificial Sequence
  Synthetic Polynucleotide
taatacgactcactatagggggtaactgaggtgtgacaacagcacttccgaacagaggagacggaagatgtgttgtcacaacctggcggcagcgcaaaagatg

SEQ ID NO: 120224 - DNA, 103 bp, Artificial Sequence
  Synthetic Polynucleotide
taatacgactcactatagggctttccctgaggtaactgaggtgtgacaacaacagaggagagttgtcatgcctcagttaaacctggcggcagcgcaaaagatg

SEQ ID NO: 120225 - DNA, 103 bp, Artificial Sequence
  Synthetic Polynucleotide
taatacgactcactatagggcagcagtgaactttccctgaggtaactgagaacagaggagactcagtatgctcagggaaaacctggcggcagcgcaaaagatg

SEQ ID NO: 120226 - DNA, 103 bp, Artificial Sequence
  Synthetic Polynucleotide
taatacgactcactatagggtattataggccagcagtgaactttccctgaaacagaggagatcagggatggttcactgcaacctggcggcagcgcaaaagatg

SEQ ID NO: 120227 - DNA, 103 bp, Artificial Sequence
  Synthetic Polynucleotide
taatacgactcactataggggctgccgctccgtacgctgagtcaaagaggaacagaggagacctcttatgctcagcgtaaacctggcggcagcgcaaaagatg

SEQ ID NO: 120228 - DNA, 103 bp, Artificial Sequence
  Synthetic Polynucleotide
taatacgactcactatagggtgggaggttgtattataggccagcagtgaaaacagaggagattcactatgggcctataaaacctggcggcagcgcaaaagatg

SEQ ID NO: 120229 - DNA, 103 bp, Artificial Sequence
  Synthetic Polynucleotide
taatacgactcactatagggttggtcggtgtgggaggttgtattataggcaacagaggagagcctatatgacaacctccaacctggcggcagcgcaaaagatg

SEQ ID NO: 120230 - DNA, 103 bp, Artificial Sequence
  Synthetic Polynucleotide
taatacgactcactatagggatcgtgaggattggtcggtgtgggaggttgaacagaggagacaacctatgacaccgaccaacctggcggcagcgcaaaagatg

SEQ ID NO: 120231 - DNA, 103 bp, Artificial Sequence
  Synthetic Polynucleotide
taatacgactcactatagggttgacactcaatcgtgaggattggtcggtgaacagaggagacaccgaatgatcctcacgaacctggcggcagcgcaaaagatg

SEQ ID NO: 120232 - DNA, 103 bp, Artificial Sequence
  Synthetic Polynucleotide
taatacgactcactatagggagggtcttctttgacactcaatcgtgaggaaacagaggagatcctcaatgttgagtgtcaacctggcggcagcgcaaaagatg

SEQ ID NO: 120233 - DNA, 103 bp, Artificial Sequence
  Synthetic Polynucleotide
taatacgactcactatagggagtcataagaagggtcttctttgacactcaaacagaggagatgagtgatgaagaagaccaacctggcggcagcgcaaaagatg

SEQ ID NO: 120234 - DNA, 103 bp, Artificial Sequence
  Synthetic Polynucleotide
taatacgactcactatagggcttctgactgagtcataagaagggtcttctaacagaggagaagaagaatgttcttatgaaacctggcggcagcgcaaaagatg

SEQ ID NO: 120235 - DNA, 103 bp, Artificial Sequence
  Synthetic Polynucleotide
taatacgactcactatagggccaagctcctcttctgactgagtcataagaaacagaggagatcttatatgtcagtcagaaacctggcggcagcgcaaaagatg

SEQ ID NO: 120236 - DNA, 103 bp, Artificial Sequence
  Synthetic Polynucleotide
taatacgactcactatagggtgttattgccccaagctcctcttctgactgaacagaggagacagtcaatggaggagcttaacctggcggcagcgcaaaagatg

SEQ ID NO: 120237 - DNA, 103 bp, Artificial Sequence
  Synthetic Polynucleotide
taatacgactcactatagggccagaattcatgttattgccccaagctcctaacagaggagaaggagcatggggcaataaaacctggcggcagcgcaaaagatg

SEQ ID NO: 120238 - DNA, 103 bp, Artificial Sequence
  Synthetic Polynucleotide
taatacgactcactatagggggggagatgggctgccgctccgtacgctgaaacagaggagatcagcgatgggagcggcaaacctggcggcagcgcaaaagatg

SEQ ID NO: 120239 - DNA, 103 bp, Artificial Sequence
  Synthetic Polynucleotide
taatacgactcactatagggtttgttgaggccagaattcatgttattgccaacagaggagaggcaatatgatgaattctaacctggcggcagcgcaaaagatg

SEQ ID NO: 120240 - DNA, 103 bp, Artificial Sequence
  Synthetic Polynucleotide
taatacgactcactatagggggggaggacttttgttgaggccagaattcaaacagaggagatgaattatggcctcaacaaacctggcggcagcgcaaaagatg

SEQ ID NO: 120241 - DNA, 103 bp, Artificial Sequence
  Synthetic Polynucleotide
taatacgactcactataggggcccctccaaggggaggacttttgttgaggaacagaggagacctcaaatgaagtcctccaacctggcggcagcgcaaaagatg

SEQ ID NO: 120242 - DNA, 103 bp, Artificial Sequence
  Synthetic Polynucleotide
taatacgactcactataggggatcgtttgtgcccctccaaggggaggactaacagaggagaagtcctatgcttggagggaacctggcggcagcgcaaaagatg

SEQ ID NO: 120243 - DNA, 103 bp, Artificial Sequence
  Synthetic Polynucleotide
taatacgactcactatagggtattcttactgatcgtttgtgcccctccaaaacagaggagattggagatgcacaaacgaaacctggcggcagcgcaaaagatg

SEQ ID NO: 120244 - DNA, 103 bp, Artificial Sequence
  Synthetic Polynucleotide
taatacgactcactatagggcgttgctctgtattcttactgatcgtttgtaacagaggagaacaaacatgcagtaagaaaacctggcggcagcgcaaaagatg

SEQ ID NO: 120245 - DNA, 103 bp, Artificial Sequence
  Synthetic Polynucleotide
taatacgactcactatagggtggctggggccgttgctctgtattcttactaacagaggagaagtaagatgacagagcaaaacctggcggcagcgcaaaagatg

SEQ ID NO: 120246 - DNA, 103 bp, Artificial Sequence
  Synthetic Polynucleotide
taatacgactcactataggggatacggatctggctggggccgttgctctgaacagaggagacagagcatgggccccagcaacctggcggcagcgcaaaagatg

SEQ ID NO: 120247 - DNA, 103 bp, Artificial Sequence
  Synthetic Polynucleotide
taatacgactcactatagggcccaggatctgatacggatctggctggggcaacagaggagagccccaatgagatccgtaaacctggcggcagcgcaaaagatg

SEQ ID NO: 120248 - DNA, 103 bp, Artificial Sequence
  Synthetic Polynucleotide
taatacgactcactataggggctggtcgggcccaggatctgatacggatcaacagaggagagatccgatgcagatcctgaacctggcggcagcgcaaaagatg

SEQ ID NO: 120249 - DNA, 103 bp, Artificial Sequence
  Synthetic Polynucleotide
taatacgactcactatagggtgtcggccttggggagatgggctgccgctcaacagaggagagagcggatgcccatctccaacctggcggcagcgcaaaagatg

SEQ ID NO: 120250 - DNA, 103 bp, Artificial Sequence
  Synthetic Polynucleotide
taatacgactcactatagggctaggcgactgctggtcgggcccaggatctaacagaggagaagatccatggcccgaccaaacctggcggcagcgcaaaagatg

SEQ ID NO: 120251 - DNA, 103 bp, Artificial Sequence
  Synthetic Polynucleotide
taatacgactcactatagggccagggttggctaggcgactgctggtcgggaacagaggagacccgacatgcagtcgcctaacctggcggcagcgcaaaagatg

SEQ ID NO: 120252 - DNA, 103 bp, Artificial Sequence
  Synthetic Polynucleotide
taatacgactcactatagggctgcccgcttccagggttggctaggcgactaacagaggagaagtcgcatggccaaccctaacctggcggcagcgcaaaagatg

SEQ ID NO: 120253 - DNA, 103 bp, Artificial Sequence
  Synthetic Polynucleotide
taatacgactcactatagggacagctggatctgcccgcttccagggttggaacagaggagaccaaccatggaagcgggcaacctggcggcagcgcaaaagatg

SEQ ID NO: 120254 - DNA, 103 bp, Artificial Sequence
  Synthetic Polynucleotide
taatacgactcactatagggaggaattgccacagctggatctgcccgcttaacagaggagaaagcggatggatccagctaacctggcggcagcgcaaaagatg

SEQ ID NO: 120255 - DNA, 103 bp, Artificial Sequence
  Synthetic Polynucleotide
taatacgactcactatagggcagctccaggaggaattgccacagctggataacagaggagaatccagatgtggcaattcaacctggcggcagcgcaaaagatg

SEQ ID NO: 120256 - DNA, 103 bp, Artificial Sequence
  Synthetic Polynucleotide
taatacgactcactatagggtgtcggagagcagctccaggaggaattgccaacagaggagaggcaatatgtcctggagcaacctggcggcagcgcaaaagatg

SEQ ID NO: 120257 - DNA, 103 bp, Artificial Sequence
  Synthetic Polynucleotide
taatacgactcactataggggcgttggcgctgtcggagagcagctccaggaacagaggagacctggaatggctctccgaaacctggcggcagcgcaaaagatg

SEQ ID NO: 120258 - DNA, 103 bp, Artificial Sequence
  Synthetic Polynucleotide
taatacgactcactataggggatacagctggcgttggcgctgtcggagagaacagaggagactctccatgagcgccaacaacctggcggcagcgcaaaagatg

SEQ ID NO: 120259 - DNA, 103 bp, Artificial Sequence
  Synthetic Polynucleotide
taatacgactcactatagggcctcccaggtgatacagctggcgttggcgcaacagaggagagcgccaatgccagctgtaaacctggcggcagcgcaaaagatg

SEQ ID NO: 120260 - DNA, 103 bp, Artificial Sequence
  Synthetic Polynucleotide
taatacgactcactataggggaggcagtcatgtcggccttggggagatggaacagaggagaccatctatgcaaggccgaaacctggcggcagcgcaaaagatg

SEQ ID NO: 120261 - DNA, 103 bp, Artificial Sequence
  Synthetic Polynucleotide
taatacgactcactatagggccgttggtcccctcccaggtgatacagctgaacagaggagacagctgatgcacctgggaaacctggcggcagcgcaaaagatg

SEQ ID NO: 120262 - DNA, 103 bp, Artificial Sequence
  Synthetic Polynucleotide
taatacgactcactatagggtttgaactccccgttggtcccctcccaggtaacagaggagaacctggatggggaccaacaacctggcggcagcgcaaaagatg

SEQ ID NO: 120263 - DNA, 103 bp, Artificial Sequence
  Synthetic Polynucleotide
taatacgactcactatagggggtccgtcattttgaactccccgttggtccaacagaggagaggaccaatggggagttcaaacctggcggcagcgcaaaagatg

SEQ ID NO: 120264 - DNA, 103 bp, Artificial Sequence
  Synthetic Polynucleotide
taatacgactcactatagggacctcatcggggtccgtcattttgaactccaacagaggagaggagttatgaatgacggaaacctggcggcagcgcaaaagatg

SEQ ID NO: 120265 - DNA, 103 bp, Artificial Sequence
  Synthetic Polynucleotide
taatacgactcactataggggcgcctggccacctcatcggggtccgtcataacagaggagaatgacgatgcccgatgagaacctggcggcagcgcaaaagatg

SEQ ID NO: 120266 - DNA, 103 bp, Artificial Sequence
  Synthetic Polynucleotide
taatacgactcactataggggctcgccccagcgcctggccacctcatcggaacagaggagaccgatgatgtggccaggcaacctggcggcagcgcaaaagatg

SEQ ID NO: 120267 - DNA, 103 bp, Artificial Sequence
  Synthetic Polynucleotide
taatacgactcactatagggttgcttttccgctcgccccagcgcctggccaacagaggagaggccagatgctggggcgaaacctggcggcagcgcaaaagatg

SEQ ID NO: 120268 - DNA, 103 bp, Artificial Sequence
  Synthetic Polynucleotide
taatacgactcactatagggcatgttgggcttgcttttccgctcgccccaaacagaggagatggggcatgcggaaaagcaacctggcggcagcgcaaaagatg

SEQ ID NO: 120269 - DNA, 103 bp, Artificial Sequence
  Synthetic Polynucleotide
taatacgactcactatagggtgtcgtaattcatgttgggcttgcttttccaacagaggagaggaaaaatgagcccaacaaacctggcggcagcgcaaaagatg

SEQ ID NO: 120270 - DNA, 103 bp, Artificial Sequence
  Synthetic Polynucleotide
taatacgactcactatagggcggctcagcttgtcgtaattcatgttgggcaacagaggagagcccaaatggaattacgaaacctggcggcagcgcaaaagatg

SEQ ID NO: 120271 - DNA, 103 bp, Artificial Sequence
  Synthetic Polynucleotide
taatacgactcactataggggtagtctgcgttgaagcccgagaacatcataacagaggagaatgatgatgtcgggcttcaacctggcggcagcgcaaaagatg

SEQ ID NO: 120272 - DNA, 103 bp, Artificial Sequence
  Synthetic Polynucleotide
taatacgactcactatagggcatgctggagaaggagtctgcgggtgagtgaacagaggagacactcaatggcagactccaacctggcggcagcgcaaaagatg

SEQ ID NO: 120273 - DNA, 103 bp, Artificial Sequence
  Synthetic Polynucleotide
taatacgactcactatagggggaagacgtgtaagcagtgcagctgggagtaacagaggagaactcccatgtgcactgctaacctggcggcagcgcaaaagatg

SEQ ID NO: 120274 - DNA, 103 bp, Artificial Sequence
  Synthetic Polynucleotide
taatacgactcactatagggtgaagacgaaggaagacgtgtaagcagtgcaacagaggagagcactgatgacacgtcttaacctggcggcagcgcaaaagatg

SEQ ID NO: 120275 - DNA, 103 bp, Artificial Sequence
  Synthetic Polynucleotide
taatacgactcactatagggtcggggtaggtgaagacgaaggaagacgtgaacagaggagacacgtcatgcttcgtcttaacctggcggcagcgcaaaagatg

SEQ ID NO: 120276 - DNA, 103 bp, Artificial Sequence
  Synthetic Polynucleotide
taatacgactcactatagggggagtcagcctcggggtaggtgaagacgaaaacagaggagattcgtcatgacctaccccaacctggcggcagcgcaaaagatg

SEQ ID NO: 120277 - DNA, 103 bp, Artificial Sequence
  Synthetic Polynucleotide
taatacgactcactatagggagctggggaaggagtcagcctcggggtaggaacagaggagacctaccatgaggctgactaacctggcggcagcgcaaaagatg

SEQ ID NO: 120278 - DNA, 103 bp, Artificial Sequence
  Synthetic Polynucleotide
taatacgactcactataggggcagctgcacagctggggaaggagtcagccaacagaggagaggctgaatgcttccccagaacctggcggcagcgcaaaagatg

SEQ ID NO: 120279 - DNA, 103 bp, Artificial Sequence
  Synthetic Polynucleotide
taatacgactcactatagggcttgcggtgggcagctgcacagctggggaaaacagaggagattccccatgtgtgcagctaacctggcggcagcgcaaaagatg

SEQ ID NO: 120280 - DNA, 103 bp, Artificial Sequence
  Synthetic Polynucleotide
taatacgactcactatagggtgctgctgcccttgcggtgggcagctgcacaacagaggagagtgcagatgcccaccgcaaacctggcggcagcgcaaaagatg

SEQ ID NO: 120281 - DNA, 103 bp, Artificial Sequence
  Synthetic Polynucleotide
taatacgactcactatagggggctcattgctgctgctgcccttgcggtggaacagaggagaccaccgatggggcagcagaacctggcggcagcgcaaaagatg

SEQ ID NO: 120282 - DNA, 103 bp, Artificial Sequence
  Synthetic Polynucleotide
taatacgactcactataggggtcagaggaaggctcattgctgctgctgccaacagaggagaggcagcatgagcaatgagaacctggcggcagcgcaaaagatg

SEQ ID NO: 120283 - DNA, 103 bp, Artificial Sequence
  Synthetic Polynucleotide
taatacgactcactatagggcaggcgagcccatgctggagaaggagtctgaacagaggagacagactatgtctccagcaaacctggcggcagcgcaaaagatg

SEQ ID NO: 120284 - DNA, 103 bp, Artificial Sequence
  Synthetic Polynucleotide
taatacgactcactatagggagctgagcgagtcagaggaaggctcattgcaacagaggagagcaatgatgcttcctctgaacctggcggcagcgcaaaagatg

SEQ ID NO: 120285 - DNA, 103 bp, Artificial Sequence
  Synthetic Polynucleotide
taatacgactcactatagggagcgtgggtgagctgagcgagtcagaggaaaacagaggagattcctcatgctcgctcagaacctggcggcagcgcaaaagatg

SEQ ID NO: 120286 - DNA, 103 bp, Artificial Sequence
  Synthetic Polynucleotide
taatacgactcactatagggcagggccagcagcgtgggtgagctgagcgaaacagaggagatcgctcatgtcacccacgaacctggcggcagcgcaaaagatg

SEQ ID NO: 120287 - DNA, 103 bp, Artificial Sequence
  Synthetic Polynucleotide
taatacgactcactatagggtgcgcgttgacaggcgagcccatgctggagaacagaggagactccagatggggctcgccaacctggcggcagcgcaaaagatg

SEQ ID NO: 120288 - DNA, 103 bp, Artificial Sequence
  Synthetic Polynucleotide
taatacgactcactataggggcagaagtcctgcgcgttgacaggcgagccaacagaggagaggctcgatggtcaacgcgaacctggcggcagcgcaaaagatg

SEQ ID NO: 120289 - DNA, 103 bp, Artificial Sequence
  Synthetic Polynucleotide
taatacgactcactatagggccaggtccgtgcagaagtcctgcgcgttgaaacagaggagatcaacgatgaggacttctaacctggcggcagcgcaaaagatg

SEQ ID NO: 120290 - DNA, 103 bp, Artificial Sequence
  Synthetic Polynucleotide
taatacgactcactatagggctggagacggccaggtccgtgcagaagtccaacagaggagaggacttatgcacggacctaacctggcggcagcgcaaaagatg

SEQ ID NO: 120291 - DNA, 103 bp, Artificial Sequence
  Synthetic Polynucleotide
taatacgactcactataggggaagttggcactggagacggccaggtccgtaacagaggagaacggacatggccgtctccaacctggcggcagcgcaaaagatg

SEQ ID NO: 120292 - DNA, 103 bp, Artificial Sequence
  Synthetic Polynucleotide
taatacgactcactatagggccgtgggaatgaagttggcactggagacggaacagaggagaccgtctatggtgccaactaacctggcggcagcgcaaaagatg

SEQ ID NO: 120293 - DNA, 103 bp, Artificial Sequence
  Synthetic Polynucleotide
taatacgactcactatagggatggcagtgaccgtgggaatgaagttggcaaacagaggagatgccaaatgcattcccacaacctggcggcagcgcaaaagatg

SEQ ID NO: 120294 - DNA, 103 bp, Artificial Sequence
  Synthetic Polynucleotide
taatacgactcactatagggactggtcgagatggcagtgaccgtgggaataacagaggagaattcccatggtcactgccaacctggcggcagcgcaaaagatg

SEQ ID NO: 120295 - DNA, 103 bp, Artificial Sequence
  Synthetic Polynucleotide
taatacgactcactatagggatgacgcctcgtagtctgcgttgaagcccgaacagaggagacgggctatgacgcagactaacctggcggcagcgcaaaagatg

SEQ ID NO: 120296 - DNA, 103 bp, Artificial Sequence
  Synthetic Polynucleotide
taatacgactcactataggggcaggtccggactggtcgagatggcagtgaaacagaggagatcactgatgtctcgaccaaacctggcggcagcgcaaaagatg

SEQ ID NO: 120297 - DNA, 103 bp, Artificial Sequence
  Synthetic Polynucleotide
taatacgactcactatagggaccagccactgcaggtccggactggtcgagaacagaggagactcgacatgtccggacctaacctggcggcagcgcaaaagatg

SEQ ID NO: 120298 - DNA, 103 bp, Artificial Sequence
  Synthetic Polynucleotide
taatacgactcactatagggggcgggctgcaccagccactgcaggtccggaacagaggagaccggacatgcagtggctgaacctggcggcagcgcaaaagatg

SEQ ID NO: 120299 - DNA, 103 bp, Artificial Sequence
  Synthetic Polynucleotide
taatacgactcactatagggaggagacgagggcgggctgcaccagccactaacagaggagaagtggcatgtgcagcccgaacctggcggcagcgcaaaagatg

SEQ ID NO: 120300 - DNA, 103 bp, Artificial Sequence
  Synthetic Polynucleotide
taatacgactcactatagggggggccacggaggagacgagggcgggctgcaacagaggagagcagccatgcctcgtctcaacctggcggcagcgcaaaagatg

SEQ ID NO: 120301 - DNA, 103 bp, Artificial Sequence
  Synthetic Polynucleotide
taatacgactcactatagggggtctgcgatggggccacggaggagacgagaacagaggagactcgtcatgtccgtggccaacctggcggcagcgcaaaagatg

SEQ ID NO: 120302 - DNA, 103 bp, Artificial Sequence
  Synthetic Polynucleotide
taatacgactcactataggggaggggctctggtctgcgatggggccacggaacagaggagaccgtggatgcatcgcagaaacctggcggcagcgcaaaagatg

SEQ ID NO: 120303 - DNA, 103 bp, Artificial Sequence
  Synthetic Polynucleotide
taatacgactcactatagggccgaaagggtgaggggctctggtctgcgataacagaggagaatcgcaatgcagagccccaacctggcggcagcgcaaaagatg

SEQ ID NO: 120304 - DNA, 103 bp, Artificial Sequence
  Synthetic Polynucleotide
taatacgactcactatagggggcggggactccgaaagggtgaggggctctaacagaggagaagagccatgcaccctttcaacctggcggcagcgcaaaagatg

SEQ ID NO: 120305 - DNA, 103 bp, Artificial Sequence
  Synthetic Polynucleotide
taatacgactcactatagggcagcggagggggcggggactccgaaagggtaacagaggagaacccttatggagtccccgaacctggcggcagcgcaaaagatg

SEQ ID NO: 120306 - DNA, 103 bp, Artificial Sequence
  Synthetic Polynucleotide
taatacgactcactatagggcagcgggaggatgacgcctcgtagtctgcgaacagaggagacgcagaatgcgaggcgtcaacctggcggcagcgcaaaagatg

SEQ ID NO: 120307 - DNA, 103 bp, Artificial Sequence
  Synthetic Polynucleotide
taatacgactcactataggggagtaagccccagcggagggggcggggactaacagaggagaagtcccatgcccctccgcaacctggcggcagcgcaaaagatg

SEQ ID NO: 120308 - DNA, 103 bp, Artificial Sequence
  Synthetic Polynucleotide
taatacgactcactataggggccagccctggagtaagccccagcggagggaacagaggagaccctccatgggggcttacaacctggcggcagcgcaaaagatg

SEQ ID NO: 120309 - DNA, 103 bp, Artificial Sequence
  Synthetic Polynucleotide
taatacgactcactatagggtcttcacaacgccagccctggagtaagcccaacagaggagagggcttatgccagggctgaacctggcggcagcgcaaaagatg

SEQ ID NO: 120310 - DNA, 103 bp, Artificial Sequence
  Synthetic Polynucleotide
taatacgactcactatagggcctgtcatggtcttcacaacgccagccctgaacagaggagacagggcatgcgttgtgaaaacctggcggcagcgcaaaagatg

SEQ ID NO: 120311 - DNA, 103 bp, Artificial Sequence
  Synthetic Polynucleotide
taatacgactcactatagggcgctcggcctcctgtcatggtcttcacaacaacagaggagagttgtgatgaccatgacaaacctggcggcagcgcaaaagatg

SEQ ID NO: 120312 - DNA, 103 bp, Artificial Sequence
  Synthetic Polynucleotide
taatacgactcactatagggcaatgctctgcgctcggcctcctgtcatggaacagaggagaccatgaatggaggccgagaacctggcggcagcgcaaaagatg

SEQ ID NO: 120313 - DNA, 103 bp, Artificial Sequence
  Synthetic Polynucleotide
taatacgactcactatagggcccctcctgccaatgctctgcgctcggcctaacagaggagaaggccgatggcagagcataacctggcggcagcgcaaaagatg

SEQ ID NO: 120314 - DNA, 103 bp, Artificial Sequence
  Synthetic Polynucleotide
taatacgactcactatagggttccaccttgcccctcctgccaatgctctgaacagaggagacagagcatgggcaggaggaacctggcggcagcgcaaaagatg

SEQ ID NO: 120315 - DNA, 103 bp, Artificial Sequence
  Synthetic Polynucleotide
taatacgactcactataggggagataactgttccaccttgcccctcctgcaacagaggagagcaggaatggcaaggtggaacctggcggcagcgcaaaagatg

SEQ ID NO: 120316 - DNA, 103 bp, Artificial Sequence
  Synthetic Polynucleotide
taatacgactcactatagggtcttcttctggagataactgttccaccttgaacagaggagacaaggtatgacagttatcaacctggcggcagcgcaaaagatg

SEQ ID NO: 120317 - DNA, 103 bp, Artificial Sequence
  Synthetic Polynucleotide
taatacgactcactatagggcgcgctgctgcagcgggaggatgacgcctcaacagaggagagaggcgatgtcctcccgcaacctggcggcagcgcaaaagatg

SEQ ID NO: 120318 - DNA, 103 bp, Artificial Sequence
  Synthetic Polynucleotide
taatacgactcactatagggccttttctcttcttcttctggagataactgaacagaggagacagttaatgccagaagaaaacctggcggcagcgcaaaagatg

SEQ ID NO: 120319 - DNA, 103 bp, Artificial Sequence
  Synthetic Polynucleotide
taatacgactcactatagggttcggattctccttttctcttcttcttctgaacagaggagacagaagatgaagagaaaaaacctggcggcagcgcaaaagatg

SEQ ID NO: 120320 - DNA, 103 bp, Artificial Sequence
  Synthetic Polynucleotide
taatacgactcactatagggttcctttcccttcggattctccttttctctaacagaggagaagagaaatggagaatccgaacctggcggcagcgcaaaagatg

SEQ ID NO: 120321 - DNA, 103 bp, Artificial Sequence
  Synthetic Polynucleotide
taatacgactcactatagggagccatcttattcctttcccttcggattctaacagaggagaagaatcatgagggaaaggaacctggcggcagcgcaaaagatg

SEQ ID NO: 120322 - DNA, 103 bp, Artificial Sequence
  Synthetic Polynucleotide
taatacgactcactatagggatttggctgcagccatcttattcctttcccaacagaggagagggaaaatgataagatggaacctggcggcagcgcaaaagatg

SEQ ID NO: 120323 - DNA, 103 bp, Artificial Sequence
  Synthetic Polynucleotide
taatacgactcactatagggcggttgcggcatttggctgcagccatcttaaacagaggagataagatatgtgcagccaaaacctggcggcagcgcaaaagatg

SEQ ID NO: 120324 - DNA, 103 bp, Artificial Sequence
  Synthetic Polynucleotide
taatacgactcactatagggctccctcctccggttgcggcatttggctgcaacagaggagagcagccatgtgccgcaacaacctggcggcagcgcaaaagatg

SEQ ID NO: 120325 - DNA, 103 bp, Artificial Sequence
  Synthetic Polynucleotide
taatacgactcactatagggtatcagtcagctccctcctccggttgcggcaacagaggagagccgcaatgggaggagggaacctggcggcagcgcaaaagatg

SEQ ID NO: 120326 - DNA, 103 bp, Artificial Sequence
  Synthetic Polynucleotide
taatacgactcactataggggcttggagtgtatcagtcagctccctcctcaacagaggagagaggagatggctgactgaaacctggcggcagcgcaaaagatg

SEQ ID NO: 120327 - DNA, 103 bp, Artificial Sequence
  Synthetic Polynucleotide
taatacgactcactataggggtctgtctccgcttggagtgtatcagtcagaacagaggagactgactatgacactccaaaacctggcggcagcgcaaaagatg

SEQ ID NO: 120328 - DNA, 103 bp, Artificial Sequence
  Synthetic Polynucleotide
taatacgactcactatagggcggccggggacgcgctgctgcagcgggaggaacagaggagacctcccatggcagcagcgaacctggcggcagcgcaaaagatg

SEQ ID NO: 120329 - DNA, 103 bp, Artificial Sequence
  Synthetic Polynucleotide
taatacgactcactatagggcttctagttggtctgtctccgcttggagtgaacagaggagacactccatgcggagacagaacctggcggcagcgcaaaagatg

SEQ ID NO: 120330 - DNA, 103 bp, Artificial Sequence
  Synthetic Polynucleotide
taatacgactcactataggggacttctcatcttctagttggtctgtctccaacagaggagaggagacatgccaactagaaacctggcggcagcgcaaaagatg

SEQ ID NO: 120331 - DNA, 103 bp, Artificial Sequence
  Synthetic Polynucleotide
taatacgactcactatagggctgcaaagcagacttctcatcttctagttgaacagaggagacaactaatggatgagaagaacctggcggcagcgcaaaagatg

SEQ ID NO: 120332 - DNA, 103 bp, Artificial Sequence
  Synthetic Polynucleotide
taatacgactcactatagggcaatctcggtctgcaaagcagacttctcataacagaggagaatgagaatgctgctttgcaacctggcggcagcgcaaaagatg

SEQ ID NO: 120333 - DNA, 103 bp, Artificial Sequence
  Synthetic Polynucleotide
taatacgactcactatagggagcaggttggcaatctcggtctgcaaagcaaacagaggagatgctttatggaccgagataacctggcggcagcgcaaaagatg

SEQ ID NO: 120334 - DNA, 103 bp, Artificial Sequence
  Synthetic Polynucleotide
taatacgactcactatagggcttctccttcagcaggttggcaatctcggtaacagaggagaaccgagatggccaacctgaacctggcggcagcgcaaaagatg

SEQ ID NO: 120335 - DNA, 103 bp, Artificial Sequence
  Synthetic Polynucleotide
taatacgactcactatagggctagtttttccttctccttcagcaggttggaacagaggagaccaaccatgtgaaggagaaacctggcggcagcgcaaaagatg

SEQ ID NO: 120336 - DNA, 103 bp, Artificial Sequence
  Synthetic Polynucleotide
taatacgactcactatagggaggatgaactctagtttttccttctccttcaacagaggagagaaggaatgggaaaaactaacctggcggcagcgcaaaagatg

SEQ ID NO: 120337 - DNA, 103 bp, Artificial Sequence
  Synthetic Polynucleotide
taatacgactcactataggggtgagctgccaggatgaactctagtttttcaacagaggagagaaaaaatggagttcatcaacctggcggcagcgcaaaagatg

SEQ ID NO: 120338 - DNA, 103 bp, Artificial Sequence
  Synthetic Polynucleotide
taatacgactcactatagggaggcaggtcggtgagctgccaggatgaactaacagaggagaagttcaatgtggcagctcaacctggcggcagcgcaaaagatg

SEQ ID NO: 120339 - DNA, 103 bp, Artificial Sequence
  Synthetic Polynucleotide
taatacgactcactatagggaggctatccccggccggggacgcgctgctgaacagaggagacagcagatggtccccggcaacctggcggcagcgcaaaagatg

SEQ ID NO: 120340 - DNA, 103 bp, Artificial Sequence
  Synthetic Polynucleotide
taatacgactcactataggggggatcttgcaggcaggtcggtgagctgccaacagaggagaggcagcatgccgacctgcaacctggcggcagcgcaaaagatg

SEQ ID NO: 120341 - DNA, 103 bp, Artificial Sequence
  Synthetic Polynucleotide
taatacgactcactatagggcaggtcatcagggatcttgcaggcaggtcgaacagaggagacgacctatgtgcaagatcaacctggcggcagcgcaaaagatg

SEQ ID NO: 120342 - DNA, 103 bp, Artificial Sequence
  Synthetic Polynucleotide
taatacgactcactatagggctgggaagcccaggtcatcagggatcttgcaacagaggagagcaagaatgctgatgaccaacctggcggcagcgcaaaagatg

SEQ ID NO: 120343 - DNA, 103 bp, Artificial Sequence
  Synthetic Polynucleotide
taatacgactcactataggggacatctcttctgggaagcccaggtcatcaaacagaggagatgatgaatggggcttcccaacctggcggcagcgcaaaagatg

SEQ ID NO: 120344 - DNA, 103 bp, Artificial Sequence
  Synthetic Polynucleotide
taatacgactcactatagggggaagccacagacatctcttctgggaagccaacagaggagaggcttcatggaagagatgaacctggcggcagcgcaaaagatg

SEQ ID NO: 120345 - DNA, 103 bp, Artificial Sequence
  Synthetic Polynucleotide
taatacgactcactatagggtcagatcaagggaagccacagacatctcttaacagaggagaaagagaatgctgtggcttaacctggcggcagcgcaaaagatg

SEQ ID NO: 120346 - DNA, 103 bp, Artificial Sequence
  Synthetic Polynucleotide
taatacgactcactatagggaggcccccagtcagatcaagggaagccacaaacagaggagatgtggcatgccttgatctaacctggcggcagcgcaaaagatg

SEQ ID NO: 120347 - DNA, 103 bp, Artificial Sequence
  Synthetic Polynucleotide
taatacgactcactatagggaacctctggcaggcccccagtcagatcaagaacagaggagacttgatatgactgggggcaacctggcggcagcgcaaaagatg

SEQ ID NO: 120348 - DNA, 103 bp, Artificial Sequence
  Synthetic Polynucleotide
taatacgactcactatagggccggggtggcaacctctggcaggcccccagaacagaggagactggggatgtgccagaggaacctggcggcagcgcaaaagatg

SEQ ID NO: 120349 - DNA, 103 bp, Artificial Sequence
  Synthetic Polynucleotide
taatacgactcactatagggtcctcagactccggggtggcaacctctggcaacagaggagagccagaatgtgccaccccaacctggcggcagcgcaaaagatg

SEQ ID NO: 120350 - DNA, 103 bp, Artificial Sequence
  Synthetic Polynucleotide
taatacgactcactataggggtagtaagagaggctatccccggccggggaaacagaggagatccccgatgggggatagcaacctggcggcagcgcaaaagatg

SEQ ID NO: 120351 - DNA, 103 bp, Artificial Sequence
  Synthetic Polynucleotide
taatacgactcactatagggggtgaaggcctcctcagactccggggtggcaacagaggagagccaccatggagtctgagaacctggcggcagcgcaaaagatg

SEQ ID NO: 120352 - DNA, 103 bp, Artificial Sequence
  Synthetic Polynucleotide
taatacgactcactatagggggagaggcagggtgaaggcctcctcagactaacagaggagaagtctgatgaggccttcaaacctggcggcagcgcaaaagatg

SEQ ID NO: 120353 - DNA, 103 bp, Artificial Sequence
  Synthetic Polynucleotide
taatacgactcactataggggggtcattgaggagaggcagggtgaaggccaacagaggagaggccttatgcctgcctctaacctggcggcagcgcaaaagatg

SEQ ID NO: 120354 - DNA, 103 bp, Artificial Sequence
  Synthetic Polynucleotide
taatacgactcactatagggcttgggctcagggtcattgaggagaggcagaacagaggagactgcctatgctcaatgacaacctggcggcagcgcaaaagatg

SEQ ID NO: 120355 - DNA, 103 bp, Artificial Sequence
  Synthetic Polynucleotide
taatacgactcactatagggccactgagggcttgggctcagggtcattgaaacagaggagatcaatgatgctgagcccaaacctggcggcagcgcaaaagatg

SEQ ID NO: 120356 - DNA, 103 bp, Artificial Sequence
  Synthetic Polynucleotide
taatacgactcactatagggttgacaggttccactgagggcttgggctcaaacagaggagatgagccatggccctcagtaacctggcggcagcgcaaaagatg

SEQ ID NO: 120357 - DNA, 103 bp, Artificial Sequence
  Synthetic Polynucleotide
taatacgactcactataggggctgatgctcttgacaggttccactgagggaacagaggagaccctcaatggaacctgtcaacctggcggcagcgcaaaagatg

SEQ ID NO: 120358 - DNA, 103 bp, Artificial Sequence
  Synthetic Polynucleotide
taatacgactcactataggggctccatgctgctgatgctcttgacaggttaacagaggagaaacctgatgagagcatcaaacctggcggcagcgcaaaagatg

SEQ ID NO: 120359 - DNA, 103 bp, Artificial Sequence
  Synthetic Polynucleotide
taatacgactcactatagggtcggtcttcagctccatgctgctgatgctcaacagaggagagagcatatgcagcatggaaacctggcggcagcgcaaaagatg

SEQ ID NO: 120360 - DNA, 103 bp, Artificial Sequence
  Synthetic Polynucleotide
taatacgactcactatagggatcaaagggctcggtcttcagctccatgctaacagaggagaagcatgatgctgaagaccaacctggcggcagcgcaaaagatg

SEQ ID NO: 120361 - DNA, 103 bp, Artificial Sequence
  Synthetic Polynucleotide
taatacgactcactatagggcgggtgagtggtagtaagagaggctatcccaacagaggagagggataatgtctcttactaacctggcggcagcgcaaaagatg

SEQ ID NO: 120362 - DNA, 103 bp, Artificial Sequence
  Synthetic Polynucleotide
taatacgactcactatagggacaggaagtcatcaaagggctcggtcttcaaacagaggagatgaagaatgagccctttgaacctggcggcagcgcaaaagatg

SEQ ID NO: 120363 - DNA, 103 bp, Artificial Sequence
  Synthetic Polynucleotide
taatacgactcactataggggatgctgggaacaggaagtcatcaaagggcaacagaggagagcccttatgtgacttcctaacctggcggcagcgcaaaagatg

SEQ ID NO: 120364 - DNA, 103 bp, Artificial Sequence
  Synthetic Polynucleotide
taatacgactcactataggggggcctggatgatgctgggaacaggaagtcaacagaggagagacttcatgttcccagcaaacctggcggcagcgcaaaagatg

SEQ ID NO: 120365 - DNA, 103 bp, Artificial Sequence
  Synthetic Polynucleotide
taatacgactcactatagggcagagccactgggcctggatgatgctgggaaacagaggagatcccagatgcatccaggcaacctggcggcagcgcaaaagatg

SEQ ID NO: 120366 - DNA, 103 bp, Artificial Sequence
  Synthetic Polynucleotide
taatacgactcactatagggcgggctgtctcagagccactgggcctggataacagaggagaatccagatgcagtggctcaacctggcggcagcgcaaaagatg

SEQ ID NO: 120367 - DNA, 103 bp, Artificial Sequence
  Synthetic Polynucleotide
taatacgactcactatagggtggcacggagcgggctgtctcagagccactaacagaggagaagtggcatggagacagccaacctggcggcagcgcaaaagatg

SEQ ID NO: 120368 - DNA, 103 bp, Artificial Sequence
  Synthetic Polynucleotide
taatacgactcactatagggggtccatgtctggcacggagcgggctgtctaacagaggagaagacagatggctccgtgcaacctggcggcagcgcaaaagatg

SEQ ID NO: 120369 - DNA, 103 bp, Artificial Sequence
  Synthetic Polynucleotide
taatacgactcactataggggacccagataggtccatgtctggcacggagaacagaggagactccgtatgagacatggaaacctggcggcagcgcaaaagatg

SEQ ID NO: 120370 - DNA, 103 bp, Artificial Sequence
  Synthetic Polynucleotide
taatacgactcactatagggtgcatagaaggacccagataggtccatgtcaacagaggagagacatgatgctatctgggaacctggcggcagcgcaaaagatg

SEQ ID NO: 120371 - DNA, 103 bp, Artificial Sequence
  Synthetic Polynucleotide
taatacgactcactatagggcccagtctgctgcatagaaggacccagataaacagaggagatatctgatgccttctatgaacctggcggcagcgcaaaagatg

SEQ ID NO: 120372 - DNA, 103 bp, Artificial Sequence
  Synthetic Polynucleotide
taatacgactcactatagggaaggagtctgcgggtgagtggtagtaagagaacagaggagactcttaatgccactcaccaacctggcggcagcgcaaaagatg

SEQ ID NO: 120373 - DNA, 103 bp, Artificial Sequence
  Synthetic Polynucleotide
taatacgactcactatagggtgcagaggctcccagtctgctgcatagaagaacagaggagacttctaatgagcagactgaacctggcggcagcgcaaaagatg

SEQ ID NO: 120374 - DNA, 103 bp, Artificial Sequence
  Synthetic Polynucleotide
taatacgactcactatagggggagccactgtgcagaggctcccagtctgcaacagaggagagcagacatggagcctctgaacctggcggcagcgcaaaagatg

SEQ ID NO: 120375 - DNA, 103 bp, Artificial Sequence
  Synthetic Polynucleotide
taatacgactcactatagggccatccccagggagccactgtgcagaggctaacagaggagaagcctcatgacagtggctaacctggcggcagcgcaaaagatg

SEQ ID NO: 120376 - DNA, 103 bp, Artificial Sequence
  Synthetic Polynucleotide
taatacgactcactataggggccatgggccccatccccagggagccactgaacagaggagacagtggatgcctggggataacctggcggcagcgcaaaagatg

SEQ ID NO: 120377 - DNA, 103 bp, Artificial Sequence
  Synthetic Polynucleotide
taatacgactcactatagggcagctctgtggccatgggccccatccccagaacagaggagactggggatggggcccatgaacctggcggcagcgcaaaagatg

SEQ ID NO: 120378 - DNA, 103 bp, Artificial Sequence
  Synthetic Polynucleotide
taatacgactcactatagggacaggggctccagctctgtggccatgggccaacagaggagaggcccaatgccacagagcaacctggcggcagcgcaaaagatg

SEQ ID NO: 120379 - DNA, 103 bp, Artificial Sequence
  Synthetic Polynucleotide
taatacgactcactatagggaccggagtgcacaggggctccagctctgtgaacagaggagacacagaatgggagcccctaacctggcggcagcgcaaaagatg

SEQ ID NO: 120380 - DNA, 103 bp, Artificial Sequence
  Synthetic Polynucleotide
taatacgactcactatagggacaggtgaccaccggagtgcacaggggctcaacagaggagagagcccatgtgcactccgaacctggcggcagcgcaaaagatg

SEQ ID NO: 120381 - DNA, 103 bp, Artificial Sequence
  Synthetic Polynucleotide
taatacgactcactatagggagctgggagtacaggtgaccaccggagtgcaacagaggagagcactcatgtggtcacctaacctggcggcagcgcaaaagatg

SEQ ID NO: 120382 - DNA, 103 bp, Artificial Sequence
  Synthetic Polynucleotide
taatacgactcactatagggtaagcagtgcagctgggagtacaggtgaccaacagaggagaggtcacatgtactcccagaacctggcggcagcgcaaaagatg

SEQ ID NO: 120383 - DNA, 103 bp, Artificial Sequence
  Synthetic Polynucleotide
taatacgactcactataggggtcgtagtctccggggaaagcctgaaacataacagaggagaatgtttatggctttccccaacctggcggcagcgcaaaagatg

SEQ ID NO: 120384 - DNA, 103 bp, Artificial Sequence
  Synthetic Polynucleotide
taatacgactcactatagggggcggcggcggtgggtggactgccgaaggaaacagaggagatccttcatgagtccacccaacctggcggcagcgcaaaagatg

SEQ ID NO: 120385 - DNA, 103 bp, Artificial Sequence
  Synthetic Polynucleotide
taatacgactcactatagggactcctgggaggcggcggcggtgggtggacaacagaggagagtccacatgccgccgccgaacctggcggcagcgcaaaagatg

SEQ ID NO: 120386 - DNA, 103 bp, Artificial Sequence
  Synthetic Polynucleotide
taatacgactcactatagggagaccggcgcactcctgggaggcggcggcgaacagaggagacgccgcatgctcccaggaaacctggcggcagcgcaaaagatg

SEQ ID NO: 120387 - DNA, 103 bp, Artificial Sequence
  Synthetic Polynucleotide
taatacgactcactatagggcatttccccgagaccggcgcactcctgggaaacagaggagatcccagatgtgcgccggtaacctggcggcagcgcaaaagatg

SEQ ID NO: 120388 - DNA, 103 bp, Artificial Sequence
  Synthetic Polynucleotide
taatacgactcactatagggaggaaccgggcatttccccgagaccggcgcaacagaggagagcgccgatgtcggggaaaaacctggcggcagcgcaaaagatg

SEQ ID NO: 120389 - DNA, 103 bp, Artificial Sequence
  Synthetic Polynucleotide
taatacgactcactataggggtgggcacgaaggaaccgggcatttccccgaacagaggagacggggaatggcccggttcaacctggcggcagcgcaaaagatg

SEQ ID NO: 120390 - DNA, 103 bp, Artificial Sequence
  Synthetic Polynucleotide
taatacgactcactatagggcgcggtgaccgtgggcacgaaggaaccgggaacagaggagacccggtatgttcgtgcccaacctggcggcagcgcaaaagatg

SEQ ID NO: 120391 - DNA, 103 bp, Artificial Sequence
  Synthetic Polynucleotide
taatacgactcactatagggtggttgtgatcgcggtgaccgtgggcacgaaacagaggagatcgtgcatgcggtcaccgaacctggcggcagcgcaaaagatg

SEQ ID NO: 120392 - DNA, 103 bp, Artificial Sequence
  Synthetic Polynucleotide
taatacgactcactatagggaggtcctggctggttgtgatcgcggtgaccaacagaggagaggtcacatggatcacaacaacctggcggcagcgcaaaagatg

SEQ ID NO: 120393 - DNA, 103 bp, Artificial Sequence
  Synthetic Polynucleotide
taatacgactcactatagggaagccactggaggtcctggctggttgtgataacagaggagaatcacaatgagccaggacaacctggcggcagcgcaaaagatg

SEQ ID NO: 120394 - DNA, 103 bp, Artificial Sequence
  Synthetic Polynucleotide
taatacgactcactataggggggagccggagtcgtagtctccggggaaagaacagaggagactttccatggagactacgaacctggcggcagcgcaaaagatg

SEQ ID NO: 120395 - DNA, 103 bp, Artificial Sequence
  Synthetic Polynucleotide
taatacgactcactatagggtgggttgcacaagccactggaggtcctggcaacagaggagagccaggatgtccagtggcaacctggcggcagcgcaaaagatg

SEQ ID NO: 120396 - DNA, 103 bp, Artificial Sequence
  Synthetic Polynucleotide
taatacgactcactataggggagatgagggtgggttgcacaagccactggaacagaggagaccagtgatgtgtgcaaccaacctggcggcagcgcaaaagatg

SEQ ID NO: 120397 - DNA, 103 bp, Artificial Sequence
  Synthetic Polynucleotide
taatacgactcactatagggggccatggaagagatgagggtgggttgcacaacagaggagagtgcaaatgaccctcatcaacctggcggcagcgcaaaagatg

SEQ ID NO: 120398 - DNA, 103 bp, Artificial Sequence
  Synthetic Polynucleotide
taatacgactcactatagggcctgggactgggccatggaagagatgagggaacagaggagaccctcaatgcttccatggaacctggcggcagcgcaaaagatg

SEQ ID NO: 120399 - DNA, 103 bp, Artificial Sequence
  Synthetic Polynucleotide
taatacgactcactatagggagtggctgcccctgggactgggccatggaaaacagaggagattccatatgccagtcccaaacctggcggcagcgcaaaagatg

SEQ ID NO: 120400 - DNA, 103 bp, Artificial Sequence
  Synthetic Polynucleotide
taatacgactcactatagggctgggaggccagtggctgcccctgggactgaacagaggagacagtccatggggcagccaaacctggcggcagcgcaaaagatg

SEQ ID NO: 120401 - DNA, 103 bp, Artificial Sequence
  Synthetic Polynucleotide
taatacgactcactatagggcgaccgggggctgggaggccagtggctgccaacagaggagaggcagcatgtggcctcccaacctggcggcagcgcaaaagatg

SEQ ID NO: 120402 - DNA, 103 bp, Artificial Sequence
  Synthetic Polynucleotide
taatacgactcactatagggtaggggtcgacgaccgggggctgggaggccaacagaggagaggcctcatggcccccggtaacctggcggcagcgcaaaagatg

SEQ ID NO: 120403 - DNA, 103 bp, Artificial Sequence
  Synthetic Polynucleotide
taatacgactcactatagggcggcatgtcgtaggggtcgacgaccgggggaacagaggagacccccgatggtcgaccccaacctggcggcagcgcaaaagatg

SEQ ID NO: 120404 - DNA, 103 bp, Artificial Sequence
  Synthetic Polynucleotide
taatacgactcactatagggagctggttcccggcatgtcgtaggggtcgaaacagaggagatcgaccatgacgacatgcaacctggcggcagcgcaaaagatg

SEQ ID NO: 120405 - DNA, 103 bp, Artificial Sequence
  Synthetic Polynucleotide
taatacgactcactataggggagctgcaccgggagccggagtcgtagtctaacagaggagaagactaatgctccggctcaacctggcggcagcgcaaaagatg

SEQ ID NO: 120406 - DNA, 103 bp, Artificial Sequence
  Synthetic Polynucleotide
taatacgactcactatagggggtgtggagtagctggttcccggcatgtcgaacagaggagacgacatatggggaaccagaacctggcggcagcgcaaaagatg

SEQ ID NO: 120407 - DNA, 103 bp, Artificial Sequence
  Synthetic Polynucleotide
taatacgactcactatagggactcatgcctggtgtggagtagctggttccaacagaggagaggaaccatgtactccacaaacctggcggcagcgcaaaagatg

SEQ ID NO: 120408 - DNA, 103 bp, Artificial Sequence
  Synthetic Polynucleotide
taatacgactcactatagggtgctgtagccactcatgcctggtgtggagtaacagaggagaactccaatgcaggcatgaaacctggcggcagcgcaaaagatg

SEQ ID NO: 120409 - DNA, 103 bp, Artificial Sequence
  Synthetic Polynucleotide
taatacgactcactataggggctccgccactgctgtagccactcatgcctaacagaggagaaggcatatgtggctacagaacctggcggcagcgcaaaagatg

SEQ ID NO: 120410 - DNA, 103 bp, Artificial Sequence
  Synthetic Polynucleotide
taatacgactcactatagggactgccactcgctccgccactgctgtagccaacagaggagaggctacatgagtggcggaaacctggcggcagcgcaaaagatg

SEQ ID NO: 120411 - DNA, 103 bp, Artificial Sequence
  Synthetic Polynucleotide
taatacgactcactatagggaaggcccaccactgccactcgctccgccacaacagaggagagtggcgatgcgagtggcaaacctggcggcagcgcaaaagatg

SEQ ID NO: 120412 - DNA, 103 bp, Artificial Sequence
  Synthetic Polynucleotide
taatacgactcactatagggccgctggtggaaggcccaccactgccactcaacagaggagagagtggatgtggtgggccaacctggcggcagcgcaaaagatg

SEQ ID NO: 120413 - DNA, 103 bp, Artificial Sequence
  Synthetic Polynucleotide
taatacgactcactatagggactggtagttccgctggtggaaggcccaccaacagaggagaggtgggatgtccaccagcaacctggcggcagcgcaaaagatg

SEQ ID NO: 120414 - DNA, 103 bp, Artificial Sequence
  Synthetic Polynucleotide
taatacgactcactataggggcccaggcccactggtagttccgctggtggaacagaggagaccaccaatggaactaccaaacctggcggcagcgcaaaagatg

SEQ ID NO: 120415 - DNA, 103 bp, Artificial Sequence
  Synthetic Polynucleotide
taatacgactcactataggggggcgggcaggcccaggcccactggtagttaacagaggagaaactacatgtgggcctggaacctggcggcagcgcaaaagatg

SEQ ID NO: 120416 - DNA, 103 bp, Artificial Sequence
  Synthetic Polynucleotide
taatacgactcactatagggagagggtgaggagctgcaccgggagccggaaacagaggagatccggcatgcggtgcagcaacctggcggcagcgcaaaagatg

SEQ ID NO: 120417 - DNA, 103 bp, Artificial Sequence
  Synthetic Polynucleotide
taatacgactcactatagggggctcgggctgggcgggcaggcccaggcccaacagaggagagggcctatgcctgcccgcaacctggcggcagcgcaaaagatg

SEQ ID NO: 120418 - DNA, 103 bp, Artificial Sequence
  Synthetic Polynucleotide
taatacgactcactatagggtcctaggccgggctcgggctgggcgggcagaacagaggagactgcccatgcagcccgagaacctggcggcagcgcaaaagatg

SEQ ID NO: 120419 - DNA, 103 bp, Artificial Sequence
  Synthetic Polynucleotide
taatacgactcactatagggtctcggggtctcctaggccgggctcgggctaacagaggagaagcccgatgccggcctagaacctggcggcagcgcaaaagatg

SEQ ID NO: 120420 - DNA, 103 bp, Artificial Sequence
  Synthetic Polynucleotide
taatacgactcactataggggagcgtctcctctcggggtctcctaggccgaacagaggagacggcctatgagaccccgaaacctggcggcagcgcaaaagatg

SEQ ID NO: 120421 - DNA, 103 bp, Artificial Sequence
  Synthetic Polynucleotide
taatacgactcactatagggcctctggggtgagcgtctcctctcggggtcaacagaggagagaccccatgaggagacgcaacctggcggcagcgcaaaagatg

SEQ ID NO: 120422 - DNA, 103 bp, Artificial Sequence
  Synthetic Polynucleotide
taatacgactcactatagggttctcctcttcctctggggtgagcgtctccaacagaggagaggagacatgcaccccagaaacctggcggcagcgcaaaagatg

SEQ ID NO: 120423 - DNA, 103 bp, Artificial Sequence
  Synthetic Polynucleotide
taatacgactcactatagggcacccttcgcttctcctcttcctctggggtaacagaggagaaccccaatggaagaggagaacctggcggcagcgcaaaagatg

SEQ ID NO: 120424 - DNA, 103 bp, Artificial Sequence
  Synthetic Polynucleotide
taatacgactcactataggggttcccggcgcacccttcgcttctcctcttaacagaggagaaagaggatgagcgaagggaacctggcggcagcgcaaaagatg

SEQ ID NO: 120425 - DNA, 103 bp, Artificial Sequence
  Synthetic Polynucleotide
taatacgactcactatagggagtttatttcgttcccggcgcacccttcgcaacagaggagagcgaagatggcgccgggaaacctggcggcagcgcaaaagatg

SEQ ID NO: 120426 - DNA, 103 bp, Artificial Sequence
  Synthetic Polynucleotide
taatacgactcactatagggagctgctgctagtttatttcgttcccggcgaacagaggagacgccggatgcgaaataaaaacctggcggcagcgcaaaagatg

SEQ ID NO: 120427 - DNA, 103 bp, Artificial Sequence
  Synthetic Polynucleotide
taatacgactcactataggggagactcggcagagggtgaggagctgcaccaacagaggagaggtgcaatgcctcaccctaacctggcggcagcgcaaaagatg

SEQ ID NO: 120428 - DNA, 103 bp, Artificial Sequence
  Synthetic Polynucleotide
taatacgactcactatagggtcctgcatttagctgctgctagtttatttcaacagaggagagaaataatgtagcagcagaacctggcggcagcgcaaaagatg

SEQ ID NO: 120429 - DNA, 103 bp, Artificial Sequence
  Synthetic Polynucleotide
taatacgactcactatagggctccgccggttcctgcatttagctgctgctaacagaggagaagcagcatgtaaatgcagaacctggcggcagcgcaaaagatg

SEQ ID NO: 120430 - DNA, 103 bp, Artificial Sequence
  Synthetic Polynucleotide
taatacgactcactatagggggtcagctccctccgccggttcctgcatttaacagaggagaaaatgcatgaaccggcggaacctggcggcagcgcaaaagatg

SEQ ID NO: 120431 - DNA, 103 bp, Artificial Sequence
  Synthetic Polynucleotide
taatacgactcactatagggggagtcggtcggtcagctccctccgccggtaacagaggagaaccggcatggggagctgaaacctggcggcagcgcaaaagatg

SEQ ID NO: 120432 - DNA, 103 bp, Artificial Sequence
  Synthetic Polynucleotide
taatacgactcactataggggtctccgcctggagtcggtcggtcagctccaacagaggagaggagctatgcgaccgactaacctggcggcagcgcaaaagatg

SEQ ID NO: 120433 - DNA, 103 bp, Artificial Sequence
  Synthetic Polynucleotide
taatacgactcactatagggcaactgatctgtctccgcctggagtcggtcaacagaggagagaccgaatgcaggcggagaacctggcggcagcgcaaaagatg

SEQ ID NO: 120434 - DNA, 103 bp, Artificial Sequence
  Synthetic Polynucleotide
taatacgactcactatagggtttcttcctccaactgatctgtctccgcctaacagaggagaaggcggatgcagatcagtaacctggcggcagcgcaaaagatg

SEQ ID NO: 120435 - DNA, 103 bp, Artificial Sequence
  Synthetic Polynucleotide
taatacgactcactatagggagctctgctttttcttcctccaactgatctaacagaggagaagatcaatgggaggaagaaacctggcggcagcgcaaaagatg

SEQ ID NO: 120436 - DNA, 103 bp, Artificial Sequence
  Synthetic Polynucleotide
taatacgactcactatagggctccgactccagctctgctttttcttcctcaacagaggagagaggaaatgaaagcagagaacctggcggcagcgcaaaagatg

SEQ ID NO: 120437 - DNA, 103 bp, Artificial Sequence
  Synthetic Polynucleotide
taatacgactcactataggggctcggcgatctccgactccagctctgcttaacagaggagaaagcagatgtggagtcggaacctggcggcagcgcaaaagatg

SEQ ID NO: 120438 - DNA, 103 bp, Artificial Sequence
  Synthetic Polynucleotide
taatacgactcactataggggacagatattgagactcggcagagggtgagaacagaggagactcaccatgtgccgagtcaacctggcggcagcgcaaaagatg

SEQ ID NO: 120439 - DNA, 103 bp, Artificial Sequence
  Synthetic Polynucleotide
taatacgactcactatagggtccttttggagctcggcgatctccgactccaacagaggagaggagtcatggatcgccgaaacctggcggcagcgcaaaagatg

SEQ ID NO: 120440 - DNA, 103 bp, Artificial Sequence
  Synthetic Polynucleotide
taatacgactcactatagggacgttccttctccttttggagctcggcgataacagaggagaatcgccatgctccaaaagaacctggcggcagcgcaaaagatg

SEQ ID NO: 120441 - DNA, 103 bp, Artificial Sequence
  Synthetic Polynucleotide
taatacgactcactatagggcaaactccagacgttccttctccttttggaaacagaggagatccaaaatgagaaggaacaacctggcggcagcgcaaaagatg

SEQ ID NO: 120442 - DNA, 103 bp, Artificial Sequence
  Synthetic Polynucleotide
taatacgactcactataggggccaccagcacaaactccagacgttccttcaacagaggagagaaggaatgtctggagttaacctggcggcagcgcaaaagatg

SEQ ID NO: 120443 - DNA, 103 bp, Artificial Sequence
  Synthetic Polynucleotide
taatacgactcactatagggcggtttgtgggccaccagcacaaactccagaacagaggagactggagatggtgctggtgaacctggcggcagcgcaaaagatg

SEQ ID NO: 120444 - DNA, 103 bp, Artificial Sequence
  Synthetic Polynucleotide
taatacgactcactatagggtcttgcagcccggtttgtgggccaccagcaaacagaggagatgctggatgcccacaaacaacctggcggcagcgcaaaagatg

SEQ ID NO: 120445 - DNA, 103 bp, Artificial Sequence
  Synthetic Polynucleotide
taatacgactcactatagggtcgtaggggatcttgcagcccggtttgtggaacagaggagaccacaaatggggctgcaaaacctggcggcagcgcaaaagatg

SEQ ID NO: 120446 - DNA, 103 bp, Artificial Sequence
  Synthetic Polynucleotide
taatacgactcactataggggggcccctcttcgtaggggatcttgcagccaacagaggagaggctgcatgatcccctacaacctggcggcagcgcaaaagatg

SEQ ID NO: 120447 - DNA, 103 bp, Artificial Sequence
  Synthetic Polynucleotide
taatacgactcactatagggggcccggcccgggcccctcttcgtaggggaaacagaggagatcccctatgaagaggggcaacctggcggcagcgcaaaagatg

SEQ ID NO: 120448 - DNA, 103 bp, Artificial Sequence
  Synthetic Polynucleotide
taatacgactcactatagggtccgccagcgggcccggcccgggcccctctaacagaggagaagagggatgcgggccgggaacctggcggcagcgcaaaagatg

SEQ ID NO: 120449 - DNA, 103 bp, Artificial Sequence
  Synthetic Polynucleotide
taatacgactcactataggggtccaccgaagacagatattgagactcggcaacagaggagagccgagatgcaatatctgaacctggcggcagcgcaaaagatg

SEQ ID NO: 120450 - DNA, 103 bp, Artificial Sequence
  Synthetic Polynucleotide
taatacgactcactatagggatctctcacctccgccagcgggcccggcccaacagaggagagggccgatgccgctggcgaacctggcggcagcgcaaaagatg

SEQ ID NO: 120451 - DNA, 103 bp, Artificial Sequence
  Synthetic Polynucleotide
taatacgactcactatagggagcccggcaaatctctcacctccgccagcgaacagaggagacgctggatgaggtgagagaacctggcggcagcgcaaaagatg

SEQ ID NO: 120452 - DNA, 103 bp, Artificial Sequence
  Synthetic Polynucleotide
taatacgactcactataggggccggtgctgagcccggcaaatctctcaccaacagaggagaggtgagatgtttgccgggaacctggcggcagcgcaaaagatg

SEQ ID NO: 120453 - DNA, 103 bp, Artificial Sequence
  Synthetic Polynucleotide
taatacgactcactatagggatcttccttagccggtgctgagcccggcaaaacagaggagattgccgatgtcagcaccgaacctggcggcagcgcaaaagatg

SEQ ID NO: 120454 - DNA, 103 bp, Artificial Sequence
  Synthetic Polynucleotide
taatacgactcactatagggagctgaagccatcttccttagccggtgctgaacagaggagacagcacatgctaaggaagaacctggcggcagcgcaaaagatg

SEQ ID NO: 120455 - DNA, 103 bp, Artificial Sequence
  Synthetic Polynucleotide
taatacgactcactatagggggcagcagccagctgaagccatcttccttaaacagaggagataaggaatgtggcttcagaacctggcggcagcgcaaaagatg

SEQ ID NO: 120456 - DNA, 103 bp, Artificial Sequence
  Synthetic Polynucleotide
taatacgactcactatagggtggcgggggcggcagcagccagctgaagccaacagaggagaggcttcatgtggctgctgaacctggcggcagcgcaaaagatg

SEQ ID NO: 120457 - DNA, 103 bp, Artificial Sequence
  Synthetic Polynucleotide
taatacgactcactatagggggggcggtggtggcgggggcggcagcagccaacagaggagaggctgcatgcgcccccgcaacctggcggcagcgcaaaagatg

SEQ ID NO: 120458 - DNA, 103 bp, Artificial Sequence
  Synthetic Polynucleotide
taatacgactcactatagggtggaagggcaggggcggtggtggcgggggcaacagaggagagcccccatgaccaccgccaacctggcggcagcgcaaaagatg

SEQ ID NO: 120459 - DNA, 103 bp, Artificial Sequence
  Synthetic Polynucleotide
taatacgactcactatagggttggctggtctggaagggcaggggcggtggaacagaggagaccaccgatgctgcccttcaacctggcggcagcgcaaaagatg

SEQ ID NO: 120460 - DNA, 103 bp, Artificial Sequence
  Synthetic Polynucleotide
taatacgactcactatagggtgccgaaggagtccaccgaagacagatattaacagaggagaaatatcatgcttcggtggaacctggcggcagcgcaaaagatg

SEQ ID NO: 120461 - DNA, 103 bp, Artificial Sequence
  Synthetic Polynucleotide
taatacgactcactatagggggggtgcgtcttggctggtctggaagggcaaacagaggagatgccctatgagaccagccaacctggcggcagcgcaaaagatg

SEQ ID NO: 120462 - DNA, 103 bp, Artificial Sequence
  Synthetic Polynucleotide
taatacgactcactataggggtcaggttggggggtgcgtcttggctggtcaacagaggagagaccagatgagacgcaccaacctggcggcagcgcaaaagatg

SEQ ID NO: 120463 - DNA, 103 bp, Artificial Sequence
  Synthetic Polynucleotide
taatacgactcactataggggagagaagccgtcaggttggggggtgcgtcaacagaggagagacgcaatgcccaacctgaacctggcggcagcgcaaaagatg

SEQ ID NO: 120464 - DNA, 103 bp, Artificial Sequence
  Synthetic Polynucleotide
taatacgactcactatagggtgtgtgtaaagagagaagccgtcaggttggaacagaggagaccaaccatgcggcttctcaacctggcggcagcgcaaaagatg

SEQ ID NO: 120465 - DNA, 103 bp, Artificial Sequence
  Synthetic Polynucleotide
taatacgactcactatagggtgaacttcactgtgtgtaaagagagaagccaacagaggagaggcttcatgctttacacaaacctggcggcagcgcaaaagatg

SEQ ID NO: 120466 - DNA, 103 bp, Artificial Sequence
  Synthetic Polynucleotide
taatacgactcactataggggccgaggacttgaacttcactgtgtgtaaaaacagaggagatttacaatgagtgaagttaacctggcggcagcgcaaaagatg

SEQ ID NO: 120467 - DNA, 103 bp, Artificial Sequence
  Synthetic Polynucleotide
taatacgactcactatagggggaaggggtcgccgaggacttgaacttcacaacagaggagagtgaagatgaagtcctcgaacctggcggcagcgcaaaagatg

SEQ ID NO: 120468 - DNA, 103 bp, Artificial Sequence
  Synthetic Polynucleotide
taatacgactcactatagggttaacaacggggaaggggtcgccgaggactaacagaggagaagtcctatgcgaccccttaacctggcggcagcgcaaaagatg

SEQ ID NO: 120469 - DNA, 103 bp, Artificial Sequence
  Synthetic Polynucleotide
taatacgactcactataggggtacgaagggttaacaacggggaaggggtcaacagaggagagaccccatgcccgttgttaacctggcggcagcgcaaaagatg

SEQ ID NO: 120470 - DNA, 103 bp, Artificial Sequence
  Synthetic Polynucleotide
taatacgactcactatagggacgaagaagtgtacgaagggttaacaacggaacagaggagaccgttgatgacccttcgtaacctggcggcagcgcaaaagatg

SEQ ID NO: 120471 - DNA, 103 bp, Artificial Sequence
  Synthetic Polynucleotide
taatacgactcactataggggtgggtggactgccgaaggagtccaccgaaaacagaggagattcggtatgctccttcggaacctggcggcagcgcaaaagatg

SEQ ID NO: 120472 - DNA, 103 bp, Artificial Sequence
  Synthetic Polynucleotide
taatacgactcactataggggtgaggacaaacgaagaagtgtacgaagggaacagaggagacccttcatgcacttcttcaacctggcggcagcgcaaaagatg

SEQ ID NO: 120473 - DNA, 103 bp, Artificial Sequence
  Synthetic Polynucleotide
taatacgactcactatagggctccgggcaggtgaggacaaacgaagaagtaacagaggagaacttctatgtttgtcctcaacctggcggcagcgcaaaagatg

SEQ ID NO: 120474 - DNA, 103 bp, Artificial Sequence
  Synthetic Polynucleotide
taatacgactcactatagggacgcggagacctccgggcaggtgaggacaaaacagaggagattgtccatgcctgcccggaacctggcggcagcgcaaaagatg

SEQ ID NO: 120475 - DNA, 103 bp, Artificial Sequence
  Synthetic Polynucleotide
taatacgactcactataggggcgccggcgaacgcggagacctccgggcagaacagaggagactgcccatgggtctccgcaacctggcggcagcgcaaaagatg

SEQ ID NO: 120476 - DNA, 103 bp, Artificial Sequence
  Synthetic Polynucleotide
taatacgactcactatagggggtgcgttgggcgccggcgaacgcggagacaacagaggagagtctccatgttcgccggcaacctggcggcagcgcaaaagatg

SEQ ID NO: 120477 - DNA, 103 bp, Artificial Sequence
  Synthetic Polynucleotide
taatacgactcactatagggcactgccgctggtgcgttgggcgccggcgaaacagaggagatcgccgatgcccaacgcaaacctggcggcagcgcaaaagatg

SEQ ID NO: 120478 - DNA, 103 bp, Artificial Sequence
  Synthetic Polynucleotide
taatacgactcactataggggaaggctggtcactgccgctggtgcgttggaacagaggagaccaacgatgcagcggcagaacctggcggcagcgcaaaagatg

SEQ ID NO: 120479 - DNA, 103 bp, Artificial Sequence
  Synthetic Polynucleotide
taatacgactcactatagggcaggggatcggaaggctggtcactgccgctaacagaggagaagcggcatggaccagcctaacctggcggcagcgcaaaagatg

SEQ ID NO: 120480 - DNA, 103 bp, Artificial Sequence
  Synthetic Polynucleotide
taatacgactcactatagggagggcgagttcaggggatcggaaggctggtaacagaggagaaccagcatgccgatccccaacctggcggcagcgcaaaagatg

SEQ ID NO: 120481 - DNA, 103 bp, Artificial Sequence
  Synthetic Polynucleotide
taatacgactcactataggggcgaggagggagggcgagttcaggggatcgaacagaggagacgatccatggaactcgccaacctggcggcagcgcaaaagatg

SEQ ID NO: 120482 - DNA, 103 bp, Artificial Sequence
  Synthetic Polynucleotide
taatacgactcactatagggcgggccgggttccccgaagtctcggaacataacagaggagaatgttcatggacttcgggaacctggcggcagcgcaaaagatg

SEQ ID NO: 120483 - DNA, 103 bp, Artificial Sequence
  Synthetic Polynucleotide
taatacgactcactataggggcttggcaccaggtggaacttctgctgggcaacagaggagagcccagatgaagttccacaacctggcggcagcgcaaaagatg

SEQ ID NO: 120484 - DNA, 103 bp, Artificial Sequence
  Synthetic Polynucleotide
taatacgactcactatagggtggtgttgatgcttggcaccaggtggaactaacagaggagaagttccatgtggtgccaaaacctggcggcagcgcaaaagatg

SEQ ID NO: 120485 - DNA, 103 bp, Artificial Sequence
  Synthetic Polynucleotide
taatacgactcactatagggctgccactcatggtgttgatgcttggcaccaacagaggagaggtgccatgcatcaacacaacctggcggcagcgcaaaagatg

SEQ ID NO: 120486 - DNA, 103 bp, Artificial Sequence
  Synthetic Polynucleotide
taatacgactcactatagggcagctcctgactgccactcatggtgttgataacagaggagaatcaacatgatgagtggcaacctggcggcagcgcaaaagatg

SEQ ID NO: 120487 - DNA, 103 bp, Artificial Sequence
  Synthetic Polynucleotide
taatacgactcactatagggccatccactgcagctcctgactgccactcaaacagaggagatgagtgatggtcaggagcaacctggcggcagcgcaaaagatg

SEQ ID NO: 120488 - DNA, 103 bp, Artificial Sequence
  Synthetic Polynucleotide
taatacgactcactatagggtgaggctgtaccatccactgcagctcctgaaacagaggagatcaggaatggcagtggataacctggcggcagcgcaaaagatg

SEQ ID NO: 120489 - DNA, 103 bp, Artificial Sequence
  Synthetic Polynucleotide
taatacgactcactatagggccccaggaaatgaggctgtaccatccactgaacagaggagacagtggatggtacagcctaacctggcggcagcgcaaaagatg

SEQ ID NO: 120490 - DNA, 103 bp, Artificial Sequence
  Synthetic Polynucleotide
taatacgactcactatagggaactgctgggccccaggaaatgaggctgtaaacagaggagatacagcatgatttcctggaacctggcggcagcgcaaaagatg

SEQ ID NO: 120491 - DNA, 103 bp, Artificial Sequence
  Synthetic Polynucleotide
taatacgactcactatagggggcctggggtaactgctgggccccaggaaaaacagaggagatttcctatggcccagcagaacctggcggcagcgcaaaagatg

SEQ ID NO: 120492 - DNA, 103 bp, Artificial Sequence
  Synthetic Polynucleotide
taatacgactcactataggggtaggtcagaggcctggggtaactgctgggaacagaggagacccagcatgtaccccaggaacctggcggcagcgcaaaagatg

SEQ ID NO: 120493 - DNA, 103 bp, Artificial Sequence
  Synthetic Polynucleotide
taatacgactcactatagggtcccggagctcgggccgggttccccgaagtaacagaggagaacttcgatgaacccggccaacctggcggcagcgcaaaagatg

SEQ ID NO: 120494 - DNA, 103 bp, Artificial Sequence
  Synthetic Polynucleotide
taatacgactcactatagggtgtactgagggtaggtcagaggcctggggtaacagaggagaaccccaatgctctgacctaacctggcggcagcgcaaaagatg

SEQ ID NO: 120495 - DNA, 103 bp, Artificial Sequence
  Synthetic Polynucleotide
taatacgactcactatagggtgtggggggctgtactgagggtaggtcagaaacagaggagatctgacatgccctcagtaaacctggcggcagcgcaaaagatg

SEQ ID NO: 120496 - DNA, 103 bp, Artificial Sequence
  Synthetic Polynucleotide
taatacgactcactatagggtggccggggttgtggggggctgtactgaggaacagaggagacctcagatgagccccccaaacctggcggcagcgcaaaagatg

SEQ ID NO: 120497 - DNA, 103 bp, Artificial Sequence
  Synthetic Polynucleotide
taatacgactcactatagggggatgactcctggccggggttgtggggggcaacagaggagagcccccatgaaccccggcaacctggcggcagcgcaaaagatg

SEQ ID NO: 120498 - DNA, 103 bp, Artificial Sequence
  Synthetic Polynucleotide
taatacgactcactatagggcccagggcccggatgactcctggccggggtaacagaggagaaccccgatgaggagtcataacctggcggcagcgcaaaagatg

SEQ ID NO: 120499 - DNA, 103 bp, Artificial Sequence
  Synthetic Polynucleotide
taatacgactcactatagggtggaggcggccccagggcccggatgactccaacagaggagaggagtcatgcgggccctgaacctggcggcagcgcaaaagatg

SEQ ID NO: 120500 - DNA, 103 bp, Artificial Sequence
  Synthetic Polynucleotide
taatacgactcactataggggacgtacccctggaggcggccccagggcccaacagaggagagggcccatgggccgcctcaacctggcggcagcgcaaaagatg

SEQ ID NO: 120501 - DNA, 103 bp, Artificial Sequence
  Synthetic Polynucleotide
taatacgactcactatagggcaaggccttcgacgtacccctggaggcggcaacagaggagagccgccatgaggggtacgaacctggcggcagcgcaaaagatg

SEQ ID NO: 120502 - DNA, 103 bp, Artificial Sequence
  Synthetic Polynucleotide
taatacgactcactataggggatctgttcacaaggccttcgacgtaccccaacagaggagaggggtaatgcgaaggcctaacctggcggcagcgcaaaagatg

SEQ ID NO: 120503 - DNA, 103 bp, Artificial Sequence
  Synthetic Polynucleotide
taatacgactcactatagggcctccgggctgatctgttcacaaggccttcaacagaggagagaaggcatggtgaacagaaacctggcggcagcgcaaaagatg

SEQ ID NO: 120504 - DNA, 103 bp, Artificial Sequence
  Synthetic Polynucleotide
taatacgactcactatagggccgccgccgttcccggagctcgggccgggtaacagaggagaacccggatggagctccggaacctggcggcagcgcaaaagatg

SEQ ID NO: 120505 - DNA, 103 bp, Artificial Sequence
  Synthetic Polynucleotide
taatacgactcactatagggcgctcctcttcctccgggctgatctgttcaaacagaggagatgaacaatgcagcccggaaacctggcggcagcgcaaaagatg

SEQ ID NO: 120506 - DNA, 103 bp, Artificial Sequence
  Synthetic Polynucleotide
taatacgactcactatagggtactcggcggcgctcctcttcctccgggctaacagaggagaagcccgatggaagaggagaacctggcggcagcgcaaaagatg

SEQ ID NO: 120507 - DNA, 103 bp, Artificial Sequence
  Synthetic Polynucleotide
taatacgactcactataggggctcgcgccttactcggcggcgctcctcttaacagaggagaaagaggatggccgccgagaacctggcggcagcgcaaaagatg

SEQ ID NO: 120508 - DNA, 103 bp, Artificial Sequence
  Synthetic Polynucleotide
taatacgactcactatagggagcttgttccgctcgcgccttactcggcggaacagaggagaccgccgatgaaggcgcgaaacctggcggcagcgcaaaagatg

SEQ ID NO: 120509 - DNA, 103 bp, Artificial Sequence
  Synthetic Polynucleotide
taatacgactcactatagggggccgcagccagcttgttccgctcgcgcctaacagaggagaaggcgcatgcggaacaagaacctggcggcagcgcaaaagatg

SEQ ID NO: 120510 - DNA, 103 bp, Artificial Sequence
  Synthetic Polynucleotide
taatacgactcactatagggtcctgcacttggccgcagccagcttgttccaacagaggagaggaacaatgtggctgcggaacctggcggcagcgcaaaagatg

SEQ ID NO: 120511 - DNA, 103 bp, Artificial Sequence
  Synthetic Polynucleotide
taatacgactcactatagggttcctccggttcctgcacttggccgcagccaacagaggagaggctgcatgcaagtgcagaacctggcggcagcgcaaaagatg

SEQ ID NO: 120512 - DNA, 103 bp, Artificial Sequence
  Synthetic Polynucleotide
taatacgactcactatagggggtcagttccttcctccggttcctgcacttaacagaggagaaagtgcatgaaccggaggaacctggcggcagcgcaaaagatg

SEQ ID NO: 120513 - DNA, 103 bp, Artificial Sequence
  Synthetic Polynucleotide
taatacgactcactataggggcaggaagtcggtcagttccttcctccggtaacagaggagaaccggaatgaggaactgaaacctggcggcagcgcaaaagatg

SEQ ID NO: 120514 - DNA, 103 bp, Artificial Sequence
  Synthetic Polynucleotide
taatacgactcactataggggtctccgcctgcaggaagtcggtcagttccaacagaggagaggaactatgcgacttcctaacctggcggcagcgcaaaagatg

SEQ ID NO: 120515 - DNA, 103 bp, Artificial Sequence
  Synthetic Polynucleotide
taatacgactcactataggggccgccgtacccgccgccgttcccggagctaacagaggagaagctccatgaacggcggcaacctggcggcagcgcaaaagatg

SEQ ID NO: 120516 - DNA, 103 bp, Artificial Sequence
  Synthetic Polynucleotide
taatacgactcactatagggcagtttgtcagtctccgcctgcaggaagtcaacagaggagagacttcatgcaggcggagaacctggcggcagcgcaaaagatg

SEQ ID NO: 120517 - DNA, 103 bp, Artificial Sequence
  Synthetic Polynucleotide
taatacgactcactatagggtctcatcttccagtttgtcagtctccgcctaacagaggagaaggcggatgctgacaaacaacctggcggcagcgcaaaagatg

SEQ ID NO: 120518 - DNA, 103 bp, Artificial Sequence
  Synthetic Polynucleotide
taatacgactcactatagggagcccagatttctcatcttccagtttgtcaaacagaggagatgacaaatgggaagatgaaacctggcggcagcgcaaaagatg

SEQ ID NO: 120519 - DNA, 103 bp, Artificial Sequence
  Synthetic Polynucleotide
taatacgactcactatagggctctcgctgcagcccagatttctcatcttcaacagaggagagaagatatgaaatctgggaacctggcggcagcgcaaaagatg

SEQ ID NO: 120520 - DNA, 103 bp, Artificial Sequence
  Synthetic Polynucleotide
taatacgactcactataggggctcctcaatctctcgctgcagcccagattaacagaggagaaatctgatgtgcagcgagaacctggcggcagcgcaaaagatg

SEQ ID NO: 120521 - DNA, 103 bp, Artificial Sequence
  Synthetic Polynucleotide
taatacgactcactatagggtgcttctgcagctcctcaatctctcgctgcaacagaggagagcagcgatggattgaggaaacctggcggcagcgcaaaagatg

SEQ ID NO: 120522 - DNA, 103 bp, Artificial Sequence
  Synthetic Polynucleotide
taatacgactcactataggggcgctccttctgcttctgcagctcctcaataacagaggagaattgagatgctgcagaagaacctggcggcagcgcaaaagatg

SEQ ID NO: 120523 - DNA, 103 bp, Artificial Sequence
  Synthetic Polynucleotide
taatacgactcactatagggccagctctaggcgctccttctgcttctgcaaacagaggagatgcagaatgagaaggagcaacctggcggcagcgcaaaagatg

SEQ ID NO: 120524 - DNA, 103 bp, Artificial Sequence
  Synthetic Polynucleotide
taatacgactcactataggggcttccagcaccagctctaggcgctccttcaacagaggagagaaggaatgcctagagctaacctggcggcagcgcaaaagatg

SEQ ID NO: 120525 - DNA, 103 bp, Artificial Sequence
  Synthetic Polynucleotide
taatacgactcactataggggggtcggtgggcttccagcaccagctctagaacagaggagactagagatggtgctggaaaacctggcggcagcgcaaaagatg

SEQ ID NO: 120526 - DNA, 103 bp, Artificial Sequence
  Synthetic Polynucleotide
taatacgactcactataggggctgcgcggggccgccgtacccgccgccgtaacagaggagaacggcgatgggtacggcgaacctggcggcagcgcaaaagatg

SEQ ID NO: 120527 - DNA, 103 bp, Artificial Sequence
  Synthetic Polynucleotide
taatacgactcactatagggttttgcagatgggtcggtgggcttccagcaaacagaggagatgctggatgcccaccgacaacctggcggcagcgcaaaagatg

SEQ ID NO: 120528 - DNA, 103 bp, Artificial Sequence
  Synthetic Polynucleotide
taatacgactcactatagggccttccgggattttgcagatgggtcggtggaacagaggagaccaccgatgcatctgcaaaacctggcggcagcgcaaaagatg

SEQ ID NO: 120529 - DNA, 103 bp, Artificial Sequence
  Synthetic Polynucleotide
taatacgactcactatagggctccttggctccttccgggattttgcagataacagaggagaatctgcatgatcccggaaaacctggcggcagcgcaaaagatg

SEQ ID NO: 120530 - DNA, 103 bp, Artificial Sequence
  Synthetic Polynucleotide
taatacgactcactatagggctgtgtccccctccttggctccttccgggaaacagaggagatcccggatggagccaaggaacctggcggcagcgcaaaagatg

SEQ ID NO: 120531 - DNA, 103 bp, Artificial Sequence
  Synthetic Polynucleotide
taatacgactcactatagggctggtactgcctgtgtccccctccttggctaacagaggagaagccaaatggggggacacaacctggcggcagcgcaaaagatg

SEQ ID NO: 120532 - DNA, 103 bp, Artificial Sequence
  Synthetic Polynucleotide
taatacgactcactataggggctggtgccactggtactgcctgtgtccccaacagaggagaggggacatgggcagtaccaacctggcggcagcgcaaaagatg

SEQ ID NO: 120533 - DNA, 103 bp, Artificial Sequence
  Synthetic Polynucleotide
taatacgactcactatagggctggtgggctgctggtgccactggtactgcaacagaggagagcagtaatggtggcaccaaacctggcggcagcgcaaaagatg

SEQ ID NO: 120534 - DNA, 103 bp, Artificial Sequence
  Synthetic Polynucleotide
taatacgactcactatagggcggcagggggctggtgggctgctggtgccaaacagaggagatggcacatgcagcccaccaacctggcggcagcgcaaaagatg

SEQ ID NO: 120535 - DNA, 103 bp, Artificial Sequence
  Synthetic Polynucleotide
taatacgactcactatagggaggtacagggcggcagggggctggtgggctaacagaggagaagcccaatggccccctgcaacctggcggcagcgcaaaagatg

SEQ ID NO: 120536 - DNA, 103 bp, Artificial Sequence
  Synthetic Polynucleotide
taatacgactcactataggggggagatacaaggtacagggcggcagggggaacagaggagaccccctatggccctgtacaacctggcggcagcgcaaaagatg

SEQ ID NO: 120537 - DNA, 103 bp, Artificial Sequence
  Synthetic Polynucleotide
taatacgactcactataggggcggccgggggctgcgcggggccgccgtacaacagaggagagtacggatgccccgcgcaaacctggcggcagcgcaaaagatg

SEQ ID NO: 120538 - DNA, 103 bp, Artificial Sequence
  Synthetic Polynucleotide
taatacgactcactatagggcctggggaaagggagatacaaggtacagggaacagaggagaccctgtatgttgtatctcaacctggcggcagcgcaaaagatg

SEQ ID NO: 120539 - DNA, 103 bp, Artificial Sequence
  Synthetic Polynucleotide
taatacgactcactatagggaagcacaggccctggggaaagggagatacaaacagaggagatgtatcatgctttccccaaacctggcggcagcgcaaaagatg

SEQ ID NO: 120540 - DNA, 103 bp, Artificial Sequence
  Synthetic Polynucleotide
taatacgactcactatagggcctcaggttcaagcacaggccctggggaaaaacagaggagatttcccatgggcctgtgcaacctggcggcagcgcaaaagatg

SEQ ID NO: 120541 - DNA, 103 bp, Artificial Sequence
  Synthetic Polynucleotide
taatacgactcactataggggtgtgcagtgcctcaggttcaagcacaggcaacagaggagagcctgtatgtgaacctgaaacctggcggcagcgcaaaagatg

SEQ ID NO: 120542 - DNA, 103 bp, Artificial Sequence
  Synthetic Polynucleotide
taatacgactcactataggggagtgtgggggtgtgcagtgcctcaggttcaacagaggagagaacctatggcactgcacaacctggcggcagcgcaaaagatg

SEQ ID NO: 120543 - DNA, 103 bp, Artificial Sequence
  Synthetic Polynucleotide
taatacgactcactataggggtgtggtcatgagtgtgggggtgtgcagtgaacagaggagacactgcatgcccccacacaacctggcggcagcgcaaaagatg

SEQ ID NO: 120544 - DNA, 103 bp, Artificial Sequence
  Synthetic Polynucleotide
taatacgactcactataggggttagggagggtgtggtcatgagtgtggggaacagaggagaccccacatgcatgaccacaacctggcggcagcgcaaaagatg

SEQ ID NO: 120545 - DNA, 103 bp, Artificial Sequence
  Synthetic Polynucleotide
taatacgactcactatagggggtgaaaggagttagggagggtgtggtcataacagaggagaatgaccatgccctccctaaacctggcggcagcgcaaaagatg

SEQ ID NO: 120546 - DNA, 103 bp, Artificial Sequence
  Synthetic Polynucleotide
taatacgactcactatagggccaggctgggggtgaaaggagttagggaggaacagaggagacctcccatgctcctttcaaacctggcggcagcgcaaaagatg

SEQ ID NO: 120547 - DNA, 103 bp, Artificial Sequence
  Synthetic Polynucleotide
taatacgactcactatagggtaggtgaagaccaggctgggggtgaaaggaaacagaggagatcctttatgccccagcctaacctggcggcagcgcaaaagatg

SEQ ID NO: 120548 - DNA, 103 bp, Artificial Sequence
  Synthetic Polynucleotide
taatacgactcactatagggtgcctgcgctgcggccgggggctgcgcgggaacagaggagacccgcgatgcccccggccaacctggcggcagcgcaaaagatg

SEQ ID NO: 120549 - DNA, 103 bp, Artificial Sequence
  Synthetic Polynucleotide
taatacgactcactatagggagtgctggggtaggtgaagaccaggctgggaacagaggagacccagcatggtcttcaccaacctggcggcagcgcaaaagatg

SEQ ID NO: 120550 - DNA, 103 bp, Artificial Sequence
  Synthetic Polynucleotide
taatacgactcactatagggaaggctcaggagtgctggggtaggtgaagaaacagaggagatcttcaatgaccccagcaaacctggcggcagcgcaaaagatg

SEQ ID NO: 120551 - DNA, 103 bp, Artificial Sequence
  Synthetic Polynucleotide
taatacgactcactataggggctgaggcacaaggctcaggagtgctggggaacagaggagaccccagatgtcctgagccaacctggcggcagcgcaaaagatg

SEQ ID NO: 120552 - DNA, 103 bp, Artificial Sequence
  Synthetic Polynucleotide
taatacgactcactatagggcttgcgatgagctgaggcacaaggctcaggaacagaggagacctgagatgtgtgcctcaaacctggcggcagcgcaaaagatg

SEQ ID NO: 120553 - DNA, 103 bp, Artificial Sequence
  Synthetic Polynucleotide
taatacgactcactatagggtgctgctactcttgcgatgagctgaggcacaacagaggagagtgcctatgctcatcgcaaacctggcggcagcgcaaaagatg

SEQ ID NO: 120554 - DNA, 103 bp, Artificial Sequence
  Synthetic Polynucleotide
taatacgactcactatagggtctccgctgctgctgctactcttgcgatgaaacagaggagatcatcgatggagtagcagaacctggcggcagcgcaaaagatg

SEQ ID NO: 120555 - DNA, 103 bp, Artificial Sequence
  Synthetic Polynucleotide
taatacgactcactatagggagaggatgggtctccgctgctgctgctactaacagaggagaagtagcatgagcagcggaaacctggcggcagcgcaaaagatg

SEQ ID NO: 120556 - DNA, 103 bp, Artificial Sequence
  Synthetic Polynucleotide
taatacgactcactatagggcaagggggtcagaggatgggtctccgctgcaacagaggagagcagcgatgacccatcctaacctggcggcagcgcaaaagatg

SEQ ID NO: 120557 - DNA, 103 bp, Artificial Sequence
  Synthetic Polynucleotide
taatacgactcactataggggttggagagccaagggggtcagaggatgggaacagaggagacccatcatgtgaccccctaacctggcggcagcgcaaaagatg

SEQ ID NO: 120558 - DNA, 103 bp, Artificial Sequence
  Synthetic Polynucleotide
taatacgactcactatagggagcgaggagggttggagagccaagggggtcaacagaggagagaccccatgggctctccaaacctggcggcagcgcaaaagatg

SEQ ID NO: 120559 - DNA, 103 bp, Artificial Sequence
  Synthetic Polynucleotide
taatacgactcactatagggtctgctgggctgcctgcgctgcggccggggaacagaggagaccccggatgcagcgcaggaacctggcggcagcgcaaaagatg

SEQ ID NO: 120560 - DNA, 103 bp, Artificial Sequence
  Synthetic Polynucleotide
taatacgactcactatagggaggtggaacttctgctgggctgcctgcgctaacagaggagaagcgcaatgagcccagcaaacctggcggcagcgcaaaagatg

SEQ ID NO: 120561 - DNA, 103 bp, Artificial Sequence
  Synthetic Polynucleotide
taatacgactcactataggggtcaaagttcccgggataatcctggtacataacagaggagaatgtacatggattatcccaacctggcggcagcgcaaaagatg

SEQ ID NO: 120562 - DNA, 103 bp, Artificial Sequence
  Synthetic Polynucleotide
taatacgactcactatagggcatatctacccggaatttctgctggccgccaacagaggagaggcggcatgcagaaattcaacctggcggcagcgcaaaagatg

SEQ ID NO: 120563 - DNA, 103 bp, Artificial Sequence
  Synthetic Polynucleotide
taatacgactcactatagggctgagccaggcatatctacccggaatttctaacagaggagaagaaatatggggtagataaacctggcggcagcgcaaaagatg

SEQ ID NO: 120564 - DNA, 103 bp, Artificial Sequence
  Synthetic Polynucleotide
taatacgactcactatagggaatgcactgcctgagccaggcatatctaccaacagaggagaggtagaatggcctggctcaacctggcggcagcgcaaaagatg

SEQ ID NO: 120565 - DNA, 103 bp, Artificial Sequence
  Synthetic Polynucleotide
taatacgactcactatagggggtggggatgaatgcactgcctgagccaggaacagaggagacctggcatgggcagtgcaaacctggcggcagcgcaaaagatg

SEQ ID NO: 120566 - DNA, 103 bp, Artificial Sequence
  Synthetic Polynucleotide
taatacgactcactatagggtggcgttgatggtggggatgaatgcactgcaacagaggagagcagtgatgtcatccccaaacctggcggcagcgcaaaagatg

SEQ ID NO: 120567 - DNA, 103 bp, Artificial Sequence
  Synthetic Polynucleotide
taatacgactcactatagggctggtcgtgatggcgttgatggtggggatgaacagaggagacatcccatgcatcaacgcaacctggcggcagcgcaaaagatg

SEQ ID NO: 120568 - DNA, 103 bp, Artificial Sequence
  Synthetic Polynucleotide
taatacgactcactatagggcaggtcctggctggtcgtgatggcgttgataacagaggagaatcaacatgatcacgaccaacctggcggcagcgcaaaagatg

SEQ ID NO: 120569 - DNA, 103 bp, Artificial Sequence
  Synthetic Polynucleotide
taatacgactcactatagggccatccactgcaggtcctggctggtcgtgaaacagaggagatcacgaatggccaggaccaacctggcggcagcgcaaaagatg

SEQ ID NO: 120570 - DNA, 103 bp, Artificial Sequence
  Synthetic Polynucleotide
taatacgactcactataggggtgggctgcaccatccactgcaggtcctggaacagaggagaccaggaatggcagtggataacctggcggcagcgcaaaagatg

SEQ ID NO: 120571 - DNA, 103 bp, Artificial Sequence
  Synthetic Polynucleotide
taatacgactcactatagggggtgatcactgtgggctgcaccatccactgaacagaggagacagtggatggtgcagcccaacctggcggcagcgcaaaagatg

SEQ ID NO: 120572 - DNA, 103 bp, Artificial Sequence
  Synthetic Polynucleotide
taatacgactcactataggggggacgaggtgtcaaagttcccgggataataacagaggagaattatcatgggaactttgaacctggcggcagcgcaaaagatg

SEQ ID NO: 120573 - DNA, 103 bp, Artificial Sequence
  Synthetic Polynucleotide
taatacgactcactatagggtggacatggaggtgatcactgtgggctgcaaacagaggagatgcagcatgcagtgatcaaacctggcggcagcgcaaaagatg

SEQ ID NO: 120574 - DNA, 103 bp, Artificial Sequence
  Synthetic Polynucleotide
taatacgactcactataggggggtatgggttggacatggaggtgatcactaacagaggagaagtgatatgctccatgtcaacctggcggcagcgcaaaagatg

SEQ ID NO: 120575 - DNA, 103 bp, Artificial Sequence
  Synthetic Polynucleotide
taatacgactcactataggggtgcgagcgagggtatgggttggacatggaaacagaggagatccatgatgaacccatacaacctggcggcagcgcaaaagatg

SEQ ID NO: 120576 - DNA, 103 bp, Artificial Sequence
  Synthetic Polynucleotide
taatacgactcactatagggggctgtaggggtgcgagcgagggtatgggtaacagaggagaacccatatgctcgctcgcaacctggcggcagcgcaaaagatg

SEQ ID NO: 120577 - DNA, 103 bp, Artificial Sequence
  Synthetic Polynucleotide
taatacgactcactatagggcccggcagggggctgtaggggtgcgagcgaaacagaggagatcgctcatgcccctacagaacctggcggcagcgcaaaagatg

SEQ ID NO: 120578 - DNA, 103 bp, Artificial Sequence
  Synthetic Polynucleotide
taatacgactcactatagggagaggccaggcccggcagggggctgtagggaacagaggagaccctacatgcccctgccgaacctggcggcagcgcaaaagatg

SEQ ID NO: 120579 - DNA, 103 bp, Artificial Sequence
  Synthetic Polynucleotide
taatacgactcactataggggtccagggacagaggccaggcccggcagggaacagaggagaccctgcatggcctggcctaacctggcggcagcgcaaaagatg

SEQ ID NO: 120580 - DNA, 103 bp, Artificial Sequence
  Synthetic Polynucleotide
taatacgactcactatagggagggccatgtgtccagggacagaggccaggaacagaggagacctggcatgtgtccctggaacctggcggcagcgcaaaagatg

SEQ ID NO: 120581 - DNA, 103 bp, Artificial Sequence
  Synthetic Polynucleotide
taatacgactcactatagggaggtcttgggagggccatgtgtccagggacaacagaggagagtccctatgcacatggccaacctggcggcagcgcaaaagatg

SEQ ID NO: 120582 - DNA, 103 bp, Artificial Sequence
  Synthetic Polynucleotide
taatacgactcactatagggtgatcacgccaggtcttgggagggccatgtaacagaggagaacatggatgtcccaagacaacctggcggcagcgcaaaagatg

SEQ ID NO: 120583 - DNA, 103 bp, Artificial Sequence
  Synthetic Polynucleotide
taatacgactcactatagggctgctgccccgggacgaggtgtcaaagttcaacagaggagagaacttatgcacctcgtcaacctggcggcagcgcaaaagatg

SEQ ID NO: 120584 - DNA, 103 bp, Artificial Sequence
  Synthetic Polynucleotide
taatacgactcactatagggccaatggtcttgatcacgccaggtcttgggaacagaggagacccaagatgtggcgtgataacctggcggcagcgcaaaagatg

SEQ ID NO: 120585 - DNA, 103 bp, Artificial Sequence
  Synthetic Polynucleotide
taatacgactcactatagggcacggtggtgccaatggtcttgatcacgccaacagaggagaggcgtgatgaagaccattaacctggcggcagcgcaaaagatg

SEQ ID NO: 120586 - DNA, 103 bp, Artificial Sequence
  Synthetic Polynucleotide
taatacgactcactatagggtcctgcggcccacggtggtgccaatggtctaacagaggagaagaccaatggcaccaccgaacctggcggcagcgcaaaagatg

SEQ ID NO: 120587 - DNA, 103 bp, Artificial Sequence
  Synthetic Polynucleotide
taatacgactcactatagggtcatctctcctcctgcggcccacggtggtgaacagaggagacaccacatggggccgcagaacctggcggcagcgcaaaagatg

SEQ ID NO: 120588 - DNA, 103 bp, Artificial Sequence
  Synthetic Polynucleotide
taatacgactcactatagggagacagctgctcatctctcctcctgcggccaacagaggagaggccgcatgaggagagataacctggcggcagcgcaaaagatg

SEQ ID NO: 120589 - DNA, 103 bp, Artificial Sequence
  Synthetic Polynucleotide
taatacgactcactatagggcctcttcaggagacagctgctcatctctccaacagaggagaggagagatgagcagctgtaacctggcggcagcgcaaaagatg

SEQ ID NO: 120590 - DNA, 103 bp, Artificial Sequence
  Synthetic Polynucleotide
taatacgactcactatagggcgcttctcctcctcttcaggagacagctgcaacagaggagagcagctatgtcctgaagaaacctggcggcagcgcaaaagatg

SEQ ID NO: 120591 - DNA, 103 bp, Artificial Sequence
  Synthetic Polynucleotide
taatacgactcactatagggccggatgcgacgcttctcctcctcttcaggaacagaggagacctgaaatggaggagaagaacctggcggcagcgcaaaagatg

SEQ ID NO: 120592 - DNA, 103 bp, Artificial Sequence
  Synthetic Polynucleotide
taatacgactcactatagggtcctctcccgccggatgcgacgcttctcctaacagaggagaaggagaatggtcgcatccaacctggcggcagcgcaaaagatg

SEQ ID NO: 120593 - DNA, 103 bp, Artificial Sequence
  Synthetic Polynucleotide
taatacgactcactataggggccagcttgttcctctcccgccggatgcgaaacagaggagatcgcatatggcgggagagaacctggcggcagcgcaaaagatg

SEQ ID NO: 120594 - DNA, 103 bp, Artificial Sequence
  Synthetic Polynucleotide
taatacgactcactatagggaggagagccgctgctgccccgggacgaggtaacagaggagaacctcgatgcggggcagcaacctggcggcagcgcaaaagatg

SEQ ID NO: 120595 - DNA, 103 bp, Artificial Sequence
  Synthetic Polynucleotide
taatacgactcactatagggcttggctgcagccagcttgttcctctcccgaacagaggagacgggagatgaacaagctgaacctggcggcagcgcaaaagatg

SEQ ID NO: 120596 - DNA, 103 bp, Artificial Sequence
  Synthetic Polynucleotide
taatacgactcactatagggggttccggcacttggctgcagccagcttgtaacagaggagaacaagcatgctgcagccaaacctggcggcagcgcaaaagatg

SEQ ID NO: 120597 - DNA, 103 bp, Artificial Sequence
  Synthetic Polynucleotide
taatacgactcactatagggtcccggcgtcggttccggcacttggctgcaaacagaggagatgcagcatggtgccggaaaacctggcggcagcgcaaaagatg

SEQ ID NO: 120598 - DNA, 103 bp, Artificial Sequence
  Synthetic Polynucleotide
taatacgactcactatagggctctgtcagctcccggcgtcggttccggcaaacagaggagatgccggatgcgacgccggaacctggcggcagcgcaaaagatg

SEQ ID NO: 120599 - DNA, 103 bp, Artificial Sequence
  Synthetic Polynucleotide
taatacgactcactatagggcctgcagcttctctgtcagctcccggcgtcaacagaggagagacgccatgagctgacagaacctggcggcagcgcaaaagatg

SEQ ID NO: 120600 - DNA, 103 bp, Artificial Sequence
  Synthetic Polynucleotide
taatacgactcactatagggtctgtctccgcctgcagcttctctgtcagcaacagaggagagctgacatggaagctgcaaacctggcggcagcgcaaaagatg

SEQ ID NO: 120601 - DNA, 103 bp, Artificial Sequence
  Synthetic Polynucleotide
taatacgactcactatagggctccagctcctctgtctccgcctgcagcttaacagaggagaaagctgatggcggagacaaacctggcggcagcgcaaaagatg

SEQ ID NO: 120602 - DNA, 103 bp, Artificial Sequence
  Synthetic Polynucleotide
taatacgactcactatagggacttctcctcctccagctcctctgtctccgaacagaggagacggagaatgaggagctggaacctggcggcagcgcaaaagatg

SEQ ID NO: 120603 - DNA, 103 bp, Artificial Sequence
  Synthetic Polynucleotide
taatacgactcactatagggtgcaggcctgacttctcctcctccagctccaacagaggagaggagctatgggaggagaaaacctggcggcagcgcaaaagatg

SEQ ID NO: 120604 - DNA, 103 bp, Artificial Sequence
  Synthetic Polynucleotide
taatacgactcactatagggaatctccttctgcaggcctgacttctcctcaacagaggagagaggagatgtcaggcctgaacctggcggcagcgcaaaagatg

SEQ ID NO: 120605 - DNA, 103 bp, Artificial Sequence
  Synthetic Polynucleotide
taatacgactcactatagggcggcgtgcgcaggagagccgctgctgccccaacagaggagaggggcaatggcggctctcaacctggcggcagcgcaaaagatg

SEQ ID NO: 120606 - DNA, 103 bp, Artificial Sequence
  Synthetic Polynucleotide
taatacgactcactataggggcagctcagcaatctccttctgcaggcctgaacagaggagacaggccatgagaaggagaaacctggcggcagcgcaaaagatg

SEQ ID NO: 120607 - DNA, 103 bp, Artificial Sequence
  Synthetic Polynucleotide
taatacgactcactatagggttctccttctgcagctcagcaatctccttcaacagaggagagaaggaatgtgctgagctaacctggcggcagcgcaaaagatg

SEQ ID NO: 120608 - DNA, 103 bp, Artificial Sequence
  Synthetic Polynucleotide
taatacgactcactatagggcagcttctccttctccttctgcagctcagcaacagaggagagctgagatgcagaaggagaacctggcggcagcgcaaaagatg

SEQ ID NO: 120609 - DNA, 103 bp, Artificial Sequence
  Synthetic Polynucleotide
taatacgactcactatagggacatgaactccagcttctccttctccttctaacagaggagaagaaggatgaggagaagcaacctggcggcagcgcaaaagatg

SEQ ID NO: 120610 - DNA, 103 bp, Artificial Sequence
  Synthetic Polynucleotide
taatacgactcactatagggtgagccaccaacatgaactccagcttctccaacagaggagaggagaaatgggagttcataacctggcggcagcgcaaaagatg

SEQ ID NO: 120611 - DNA, 103 bp, Artificial Sequence
  Synthetic Polynucleotide
taatacgactcactatagggcactgggccgtgagccaccaacatgaactcaacagaggagagagttcatgttggtggctaacctggcggcagcgcaaaagatg

SEQ ID NO: 120612 - DNA, 103 bp, Artificial Sequence
  Synthetic Polynucleotide
taatacgactcactatagggtaatcttgcacactgggccgtgagccaccaaacagaggagatggtggatgacggcccagaacctggcggcagcgcaaaagatg

SEQ ID NO: 120613 - DNA, 103 bp, Artificial Sequence
  Synthetic Polynucleotide
taatacgactcactatagggtcctcggggctaatcttgcacactgggccgaacagaggagacggcccatggtgcaagataacctggcggcagcgcaaaagatg

SEQ ID NO: 120614 - DNA, 103 bp, Artificial Sequence
  Synthetic Polynucleotide
taatacgactcactatagggcgatcggcgctcctcggggctaatcttgcaaacagaggagatgcaagatgagccccgagaacctggcggcagcgcaaaagatg

SEQ ID NO: 120615 - DNA, 103 bp, Artificial Sequence
  Synthetic Polynucleotide
taatacgactcactataggggggctgggggcgatcggcgctcctcggggcaacagaggagagccccgatgagcgccgataacctggcggcagcgcaaaagatg

SEQ ID NO: 120616 - DNA, 103 bp, Artificial Sequence
  Synthetic Polynucleotide
taatacgactcactataggggagtaggactcggcgtgcgcaggagagccgaacagaggagacggctcatgtgcgcacgcaacctggcggcagcgcaaaagatg

SEQ ID NO: 120617 - DNA, 103 bp, Artificial Sequence
  Synthetic Polynucleotide
taatacgactcactatagggtgcagcccaggggctgggggcgatcggcgcaacagaggagagcgccgatggcccccagcaacctggcggcagcgcaaaagatg

SEQ ID NO: 120618 - DNA, 103 bp, Artificial Sequence
  Synthetic Polynucleotide
taatacgactcactataggggcgcatgggctgcagcccaggggctgggggaacagaggagacccccaatgcctgggctgaacctggcggcagcgcaaaagatg

SEQ ID NO: 120619 - DNA, 103 bp, Artificial Sequence
  Synthetic Polynucleotide
taatacgactcactatagggcacccccactgcgcatgggctgcagcccagaacagaggagactgggcatgagcccatgcaacctggcggcagcgcaaaagatg

SEQ ID NO: 120620 - DNA, 103 bp, Artificial Sequence
  Synthetic Polynucleotide
taatacgactcactatagggcccaccgagccacccccactgcgcatgggcaacagaggagagcccatatgcagtgggggaacctggcggcagcgcaaaagatg

SEQ ID NO: 120621 - DNA, 103 bp, Artificial Sequence
  Synthetic Polynucleotide
taatacgactcactatagggcactacagcgcccaccgagccacccccactaacagaggagaagtgggatgggctcggtgaacctggcggcagcgcaaaagatg

SEQ ID NO: 120622 - DNA, 103 bp, Artificial Sequence
  Synthetic Polynucleotide
taatacgactcactatagggcctgtttcaccactacagcgcccaccgagcaacagaggagagctcggatggcgctgtagaacctggcggcagcgcaaaagatg

SEQ ID NO: 120623 - DNA, 103 bp, Artificial Sequence
  Synthetic Polynucleotide
taatacgactcactatagggtccaggggctcctgtttcaccactacagcgaacagaggagacgctgtatgggtgaaacaaacctggcggcagcgcaaaagatg

SEQ ID NO: 120624 - DNA, 103 bp, Artificial Sequence
  Synthetic Polynucleotide
taatacgactcactataggggctgtcctcttccaggggctcctgtttcacaacagaggagagtgaaaatggagcccctgaacctggcggcagcgcaaaagatg

SEQ ID NO: 120625 - DNA, 103 bp, Artificial Sequence
  Synthetic Polynucleotide
taatacgactcactatagggaggacgaggggctgtcctcttccaggggctaacagaggagaagccccatgaagaggacaaacctggcggcagcgcaaaagatg

SEQ ID NO: 120626 - DNA, 103 bp, Artificial Sequence
  Synthetic Polynucleotide
taatacgactcactatagggcccgccgacgaggacgaggggctgtcctctaacagaggagaagaggaatgcccctcgtcaacctggcggcagcgcaaaagatg

SEQ ID NO: 120627 - DNA, 103 bp, Artificial Sequence
  Synthetic Polynucleotide
taatacgactcactataggggccgccgctggagtaggactcggcgtgcgcaacagaggagagcgcacatggagtcctacaacctggcggcagcgcaaaagatg

SEQ ID NO: 120628 - DNA, 103 bp, Artificial Sequence
  Synthetic Polynucleotide
taatacgactcactatagggcttgtccagccccgccgacgaggacgagggaacagaggagaccctcgatgtcgtcggcgaacctggcggcagcgcaaaagatg

SEQ ID NO: 120629 - DNA, 103 bp, Artificial Sequence
  Synthetic Polynucleotide
taatacgactcactatagggagcgctgggccttgtccagccccgccgacgaacagaggagacgtcggatgggctggacaaacctggcggcagcgcaaaagatg

SEQ ID NO: 120630 - DNA, 103 bp, Artificial Sequence
  Synthetic Polynucleotide
taatacgactcactatagggttgatgacagagcgctgggccttgtccagcaacagaggagagctggaatgggcccagcgaacctggcggcagcgcaaaagatg

SEQ ID NO: 120631 - DNA, 103 bp, Artificial Sequence
  Synthetic Polynucleotide
taatacgactcactataggggctgatgggcttgatgacagagcgctgggcaacagaggagagcccagatgtctgtcatcaacctggcggcagcgcaaaagatg

SEQ ID NO: 120632 - DNA, 103 bp, Artificial Sequence
  Synthetic Polynucleotide
taatacgactcactatagggccccagcaatgctgatgggcttgatgacagaacagaggagactgtcaatgagcccatcaaacctggcggcagcgcaaaagatg

SEQ ID NO: 120633 - DNA, 103 bp, Artificial Sequence
  Synthetic Polynucleotide
taatacgactcactatagggccgtagaagcccccagcaatgctgatgggcaacagaggagagcccatatgcattgctggaacctggcggcagcgcaaaagatg

SEQ ID NO: 120634 - DNA, 103 bp, Artificial Sequence
  Synthetic Polynucleotide
taatacgactcactataggggggctcctcaccgtagaagcccccagcaataacagaggagaattgctatgggcttctacaacctggcggcagcgcaaaagatg

SEQ ID NO: 120635 - DNA, 103 bp, Artificial Sequence
  Synthetic Polynucleotide
taatacgactcactataggggggtgtgcaggggctcctcaccgtagaagcaacagaggagagcttctatggtgaggagcaacctggcggcagcgcaaaagatg

SEQ ID NO: 120636 - DNA, 103 bp, Artificial Sequence
  Synthetic Polynucleotide
taatacgactcactatagggaccacgatgggggtgtgcaggggctcctcaaacagaggagatgaggaatgcctgcacacaacctggcggcagcgcaaaagatg

SEQ ID NO: 120637 - DNA, 103 bp, Artificial Sequence
  Synthetic Polynucleotide
taatacgactcactatagggtgtggaggtcaccacgatgggggtgtgcagaacagaggagactgcacatgcccatcgtgaacctggcggcagcgcaaaagatg

SEQ ID NO: 120638 - DNA, 103 bp, Artificial Sequence
  Synthetic Polynucleotide
taatacgactcactataggggctggccgccgccgccgctggagtaggactaacagaggagaagtcctatgccagcggcgaacctggcggcagcgcaaaagatg

SEQ ID NO: 120639 - DNA, 103 bp, Artificial Sequence
  Synthetic Polynucleotide
taatacgactcactatagggtgacagcaggtgtggaggtcaccacgatggaacagaggagaccatcgatgtgacctccaaacctggcggcagcgcaaaagatg

SEQ ID NO: 120640 - DNA, 103 bp, Artificial Sequence
  Synthetic Polynucleotide
taatacgactcactataggggtgcccggagtgacagcaggtgtggaggtcaacagaggagagacctcatgacctgctgtaacctggcggcagcgcaaaagatg

SEQ ID NO: 120641 - DNA, 103 bp, Artificial Sequence
  Synthetic Polynucleotide
taatacgactcactataggggaggttcgaggtgcccggagtgacagcaggaacagaggagacctgctatgactccgggcaacctggcggcagcgcaaaagatg

SEQ ID NO: 120642 - DNA, 103 bp, Artificial Sequence
  Synthetic Polynucleotide
taatacgactcactatagggaggtgaagacgaggttcgaggtgcccggagaacagaggagactccggatgcctcgaaccaacctggcggcagcgcaaaagatg

SEQ ID NO: 120643 - DNA, 103 bp, Artificial Sequence
  Synthetic Polynucleotide
taatacgactcactatagggacgctaggataggtgaagacgaggttcgagaacagaggagactcgaaatgcgtcttcacaacctggcggcagcgcaaaagatg

SEQ ID NO: 120644 - DNA, 103 bp, Artificial Sequence
  Synthetic Polynucleotide
taatacgactcactatagggctgctccaggacgctaggataggtgaagacaacagaggagagtcttcatgtatcctagcaacctggcggcagcgcaaaagatg

SEQ ID NO: 120645 - DNA, 103 bp, Artificial Sequence
  Synthetic Polynucleotide
taatacgactcactatagggcgggtgactcctgctccaggacgctaggataacagaggagaatcctaatgtcctggagcaacctggcggcagcgcaaaagatg

SEQ ID NO: 120646 - DNA, 103 bp, Artificial Sequence
  Synthetic Polynucleotide
taatacgactcactataggggagggagatgcgggtgactcctgctccaggaacagaggagacctggaatgggagtcaccaacctggcggcagcgcaaaagatg

SEQ ID NO: 120647 - DNA, 103 bp, Artificial Sequence
  Synthetic Polynucleotide
taatacgactcactataggggcaggattcggagggagatgcgggtgactcaacagaggagagagtcaatggcatctcccaacctggcggcagcgcaaaagatg

SEQ ID NO: 120648 - DNA, 103 bp, Artificial Sequence
  Synthetic Polynucleotide
taatacgactcactataggggagccttggagcaggattcggagggagatgaacagaggagacatctcatgccgaatcctaacctggcggcagcgcaaaagatg

SEQ ID NO: 120649 - DNA, 103 bp, Artificial Sequence
  Synthetic Polynucleotide
taatacgactcactatagggcggaatttctgctggccgccgccgccgctgaacagaggagacagcggatgcggcggccaaacctggcggcagcgcaaaagatg

SEQ ID NO: 120650 - DNA, 103 bp, Artificial Sequence
  Synthetic Polynucleotide
taatacgactcactatagggcttctgcggtgagccttggagcaggattcgaacagaggagacgaatcatgctccaaggcaacctggcggcagcgcaaaagatg

SEQ ID NO: 120651 - DNA, 103 bp, Artificial Sequence
  Synthetic Polynucleotide
taatacgactcactataggggctgctactgcttctgcggtgagccttggaaacagaggagatccaagatgcaccgcagaaacctggcggcagcgcaaaagatg

SEQ ID NO: 120652 - DNA, 103 bp, Artificial Sequence
  Synthetic Polynucleotide
taatacgactcactatagggattggtccccgctgctactgcttctgcggtaacagaggagaaccgcaatggcagtagcaaacctggcggcagcgcaaaagatg

SEQ ID NO: 120653 - DNA, 103 bp, Artificial Sequence
  Synthetic Polynucleotide
taatacgactcactataggggagtctgatgattggtccccgctgctactgaacagaggagacagtagatgcggggaccaaacctggcggcagcgcaaaagatg

SEQ ID NO: 120654 - DNA, 103 bp, Artificial Sequence
  Synthetic Polynucleotide
taatacgactcactatagggggagttcaaggagtctgatgattggtccccaacagaggagaggggacatgtcatcagacaacctggcggcagcgcaaaagatg

SEQ ID NO: 120655 - DNA, 103 bp, Artificial Sequence
  Synthetic Polynucleotide
taatacgactcactataggggcagagtgggggagttcaaggagtctgatgaacagaggagacatcagatgccttgaactaacctggcggcagcgcaaaagatg

SEQ ID NO: 120656 - DNA, 103 bp, Artificial Sequence
  Synthetic Polynucleotide
taatacgactcactatagggtacagagccagcagagtgggggagttcaagaacagaggagacttgaaatgccccactctaacctggcggcagcgcaaaagatg

SEQ ID NO: 120657 - DNA, 103 bp, Artificial Sequence
  Synthetic Polynucleotide
taatacgactcactatagggatgcccttccatcttcacagttcctaacataacagaggagaatgttaatgactgtgaagaacctggcggcagcgcaaaagatg

SEQ ID NO: 120658 - DNA, 103 bp, Artificial Sequence
  Synthetic Polynucleotide
taatacgactcactatagggggagcccaggcctgagttcatgttgctgacaacagaggagagtcagcatgatgaactcaaacctggcggcagcgcaaaagatg

SEQ ID NO: 120659 - DNA, 103 bp, Artificial Sequence
  Synthetic Polynucleotide
taatacgactcactatagggcgccccactgtggtccagagtctgggggctaacagaggagaagccccatgactctggacaacctggcggcagcgcaaaagatg

SEQ ID NO: 120660 - DNA, 103 bp, Artificial Sequence
  Synthetic Polynucleotide
taatacgactcactatagggctgtcgccgtcgccccactgtggtccagagaacagaggagactctggatgacagtggggaacctggcggcagcgcaaaagatg

SEQ ID NO: 120661 - DNA, 103 bp, Artificial Sequence
  Synthetic Polynucleotide
taatacgactcactataggggaggcgccccctgtcgccgtcgccccactgaacagaggagacagtggatggacggcgacaacctggcggcagcgcaaaagatg

SEQ ID NO: 120662 - DNA, 103 bp, Artificial Sequence
  Synthetic Polynucleotide
taatacgactcactatagggcttcaactccgaggcgccccctgtcgccgtaacagaggagaacggcgatggggggcgccaacctggcggcagcgcaaaagatg

SEQ ID NO: 120663 - DNA, 103 bp, Artificial Sequence
  Synthetic Polynucleotide
taatacgactcactatagggaggctggagtcttcaactccgaggcgccccaacagaggagaggggcgatgcggagttgaaacctggcggcagcgcaaaagatg

SEQ ID NO: 120664 - DNA, 103 bp, Artificial Sequence
  Synthetic Polynucleotide
taatacgactcactataggggcagttgaggaggctggagtcttcaactccaacagaggagaggagttatggactccagcaacctggcggcagcgcaaaagatg

SEQ ID NO: 120665 - DNA, 103 bp, Artificial Sequence
  Synthetic Polynucleotide
taatacgactcactatagggtatggggggcgcagttgaggaggctggagtaacagaggagaactccaatgtcctcaactaacctggcggcagcgcaaaagatg

SEQ ID NO: 120666 - DNA, 103 bp, Artificial Sequence
  Synthetic Polynucleotide
taatacgactcactataggggcccggagcttatggggggcgcagttgaggaacagaggagacctcaaatgcgccccccaaacctggcggcagcgcaaaagatg

SEQ ID NO: 120667 - DNA, 103 bp, Artificial Sequence
  Synthetic Polynucleotide
taatacgactcactatagggagcgccccgggcccggagcttatggggggcaacagaggagagcccccatgaagctccggaacctggcggcagcgcaaaagatg

SEQ ID NO: 120668 - DNA, 103 bp, Artificial Sequence
  Synthetic Polynucleotide
taatacgactcactatagggcacagaggccagcgccccgggcccggagctaacagaggagaagctccatgcccggggcgaacctggcggcagcgcaaaagatg

SEQ ID NO: 120669 - DNA, 103 bp, Artificial Sequence
  Synthetic Polynucleotide
taatacgactcactatagggtggagttcatggagcccaggcctgagttcaaacagaggagatgaactatggcctgggctaacctggcggcagcgcaaaagatg

SEQ ID NO: 120670 - DNA, 103 bp, Artificial Sequence
  Synthetic Polynucleotide
taatacgactcactataggggagaggcgggcacagaggccagcgccccggaacagaggagaccggggatgtggcctctgaacctggcggcagcgcaaaagatg

SEQ ID NO: 120671 - DNA, 103 bp, Artificial Sequence
  Synthetic Polynucleotide
taatacgactcactatagggtgtgccgggtgagaggcgggcacagaggccaacagaggagaggcctcatggcccgcctcaacctggcggcagcgcaaaagatg

SEQ ID NO: 120672 - DNA, 103 bp, Artificial Sequence
  Synthetic Polynucleotide
taatacgactcactatagggtgccaagccgtgtgccgggtgagaggcgggaacagaggagacccgccatgcacccggcaaacctggcggcagcgcaaaagatg

SEQ ID NO: 120673 - DNA, 103 bp, Artificial Sequence
  Synthetic Polynucleotide
taatacgactcactatagggactcgtggggtgccaagccgtgtgccgggtaacagaggagaacccggatgacggcttggaacctggcggcagcgcaaaagatg

SEQ ID NO: 120674 - DNA, 103 bp, Artificial Sequence
  Synthetic Polynucleotide
taatacgactcactatagggtgcagctgggactcgtggggtgccaagccgaacagaggagacggcttatgaccccacgaaacctggcggcagcgcaaaagatg

SEQ ID NO: 120675 - DNA, 103 bp, Artificial Sequence
  Synthetic Polynucleotide
taatacgactcactatagggccctttcaggtgcagctgggactcgtggggaacagaggagaccccacatgtcccagctgaacctggcggcagcgcaaaagatg

SEQ ID NO: 120676 - DNA, 103 bp, Artificial Sequence
  Synthetic Polynucleotide
taatacgactcactatagggagtgggggtcccctttcaggtgcagctgggaacagaggagacccagcatgacctgaaagaacctggcggcagcgcaaaagatg

SEQ ID NO: 120677 - DNA, 103 bp, Artificial Sequence
  Synthetic Polynucleotide
taatacgactcactatagggttgaaggagtagtgggggtcccctttcaggaacagaggagacctgaaatgggacccccaaacctggcggcagcgcaaaagatg

SEQ ID NO: 120678 - DNA, 103 bp, Artificial Sequence
  Synthetic Polynucleotide
taatacgactcactataggggaacgggtggttgaaggagtagtgggggtcaacagaggagagaccccatgtactccttcaacctggcggcagcgcaaaagatg

SEQ ID NO: 120679 - DNA, 103 bp, Artificial Sequence
  Synthetic Polynucleotide
taatacgactcactatagggtgttgatggagaacgggtggttgaaggagtaacagaggagaactcctatgaccacccgtaacctggcggcagcgcaaaagatg

SEQ ID NO: 120680 - DNA, 103 bp, Artificial Sequence
  Synthetic Polynucleotide
taatacgactcactatagggtaggtgttcatggagttcatggagcccaggaacagaggagacctgggatgcatgaactcaacctggcggcagcgcaaaagatg

SEQ ID NO: 120681 - DNA, 103 bp, Artificial Sequence
  Synthetic Polynucleotide
taatacgactcactataggggacatgaggttgttgatggagaacgggtggaacagaggagaccacccatgctccatcaaaacctggcggcagcgcaaaagatg

SEQ ID NO: 120682 - DNA, 103 bp, Artificial Sequence
  Synthetic Polynucleotide
taatacgactcactatagggctccgaggaggacatgaggttgttgatggaaacagaggagatccatcatgaacctcatgaacctggcggcagcgcaaaagatg

SEQ ID NO: 120683 - DNA, 103 bp, Artificial Sequence
  Synthetic Polynucleotide
taatacgactcactatagggtatgctgctgctccgaggaggacatgaggtaacagaggagaacctcaatgcctcctcggaacctggcggcagcgcaaaagatg

SEQ ID NO: 120684 - DNA, 103 bp, Artificial Sequence
  Synthetic Polynucleotide
taatacgactcactatagggaagtccagcttatgctgctgctccgaggagaacagaggagactcctcatggcagcagcaaacctggcggcagcgcaaaagatg

SEQ ID NO: 120685 - DNA, 103 bp, Artificial Sequence
  Synthetic Polynucleotide
taatacgactcactataggggtatgccttgaagtccagcttatgctgctgaacagaggagacagcagatgaagctggacaacctggcggcagcgcaaaagatg

SEQ ID NO: 120686 - DNA, 103 bp, Artificial Sequence
  Synthetic Polynucleotide
taatacgactcactataggggtgcctgttcgtatgccttgaagtccagctaacagaggagaagctggatgtcaaggcataacctggcggcagcgcaaaagatg

SEQ ID NO: 120687 - DNA, 103 bp, Artificial Sequence
  Synthetic Polynucleotide
taatacgactcactataggggagtattgcagtgcctgttcgtatgccttgaacagaggagacaaggcatgcgaacaggcaacctggcggcagcgcaaaagatg

SEQ ID NO: 120688 - DNA, 103 bp, Artificial Sequence
  Synthetic Polynucleotide
taatacgactcactataggggccgtaaggcgagtattgcagtgcctgttcaacagaggagagaacagatgctgcaatacaacctggcggcagcgcaaaagatg

SEQ ID NO: 120689 - DNA, 103 bp, Artificial Sequence
  Synthetic Polynucleotide
taatacgactcactataggggcaacgtagagccgtaaggcgagtattgcaaacagaggagatgcaatatgcgccttacgaacctggcggcagcgcaaaagatg

SEQ ID NO: 120690 - DNA, 103 bp, Artificial Sequence
  Synthetic Polynucleotide
taatacgactcactatagggaggctggcgggcaacgtagagccgtaaggcaacagaggagagccttaatgctctacgttaacctggcggcagcgcaaaagatg

SEQ ID NO: 120691 - DNA, 103 bp, Artificial Sequence
  Synthetic Polynucleotide
taatacgactcactatagggcatggtcatgtaggtgttcatggagttcataacagaggagaatgaacatgatgaacaccaacctggcggcagcgcaaaagatg

SEQ ID NO: 120692 - DNA, 103 bp, Artificial Sequence
  Synthetic Polynucleotide
taatacgactcactataggggcctagaggcaggctggcgggcaacgtagaaacagaggagatctacgatgcccgccagcaacctggcggcagcgcaaaagatg

SEQ ID NO: 120693 - DNA, 103 bp, Artificial Sequence
  Synthetic Polynucleotide
taatacgactcactatagggccgaggcgctgcctagaggcaggctggcggaacagaggagaccgccaatgtgcctctagaacctggcggcagcgcaaaagatg

SEQ ID NO: 120694 - DNA, 103 bp, Artificial Sequence
  Synthetic Polynucleotide
taatacgactcactatagggctggtggtcaccgaggcgctgcctagaggcaacagaggagagcctctatgcagcgcctcaacctggcggcagcgcaaaagatg

SEQ ID NO: 120695 - DNA, 103 bp, Artificial Sequence
  Synthetic Polynucleotide
taatacgactcactataggggatggggctcctggtggtcaccgaggcgctaacagaggagaagcgccatggtgaccaccaacctggcggcagcgcaaaagatg

SEQ ID NO: 120696 - DNA, 103 bp, Artificial Sequence
  Synthetic Polynucleotide
taatacgactcactatagggctgagggctcgatggggctcctggtggtcaaacagaggagatgaccaatgggagccccaaacctggcggcagcgcaaaagatg

SEQ ID NO: 120697 - DNA, 103 bp, Artificial Sequence
  Synthetic Polynucleotide
taatacgactcactatagggggctccagggctgagggctcgatggggctcaacagaggagagagcccatgcgagccctcaacctggcggcagcgcaaaagatg

SEQ ID NO: 120698 - DNA, 103 bp, Artificial Sequence
  Synthetic Polynucleotide
taatacgactcactataggggtagtacgccggctccagggctgagggctcaacagaggagagagcccatggccctggagaacctggcggcagcgcaaaagatg

SEQ ID NO: 120699 - DNA, 103 bp, Artificial Sequence
  Synthetic Polynucleotide
taatacgactcactatagggacacaccttggtagtacgccggctccagggaacagaggagaccctggatgcggcgtactaacctggcggcagcgcaaaagatg

SEQ ID NO: 120700 - DNA, 103 bp, Artificial Sequence
  Synthetic Polynucleotide
taatacgactcactatagggggtctggaatacacaccttggtagtacgccaacagaggagaggcgtaatgccaaggtgtaacctggcggcagcgcaaaagatg

SEQ ID NO: 120701 - DNA, 103 bp, Artificial Sequence
  Synthetic Polynucleotide
taatacgactcactataggggtttaggacgggtctggaatacacaccttgaacagaggagacaaggtatgtattccagaaacctggcggcagcgcaaaagatg

SEQ ID NO: 120702 - DNA, 103 bp, Artificial Sequence
  Synthetic Polynucleotide
taatacgactcactatagggtcatggtgttcatggtcatgtaggtgttcaaacagaggagatgaacaatgacatgaccaaacctggcggcagcgcaaaagatg

SEQ ID NO: 120703 - DNA, 103 bp, Artificial Sequence
  Synthetic Polynucleotide
taatacgactcactatagggccgctcgtagtcatggtgttcatggtcatgaacagaggagacatgacatggaacaccataacctggcggcagcgcaaaagatg

SEQ ID NO: 120704 - DNA, 103 bp, Artificial Sequence
  Synthetic Polynucleotide
taatacgactcactatagggggtcatgttgccgctcgtagtcatggtgttaacagaggagaaacaccatgactacgagcaacctggcggcagcgcaaaagatg

SEQ ID NO: 120705 - DNA, 103 bp, Artificial Sequence
  Synthetic Polynucleotide
taatacgactcactatagggaggacgccggggtcatgttgccgctcgtagaacagaggagactacgaatggcaacatgaaacctggcggcagcgcaaaagatg

SEQ ID NO: 120706 - DNA, 103 bp, Artificial Sequence
  Synthetic Polynucleotide
taatacgactcactataggggacatgttgaaggacgccggggtcatgttgaacagaggagacaacatatgcccggcgtcaacctggcggcagcgcaaaagatg

SEQ ID NO: 120707 - DNA, 103 bp, Artificial Sequence
  Synthetic Polynucleotide
taatacgactcactataggggttggcataggacatgttgaaggacgccggaacagaggagaccggcgatgttcaacatgaacctggcggcagcgcaaaagatg

SEQ ID NO: 120708 - DNA, 103 bp, Artificial Sequence
  Synthetic Polynucleotide
taatacgactcactatagggcgctggtttcatgcccttccatcttcacagaacagaggagactgtgaatgtggaagggcaacctggcggcagcgcaaaagatg

SEQ ID NO: 120709 - DNA, 103 bp, Artificial Sequence
  Synthetic Polynucleotide
taatacgactcactatagggctaggcccgggttggcataggacatgttgaaacagaggagatcaacaatgcctatgccaaacctggcggcagcgcaaaagatg

SEQ ID NO: 120710 - DNA, 103 bp, Artificial Sequence
  Synthetic Polynucleotide
taatacgactcactatagggaggccggcccctaggcccgggttggcatagaacagaggagactatgcatgcccgggcctaacctggcggcagcgcaaaagatg

SEQ ID NO: 120711 - DNA, 103 bp, Artificial Sequence
  Synthetic Polynucleotide
taatacgactcactataggggccgggactcaggccggcccctaggcccggaacagaggagaccgggcatgggggccggcaacctggcggcagcgcaaaagatg

SEQ ID NO: 120712 - DNA, 103 bp, Artificial Sequence
  Synthetic Polynucleotide
taatacgactcactatagggcggctactgcgccgggactcaggccggcccaacagaggagagggccgatgtgagtcccgaacctggcggcagcgcaaaagatg

SEQ ID NO: 120713 - DNA, 103 bp, Artificial Sequence
  Synthetic Polynucleotide
taatacgactcactatagggcccggcatgccggctactgcgccgggactcaacagaggagagagtccatgcgcagtagcaacctggcggcagcgcaaaagatg

SEQ ID NO: 120714 - DNA, 103 bp, Artificial Sequence
  Synthetic Polynucleotide
taatacgactcactatagggcgccgagccccccggcatgccggctactgcaacagaggagagcagtaatgggcatgccgaacctggcggcagcgcaaaagatg

SEQ ID NO: 120715 - DNA, 103 bp, Artificial Sequence
  Synthetic Polynucleotide
taatacgactcactatagggtcatggcgcccgccgagccccccggcatgcaacagaggagagcatgcatgggggctcggaacctggcggcagcgcaaaagatg

SEQ ID NO: 120716 - DNA, 103 bp, Artificial Sequence
  Synthetic Polynucleotide
taatacgactcactataggggtcatgctgttcatggcgcccgccgagcccaacagaggagagggctcatggggcgccataacctggcggcagcgcaaaagatg

SEQ ID NO: 120717 - DNA, 103 bp, Artificial Sequence
  Synthetic Polynucleotide
taatacgactcactataggggccggccgcagtcatgctgttcatggcgccaacagaggagaggcgccatgaacagcatgaacctggcggcagcgcaaaagatg

SEQ ID NO: 120718 - DNA, 103 bp, Artificial Sequence
  Synthetic Polynucleotide
taatacgactcactatagggtggccgtcacgccggccgcagtcatgctgtaacagaggagaacagcaatgctgcggccgaacctggcggcagcgcaaaagatg

SEQ ID NO: 120719 - DNA, 103 bp, Artificial Sequence
  Synthetic Polynucleotide
taatacgactcactatagggctgttccagtcgctggtttcatgcccttccaacagaggagaggaaggatgtgaaaccagaacctggcggcagcgcaaaagatg

SEQ ID NO: 120720 - DNA, 103 bp, Artificial Sequence
  Synthetic Polynucleotide
taatacgactcactataggggccgtacccatggccgtcacgccggccgcaaacagaggagatgcggcatgcgtgacggcaacctggcggcagcgcaaaagatg

SEQ ID NO: 120721 - DNA, 103 bp, Artificial Sequence
  Synthetic Polynucleotide
taatacgactcactatagggcgggctcagcgccgtacccatggccgtcacaacagaggagagtgacgatgatgggtacgaacctggcggcagcgcaaaagatg

SEQ ID NO: 120722 - DNA, 103 bp, Artificial Sequence
  Synthetic Polynucleotide
taatacgactcactatagggccatgccgctcgggctcagcgccgtacccaaacagaggagatgggtaatgcgctgagccaacctggcggcagcgcaaaagatg

SEQ ID NO: 120723 - DNA, 103 bp, Artificial Sequence
  Synthetic Polynucleotide
taatacgactcactatagggcccatggcgcccatgccgctcgggctcagcaacagaggagagctgagatggagcggcataacctggcggcagcgcaaaagatg

SEQ ID NO: 120724 - DNA, 103 bp, Artificial Sequence
  Synthetic Polynucleotide
taatacgactcactatagggctgctgcgcacccatggcgcccatgccgctaacagaggagaagcggcatgggcgccatgaacctggcggcagcgcaaaagatg

SEQ ID NO: 120725 - DNA, 103 bp, Artificial Sequence
  Synthetic Polynucleotide
taatacgactcactatagggtggaggccgcctgctgcgcacccatggcgcaacagaggagagcgccaatggtgcgcagcaacctggcggcagcgcaaaagatg

SEQ ID NO: 120726 - DNA, 103 bp, Artificial Sequence
  Synthetic Polynucleotide
taatacgactcactatagggaggccattcatggaggccgcctgctgcgcaaacagaggagatgcgcaatgggcggcctcaacctggcggcagcgcaaaagatg

SEQ ID NO: 120727 - DNA, 103 bp, Artificial Sequence
  Synthetic Polynucleotide
taatacgactcactataggggtaggggcccaggccattcatggaggccgcaacagaggagagcggccatgatgaatggcaacctggcggcagcgcaaaagatg

SEQ ID NO: 120728 - DNA, 103 bp, Artificial Sequence
  Synthetic Polynucleotide
taatacgactcactatagggtggcggccgcgtaggggcccaggccattcaaacagaggagatgaatgatgtgggcccctaacctggcggcagcgcaaaagatg

SEQ ID NO: 120729 - DNA, 103 bp, Artificial Sequence
  Synthetic Polynucleotide
taatacgactcactatagggcacgggttcatggcggccgcgtaggggcccaacagaggagagggcccatgcgcggccgcaacctggcggcagcgcaaaagatg

SEQ ID NO: 120730 - DNA, 103 bp, Artificial Sequence
  Synthetic Polynucleotide
taatacgactcactatagggtgcgtagtagctgttccagtcgctggtttcaacagaggagagaaaccatggactggaacaacctggcggcagcgcaaaagatg

SEQ ID NO: 120731 - DNA, 103 bp, Artificial Sequence
  Synthetic Polynucleotide
taatacgactcactatagggggggctcatgcacgggttcatggcggccgcaacagaggagagcggccatgatgaacccgaacctggcggcagcgcaaaagatg

SEQ ID NO: 120732 - DNA, 103 bp, Artificial Sequence
  Synthetic Polynucleotide
taatacgactcactatagggcgtacgccatggggctcatgcacgggttcaaacagaggagatgaaccatggcatgagccaacctggcggcagcgcaaaagatg

SEQ ID NO: 120733 - DNA, 103 bp, Artificial Sequence
  Synthetic Polynucleotide
taatacgactcactatagggttggacggcgcgtacgccatggggctcatgaacagaggagacatgagatgcatggcgtaaacctggcggcagcgcaaaagatg

SEQ ID NO: 120734 - DNA, 103 bp, Artificial Sequence
  Synthetic Polynucleotide
taatacgactcactataggggcggcccaggttggacggcgcgtacgccataacagaggagaatggcgatggcgccgtccaacctggcggcagcgcaaaagatg

SEQ ID NO: 120735 - DNA, 103 bp, Artificial Sequence
  Synthetic Polynucleotide
taatacgactcactatagggccgcgcggctgcggcccaggttggacggcgaacagaggagacgccgtatgacctgggccaacctggcggcagcgcaaaagatg

SEQ ID NO: 120736 - DNA, 103 bp, Artificial Sequence
  Synthetic Polynucleotide
taatacgactcactatagggccgccgccgcccgcgcggctgcggcccaggaacagaggagacctgggatgcagccgcgcaacctggcggcagcgcaaaagatg

SEQ ID NO: 120737 - DNA, 103 bp, Artificial Sequence
  Synthetic Polynucleotide
taatacgactcactatagggcttggcgtcgccgccgccgcccgcgcggctaacagaggagaagccgcatgggcggcggcaacctggcggcagcgcaaaagatg

SEQ ID NO: 120738 - DNA, 103 bp, Artificial Sequence
  Synthetic Polynucleotide
taatacgactcactataggggcttgaacgtcttggcgtcgccgccgccgcaacagaggagagcggcgatggcgacgccaaacctggcggcagcgcaaaagatg

SEQ ID NO: 120739 - DNA, 103 bp, Artificial Sequence
  Synthetic Polynucleotide
taatacgactcactataggggggtagctgcgcttgaacgtcttggcgtcgaacagaggagacgacgcatggacgttcaaaacctggcggcagcgcaaaagatg

SEQ ID NO: 120740 - DNA, 103 bp, Artificial Sequence
  Synthetic Polynucleotide
taatacgactcactatagggcttggcgtgcgggtagctgcgcttgaacgtaacagaggagaacgttcatgcgcagctacaacctggcggcagcgcaaaagatg

SEQ ID NO: 120741 - DNA, 103 bp, Artificial Sequence
  Synthetic Polynucleotide
taatacgactcactatagggcctgcgtgtctgcgtagtagctgttccagtaacagaggagaactggaatggctactacgaacctggcggcagcgcaaaagatg

SEQ ID NO: 120742 - DNA, 103 bp, Artificial Sequence
  Synthetic Polynucleotide
taatacgactcactatagggagtagggcggcttggcgtgcgggtagctgcaacagaggagagcagctatgcgcacgccaaacctggcggcagcgcaaaagatg

SEQ ID NO: 120743 - DNA, 103 bp, Artificial Sequence
  Synthetic Polynucleotide
taatacgactcactataggggagatgtacgagtagggcggcttggcgtgcaacagaggagagcacgcatggccgccctaaacctggcggcagcgcaaaagatg

SEQ ID NO: 120744 - DNA, 103 bp, Artificial Sequence
  Synthetic Polynucleotide
taatacgactcactatagggggtgatgagcgagatgtacgagtagggcggaacagaggagaccgcccatgtcgtacatcaacctggcggcagcgcaaaagatg

SEQ ID NO: 120745 - DNA, 103 bp, Artificial Sequence
  Synthetic Polynucleotide
taatacgactcactatagggggatggccatggtgatgagcgagatgtacgaacagaggagacgtacaatgcgctcatcaaacctggcggcagcgcaaaagatg

SEQ ID NO: 120746 - DNA, 103 bp, Artificial Sequence
  Synthetic Polynucleotide
taatacgactcactatagggggcgcctgctggatggccatggtgatgagcaacagaggagagctcatatgcatggccataacctggcggcagcgcaaaagatg

SEQ ID NO: 120747 - DNA, 103 bp, Artificial Sequence
  Synthetic Polynucleotide
taatacgactcactatagggcatcttgctgggcgcctgctggatggccataacagaggagaatggccatgcagcaggcgaacctggcggcagcgcaaaagatg

SEQ ID NO: 120748 - DNA, 103 bp, Artificial Sequence
  Synthetic Polynucleotide
taatacgactcactatagggtcagcgtgagcatcttgctgggcgcctgctaacagaggagaagcaggatgccagcaagaaacctggcggcagcgcaaaagatg

SEQ ID NO: 120749 - DNA, 103 bp, Artificial Sequence
  Synthetic Polynucleotide
taatacgactcactatagggtagatctcgctcagcgtgagcatcttgctgaacagaggagacagcaaatggctcacgctaacctggcggcagcgcaaaagatg

SEQ ID NO: 120750 - DNA, 103 bp, Artificial Sequence
  Synthetic Polynucleotide
taatacgactcactataggggatccactggtagatctcgctcagcgtgagaacagaggagactcacgatgagcgagatcaacctggcggcagcgcaaaagatg

SEQ ID NO: 120751 - DNA, 103 bp, Artificial Sequence
  Synthetic Polynucleotide
taatacgactcactatagggagaggtccatgatccactggtagatctcgcaacagaggagagcgagaatgaccagtggaaacctggcggcagcgcaaaagatg

SEQ ID NO: 120752 - DNA, 103 bp, Artificial Sequence
  Synthetic Polynucleotide
taatacgactcactataggggagtaggcctcctgcgtgtctgcgtagtagaacagaggagactactaatgagacacgcaaacctggcggcagcgcaaaagatg

SEQ ID NO: 120753 - DNA, 103 bp, Artificial Sequence
  Synthetic Polynucleotide
taatacgactcactatagggtaataggggaagaggtccatgatccactggaacagaggagaccagtgatgcatggacctaacctggcggcagcgcaaaagatg

SEQ ID NO: 120754 - DNA, 103 bp, Artificial Sequence
  Synthetic Polynucleotide
taatacgactcactataggggttctgccggtaataggggaagaggtccataacagaggagaatggacatgttcccctataacctggcggcagcgcaaaagatg

SEQ ID NO: 120755 - DNA, 103 bp, Artificial Sequence
  Synthetic Polynucleotide
taatacgactcactatagggagcgctgctggttctgccggtaataggggaaacagaggagatcccctatgaccggcagaaacctggcggcagcgcaaaagatg

SEQ ID NO: 120756 - DNA, 103 bp, Artificial Sequence
  Synthetic Polynucleotide
taatacgactcactataggggagttctgccagcgctgctggttctgccggaacagaggagaccggcaatgccagcagcgaacctggcggcagcgcaaaagatg

SEQ ID NO: 120757 - DNA, 103 bp, Artificial Sequence
  Synthetic Polynucleotide
taatacgactcactataggggtggcggatggagttctgccagcgctgctgaacagaggagacagcagatgtggcagaacaacctggcggcagcgcaaaagatg

SEQ ID NO: 120758 - DNA, 103 bp, Artificial Sequence
  Synthetic Polynucleotide
taatacgactcactatagggaggacagcgagtggcggatggagttctgccaacagaggagaggcagaatgccatccgccaacctggcggcagcgcaaaagatg

SEQ ID NO: 120759 - DNA, 103 bp, Artificial Sequence
  Synthetic Polynucleotide
taatacgactcactatagggcagtcattgaaggacagcgagtggcggatgaacagaggagacatccgatgctcgctgtcaacctggcggcagcgcaaaagatg

SEQ ID NO: 120760 - DNA, 103 bp, Artificial Sequence
  Synthetic Polynucleotide
taatacgactcactatagggcttgacgaagcagtcattgaaggacagcgaaacagaggagatcgctgatgttcaatgacaacctggcggcagcgcaaaagatg

SEQ ID NO: 120761 - DNA, 103 bp, Artificial Sequence
  Synthetic Polynucleotide
taatacgactcactatagggagcgtgccaccttgacgaagcagtcattgaaacagaggagatcaatgatggcttcgtcaaacctggcggcagcgcaaaagatg

SEQ ID NO: 120762 - DNA, 103 bp, Artificial Sequence
  Synthetic Polynucleotide
taatacgactcactatagggttgtccggggagcgtgccaccttgacgaagaacagaggagacttcgtatgggtggcacgaacctggcggcagcgcaaaagatg

SEQ ID NO: 120763 - DNA, 103 bp, Artificial Sequence
  Synthetic Polynucleotide
taatacgactcactatagggcgggacggaggagtaggcctcctgcgtgtcaacagaggagagacacgatggaggcctacaacctggcggcagcgcaaaagatg

SEQ ID NO: 120764 - DNA, 103 bp, Artificial Sequence
  Synthetic Polynucleotide
taatacgactcactatagggcttgcccggcttgtccggggagcgtgccacaacagaggagagtggcaatgtccccggacaacctggcggcagcgcaaaagatg

SEQ ID NO: 120765 - DNA, 103 bp, Artificial Sequence
  Synthetic Polynucleotide
taatacgactcactatagggagtaggagcccttgcccggcttgtccggggaacagaggagaccccggatgagccgggcaaacctggcggcagcgcaaaagatg

SEQ ID NO: 120766 - DNA, 103 bp, Artificial Sequence
  Synthetic Polynucleotide
taatacgactcactatagggtgcagcgtccagtaggagcccttgcccggcaacagaggagagccgggatggggctcctaaacctggcggcagcgcaaaagatg

SEQ ID NO: 120767 - DNA, 103 bp, Artificial Sequence
  Synthetic Polynucleotide
taatacgactcactatagggggagtccgggtgcagcgtccagtaggagccaacagaggagaggctccatgtggacgctgaacctggcggcagcgcaaaagatg

SEQ ID NO: 120768 - DNA, 103 bp, Artificial Sequence
  Synthetic Polynucleotide
taatacgactcactatagggacatgttgccggagtccgggtgcagcgtccaacagaggagaggacgcatgacccggactaacctggcggcagcgcaaaagatg

SEQ ID NO: 120769 - DNA, 103 bp, Artificial Sequence
  Synthetic Polynucleotide
taatacgactcactatagggccgttctcgaacatgttgccggagtccgggaacagaggagacccggaatgcggcaacataacctggcggcagcgcaaaagatg

SEQ ID NO: 120770 - DNA, 103 bp, Artificial Sequence
  Synthetic Polynucleotide
taatacgactcactatagggcaagtagcagccgttctcgaacatgttgccaacagaggagaggcaacatgttcgagaacaacctggcggcagcgcaaaagatg

SEQ ID NO: 120771 - DNA, 103 bp, Artificial Sequence
  Synthetic Polynucleotide
taatacgactcactatagggtctggcggcgcaagtagcagccgttctcgaaacagaggagatcgagaatggctgctactaacctggcggcagcgcaaaagatg

SEQ ID NO: 120772 - DNA, 103 bp, Artificial Sequence
  Synthetic Polynucleotide
taatacgactcactatagggttgaagcgcttctggcggcgcaagtagcagaacagaggagactgctaatggcgccgccaaacctggcggcagcgcaaaagatg

SEQ ID NO: 120773 - DNA, 103 bp, Artificial Sequence
  Synthetic Polynucleotide
taatacgactcactatagggcttctcgcacttgaagcgcttctggcggcgaacagaggagacgccgcatgaagcgcttcaacctggcggcagcgcaaaagatg

SEQ ID NO: 120774 - DNA, 103 bp, Artificial Sequence
  Synthetic Polynucleotide
taatacgactcactatagggtgttgctgaccgggacggaggagtaggcctaacagaggagaaggcctatgcctccgtccaacctggcggcagcgcaaaagatg

SEQ ID NO: 120775 - DNA, 103 bp, Artificial Sequence
  Synthetic Polynucleotide
taatacgactcactatagggcccccggctgcttctcgcacttgaagcgctaacagaggagaagcgctatgagtgcgagaaacctggcggcagcgcaaaagatg

SEQ ID NO: 120776 - DNA, 103 bp, Artificial Sequence
  Synthetic Polynucleotide
taatacgactcactatagggccgccgccggcccccggctgcttctcgcacaacagaggagagtgcgaatggcagccgggaacctggcggcagcgcaaaagatg

SEQ ID NO: 120777 - DNA, 103 bp, Artificial Sequence
  Synthetic Polynucleotide
taatacgactcactataggggctcccgcccccgccgccggcccccggctgaacagaggagacagccgatggccggcggcaacctggcggcagcgcaaaagatg

SEQ ID NO: 120778 - DNA, 103 bp, Artificial Sequence
  Synthetic Polynucleotide
taatacgactcactatagggccccgcttccgctcccgcccccgccgccggaacagaggagaccggcgatgggggcgggaaacctggcggcagcgcaaaagatg

SEQ ID NO: 120779 - DNA, 103 bp, Artificial Sequence
  Synthetic Polynucleotide
taatacgactcactataggggcgccgctgcccccgcttccgctcccgcccaacagaggagagggcggatgcggaagcggaacctggcggcagcgcaaaagatg

SEQ ID NO: 120780 - DNA, 103 bp, Artificial Sequence
  Synthetic Polynucleotide
taatacgactcactataggggccgcccttggcgccgctgcccccgcttccaacagaggagaggaagcatgggcagcggcaacctggcggcagcgcaaaagatg

SEQ ID NO: 120781 - DNA, 103 bp, Artificial Sequence
  Synthetic Polynucleotide
taatacgactcactatagggggctctcagggccgcccttggcgccgctgcaacagaggagagcagcgatgccaagggcgaacctggcggcagcgcaaaagatg

SEQ ID NO: 120782 - DNA, 103 bp, Artificial Sequence
  Synthetic Polynucleotide
taatacgactcactataggggggtccttgcggctctcagggccgcccttgaacagaggagacaagggatgccctgagagaacctggcggcagcgcaaaagatg

SEQ ID NO: 120783 - DNA, 103 bp, Artificial Sequence
  Synthetic Polynucleotide
taatacgactcactatagggggcgccagaggggtccttgcggctctcaggaacagaggagacctgagatgcgcaaggacaacctggcggcagcgcaaaagatg

SEQ ID NO: 120784 - DNA, 103 bp, Artificial Sequence
  Synthetic Polynucleotide
taatacgactcactatagggtggggttagaggcgccagaggggtccttgcaacagaggagagcaaggatgcctctggcgaacctggcggcagcgcaaaagatg

SEQ ID NO: 120785 - DNA, 103 bp, Artificial Sequence
  Synthetic Polynucleotide
taatacgactcactatagggcctgagttcatgttgctgaccgggacggagaacagaggagactccgtatgggtcagcaaaacctggcggcagcgcaaaagatg

SEQ ID NO: 120786 - DNA, 103 bp, Artificial Sequence
  Synthetic Polynucleotide
taatacgactcactataggggagtcggcgctggggttagaggcgccagagaacagaggagactctggatgctctaacccaacctggcggcagcgcaaaagatg

SEQ ID NO: 120787 - DNA, 103 bp, Artificial Sequence
  Synthetic Polynucleotide
taatacgactcactatagggatggaggggcgagtcggcgctggggttagaaacagaggagatctaacatgagcgccgacaacctggcggcagcgcaaaagatg

SEQ ID NO: 120788 - DNA, 103 bp, Artificial Sequence
  Synthetic Polynucleotide
taatacgactcactataggggcacaccccgatggaggggcgagtcggcgcaacagaggagagcgccgatgcgcccctccaacctggcggcagcgcaaaagatg

SEQ ID NO: 120789 - DNA, 103 bp, Artificial Sequence
  Synthetic Polynucleotide
taatacgactcactataggggtcttcccgtgcacaccccgatggaggggcaacagaggagagcccctatgtcggggtgtaacctggcggcagcgcaaaagatg

SEQ ID NO: 120790 - DNA, 103 bp, Artificial Sequence
  Synthetic Polynucleotide
taatacgactcactatagggtagctggccggtcttcccgtgcacaccccgaacagaggagacggggtatgcacgggaagaacctggcggcagcgcaaaagatg

SEQ ID NO: 120791 - DNA, 103 bp, Artificial Sequence
  Synthetic Polynucleotide
taatacgactcactataggggcgcgccctctagctggccggtcttcccgtaacagaggagaacgggaatgccggccagcaacctggcggcagcgcaaaagatg

SEQ ID NO: 120792 - DNA, 103 bp, Artificial Sequence
  Synthetic Polynucleotide
taatacgactcactatagggccgggggccggcgcgccctctagctggccgaacagaggagacggccaatgagagggcgcaacctggcggcagcgcaaaagatg

SEQ ID NO: 120793 - DNA, 103 bp, Artificial Sequence
  Synthetic Polynucleotide
taatacgactcactatagggggcggcgggcccgggggccggcgcgccctcaacagaggagagagggcatgccggcccccaacctggcggcagcgcaaaagatg

SEQ ID NO: 120794 - DNA, 103 bp, Artificial Sequence
  Synthetic Polynucleotide
taatacgactcactatagggtctgggggctggcggcgggcccgggggccgaacagaggagacggcccatgggcccgccgaacctggcggcagcgcaaaagatg

SEQ ID NO: 120795 - DNA, 103 bp, Artificial Sequence
  Synthetic Polynucleotide
taatacgactcactatagggtggtccagagtctgggggctggcggcgggcaacagaggagagcccgcatgcagcccccaaacctggcggcagcgcaaaagatg

SEQ ID NO: 120796 - DNA, 103 bp, Artificial Sequence
  Synthetic Polynucleotide
taatacgactcactataggggtgcccttccatcttcaccgctcccagcataacagaggagaatgctgatggcggtgaagaacctggcggcagcgcaaaagatg

SEQ ID NO: 120797 - DNA, 103 bp, Artificial Sequence
  Synthetic Polynucleotide
taatacgactcactatagggcatgccgttcatccccaggccggcgttcataacagaggagaatgaacatgggcctggggaacctggcggcagcgcaaaagatg

SEQ ID NO: 120798 - DNA, 103 bp, Artificial Sequence
  Synthetic Polynucleotide
taatacgactcactatagggcccgggagagggcgccggctctggggggctaacagaggagaagccccatggagccggcgaacctggcggcagcgcaaaagatg

SEQ ID NO: 120799 - DNA, 103 bp, Artificial Sequence
  Synthetic Polynucleotide
taatacgactcactataggggctgctgctgcccgggagagggcgccggctaacagaggagaagccggatgcctctcccgaacctggcggcagcgcaaaagatg

SEQ ID NO: 120800 - DNA, 103 bp, Artificial Sequence
  Synthetic Polynucleotide
taatacgactcactataggggccgcggcctgctgctgctgcccgggagagaacagaggagactctccatggcagcagcaaacctggcggcagcgcaaaagatg

SEQ ID NO: 120801 - DNA, 103 bp, Artificial Sequence
  Synthetic Polynucleotide
taatacgactcactatagggcagcaggtgggccgcggcctgctgctgctgaacagaggagacagcagatgcaggccgcgaacctggcggcagcgcaaaagatg

SEQ ID NO: 120802 - DNA, 103 bp, Artificial Sequence
  Synthetic Polynucleotide
taatacgactcactatagggggggcgggcccagcaggtgggccgcggcctaacagaggagaaggccgatgcccacctgcaacctggcggcagcgcaaaagatg

SEQ ID NO: 120803 - DNA, 103 bp, Artificial Sequence
  Synthetic Polynucleotide
taatacgactcactatagggcccgggtggtggggcgggcccagcaggtggaacagaggagaccacctatggggcccgccaacctggcggcagcgcaaaagatg

SEQ ID NO: 120804 - DNA, 103 bp, Artificial Sequence
  Synthetic Polynucleotide
taatacgactcactatagggaggcggcaggcccgggtggtggggcgggccaacagaggagaggcccgatgcaccacccgaacctggcggcagcgcaaaagatg

SEQ ID NO: 120805 - DNA, 103 bp, Artificial Sequence
  Synthetic Polynucleotide
taatacgactcactatagggggtgggcctcaggcggcaggcccgggtggtaacagaggagaaccaccatggcctgccgcaacctggcggcagcgcaaaagatg

SEQ ID NO: 120806 - DNA, 103 bp, Artificial Sequence
  Synthetic Polynucleotide
taatacgactcactatagggtccggcttcaggtgggcctcaggcggcaggaacagaggagacctgccatgtgaggcccaaacctggcggcagcgcaaaagatg

SEQ ID NO: 120807 - DNA, 103 bp, Artificial Sequence
  Synthetic Polynucleotide
taatacgactcactataggggtagtggtgttccggcttcaggtgggcctcaacagaggagagaggccatgctgaagccgaacctggcggcagcgcaaaagatg

SEQ ID NO: 120808 - DNA, 103 bp, Artificial Sequence
  Synthetic Polynucleotide
taatacgactcactatagggtgtacgtgttcatgccgttcatccccaggcaacagaggagagcctggatgtgaacggcaaacctggcggcagcgcaaaagatg

SEQ ID NO: 120809 - DNA, 103 bp, Artificial Sequence
  Synthetic Polynucleotide
taatacgactcactatagggggttgaaggcgtagtggtgttccggcttcaaacagaggagatgaagcatgaacaccactaacctggcggcagcgcaaaagatg

SEQ ID NO: 120810 - DNA, 103 bp, Artificial Sequence
  Synthetic Polynucleotide
taatacgactcactataggggagaacgggtggttgaaggcgtagtggtgtaacagaggagaacaccaatgcgccttcaaaacctggcggcagcgcaaaagatg

SEQ ID NO: 120811 - DNA, 103 bp, Artificial Sequence
  Synthetic Polynucleotide
taatacgactcactataggggttgttgatggagaacgggtggttgaaggcaacagaggagagccttcatgcacccgttcaacctggcggcagcgcaaaagatg

SEQ ID NO: 120812 - DNA, 103 bp, Artificial Sequence
  Synthetic Polynucleotide
taatacgactcactatagggaggacatgaggttgttgatggagaacgggtaacagaggagaacccgtatgccatcaacaaacctggcggcagcgcaaaagatg

SEQ ID NO: 120813 - DNA, 103 bp, Artificial Sequence
  Synthetic Polynucleotide
taatacgactcactatagggtgctgctccgaggacatgaggttgttgatgaacagaggagacatcaaatgcctcatgtcaacctggcggcagcgcaaaagatg

SEQ ID NO: 120814 - DNA, 103 bp, Artificial Sequence
  Synthetic Polynucleotide
taatacgactcactataggggtggtggtgctgctgctccgaggacatgagaacagaggagactcatgatgtcggagcagaacctggcggcagcgcaaaagatg

SEQ ID NO: 120815 - DNA, 103 bp, Artificial Sequence
  Synthetic Polynucleotide
taatacgactcactatagggggtggtggctgtggtggtgctgctgctccgaacagaggagacggagcatgagcaccaccaacctggcggcagcgcaaaagatg

SEQ ID NO: 120816 - DNA, 103 bp, Artificial Sequence
  Synthetic Polynucleotide
taatacgactcactatagggggttggtggtggtggtggctgtggtggtgcaacagaggagagcaccaatgcagccaccaaacctggcggcagcgcaaaagatg

SEQ ID NO: 120817 - DNA, 103 bp, Artificial Sequence
  Synthetic Polynucleotide
taatacgactcactatagggcattttgtggggttggtggtggtggtggctaacagaggagaagccacatgcaccaccaaaacctggcggcagcgcaaaagatg

SEQ ID NO: 120818 - DNA, 103 bp, Artificial Sequence
  Synthetic Polynucleotide
taatacgactcactatagggccttgaggtccattttgtggggttggtggtaacagaggagaaccaccatgcccacaaaaaacctggcggcagcgcaaaagatg

SEQ ID NO: 120819 - DNA, 103 bp, Artificial Sequence
  Synthetic Polynucleotide
taatacgactcactataggggacatgctcatgtacgtgttcatgccgttcaacagaggagagaacggatggaacacgtaaacctggcggcagcgcaaaagatg

SEQ ID NO: 120820 - DNA, 103 bp, Artificial Sequence
  Synthetic Polynucleotide
taatacgactcactatagggtgttcgtaggccttgaggtccattttgtggaacagaggagaccacaaatgggacctcaaaacctggcggcagcgcaaaagatg

SEQ ID NO: 120821 - DNA, 103 bp, Artificial Sequence
  Synthetic Polynucleotide
taatacgactcactataggggtgcatcacctgttcgtaggccttgaggtcaacagaggagagacctcatggcctacgaaaacctggcggcagcgcaaaagatg

SEQ ID NO: 120822 - DNA, 103 bp, Artificial Sequence
  Synthetic Polynucleotide
taatacgactcactatagggagccggggtagtgcatcacctgttcgtaggaacagaggagacctacgatgaggtgatgcaacctggcggcagcgcaaaagatg

SEQ ID NO: 120823 - DNA, 103 bp, Artificial Sequence
  Synthetic Polynucleotide
taatacgactcactatagggggggaaccgtagccggggtagtgcatcaccaacagaggagaggtgatatgctaccccggaacctggcggcagcgcaaaagatg

SEQ ID NO: 120824 - DNA, 103 bp, Artificial Sequence
  Synthetic Polynucleotide
taatacgactcactataggggccaggcatgggggaaccgtagccggggtaaacagaggagataccccatgtacggttccaacctggcggcagcgcaaaagatg

SEQ ID NO: 120825 - DNA, 103 bp, Artificial Sequence
  Synthetic Polynucleotide
taatacgactcactatagggtggccaagctgccaggcatgggggaaccgtaacagaggagaacggttatgccatgcctgaacctggcggcagcgcaaaagatg

SEQ ID NO: 120826 - DNA, 103 bp, Artificial Sequence
  Synthetic Polynucleotide
taatacgactcactatagggaccgggcccatggccaagctgccaggcatgaacagaggagacatgccatgcagcttggcaacctggcggcagcgcaaaagatg

SEQ ID NO: 120827 - DNA, 103 bp, Artificial Sequence
  Synthetic Polynucleotide
taatacgactcactatagggtttgttcgtgaccgggcccatggccaagctaacagaggagaagcttgatgatgggcccgaacctggcggcagcgcaaaagatg

SEQ ID NO: 120828 - DNA, 103 bp, Artificial Sequence
  Synthetic Polynucleotide
taatacgactcactatagggccaggcccgttttgttcgtgaccgggcccaaacagaggagatgggccatgtcacgaacaaacctggcggcagcgcaaaagatg

SEQ ID NO: 120829 - DNA, 103 bp, Artificial Sequence
  Synthetic Polynucleotide
taatacgactcactatagggggcgaggcgtccaggcccgttttgttcgtgaacagaggagacacgaaatgaacgggcctaacctggcggcagcgcaaaagatg

SEQ ID NO: 120830 - DNA, 103 bp, Artificial Sequence
  Synthetic Polynucleotide
taatacgactcactatagggggcggccgccgacatgctcatgtacgtgttaacagaggagaaacacgatgatgagcatgaacctggcggcagcgcaaaagatg

SEQ ID NO: 120831 - DNA, 103 bp, Artificial Sequence
  Synthetic Polynucleotide
taatacgactcactatagggtgcggccaggggcgaggcgtccaggcccgtaacagaggagaacgggcatggacgcctcgaacctggcggcagcgcaaaagatg

SEQ ID NO: 120832 - DNA, 103 bp, Artificial Sequence
  Synthetic Polynucleotide
taatacgactcactatagggaggaggtatctgcggccaggggcgaggcgtaacagaggagaacgcctatgccctggccgaacctggcggcagcgcaaaagatg

SEQ ID NO: 120833 - DNA, 103 bp, Artificial Sequence
  Synthetic Polynucleotide
taatacgactcactatagggccctggtagtaggaggtatctgcggccaggaacagaggagacctggcatgagatacctcaacctggcggcagcgcaaaagatg

SEQ ID NO: 120834 - DNA, 103 bp, Artificial Sequence
  Synthetic Polynucleotide
taatacgactcactatagggggagtacaccccctggtagtaggaggtatcaacagaggagagataccatgtactaccagaacctggcggcagcgcaaaagatg

SEQ ID NO: 120835 - DNA, 103 bp, Artificial Sequence
  Synthetic Polynucleotide
taatacgactcactatagggtaatgggccgggagtacaccccctggtagtaacagaggagaactaccatggggtgtactaacctggcggcagcgcaaaagatg

SEQ ID NO: 120836 - DNA, 103 bp, Artificial Sequence
  Synthetic Polynucleotide
taatacgactcactataggggaggagttcataatgggccgggagtacaccaacagaggagaggtgtaatgccggcccataacctggcggcagcgcaaaagatg

SEQ ID NO: 120837 - DNA, 103 bp, Artificial Sequence
  Synthetic Polynucleotide
taatacgactcactatagggcgctgcccatggcggccgccgacatgctcaaacagaggagatgagcaatgcggcggccgaacctggcggcagcgcaaaagatg

SEQ ID NO: 120838 - DNA, 103 bp, Artificial Sequence
  Synthetic Polynucleotide
taatacgactcactatagggttgcccgagccgctgcccatggcggccgccaacagaggagaggcggcatgcatgggcagaacctggcggcagcgcaaaagatg

SEQ ID NO: 120839 - DNA, 103 bp, Artificial Sequence
  Synthetic Polynucleotide
taatacgactcactatagggcgcgctcatgttgcccgagccgctgcccataacagaggagaatgggcatgggctcgggcaacctggcggcagcgcaaaagatg

SEQ ID NO: 120840 - DNA, 103 bp, Artificial Sequence
  Synthetic Polynucleotide
taatacgactcactatagggtcatggagcccgcgctcatgttgcccgagcaacagaggagagctcggatgacatgagcgaacctggcggcagcgcaaaagatg

SEQ ID NO: 120841 - DNA, 103 bp, Artificial Sequence
  Synthetic Polynucleotide
taatacgactcactataggggacgacatgttcatggagcccgcgctcatgaacagaggagacatgagatggggctccataacctggcggcagcgcaaaagatg

SEQ ID NO: 120842 - DNA, 103 bp, Artificial Sequence
  Synthetic Polynucleotide
taatacgactcactataggggcccacgtacgacgacatgttcatggagccaacagaggagaggctccatgaacatgtcgaacctggcggcagcgcaaaagatg

SEQ ID NO: 120843 - DNA, 103 bp, Artificial Sequence
  Synthetic Polynucleotide
taatacgactcactatagggcggacggctcgtgcccttccatcttcaccgaacagaggagacggtgaatgtggaagggcaacctggcggcagcgcaaaagatg

SEQ ID NO: 120844 - DNA, 103 bp, Artificial Sequence
  Synthetic Polynucleotide
taatacgactcactatagggtcatgccagcgcccacgtacgacgacatgtaacagaggagaacatgtatgcgtacgtggaacctggcggcagcgcaaaagatg

SEQ ID NO: 120845 - DNA, 103 bp, Artificial Sequence
  Synthetic Polynucleotide
taatacgactcactatagggagggacgggctcatgccagcgcccacgtacaacagaggagagtacgtatgcgctggcataacctggcggcagcgcaaaagatg

SEQ ID NO: 120846 - DNA, 103 bp, Artificial Sequence
  Synthetic Polynucleotide
taatacgactcactatagggcatccccgccagggacgggctcatgccagcaacagaggagagctggcatgagcccgtccaacctggcggcagcgcaaaagatg

SEQ ID NO: 120847 - DNA, 103 bp, Artificial Sequence
  Synthetic Polynucleotide
taatacgactcactatagggcgccgggggacatccccgccagggacgggcaacagaggagagcccgtatgtggcggggaaacctggcggcagcgcaaaagatg

SEQ ID NO: 120848 - DNA, 103 bp, Artificial Sequence
  Synthetic Polynucleotide
taatacgactcactatagggatggcgcccgcgccgggggacatccccgccaacagaggagaggcgggatggtcccccggaacctggcggcagcgcaaaagatg

SEQ ID NO: 120849 - DNA, 103 bp, Artificial Sequence
  Synthetic Polynucleotide
taatacgactcactatagggcatgcccgccatggcgcccgcgccgggggaaacagaggagatcccccatggcgggcgccaacctggcggcagcgcaaaagatg

SEQ ID NO: 120850 - DNA, 103 bp, Artificial Sequence
  Synthetic Polynucleotide
taatacgactcactatagggccgagccgcccatgcccgccatggcgcccgaacagaggagacgggcgatgtggcgggcaaacctggcggcagcgcaaaagatg

SEQ ID NO: 120851 - DNA, 103 bp, Artificial Sequence
  Synthetic Polynucleotide
taatacgactcactataggggccgccccggccgagccgcccatgcccgccaacagaggagaggcgggatggggcggctcaacctggcggcagcgcaaaagatg

SEQ ID NO: 120852 - DNA, 103 bp, Artificial Sequence
  Synthetic Polynucleotide
taatacgactcactatagggcgccacgccggccgccccggccgagccgccaacagaggagaggcggcatggccggggcgaacctggcggcagcgcaaaagatg

SEQ ID NO: 120853 - DNA, 103 bp, Artificial Sequence
  Synthetic Polynucleotide
taatacgactcactataggggccccatgcccgccacgccggccgccccggaacagaggagaccggggatgccggcgtggaacctggcggcagcgcaaaagatg

SEQ ID NO: 120854 - DNA, 103 bp, Artificial Sequence
  Synthetic Polynucleotide
taatacgactcactatagggctgctccagtcggacggctcgtgcccttccaacagaggagaggaaggatgcgagccgtcaacctggcggcagcgcaaaagatg

SEQ ID NO: 120855 - DNA, 103 bp, Artificial Sequence
  Synthetic Polynucleotide
taatacgactcactatagggctcaagtgcggccccatgcccgccacgccgaacagaggagacggcgtatggggcatgggaacctggcggcagcgcaaaagatg

SEQ ID NO: 120856 - DNA, 103 bp, Artificial Sequence
  Synthetic Polynucleotide
taatacgactcactatagggcaggctgggactcaagtgcggccccatgccaacagaggagaggcatgatgccgcacttgaacctggcggcagcgcaaaagatg

SEQ ID NO: 120857 - DNA, 103 bp, Artificial Sequence
  Synthetic Polynucleotide
taatacgactcactatagggcgagcgggctcaggctgggactcaagtgcgaacagaggagacgcactatggtcccagccaacctggcggcagcgcaaaagatg

SEQ ID NO: 120858 - DNA, 103 bp, Artificial Sequence
  Synthetic Polynucleotide
taatacgactcactataggggcctgccccccgagcgggctcaggctgggaaacagaggagatcccagatggagcccgctaacctggcggcagcgcaaaagatg

SEQ ID NO: 120859 - DNA, 103 bp, Artificial Sequence
  Synthetic Polynucleotide
taatacgactcactatagggggccccggccgcctgccccccgagcgggctaacagaggagaagcccgatgggggggcagaacctggcggcagcgcaaaagatg

SEQ ID NO: 120860 - DNA, 103 bp, Artificial Sequence
  Synthetic Polynucleotide
taatacgactcactatagggggccgcccatggccccggccgcctgcccccaacagaggagagggggcatgcggccggggaacctggcggcagcgcaaaagatg

SEQ ID NO: 120861 - DNA, 103 bp, Artificial Sequence
  Synthetic Polynucleotide
taatacgactcactatagggtagggggccaggccgcccatggccccggccaacagaggagaggccggatgcatgggcggaacctggcggcagcgcaaaagatg

SEQ ID NO: 120862 - DNA, 103 bp, Artificial Sequence
  Synthetic Polynucleotide
taatacgactcactatagggcatgttggcgtagggggccaggccgcccataacagaggagaatgggcatgctggcccccaacctggcggcagcgcaaaagatg

SEQ ID NO: 120863 - DNA, 103 bp, Artificial Sequence
  Synthetic Polynucleotide
taatacgactcactatagggtcatggagttcatgttggcgtagggggccaaacagaggagatggcccatgacgccaacaaacctggcggcagcgcaaaagatg

SEQ ID NO: 120864 - DNA, 103 bp, Artificial Sequence
  Synthetic Polynucleotide
taatacgactcactatagggtacatggggctcatggagttcatgttggcgaacagaggagacgccaaatggaactccataacctggcggcagcgcaaaagatg

SEQ ID NO: 120865 - DNA, 103 bp, Artificial Sequence
  Synthetic Polynucleotide
taatacgactcactatagggtgcatagtagctgctccagtcggacggctcaacagaggagagagccgatggactggagcaacctggcggcagcgcaaaagatg

SEQ ID NO: 120866 - DNA, 103 bp, Artificial Sequence
  Synthetic Polynucleotide
taatacgactcactatagggcgcctgcccgtacatggggctcatggagttaacagaggagaaactccatgagccccatgaacctggcggcagcgcaaaagatg

SEQ ID NO: 120867 - DNA, 103 bp, Artificial Sequence
  Synthetic Polynucleotide
taatacgactcactatagggggctcaggcccgcctgcccgtacatggggcaacagaggagagccccaatgacgggcaggaacctggcggcagcgcaaaagatg

SEQ ID NO: 120868 - DNA, 103 bp, Artificial Sequence
  Synthetic Polynucleotide
taatacgactcactatagggtcgcgggcgcggctcaggcccgcctgcccgaacagaggagacgggcaatggggcctgagaacctggcggcagcgcaaaagatg

SEQ ID NO: 120869 - DNA, 103 bp, Artificial Sequence
  Synthetic Polynucleotide
taatacgactcactatagggggtcttggggtcgcgggcgcggctcaggccaacagaggagaggcctgatgcgcgcccgcaacctggcggcagcgcaaaagatg

SEQ ID NO: 120870 - DNA, 103 bp, Artificial Sequence
  Synthetic Polynucleotide
taatacgactcactatagggtgcgcctgtaggtcttggggtcgcgggcgcaacagaggagagcgcccatgaccccaagaaacctggcggcagcgcaaaagatg

SEQ ID NO: 120871 - DNA, 103 bp, Artificial Sequence
  Synthetic Polynucleotide
taatacgactcactatagggtgcgtgtagctgcgcctgtaggtcttggggaacagaggagaccccaaatgctacaggcgaacctggcggcagcgcaaaagatg

SEQ ID NO: 120872 - DNA, 103 bp, Artificial Sequence
  Synthetic Polynucleotide
taatacgactcactatagggcggctttgcgtgcgtgtagctgcgcctgtaaacagaggagatacaggatgagctacacgaacctggcggcagcgcaaaagatg

SEQ ID NO: 120873 - DNA, 103 bp, Artificial Sequence
  Synthetic Polynucleotide
taatacgactcactatagggacgagtagggcggctttgcgtgcgtgtagcaacagaggagagctacaatgacgcaaagcaacctggcggcagcgcaaaagatg

SEQ ID NO: 120874 - DNA, 103 bp, Artificial Sequence
  Synthetic Polynucleotide
taatacgactcactatagggagcgagatgtacgagtagggcggctttgcgaacagaggagacgcaaaatggccctactcaacctggcggcagcgcaaaagatg

SEQ ID NO: 120875 - DNA, 103 bp, Artificial Sequence
  Synthetic Polynucleotide
taatacgactcactatagggcatggtgatgagcgagatgtacgagtagggaacagaggagaccctacatgtacatctcgaacctggcggcagcgcaaaagatg

SEQ ID NO: 120876 - DNA, 103 bp, Artificial Sequence
  Synthetic Polynucleotide
taatacgactcactatagggcctcgggctctgcatagtagctgctccagtaacagaggagaactggaatggctactatgaacctggcggcagcgcaaaagatg

SEQ ID NO: 120877 - DNA, 103 bp, Artificial Sequence
  Synthetic Polynucleotide
taatacgactcactataggggctggatggccatggtgatgagcgagatgtaacagaggagaacatctatgtcatcaccaaacctggcggcagcgcaaaagatg

SEQ ID NO: 120878 - DNA, 103 bp, Artificial Sequence
  Synthetic Polynucleotide
taatacgactcactatagggttggggctctgctggatggccatggtgatgaacagaggagacatcacatgggccatccaaacctggcggcagcgcaaaagatg

SEQ ID NO: 120879 - DNA, 103 bp, Artificial Sequence
  Synthetic Polynucleotide
taatacgactcactatagggcagcatcttgttggggctctgctggatggcaacagaggagagccatcatgcagagccccaacctggcggcagcgcaaaagatg

SEQ ID NO: 120880 - DNA, 103 bp, Artificial Sequence
  Synthetic Polynucleotide
taatacgactcactatagggcgctcagcgtcagcatcttgttggggctctaacagaggagaagagccatgacaagatgcaacctggcggcagcgcaaaagatg

SEQ ID NO: 120881 - DNA, 103 bp, Artificial Sequence
  Synthetic Polynucleotide
taatacgactcactatagggtggtagatctcgctcagcgtcagcatcttgaacagaggagacaagatatggacgctgagaacctggcggcagcgcaaaagatg

SEQ ID NO: 120882 - DNA, 103 bp, Artificial Sequence
  Synthetic Polynucleotide
taatacgactcactatagggcatgatccactggtagatctcgctcagcgtaacagaggagaacgctgatggagatctacaacctggcggcagcgcaaaagatg

SEQ ID NO: 120883 - DNA, 103 bp, Artificial Sequence
  Synthetic Polynucleotide
taatacgactcactatagggggaagaggtccatgatccactggtagatctaacagaggagaagatctatgagtggatcaaacctggcggcagcgcaaaagatg

SEQ ID NO: 120884 - DNA, 103 bp, Artificial Sequence
  Synthetic Polynucleotide
taatacgactcactatagggcggtagaaggggaagaggtccatgatccacaacagaggagagtggatatgggacctcttaacctggcggcagcgcaaaagatg

SEQ ID NO: 120885 - DNA, 103 bp, Artificial Sequence
  Synthetic Polynucleotide
taatacgactcactatagggctggttctgccggtagaaggggaagaggtcaacagaggagagacctcatgcccttctacaacctggcggcagcgcaaaagatg

SEQ ID NO: 120886 - DNA, 103 bp, Artificial Sequence
  Synthetic Polynucleotide
taatacgactcactataggggccagcgctgctggttctgccggtagaaggaacagaggagaccttctatgggcagaaccaacctggcggcagcgcaaaagatg

SEQ ID NO: 120887 - DNA, 103 bp, Artificial Sequence
  Synthetic Polynucleotide
taatacgactcactataggggaggagtagccctcgggctctgcatagtagaacagaggagactactaatgagagcccgaaacctggcggcagcgcaaaagatg

SEQ ID NO: 120888 - DNA, 103 bp, Artificial Sequence
  Synthetic Polynucleotide
taatacgactcactatagggatggagttctgccagcgctgctggttctgcaacagaggagagcagaaatggcagcgctgaacctggcggcagcgcaaaagatg

SEQ ID NO: 120889 - DNA, 103 bp, Artificial Sequence
  Synthetic Polynucleotide
taatacgactcactatagggcgagtggcggatggagttctgccagcgctgaacagaggagacagcgcatgcagaactccaacctggcggcagcgcaaaagatg

SEQ ID NO: 120890 - DNA, 103 bp, Artificial Sequence
  Synthetic Polynucleotide
taatacgactcactatagggtgaaggagagcgagtggcggatggagttctaacagaggagaagaactatgtccgccactaacctggcggcagcgcaaaagatg

SEQ ID NO: 120891 - DNA, 103 bp, Artificial Sequence
  Synthetic Polynucleotide
taatacgactcactatagggaaacagtcgttgaaggagagcgagtggcggaacagaggagaccgccaatggctctccttaacctggcggcagcgcaaaagatg

SEQ ID NO: 120892 - DNA, 103 bp, Artificial Sequence
  Synthetic Polynucleotide
taatacgactcactatagggcaccttcaggaaacagtcgttgaaggagagaacagaggagactctccatgaacgactgtaacctggcggcagcgcaaaagatg

SEQ ID NO: 120893 - DNA, 103 bp, Artificial Sequence
  Synthetic Polynucleotide
taatacgactcactataggggcgagcggggcaccttcaggaaacagtcgtaacagaggagaacgactatgtcctgaaggaacctggcggcagcgcaaaagatg

SEQ ID NO: 120894 - DNA, 103 bp, Artificial Sequence
  Synthetic Polynucleotide
taatacgactcactatagggggcttgtcgggcgagcggggcaccttcaggaacagaggagacctgaaatggccccgctcaacctggcggcagcgcaaaagatg

SEQ ID NO: 120895 - DNA, 103 bp, Artificial Sequence
  Synthetic Polynucleotide
taatacgactcactataggggcccttgccgggcttgtcgggcgagcggggaacagaggagaccccgcatgcccgacaagaacctggcggcagcgcaaaagatg

SEQ ID NO: 120896 - DNA, 103 bp, Artificial Sequence
  Synthetic Polynucleotide
taatacgactcactatagggtccagaaggagcccttgccgggcttgtcggaacagaggagaccgacaatgccggcaaggaacctggcggcagcgcaaaagatg

SEQ ID NO: 120897 - DNA, 103 bp, Artificial Sequence
  Synthetic Polynucleotide
taatacgactcactataggggggtgcagggtccagaaggagcccttgccgaacagaggagacggcaaatgctccttctgaacctggcggcagcgcaaaagatg

SEQ ID NO: 120898 - DNA, 103 bp, Artificial Sequence
  Synthetic Polynucleotide
taatacgactcactataggggttgctcacggaggagtagccctcgggctcaacagaggagagagcccatgggctactccaacctggcggcagcgcaaaagatg

SEQ ID NO: 120899 - DNA, 103 bp, Artificial Sequence
  Synthetic Polynucleotide
taatacgactcactataggggcccgagtcagggtgcagggtccagaaggaaacagaggagatccttcatgaccctgcacaacctggcggcagcgcaaaagatg

SEQ ID NO: 120900 - DNA, 103 bp, Artificial Sequence
  Synthetic Polynucleotide
taatacgactcactatagggcgaacatgttgcccgagtcagggtgcagggaacagaggagaccctgcatgctgactcggaacctggcggcagcgcaaaagatg

SEQ ID NO: 120901 - DNA, 103 bp, Artificial Sequence
  Synthetic Polynucleotide
taatacgactcactatagggcagccgttctcgaacatgttgcccgagtcaaacagaggagatgactcatgcaacatgttaacctggcggcagcgcaaaagatg

SEQ ID NO: 120902 - DNA, 103 bp, Artificial Sequence
  Synthetic Polynucleotide
taatacgactcactataggggcgcaggtagcagccgttctcgaacatgttaacagaggagaaacatgatggagaacggcaacctggcggcagcgcaaaagatg

SEQ ID NO: 120903 - DNA, 103 bp, Artificial Sequence
  Synthetic Polynucleotide
taatacgactcactataggggcttctggcggcgcaggtagcagccgttctaacagaggagaagaacgatggctacctgcaacctggcggcagcgcaaaagatg

SEQ ID NO: 120904 - DNA, 103 bp, Artificial Sequence
  Synthetic Polynucleotide
taatacgactcactatagggcacttgaagcgcttctggcggcgcaggtagaacagaggagactacctatgccgccagaaaacctggcggcagcgcaaaagatg

SEQ ID NO: 120905 - DNA, 103 bp, Artificial Sequence
  Synthetic Polynucleotide
taatacgactcactatagggctgcttctcgcacttgaagcgcttctggcgaacagaggagacgccagatgcgcttcaagaacctggcggcagcgcaaaagatg

SEQ ID NO: 120906 - DNA, 103 bp, Artificial Sequence
  Synthetic Polynucleotide
taatacgactcactatagggtcagcgccagctgcttctcgcacttgaagcaacagaggagagcttcaatggcgagaagcaacctggcggcagcgcaaaagatg

SEQ ID NO: 120907 - DNA, 103 bp, Artificial Sequence
  Synthetic Polynucleotide
taatacgactcactataggggcggcctccttcagcgccagctgcttctcgaacagaggagacgagaaatggctggcgctaacctggcggcagcgcaaaagatg

SEQ ID NO: 120908 - DNA, 103 bp, Artificial Sequence
  Synthetic Polynucleotide
taatacgactcactatagggggcggcgcctgcggcctccttcagcgccagaacagaggagactggcgatgaaggaggccaacctggcggcagcgcaaaagatg

SEQ ID NO: 120909 - DNA, 103 bp, Artificial Sequence
  Synthetic Polynucleotide
taatacgactcactatagggcggcgttcatgttgctcacggaggagtagcaacagaggagagctactatgccgtgagcaaacctggcggcagcgcaaaagatg

SEQ ID NO: 120910 - DNA, 103 bp, Artificial Sequence
  Synthetic Polynucleotide
taatacgactcactatagggtgccgctgccggcggcgcctgcggcctcctaacagaggagaaggaggatgcaggcgccgaacctggcggcagcgcaaaagatg

SEQ ID NO: 120911 - DNA, 103 bp, Artificial Sequence
  Synthetic Polynucleotide
taatacgactcactataggggccgccttcttgccgctgccggcggcgcctaacagaggagaaggcgcatgcggcagcggaacctggcggcagcgcaaaagatg

SEQ ID NO: 120912 - DNA, 103 bp, Artificial Sequence
  Synthetic Polynucleotide
taatacgactcactatagggggctccggcggccgccttcttgccgctgccaacagaggagaggcagcatgaagaaggcgaacctggcggcagcgcaaaagatg

SEQ ID NO: 120913 - DNA, 103 bp, Artificial Sequence
  Synthetic Polynucleotide
taatacgactcactataggggtgaggcctgggctccggcggccgccttctaacagaggagaagaaggatgccgccggagaacctggcggcagcgcaaaagatg

SEQ ID NO: 120914 - DNA, 103 bp, Artificial Sequence
  Synthetic Polynucleotide
taatacgactcactatagggagttgagcctgtgaggcctgggctccggcgaacagaggagacgccggatgccaggcctcaacctggcggcagcgcaaaagatg

SEQ ID NO: 120915 - DNA, 103 bp, Artificial Sequence
  Synthetic Polynucleotide
taatacgactcactatagggggcctccccgagttgagcctgtgaggcctgaacagaggagacaggccatgcaggctcaaaacctggcggcagcgcaaaagatg

SEQ ID NO: 120916 - DNA, 103 bp, Artificial Sequence
  Synthetic Polynucleotide
taatacgactcactatagggccggcccggcggcctccccgagttgagcctaacagaggagaaggctcatgtcggggaggaacctggcggcagcgcaaaagatg

SEQ ID NO: 120917 - DNA, 103 bp, Artificial Sequence
  Synthetic Polynucleotide
taatacgactcactataggggtctcggaggccggcccggcggcctccccgaacagaggagacggggaatgcgccgggccaacctggcggcagcgcaaaagatg

SEQ ID NO: 120918 - DNA, 103 bp, Artificial Sequence
  Synthetic Polynucleotide
taatacgactcactataggggcccgccggagtctcggaggccggcccggcaacagaggagagccgggatggcctccgagaacctggcggcagcgcaaaagatg

SEQ ID NO: 120919 - DNA, 103 bp, Artificial Sequence
  Synthetic Polynucleotide
taatacgactcactataggggcgactcggtgcccgccggagtctcggaggaacagaggagacctccgatgctccggcggaacctggcggcagcgcaaaagatg

SEQ ID NO: 120920 - DNA, 103 bp, Artificial Sequence
  Synthetic Polynucleotide
taatacgactcactatagggatccccaggccggcgttcatgttgctcacgaacagaggagacgtgagatgcatgaacgcaacctggcggcagcgcaaaagatg

SEQ ID NO: 120921 - DNA, 103 bp, Artificial Sequence
  Synthetic Polynucleotide
taatacgactcactatagggctcgagtgaggcgactcggtgcccgccggaaacagaggagatccggcatgcaccgagtcaacctggcggcagcgcaaaagatg

SEQ ID NO: 120922 - DNA, 103 bp, Artificial Sequence
  Synthetic Polynucleotide
taatacgactcactatagggcggggaggcgctcgagtgaggcgactcggtaacagaggagaaccgagatgcctcactcgaacctggcggcagcgcaaaagatg

SEQ ID NO: 120923 - DNA, 103 bp, Artificial Sequence
  Synthetic Polynucleotide
taatacgactcactataggggctcctggcacggggaggcgctcgagtgagaacagaggagactcactatggcgcctcccaacctggcggcagcgcaaaagatg

SEQ ID NO: 120924 - DNA, 103 bp, Artificial Sequence
  Synthetic Polynucleotide
taatacgactcactatagggcctcgcttgtgctcctggcacggggaggcgaacagaggagacgcctcatggtgccaggaaacctggcggcagcgcaaaagatg

SEQ ID NO: 120925 - DNA, 103 bp, Artificial Sequence
  Synthetic Polynucleotide
taatacgactcactatagggtcccaggccccctcgcttgtgctcctggcaaacagaggagatgccagatgcacaagcgaaacctggcggcagcgcaaaagatg

SEQ ID NO: 120926 - DNA, 103 bp, Artificial Sequence
  Synthetic Polynucleotide
taatacgactcactatagggccttcagctctcccaggccccctcgcttgtaacagaggagaacaagcatgggggcctggaacctggcggcagcgcaaaagatg

SEQ ID NO: 120927 - DNA, 103 bp, Artificial Sequence
  Synthetic Polynucleotide
taatacgactcactataggggccggcgtccccttcagctctcccaggcccaacagaggagagggcctatgagagctgaaaacctggcggcagcgcaaaagatg

SEQ ID NO: 120928 - DNA, 103 bp, Artificial Sequence
  Synthetic Polynucleotide
taatacgactcactatagggcagcgccgcagccggcgtccccttcagctcaacagaggagagagctgatggggacgccgaacctggcggcagcgcaaaagatg

SEQ ID NO: 120929 - DNA, 103 bp, Artificial Sequence
  Synthetic Polynucleotide
taatacgactcactatagggctggggggctcagcgccgcagccggcgtccaacagaggagaggacgcatgctgcggcgcaacctggcggcagcgcaaaagatg

SEQ ID NO: 120930 - DNA, 103 bp, Artificial Sequence
  Synthetic Polynucleotide
taatacgactcactatagggggcgccggctctggggggctcagcgccgcaaacagaggagatgcggcatggagccccccaacctggcggcagcgcaaaagatg

SEQ ID NO: 120931 - DNA, 103 bp, Artificial Sequence
  Synthetic Polynucleotide
taatacgactcactatagggatgggcctccatcttcactgagcccagcataacagaggagaatgctgatgtcagtgaagaacctggcggcagcgcaaaagatg

SEQ ID NO: 120932 - DNA, 103 bp, Artificial Sequence
  Synthetic Polynucleotide
taatacgactcactataggggtaggagttgaggggggccatggtgggcacaacagaggagagtgcccatgatggcccccaacctggcggcagcgcaaaagatg

SEQ ID NO: 120933 - DNA, 103 bp, Artificial Sequence
  Synthetic Polynucleotide
taatacgactcactataggggccctggtagtagactccaggctccccaccaacagaggagaggtgggatgcctggagtcaacctggcggcagcgcaaaagatg

SEQ ID NO: 120934 - DNA, 103 bp, Artificial Sequence
  Synthetic Polynucleotide
taatacgactcactataggggggaatagaggccctggtagtagactccagaacagaggagactggagatgactaccaggaacctggcggcagcgcaaaagatg

SEQ ID NO: 120935 - DNA, 103 bp, Artificial Sequence
  Synthetic Polynucleotide
taatacgactcactatagggagcaaagagcgggaatagaggccctggtagaacagaggagactaccaatgcctctattcaacctggcggcagcgcaaaagatg

SEQ ID NO: 120936 - DNA, 103 bp, Artificial Sequence
  Synthetic Polynucleotide
taatacgactcactatagggggatgcattaagcaaagagcgggaatagagaacagaggagactctatatgcgctctttgaacctggcggcagcgcaaaagatg

SEQ ID NO: 120937 - DNA, 103 bp, Artificial Sequence
  Synthetic Polynucleotide
taatacgactcactatagggtcagggtcatgtaggagttgaggggggccaaacagaggagatggcccatgtcaactcctaacctggcggcagcgcaaaagatg

SEQ ID NO: 120938 - DNA, 103 bp, Artificial Sequence
  Synthetic Polynucleotide
taatacgactcactatagggcttagaggattcagggtcatgtaggagttgaacagaggagacaactcatgcatgaccctaacctggcggcagcgcaaaagatg

SEQ ID NO: 120939 - DNA, 103 bp, Artificial Sequence
  Synthetic Polynucleotide
taatacgactcactatagggatagggagagcttagaggattcagggtcataacagaggagaatgaccatgaatcctctaaacctggcggcagcgcaaaagatg

SEQ ID NO: 120940 - DNA, 103 bp, Artificial Sequence
  Synthetic Polynucleotide
taatacgactcactatagggccccagggggatagggagagcttagaggataacagaggagaatcctcatggctctccctaacctggcggcagcgcaaaagatg

SEQ ID NO: 120941 - DNA, 103 bp, Artificial Sequence
  Synthetic Polynucleotide
taatacgactcactataggggcagggagccccccagggggatagggagagaacagaggagactctccatgtccccctggaacctggcggcagcgcaaaagatg

SEQ ID NO: 120942 - DNA, 103 bp, Artificial Sequence
  Synthetic Polynucleotide
taatacgactcactatagggcagtggggaggcagggagccccccagggggaacagaggagaccccctatggggctccctaacctggcggcagcgcaaaagatg

SEQ ID NO: 120943 - DNA, 103 bp, Artificial Sequence
  Synthetic Polynucleotide
taatacgactcactataggggtcctgagggcagtggggaggcagggagccaacagaggagaggctccatgcctccccacaacctggcggcagcgcaaaagatg

SEQ ID NO: 120944 - DNA, 103 bp, Artificial Sequence
  Synthetic Polynucleotide
taatacgactcactatagggggtgccaggggtcctgagggcagtggggagaacagaggagactccccatggccctcaggaacctggcggcagcgcaaaagatg

SEQ ID NO: 120945 - DNA, 103 bp, Artificial Sequence
  Synthetic Polynucleotide
taatacgactcactatagggaggtgctgggggtgccaggggtcctgagggaacagaggagaccctcaatgcccctggcaaacctggcggcagcgcaaaagatg

SEQ ID NO: 120946 - DNA, 103 bp, Artificial Sequence
  Synthetic Polynucleotide
taatacgactcactatagggcggccaggtcatgggcctccatcttcactgaacagaggagacagtgaatgtggaggcccaacctggcggcagcgcaaaagatg

SEQ ID NO: 120947 - DNA, 103 bp, Artificial Sequence
  Synthetic Polynucleotide
taatacgactcactatagggggggggctgcaggtgctgggggtgccagggaacagaggagaccctggatgccccagcacaacctggcggcagcgcaaaagatg

SEQ ID NO: 120948 - DNA, 103 bp, Artificial Sequence
  Synthetic Polynucleotide
taatacgactcactataggggtgggccccaggggggctgcaggtgctgggaacagaggagacccagcatgtgcagccccaacctggcggcagcgcaaaagatg

SEQ ID NO: 120949 - DNA, 103 bp, Artificial Sequence
  Synthetic Polynucleotide
taatacgactcactataggggcctgggaaagtgggccccaggggggctgcaacagaggagagcagccatgctggggcccaacctggcggcagcgcaaaagatg

SEQ ID NO: 120950 - DNA, 103 bp, Artificial Sequence
  Synthetic Polynucleotide
taatacgactcactatagggtgacacccaggcctgggaaagtgggccccaaacagaggagatggggcatgctttcccagaacctggcggcagcgcaaaagatg

SEQ ID NO: 120951 - DNA, 103 bp, Artificial Sequence
  Synthetic Polynucleotide
taatacgactcactatagggctgccaccgctgacacccaggcctgggaaaaacagaggagatttcccatgcctgggtgtaacctggcggcagcgcaaaagatg

SEQ ID NO: 120952 - DNA, 103 bp, Artificial Sequence
  Synthetic Polynucleotide
taatacgactcactatagggggagctgctgctgccaccgctgacacccagaacagaggagactgggtatgagcggtggcaacctggcggcagcgcaaaagatg

SEQ ID NO: 120953 - DNA, 103 bp, Artificial Sequence
  Synthetic Polynucleotide
taatacgactcactatagggccccgtacccggagctgctgctgccaccgcaacagaggagagcggtgatggcagcagctaacctggcggcagcgcaaaagatg

SEQ ID NO: 120954 - DNA, 103 bp, Artificial Sequence
  Synthetic Polynucleotide
taatacgactcactatagggggacccggggccccgtacccggagctgctgaacagaggagacagcagatgcgggtacggaacctggcggcagcgcaaaagatg

SEQ ID NO: 120955 - DNA, 103 bp, Artificial Sequence
  Synthetic Polynucleotide
taatacgactcactatagggcaccagcccaggacccggggccccgtacccaacagaggagagggtacatggccccgggtaacctggcggcagcgcaaaagatg

SEQ ID NO: 120956 - DNA, 103 bp, Artificial Sequence
  Synthetic Polynucleotide
taatacgactcactatagggccttcccgtgcaccagcccaggacccggggaacagaggagaccccggatgctgggctggaacctggcggcagcgcaaaagatg

SEQ ID NO: 120957 - DNA, 103 bp, Artificial Sequence
  Synthetic Polynucleotide
taatacgactcactatagggtagctccactcggccaggtcatgggcctccaacagaggagaggaggcatgtgacctggcaacctggcggcagcgcaaaagatg

SEQ ID NO: 120958 - DNA, 103 bp, Artificial Sequence
  Synthetic Polynucleotide
taatacgactcactatagggttcggcatctccttcccgtgcaccagcccaaacagaggagatgggctatggcacgggaaaacctggcggcagcgcaaaagatg

SEQ ID NO: 120959 - DNA, 103 bp, Artificial Sequence
  Synthetic Polynucleotide
taatacgactcactatagggccgataccccttcggcatctccttcccgtgaacagaggagacacgggatggagatgccgaacctggcggcagcgcaaaagatg

SEQ ID NO: 120960 - DNA, 103 bp, Artificial Sequence
  Synthetic Polynucleotide
taatacgactcactatagggccaggggccgccgataccccttcggcatctaacagaggagaagatgcatgaggggtatcaacctggcggcagcgcaaaagatg

SEQ ID NO: 120961 - DNA, 103 bp, Artificial Sequence
  Synthetic Polynucleotide
taatacgactcactatagggttggcgtgtgccaggggccgccgataccccaacagaggagaggggtaatggcggcccctaacctggcggcagcgcaaaagatg

SEQ ID NO: 120962 - DNA, 103 bp, Artificial Sequence
  Synthetic Polynucleotide
taatacgactcactatagggatacggtggcttggcgtgtgccaggggccgaacagaggagacggcccatggcacacgccaacctggcggcagcgcaaaagatg

SEQ ID NO: 120963 - DNA, 103 bp, Artificial Sequence
  Synthetic Polynucleotide
taatacgactcactatagggagatataggaatacggtggcttggcgtgtgaacagaggagacacacgatgagccaccgtaacctggcggcagcgcaaaagatg

SEQ ID NO: 120964 - DNA, 103 bp, Artificial Sequence
  Synthetic Polynucleotide
taatacgactcactataggggtgatgagtgagatataggaatacggtggcaacagaggagagccaccatgttcctatataacctggcggcagcgcaaaagatg

SEQ ID NO: 120965 - DNA, 103 bp, Artificial Sequence
  Synthetic Polynucleotide
taatacgactcactataggggatggccatggtgatgagtgagatataggaaacagaggagatcctatatgtcactcatcaacctggcggcagcgcaaaagatg

SEQ ID NO: 120966 - DNA, 103 bp, Artificial Sequence
  Synthetic Polynucleotide
taatacgactcactataggggcgcctgctggatggccatggtgatgagtgaacagaggagacactcaatgccatggccaaacctggcggcagcgcaaaagatg

SEQ ID NO: 120967 - DNA, 103 bp, Artificial Sequence
  Synthetic Polynucleotide
taatacgactcactatagggatcttgcccggcgcctgctggatggccatgaacagaggagacatggcatgccagcaggcaacctggcggcagcgcaaaagatg

SEQ ID NO: 120968 - DNA, 103 bp, Artificial Sequence
  Synthetic Polynucleotide
taatacgactcactatagggctccgggtagtagctccactcggccaggtcaacagaggagagacctgatggagtggagcaacctggcggcagcgcaaaagatg

SEQ ID NO: 120969 - DNA, 103 bp, Artificial Sequence
  Synthetic Polynucleotide
taatacgactcactatagggcaaggtcagcatcttgcccggcgcctgctgaacagaggagacagcagatgccgggcaagaacctggcggcagcgcaaaagatg

SEQ ID NO: 120970 - DNA, 103 bp, Artificial Sequence
  Synthetic Polynucleotide
taatacgactcactatagggagatttcactcaaggtcagcatcttgcccgaacagaggagacgggcaatgtgctgacctaacctggcggcagcgcaaaagatg

SEQ ID NO: 120971 - DNA, 103 bp, Artificial Sequence
  Synthetic Polynucleotide
taatacgactcactatagggatccactggtagatttcactcaaggtcagcaacagaggagagctgacatggagtgaaataacctggcggcagcgcaaaagatg

SEQ ID NO: 120972 - DNA, 103 bp, Artificial Sequence
  Synthetic Polynucleotide
taatacgactcactataggggaggtccatgatccactggtagatttcactaacagaggagaagtgaaatgtaccagtggaacctggcggcagcgcaaaagatg

SEQ ID NO: 120973 - DNA, 103 bp, Artificial Sequence
  Synthetic Polynucleotide
taatacgactcactatagggagtaagggaagaggtccatgatccactggtaacagaggagaaccagtatgtcatggaccaacctggcggcagcgcaaaagatg

SEQ ID NO: 120974 - DNA, 103 bp, Artificial Sequence
  Synthetic Polynucleotide
taatacgactcactatagggttctcccggtagtaagggaagaggtccatgaacagaggagacatggaatgcttcccttaaacctggcggcagcgcaaaagatg

SEQ ID NO: 120975 - DNA, 103 bp, Artificial Sequence
  Synthetic Polynucleotide
taatacgactcactataggggcgctgctgattctcccggtagtaagggaaaacagaggagattccctatgtaccgggagaacctggcggcagcgcaaaagatg

SEQ ID NO: 120976 - DNA, 103 bp, Artificial Sequence
  Synthetic Polynucleotide
taatacgactcactatagggagttctgccagcgctgctgattctcccggtaacagaggagaaccgggatgatcagcagcaacctggcggcagcgcaaaagatg

SEQ ID NO: 120977 - DNA, 103 bp, Artificial Sequence
  Synthetic Polynucleotide
taatacgactcactatagggtggcgaatggagttctgccagcgctgctgaaacagaggagatcagcaatgctggcagaaaacctggcggcagcgcaaaagatg

SEQ ID NO: 120978 - DNA, 103 bp, Artificial Sequence
  Synthetic Polynucleotide
taatacgactcactatagggagacagcgagtggcgaatggagttctgccaaacagaggagatggcagatgtccattcgcaacctggcggcagcgcaaaagatg

SEQ ID NO: 120979 - DNA, 103 bp, Artificial Sequence
  Synthetic Polynucleotide
taatacgactcactatagggcctcgcccgcctccgggtagtagctccactaacagaggagaagtggaatgactacccggaacctggcggcagcgcaaaagatg

SEQ ID NO: 120980 - DNA, 103 bp, Artificial Sequence
  Synthetic Polynucleotide
taatacgactcactatagggagtcgttgaaagacagcgagtggcgaatggaacagaggagaccattcatgactcgctgtaacctggcggcagcgcaaaagatg

SEQ ID NO: 120981 - DNA, 103 bp, Artificial Sequence
  Synthetic Polynucleotide
taatacgactcactatagggttgacgaagcagtcgttgaaagacagcgagaacagaggagactcgctatgtttcaacgaaacctggcggcagcgcaaaagatg

SEQ ID NO: 120982 - DNA, 103 bp, Artificial Sequence
  Synthetic Polynucleotide
taatacgactcactatagggacgcgccaccttgacgaagcagtcgttgaaaacagaggagattcaacatgtgcttcgtcaacctggcggcagcgcaaaagatg

SEQ ID NO: 120983 - DNA, 103 bp, Artificial Sequence
  Synthetic Polynucleotide
taatacgactcactatagggtgtctggggaacgcgccaccttgacgaagcaacagaggagagcttcgatgaggtggcgcaacctggcggcagcgcaaaagatg

SEQ ID NO: 120984 - DNA, 103 bp, Artificial Sequence
  Synthetic Polynucleotide
taatacgactcactatagggttgccaggcttgtctggggaacgcgccaccaacagaggagaggtggcatgttccccagaaacctggcggcagcgcaaaagatg

SEQ ID NO: 120985 - DNA, 103 bp, Artificial Sequence
  Synthetic Polynucleotide
taatacgactcactataggggtaggagcccttgccaggcttgtctggggaaacagaggagatccccaatgaagcctggcaacctggcggcagcgcaaaagatg

SEQ ID NO: 120986 - DNA, 103 bp, Artificial Sequence
  Synthetic Polynucleotide
taatacgactcactataggggtagggcccagtaggagcccttgccaggctaacagaggagaagcctgatgagggctcctaacctggcggcagcgcaaaagatg

SEQ ID NO: 120987 - DNA, 103 bp, Artificial Sequence
  Synthetic Polynucleotide
taatacgactcactataggggagctggggtgtagggcccagtaggagcccaacagaggagagggctcatgctgggccctaacctggcggcagcgcaaaagatg

SEQ ID NO: 120988 - DNA, 103 bp, Artificial Sequence
  Synthetic Polynucleotide
taatacgactcactatagggcatgttccctgagctggggtgtagggcccaaacagaggagatgggccatgcaccccagcaacctggcggcagcgcaaaagatg

SEQ ID NO: 120989 - DNA, 103 bp, Artificial Sequence
  Synthetic Polynucleotide
taatacgactcactatagggcattctcaaacatgttccctgagctggggtaacagaggagaaccccaatgcagggaacaaacctggcggcagcgcaaaagatg

SEQ ID NO: 120990 - DNA, 103 bp, Artificial Sequence
  Synthetic Polynucleotide
taatacgactcactatagggggcgagtagacctcgcccgcctccgggtagaacagaggagactacccatgggcgggcgaaacctggcggcagcgcaaaagatg

SEQ ID NO: 120991 - DNA, 103 bp, Artificial Sequence
  Synthetic Polynucleotide
taatacgactcactatagggaggtagcagccattctcaaacatgttccctaacagaggagaagggaaatggtttgagaaaacctggcggcagcgcaaaagatg

SEQ ID NO: 120992 - DNA, 103 bp, Artificial Sequence
  Synthetic Polynucleotide
taatacgactcactatagggctggcggcgcaggtagcagccattctcaaaaacagaggagatttgagatgggctgctacaacctggcggcagcgcaaaagatg

SEQ ID NO: 120993 - DNA, 103 bp, Artificial Sequence
  Synthetic Polynucleotide
taatacgactcactatagggtgaagcgtttctggcggcgcaggtagcagcaacagaggagagctgctatgtgcgccgccaacctggcggcagcgcaaaagatg

SEQ ID NO: 120994 - DNA, 103 bp, Artificial Sequence
  Synthetic Polynucleotide
taatacgactcactatagggtcctccagcttgaagcgtttctggcggcgcaacagaggagagcgccgatggaaacgcttaacctggcggcagcgcaaaagatg

SEQ ID NO: 120995 - DNA, 103 bp, Artificial Sequence
  Synthetic Polynucleotide
taatacgactcactatagggtttcaccttctcctccagcttgaagcgtttaacagaggagaaaacgcatgaagctggagaacctggcggcagcgcaaaagatg

SEQ ID NO: 120996 - DNA, 103 bp, Artificial Sequence
  Synthetic Polynucleotide
taatacgactcactatagggtgcccccttttttcaccttctcctccagctaacagaggagaagctggatgagaaggtgaaacctggcggcagcgcaaaagatg

SEQ ID NO: 120997 - DNA, 103 bp, Artificial Sequence
  Synthetic Polynucleotide
taatacgactcactataggggcagccccgctgcccccttttttcaccttcaacagaggagagaaggtatgaaaagggggaacctggcggcagcgcaaaagatg

SEQ ID NO: 120998 - DNA, 103 bp, Artificial Sequence
  Synthetic Polynucleotide
taatacgactcactatagggggtggtggtggcagccccgctgccccctttaacagaggagaaaagggatgagcggggctaacctggcggcagcgcaaaagatg

SEQ ID NO: 120999 - DNA, 103 bp, Artificial Sequence
  Synthetic Polynucleotide
taatacgactcactatagggtcccgttcctggtggtggtggcagccccgcaacagaggagagcggggatgccaccaccaaacctggcggcagcgcaaaagatg

SEQ ID NO: 121000 - DNA, 103 bp, Artificial Sequence
  Synthetic Polynucleotide
taatacgactcactataggggcagaccctgtcccgttcctggtggtggtgaacagaggagacaccacatgcaggaacggaacctggcggcagcgcaaaagatg

SEQ ID NO: 121001 - DNA, 103 bp, Artificial Sequence
  Synthetic Polynucleotide
taatacgactcactatagggtggggtcaccggcgagtagacctcgcccgcaacagaggagagcgggcatggtctactcgaacctggcggcagcgcaaaagatg

SEQ ID NO: 121002 - DNA, 103 bp, Artificial Sequence
  Synthetic Polynucleotide
taatacgactcactatagggggtcgaggcagcagaccctgtcccgttcctaacagaggagaaggaacatgacagggtctaacctggcggcagcgcaaaagatg

SEQ ID NO: 121003 - DNA, 103 bp, Artificial Sequence
  Synthetic Polynucleotide
taatacgactcactatagggcgggggtggtggtcgaggcagcagaccctgaacagaggagacagggtatgctgcctcgaaacctggcggcagcgcaaaagatg

SEQ ID NO: 121004 - DNA, 103 bp, Artificial Sequence
  Synthetic Polynucleotide
taatacgactcactatagggactgtggccgcgggggtggtggtcgaggcaaacagaggagatgcctcatgcaccaccccaacctggcggcagcgcaaaagatg

SEQ ID NO: 121005 - DNA, 103 bp, Artificial Sequence
  Synthetic Polynucleotide
taatacgactcactatagggcggggaggtgactgtggccgcgggggtggtaacagaggagaaccaccatggcggccacaaacctggcggcagcgcaaaagatg

SEQ ID NO: 121006 - DNA, 103 bp, Artificial Sequence
  Synthetic Polynucleotide
taatacgactcactatagggggggctggggcggggaggtgactgtggccgaacagaggagacggccaatgtcacctcccaacctggcggcagcgcaaaagatg

SEQ ID NO: 121007 - DNA, 103 bp, Artificial Sequence
  Synthetic Polynucleotide
taatacgactcactataggggctggaggcgggggctggggcggggaggtgaacagaggagacacctcatggccccagccaacctggcggcagcgcaaaagatg

SEQ ID NO: 121008 - DNA, 103 bp, Artificial Sequence
  Synthetic Polynucleotide
taatacgactcactatagggaggctcaggggctggaggcgggggctggggaacagaggagaccccagatgccgcctccaaacctggcggcagcgcaaaagatg

SEQ ID NO: 121009 - DNA, 103 bp, Artificial Sequence
  Synthetic Polynucleotide
taatacgactcactatagggcctgggcctcaggctcaggggctggaggcgaacagaggagacgcctcatgcccctgagcaacctggcggcagcgcaaaagatg

SEQ ID NO: 121010 - DNA, 103 bp, Artificial Sequence
  Synthetic Polynucleotide
taatacgactcactatagggtcttccccgccctgggcctcaggctcagggaacagaggagaccctgaatgtgaggcccaaacctggcggcagcgcaaaagatg

SEQ ID NO: 121011 - DNA, 103 bp, Artificial Sequence
  Synthetic Polynucleotide
taatacgactcactatagggagcccccacatcttccccgccctgggcctcaacagaggagagaggccatgggcggggaaaacctggcggcagcgcaaaagatg

SEQ ID NO: 121012 - DNA, 103 bp, Artificial Sequence
  Synthetic Polynucleotide
taatacgactcactatagggtggtgggcactggggtcaccggcgagtagaaacagaggagatctactatgcggtgacccaacctggcggcagcgcaaaagatg

SEQ ID NO: 121013 - DNA, 103 bp, Artificial Sequence
  Synthetic Polynucleotide
taatacgactcactatagggcacagtccagagcccccacatcttccccgcaacagaggagagcggggatgatgtgggggaacctggcggcagcgcaaaagatg

SEQ ID NO: 121014 - DNA, 103 bp, Artificial Sequence
  Synthetic Polynucleotide
taatacgactcactataggggcgggtgagccacagtccagagcccccacaaacagaggagatgtgggatgtctggactgaacctggcggcagcgcaaaagatg

SEQ ID NO: 121015 - DNA, 103 bp, Artificial Sequence
  Synthetic Polynucleotide
taatacgactcactatagggtgtggaggaagcgggtgagccacagtccagaacagaggagactggacatgggctcacccaacctggcggcagcgcaaaagatg

SEQ ID NO: 121016 - DNA, 103 bp, Artificial Sequence
  Synthetic Polynucleotide
taatacgactcactatagggtgaaatagggtgtggaggaagcgggtgagcaacagaggagagctcacatgcttcctccaaacctggcggcagcgcaaaagatg

SEQ ID NO: 121017 - DNA, 103 bp, Artificial Sequence
  Synthetic Polynucleotide
taatacgactcactatagggtccaggccagtgaaatagggtgtggaggaaaacagaggagattcctcatgaccctatttaacctggcggcagcgcaaaagatg

SEQ ID NO: 121018 - DNA, 103 bp, Artificial Sequence
  Synthetic Polynucleotide
taatacgactcactatagggccctgggagctccaggccagtgaaatagggaacagaggagaccctatatgactggcctgaacctggcggcagcgcaaaagatg

SEQ ID NO: 121019 - DNA, 103 bp, Artificial Sequence
  Synthetic Polynucleotide
taatacgactcactataggggcttcagctcccctgggagctccaggccagaacagaggagactggccatgagctcccagaacctggcggcagcgcaaaagatg

SEQ ID NO: 121020 - DNA, 103 bp, Artificial Sequence
  Synthetic Polynucleotide
taatacgactcactatagggggcgcgtccagcttcagctcccctgggagcaacagaggagagctcccatgggagctgaaaacctggcggcagcgcaaaagatg

SEQ ID NO: 121021 - DNA, 103 bp, Artificial Sequence
  Synthetic Polynucleotide
taatacgactcactataggggaagttgtagggcgcgtccagcttcagctcaacagaggagagagctgatgctggacgcgaacctggcggcagcgcaaaagatg

SEQ ID NO: 121022 - DNA, 103 bp, Artificial Sequence
  Synthetic Polynucleotide
taatacgactcactatagggaagggtggttgaagttgtagggcgcgtccaaacagaggagatggacgatgcctacaactaacctggcggcagcgcaaaagatg

SEQ ID NO: 121023 - DNA, 103 bp, Artificial Sequence
  Synthetic Polynucleotide
taatacgactcactatagggaggggggccatggtgggcactggggtcaccaacagaggagaggtgacatgagtgcccacaacctggcggcagcgcaaaagatg

SEQ ID NO: 121024 - DNA, 103 bp, Artificial Sequence
  Synthetic Polynucleotide
taatacgactcactatagggttgatggagaaagggtggttgaagttgtagaacagaggagactacaaatgcaaccacccaacctggcggcagcgcaaaagatg

SEQ ID NO: 121025 - DNA, 103 bp, Artificial Sequence
  Synthetic Polynucleotide
taatacgactcactatagggcattaggttgttgatggagaaagggtggttaacagaggagaaaccacatgttctccatcaacctggcggcagcgcaaaagatg

SEQ ID NO: 121026 - DNA, 103 bp, Artificial Sequence
  Synthetic Polynucleotide
taatacgactcactatagggtctgttctgacattaggttgttgatggagaaacagaggagatctccaatgacaacctaaaacctggcggcagcgcaaaagatg

SEQ ID NO: 121027 - DNA, 103 bp, Artificial Sequence
  Synthetic Polynucleotide
taatacgactcactatagggggtgctggtgtctgttctgacattaggttgaacagaggagacaacctatggtcagaacaaacctggcggcagcgcaaaagatg

SEQ ID NO: 121028 - DNA, 103 bp, Artificial Sequence
  Synthetic Polynucleotide
taatacgactcactatagggcagtttgggaggtgctggtgtctgttctgaaacagaggagatcagaaatgacaccagcaaacctggcggcagcgcaaaagatg

SEQ ID NO: 121029 - DNA, 103 bp, Artificial Sequence
  Synthetic Polynucleotide
taatacgactcactatagggaccccacgtccagtttgggaggtgctggtgaacagaggagacaccagatgctcccaaacaacctggcggcagcgcaaaagatg

SEQ ID NO: 121030 - DNA, 103 bp, Artificial Sequence
  Synthetic Polynucleotide
taatacgactcactatagggtagcccccaaaccccacgtccagtttgggaaacagaggagatcccaaatgggacgtgggaacctggcggcagcgcaaaagatg

SEQ ID NO: 121031 - DNA, 103 bp, Artificial Sequence
  Synthetic Polynucleotide
taatacgactcactatagggttcagccccgtagcccccaaaccccacgtcaacagaggagagacgtgatgtttgggggcaacctggcggcagcgcaaaagatg

SEQ ID NO: 121032 - DNA, 103 bp, Artificial Sequence
  Synthetic Polynucleotide
taatacgactcactataggggctccccaccttcagccccgtagcccccaaaacagaggagattggggatgacggggctgaacctggcggcagcgcaaaagatg

SEQ ID NO: 121033 - DNA, 103 bp, Artificial Sequence
  Synthetic Polynucleotide
taatacgactcactatagggtagactccaggctccccaccttcagccccgaacagaggagacggggcatgaggtggggaaacctggcggcagcgcaaaagatg

SEQ ID NO: 121034 - DNA, 103 bp, Artificial Sequence
  Synthetic Polynucleotide
taatacgactcactatagggggggctggacacggagtagcgcgcctgcataacagaggagaatgcagatgcgctactccaacctggcggcagcgcaaaagatg

SEQ ID NO: 121035 - DNA, 103 bp, Artificial Sequence
  Synthetic Polynucleotide
taatacgactcactatagggcatggcggtgtagccgcccccggccgccgcaacagaggagagcggcgatggggggcggcaacctggcggcagcgcaaaagatg

SEQ ID NO: 121036 - DNA, 103 bp, Artificial Sequence
  Synthetic Polynucleotide
taatacgactcactatagggcgaggacgcggccgccgaggccagaaggccaacagaggagaggccttatggcctcggcgaacctggcggcagcgcaaaagatg

SEQ ID NO: 121037 - DNA, 103 bp, Artificial Sequence
  Synthetic Polynucleotide
taatacgactcactatagggtccccgcgcgcgaggacgcggccgccgaggaacagaggagacctcggatgccgcgtcctaacctggcggcagcgcaaaagatg

SEQ ID NO: 121038 - DNA, 103 bp, Artificial Sequence
  Synthetic Polynucleotide
taatacgactcactataggggggggtgcgatccccgcgcgcgaggacgcgaacagaggagacgcgtcatggcgcgcgggaacctggcggcagcgcaaaagatg

SEQ ID NO: 121039 - DNA, 103 bp, Artificial Sequence
  Synthetic Polynucleotide
taatacgactcactataggggagcgccagcgggggtgcgatccccgcgcgaacagaggagacgcgcgatgatcgcacccaacctggcggcagcgcaaaagatg

SEQ ID NO: 121040 - DNA, 103 bp, Artificial Sequence
  Synthetic Polynucleotide
taatacgactcactatagggagtaggcgccgagcgccagcgggggtgcgaaacagaggagatcgcacatgcgctggcgcaacctggcggcagcgcaaaagatg

SEQ ID NO: 121041 - DNA, 103 bp, Artificial Sequence
  Synthetic Polynucleotide
taatacgactcactatagggtggccgggcgagtaggcgccgagcgccagcaacagaggagagctggcatgcggcgcctaaacctggcggcagcgcaaaagatg

SEQ ID NO: 121042 - DNA, 103 bp, Artificial Sequence
  Synthetic Polynucleotide
taatacgactcactataggggagggagctctggccgggcgagtaggcgccaacagaggagaggcgccatgtcgcccggcaacctggcggcagcgcaaaagatg

SEQ ID NO: 121043 - DNA, 103 bp, Artificial Sequence
  Synthetic Polynucleotide
taatacgactcactataggggggagctgtagagggagctctggccgggcgaacagaggagacgcccgatgagagctcccaacctggcggcagcgcaaaagatg

SEQ ID NO: 121044 - DNA, 103 bp, Artificial Sequence
  Synthetic Polynucleotide
taatacgactcactatagggtggctgcagggggagctgtagagggagctcaacagaggagagagctcatgctacagctcaacctggcggcagcgcaaaagatg

SEQ ID NO: 121045 - DNA, 103 bp, Artificial Sequence
  Synthetic Polynucleotide
taatacgactcactataggggctggaggtctggctgcagggggagctgtaaacagaggagatacagcatgccctgcagcaacctggcggcagcgcaaaagatg

SEQ ID NO: 121046 - DNA, 103 bp, Artificial Sequence
  Synthetic Polynucleotide
taatacgactcactatagggtgggggccggcatggcggtgtagccgccccaacagaggagaggggcgatgacaccgccaaacctggcggcagcgcaaaagatg

SEQ ID NO: 121047 - DNA, 103 bp, Artificial Sequence
  Synthetic Polynucleotide
taatacgactcactatagggagctgcccgcgctggaggtctggctgcaggaacagaggagacctgcaatgagacctccaaacctggcggcagcgcaaaagatg

SEQ ID NO: 121048 - DNA, 103 bp, Artificial Sequence
  Synthetic Polynucleotide
taatacgactcactatagggccgccgcccgagctgcccgcgctggaggtcaacagaggagagacctcatgcgcgggcagaacctggcggcagcgcaaaagatg

SEQ ID NO: 121049 - DNA, 103 bp, Artificial Sequence
  Synthetic Polynucleotide
taatacgactcactataggggccgccgccgccgccgcccgagctgcccgcaacagaggagagcgggcatgtcgggcggcaacctggcggcagcgcaaaagatg

SEQ ID NO: 121050 - DNA, 103 bp, Artificial Sequence
  Synthetic Polynucleotide
taatacgactcactatagggcggcccccgcgccgccgccgccgccgcccgaacagaggagacgggcgatggcggcggcgaacctggcggcagcgcaaaagatg

SEQ ID NO: 121051 - DNA, 103 bp, Artificial Sequence
  Synthetic Polynucleotide
taatacgactcactataggggcgccccccgcggcccccgcgccgccgccgaacagaggagacggcggatgcgcgggggcaacctggcggcagcgcaaaagatg

SEQ ID NO: 121052 - DNA, 103 bp, Artificial Sequence
  Synthetic Polynucleotide
taatacgactcactatagggggcgccgcccgcgccccccgcggcccccgcaacagaggagagcggggatggcggggggcaacctggcggcagcgcaaaagatg

SEQ ID NO: 121053 - DNA, 103 bp, Artificial Sequence
  Synthetic Polynucleotide
taatacgactcactatagggggtaggtcccggcgccgcccgcgccccccgaacagaggagacgggggatgcgggcggcgaacctggcggcagcgcaaaagatg

SEQ ID NO: 121054 - DNA, 103 bp, Artificial Sequence
  Synthetic Polynucleotide
taatacgactcactatagggaggttgcagtggtaggtcccggcgccgcccaacagaggagagggcggatgcgggacctaaacctggcggcagcgcaaaagatg

SEQ ID NO: 121055 - DNA, 103 bp, Artificial Sequence
  Synthetic Polynucleotide
taatacgactcactatagggcatggcttgcaggttgcagtggtaggtcccaacagaggagagggaccatgcactgcaacaacctggcggcagcgcaaaagatg

SEQ ID NO: 121056 - DNA, 103 bp, Artificial Sequence
  Synthetic Polynucleotide
taatacgactcactatagggcgtacaggctcatggcttgcaggttgcagtaacagaggagaactgcaatgtgcaagccaaacctggcggcagcgcaaaagatg

SEQ ID NO: 121057 - DNA, 103 bp, Artificial Sequence
  Synthetic Polynucleotide
taatacgactcactatagggtacacgctcatgggggccggcatggcggtgaacagaggagacaccgcatggccggccccaacctggcggcagcgcaaaagatg

SEQ ID NO: 121058 - DNA, 103 bp, Artificial Sequence
  Synthetic Polynucleotide
taatacgactcactatagggtcgccggccgcgtacaggctcatggcttgcaacagaggagagcaagcatggagcctgtaaacctggcggcagcgcaaaagatg

SEQ ID NO: 121059 - DNA, 103 bp, Artificial Sequence
  Synthetic Polynucleotide
taatacgactcactataggggcccccgcgctcgccggccgcgtacaggctaacagaggagaagcctgatggcggccggcaacctggcggcagcgcaaaagatg

SEQ ID NO: 121060 - DNA, 103 bp, Artificial Sequence
  Synthetic Polynucleotide
taatacgactcactatagggcctgcaagtggcccccgcgctcgccggccgaacagaggagacggccgatgagcgcggggaacctggcggcagcgcaaaagatg

SEQ ID NO: 121061 - DNA, 103 bp, Artificial Sequence
  Synthetic Polynucleotide
taatacgactcactatagggccgggcgcgccctgcaagtggcccccgcgcaacagaggagagcgcggatgccacttgcaaacctggcggcagcgcaaaagatg

SEQ ID NO: 121062 - DNA, 103 bp, Artificial Sequence
  Synthetic Polynucleotide
taatacgactcactataggggcccgcgcccccgggcgcgccctgcaagtgaacagaggagacacttgatgggcgcgcccaacctggcggcagcgcaaaagatg

SEQ ID NO: 121063 - DNA, 103 bp, Artificial Sequence
  Synthetic Polynucleotide
taatacgactcactatagggcggccgagccgcccgcgcccccgggcgcgcaacagaggagagcgcgcatgggggcgcggaacctggcggcagcgcaaaagatg

SEQ ID NO: 121064 - DNA, 103 bp, Artificial Sequence
  Synthetic Polynucleotide
taatacgactcactataggggggtcgtccacggccgagccgcccgcgcccaacagaggagagggcgcatgcggctcggcaacctggcggcagcgcaaaagatg

SEQ ID NO: 121065 - DNA, 103 bp, Artificial Sequence
  Synthetic Polynucleotide
taatacgactcactataggggtcgggcagggggtcgtccacggccgagccaacagaggagaggctcgatggtggacgacaacctggcggcagcgcaaaagatg

SEQ ID NO: 121066 - DNA, 103 bp, Artificial Sequence
  Synthetic Polynucleotide
taatacgactcactataggggcagagagtagtcgggcagggggtcgtccaaacagaggagatggacgatgccctgcccgaacctggcggcagcgcaaaagatg

SEQ ID NO: 121067 - DNA, 103 bp, Artificial Sequence
  Synthetic Polynucleotide
taatacgactcactataggggtgaccggaggcagagagtagtcgggcaggaacagaggagacctgccatgctactctctaacctggcggcagcgcaaaagatg

SEQ ID NO: 121068 - DNA, 103 bp, Artificial Sequence
  Synthetic Polynucleotide
taatacgactcactatagggagggtgcgagtacacgctcatgggggccggaacagaggagaccggccatgatgagcgtgaacctggcggcagcgcaaaagatg

SEQ ID NO: 121069 - DNA, 103 bp, Artificial Sequence
  Synthetic Polynucleotide
taatacgactcactataggggctgctgctggtgaccggaggcagagagtaaacagaggagatactctatgcctccggtcaacctggcggcagcgcaaaagatg

SEQ ID NO: 121070 - DNA, 103 bp, Artificial Sequence
  Synthetic Polynucleotide
taatacgactcactataggggggacgacgagctgctgctggtgaccggagaacagaggagactccggatgccagcagcaaacctggcggcagcgcaaaagatg

SEQ ID NO: 121071 - DNA, 103 bp, Artificial Sequence
  Synthetic Polynucleotide
taatacgactcactatagggccgtgactcagggacgacgagctgctgctgaacagaggagacagcagatgctcgtcgtcaacctggcggcagcgcaaaagatg

SEQ ID NO: 121072 - DNA, 103 bp, Artificial Sequence
  Synthetic Polynucleotide
taatacgactcactataggggccgccgccgccgtgactcagggacgacgaaacagaggagatcgtcgatgctgagtcacaacctggcggcagcgcaaaagatg

SEQ ID NO: 121073 - DNA, 103 bp, Artificial Sequence
  Synthetic Polynucleotide
taatacgactcactatagggcgccgccgccgccgccgccgccgtgactcaaacagaggagatgagtcatggcggcggcgaacctggcggcagcgcaaaagatg

SEQ ID NO: 121074 - DNA, 103 bp, Artificial Sequence
  Synthetic Polynucleotide
taatacgactcactatagggtggcctcccccgccgccgccgccgccgccgaacagaggagacggcggatgcggcggcggaacctggcggcagcgcaaaagatg

SEQ ID NO: 121075 - DNA, 103 bp, Artificial Sequence
  Synthetic Polynucleotide
taatacgactcactataggggccggcctcctggcctcccccgccgccgccaacagaggagaggcggcatggggggaggcaacctggcggcagcgcaaaagatg

SEQ ID NO: 121076 - DNA, 103 bp, Artificial Sequence
  Synthetic Polynucleotide
taatacgactcactatagggcagggtggtggccggcctcctggcctccccaacagaggagaggggagatgaggaggccgaacctggcggcagcgcaaaagatg

SEQ ID NO: 121077 - DNA, 103 bp, Artificial Sequence
  Synthetic Polynucleotide
taatacgactcactatagggtggtgggccgcagggtggtggccggcctccaacagaggagaggaggcatgccaccacccaacctggcggcagcgcaaaagatg

SEQ ID NO: 121078 - DNA, 103 bp, Artificial Sequence
  Synthetic Polynucleotide
taatacgactcactataggggaggcggccttggtgggccgcagggtggtgaacagaggagacaccacatggcggcccacaacctggcggcagcgcaaaagatg

SEQ ID NO: 121079 - DNA, 103 bp, Artificial Sequence
  Synthetic Polynucleotide
taatacgactcactatagggcggcgtgcgcagggtgcgagtacacgctcaaacagaggagatgagcgatgactcgcaccaacctggcggcagcgcaaaagatg

SEQ ID NO: 121080 - DNA, 103 bp, Artificial Sequence
  Synthetic Polynucleotide
taatacgactcactatagggaccacgaggtgaggcggccttggtgggccgaacagaggagacggcccatgaaggccgccaacctggcggcagcgcaaaagatg

SEQ ID NO: 121081 - DNA, 103 bp, Artificial Sequence
  Synthetic Polynucleotide
taatacgactcactatagggtggttcaggtaccacgaggtgaggcggcctaacagaggagaaggccgatgcacctcgtgaacctggcggcagcgcaaaagatg

SEQ ID NO: 121082 - DNA, 103 bp, Artificial Sequence
  Synthetic Polynucleotide
taatacgactcactatagggtccgcccgcctggttcaggtaccacgaggtaacagaggagaacctcgatgtacctgaacaacctggcggcagcgcaaaagatg

SEQ ID NO: 121083 - DNA, 103 bp, Artificial Sequence
  Synthetic Polynucleotide
taatacgactcactatagggggcccaggtctccgcccgcctggttcaggtaacagaggagaacctgaatgaggcgggcgaacctggcggcagcgcaaaagatg

SEQ ID NO: 121084 - DNA, 103 bp, Artificial Sequence
  Synthetic Polynucleotide
taatacgactcactatagggctcgccaagtggcccaggtctccgcccgccaacagaggagaggcgggatgagacctgggaacctggcggcagcgcaaaagatg

SEQ ID NO: 121085 - DNA, 103 bp, Artificial Sequence
  Synthetic Polynucleotide
taatacgactcactatagggcgccgccgcgctcgccaagtggcccaggtcaacagaggagagacctgatgcacttggcgaacctggcggcagcgcaaaagatg

SEQ ID NO: 121086 - DNA, 103 bp, Artificial Sequence
  Synthetic Polynucleotide
taatacgactcactatagggccgccgccgccgccgccgcgctcgccaagtaacagaggagaacttggatggcgcggcggaacctggcggcagcgcaaaagatg

SEQ ID NO: 121087 - DNA, 103 bp, Artificial Sequence
  Synthetic Polynucleotide
taatacgactcactatagggtagcctgcggccgccgccgccgccgccgcgaacagaggagacgcggcatgggcggcggcaacctggcggcagcgcaaaagatg

SEQ ID NO: 121088 - DNA, 103 bp, Artificial Sequence
  Synthetic Polynucleotide
taatacgactcactatagggctggcccgggtagcctgcggccgccgccgcaacagaggagagcggcgatggccgcaggcaacctggcggcagcgcaaaagatg

SEQ ID NO: 121089 - DNA, 103 bp, Artificial Sequence
  Synthetic Polynucleotide
taatacgactcactatagggagttctgctgctggcccgggtagcctgcggaacagaggagaccgcagatgacccgggccaacctggcggcagcgcaaaagatg

SEQ ID NO: 121090 - DNA, 103 bp, Artificial Sequence
  Synthetic Polynucleotide
taatacgactcactataggggggtactgctcggcgtgcgcagggtgcgagaacagaggagactcgcaatgtgcgcacgcaacctggcggcagcgcaaaagatg

SEQ ID NO: 121091 - DNA, 103 bp, Artificial Sequence
  Synthetic Polynucleotide
taatacgactcactatagggaccgagtggaagttctgctgctggcccgggaacagaggagacccgggatggcagcagaaaacctggcggcagcgcaaaagatg

SEQ ID NO: 121092 - DNA, 103 bp, Artificial Sequence
  Synthetic Polynucleotide
taatacgactcactatagggcatctcccgcaccgagtggaagttctgctgaacagaggagacagcagatgttccactcgaacctggcggcagcgcaaaagatg

SEQ ID NO: 121093 - DNA, 103 bp, Artificial Sequence
  Synthetic Polynucleotide
taatacgactcactataggggtgactcgaacatctcccgcaccgagtggaaacagaggagatccactatgtgcgggagaaacctggcggcagcgcaaaagatg

SEQ ID NO: 121094 - DNA, 103 bp, Artificial Sequence
  Synthetic Polynucleotide
taatacgactcactatagggccgatcctctgtgactcgaacatctcccgcaacagaggagagcgggaatggttcgagtcaacctggcggcagcgcaaaagatg

SEQ ID NO: 121095 - DNA, 103 bp, Artificial Sequence
  Synthetic Polynucleotide
taatacgactcactataggggttgttcaagccgatcctctgtgactcgaaaacagaggagattcgagatgcagaggatcaacctggcggcagcgcaaaagatg

SEQ ID NO: 121096 - DNA, 103 bp, Artificial Sequence
  Synthetic Polynucleotide
taatacgactcactatagggtcactggagagttgttcaagccgatcctctaacagaggagaagaggaatggcttgaacaaacctggcggcagcgcaaaagatg

SEQ ID NO: 121097 - DNA, 103 bp, Artificial Sequence
  Synthetic Polynucleotide
taatacgactcactatagggctattcccgttcactggagagttgttcaagaacagaggagacttgaaatgctctccagtaacctggcggcagcgcaaaagatg

SEQ ID NO: 121098 - DNA, 103 bp, Artificial Sequence
  Synthetic Polynucleotide
taatacgactcactatagggttgacagctactattcccgttcactggagaaacagaggagatctccaatgaacgggaataacctggcggcagcgcaaaagatg

SEQ ID NO: 121099 - DNA, 103 bp, Artificial Sequence
  Synthetic Polynucleotide
taatacgactcactatagggggaaggccatttgacagctactattcccgtaacagaggagaacgggaatggtagctgtcaacctggcggcagcgcaaaagatg

SEQ ID NO: 121100 - DNA, 103 bp, Artificial Sequence
  Synthetic Polynucleotide
taatacgactcactatagggtggctggaagggaaggccatttgacagctaaacagaggagatagctgatgaatggccttaacctggcggcagcgcaaaagatg

SEQ ID NO: 121101 - DNA, 103 bp, Artificial Sequence
  Synthetic Polynucleotide
taatacgactcactatagggcatgccgcccgggtactgctcggcgtgcgcaacagaggagagcgcacatggagcagtacaacctggcggcagcgcaaaagatg

SEQ ID NO: 121102 - DNA, 103 bp, Artificial Sequence
  Synthetic Polynucleotide
taatacgactcactataggggtacagagactggctggaagggaaggccataacagaggagaatggccatgccttccagcaacctggcggcagcgcaaaagatg

SEQ ID NO: 121103 - DNA, 103 bp, Artificial Sequence
  Synthetic Polynucleotide
taatacgactcactatagggcggacgtgcggtacagagactggctggaagaacagaggagacttccaatgagtctctgtaacctggcggcagcgcaaaagatg

SEQ ID NO: 121104 - DNA, 103 bp, Artificial Sequence
  Synthetic Polynucleotide
taatacgactcactatagggacgaaagctccggacgtgcggtacagagacaacagaggagagtctctatgccgcacgtcaacctggcggcagcgcaaaagatg

SEQ ID NO: 121105 - DNA, 103 bp, Artificial Sequence
  Synthetic Polynucleotide
taatacgactcactatagggacagtcgtagacgaaagctccggacgtgcgaacagaggagacgcacgatgggagctttcaacctggcggcagcgcaaaagatg

SEQ ID NO: 121106 - DNA, 103 bp, Artificial Sequence
  Synthetic Polynucleotide
taatacgactcactatagggaaaacttgctacagtcgtagacgaaagctcaacagaggagagagcttatgtctacgactaacctggcggcagcgcaaaagatg

SEQ ID NO: 121107 - DNA, 103 bp, Artificial Sequence
  Synthetic Polynucleotide
taatacgactcactatagggaggcgcgggccatgccgcccgggtactgctaacagaggagaagcagtatgcgggcggcaaacctggcggcagcgcaaaagatg

SEQ ID NO: 121108 - DNA, 103 bp, Artificial Sequence
  Synthetic Polynucleotide
taatacgactcactatagggtagggcccgtaggcgcgggccatgccgcccaacagaggagagggcggatgggcccgcgcaacctggcggcagcgcaaaagatg

SEQ ID NO: 121109 - DNA, 103 bp, Artificial Sequence
  Synthetic Polynucleotide
taatacgactcactatagggctgcggcgtgtagggcccgtaggcgcgggcaacagaggagagcccgcatgtacgggcccaacctggcggcagcgcaaaagatg

SEQ ID NO: 121110 - DNA, 103 bp, Artificial Sequence
  Synthetic Polynucleotide
taatacgactcactatagggccagggagttggggctggacacggagtagcaacagaggagagctactatgtgtccagccaacctggcggcagcgcaaaagatg

SEQ ID NO: 121111 - DNA, 103 bp, Artificial Sequence
  Synthetic Polynucleotide
taatacgactcactatagggtgggctgcggctgcggcgtgtagggcccgtaacagaggagaacgggcatgacacgccgcaacctggcggcagcgcaaaagatg

SEQ ID NO: 121112 - DNA, 103 bp, Artificial Sequence
  Synthetic Polynucleotide
taatacgactcactatagggaccatgtccttgggctgcggctgcggcgtgaacagaggagacacgccatggccgcagccaacctggcggcagcgcaaaagatg

SEQ ID NO: 121113 - DNA, 103 bp, Artificial Sequence
  Synthetic Polynucleotide
taatacgactcactataggggggcggcttcaccatgtccttgggctgcggaacagaggagaccgcagatgaaggacatgaacctggcggcagcgcaaaagatg

SEQ ID NO: 121114 - DNA, 103 bp, Artificial Sequence
  Synthetic Polynucleotide
taatacgactcactatagggtgtagctatagggcggcttcaccatgtcctaacagaggagaaggacaatgtgaagccgcaacctggcggcagcgcaaaagatg

SEQ ID NO: 121115 - DNA, 103 bp, Artificial Sequence
  Synthetic Polynucleotide
taatacgactcactatagggatgagcgcgatgtagctatagggcggcttcaacagaggagagaagccatgctatagctaaacctggcggcagcgcaaaagatg

SEQ ID NO: 121116 - DNA, 103 bp, Artificial Sequence
  Synthetic Polynucleotide
taatacgactcactatagggggccatggtgatgagcgcgatgtagctataaacagaggagatatagcatgatcgcgctcaacctggcggcagcgcaaaagatg

SEQ ID NO: 121117 - DNA, 103 bp, Artificial Sequence
  Synthetic Polynucleotide
taatacgactcactatagggcgttctggatggccatggtgatgagcgcgaaacagaggagatcgcgcatgtcaccatggaacctggcggcagcgcaaaagatg

SEQ ID NO: 121118 - DNA, 103 bp, Artificial Sequence
  Synthetic Polynucleotide
taatacgactcactatagggttgtccggggcgttctggatggccatggtgaacagaggagacaccatatgcatccagaaaacctggcggcagcgcaaaagatg

SEQ ID NO: 121119 - DNA, 103 bp, Artificial Sequence
  Synthetic Polynucleotide
taatacgactcactatagggggtgatcttcttgtccggggcgttctggataacagaggagaatccagatggccccggacaacctggcggcagcgcaaaagatg

SEQ ID NO: 121120 - DNA, 103 bp, Artificial Sequence
  Synthetic Polynucleotide
taatacgactcactatagggtgccgttcagggtgatcttcttgtccggggaacagaggagaccccggatgagaagatcaaacctggcggcagcgcaaaagatg

SEQ ID NO: 121121 - DNA, 103 bp, Artificial Sequence
  Synthetic Polynucleotide
taatacgactcactatagggggcaccactcccagggagttggggctggacaacagaggagagtccagatgcaactccctaacctggcggcagcgcaaaagatg

SEQ ID NO: 121122 - DNA, 103 bp, Artificial Sequence
  Synthetic Polynucleotide
taatacgactcactatagggaactggtagatgccgttcagggtgatcttcaacagaggagagaagatatgcctgaacggaacctggcggcagcgcaaaagatg

SEQ ID NO: 121123 - DNA, 103 bp, Artificial Sequence
  Synthetic Polynucleotide
taatacgactcactataggggtccatgatgaactggtagatgccgttcagaacagaggagactgaacatgatctaccagaacctggcggcagcgcaaaagatg

SEQ ID NO: 121124 - DNA, 103 bp, Artificial Sequence
  Synthetic Polynucleotide
taatacgactcactatagggaggggaagcggtccatgatgaactggtagaaacagaggagatctaccatgtcatcatggaacctggcggcagcgcaaaagatg

SEQ ID NO: 121125 - DNA, 103 bp, Artificial Sequence
  Synthetic Polynucleotide
taatacgactcactatagggtcccggtagaaggggaagcggtccatgatgaacagaggagacatcatatgccgcttcccaacctggcggcagcgcaaaagatg

SEQ ID NO: 121126 - DNA, 103 bp, Artificial Sequence
  Synthetic Polynucleotide
taatacgactcactatagggctgcttgttgtcccggtagaaggggaagcgaacagaggagacgcttcatgttctaccggaacctggcggcagcgcaaaagatg

SEQ ID NO: 121127 - DNA, 103 bp, Artificial Sequence
  Synthetic Polynucleotide
taatacgactcactatagggtctgccagccctgcttgttgtcccggtagaaacagaggagatctaccatgacaacaagcaacctggcggcagcgcaaaagatg

SEQ ID NO: 121128 - DNA, 103 bp, Artificial Sequence
  Synthetic Polynucleotide
taatacgactcactatagggcggatgctgttctgccagccctgcttgttgaacagaggagacaacaaatggggctggcaaacctggcggcagcgcaaaagatg

SEQ ID NO: 121129 - DNA, 103 bp, Artificial Sequence
  Synthetic Polynucleotide
taatacgactcactataggggaggttgtggcggatgctgttctgccagccaacagaggagaggctggatgaacagcatcaacctggcggcagcgcaaaagatg

SEQ ID NO: 121130 - DNA, 103 bp, Artificial Sequence
  Synthetic Polynucleotide
taatacgactcactatagggcgttgagcgagaggttgtggcggatgctgtaacagaggagaacagcaatggccacaaccaacctggcggcagcgcaaaagatg

SEQ ID NO: 121131 - DNA, 103 bp, Artificial Sequence
  Synthetic Polynucleotide
taatacgactcactatagggacgaagcactcgttgagcgagaggttgtggaacagaggagaccacaaatgctcgctcaaaacctggcggcagcgcaaaagatg

SEQ ID NO: 121132 - DNA, 103 bp, Artificial Sequence
  Synthetic Polynucleotide
taatacgactcactataggggccgaggtagggcaccactcccagggagttaacagaggagaaactccatgggagtggtgaacctggcggcagcgcaaaagatg

SEQ ID NO: 121133 - DNA, 103 bp, Artificial Sequence
  Synthetic Polynucleotide
taatacgactcactatagggcggcaccttgacgaagcactcgttgagcgaaacagaggagatcgctcatggagtgcttcaacctggcggcagcgcaaaagatg

SEQ ID NO: 121134 - DNA, 103 bp, Artificial Sequence
  Synthetic Polynucleotide
taatacgactcactatagggtgtcgtcgcgcggcaccttgacgaagcactaacagaggagaagtgctatgtcaaggtgcaacctggcggcagcgcaaaagatg

SEQ ID NO: 121135 - DNA, 103 bp, Artificial Sequence
  Synthetic Polynucleotide
taatacgactcactatagggcccggcttcttgtcgtcgcgcggcaccttgaacagaggagacaaggtatggcgcgacgaaacctggcggcagcgcaaaagatg

SEQ ID NO: 121136 - DNA, 103 bp, Artificial Sequence
  Synthetic Polynucleotide
taatacgactcactataggggctgcccttgcccggcttcttgtcgtcgcgaacagaggagacgcgacatgaagaagccgaacctggcggcagcgcaaaagatg

SEQ ID NO: 121137 - DNA, 103 bp, Artificial Sequence
  Synthetic Polynucleotide
taatacgactcactataggggcgtccagtagctgcccttgcccggcttctaacagaggagaagaagcatggcaagggcaaacctggcggcagcgcaaaagatg

SEQ ID NO: 121138 - DNA, 103 bp, Artificial Sequence
  Synthetic Polynucleotide
taatacgactcactatagggtccgggtccagcgtccagtagctgcccttgaacagaggagacaagggatgctactggacaacctggcggcagcgcaaaagatg

SEQ ID NO: 121139 - DNA, 103 bp, Artificial Sequence
  Synthetic Polynucleotide
taatacgactcactataggggttgtaggagtccgggtccagcgtccagtaaacagaggagatactggatgctggacccgaacctggcggcagcgcaaaagatg

SEQ ID NO: 121140 - DNA, 103 bp, Artificial Sequence
  Synthetic Polynucleotide
taatacgactcactatagggtctcgaacatgttgtaggagtccgggtccaaacagaggagatggaccatgactcctacaaacctggcggcagcgcaaaagatg

SEQ ID NO: 121141 - DNA, 103 bp, Artificial Sequence
  Synthetic Polynucleotide
taatacgactcactatagggaagctgccgttctcgaacatgttgtaggagaacagaggagactcctaatgcatgttcgaaacctggcggcagcgcaaaagatg

SEQ ID NO: 121142 - DNA, 103 bp, Artificial Sequence
  Synthetic Polynucleotide
taatacgactcactatagggccgccgcaggaagctgccgttctcgaacataacagaggagaatgttcatgaacggcagcaacctggcggcagcgcaaaagatg

SEQ ID NO: 121143 - DNA, 103 bp, Artificial Sequence
  Synthetic Polynucleotide
taatacgactcactatagggtctgctcgccgccgaggtagggcaccactcaacagaggagagagtggatgcctacctcgaacctggcggcagcgcaaaagatg

SEQ ID NO: 121144 - DNA, 103 bp, Artificial Sequence
  Synthetic Polynucleotide
taatacgactcactatagggagcgccgccgccgccgcaggaagctgccgtaacagaggagaacggcaatgtcctgcggcaacctggcggcagcgcaaaagatg

SEQ ID NO: 121145 - DNA, 103 bp, Artificial Sequence
  Synthetic Polynucleotide
taatacgactcactatagggttcttcttgaagcgccgccgccgccgcaggaacagaggagacctgcgatggcggcggcgaacctggcggcagcgcaaaagatg

SEQ ID NO: 121146 - DNA, 103 bp, Artificial Sequence
  Synthetic Polynucleotide
taatacgactcactatagggcaccgcgtccttcttcttgaagcgccgccgaacagaggagacggcggatgttcaagaagaacctggcggcagcgcaaaagatg

SEQ ID NO: 121147 - DNA, 103 bp, Artificial Sequence
  Synthetic Polynucleotide
taatacgactcactatagggccttgtccttcaccgcgtccttcttcttgaaacagaggagatcaagaatgaggacgcggaacctggcggcagcgcaaaagatg

SEQ ID NO: 121148 - DNA, 103 bp, Artificial Sequence
  Synthetic Polynucleotide
taatacgactcactatagggtccttctcctccttgtccttcaccgcgtccaacagaggagaggacgcatggaaggacaaaacctggcggcagcgcaaaagatg

SEQ ID NO: 121149 - DNA, 103 bp, Artificial Sequence
  Synthetic Polynucleotide
taatacgactcactataggggtgcagcctgtccttctcctccttgtccttaacagaggagaaaggacatggaggagaagaacctggcggcagcgcaaaagatg

SEQ ID NO: 121150 - DNA, 103 bp, Artificial Sequence
  Synthetic Polynucleotide
taatacgactcactataggggctccttgaggtgcagcctgtccttctcctaacagaggagaaggagaatgacaggctgcaacctggcggcagcgcaaaagatg

SEQ ID NO: 121151 - DNA, 103 bp, Artificial Sequence
  Synthetic Polynucleotide
taatacgactcactatagggggcgggggcggctccttgaggtgcagcctgaacagaggagacaggctatgcctcaaggaaacctggcggcagcgcaaaagatg

SEQ ID NO: 121152 - DNA, 103 bp, Artificial Sequence
  Synthetic Polynucleotide
taatacgactcactatagggctggcggccgggcgggggcggctccttgagaacagaggagactcaagatgccgcccccgaacctggcggcagcgcaaaagatg

SEQ ID NO: 121153 - DNA, 103 bp, Artificial Sequence
  Synthetic Polynucleotide
taatacgactcactatagggcgggcgggggctggcggccgggcgggggcgaacagaggagacgccccatgccggccgccaacctggcggcagcgcaaaagatg

SEQ ID NO: 121154 - DNA, 103 bp, Artificial Sequence
  Synthetic Polynucleotide
taatacgactcactatagggcggtagtagctctgctcgccgccgaggtagaacagaggagactacctatgcggcgagcaaacctggcggcagcgcaaaagatg

SEQ ID NO: 121155 - DNA, 103 bp, Artificial Sequence
  Synthetic Polynucleotide
taatacgactcactatagggtccggcggcgcgggcgggggctggcggccgaacagaggagacggccgatggcccccgccaacctggcggcagcgcaaaagatg

SEQ ID NO: 121156 - DNA, 103 bp, Artificial Sequence
  Synthetic Polynucleotide
taatacgactcactataggggtcggcctgctccggcggcgcgggcgggggaacagaggagacccccgatggcgccgccgaacctggcggcagcgcaaaagatg

SEQ ID NO: 121157 - DNA, 103 bp, Artificial Sequence
  Synthetic Polynucleotide
taatacgactcactataggggcgcgttgccgtcggcctgctccggcggcgaacagaggagacgccgcatgagcaggccgaacctggcggcagcgcaaaagatg

SEQ ID NO: 121158 - DNA, 103 bp, Artificial Sequence
  Synthetic Polynucleotide
taatacgactcactatagggtgcggaccgggcgcgttgccgtcggcctgcaacagaggagagcaggcatgcggcaacgcaacctggcggcagcgcaaaagatg

SEQ ID NO: 121159 - DNA, 103 bp, Artificial Sequence
  Synthetic Polynucleotide
taatacgactcactataggggggcggcggctgcggaccgggcgcgttgccaacagaggagaggcaacatgcccggtccgaacctggcggcagcgcaaaagatg

SEQ ID NO: 121160 - DNA, 103 bp, Artificial Sequence
  Synthetic Polynucleotide
taatacgactcactatagggggatgcgcacgggcggcggctgcggaccggaacagaggagaccggtcatgagccgccgcaacctggcggcagcgcaaaagatg

SEQ ID NO: 121161 - DNA, 103 bp, Artificial Sequence
  Synthetic Polynucleotide
taatacgactcactatagggttgatgtcctggatgcgcacgggcggcggcaacagaggagagccgccatgcgtgcgcataacctggcggcagcgcaaaagatg

SEQ ID NO: 121162 - DNA, 103 bp, Artificial Sequence
  Synthetic Polynucleotide
taatacgactcactataggggttctcggtcttgatgtcctggatgcgcacaacagaggagagtgcgcatgcaggacatcaacctggcggcagcgcaaaagatg

SEQ ID NO: 121163 - DNA, 103 bp, Artificial Sequence
  Synthetic Polynucleotide
taatacgactcactatagggggcacgtaccgttctcggtcttgatgtcctaacagaggagaaggacaatgagaccgagaaacctggcggcagcgcaaaagatg

SEQ ID NO: 121164 - DNA, 103 bp, Artificial Sequence
  Synthetic Polynucleotide
taatacgactcactatagggggcggcgaggggcacgtaccgttctcggtcaacagaggagagaccgaatgcggtacgtgaacctggcggcagcgcaaaagatg

SEQ ID NO: 121165 - DNA, 103 bp, Artificial Sequence
  Synthetic Polynucleotide
taatacgactcactatagggggccgccgcgcggtagtagctctgctcgccaacagaggagaggcgagatgagctactacaacctggcggcagcgcaaaagatg

SEQ ID NO: 121166 - DNA, 103 bp, Artificial Sequence
  Synthetic Polynucleotide
taatacgactcactatagggcaggggctggggcggcgaggggcacgtaccaacagaggagaggtacgatgccctcgccgaacctggcggcagcgcaaaagatg

SEQ ID NO: 121167 - DNA, 103 bp, Artificial Sequence
  Synthetic Polynucleotide
taatacgactcactatagggcggccggggacaggggctggggcggcgaggaacagaggagacctcgcatgcccagccccaacctggcggcagcgcaaaagatg

SEQ ID NO: 121168 - DNA, 103 bp, Artificial Sequence
  Synthetic Polynucleotide
taatacgactcactatagggcccagggcggcggccggggacaggggctggaacagaggagaccagccatggtccccggcaacctggcggcagcgcaaaagatg

SEQ ID NO: 121169 - DNA, 103 bp, Artificial Sequence
  Synthetic Polynucleotide
taatacgactcactataggggctgccgctgcccagggcggcggccggggaaacagaggagatccccgatggccgccctgaacctggcggcagcgcaaaagatg

SEQ ID NO: 121170 - DNA, 103 bp, Artificial Sequence
  Synthetic Polynucleotide
taatacgactcactatagggccgcggcggcgctgccgctgcccagggcggaacagaggagaccgcccatggcagcggcaaacctggcggcagcgcaaaagatg

SEQ ID NO: 121171 - DNA, 103 bp, Artificial Sequence
  Synthetic Polynucleotide
taatacgactcactatagggatcttgggcaccgcggcggcgctgccgctgaacagaggagacagcggatgcgccgccgcaacctggcggcagcgcaaaagatg

SEQ ID NO: 121172 - DNA, 103 bp, Artificial Sequence
  Synthetic Polynucleotide
taatacgactcactatagggggggctctcgatcttgggcaccgcggcggcaacagaggagagccgccatggtgcccaagaacctggcggcagcgcaaaagatg

SEQ ID NO: 121173 - DNA, 103 bp, Artificial Sequence
  Synthetic Polynucleotide
taatacgactcactatagggtgctgctgtcggggctctcgatcttgggcaaacagaggagatgcccaatgtcgagagccaacctggcggcagcgcaaaagatg

SEQ ID NO: 121174 - DNA, 103 bp, Artificial Sequence
  Synthetic Polynucleotide
taatacgactcactatagggaggctgctgctgctgctgtcggggctctcgaacagaggagacgagagatgcgacagcagaacctggcggcagcgcaaaagatg

SEQ ID NO: 121175 - DNA, 103 bp, Artificial Sequence
  Synthetic Polynucleotide
taatacgactcactatagggcccgctggacaggctgctgctgctgctgtcaacagaggagagacagcatgagcagcagcaacctggcggcagcgcaaaagatg

SEQ ID NO: 121176 - DNA, 103 bp, Artificial Sequence
  Synthetic Polynucleotide
taatacgactcactatagggcggccgccgcggccgccgcgcggtagtagcaacagaggagagctactatggcgcggcggaacctggcggcagcgcaaaagatg

SEQ ID NO: 121177 - DNA, 103 bp, Artificial Sequence
  Synthetic Polynucleotide
taatacgactcactataggggggggctgctcccgctggacaggctgctgcaacagaggagagcagcaatgtgtccagcgaacctggcggcagcgcaaaagatg

SEQ ID NO: 121178 - DNA, 103 bp, Artificial Sequence
  Synthetic Polynucleotide
taatacgactcactatagggaggctgcccggggggctgctcccgctggacaacagaggagagtccagatggagcagcccaacctggcggcagcgcaaaagatg

SEQ ID NO: 121179 - DNA, 103 bp, Artificial Sequence
  Synthetic Polynucleotide
taatacgactcactatagggcgccgacggcaggctgcccggggggctgctaacagaggagaagcagcatgccgggcagcaacctggcggcagcgcaaaagatg

SEQ ID NO: 121180 - DNA, 103 bp, Artificial Sequence
  Synthetic Polynucleotide
taatacgactcactatagggtgagcggccgcgccgacggcaggctgcccgaacagaggagacgggcaatgtgccgtcggaacctggcggcagcgcaaaagatg

SEQ ID NO: 121181 - DNA, 103 bp, Artificial Sequence
  Synthetic Polynucleotide
taatacgactcactatagggccgtccaggctgagcggccgcgccgacggcaacagaggagagccgtcatggcggccgctaacctggcggcagcgcaaaagatg

SEQ ID NO: 121182 - DNA, 103 bp, Artificial Sequence
  Synthetic Polynucleotide
taatacgactcactatagggggaatccgcaccgtccaggctgagcggccgaacagaggagacggccgatgagcctggacaacctggcggcagcgcaaaagatg

SEQ ID NO: 121183 - DNA, 103 bp, Artificial Sequence
  Synthetic Polynucleotide
taatacgactcactataggggcggcggcgcggaatccgcaccgtccaggcaacagaggagagcctggatggtgcggattaacctggcggcagcgcaaaagatg

SEQ ID NO: 121184 - DNA, 103 bp, Artificial Sequence
  Synthetic Polynucleotide
taatacgactcactatagggggcgcgggcggcggcggcgcggaatccgcaaacagaggagatgcggaatgcgcgccgccaacctggcggcagcgcaaaagatg

SEQ ID NO: 121185 - DNA, 103 bp, Artificial Sequence
  Synthetic Polynucleotide
taatacgactcactatagggcggggcggagggcgcgggcggcggcggcgcaacagaggagagcgccgatgccgcccgcgaacctggcggcagcgcaaaagatg

SEQ ID NO: 121186 - DNA, 103 bp, Artificial Sequence
  Synthetic Polynucleotide
taatacgactcactatagggggtgcggcggcggggcggagggcgcgggcgaacagaggagacgcccgatgcctccgcccaacctggcggcagcgcaaaagatg

SEQ ID NO: 121187 - DNA, 103 bp, Artificial Sequence
  Synthetic Polynucleotide
taatacgactcactatagggtagccgcccccggccgccgcggccgccgcgaacagaggagacgcggcatgcgcggcggcaacctggcggcagcgcaaaagatg

SEQ ID NO: 121188 - DNA, 103 bp, Artificial Sequence
  Synthetic Polynucleotide
taatacgactcactatagggccctggctatggtgcggcggcggggcggagaacagaggagactccgcatggccgccgcaaacctggcggcagcgcaaaagatg

SEQ ID NO: 121189 - DNA, 103 bp, Artificial Sequence
  Synthetic Polynucleotide
taatacgactcactatagggcacgctgaagccctggctatggtgcggcggaacagaggagaccgccgatgcatagccagaacctggcggcagcgcaaaagatg

SEQ ID NO: 121190 - DNA, 103 bp, Artificial Sequence
  Synthetic Polynucleotide
taatacgactcactatagggtgatgttgtccacgctgaagccctggctataacagaggagaatagccatggcttcagcgaacctggcggcagcgcaaaagatg

SEQ ID NO: 121191 - DNA, 103 bp, Artificial Sequence
  Synthetic Polynucleotide
taatacgactcactatagggagcgacgtcatgatgttgtccacgctgaagaacagaggagacttcagatgggacaacataacctggcggcagcgcaaaagatg

SEQ ID NO: 121192 - DNA, 103 bp, Artificial Sequence
  Synthetic Polynucleotide
taatacgactcactatagggcgacccccgcagcgacgtcatgatgttgtcaacagaggagagacaacatgatgacgtcgaacctggcggcagcgcaaaagatg

SEQ ID NO: 121193 - DNA, 103 bp, Artificial Sequence
  Synthetic Polynucleotide
taatacgactcactatagggcgctctgcggcgacccccgcagcgacgtcaaacagaggagatgacgtatgtgcgggggtaacctggcggcagcgcaaaagatg

SEQ ID NO: 121194 - DNA, 103 bp, Artificial Sequence
  Synthetic Polynucleotide
taatacgactcactatagggtccgcggccgcgctctgcggcgacccccgcaacagaggagagcggggatggccgcagagaacctggcggcagcgcaaaagatg

SEQ ID NO: 121195 - DNA, 103 bp, Artificial Sequence
  Synthetic Polynucleotide
taatacgactcactatagggggagctgagctccgcggccgcgctctgcggaacagaggagaccgcagatggcggccgcgaacctggcggcagcgcaaaagatg

SEQ ID NO: 121196 - DNA, 103 bp, Artificial Sequence
  Synthetic Polynucleotide
taatacgactcactatagggccagaaggccggagctgagctccgcggccgaacagaggagacggccgatgagctcagctaacctggcggcagcgcaaaagatg

SEQ ID NO: 121197 - DNA, 103 bp, Artificial Sequence
  Synthetic Polynucleotide
taatacgactcactataggggccgccgaggccagaaggccggagctgagcaacagaggagagctcagatgcggccttctaacctggcggcagcgcaaaagatg

SEQ ID NO: 121198 - DNA, 103 bp, Artificial Sequence
  Synthetic Polynucleotide
taatacgactcactatagggggggtcggacacggagtagcgcgcctgcataacagaggagaatgcagatgcgctactccaacctggcggcagcgcaaaagatg

SEQ ID NO: 121199 - DNA, 103 bp, Artificial Sequence
  Synthetic Polynucleotide
taatacgactcactataggggacgcccatggggctggccatgccgccgtaaacagaggagatacggcatgatggccagcaacctggcggcagcgcaaaagatg

SEQ ID NO: 121200 - DNA, 103 bp, Artificial Sequence
  Synthetic Polynucleotide
taatacgactcactatagggggtgtacaggctcatcgctcgcatgctgcaaacagaggagatgcagcatgcgagcgatgaacctggcggcagcgcaaaagatg

SEQ ID NO: 121201 - DNA, 103 bp, Artificial Sequence
  Synthetic Polynucleotide
taatacgactcactataggggctcggccccggtgtacaggctcatcgctcaacagaggagagagcgaatggcctgtacaaacctggcggcagcgcaaaagatg

SEQ ID NO: 121202 - DNA, 103 bp, Artificial Sequence
  Synthetic Polynucleotide
taatacgactcactatagggtgcgccggccgctcggccccggtgtacaggaacagaggagacctgtaatgcggggccgaaacctggcggcagcgcaaaagatg

SEQ ID NO: 121203 - DNA, 103 bp, Artificial Sequence
  Synthetic Polynucleotide
taatacgactcactataggggacgcacatgtgcgccggccgctcggccccaacagaggagaggggccatgcggccggcgaacctggcggcagcgcaaaagatg

SEQ ID NO: 121204 - DNA, 103 bp, Artificial Sequence
  Synthetic Polynucleotide
taatacgactcactataggggggcgggcgggacgcacatgtgcgccggccaacagaggagaggccggatgacatgtgcgaacctggcggcagcgcaaaagatg

SEQ ID NO: 121205 - DNA, 103 bp, Artificial Sequence
  Synthetic Polynucleotide
taatacgactcactataggggcctcgtccagggcgggcgggacgcacatgaacagaggagacatgtgatgcccgcccgcaacctggcggcagcgcaaaagatg

SEQ ID NO: 121206 - DNA, 103 bp, Artificial Sequence
  Synthetic Polynucleotide
taatacgactcactataggggtccgagagggcctcgtccagggcgggcggaacagaggagaccgcccatgctggacgagaacctggcggcagcgcaaaagatg

SEQ ID NO: 121207 - DNA, 103 bp, Artificial Sequence
  Synthetic Polynucleotide
taatacgactcactatagggcgctcgggtggtccgagagggcctcgtccaaacagaggagatggacgatgccctctcggaacctggcggcagcgcaaaagatg

SEQ ID NO: 121208 - DNA, 103 bp, Artificial Sequence
  Synthetic Polynucleotide
taatacgactcactataggggacgtggggccgctcgggtggtccgagaggaacagaggagacctctcatgccacccgagaacctggcggcagcgcaaaagatg

SEQ ID NO: 121209 - DNA, 103 bp, Artificial Sequence
  Synthetic Polynucleotide
taatacgactcactataggggctcaggggcgacgtggggccgctcgggtgaacagaggagacacccgatgggccccacgaacctggcggcagcgcaaaagatg

SEQ ID NO: 121210 - DNA, 103 bp, Artificial Sequence
  Synthetic Polynucleotide
taatacgactcactatagggggccggaatagacgcccatggggctggccaaacagaggagatggccaatgccatgggcgaacctggcggcagcgcaaaagatg

SEQ ID NO: 121211 - DNA, 103 bp, Artificial Sequence
  Synthetic Polynucleotide
taatacgactcactatagggggttgagagcgctcaggggcgacgtggggcaacagaggagagccccaatgcgcccctgaaacctggcggcagcgcaaaagatg

SEQ ID NO: 121212 - DNA, 103 bp, Artificial Sequence
  Synthetic Polynucleotide
taatacgactcactatagggccggcggcgaggttgagagcgctcaggggcaacagaggagagcccctatgcgctctcaaaacctggcggcagcgcaaaagatg

SEQ ID NO: 121213 - DNA, 103 bp, Artificial Sequence
  Synthetic Polynucleotide
taatacgactcactataggggccctcctggccggcggcgaggttgagagcaacagaggagagctctcatgctcgccgccaacctggcggcagcgcaaaagatg

SEQ ID NO: 121214 - DNA, 103 bp, Artificial Sequence
  Synthetic Polynucleotide
taatacgactcactatagggcggcgagcgcgccctcctggccggcggcgaaacagaggagatcgccgatggccaggaggaacctggcggcagcgcaaaagatg

SEQ ID NO: 121215 - DNA, 103 bp, Artificial Sequence
  Synthetic Polynucleotide
taatacgactcactatagggtggcccgtggcggcgagcgcgccctcctggaacagaggagaccaggaatgcgcgctcgcaacctggcggcagcgcaaaagatg

SEQ ID NO: 121216 - DNA, 103 bp, Artificial Sequence
  Synthetic Polynucleotide
taatacgactcactatagggctggtggtggtggcccgtggcggcgagcgcaacagaggagagcgctcatggccacgggcaacctggcggcagcgcaaaagatg

SEQ ID NO: 121217 - DNA, 103 bp, Artificial Sequence
  Synthetic Polynucleotide
taatacgactcactatagggggccgtggtgctggtggtggtggcccgtggaacagaggagaccacggatgaccaccaccaacctggcggcagcgcaaaagatg

SEQ ID NO: 121218 - DNA, 103 bp, Artificial Sequence
  Synthetic Polynucleotide
taatacgactcactataggggggtggtggtggccgtggtgctggtggtggaacagaggagaccaccaatggcaccacggaacctggcggcagcgcaaaagatg

SEQ ID NO: 121219 - DNA, 103 bp, Artificial Sequence
  Synthetic Polynucleotide
taatacgactcactatagggcggcgcctgcgggtggtggtggccgtggtgaacagaggagacaccacatgcaccaccacaacctggcggcagcgcaaaagatg

SEQ ID NO: 121220 - DNA, 103 bp, Artificial Sequence
  Synthetic Polynucleotide
taatacgactcactataggggcgggggcggcggcgcctgcgggtggtggtaacagaggagaaccaccatgcgcaggcgcaacctggcggcagcgcaaaagatg

SEQ ID NO: 121221 - DNA, 103 bp, Artificial Sequence
  Synthetic Polynucleotide
taatacgactcactatagggtgctccgggtggccggaatagacgcccatgaacagaggagacatgggatgctattccggaacctggcggcagcgcaaaagatg

SEQ ID NO: 121222 - DNA, 103 bp, Artificial Sequence
  Synthetic Polynucleotide
taatacgactcactatagggtggggagccggcgggggcggcggcgcctgcaacagaggagagcaggcatggccgcccccaacctggcggcagcgcaaaagatg

SEQ ID NO: 121223 - DNA, 103 bp, Artificial Sequence
  Synthetic Polynucleotide
taatacgactcactatagggcggctggggctggggagccggcgggggcggaacagaggagaccgcccatgccggctcccaacctggcggcagcgcaaaagatg

SEQ ID NO: 121224 - DNA, 103 bp, Artificial Sequence
  Synthetic Polynucleotide
taatacgactcactataggggctgcggcgtcggctggggctggggagccgaacagaggagacggctcatgagccccagcaacctggcggcagcgcaaaagatg

SEQ ID NO: 121225 - DNA, 103 bp, Artificial Sequence
  Synthetic Polynucleotide
taatacgactcactataggggcggccccgggctgcggcgtcggctggggcaacagaggagagccccaatggacgccgcaaacctggcggcagcgcaaaagatg

SEQ ID NO: 121226 - DNA, 103 bp, Artificial Sequence
  Synthetic Polynucleotide
taatacgactcactatagggctgcgccgcggcggccccgggctgcggcgtaacagaggagaacgccgatgcccggggccaacctggcggcagcgcaaaagatg

SEQ ID NO: 121227 - DNA, 103 bp, Artificial Sequence
  Synthetic Polynucleotide
taatacgactcactatagggaggaggccgcctgcgccgcggcggccccggaacagaggagaccggggatgccgcggcgcaacctggcggcagcgcaaaagatg

SEQ ID NO: 121228 - DNA, 103 bp, Artificial Sequence
  Synthetic Polynucleotide
taatacgactcactatagggttgagataccaggaggccgcctgcgccgcgaacagaggagacgcggcatgggcggcctcaacctggcggcagcgcaaaagatg

SEQ ID NO: 121229 - DNA, 103 bp, Artificial Sequence
  Synthetic Polynucleotide
taatacgactcactatagggcccgctgtggttgagataccaggaggccgcaacagaggagagcggccatgtggtatctcaacctggcggcagcgcaaaagatg

SEQ ID NO: 121230 - DNA, 103 bp, Artificial Sequence
  Synthetic Polynucleotide
taatacgactcactatagggggttcaggtccccgctgtggttgagataccaacagaggagaggtatcatgaccacagcgaacctggcggcagcgcaaaagatg

SEQ ID NO: 121231 - DNA, 103 bp, Artificial Sequence
  Synthetic Polynucleotide
taatacgactcactatagggccggggaggtggttcaggtccccgctgtggaacagaggagaccacagatgggacctgaaaacctggcggcagcgcaaaagatg

SEQ ID NO: 121232 - DNA, 103 bp, Artificial Sequence
  Synthetic Polynucleotide
taatacgactcactatagggcgcgctgtactgctccgggtggccggaataaacagaggagatattccatgcacccggagaacctggcggcagcgcaaaagatg

SEQ ID NO: 121233 - DNA, 103 bp, Artificial Sequence
  Synthetic Polynucleotide
taatacgactcactataggggaacgtgtggccggggaggtggttcaggtcaacagaggagagacctgatgcacctccccaacctggcggcagcgcaaaagatg

SEQ ID NO: 121234 - DNA, 103 bp, Artificial Sequence
  Synthetic Polynucleotide
taatacgactcactataggggctgggccgcgaacgtgtggccggggaggtaacagaggagaacctccatggccacacgtaacctggcggcagcgcaaaagatg

SEQ ID NO: 121235 - DNA, 103 bp, Artificial Sequence
  Synthetic Polynucleotide
taatacgactcactatagggaaagtttgctgctgggccgcgaacgtgtggaacagaggagaccacacatgcgcggcccaaacctggcggcagcgcaaaagatg

SEQ ID NO: 121236 - DNA, 103 bp, Artificial Sequence
  Synthetic Polynucleotide
taatacgactcactatagggcacgttggggaaagtttgctgctgggccgcaacagaggagagcggccatgcagcaaactaacctggcggcagcgcaaaagatg

SEQ ID NO: 121237 - DNA, 103 bp, Artificial Sequence
  Synthetic Polynucleotide
taatacgactcactatagggacatctcccgcacgttggggaaagtttgctaacagaggagaagcaaaatgtccccaacgaacctggcggcagcgcaaaagatg

SEQ ID NO: 121238 - DNA, 103 bp, Artificial Sequence
  Synthetic Polynucleotide
taatacgactcactatagggtgggagttgaacatctcccgcacgttggggaacagaggagaccccaaatggcgggagataacctggcggcagcgcaaaagatg

SEQ ID NO: 121239 - DNA, 103 bp, Artificial Sequence
  Synthetic Polynucleotide
taatacgactcactatagggccccagccggtgggagttgaacatctcccgaacagaggagacgggagatgttcaactccaacctggcggcagcgcaaaagatg

SEQ ID NO: 121240 - DNA, 103 bp, Artificial Sequence
  Synthetic Polynucleotide
taatacgactcactatagggagttctcaatccccagccggtgggagttgaaacagaggagatcaactatgaccggctggaacctggcggcagcgcaaaagatg

SEQ ID NO: 121241 - DNA, 103 bp, Artificial Sequence
  Synthetic Polynucleotide
taatacgactcactatagggccgagggtcgagttctcaatccccagccggaacagaggagaccggctatggattgagaaaacctggcggcagcgcaaaagatg

SEQ ID NO: 121242 - DNA, 103 bp, Artificial Sequence
  Synthetic Polynucleotide
taatacgactcactatagggctgggactccccgagggtcgagttctcaataacagaggagaattgagatgtcgaccctcaacctggcggcagcgcaaaagatg

SEQ ID NO: 121243 - DNA, 103 bp, Artificial Sequence
  Synthetic Polynucleotide
taatacgactcactatagggggcccatccccgcgctgtactgctccgggtaacagaggagaacccggatgagtacagcgaacctggcggcagcgcaaaagatg

SEQ ID NO: 121244 - DNA, 103 bp, Artificial Sequence
  Synthetic Polynucleotide
taatacgactcactatagggtgccactcacctgggactccccgagggtcgaacagaggagacgacccatggggagtcccaacctggcggcagcgcaaaagatg

SEQ ID NO: 121245 - DNA, 103 bp, Artificial Sequence
  Synthetic Polynucleotide
taatacgactcactatagggcagctggcattgccactcacctgggactccaacagaggagaggagtcatgggtgagtggaacctggcggcagcgcaaaagatg

SEQ ID NO: 121246 - DNA, 103 bp, Artificial Sequence
  Synthetic Polynucleotide
taatacgactcactataggggggcagctggcagctggcattgccactcacaacagaggagagtgagtatgaatgccagcaacctggcggcagcgcaaaagatg

SEQ ID NO: 121247 - DNA, 103 bp, Artificial Sequence
  Synthetic Polynucleotide
taatacgactcactatagggtggatctgtagggcagctggcagctggcataacagaggagaatgccaatggccagctgcaacctggcggcagcgcaaaagatg

SEQ ID NO: 121248 - DNA, 103 bp, Artificial Sequence
  Synthetic Polynucleotide
taatacgactcactatagggagaggcggcgtggatctgtagggcagctggaacagaggagaccagctatgctacagatcaacctggcggcagcgcaaaagatg

SEQ ID NO: 121249 - DNA, 103 bp, Artificial Sequence
  Synthetic Polynucleotide
taatacgactcactataggggtggcgatagagaggcggcgtggatctgtaaacagaggagatacagaatgacgccgcctaacctggcggcagcgcaaaagatg

SEQ ID NO: 121250 - DNA, 103 bp, Artificial Sequence
  Synthetic Polynucleotide
taatacgactcactatagggagggggctgcgtggcgatagagaggcggcgaacagaggagacgccgcatgtctatcgccaacctggcggcagcgcaaaagatg

SEQ ID NO: 121251 - DNA, 103 bp, Artificial Sequence
  Synthetic Polynucleotide
taatacgactcactatagggtcgtaggagtagggggctgcgtggcgatagaacagaggagactatcgatgcgcagccccaacctggcggcagcgcaaaagatg

SEQ ID NO: 121252 - DNA, 103 bp, Artificial Sequence
  Synthetic Polynucleotide
taatacgactcactatagggtttcgtgcagtcgtaggagtagggggctgcaacagaggagagcagccatgtactcctacaacctggcggcagcgcaaaagatg

SEQ ID NO: 121253 - DNA, 103 bp, Artificial Sequence
  Synthetic Polynucleotide
taatacgactcactataggggcgtaggagcggcccatccccgcgctgtacaacagaggagagtacagatgggggatgggaacctggcggcagcgcaaaagatg

SEQ ID NO: 121254 - DNA, 103 bp, Artificial Sequence
  Synthetic Polynucleotide
taatacgactcactataggggtggtagggcgcgtaggagcggcccatcccaacagaggagagggatgatgcgctcctacaacctggcggcagcgcaaaagatg

SEQ ID NO: 121255 - DNA, 103 bp, Artificial Sequence
  Synthetic Polynucleotide
taatacgactcactataggggctggtggtggtggtagggcgcgtaggagcaacagaggagagctcctatgcgccctaccaacctggcggcagcgcaaaagatg

SEQ ID NO: 121256 - DNA, 103 bp, Artificial Sequence
  Synthetic Polynucleotide
taatacgactcactatagggggcgccgcgggctggtggtggtggtagggcaacagaggagagccctaatgccaccaccaaacctggcggcagcgcaaaagatg

SEQ ID NO: 121257 - DNA, 103 bp, Artificial Sequence
  Synthetic Polynucleotide
taatacgactcactatagggcaggtccttaggcgccgcgggctggtggtgaacagaggagacaccacatgcccgcggcgaacctggcggcagcgcaaaagatg

SEQ ID NO: 121258 - DNA, 103 bp, Artificial Sequence
  Synthetic Polynucleotide
taatacgactcactatagggccagggcgttggggtcggacacggagtagcaacagaggagagctactatgtgtccgaccaacctggcggcagcgcaaaagatg

SEQ ID NO: 121259 - DNA, 103 bp, Artificial Sequence
  Synthetic Polynucleotide
taatacgactcactataggggcggcttcaccaggtccttaggcgccgcggaacagaggagaccgcggatgctaaggaccaacctggcggcagcgcaaaagatg

SEQ ID NO: 121260 - DNA, 103 bp, Artificial Sequence
  Synthetic Polynucleotide
taatacgactcactatagggtagctgtagggcggcttcaccaggtccttaaacagaggagataaggaatgggtgaagccaacctggcggcagcgcaaaagatg

SEQ ID NO: 121261 - DNA, 103 bp, Artificial Sequence
  Synthetic Polynucleotide
taatacgactcactataggggagcgcgatgtagctgtagggcggcttcacaacagaggagagtgaagatgccctacagcaacctggcggcagcgcaaaagatg

SEQ ID NO: 121262 - DNA, 103 bp, Artificial Sequence
  Synthetic Polynucleotide
taatacgactcactatagggccatggtgatgagcgcgatgtagctgtaggaacagaggagacctacaatgacatcgcgcaacctggcggcagcgcaaaagatg

SEQ ID NO: 121263 - DNA, 103 bp, Artificial Sequence
  Synthetic Polynucleotide
taatacgactcactatagggttctggatggccatggtgatgagcgcgatgaacagaggagacatcgcatgcatcaccataacctggcggcagcgcaaaagatg

SEQ ID NO: 121264 - DNA, 103 bp, Artificial Sequence
  Synthetic Polynucleotide
taatacgactcactatagggctcgggcgcgttctggatggccatggtgataacagaggagaatcaccatggccatccagaacctggcggcagcgcaaaagatg

SEQ ID NO: 121265 - DNA, 103 bp, Artificial Sequence
  Synthetic Polynucleotide
taatacgactcactatagggtgatcttcttctcgggcgcgttctggatggaacagaggagaccatccatgacgcgcccgaacctggcggcagcgcaaaagatg

SEQ ID NO: 121266 - DNA, 103 bp, Artificial Sequence
  Synthetic Polynucleotide
taatacgactcactatagggccgttcaaggtgatcttcttctcgggcgcgaacagaggagacgcgccatggaagaagataacctggcggcagcgcaaaagatg

SEQ ID NO: 121267 - DNA, 103 bp, Artificial Sequence
  Synthetic Polynucleotide
taatacgactcactatagggctggtagatgccgttcaaggtgatcttcttaacagaggagaaagaagatgaccttgaacaacctggcggcagcgcaaaagatg

SEQ ID NO: 121268 - DNA, 103 bp, Artificial Sequence
  Synthetic Polynucleotide
taatacgactcactatagggccatgatgaactggtagatgccgttcaaggaacagaggagaccttgaatggcatctaccaacctggcggcagcgcaaaagatg

SEQ ID NO: 121269 - DNA, 103 bp, Artificial Sequence
  Synthetic Polynucleotide
taatacgactcactatagggggcaccactcccagggcgttggggtcggacaacagaggagagtccgaatgcaacgccctaacctggcggcagcgcaaaagatg

SEQ ID NO: 121270 - DNA, 103 bp, Artificial Sequence
  Synthetic Polynucleotide
taatacgactcactataggggggaagcggtccatgatgaactggtagatgaacagaggagacatctaatggttcatcataacctggcggcagcgcaaaagatg

SEQ ID NO: 121271 - DNA, 103 bp, Artificial Sequence
  Synthetic Polynucleotide
taatacgactcactatagggccggtagaaggggaagcggtccatgatgaaaacagaggagattcatcatggaccgcttcaacctggcggcagcgcaaaagatg

SEQ ID NO: 121272 - DNA, 103 bp, Artificial Sequence
  Synthetic Polynucleotide
taatacgactcactataggggcttgttctcccggtagaaggggaagcggtaacagaggagaaccgctatgccttctaccaacctggcggcagcgcaaaagatg

SEQ ID NO: 121273 - DNA, 103 bp, Artificial Sequence
  Synthetic Polynucleotide
taatacgactcactatagggtgccagccctgcttgttctcccggtagaagaacagaggagacttctaatgggagaacaaaacctggcggcagcgcaaaagatg

SEQ ID NO: 121274 - DNA, 103 bp, Artificial Sequence
  Synthetic Polynucleotide
taatacgactcactataggggatgctgttctgccagccctgcttgttctcaacagaggagagagaacatgcagggctggaacctggcggcagcgcaaaagatg

SEQ ID NO: 121275 - DNA, 103 bp, Artificial Sequence
  Synthetic Polynucleotide
taatacgactcactatagggggttgtggcggatgctgttctgccagccctaacagaggagaagggctatgagaacagcaaacctggcggcagcgcaaaagatg

SEQ ID NO: 121276 - DNA, 103 bp, Artificial Sequence
  Synthetic Polynucleotide
taatacgactcactatagggttgagcgagaggttgtggcggatgctgttcaacagaggagagaacagatgccgccacaaaacctggcggcagcgcaaaagatg

SEQ ID NO: 121277 - DNA, 103 bp, Artificial Sequence
  Synthetic Polynucleotide
taatacgactcactataggggaagcactcgttgagcgagaggttgtggcgaacagaggagacgccacatgctctcgctcaacctggcggcagcgcaaaagatg

SEQ ID NO: 121278 - DNA, 103 bp, Artificial Sequence
  Synthetic Polynucleotide
taatacgactcactataggggcaccttgacgaagcactcgttgagcgagaaacagaggagatctcgcatgacgagtgctaacctggcggcagcgcaaaagatg

SEQ ID NO: 121279 - DNA, 103 bp, Artificial Sequence
  Synthetic Polynucleotide
taatacgactcactatagggtcgtcgcggggcaccttgacgaagcactcgaacagaggagacgagtgatgcgtcaaggtaacctggcggcagcgcaaaagatg

SEQ ID NO: 121280 - DNA, 103 bp, Artificial Sequence
  Synthetic Polynucleotide
taatacgactcactataggggctcaggtagggcaccactcccagggcgttaacagaggagaaacgccatgggagtggtgaacctggcggcagcgcaaaagatg

SEQ ID NO: 121281 - DNA, 103 bp, Artificial Sequence
  Synthetic Polynucleotide
taatacgactcactataggggggcttcttgtcgtcgcggggcaccttgacaacagaggagagtcaagatgccccgcgacaacctggcggcagcgcaaaagatg

SEQ ID NO: 121282 - DNA, 103 bp, Artificial Sequence
  Synthetic Polynucleotide
taatacgactcactatagggtgcccttgccgggcttcttgtcgtcgcgggaacagaggagacccgcgatgacaagaagcaacctggcggcagcgcaaaagatg

SEQ ID NO: 121283 - DNA, 103 bp, Artificial Sequence
  Synthetic Polynucleotide
taatacgactcactataggggtccagtaactgcccttgccgggcttcttgaacagaggagacaagaaatgcggcaagggaacctggcggcagcgcaaaagatg

SEQ ID NO: 121284 - DNA, 103 bp, Artificial Sequence
  Synthetic Polynucleotide
taatacgactcactatagggcgggtccagggtccagtaactgcccttgccaacagaggagaggcaagatgagttactggaacctggcggcagcgcaaaagatg

SEQ ID NO: 121285 - DNA, 103 bp, Artificial Sequence
  Synthetic Polynucleotide
taatacgactcactatagggtgtaggagtccgggtccagggtccagtaacaacagaggagagttactatgccctggaccaacctggcggcagcgcaaaagatg

SEQ ID NO: 121286 - DNA, 103 bp, Artificial Sequence
  Synthetic Polynucleotide
taatacgactcactatagggtcgaacatgttgtaggagtccgggtccaggaacagaggagacctggaatgggactcctaaacctggcggcagcgcaaaagatg

SEQ ID NO: 121287 - DNA, 103 bp, Artificial Sequence
  Synthetic Polynucleotide
taatacgactcactataggggctgccgttctcgaacatgttgtaggagtcaacagaggagagactccatgaacatgttcaacctggcggcagcgcaaaagatg

SEQ ID NO: 121288 - DNA, 103 bp, Artificial Sequence
  Synthetic Polynucleotide
taatacgactcactataggggccgcaggaagctgccgttctcgaacatgtaacagaggagaacatgtatgagaacggcaaacctggcggcagcgcaaaagatg

SEQ ID NO: 121289 - DNA, 103 bp, Artificial Sequence
  Synthetic Polynucleotide
taatacgactcactatagggcgccgccggcgccgcaggaagctgccgttcaacagaggagagaacggatgcttcctgcgaacctggcggcagcgcaaaagatg

SEQ ID NO: 121290 - DNA, 103 bp, Artificial Sequence
  Synthetic Polynucleotide
taatacgactcactatagggctttttgaagcgccgccggcgccgcaggaaaacagaggagattcctgatgcgccggcggaacctggcggcagcgcaaaagatg

SEQ ID NO: 121291 - DNA, 103 bp, Artificial Sequence
  Synthetic Polynucleotide
taatacgactcactatagggaattctgctcgctcaggtagggcaccactcaacagaggagagagtggatgcctacctgaaacctggcggcagcgcaaaagatg

SEQ ID NO: 121292 - DNA, 103 bp, Artificial Sequence
  Synthetic Polynucleotide
taatacgactcactatagggacacgtccttctttttgaagcgccgccggcaacagaggagagccggcatggcttcaaaaaacctggcggcagcgcaaaagatg

SEQ ID NO: 121293 - DNA, 103 bp, Artificial Sequence
  Synthetic Polynucleotide
taatacgactcactatagggttctccttggacacgtccttctttttgaagaacagaggagacttcaaatggaaggacgtaacctggcggcagcgcaaaagatg

SEQ ID NO: 121294 - DNA, 103 bp, Artificial Sequence
  Synthetic Polynucleotide
taatacgactcactatagggccgctcctccttctccttggacacgtccttaacagaggagaaaggacatgtccaaggagaacctggcggcagcgcaaaagatg

SEQ ID NO: 121295 - DNA, 103 bp, Artificial Sequence
  Synthetic Polynucleotide
taatacgactcactatagggtgaggtgggcccgctcctccttctccttggaacagaggagaccaaggatgaggaggagcaacctggcggcagcgcaaaagatg

SEQ ID NO: 121296 - DNA, 103 bp, Artificial Sequence
  Synthetic Polynucleotide
taatacgactcactatagggggcggctccttgaggtgggcccgctcctccaacagaggagaggaggaatgggcccacctaacctggcggcagcgcaaaagatg

SEQ ID NO: 121297 - DNA, 103 bp, Artificial Sequence
  Synthetic Polynucleotide
taatacgactcactatagggcgccgccgggggcggctccttgaggtgggcaacagaggagagcccacatgaaggagccgaacctggcggcagcgcaaaagatg

SEQ ID NO: 121298 - DNA, 103 bp, Artificial Sequence
  Synthetic Polynucleotide
taatacgactcactatagggcgcccttggacgccgccgggggcggctcctaacagaggagaaggagcatgccccggcggaacctggcggcagcgcaaaagatg

SEQ ID NO: 121299 - DNA, 103 bp, Artificial Sequence
  Synthetic Polynucleotide
taatacgactcactataggggtggccggggcgcccttggacgccgccgggaacagaggagacccggcatggtccaagggaacctggcggcagcgcaaaagatg

SEQ ID NO: 121300 - DNA, 103 bp, Artificial Sequence
  Synthetic Polynucleotide
taatacgactcactatagggtaggtggggggtggccggggcgcccttggaaacagaggagatccaagatggccccggccaacctggcggcagcgcaaaagatg

SEQ ID NO: 121301 - DNA, 103 bp, Artificial Sequence
  Synthetic Polynucleotide
taatacgactcactataggggggcgtccgctaggtggggggtggccggggaacagaggagaccccggatgccccccaccaacctggcggcagcgcaaaagatg

SEQ ID NO: 121302 - DNA, 103 bp, Artificial Sequence
  Synthetic Polynucleotide
taatacgactcactataggggcccggtagtaattctgctcgctcaggtagaacagaggagactacctatgcgagcagaaaacctggcggcagcgcaaaagatg

SEQ ID NO: 121303 - DNA, 103 bp, Artificial Sequence
  Synthetic Polynucleotide
taatacgactcactataggggcctccttgggggcgtccgctaggtgggggaacagaggagacccccaatgagcggacgcaacctggcggcagcgcaaaagatg

SEQ ID NO: 121304 - DNA, 103 bp, Artificial Sequence
  Synthetic Polynucleotide
taatacgactcactatagggcttcttctcggcctccttgggggcgtccgcaacagaggagagcggacatgcccaaggagaacctggcggcagcgcaaaagatg

SEQ ID NO: 121305 - DNA, 103 bp, Artificial Sequence
  Synthetic Polynucleotide
taatacgactcactatagggtgatcaccaccttcttctcggcctccttggaacagaggagaccaaggatgccgagaagaaacctggcggcagcgcaaaagatg

SEQ ID NO: 121306 - DNA, 103 bp, Artificial Sequence
  Synthetic Polynucleotide
taatacgactcactataggggcctcgctcttgatcaccaccttcttctcgaacagaggagacgagaaatgggtggtgataacctggcggcagcgcaaaagatg

SEQ ID NO: 121307 - DNA, 103 bp, Artificial Sequence
  Synthetic Polynucleotide
taatacgactcactatagggcggggacgccgcctcgctcttgatcaccacaacagaggagagtggtgatgaagagcgagaacctggcggcagcgcaaaagatg

SEQ ID NO: 121308 - DNA, 103 bp, Artificial Sequence
  Synthetic Polynucleotide
taatacgactcactatagggccggcagcgccggggacgccgcctcgctctaacagaggagaagagcgatgcggcgtcccaacctggcggcagcgcaaaagatg

SEQ ID NO: 121309 - DNA, 103 bp, Artificial Sequence
  Synthetic Polynucleotide
taatacgactcactatagggttggtgatgaccggcagcgccggggacgccaacagaggagaggcgtcatgggcgctgccaacctggcggcagcgcaaaagatg

SEQ ID NO: 121310 - DNA, 103 bp, Artificial Sequence
  Synthetic Polynucleotide
taatacgactcactatagggcgtctccaccttggtgatgaccggcagcgcaacagaggagagcgctgatggtcatcaccaacctggcggcagcgcaaaagatg

SEQ ID NO: 121311 - DNA, 103 bp, Artificial Sequence
  Synthetic Polynucleotide
taatacgactcactatagggcggggctcagcgtctccaccttggtgatgaaacagaggagatcatcaatgaggtggagaaacctggcggcagcgcaaaagatg

SEQ ID NO: 121312 - DNA, 103 bp, Artificial Sequence
  Synthetic Polynucleotide
taatacgactcactatagggagcgcgctctcggggctcagcgtctccaccaacagaggagaggtggaatggctgagcccaacctggcggcagcgcaaaagatg

SEQ ID NO: 121313 - DNA, 103 bp, Artificial Sequence
  Synthetic Polynucleotide
taatacgactcactataggggctgcccgcagcccggtagtaattctgctcaacagaggagagagcagatgtactaccggaacctggcggcagcgcaaaagatg

SEQ ID NO: 121314 - DNA, 103 bp, Artificial Sequence
  Synthetic Polynucleotide
taatacgactcactataggggctgccctgcagcgcgctctcggggctcagaacagaggagactgagcatggagagcgcgaacctggcggcagcgcaaaagatg

SEQ ID NO: 121315 - DNA, 103 bp, Artificial Sequence
  Synthetic Polynucleotide
taatacgactcactatagggcgctgcgcgggctgccctgcagcgcgctctaacagaggagaagagcgatgtgcagggcaaacctggcggcagcgcaaaagatg

SEQ ID NO: 121316 - DNA, 103 bp, Artificial Sequence
  Synthetic Polynucleotide
taatacgactcactataggggtggaggccgcgctgcgcgggctgccctgcaacagaggagagcagggatgcccgcgcagaacctggcggcagcgcaaaagatg

SEQ ID NO: 121317 - DNA, 103 bp, Artificial Sequence
  Synthetic Polynucleotide
taatacgactcactataggggccggcgggcgtggaggccgcgctgcgcggaacagaggagaccgcgcatggcggcctccaacctggcggcagcgcaaaagatg

SEQ ID NO: 121318 - DNA, 103 bp, Artificial Sequence
  Synthetic Polynucleotide
taatacgactcactatagggcgtcgggggagccggcgggcgtggaggccgaacagaggagacggcctatgcgcccgccgaacctggcggcagcgcaaaagatg

SEQ ID NO: 121319 - DNA, 103 bp, Artificial Sequence
  Synthetic Polynucleotide
taatacgactcactatagggggcagcgagccgtcgggggagccggcgggcaacagaggagagcccgcatgctcccccgaaacctggcggcagcgcaaaagatg

SEQ ID NO: 121320 - DNA, 103 bp, Artificial Sequence
  Synthetic Polynucleotide
taatacgactcactataggggtggtgctccggcagcgagccgtcgggggaaacagaggagatcccccatgggctcgctgaacctggcggcagcgcaaaagatg

SEQ ID NO: 121321 - DNA, 103 bp, Artificial Sequence
  Synthetic Polynucleotide
taatacgactcactataggggcgccgcggcgtggtgctccggcagcgagcaacagaggagagctcgcatgcggagcaccaacctggcggcagcgcaaaagatg

SEQ ID NO: 121322 - DNA, 103 bp, Artificial Sequence
  Synthetic Polynucleotide
taatacgactcactatagggagcccgttgggcgccgcggcgtggtgctccaacagaggagaggagcaatgcgccgcggcaacctggcggcagcgcaaaagatg

SEQ ID NO: 121323 - DNA, 103 bp, Artificial Sequence
  Synthetic Polynucleotide
taatacgactcactataggggaagccaggcagcccgttgggcgccgcggcaacagaggagagccgcgatgcccaacgggaacctggcggcagcgcaaaagatg

SEQ ID NO: 121324 - DNA, 103 bp, Artificial Sequence
  Synthetic Polynucleotide
taatacgactcactatagggtgccgccgtagctgcccgcagcccggtagtaacagaggagaactaccatgctgcgggcaaacctggcggcagcgcaaaagatg

SEQ ID NO: 121325 - DNA, 103 bp, Artificial Sequence
  Synthetic Polynucleotide
taatacgactcactatagggtctccacgctgaagccaggcagcccgttggaacagaggagaccaacgatgtgcctggctaacctggcggcagcgcaaaagatg

SEQ ID NO: 121326 - DNA, 103 bp, Artificial Sequence
  Synthetic Polynucleotide
taatacgactcactataggggtcatgatgttctccacgctgaagccaggcaacagaggagagcctggatgcagcgtggaaacctggcggcagcgcaaaagatg

SEQ ID NO: 121327 - DNA, 103 bp, Artificial Sequence
  Synthetic Polynucleotide
taatacgactcactatagggcgttcgcagggtcatgatgttctccacgctaacagaggagaagcgtgatgaacatcatgaacctggcggcagcgcaaaagatg

SEQ ID NO: 121328 - DNA, 103 bp, Artificial Sequence
  Synthetic Polynucleotide
taatacgactcactatagggccggcggcgacgttcgcagggtcatgatgtaacagaggagaacatcaatgccctgcgaaaacctggcggcagcgcaaaagatg

SEQ ID NO: 121329 - DNA, 103 bp, Artificial Sequence
  Synthetic Polynucleotide
taatacgactcactatagggagctctccgcccggcggcgacgttcgcaggaacagaggagacctgcgatggtcgccgccaacctggcggcagcgcaaaagatg

SEQ ID NO: 121330 - DNA, 103 bp, Artificial Sequence
  Synthetic Polynucleotide
taatacgactcactatagggccccgggctcagctctccgcccggcggcgaaacagaggagatcgccgatgggcggagagaacctggcggcagcgcaaaagatg

SEQ ID NO: 121331 - DNA, 103 bp, Artificial Sequence
  Synthetic Polynucleotide
taatacgactcactatagggcgcgtccggcccccgggctcagctctccgcaacagaggagagcggagatgtgagcccggaacctggcggcagcgcaaaagatg

SEQ ID NO: 121332 - DNA, 103 bp, Artificial Sequence
  Synthetic Polynucleotide
taatacgactcactatagggaccaggcccgcgcgtccggcccccgggctcaacagaggagagagcccatgggccggacgaacctggcggcagcgcaaaagatg

SEQ ID NO: 121333 - DNA, 103 bp, Artificial Sequence
  Synthetic Polynucleotide
taatacgactcactatagggcggcggcaccaccaggcccgcgcgtccggcaacagaggagagccggaatggcgggcctgaacctggcggcagcgcaaaagatg

SEQ ID NO: 121334 - DNA, 103 bp, Artificial Sequence
  Synthetic Polynucleotide
taatacgactcactataggggcagcgccagcggcggcaccaccaggcccgaacagaggagacgggccatgtggtgccgcaacctggcggcagcgcaaaagatg

SEQ ID NO: 121335 - DNA, 103 bp, Artificial Sequence
  Synthetic Polynucleotide
taatacgactcactataggggggctggccatgccgccgtagctgcccgcaaacagaggagatgcgggatgctacggcggaacctggcggcagcgcaaaagatg

SEQ ID NO: 121336 - DNA, 103 bp, Artificial Sequence
  Synthetic Polynucleotide
taatacgactcactataggggcggcgtagggcagcgccagcggcggcaccaacagaggagaggtgccatggctggcgctaacctggcggcagcgcaaaagatg

SEQ ID NO: 121337 - DNA, 103 bp, Artificial Sequence
  Synthetic Polynucleotide
taatacgactcactataggggggcggcgcggcggcgtagggcagcgccagaacagaggagactggcgatgccctacgccaacctggcggcagcgcaaaagatg

SEQ ID NO: 121338 - DNA, 103 bp, Artificial Sequence
  Synthetic Polynucleotide
taatacgactcactatagggcgtaggcggcgggcggcgcggcggcgtaggaacagaggagacctacgatgccgcgccgcaacctggcggcagcgcaaaagatg

SEQ ID NO: 121339 - DNA, 103 bp, Artificial Sequence
  Synthetic Polynucleotide
taatacgactcactatagggcacggctggccgtaggcggcgggcggcgcgaacagaggagacgcgccatgcgccgcctaaacctggcggcagcgcaaaagatg

SEQ ID NO: 121340 - DNA, 103 bp, Artificial Sequence
  Synthetic Polynucleotide
taatacgactcactataggggccctgagcgcacggctggccgtaggcggcaacagaggagagccgccatgggccagccgaacctggcggcagcgcaaaagatg

SEQ ID NO: 121341 - DNA, 103 bp, Artificial Sequence
  Synthetic Polynucleotide
taatacgactcactatagggcggcctccaggccctgagcgcacggctggcaacagaggagagccagcatggcgctcaggaacctggcggcagcgcaaaagatg

SEQ ID NO: 121342 - DNA, 103 bp, Artificial Sequence
  Synthetic Polynucleotide
taatacgactcactatagggccggcggccccggcctccaggccctgagcgaacagaggagacgctcaatgcctggaggcaacctggcggcagcgcaaaagatg

SEQ ID NO: 121343 - DNA, 103 bp, Artificial Sequence
  Synthetic Polynucleotide
taatacgactcactatagggctggtagcccccggcggccccggcctccagaacagaggagactggagatgggggccgccaacctggcggcagcgcaaaagatg

SEQ ID NO: 121344 - DNA, 103 bp, Artificial Sequence
  Synthetic Polynucleotide
taatacgactcactataggggcatgctgcactggtagcccccggcggcccaacagaggagagggccgatgggggctaccaacctggcggcagcgcaaaagatg

SEQ ID NO: 121345 - DNA, 103 bp, Artificial Sequence
  Synthetic Polynucleotide
taatacgactcactatagggctcatcgctcgcatgctgcactggtagcccaacagaggagagggctaatggtgcagcataacctggcggcagcgcaaaagatg

SEQ ID NO: 121346 - DNA, 103 bp, Artificial Sequence
  Synthetic Polynucleotide
taatacgactcactatagggggcatcggacatctcagtgctcagggtcataacagaggagaatgaccatgagcactgagaacctggcggcagcgcaaaagatg

SEQ ID NO: 121347 - DNA, 103 bp, Artificial Sequence
  Synthetic Polynucleotide
taatacgactcactataggggccgccctcgtcgtcgtcctcctcttcctcaacagaggagagaggaaatggaggacgacaacctggcggcagcgcaaaagatg

SEQ ID NO: 121348 - DNA, 103 bp, Artificial Sequence
  Synthetic Polynucleotide
taatacgactcactataggggccgggtagggcggcgccgagcgggtgcggaacagaggagaccgcacatgctcggcgccaacctggcggcagcgcaaaagatg

SEQ ID NO: 121349 - DNA, 103 bp, Artificial Sequence
  Synthetic Polynucleotide
taatacgactcactatagggccggcagggggccgggtagggcggcgccgaaacagaggagatcggcgatgccctacccgaacctggcggcagcgcaaaagatg

SEQ ID NO: 121350 - DNA, 103 bp, Artificial Sequence
  Synthetic Polynucleotide
taatacgactcactataggggccgcggaggccggcagggggccgggtaggaacagaggagacctaccatgccccctgccaacctggcggcagcgcaaaagatg

SEQ ID NO: 121351 - DNA, 103 bp, Artificial Sequence
  Synthetic Polynucleotide
taatacgactcactataggggcccgccttggccgcggaggccggcaggggaacagaggagacccctgatggcctccgcgaacctggcggcagcgcaaaagatg

SEQ ID NO: 121352 - DNA, 103 bp, Artificial Sequence
  Synthetic Polynucleotide
taatacgactcactatagggcgcccgggccgcccgccttggccgcggaggaacagaggagacctccgatgccaaggcggaacctggcggcagcgcaaaagatg

SEQ ID NO: 121353 - DNA, 103 bp, Artificial Sequence
  Synthetic Polynucleotide
taatacgactcactatagggagcgctgaggcgcccgggccgcccgccttgaacagaggagacaaggcatgcggcccgggaacctggcggcagcgcaaaagatg

SEQ ID NO: 121354 - DNA, 103 bp, Artificial Sequence
  Synthetic Polynucleotide
taatacgactcactatagggcgagcgcgccagcgctgaggcgcccgggccaacagaggagaggcccgatggcctcagcgaacctggcggcagcgcaaaagatg

SEQ ID NO: 121355 - DNA, 103 bp, Artificial Sequence
  Synthetic Polynucleotide
taatacgactcactatagggtggagaagggcgagcgcgccagcgctgaggaacagaggagacctcagatgtggcgcgctaacctggcggcagcgcaaaagatg

SEQ ID NO: 121356 - DNA, 103 bp, Artificial Sequence
  Synthetic Polynucleotide
taatacgactcactatagggatgctctcgatggagaagggcgagcgcgccaacagaggagaggcgcgatggcccttctcaacctggcggcagcgcaaaagatg

SEQ ID NO: 121357 - DNA, 103 bp, Artificial Sequence
  Synthetic Polynucleotide
taatacgactcactataggggcccccgatgatgctctcgatggagaagggaacagaggagacccttcatgatcgagagcaacctggcggcagcgcaaaagatg

SEQ ID NO: 121358 - DNA, 103 bp, Artificial Sequence
  Synthetic Polynucleotide
taatacgactcactataggggcccgccaccgccgccctcgtcgtcgtcctaacagaggagaaggacgatgacgagggcgaacctggcggcagcgcaaaagatg

SEQ ID NO: 121359 - DNA, 103 bp, Artificial Sequence
  Synthetic Polynucleotide
taatacgactcactatagggggcccaagctgcccccgatgatgctctcgaaacagaggagatcgagaatgtcatcggggaacctggcggcagcgcaaaagatg

SEQ ID NO: 121360 - DNA, 103 bp, Artificial Sequence
  Synthetic Polynucleotide
taatacgactcactataggggcggcggccgggcccaagctgcccccgatgaacagaggagacatcggatgcagcttgggaacctggcggcagcgcaaaagatg

SEQ ID NO: 121361 - DNA, 103 bp, Artificial Sequence
  Synthetic Polynucleotide
taatacgactcactatagggggcggcggcagcggcggccgggcccaagctaacagaggagaagcttgatgccggccgccaacctggcggcagcgcaaaagatg

SEQ ID NO: 121362 - DNA, 103 bp, Artificial Sequence
  Synthetic Polynucleotide
taatacgactcactatagggcctgcgcggcggcggcggcagcggcggccgaacagaggagacggccgatgctgccgccgaacctggcggcagcgcaaaagatg

SEQ ID NO: 121363 - DNA, 103 bp, Artificial Sequence
  Synthetic Polynucleotide
taatacgactcactataggggcggcggcggcctgcgcggcggcggcggcaaacagaggagatgccgcatgcgccgcgcaaacctggcggcagcgcaaaagatg

SEQ ID NO: 121364 - DNA, 103 bp, Artificial Sequence
  Synthetic Polynucleotide
taatacgactcactatagggggcctgagcggcggcggcggcctgcgcggcaacagaggagagccgcgatggccgccgccaacctggcggcagcgcaaaagatg

SEQ ID NO: 121365 - DNA, 103 bp, Artificial Sequence
  Synthetic Polynucleotide
taatacgactcactataggggcgagggcgaggcctgagcggcggcggcggaacagaggagaccgccgatgccgctcaggaacctggcggcagcgcaaaagatg

SEQ ID NO: 121366 - DNA, 103 bp, Artificial Sequence
  Synthetic Polynucleotide
taatacgactcactatagggaccggcgagggcgagggcgaggcctgagcgaacagaggagacgctcaatgctcgccctcaacctggcggcagcgcaaaagatg

SEQ ID NO: 121367 - DNA, 103 bp, Artificial Sequence
  Synthetic Polynucleotide
taatacgactcactatagggcggcgccgccaccggcgagggcgagggcgaaacagaggagatcgcccatgccctcgccgaacctggcggcagcgcaaaagatg

SEQ ID NO: 121368 - DNA, 103 bp, Artificial Sequence
  Synthetic Polynucleotide
taatacgactcactatagggcgggagctggcggcgccgccaccggcgaggaacagaggagacctcgcatgtggcggcgcaacctggcggcagcgcaaaagatg

SEQ ID NO: 121369 - DNA, 103 bp, Artificial Sequence
  Synthetic Polynucleotide
taatacgactcactataggggccagccggggcccgccaccgccgccctcgaacagaggagacgagggatgcggtggcggaacctggcggcagcgcaaaagatg

SEQ ID NO: 121370 - DNA, 103 bp, Artificial Sequence
  Synthetic Polynucleotide
taatacgactcactatagggccgctggatccgggagctggcggcgccgccaacagaggagaggcggcatggccagctccaacctggcggcagcgcaaaagatg

SEQ ID NO: 121371 - DNA, 103 bp, Artificial Sequence
  Synthetic Polynucleotide
taatacgactcactataggggcagcctcctccgctggatccgggagctggaacagaggagaccagctatgggatccagcaacctggcggcagcgcaaaagatg

SEQ ID NO: 121372 - DNA, 103 bp, Artificial Sequence
  Synthetic Polynucleotide
taatacgactcactatagggcctgcgccgcgcagcctcctccgctggatcaacagaggagagatccaatggaggaggctaacctggcggcagcgcaaaagatg

SEQ ID NO: 121373 - DNA, 103 bp, Artificial Sequence
  Synthetic Polynucleotide
taatacgactcactatagggcccacggccgcctgcgccgcgcagcctcctaacagaggagaaggaggatgcgcggcgcaaacctggcggcagcgcaaaagatg

SEQ ID NO: 121374 - DNA, 103 bp, Artificial Sequence
  Synthetic Polynucleotide
taatacgactcactatagggggccgccgggcccacggccgcctgcgccgcaacagaggagagcggcgatggcggccgtgaacctggcggcagcgcaaaagatg

SEQ ID NO: 121375 - DNA, 103 bp, Artificial Sequence
  Synthetic Polynucleotide
taatacgactcactataggggggtgagcgcggccgccgggcccacggccgaacagaggagacggccgatggcccggcggaacctggcggcagcgcaaaagatg

SEQ ID NO: 121376 - DNA, 103 bp, Artificial Sequence
  Synthetic Polynucleotide
taatacgactcactatagggacgagggatcgggtgagcgcggccgccgggaacagaggagacccggcatgcgcgctcacaacctggcggcagcgcaaaagatg

SEQ ID NO: 121377 - DNA, 103 bp, Artificial Sequence
  Synthetic Polynucleotide
taatacgactcactatagggcgcggcggccacgagggatcgggtgagcgcaacagaggagagcgctcatgcgatccctcaacctggcggcagcgcaaaagatg

SEQ ID NO: 121378 - DNA, 103 bp, Artificial Sequence
  Synthetic Polynucleotide
taatacgactcactatagggcggcggcggccgcggcggccacgagggatcaacagaggagagatcccatgtggccgccgaacctggcggcagcgcaaaagatg

SEQ ID NO: 121379 - DNA, 103 bp, Artificial Sequence
  Synthetic Polynucleotide
taatacgactcactatagggactgaggaggcggcggcggccgcggcggccaacagaggagaggccgcatgggccgccgcaacctggcggcagcgcaaaagatg

SEQ ID NO: 121380 - DNA, 103 bp, Artificial Sequence
  Synthetic Polynucleotide
taatacgactcactatagggcgcggggacagccagccggggcccgccaccaacagaggagaggtggcatgccccggctgaacctggcggcagcgcaaaagatg

SEQ ID NO: 121381 - DNA, 103 bp, Artificial Sequence
  Synthetic Polynucleotide
taatacgactcactatagggggacgaggagactgaggaggcggcggcggcaacagaggagagccgccatggcctcctcaaacctggcggcagcgcaaaagatg

SEQ ID NO: 121382 - DNA, 103 bp, Artificial Sequence
  Synthetic Polynucleotide
taatacgactcactatagggccaaggcggcggacgaggagactgaggaggaacagaggagacctcctatgtctcctcgtaacctggcggcagcgcaaaagatg

SEQ ID NO: 121383 - DNA, 103 bp, Artificial Sequence
  Synthetic Polynucleotide
taatacgactcactatagggtgcagagtccccaaggcggcggacgaggagaacagaggagactcctcatgcgccgccttaacctggcggcagcgcaaaagatg

SEQ ID NO: 121384 - DNA, 103 bp, Artificial Sequence
  Synthetic Polynucleotide
taatacgactcactatagggagtcccttggtgcagagtccccaaggcggcaacagaggagagccgccatggggactctgaacctggcggcagcgcaaaagatg

SEQ ID NO: 121385 - DNA, 103 bp, Artificial Sequence
  Synthetic Polynucleotide
taatacgactcactatagggtggacagggcagtcccttggtgcagagtccaacagaggagaggactcatgaccaagggaaacctggcggcagcgcaaaagatg

SEQ ID NO: 121386 - DNA, 103 bp, Artificial Sequence
  Synthetic Polynucleotide
taatacgactcactatagggttctcgacactggacagggcagtcccttggaacagaggagaccaaggatgtgccctgtcaacctggcggcagcgcaaaagatg

SEQ ID NO: 121387 - DNA, 103 bp, Artificial Sequence
  Synthetic Polynucleotide
taatacgactcactatagggagcagtaaagttctcgacactggacagggcaacagaggagagccctgatgagtgtcgagaacctggcggcagcgcaaaagatg

SEQ ID NO: 121388 - DNA, 103 bp, Artificial Sequence
  Synthetic Polynucleotide
taatacgactcactatagggtggaaatcctagcagtaaagttctcgacacaacagaggagagtgtcgatgactttactgaacctggcggcagcgcaaaagatg

SEQ ID NO: 121389 - DNA, 103 bp, Artificial Sequence
  Synthetic Polynucleotide
taatacgactcactataggggccgccgctgcgcggggacagccagccgggaacagaggagacccggcatgctgtccccgaacctggcggcagcgcaaaagatg

SEQ ID NO: 121390 - DNA, 103 bp, Artificial Sequence
  Synthetic Polynucleotide
taatacgactcactatagggcgccgccgccgccgccgctgcgcggggacaaacagaggagatgtcccatggcagcggcgaacctggcggcagcgcaaaagatg

SEQ ID NO: 121391 - DNA, 103 bp, Artificial Sequence
  Synthetic Polynucleotide
taatacgactcactatagggggcgtacgagcgccgccgccgccgccgctgaacagaggagacagcggatgcggcggcggaacctggcggcagcgcaaaagatg

SEQ ID NO: 121392 - DNA, 103 bp, Artificial Sequence
  Synthetic Polynucleotide
taatacgactcactatagggcgtcctccccggcgtacgagcgccgccgccaacagaggagaggcggcatggctcgtacgaacctggcggcagcgcaaaagatg

SEQ ID NO: 121393 - DNA, 103 bp, Artificial Sequence
  Synthetic Polynucleotide
taatacgactcactatagggtcctccagctcgtcctccccggcgtacgagaacagaggagactcgtaatgcggggaggaaacctggcggcagcgcaaaagatg

SEQ ID NO: 121394 - DNA, 103 bp, Artificial Sequence
  Synthetic Polynucleotide
taatacgactcactatagggctcctccagatcctccagctcgtcctccccaacagaggagaggggagatggagctggagaacctggcggcagcgcaaaagatg

SEQ ID NO: 121395 - DNA, 103 bp, Artificial Sequence
  Synthetic Polynucleotide
taatacgactcactatagggcgaggccagaggcatcggacatctcagtgcaacagaggagagcactgatgtgtccgatgaacctggcggcagcgcaaaagatg

SEQ ID NO: 121396 - DNA, 103 bp, Artificial Sequence
  Synthetic Polynucleotide
taatacgactcactatagggcgtcctcctcctcctccagatcctccagctaacagaggagaagctggatgatctggaggaacctggcggcagcgcaaaagatg

SEQ ID NO: 121397 - DNA, 103 bp, Artificial Sequence
  Synthetic Polynucleotide
taatacgactcactatagggatgtcatcgtcgtcctcctcctcctccagaaacagaggagatctggaatgggaggaggaaacctggcggcagcgcaaaagatg

SEQ ID NO: 121398 - DNA, 103 bp, Artificial Sequence
  Synthetic Polynucleotide
taatacgactcactatagggggccagcaggatgtcatcgtcgtcctcctcaacagaggagagaggagatggacgatgacaacctggcggcagcgcaaaagatg

SEQ ID NO: 121399 - DNA, 103 bp, Artificial Sequence
  Synthetic Polynucleotide
taatacgactcactatagggcagcaggcggggccagcaggatgtcatcgtaacagaggagaacgatgatgtcctgctggaacctggcggcagcgcaaaagatg

SEQ ID NO: 121400 - DNA, 103 bp, Artificial Sequence
  Synthetic Polynucleotide
taatacgactcactatagggggggagcccccagcaggcggggccagcaggaacagaggagacctgctatgcccgcctgcaacctggcggcagcgcaaaagatg

SEQ ID NO: 121401 - DNA, 103 bp, Artificial Sequence
  Synthetic Polynucleotide
taatacgactcactatagggcgggggcgccggggagcccccagcaggcggaacagaggagaccgcctatggggggctccaacctggcggcagcgcaaaagatg

SEQ ID NO: 121402 - DNA, 103 bp, Artificial Sequence
  Synthetic Polynucleotide
taatacgactcactataggggggccgggcccgggggcgccggggagccccaacagaggagaggggctatgcggcgccccaacctggcggcagcgcaaaagatg

SEQ ID NO: 121403 - DNA, 103 bp, Artificial Sequence
  Synthetic Polynucleotide
taatacgactcactatagggcccgccgccggggccgggcccgggggcgccaacagaggagaggcgccatggggcccggcaacctggcggcagcgcaaaagatg

SEQ ID NO: 121404 - DNA, 103 bp, Artificial Sequence
  Synthetic Polynucleotide
taatacgactcactatagggggctcctgcccccgccgccggggccgggccaacagaggagaggcccgatgccggcggcgaacctggcggcagcgcaaaagatg

SEQ ID NO: 121405 - DNA, 103 bp, Artificial Sequence
  Synthetic Polynucleotide
taatacgactcactatagggcgcccccaccggctcctgcccccgccgccgaacagaggagacggcggatggggcaggagaacctggcggcagcgcaaaagatg

SEQ ID NO: 121406 - DNA, 103 bp, Artificial Sequence
  Synthetic Polynucleotide
taatacgactcactataggggtttcctcggcgaggccagaggcatcggacaacagaggagagtccgaatgctctggcctaacctggcggcagcgcaaaagatg

SEQ ID NO: 121407 - DNA, 103 bp, Artificial Sequence
  Synthetic Polynucleotide
taatacgactcactatagggccgccgccgccgcccccaccggctcctgccaacagaggagaggcaggatgcggtgggggaacctggcggcagcgcaaaagatg

SEQ ID NO: 121408 - DNA, 103 bp, Artificial Sequence
  Synthetic Polynucleotide
taatacgactcactataggggcccgcgccgccgccgccgccgcccccaccaacagaggagaggtgggatgggcggcggcaacctggcggcagcgcaaaagatg

SEQ ID NO: 121409 - DNA, 103 bp, Artificial Sequence
  Synthetic Polynucleotide
taatacgactcactatagggtcccgccgccgcccgcgccgccgccgccgcaacagaggagagcggcgatggcggcgcggaacctggcggcagcgcaaaagatg

SEQ ID NO: 121410 - DNA, 103 bp, Artificial Sequence
  Synthetic Polynucleotide
taatacgactcactatagggctacccgcgctcccgccgccgcccgcgccgaacagaggagacggcgcatgcggcggcggaacctggcggcagcgcaaaagatg

SEQ ID NO: 121411 - DNA, 103 bp, Artificial Sequence
  Synthetic Polynucleotide
taatacgactcactatagggcttggcgccgctacccgcgctcccgccgccaacagaggagaggcggcatgagcgcgggtaacctggcggcagcgcaaaagatg

SEQ ID NO: 121412 - DNA, 103 bp, Artificial Sequence
  Synthetic Polynucleotide
taatacgactcactatagggccagcgggttcttggcgccgctacccgcgcaacagaggagagcgcggatggcggcgccaaacctggcggcagcgcaaaagatg

SEQ ID NO: 121413 - DNA, 103 bp, Artificial Sequence
  Synthetic Polynucleotide
taatacgactcactatagggggcggcttcaccagcgggttcttggcgccgaacagaggagacggcgcatggaacccgctaacctggcggcagcgcaaaagatg

SEQ ID NO: 121414 - DNA, 103 bp, Artificial Sequence
  Synthetic Polynucleotide
taatacgactcactatagggatacgagtagggcggcttcaccagcgggttaacagaggagaaacccgatggtgaagccgaacctggcggcagcgcaaaagatg

SEQ ID NO: 121415 - DNA, 103 bp, Artificial Sequence
  Synthetic Polynucleotide
taatacgactcactatagggtgagcgcgatatacgagtagggcggcttcaaacagaggagatgaagcatgcctactcgtaacctggcggcagcgcaaaagatg

SEQ ID NO: 121416 - DNA, 103 bp, Artificial Sequence
  Synthetic Polynucleotide
taatacgactcactataggggccatagtgatgagcgcgatatacgagtagaacagaggagactactcatgtatcgcgctaacctggcggcagcgcaaaagatg

SEQ ID NO: 121417 - DNA, 103 bp, Artificial Sequence
  Synthetic Polynucleotide
taatacgactcactataggggtcgatgtctgtttcctcggcgaggccagaaacagaggagatctggcatggccgaggaaaacctggcggcagcgcaaaagatg

SEQ ID NO: 121418 - DNA, 103 bp, Artificial Sequence
  Synthetic Polynucleotide
taatacgactcactatagggctgcaggatggccatagtgatgagcgcgataacagaggagaatcgcgatgatcactatgaacctggcggcagcgcaaaagatg

SEQ ID NO: 121419 - DNA, 103 bp, Artificial Sequence
  Synthetic Polynucleotide
taatacgactcactatagggtcttggggctctgcaggatggccatagtgaaacagaggagatcactaatgccatcctgcaacctggcggcagcgcaaaagatg

SEQ ID NO: 121420 - DNA, 103 bp, Artificial Sequence
  Synthetic Polynucleotide
taatacgactcactataggggtcagccgcttcttggggctctgcaggatgaacagaggagacatcctatggagccccaaaacctggcggcagcgcaaaagatg

SEQ ID NO: 121421 - DNA, 103 bp, Artificial Sequence
  Synthetic Polynucleotide
taatacgactcactatagggctcgctcagcgtcagccgcttcttggggctaacagaggagaagccccatgaagcggctgaacctggcggcagcgcaaaagatg

SEQ ID NO: 121422 - DNA, 103 bp, Artificial Sequence
  Synthetic Polynucleotide
taatacgactcactatagggactcacagatctcgctcagcgtcagccgctaacagaggagaagcggcatgcgctgagcgaacctggcggcagcgcaaaagatg

SEQ ID NO: 121423 - DNA, 103 bp, Artificial Sequence
  Synthetic Polynucleotide
taatacgactcactatagggccgctgatgaactcacagatctcgctcagcaacagaggagagctgagatggatctgtgaaacctggcggcagcgcaaaagatg

SEQ ID NO: 121424 - DNA, 103 bp, Artificial Sequence
  Synthetic Polynucleotide
taatacgactcactatagggggggaagcggccgctgatgaactcacagataacagaggagaatctgtatgttcatcagcaacctggcggcagcgcaaaagatg

SEQ ID NO: 121425 - DNA, 103 bp, Artificial Sequence
  Synthetic Polynucleotide
taatacgactcactatagggcccggtagtaggggaagcggccgctgatgaaacagaggagatcatcaatggccgcttccaacctggcggcagcgcaaaagatg

SEQ ID NO: 121426 - DNA, 103 bp, Artificial Sequence
  Synthetic Polynucleotide
taatacgactcactataggggggaacttctcccggtagtaggggaagcggaacagaggagaccgcttatgctactaccgaacctggcggcagcgcaaaagatg

SEQ ID NO: 121427 - DNA, 103 bp, Artificial Sequence
  Synthetic Polynucleotide
taatacgactcactatagggctgccaggcggggaacttctcccggtagtaaacagaggagatactacatggagaagttcaacctggcggcagcgcaaaagatg

SEQ ID NO: 121428 - DNA, 103 bp, Artificial Sequence
  Synthetic Polynucleotide
taatacgactcactatagggcccccaccacgtcgatgtctgtttcctcggaacagaggagaccgaggatgcagacatcgaacctggcggcagcgcaaaagatg

SEQ ID NO: 121429 - DNA, 103 bp, Artificial Sequence
  Synthetic Polynucleotide
taatacgactcactatagggggatgctgttctgccaggcggggaacttctaacagaggagaagaagtatgccgcctggcaacctggcggcagcgcaaaagatg

SEQ ID NO: 121430 - DNA, 103 bp, Artificial Sequence
  Synthetic Polynucleotide
taatacgactcactatagggaggttgtggcggatgctgttctgccaggcgaacagaggagacgcctgatggaacagcataacctggcggcagcgcaaaagatg

SEQ ID NO: 121431 - DNA, 103 bp, Artificial Sequence
  Synthetic Polynucleotide
taatacgactcactataggggttgagcgagaggttgtggcggatgctgttaacagaggagaaacagcatgcgccacaacaacctggcggcagcgcaaaagatg

SEQ ID NO: 121432 - DNA, 103 bp, Artificial Sequence
  Synthetic Polynucleotide
taatacgactcactatagggcgaagcagtcgttgagcgagaggttgtggcaacagaggagagccacaatgtctcgctcaaacctggcggcagcgcaaaagatg

SEQ ID NO: 121433 - DNA, 103 bp, Artificial Sequence
  Synthetic Polynucleotide
taatacgactcactataggggggatcttgacgaagcagtcgttgagcgagaacagaggagactcgctatgcgactgcttaacctggcggcagcgcaaaagatg

SEQ ID NO: 121434 - DNA, 103 bp, Artificial Sequence
  Synthetic Polynucleotide
taatacgactcactataggggggctcgcgggggatcttgacgaagcagtcaacagaggagagactgcatggtcaagatcaacctggcggcagcgcaaaagatg

SEQ ID NO: 121435 - DNA, 103 bp, Artificial Sequence
  Synthetic Polynucleotide
taatacgactcactatagggccgggttgccgggctcgcgggggatcttgaaacagaggagatcaagaatgcccgcgagcaacctggcggcagcgcaaaagatg

SEQ ID NO: 121436 - DNA, 103 bp, Artificial Sequence
  Synthetic Polynucleotide
taatacgactcactatagggttgcccttgcccgggttgccgggctcgcggaacagaggagaccgcgaatgcggcaacccaacctggcggcagcgcaaaagatg

SEQ ID NO: 121437 - DNA, 103 bp, Artificial Sequence
  Synthetic Polynucleotide
taatacgactcactatagggcgtccagtagttgcccttgcccgggttgccaacagaggagaggcaacatgggcaagggcaacctggcggcagcgcaaaagatg

SEQ ID NO: 121438 - DNA, 103 bp, Artificial Sequence
  Synthetic Polynucleotide
taatacgactcactatagggccgggtccagcgtccagtagttgcccttgcaacagaggagagcaaggatgactactggaaacctggcggcagcgcaaaagatg

SEQ ID NO: 121439 - DNA, 103 bp, Artificial Sequence
  Synthetic Polynucleotide
taatacgactcactatagggtcctcgccctcccccaccacgtcgatgtctaacagaggagaagacatatgcgtggtgggaacctggcggcagcgcaaaagatg

SEQ ID NO: 121440 - DNA, 103 bp, Artificial Sequence
  Synthetic Polynucleotide
taatacgactcactatagggtcggcggactccgggtccagcgtccagtagaacagaggagactactgatggctggacccaacctggcggcagcgcaaaagatg

SEQ ID NO: 121441 - DNA, 103 bp, Artificial Sequence
  Synthetic Polynucleotide
taatacgactcactataggggtcgaacatgtcggcggactccgggtccagaacagaggagactggacatggagtccgccaacctggcggcagcgcaaaagatg

SEQ ID NO: 121442 - DNA, 103 bp, Artificial Sequence
  Synthetic Polynucleotide
taatacgactcactatagggagctgccgttgtcgaacatgtcggcggactaacagaggagaagtccgatgacatgttcgaacctggcggcagcgcaaaagatg

SEQ ID NO: 121443 - DNA, 103 bp, Artificial Sequence
  Synthetic Polynucleotide
taatacgactcactatagggcggcgcaggaagctgccgttgtcgaacatgaacagaggagacatgttatgcaacggcagaacctggcggcagcgcaaaagatg

SEQ ID NO: 121444 - DNA, 103 bp, Artificial Sequence
  Synthetic Polynucleotide
taatacgactcactataggggcgcttcctccggcgcaggaagctgccgttaacagaggagaaacggcatgttcctgcgcaacctggcggcagcgcaaaagatg

SEQ ID NO: 121445 - DNA, 103 bp, Artificial Sequence
  Synthetic Polynucleotide
taatacgactcactataggggccgcttgaagcgcttcctccggcgcaggaaacagaggagatcctgcatgggaggaagcaacctggcggcagcgcaaaagatg

SEQ ID NO: 121446 - DNA, 103 bp, Artificial Sequence
  Synthetic Polynucleotide
taatacgactcactatagggagcagcggctgccgcttgaagcgcttcctcaacagaggagagaggaaatgcttcaagcgaacctggcggcagcgcaaaagatg

SEQ ID NO: 121447 - DNA, 103 bp, Artificial Sequence
  Synthetic Polynucleotide
taatacgactcactataggggttgggtgggagcagcggctgccgcttgaaaacagaggagattcaagatgcagccgctgaacctggcggcagcgcaaaagatg

SEQ ID NO: 121448 - DNA, 103 bp, Artificial Sequence
  Synthetic Polynucleotide
taatacgactcactatagggcggccgcggcgttgggtgggagcagcggctaacagaggagaagccgcatgtcccacccaaacctggcggcagcgcaaaagatg

SEQ ID NO: 121449 - DNA, 103 bp, Artificial Sequence
  Synthetic Polynucleotide
taatacgactcactatagggagagactcggcggccgcggcgttgggtgggaacagaggagacccaccatgcgccgcggcaacctggcggcagcgcaaaagatg

SEQ ID NO: 121450 - DNA, 103 bp, Artificial Sequence
  Synthetic Polynucleotide
taatacgactcactataggggtcttcttcgtcctcgccctcccccaccacaacagaggagagtggtgatggagggcgagaacctggcggcagcgcaaaagatg

SEQ ID NO: 121451 - DNA, 103 bp, Artificial Sequence
  Synthetic Polynucleotide
taatacgactcactataggggcgcagcagcagagactcggcggccgcggcaacagaggagagccgcgatggccgagtctaacctggcggcagcgcaaaagatg

SEQ ID NO: 121452 - DNA, 103 bp, Artificial Sequence
  Synthetic Polynucleotide
taatacgactcactatagggctcccgcgccgcgcagcagcagagactcggaacagaggagaccgagtatgtgctgctgcaacctggcggcagcgcaaaagatg

SEQ ID NO: 121453 - DNA, 103 bp, Artificial Sequence
  Synthetic Polynucleotide
taatacgactcactatagggccccctgcggctcccgcgccgcgcagcagcaacagaggagagctgctatgcggcgcgggaacctggcggcagcgcaaaagatg

SEQ ID NO: 121454 - DNA, 103 bp, Artificial Sequence
  Synthetic Polynucleotide
taatacgactcactataggggtcgcccgcgccccctgcggctcccgcgccaacagaggagaggcgcgatggccgcagggaacctggcggcagcgcaaaagatg

SEQ ID NO: 121455 - DNA, 103 bp, Artificial Sequence
  Synthetic Polynucleotide
taatacgactcactatagggcggctgccgggtcgcccgcgccccctgcggaacagaggagaccgcagatggcgcgggcgaacctggcggcagcgcaaaagatg

SEQ ID NO: 121456 - DNA, 103 bp, Artificial Sequence
  Synthetic Polynucleotide
taatacgactcactatagggagcgcggcggcggctgccgggtcgcccgcgaacagaggagacgcgggatgcccggcagcaacctggcggcagcgcaaaagatg

SEQ ID NO: 121457 - DNA, 103 bp, Artificial Sequence
  Synthetic Polynucleotide
taatacgactcactataggggggcgggaagagcgcggcggcggctgccggaacagaggagaccggcaatggccgccgcgaacctggcggcagcgcaaaagatg

SEQ ID NO: 121458 - DNA, 103 bp, Artificial Sequence
  Synthetic Polynucleotide
taatacgactcactataggggcgggggcgcgggcgggaagagcgcggcggaacagaggagaccgccgatgtcttcccgcaacctggcggcagcgcaaaagatg

SEQ ID NO: 121459 - DNA, 103 bp, Artificial Sequence
  Synthetic Polynucleotide
taatacgactcactatagggtgcgggggcggcgggggcgcgggcgggaagaacagaggagacttcccatgcgcgcccccaacctggcggcagcgcaaaagatg

SEQ ID NO: 121460 - DNA, 103 bp, Artificial Sequence
  Synthetic Polynucleotide
taatacgactcactataggggccgtaggcatgcgggggcggcgggggcgcaacagaggagagcgcccatgccgcccccgaacctggcggcagcgcaaaagatg

SEQ ID NO: 121461 - DNA, 103 bp, Artificial Sequence
  Synthetic Polynucleotide
taatacgactcactatagggcctcttcctcgtcttcttcgtcctcgccctaacagaggagaagggcgatgacgaagaagaacctggcggcagcgcaaaagatg

SEQ ID NO: 121462 - DNA, 103 bp, Artificial Sequence
  Synthetic Polynucleotide
taatacgactcactatagggaggggccgtagccgtaggcatgcgggggcgaacagaggagacgccccatgatgcctacgaacctggcggcagcgcaaaagatg

SEQ ID NO: 121463 - DNA, 103 bp, Artificial Sequence
  Synthetic Polynucleotide
taatacgactcactatagggccgcagccgtaggggccgtagccgtaggcaaacagaggagatgcctaatgctacggcccaacctggcggcagcgcaaaagatg

SEQ ID NO: 121464 - DNA, 103 bp, Artificial Sequence
  Synthetic Polynucleotide
taatacgactcactatagggcaggccgtagccgcagccgtaggggccgtaaacagaggagatacggcatgtacggctgcaacctggcggcagcgcaaaagatg

SEQ ID NO: 121465 - DNA, 103 bp, Artificial Sequence
  Synthetic Polynucleotide
taatacgactcactataggggcggcagctgcaggccgtagccgcagccgtaacagaggagaacggctatggctacggccaacctggcggcagcgcaaaagatg

SEQ ID NO: 121466 - DNA, 103 bp, Artificial Sequence
  Synthetic Polynucleotide
taatacgactcactatagggggcgcgtaaggcggcagctgcaggccgtagaacagaggagactacggatggcagctgccaacctggcggcagcgcaaaagatg

SEQ ID NO: 121467 - DNA, 103 bp, Artificial Sequence
  Synthetic Polynucleotide
taatacgactcactatagggggccgagggcggcgcgtaaggcggcagctgaacagaggagacagctgatgccttacgcgaacctggcggcagcgcaaaagatg

SEQ ID NO: 121468 - DNA, 103 bp, Artificial Sequence
  Synthetic Polynucleotide
taatacgactcactatagggcggcgaagagggccgagggcggcgcgtaagaacagaggagacttacgatgcgccctcggaacctggcggcagcgcaaaagatg

SEQ ID NO: 121469 - DNA, 103 bp, Artificial Sequence
  Synthetic Polynucleotide
taatacgactcactataggggccgctgcggcggcgaagagggccgagggcaacagaggagagccctcatgcctcttcgcaacctggcggcagcgcaaaagatg

SEQ ID NO: 121470 - DNA, 103 bp, Artificial Sequence
  Synthetic Polynucleotide
taatacgactcactatagggggcggcggcggccgctgcggcggcgaagagaacagaggagactcttcatggccgcagcgaacctggcggcagcgcaaaagatg

SEQ ID NO: 121471 - DNA, 103 bp, Artificial Sequence
  Synthetic Polynucleotide
taatacgactcactatagggaggcggcggcggcggcggcggccgctgcggaacagaggagaccgcagatgccgccgccgaacctggcggcagcgcaaaagatg

SEQ ID NO: 121472 - DNA, 103 bp, Artificial Sequence
  Synthetic Polynucleotide
taatacgactcactatagggtcgtcgtcctcctcttcctcgtcttcttcgaacagaggagacgaagaatgcgaggaagaaacctggcggcagcgcaaaagatg

SEQ ID NO: 121473 - DNA, 103 bp, Artificial Sequence
  Synthetic Polynucleotide
taatacgactcactatagggtgcgggtggaaggcggcggcggcggcggcgaacagaggagacgccgcatgcgccgccgcaacctggcggcagcgcaaaagatg

SEQ ID NO: 121474 - DNA, 103 bp, Artificial Sequence
  Synthetic Polynucleotide
taatacgactcactatagggcgggggcgagtgcgggtggaaggcggcggcaacagaggagagccgccatgttccacccgaacctggcggcagcgcaaaagatg

SEQ ID NO: 121475 - DNA, 103 bp, Artificial Sequence
  Synthetic Polynucleotide
taatacgactcactataggggcgggggcggcgggggcgagtgcgggtggaaacagaggagatccaccatgactcgccccaacctggcggcagcgcaaaagatg

SEQ ID NO: 121476 - DNA, 103 bp, Artificial Sequence
  Synthetic Polynucleotide
taatacgactcactatagggccgtgcggtggcgggggcggcgggggcgagaacagaggagactcgccatggccgcccccaacctggcggcagcgcaaaagatg

SEQ ID NO: 121477 - DNA, 103 bp, Artificial Sequence
  Synthetic Polynucleotide
taatacgactcactatagggggcggccgcgccgtgcggtggcgggggcggaacagaggagaccgcccatgccaccgcacaacctggcggcagcgcaaaagatg

SEQ ID NO: 121478 - DNA, 103 bp, Artificial Sequence
  Synthetic Polynucleotide
taatacgactcactataggggggccagctcggcggccgcgccgtgcggtgaacagaggagacaccgcatggcgcggccgaacctggcggcagcgcaaaagatg

SEQ ID NO: 121479 - DNA, 103 bp, Artificial Sequence
  Synthetic Polynucleotide
taatacgactcactatagggaaggcggtccgggccagctcggcggccgcgaacagaggagacgcggcatgcgagctggcaacctggcggcagcgcaaaagatg

SEQ ID NO: 121480 - DNA, 103 bp, Artificial Sequence
  Synthetic Polynucleotide
taatacgactcactatagggccggtagccgaaggcggtccgggccagctcaacagaggagagagctgatgcggaccgccaacctggcggcagcgcaaaagatg

SEQ ID NO: 121481 - DNA, 103 bp, Artificial Sequence
  Synthetic Polynucleotide
taatacgactcactataggggcgggtgcggccggtagccgaaggcggtccaacagaggagaggaccgatgtcggctaccaacctggcggcagcgcaaaagatg

SEQ ID NO: 121482 - DNA, 103 bp, Artificial Sequence
  Synthetic Polynucleotide
taatacgactcactataggggcggcgccgagcgggtgcggccggtagccgaacagaggagacggctaatggccgcacccaacctggcggcagcgcaaaagatg

SEQ ID NO: 121483 - DNA, 103 bp, Artificial Sequence
  Synthetic Polynucleotide
taatacgactcactataggggctggcgctgccgccgccggagagggtcataacagaggagaatgaccatgtccggcggcaacctggcggcagcgcaaaagatg

SEQ ID NO: 121484 - DNA, 103 bp, Artificial Sequence
  Synthetic Polynucleotide
taatacgactcactataggggctgtccttctcttccagcccgtcgtcgccaacagaggagaggcgacatggggctggaaaacctggcggcagcgcaaaagatg

SEQ ID NO: 121485 - DNA, 103 bp, Artificial Sequence
  Synthetic Polynucleotide
taatacgactcactataggggcccgggccgagctgtgagccgaaggcggcaacagaggagagccgccatgggctcacagaacctggcggcagcgcaaaagatg

SEQ ID NO: 121486 - DNA, 103 bp, Artificial Sequence
  Synthetic Polynucleotide
taatacgactcactataggggcagctgcaggcccgggccgagctgtgagcaacagaggagagctcacatgtcggcccggaacctggcggcagcgcaaaagatg

SEQ ID NO: 121487 - DNA, 103 bp, Artificial Sequence
  Synthetic Polynucleotide
taatacgactcactatagggctattgagctgcagctgcaggcccgggccgaacagaggagacggcccatgcctgcagctaacctggcggcagcgcaaaagatg

SEQ ID NO: 121488 - DNA, 103 bp, Artificial Sequence
  Synthetic Polynucleotide
taatacgactcactatagggggcgcccaggctattgagctgcagctgcagaacagaggagactgcagatgcagctcaataacctggcggcagcgcaaaagatg

SEQ ID NO: 121489 - DNA, 103 bp, Artificial Sequence
  Synthetic Polynucleotide
taatacgactcactatagggcggccgcggcggcgcccaggctattgagctaacagaggagaagctcaatggcctgggcgaacctggcggcagcgcaaaagatg

SEQ ID NO: 121490 - DNA, 103 bp, Artificial Sequence
  Synthetic Polynucleotide
taatacgactcactataggggtgcccgcagcggccgcggcggcgcccaggaacagaggagacctgggatgcgccgcggcaacctggcggcagcgcaaaagatg

SEQ ID NO: 121491 - DNA, 103 bp, Artificial Sequence
  Synthetic Polynucleotide
taatacgactcactatagggggcgcccgctgtgcccgcagcggccgcggcaacagaggagagccgcgatggctgcgggcaacctggcggcagcgcaaaagatg

SEQ ID NO: 121492 - DNA, 103 bp, Artificial Sequence
  Synthetic Polynucleotide
taatacgactcactatagggtggtgcccgcggcgcccgctgtgcccgcagaacagaggagactgcggatgcagcgggcgaacctggcggcagcgcaaaagatg

SEQ ID NO: 121493 - DNA, 103 bp, Artificial Sequence
  Synthetic Polynucleotide
taatacgactcactatagggagcgacgcggtggtgcccgcggcgcccgctaacagaggagaagcgggatgcgcgggcacaacctggcggcagcgcaaaagatg

SEQ ID NO: 121494 - DNA, 103 bp, Artificial Sequence
  Synthetic Polynucleotide
taatacgactcactatagggggacttgatgagcgacgcggtggtgcccgcaacagaggagagcgggcatgaccgcgtcgaacctggcggcagcgcaaaagatg

SEQ ID NO: 121495 - DNA, 103 bp, Artificial Sequence
  Synthetic Polynucleotide
taatacgactcactatagggaacctgcgtcgctgtccttctcttccagccaacagaggagaggctggatgagaaggacaaacctggcggcagcgcaaaagatg

SEQ ID NO: 121496 - DNA, 103 bp, Artificial Sequence
  Synthetic Polynucleotide
taatacgactcactatagggcgcttggctcggacttgatgagcgacgcggaacagaggagaccgcgtatgtcatcaagtaacctggcggcagcgcaaaagatg

SEQ ID NO: 121497 - DNA, 103 bp, Artificial Sequence
  Synthetic Polynucleotide
taatacgactcactataggggacggccgcgcgcttggctcggacttgatgaacagaggagacatcaaatgcgagccaagaacctggcggcagcgcaaaagatg

SEQ ID NO: 121498 - DNA, 103 bp, Artificial Sequence
  Synthetic Polynucleotide
taatacgactcactataggggatgctgaacgacggccgcgcgcttggctcaacagaggagagagccaatggcgcggccgaacctggcggcagcgcaaaagatg

SEQ ID NO: 121499 - DNA, 103 bp, Artificial Sequence
  Synthetic Polynucleotide
taatacgactcactatagggtgatgttctcgatgctgaacgacggccgcgaacagaggagacgcggcatgcgttcagcaaacctggcggcagcgcaaaagatg

SEQ ID NO: 121500 - DNA, 103 bp, Artificial Sequence
  Synthetic Polynucleotide
taatacgactcactatagggcccccacctatgatgttctcgatgctgaacaacagaggagagttcagatgcgagaacataacctggcggcagcgcaaaagatg

SEQ ID NO: 121501 - DNA, 103 bp, Artificial Sequence
  Synthetic Polynucleotide
taatacgactcactatagggagccgcggggcccccacctatgatgttctcaacagaggagagagaacatgataggtgggaacctggcggcagcgcaaaagatg

SEQ ID NO: 121502 - DNA, 103 bp, Artificial Sequence
  Synthetic Polynucleotide
taatacgactcactatagggagcccccaggagccgcggggcccccacctaaacagaggagataggtgatggccccgcggaacctggcggcagcgcaaaagatg

SEQ ID NO: 121503 - DNA, 103 bp, Artificial Sequence
  Synthetic Polynucleotide
taatacgactcactatagggcccaccgccgagcccccaggagccgcggggaacagaggagaccccgcatgtcctgggggaacctggcggcagcgcaaaagatg

SEQ ID NO: 121504 - DNA, 103 bp, Artificial Sequence
  Synthetic Polynucleotide
taatacgactcactataggggaccccagcgcccaccgccgagcccccaggaacagaggagacctgggatgtcggcggtgaacctggcggcagcgcaaaagatg

SEQ ID NO: 121505 - DNA, 103 bp, Artificial Sequence
  Synthetic Polynucleotide
taatacgactcactatagggtgccgccggcgaccccagcgcccaccgccgaacagaggagacggcggatggcgctggggaacctggcggcagcgcaaaagatg

SEQ ID NO: 121506 - DNA, 103 bp, Artificial Sequence
  Synthetic Polynucleotide
taatacgactcactataggggggctatcgcaacctgcgtcgctgtccttcaacagaggagagaaggaatgcgacgcaggaacctggcggcagcgcaaaagatg

SEQ ID NO: 121507 - DNA, 103 bp, Artificial Sequence
  Synthetic Polynucleotide
taatacgactcactataggggaacccccagtgccgccggcgaccccagcgaacagaggagacgctggatgcgccggcggaacctggcggcagcgcaaaagatg

SEQ ID NO: 121508 - DNA, 103 bp, Artificial Sequence
  Synthetic Polynucleotide
taatacgactcactataggggccgccccctgaacccccagtgccgccggcaacagaggagagccggcatgactgggggtaacctggcggcagcgcaaaagatg

SEQ ID NO: 121509 - DNA, 103 bp, Artificial Sequence
  Synthetic Polynucleotide
taatacgactcactataggggcgccgtgctgccgccccctgaacccccagaacagaggagactggggatgcagggggcgaacctggcggcagcgcaaaagatg

SEQ ID NO: 121510 - DNA, 103 bp, Artificial Sequence
  Synthetic Polynucleotide
taatacgactcactatagggagaaacgactgcgccgtgctgccgccccctaacagaggagaagggggatgcagcacggcaacctggcggcagcgcaaaagatg

SEQ ID NO: 121511 - DNA, 103 bp, Artificial Sequence
  Synthetic Polynucleotide
taatacgactcactataggggggtggccgcagaaacgactgcgccgtgctaacagaggagaagcacgatgcagtcgtttaacctggcggcagcgcaaaagatg

SEQ ID NO: 121512 - DNA, 103 bp, Artificial Sequence
  Synthetic Polynucleotide
taatacgactcactataggggcacggtcccgggtggccgcagaaacgactaacagaggagaagtcgtatgtgcggccacaacctggcggcagcgcaaaagatg

SEQ ID NO: 121513 - DNA, 103 bp, Artificial Sequence
  Synthetic Polynucleotide
taatacgactcactataggggctgccgactgcacggtcccgggtggccgcaacagaggagagcggccatgcgggaccgtaacctggcggcagcgcaaaagatg

SEQ ID NO: 121514 - DNA, 103 bp, Artificial Sequence
  Synthetic Polynucleotide
taatacgactcactatagggggccatgagcgctgccgactgcacggtcccaacagaggagagggaccatgcagtcggcaaacctggcggcagcgcaaaagatg

SEQ ID NO: 121515 - DNA, 103 bp, Artificial Sequence
  Synthetic Polynucleotide
taatacgactcactataggggttggtgggtggccatgagcgctgccgactaacagaggagaagtcggatgcgctcatggaacctggcggcagcgcaaaagatg

SEQ ID NO: 121516 - DNA, 103 bp, Artificial Sequence
  Synthetic Polynucleotide
taatacgactcactatagggagcgacagcggttggtgggtggccatgagcaacagaggagagctcatatgcacccaccaaacctggcggcagcgcaaaagatg

SEQ ID NO: 121517 - DNA, 103 bp, Artificial Sequence
  Synthetic Polynucleotide
taatacgactcactatagggcggccccgcggggctatcgcaacctgcgtcaacagaggagagacgcaatgtgcgatagcaacctggcggcagcgcaaaagatg

SEQ ID NO: 121518 - DNA, 103 bp, Artificial Sequence
  Synthetic Polynucleotide
taatacgactcactatagggcgtccggctcagcgacagcggttggtgggtaacagaggagaacccacatgccgctgtcgaacctggcggcagcgcaaaagatg

SEQ ID NO: 121519 - DNA, 103 bp, Artificial Sequence
  Synthetic Polynucleotide
taatacgactcactatagggtggtggcagtcgtccggctcagcgacagcgaacagaggagacgctgtatgtgagccggaaacctggcggcagcgcaaaagatg

SEQ ID NO: 121520 - DNA, 103 bp, Artificial Sequence
  Synthetic Polynucleotide
taatacgactcactatagggatgggcgcgatggtggcagtcgtccggctcaacagaggagagagccgatggactgccacaacctggcggcagcgcaaaagatg

SEQ ID NO: 121521 - DNA, 103 bp, Artificial Sequence
  Synthetic Polynucleotide
taatacgactcactatagggcacgctaagaatgggcgcgatggtggcagtaacagaggagaactgccatgatcgcgcccaacctggcggcagcgcaaaagatg

SEQ ID NO: 121522 - DNA, 103 bp, Artificial Sequence
  Synthetic Polynucleotide
taatacgactcactatagggcggagagtggcacgctaagaatgggcgcgaaacagaggagatcgcgcatgttcttagcgaacctggcggcagcgcaaaagatg

SEQ ID NO: 121523 - DNA, 103 bp, Artificial Sequence
  Synthetic Polynucleotide
taatacgactcactatagggagaaactgtccggagagtggcacgctaagaaacagaggagatcttagatggccactctcaacctggcggcagcgcaaaagatg

SEQ ID NO: 121524 - DNA, 103 bp, Artificial Sequence
  Synthetic Polynucleotide
taatacgactcactatagggtgcgggctgcagaaactgtccggagagtggaacagaggagaccactcatgggacagtttaacctggcggcagcgcaaaagatg

SEQ ID NO: 121525 - DNA, 103 bp, Artificial Sequence
  Synthetic Polynucleotide
taatacgactcactatagggcggccgaggctgcgggctgcagaaactgtcaacagaggagagacagtatgtgcagcccgaacctggcggcagcgcaaaagatg

SEQ ID NO: 121526 - DNA, 103 bp, Artificial Sequence
  Synthetic Polynucleotide
taatacgactcactataggggcagcggcggcggccgaggctgcgggctgcaacagaggagagcagccatgagcctcggcaacctggcggcagcgcaaaagatg

SEQ ID NO: 121527 - DNA, 103 bp, Artificial Sequence
  Synthetic Polynucleotide
taatacgactcactatagggggcggccgcagcagcggcggcggccgaggcaacagaggagagcctcgatggccgccgctaacctggcggcagcgcaaaagatg

SEQ ID NO: 121528 - DNA, 103 bp, Artificial Sequence
  Synthetic Polynucleotide
taatacgactcactataggggcagctccggcggccccgcggggctatcgcaacagaggagagcgataatgccgcggggcaacctggcggcagcgcaaaagatg

SEQ ID NO: 121529 - DNA, 103 bp, Artificial Sequence
  Synthetic Polynucleotide
taatacgactcactatagggtggcttgagcggcggccgcagcagcggcggaacagaggagaccgccgatgctgcggccgaacctggcggcagcgcaaaagatg

SEQ ID NO: 121530 - DNA, 103 bp, Artificial Sequence
  Synthetic Polynucleotide
taatacgactcactataggggccggccatttggcttgagcggcggccgcaaacagaggagatgcggcatgcgctcaagcaacctggcggcagcgcaaaagatg

SEQ ID NO: 121531 - DNA, 103 bp, Artificial Sequence
  Synthetic Polynucleotide
taatacgactcactatagggtcgtccaggcgcagctccggcggccccgcgaacagaggagacgcgggatggccggagctaacctggcggcagcgcaaaagatg

SEQ ID NO: 121532 - DNA, 103 bp, Artificial Sequence
  Synthetic Polynucleotide
taatacgactcactatagggctcgtccgcctcgtccaggcgcagctccggaacagaggagaccggagatgcgcctggacaacctggcggcagcgcaaaagatg

SEQ ID NO: 121533 - DNA, 103 bp, Artificial Sequence
  Synthetic Polynucleotide
taatacgactcactatagggccgggggcacctcgtccgcctcgtccaggcaacagaggagagcctggatgaggcggacgaacctggcggcagcgcaaaagatg

SEQ ID NO: 121534 - DNA, 103 bp, Artificial Sequence
  Synthetic Polynucleotide
taatacgactcactatagggtggggtgccgccgggggcacctcgtccgccaacagaggagaggcggaatgggtgcccccaacctggcggcagcgcaaaagatg

SEQ ID NO: 121535 - DNA, 103 bp, Artificial Sequence
  Synthetic Polynucleotide
taatacgactcactatagggctgtccgtgatggggtgccgccgggggcacaacagaggagagtgcccatggcggcacccaacctggcggcagcgcaaaagatg

SEQ ID NO: 121536 - DNA, 103 bp, Artificial Sequence
  Synthetic Polynucleotide
taatacgactcactatagggcggacatgtcgctggcgctgccgccgccggaacagaggagaccggcgatggcagcgccaaacctggcggcagcgcaaaagatg

SEQ ID NO: 121537 - DNA, 103 bp, Artificial Sequence
  Synthetic Polynucleotide
taatacgactcactataggggcggctgaggctgtccgtgatggggtgccgaacagaggagacggcacatgatcacggacaacctggcggcagcgcaaaagatg

SEQ ID NO: 121538 - DNA, 103 bp, Artificial Sequence
  Synthetic Polynucleotide
taatacgactcactatagggtgctggtggggcggctgaggctgtccgtgaaacagaggagatcacggatggcctcagccaacctggcggcagcgcaaaagatg

SEQ ID NO: 121539 - DNA, 103 bp, Artificial Sequence
  Synthetic Polynucleotide
taatacgactcactatagggtgtcaggggctgctggtggggcggctgaggaacagaggagacctcagatgccccaccagaacctggcggcagcgcaaaagatg

SEQ ID NO: 121540 - DNA, 103 bp, Artificial Sequence
  Synthetic Polynucleotide
taatacgactcactatagggccttgggcaatgtcaggggctgctggtgggaacagaggagacccaccatgagcccctgaaacctggcggcagcgcaaaagatg

SEQ ID NO: 121541 - DNA, 103 bp, Artificial Sequence
  Synthetic Polynucleotide
taatacgactcactatagggccggccgcctccttgggcaatgtcaggggcaacagaggagagcccctatgattgcccaaaacctggcggcagcgcaaaagatg

SEQ ID NO: 121542 - DNA, 103 bp, Artificial Sequence
  Synthetic Polynucleotide
taatacgactcactatagggggccccggctccggccgcctccttgggcaaaacagaggagattgcccatggaggcggccaacctggcggcagcgcaaaagatg

SEQ ID NO: 121543 - DNA, 103 bp, Artificial Sequence
  Synthetic Polynucleotide
taatacgactcactatagggcccccggtccggccccggctccggccgcctaacagaggagaaggcggatggagccggggaacctggcggcagcgcaaaagatg

SEQ ID NO: 121544 - DNA, 103 bp, Artificial Sequence
  Synthetic Polynucleotide
taatacgactcactatagggcccacgtcgccccccggtccggccccggctaacagaggagaagccggatgcggaccgggaacctggcggcagcgcaaaagatg

SEQ ID NO: 121545 - DNA, 103 bp, Artificial Sequence
  Synthetic Polynucleotide
taatacgactcactatagggctccggcgcgcccacgtcgccccccggtccaacagaggagaggaccgatgggcgacgtgaacctggcggcagcgcaaaagatg

SEQ ID NO: 121546 - DNA, 103 bp, Artificial Sequence
  Synthetic Polynucleotide
taatacgactcactatagggagccgtccgcctccggcgcgcccacgtcgcaacagaggagagcgacgatggcgcgccggaacctggcggcagcgcaaaagatg

SEQ ID NO: 121547 - DNA, 103 bp, Artificial Sequence
  Synthetic Polynucleotide
taatacgactcactatagggaccgtctggccggacatgtcgctggcgctgaacagaggagacagcgcatgcgacatgtcaacctggcggcagcgcaaaagatg

SEQ ID NO: 121548 - DNA, 103 bp, Artificial Sequence
  Synthetic Polynucleotide
taatacgactcactatagggccgcccttgcagccgtccgcctccggcgcgaacagaggagacgcgccatgggcggacggaacctggcggcagcgcaaaagatg

SEQ ID NO: 121549 - DNA, 103 bp, Artificial Sequence
  Synthetic Polynucleotide
taatacgactcactataggggccgccaacaccgcccttgcagccgtccgcaacagaggagagcggacatgtgcaagggcaacctggcggcagcgcaaaagatg

SEQ ID NO: 121550 - DNA, 103 bp, Artificial Sequence
  Synthetic Polynucleotide
taatacgactcactatagggcgccctcctcgccgccaacaccgcccttgcaacagaggagagcaaggatggtgttggcgaacctggcggcagcgcaaaagatg

SEQ ID NO: 121551 - DNA, 103 bp, Artificial Sequence
  Synthetic Polynucleotide
taatacgactcactatagggccgctcgcgccgccctcctcgccgccaacaaacagaggagatgttggatgcgaggagggaacctggcggcagcgcaaaagatg

SEQ ID NO: 121552 - DNA, 103 bp, Artificial Sequence
  Synthetic Polynucleotide
taatacgactcactatagggaggcccgccgccgctcgcgccgccctcctcaacagaggagagaggagatgggcgcgagcaacctggcggcagcgcaaaagatg

SEQ ID NO: 121553 - DNA, 103 bp, Artificial Sequence
  Synthetic Polynucleotide
taatacgactcactatagggtgcccgcgccaggcccgccgccgctcgcgcaacagaggagagcgcgaatggcggcgggcaacctggcggcagcgcaaaagatg

SEQ ID NO: 121554 - DNA, 103 bp, Artificial Sequence
  Synthetic Polynucleotide
taatacgactcactataggggccgaaccgctgcccgcgccaggcccgccgaacagaggagacggcggatgtggcgcgggaacctggcggcagcgcaaaagatg

SEQ ID NO: 121555 - DNA, 103 bp, Artificial Sequence
  Synthetic Polynucleotide
taatacgactcactatagggcaggcctcccgccgaaccgctgcccgcgccaacagaggagaggcgcgatgagcggttcgaacctggcggcagcgcaaaagatg

SEQ ID NO: 121556 - DNA, 103 bp, Artificial Sequence
  Synthetic Polynucleotide
taatacgactcactatagggtgctcggggccaggcctcccgccgaaccgcaacagaggagagcggttatgcgggaggccaacctggcggcagcgcaaaagatg

SEQ ID NO: 121557 - DNA, 103 bp, Artificial Sequence
  Synthetic Polynucleotide
taatacgactcactatagggttcttgggcttgctcggggccaggcctcccaacagaggagagggaggatgggccccgagaacctggcggcagcgcaaaagatg

SEQ ID NO: 121558 - DNA, 103 bp, Artificial Sequence
  Synthetic Polynucleotide
taatacgactcactatagggggccgtcagcaccgtctggccggacatgtcaacagaggagagacatgatgggccagacgaacctggcggcagcgcaaaagatg

SEQ ID NO: 121559 - DNA, 103 bp, Artificial Sequence
  Synthetic Polynucleotide
taatacgactcactatagggcactaggctgttcttgggcttgctcggggcaacagaggagagccccgatgaagcccaagaacctggcggcagcgcaaaagatg

SEQ ID NO: 121560 - DNA, 103 bp, Artificial Sequence
  Synthetic Polynucleotide
taatacgactcactatagggaaggcggcttcactaggctgttcttgggctaacagaggagaagcccaatgacagcctagaacctggcggcagcgcaaaagatg

SEQ ID NO: 121561 - DNA, 103 bp, Artificial Sequence
  Synthetic Polynucleotide
taatacgactcactatagggatgtacgagtaaggcggcttcactaggctgaacagaggagacagcctatggaagccgccaacctggcggcagcgcaaaagatg

SEQ ID NO: 121562 - DNA, 103 bp, Artificial Sequence
  Synthetic Polynucleotide
taatacgactcactataggggatgagcgcgatgtacgagtaaggcggcttaacagaggagaaagccgatgtactcgtacaacctggcggcagcgcaaaagatg

SEQ ID NO: 121563 - DNA, 103 bp, Artificial Sequence
  Synthetic Polynucleotide
taatacgactcactatagggtggccatggtgatgagcgcgatgtacgagtaacagaggagaactcgtatgtcgcgctcaaacctggcggcagcgcaaaagatg

SEQ ID NO: 121564 - DNA, 103 bp, Artificial Sequence
  Synthetic Polynucleotide
taatacgactcactatagggctctgcaggatggccatggtgatgagcgcgaacagaggagacgcgctatgcaccatggcaacctggcggcagcgcaaaagatg

SEQ ID NO: 121565 - DNA, 103 bp, Artificial Sequence
  Synthetic Polynucleotide
taatacgactcactatagggcttctgcgggctctgcaggatggccatggtaacagaggagaaccatgatgatcctgcagaacctggcggcagcgcaaaagatg

SEQ ID NO: 121566 - DNA, 103 bp, Artificial Sequence
  Synthetic Polynucleotide
taatacgactcactataggggggtcagcttcttctgcgggctctgcaggaaacagaggagatcctgcatggcccgcagaaacctggcggcagcgcaaaagatg

SEQ ID NO: 121567 - DNA, 103 bp, Artificial Sequence
  Synthetic Polynucleotide
taatacgactcactatagggatgccgctcagggtcagcttcttctgcgggaacagaggagacccgcaatggaagctgacaacctggcggcagcgcaaaagatg

SEQ ID NO: 121568 - DNA, 103 bp, Artificial Sequence
  Synthetic Polynucleotide
taatacgactcactataggggaactcgcagatgccgctcagggtcagcttaacagaggagaaagctgatgctgagcggcaacctggcggcagcgcaaaagatg

SEQ ID NO: 121569 - DNA, 103 bp, Artificial Sequence
  Synthetic Polynucleotide
taatacgactcactatagggccacgtcctcggccgtcagcaccgtctggcaacagaggagagccagaatgtgctgacggaacctggcggcagcgcaaaagatg

SEQ ID NO: 121570 - DNA, 103 bp, Artificial Sequence
  Synthetic Polynucleotide
taatacgactcactatagggggttgctgatgaactcgcagatgccgctcaaacagaggagatgagcgatgtctgcgagtaacctggcggcagcgcaaaagatg

SEQ ID NO: 121571 - DNA, 103 bp, Artificial Sequence
  Synthetic Polynucleotide
taatacgactcactatagggtaggggaagcggttgctgatgaactcgcagaacagaggagactgcgaatgcatcagcaaaacctggcggcagcgcaaaagatg

SEQ ID NO: 121572 - DNA, 103 bp, Artificial Sequence
  Synthetic Polynucleotide
taatacgactcactatagggctccctgtagtaggggaagcggttgctgataacagaggagaatcagcatgcgcttccccaacctggcggcagcgcaaaagatg

SEQ ID NO: 121573 - DNA, 103 bp, Artificial Sequence
  Synthetic Polynucleotide
taatacgactcactatagggcggggaacttctccctgtagtaggggaagcaacagaggagagcttccatgactacagggaacctggcggcagcgcaaaagatg

SEQ ID NO: 121574 - DNA, 103 bp, Artificial Sequence
  Synthetic Polynucleotide
taatacgactcactatagggttctgccaggcggggaacttctccctgtagaacagaggagactacagatggaagttcccaacctggcggcagcgcaaaagatg

SEQ ID NO: 121575 - DNA, 103 bp, Artificial Sequence
  Synthetic Polynucleotide
taatacgactcactataggggcggatgctgttctgccaggcggggaacttaacagaggagaaagttcatggcctggcagaacctggcggcagcgcaaaagatg

SEQ ID NO: 121576 - DNA, 103 bp, Artificial Sequence
  Synthetic Polynucleotide
taatacgactcactatagggagaggttgtggcggatgctgttctgccaggaacagaggagacctggcatgacagcatccaacctggcggcagcgcaaaagatg

SEQ ID NO: 121577 - DNA, 103 bp, Artificial Sequence
  Synthetic Polynucleotide
taatacgactcactatagggtcgttgagtgagaggttgtggcggatgctgaacagaggagacagcatatgccacaacctaacctggcggcagcgcaaaagatg

SEQ ID NO: 121578 - DNA, 103 bp, Artificial Sequence
  Synthetic Polynucleotide
taatacgactcactataggggacgaagcagtcgttgagtgagaggttgtgaacagaggagacacaacatgtcactcaacaacctggcggcagcgcaaaagatg

SEQ ID NO: 121579 - DNA, 103 bp, Artificial Sequence
  Synthetic Polynucleotide
taatacgactcactataggggggggatcttgacgaagcagtcgttgagtgaacagaggagacactcaatgactgcttcgaacctggcggcagcgcaaaagatg

SEQ ID NO: 121580 - DNA, 103 bp, Artificial Sequence
  Synthetic Polynucleotide
taatacgactcactatagggacatcgatgtccacgtcctcggccgtcagcaacagaggagagctgacatgcgaggacgtaacctggcggcagcgcaaaagatg

SEQ ID NO: 121581 - DNA, 103 bp, Artificial Sequence
  Synthetic Polynucleotide
taatacgactcactatagggcccggctcgcgggggatcttgacgaagcagaacagaggagactgcttatgcaagatcccaacctggcggcagcgcaaaagatg

SEQ ID NO: 121582 - DNA, 103 bp, Artificial Sequence
  Synthetic Polynucleotide
taatacgactcactataggggcccgggttgcccggctcgcgggggatcttaacagaggagaaagatcatgcgcgagccgaacctggcggcagcgcaaaagatg

SEQ ID NO: 121583 - DNA, 103 bp, Artificial Sequence
  Synthetic Polynucleotide
taatacgactcactatagggagttgcccttgcccgggttgcccggctcgcaacagaggagagcgagcatggcaacccggaacctggcggcagcgcaaaagatg

SEQ ID NO: 121584 - DNA, 103 bp, Artificial Sequence
  Synthetic Polynucleotide
taatacgactcactatagggagggtccagtagttgcccttgcccgggttgaacagaggagacaacccatgcaagggcaaaacctggcggcagcgcaaaagatg

SEQ ID NO: 121585 - DNA, 103 bp, Artificial Sequence
  Synthetic Polynucleotide
taatacgactcactatagggctgcgggtccagggtccagtagttgcccttaacagaggagaaagggcatgtactggaccaacctggcggcagcgcaaaagatg

SEQ ID NO: 121586 - DNA, 103 bp, Artificial Sequence
  Synthetic Polynucleotide
taatacgactcactatagggtgtcctcggactgcgggtccagggtccagtaacagaggagaactggaatgtggacccgcaacctggcggcagcgcaaaagatg

SEQ ID NO: 121587 - DNA, 103 bp, Artificial Sequence
  Synthetic Polynucleotide
taatacgactcactatagggttgtcgaacatgtcctcggactgcgggtccaacagaggagaggacccatggtccgaggaaacctggcggcagcgcaaaagatg

SEQ ID NO: 121588 - DNA, 103 bp, Artificial Sequence
  Synthetic Polynucleotide
taatacgactcactataggggaagctgccgttgtcgaacatgtcctcggaaacagaggagatccgagatgatgttcgacaacctggcggcagcgcaaaagatg

SEQ ID NO: 121589 - DNA, 103 bp, Artificial Sequence
  Synthetic Polynucleotide
taatacgactcactatagggggcgccgcaggaagctgccgttgtcgaacaaacagaggagatgttcgatgacggcagctaacctggcggcagcgcaaaagatg

SEQ ID NO: 121590 - DNA, 103 bp, Artificial Sequence
  Synthetic Polynucleotide
taatacgactcactatagggaagcgtttccggcgccgcaggaagctgccgaacagaggagacggcagatgcctgcggcgaacctggcggcagcgcaaaagatg

SEQ ID NO: 121591 - DNA, 103 bp, Artificial Sequence
  Synthetic Polynucleotide
taatacgactcactatagggctcgcccaccacatcgatgtccacgtcctcaacagaggagagaggacatggacatcgataacctggcggcagcgcaaaagatg

SEQ ID NO: 121592 - DNA, 103 bp, Artificial Sequence
  Synthetic Polynucleotide
taatacgactcactataggggtggcgcttgaagcgtttccggcgccgcagaacagaggagactgcggatgcggaaacgcaacctggcggcagcgcaaaagatg

SEQ ID NO: 121593 - DNA, 103 bp, Artificial Sequence
  Synthetic Polynucleotide
taatacgactcactataggggctcctgctggtggcgcttgaagcgtttccaacagaggagaggaaacatgtcaagcgccaacctggcggcagcgcaaaagatg

SEQ ID NO: 121594 - DNA, 103 bp, Artificial Sequence
  Synthetic Polynucleotide
taatacgactcactatagggtcgcgcaggtgctcctgctggtggcgcttgaacagaggagacaagcgatgccagcaggaaacctggcggcagcgcaaaagatg

SEQ ID NO: 121595 - DNA, 103 bp, Artificial Sequence
  Synthetic Polynucleotide
taatacgactcactatagggcgccgtctgctcgcgcaggtgctcctgctgaacagaggagacagcagatgcacctgcgcaacctggcggcagcgcaaaagatg

SEQ ID NO: 121596 - DNA, 103 bp, Artificial Sequence
  Synthetic Polynucleotide
taatacgactcactataggggcatcatgagcgccgtctgctcgcgcaggtaacagaggagaacctgcatgagcagacggaacctggcggcagcgcaaaagatg

SEQ ID NO: 121597 - DNA, 103 bp, Artificial Sequence
  Synthetic Polynucleotide
taatacgactcactatagggccgaagctctgcatcatgagcgccgtctgcaacagaggagagcagacatggctcatgataacctggcggcagcgcaaaagatg

SEQ ID NO: 121598 - DNA, 103 bp, Artificial Sequence
  Synthetic Polynucleotide
taatacgactcactataggggctgtaagcgccgaagctctgcatcatgagaacagaggagactcatgatgcagagcttcaacctggcggcagcgcaaaagatg

SEQ ID NO: 121599 - DNA, 103 bp, Artificial Sequence
  Synthetic Polynucleotide
taatacgactcactatagggccgccgccaggctgtaagcgccgaagctctaacagaggagaagagctatggcgcttacaaacctggcggcagcgcaaaagatg

SEQ ID NO: 121600 - DNA, 103 bp, Artificial Sequence
  Synthetic Polynucleotide
taatacgactcactataggggcgccggccgccgccgccaggctgtaagcgaacagaggagacgcttaatgcctggcggcaacctggcggcagcgcaaaagatg

SEQ ID NO: 121601 - DNA, 103 bp, Artificial Sequence
  Synthetic Polynucleotide
taatacgactcactataggggggtcccgcggcgccggccgccgccgccagaacagaggagactggcgatggcggccggcaacctggcggcagcgcaaaagatg

SEQ ID NO: 121602 - DNA, 103 bp, Artificial Sequence
  Synthetic Polynucleotide
taatacgactcactatagggcgtcgtcgccctcgcccaccacatcgatgtaacagaggagaacatcgatgtggtgggcgaacctggcggcagcgcaaaagatg

SEQ ID NO: 121603 - DNA, 103 bp, Artificial Sequence
  Synthetic Polynucleotide
taatacgactcactatagggggcggccgtagggtcccgcggcgccggccgaacagaggagacggccgatgccgcgggacaacctggcggcagcgcaaaagatg

SEQ ID NO: 121604 - DNA, 103 bp, Artificial Sequence
  Synthetic Polynucleotide
taatacgactcactatagggaggccgtaggggcggccgtagggtcccgcgaacagaggagacgcgggatgctacggccgaacctggcggcagcgcaaaagatg

SEQ ID NO: 121605 - DNA, 103 bp, Artificial Sequence
  Synthetic Polynucleotide
taatacgactcactatagggcgcagggtgcaggccgtaggggcggccgtaaacagaggagatacggcatgccctacggcaacctggcggcagcgcaaaagatg

SEQ ID NO: 121606 - DNA, 103 bp, Artificial Sequence
  Synthetic Polynucleotide
taatacgactcactatagggcggccgccgccgcagggtgcaggccgtaggaacagaggagacctacgatgtgcaccctgaacctggcggcagcgcaaaagatg

SEQ ID NO: 121607 - DNA, 103 bp, Artificial Sequence
  Synthetic Polynucleotide
taatacgactcactataggggaataggcaccggccgccgccgcagggtgcaacagaggagagcacccatgggcggcggcaacctggcggcagcgcaaaagatg

SEQ ID NO: 121608 - DNA, 103 bp, Artificial Sequence
  Synthetic Polynucleotide
taatacgactcactatagggtgccgggtgcgaataggcaccggccgccgcaacagaggagagcggcgatgggtgcctataacctggcggcagcgcaaaagatg

SEQ ID NO: 121609 - DNA, 103 bp, Artificial Sequence
  Synthetic Polynucleotide
taatacgactcactatagggccgccgccgctgccgggtgcgaataggcacaacagaggagagtgcctatgcgcacccggaacctggcggcagcgcaaaagatg

SEQ ID NO: 121610 - DNA, 103 bp, Artificial Sequence
  Synthetic Polynucleotide
taatacgactcactataggggcagccgcggccgccgccgctgccgggtgcaacagaggagagcacccatgagcggcggcaacctggcggcagcgcaaaagatg

SEQ ID NO: 121611 - DNA, 103 bp, Artificial Sequence
  Synthetic Polynucleotide
taatacgactcactatagggcgccgccgcagcagccgcggccgccgccgcaacagaggagagcggcgatggccgcggctaacctggcggcagcgcaaaagatg

SEQ ID NO: 121612 - DNA, 103 bp, Artificial Sequence
  Synthetic Polynucleotide
taatacgactcactatagggggtactggagcgccgccgcagcagccgcggaacagaggagaccgcggatgctgcggcggaacctggcggcagcgcaaaagatg

SEQ ID NO: 121613 - DNA, 103 bp, Artificial Sequence
  Synthetic Polynucleotide
taatacgactcactatagggtcttccagcccgtcgtcgccctcgcccaccaacagaggagaggtgggatggggcgacgaaacctggcggcagcgcaaaagatg

SEQ ID NO: 121614 - DNA, 103 bp, Artificial Sequence
  Synthetic Polynucleotide
taatacgactcactatagggagcgcgtacgggtactggagcgccgccgcaaacagaggagatgcggcatggctccagtaaacctggcggcagcgcaaaagatg

SEQ ID NO: 121615 - DNA, 103 bp, Artificial Sequence
  Synthetic Polynucleotide
taatacgactcactatagggcaccggcggcagcgcgtacgggtactggagaacagaggagactccagatgccgtacgcgaacctggcggcagcgcaaaagatg

SEQ ID NO: 121616 - DNA, 103 bp, Artificial Sequence
  Synthetic Polynucleotide
taatacgactcactataggggcaccggtgccaccggcggcagcgcgtacgaacagaggagacgtacgatgtgccgccggaacctggcggcagcgcaaaagatg

SEQ ID NO: 121617 - DNA, 103 bp, Artificial Sequence
  Synthetic Polynucleotide
taatacgactcactataggggcgggaggcagcaccggtgccaccggcggcaacagaggagagccgccatgggcaccggtaacctggcggcagcgcaaaagatg

SEQ ID NO: 121618 - DNA, 103 bp, Artificial Sequence
  Synthetic Polynucleotide
taatacgactcactatagggcagcggcacagcgggaggcagcaccggtgcaacagaggagagcaccgatgctgcctcccaacctggcggcagcgcaaaagatg

SEQ ID NO: 121619 - DNA, 103 bp, Artificial Sequence
  Synthetic Polynucleotide
taatacgactcactatagggccgagggcagcagcggcacagcgggaggcaaacagaggagatgcctcatgctgtgccgcaacctggcggcagcgcaaaagatg

SEQ ID NO: 121620 - DNA, 103 bp, Artificial Sequence
  Synthetic Polynucleotide
taatacgactcactatagggcccagctcgcccgagggcagcagcggcacaaacagaggagatgtgccatggctgccctcaacctggcggcagcgcaaaagatg

SEQ ID NO: 121621 - DNA, 103 bp, Artificial Sequence
  Synthetic Polynucleotide
taatacgactcactatagggcgctttgcggcccagctcgcccgagggcagaacagaggagactgcccatgggcgagctgaacctggcggcagcgcaaaagatg

SEQ ID NO: 121622 - DNA, 103 bp, Artificial Sequence
  Synthetic Polynucleotide
taatacgactcactatagggcgaaggcggccgctttgcggcccagctcgcaacagaggagagcgagcatggccgcaaagaacctggcggcagcgcaaaagatg

SEQ ID NO: 121623 - DNA, 103 bp, Artificial Sequence
  Synthetic Polynucleotide
taatacgactcactatagggagctgtgagccgaaggcggccgctttgcggaacagaggagaccgcaaatgggccgccttaacctggcggcagcgcaaaagatg

SEQ ID NO: 121624 - DNA, 103 bp, Artificial Sequence
  Synthetic Polynucleotide
taatacgactcactatagggtggctgctgcttctcgggcgccgaagacataacagaggagaatgtctatggcgcccgagaacctggcggcagcgcaaaagatg

SEQ ID NO: 121625 - DNA, 103 bp, Artificial Sequence
  Synthetic Polynucleotide
taatacgactcactataggggttggtcttcttggccttggacgggccggaaacagaggagatccggcatgtccaaggccaacctggcggcagcgcaaaagatg

SEQ ID NO: 121626 - DNA, 103 bp, Artificial Sequence
  Synthetic Polynucleotide
taatacgactcactataggggtcacacatgctgggcgactgcgagtgataaacagaggagatatcacatgcagtcgcccaacctggcggcagcgcaaaagatg

SEQ ID NO: 121627 - DNA, 103 bp, Artificial Sequence
  Synthetic Polynucleotide
taatacgactcactatagggactcctttcggtcacacatgctgggcgactaacagaggagaagtcgcatggcatgtgtgaacctggcggcagcgcaaaagatg

SEQ ID NO: 121628 - DNA, 103 bp, Artificial Sequence
  Synthetic Polynucleotide
taatacgactcactataggggagaagacaaactcctttcggtcacacatgaacagaggagacatgtgatgccgaaaggaaacctggcggcagcgcaaaagatg

SEQ ID NO: 121629 - DNA, 103 bp, Artificial Sequence
  Synthetic Polynucleotide
taatacgactcactatagggggcgttgaaagagaagacaaactcctttcgaacagaggagacgaaagatgtttgtcttcaacctggcggcagcgcaaaagatg

SEQ ID NO: 121630 - DNA, 103 bp, Artificial Sequence
  Synthetic Polynucleotide
taatacgactcactatagggaggacgccatggcgttgaaagagaagacaaaacagaggagattgtctatgctttcaacgaacctggcggcagcgcaaaagatg

SEQ ID NO: 121631 - DNA, 103 bp, Artificial Sequence
  Synthetic Polynucleotide
taatacgactcactatagggtgcatggaagaggacgccatggcgttgaaaaacagaggagatttcaaatgcatggcgtcaacctggcggcagcgcaaaagatg

SEQ ID NO: 121632 - DNA, 103 bp, Artificial Sequence
  Synthetic Polynucleotide
taatacgactcactataggggccggccgagtgcatggaagaggacgccataacagaggagaatggcgatgtcttccatgaacctggcggcagcgcaaaagatg

SEQ ID NO: 121633 - DNA, 103 bp, Artificial Sequence
  Synthetic Polynucleotide
taatacgactcactatagggaggagcccccgccggccgagtgcatggaagaacagaggagacttccaatgactcggccgaacctggcggcagcgcaaaagatg

SEQ ID NO: 121634 - DNA, 103 bp, Artificial Sequence
  Synthetic Polynucleotide
taatacgactcactatagggtggtggtagtaggagcccccgccggccgagaacagaggagactcggcatgcgggggctcaacctggcggcagcgcaaaagatg

SEQ ID NO: 121635 - DNA, 103 bp, Artificial Sequence
  Synthetic Polynucleotide
taatacgactcactatagggggtgacctgctggtggtagtaggagcccccaacagaggagagggggcatgtactaccacaacctggcggcagcgcaaaagatg

SEQ ID NO: 121636 - DNA, 103 bp, Artificial Sequence
  Synthetic Polynucleotide
taatacgactcactatagggggatgccggcgttggtcttcttggccttggaacagaggagaccaaggatgagaagaccaaacctggcggcagcgcaaaagatg

SEQ ID NO: 121637 - DNA, 103 bp, Artificial Sequence
  Synthetic Polynucleotide
taatacgactcactatagggtgtcttggtaggtgacctgctggtggtagtaacagaggagaactaccatgagcaggtcaaacctggcggcagcgcaaaagatg

SEQ ID NO: 121638 - DNA, 103 bp, Artificial Sequence
  Synthetic Polynucleotide
taatacgactcactatagggcaaggcttgatgtcttggtaggtgacctgcaacagaggagagcaggtatgctaccaagaaacctggcggcagcgcaaaagatg

SEQ ID NO: 121639 - DNA, 103 bp, Artificial Sequence
  Synthetic Polynucleotide
taatacgactcactatagggtcacatcacgcaaggcttgatgtcttggtaaacagaggagataccaaatgatcaagcctaacctggcggcagcgcaaaagatg

SEQ ID NO: 121640 - DNA, 103 bp, Artificial Sequence
  Synthetic Polynucleotide
taatacgactcactatagggtccgggcgccggatgccggcgttggtcttcaacagaggagagaagacatgcgccggcataacctggcggcagcgcaaaagatg

SEQ ID NO: 121641 - DNA, 103 bp, Artificial Sequence
  Synthetic Polynucleotide
taatacgactcactataggggggcggcttctccgggcgccggatgccggcaacagaggagagccggcatgcggcgcccgaacctggcggcagcgcaaaagatg

SEQ ID NO: 121642 - DNA, 103 bp, Artificial Sequence
  Synthetic Polynucleotide
taatacgactcactatagggtgtaggaatagggcggcttctccgggcgccaacagaggagaggcgccatgagaagccgcaacctggcggcagcgcaaaagatg

SEQ ID NO: 121643 - DNA, 103 bp, Artificial Sequence
  Synthetic Polynucleotide
taatacgactcactatagggatgagcgcgatgtaggaatagggcggcttcaacagaggagagaagccatgctattcctaaacctggcggcagcgcaaaagatg

SEQ ID NO: 121644 - DNA, 103 bp, Artificial Sequence
  Synthetic Polynucleotide
taatacgactcactatagggggccatgacgatgagcgcgatgtaggaataaacagaggagatattccatgatcgcgctcaacctggcggcagcgcaaaagatg

SEQ ID NO: 121645 - DNA, 103 bp, Artificial Sequence
  Synthetic Polynucleotide
taatacgactcactatagggaactctggatggccatgacgatgagcgcgaaacagaggagatcgcgcatgtcgtcatggaacctggcggcagcgcaaaagatg

SEQ ID NO: 121646 - DNA, 103 bp, Artificial Sequence
  Synthetic Polynucleotide
taatacgactcactatagggttggtgggtgaactctggatggccatgacgaacagaggagacgtcatatgcatccagagaacctggcggcagcgcaaaagatg

SEQ ID NO: 121647 - DNA, 103 bp, Artificial Sequence
  Synthetic Polynucleotide
taatacgactcactatagggcgtcaggcgcttggtgggtgaactctggataacagaggagaatccagatgtcacccaccaacctggcggcagcgcaaaagatg

SEQ ID NO: 121648 - DNA, 103 bp, Artificial Sequence
  Synthetic Polynucleotide
taatacgactcactatagggcgccgtgcggtggctgctgcttctcgggcgaacagaggagacgcccgatgagcagcagcaacctggcggcagcgcaaaagatg

SEQ ID NO: 121649 - DNA, 103 bp, Artificial Sequence
  Synthetic Polynucleotide
taatacgactcactatagggtctcgctcagcgtcaggcgcttggtgggtgaacagaggagacacccaatgagcgcctgaaacctggcggcagcgcaaaagatg

SEQ ID NO: 121650 - DNA, 103 bp, Artificial Sequence
  Synthetic Polynucleotide
taatacgactcactatagggaactggtagatctcgctcagcgtcaggcgcaacagaggagagcgcctatggctgagcgaaacctggcggcagcgcaaaagatg

SEQ ID NO: 121651 - DNA, 103 bp, Artificial Sequence
  Synthetic Polynucleotide
taatacgactcactataggggctctgcaggaactggtagatctcgctcagaacagaggagactgagcatgatctaccagaacctggcggcagcgcaaaagatg

SEQ ID NO: 121652 - DNA, 103 bp, Artificial Sequence
  Synthetic Polynucleotide
taatacgactcactatagggaggggaagcggctctgcaggaactggtagaaacagaggagatctaccatgtcctgcagaaacctggcggcagcgcaaaagatg

SEQ ID NO: 121653 - DNA, 103 bp, Artificial Sequence
  Synthetic Polynucleotide
taatacgactcactatagggccccggaagaaggggaagcggctctgcaggaacagaggagacctgcaatgccgcttcccaacctggcggcagcgcaaaagatg

SEQ ID NO: 121654 - DNA, 103 bp, Artificial Sequence
  Synthetic Polynucleotide
taatacgactcactatagggctggtaggagccccggaagaaggggaagcgaacagaggagacgcttcatgttcttccggaacctggcggcagcgcaaaagatg

SEQ ID NO: 121655 - DNA, 103 bp, Artificial Sequence
  Synthetic Polynucleotide
taatacgactcactatagggtcttccagccctggtaggagccccggaagaaacagaggagatcttccatggctcctaccaacctggcggcagcgcaaaagatg

SEQ ID NO: 121656 - DNA, 103 bp, Artificial Sequence
  Synthetic Polynucleotide
taatacgactcactatagggcgcacggagttcttccagccctggtaggagaacagaggagactcctaatggggctggaaaacctggcggcagcgcaaaagatg

SEQ ID NO: 121657 - DNA, 103 bp, Artificial Sequence
  Synthetic Polynucleotide
taatacgactcactataggggaggttgtggcgcacggagttcttccagccaacagaggagaggctggatgaactccgtgaacctggcggcagcgcaaaagatg

SEQ ID NO: 121658 - DNA, 103 bp, Artificial Sequence
  Synthetic Polynucleotide
taatacgactcactatagggcgttgagcgagaggttgtggcgcacggagtaacagaggagaactccgatggccacaaccaacctggcggcagcgcaaaagatg

SEQ ID NO: 121659 - DNA, 103 bp, Artificial Sequence
  Synthetic Polynucleotide
taatacgactcactatagggccgccgccgccgccgtgcggtggctgctgcaacagaggagagcagcaatgaccgcacggaacctggcggcagcgcaaaagatg

SEQ ID NO: 121660 - DNA, 103 bp, Artificial Sequence
  Synthetic Polynucleotide
taatacgactcactatagggatgaagcactcgttgagcgagaggttgtggaacagaggagaccacaaatgctcgctcaaaacctggcggcagcgcaaaagatg

SEQ ID NO: 121661 - DNA, 103 bp, Artificial Sequence
  Synthetic Polynucleotide
taatacgactcactataggggggtagcttgatgaagcactcgttgagcgaaacagaggagatcgctcatggagtgcttcaacctggcggcagcgcaaaagatg

SEQ ID NO: 121662 - DNA, 103 bp, Artificial Sequence
  Synthetic Polynucleotide
taatacgactcactatagggcaaggcccttgggtagcttgatgaagcactaacagaggagaagtgctatgtcaagctacaacctggcggcagcgcaaaagatg

SEQ ID NO: 121663 - DNA, 103 bp, Artificial Sequence
  Synthetic Polynucleotide
taatacgactcactatagggccgggccgcccaaggcccttgggtagcttgaacagaggagacaagctatgcaagggcctaacctggcggcagcgcaaaagatg

SEQ ID NO: 121664 - DNA, 103 bp, Artificial Sequence
  Synthetic Polynucleotide
taatacgactcactataggggtggcccttgccgggccgcccaaggcccttaacagaggagaaagggcatggggcggcccaacctggcggcagcgcaaaagatg

SEQ ID NO: 121665 - DNA, 103 bp, Artificial Sequence
  Synthetic Polynucleotide
taatacgactcactatagggtggtccagtagtggcccttgccgggccgccaacagaggagaggcggcatggcaagggccaacctggcggcagcgcaaaagatg

SEQ ID NO: 121666 - DNA, 103 bp, Artificial Sequence
  Synthetic Polynucleotide
taatacgactcactataggggccgggtcgatggtccagtagtggcccttgaacagaggagacaagggatgctactggacaacctggcggcagcgcaaaagatg

SEQ ID NO: 121667 - DNA, 103 bp, Artificial Sequence
  Synthetic Polynucleotide
taatacgactcactataggggaactcgctggccgggtcgatggtccagtaaacagaggagatactggatgatcgacccgaacctggcggcagcgcaaaagatg

SEQ ID NO: 121668 - DNA, 103 bp, Artificial Sequence
  Synthetic Polynucleotide
taatacgactcactatagggcctcgaacatgaactcgctggccgggtcgaaacagaggagatcgaccatgccagcgagtaacctggcggcagcgcaaaagatg

SEQ ID NO: 121669 - DNA, 103 bp, Artificial Sequence
  Synthetic Polynucleotide
taatacgactcactatagggaaggagccctcctcgaacatgaactcgctgaacagaggagacagcgaatgcatgttcgaaacctggcggcagcgcaaaagatg

SEQ ID NO: 121670 - DNA, 103 bp, Artificial Sequence
  Synthetic Polynucleotide
taatacgactcactatagggcccgccgccgccgccgccgccgccgtgcggaacagaggagaccgcacatgggcggcggcaacctggcggcagcgcaaaagatg

SEQ ID NO: 121671 - DNA, 103 bp, Artificial Sequence
  Synthetic Polynucleotide
taatacgactcactatagggccgccgccgaaaggagccctcctcgaacataacagaggagaatgttcatggagggctccaacctggcggcagcgcaaaagatg

SEQ ID NO: 121672 - DNA, 103 bp, Artificial Sequence
  Synthetic Polynucleotide
taatacgactcactatagggagccgcgcggccgccgccgaaaggagccctaacagaggagaagggctatgttcggcggcaacctggcggcagcgcaaaagatg

SEQ ID NO: 121673 - DNA, 103 bp, Artificial Sequence
  Synthetic Polynucleotide
taatacgactcactatagggttccttcggaagccgcgcggccgccgccgaaacagaggagatcggcgatggccgcgcggaacctggcggcagcgcaaaagatg

SEQ ID NO: 121674 - DNA, 103 bp, Artificial Sequence
  Synthetic Polynucleotide
taatacgactcactatagggcgcctggcatttccttcggaagccgcgcggaacagaggagaccgcgcatgttccgaaggaacctggcggcagcgcaaaagatg

SEQ ID NO: 121675 - DNA, 103 bp, Artificial Sequence
  Synthetic Polynucleotide
taatacgactcactatagggtgggcttgagcgcctggcatttccttcggaaacagaggagatccgaaatgaatgccaggaacctggcggcagcgcaaaagatg

SEQ ID NO: 121676 - DNA, 103 bp, Artificial Sequence
  Synthetic Polynucleotide
taatacgactcactatagggatgctgtacatgggcttgagcgcctggcataacagaggagaatgccaatggctcaagccaacctggcggcagcgcaaaagatg

SEQ ID NO: 121677 - DNA, 103 bp, Artificial Sequence
  Synthetic Polynucleotide
taatacgactcactatagggcccgttcatcatgctgtacatgggcttgagaacagaggagactcaagatgatgtacagcaacctggcggcagcgcaaaagatg

SEQ ID NO: 121678 - DNA, 103 bp, Artificial Sequence
  Synthetic Polynucleotide
taatacgactcactatagggtgaagccgagcccgttcatcatgctgtacaaacagaggagatgtacaatgtgatgaacgaacctggcggcagcgcaaaagatg

SEQ ID NO: 121679 - DNA, 103 bp, Artificial Sequence
  Synthetic Polynucleotide
taatacgactcactataggggggaggtggttgaagccgagcccgttcatcaacagaggagagatgaaatggctcggcttaacctggcggcagcgcaaaagatg

SEQ ID NO: 121680 - DNA, 103 bp, Artificial Sequence
  Synthetic Polynucleotide
taatacgactcactataggggtaggtgtccgggaggtggttgaagccgagaacagaggagactcggcatgaaccacctcaacctggcggcagcgcaaaagatg

SEQ ID NO: 121681 - DNA, 103 bp, Artificial Sequence
  Synthetic Polynucleotide
taatacgactcactatagggcgccgcctcccccgccgccgccgccgccgcaacagaggagagcggcgatggcggcggcgaacctggcggcagcgcaaaagatg

SEQ ID NO: 121682 - DNA, 103 bp, Artificial Sequence
  Synthetic Polynucleotide
taatacgactcactatagggcctggaagccgtaggtgtccgggaggtggtaacagaggagaaccaccatgcggacacctaacctggcggcagcgcaaaagatg

SEQ ID NO: 121683 - DNA, 103 bp, Artificial Sequence
  Synthetic Polynucleotide
taatacgactcactatagggccggccgagccctggaagccgtaggtgtccaacagaggagaggacacatgcggcttccaaacctggcggcagcgcaaaagatg

SEQ ID NO: 121684 - DNA, 103 bp, Artificial Sequence
  Synthetic Polynucleotide
taatacgactcactatagggcgagaggccgccggccgagccctggaagccaacagaggagaggcttcatgggctcggccaacctggcggcagcgcaaaagatg

SEQ ID NO: 121685 - DNA, 103 bp, Artificial Sequence
  Synthetic Polynucleotide
taatacgactcactatagggtgggcgggcacgagaggccgccggccgagcaacagaggagagctcggatggcggcctctaacctggcggcagcgcaaaagatg

SEQ ID NO: 121686 - DNA, 103 bp, Artificial Sequence
  Synthetic Polynucleotide
taatacgactcactataggggccaggctgttgggcgggcacgagaggccgaacagaggagacggcctatggtgcccgccaacctggcggcagcgcaaaagatg

SEQ ID NO: 121687 - DNA, 103 bp, Artificial Sequence
  Synthetic Polynucleotide
taatacgactcactataggggccctccagcgccaggctgttgggcgggcaaacagaggagatgcccgatgaacagcctgaacctggcggcagcgcaaaagatg

SEQ ID NO: 121688 - DNA, 103 bp, Artificial Sequence
  Synthetic Polynucleotide
taatacgactcactatagggtgcccaggccgccctccagcgccaggctgtaacagaggagaacagccatgcgctggaggaacctggcggcagcgcaaaagatg

SEQ ID NO: 121689 - DNA, 103 bp, Artificial Sequence
  Synthetic Polynucleotide
taatacgactcactatagggccgttcatcatgcccaggccgccctccagcaacagaggagagctggaatgcggcctgggaacctggcggcagcgcaaaagatg

SEQ ID NO: 121690 - DNA, 103 bp, Artificial Sequence
  Synthetic Polynucleotide
taatacgactcactatagggcggcaagtggccgttcatcatgcccaggccaacagaggagaggcctgatgatgatgaacaacctggcggcagcgcaaaagatg

SEQ ID NO: 121691 - DNA, 103 bp, Artificial Sequence
  Synthetic Polynucleotide
taatacgactcactatagggccacgttgcccggcaagtggccgttcatcaaacagaggagatgatgaatggccacttgcaacctggcggcagcgcaaaagatg

SEQ ID NO: 121692 - DNA, 103 bp, Artificial Sequence
  Synthetic Polynucleotide
taatacgactcactatagggtccatggccgcgccgcctcccccgccgccgaacagaggagacggcggatggggaggcggaacctggcggcagcgcaaaagatg

SEQ ID NO: 121693 - DNA, 103 bp, Artificial Sequence
  Synthetic Polynucleotide
taatacgactcactataggggccatgccgtccacgttgcccggcaagtggaacagaggagaccacttatggggcaacgtaacctggcggcagcgcaaaagatg

SEQ ID NO: 121694 - DNA, 103 bp, Artificial Sequence
  Synthetic Polynucleotide
taatacgactcactataggggctgggcagggccatgccgtccacgttgccaacagaggagaggcaacatggacggcatgaacctggcggcagcgcaaaagatg

SEQ ID NO: 121695 - DNA, 103 bp, Artificial Sequence
  Synthetic Polynucleotide
taatacgactcactataggggcaccgagtggctgggcagggccatgccgtaacagaggagaacggcaatgccctgcccaaacctggcggcagcgcaaaagatg

SEQ ID NO: 121696 - DNA, 103 bp, Artificial Sequence
  Synthetic Polynucleotide
taatacgactcactatagggggcaggtggggcaccgagtggctgggcaggaacagaggagacctgccatgccactcggtaacctggcggcagcgcaaaagatg

SEQ ID NO: 121697 - DNA, 103 bp, Artificial Sequence
  Synthetic Polynucleotide
taatacgactcactataggggccgttggaaggcaggtggggcaccgagtgaacagaggagacactcgatgccccacctgaacctggcggcagcgcaaaagatg

SEQ ID NO: 121698 - DNA, 103 bp, Artificial Sequence
  Synthetic Polynucleotide
taatacgactcactatagggacgagtggccgccgttggaaggcaggtgggaacagaggagacccaccatgcttccaacgaacctggcggcagcgcaaaagatg

SEQ ID NO: 121699 - DNA, 103 bp, Artificial Sequence
  Synthetic Polynucleotide
taatacgactcactatagggccgcccatgtacgagtggccgccgttggaaaacagaggagattccaaatgcggccactcaacctggcggcagcgcaaaagatg

SEQ ID NO: 121700 - DNA, 103 bp, Artificial Sequence
  Synthetic Polynucleotide
taatacgactcactataggggccgccgcagccgcccatgtacgagtggccaacagaggagaggccacatgtacatgggcaacctggcggcagcgcaaaagatg

SEQ ID NO: 121701 - DNA, 103 bp, Artificial Sequence
  Synthetic Polynucleotide
taatacgactcactatagggcggccgccgcgccgccgcagccgcccatgtaacagaggagaacatggatggctgcggcgaacctggcggcagcgcaaaagatg

SEQ ID NO: 121702 - DNA, 103 bp, Artificial Sequence
  Synthetic Polynucleotide
taatacgactcactataggggggtactcgccggccgccgcgccgccgcagaacagaggagactgcggatgcgcggcggcaacctggcggcagcgcaaaagatg

SEQ ID NO: 121703 - DNA, 103 bp, Artificial Sequence
  Synthetic Polynucleotide
taatacgactcactatagggcgacgcggggtccatggccgcgccgcctccaacagaggagaggaggcatggcggccatgaacctggcggcagcgcaaaagatg

SEQ ID NO: 121704 - DNA, 103 bp, Artificial Sequence
  Synthetic Polynucleotide
taatacgactcactataggggtcgtggtgcgggtactcgccggccgccgcaacagaggagagcggcgatgggcgagtacaacctggcggcagcgcaaaagatg

SEQ ID NO: 121705 - DNA, 103 bp, Artificial Sequence
  Synthetic Polynucleotide
taatacgactcactataggggcaccgagctgtcgtggtgcgggtactcgcaacagaggagagcgagtatgcgcaccacgaacctggcggcagcgcaaaagatg

SEQ ID NO: 121706 - DNA, 103 bp, Artificial Sequence
  Synthetic Polynucleotide
taatacgactcactatagggggggaggcgggcaccgagctgtcgtggtgcaacagaggagagcaccaatgcagctcggtaacctggcggcagcgcaaaagatg

SEQ ID NO: 121707 - DNA, 103 bp, Artificial Sequence
  Synthetic Polynucleotide
taatacgactcactataggggggcagcagcggggaggcgggcaccgagctaacagaggagaagctcgatgcccgcctccaacctggcggcagcgcaaaagatg

SEQ ID NO: 121708 - DNA, 103 bp, Artificial Sequence
  Synthetic Polynucleotide
taatacgactcactatagggcggcgccggtgggcagcagcggggaggcggaacagaggagaccgcctatgcgctgctgcaacctggcggcagcgcaaaagatg

SEQ ID NO: 121709 - DNA, 103 bp, Artificial Sequence
  Synthetic Polynucleotide
taatacgactcactatagggatgaccccaccggcgccggtgggcagcagcaacagaggagagctgctatgcaccggcgcaacctggcggcagcgcaaaagatg

SEQ ID NO: 121710 - DNA, 103 bp, Artificial Sequence
  Synthetic Polynucleotide
taatacgactcactataggggtgcggctccatgaccccaccggcgccggtaacagaggagaaccggcatgggtggggtcaacctggcggcagcgcaaaagatg

SEQ ID NO: 121711 - DNA, 103 bp, Artificial Sequence
  Synthetic Polynucleotide
taatacgactcactatagggagtagacggcgtgcggctccatgaccccacaacagaggagagtggggatgtggagccgcaacctggcggcagcgcaaaagatg

SEQ ID NO: 121712 - DNA, 103 bp, Artificial Sequence
  Synthetic Polynucleotide
taatacgactcactataggggccgagcccgagtagacggcgtgcggctccaacagaggagaggagccatgcgccgtctaaacctggcggcagcgcaaaagatg

SEQ ID NO: 121713 - DNA, 103 bp, Artificial Sequence
  Synthetic Polynucleotide
taatacgactcactatagggccaggccgccgccgagcccgagtagacggcaacagaggagagccgtcatgtcgggctcgaacctggcggcagcgcaaaagatg

SEQ ID NO: 121714 - DNA, 103 bp, Artificial Sequence
  Synthetic Polynucleotide
taatacgactcactatagggacgggccggacgacgcggggtccatggccgaacagaggagacggccaatgaccccgcgtaacctggcggcagcgcaaaagatg

SEQ ID NO: 121715 - DNA, 103 bp, Artificial Sequence
  Synthetic Polynucleotide
taatacgactcactatagggccgagggcggccaggccgccgccgagcccgaacagaggagacgggctatgcggcggcctaacctggcggcagcgcaaaagatg

SEQ ID NO: 121716 - DNA, 103 bp, Artificial Sequence
  Synthetic Polynucleotide
taatacgactcactataggggccgcggacgccgagggcggccaggccgccaacagaggagaggcggcatggccgccctcaacctggcggcagcgcaaaagatg

SEQ ID NO: 121717 - DNA, 103 bp, Artificial Sequence
  Synthetic Polynucleotide
taatacgactcactataggggctgttgagcgccgcggacgccgagggcggaacagaggagaccgcccatggcgtccgcgaacctggcggcagcgcaaaagatg

SEQ ID NO: 121718 - DNA, 103 bp, Artificial Sequence
  Synthetic Polynucleotide
taatacgactcactatagggaagaggcgccgctgttgagcgccgcggacgaacagaggagacgtccgatgcgctcaacaaacctggcggcagcgcaaaagatg

SEQ ID NO: 121719 - DNA, 103 bp, Artificial Sequence
  Synthetic Polynucleotide
taatacgactcactatagggtgcttgatataagaggcgccgctgttgagcaacagaggagagctcaaatgcggcgcctcaacctggcggcagcgcaaaagatg

SEQ ID NO: 121720 - DNA, 103 bp, Artificial Sequence
  Synthetic Polynucleotide
taatacgactcactatagggcaggggctgctgcttgatataagaggcgccaacagaggagaggcgccatgtatatcaagaacctggcggcagcgcaaaagatg

SEQ ID NO: 121721 - DNA, 103 bp, Artificial Sequence
  Synthetic Polynucleotide
taatacgactcactatagggtacagggggacaggggctgctgcttgatataacagaggagaatatcaatgagcagccccaacctggcggcagcgcaaaagatg

SEQ ID NO: 121722 - DNA, 103 bp, Artificial Sequence
  Synthetic Polynucleotide
taatacgactcactataggggccgcggggttacagggggacaggggctgcaacagaggagagcagccatggtccccctgaacctggcggcagcgcaaaagatg

SEQ ID NO: 121723 - DNA, 103 bp, Artificial Sequence
  Synthetic Polynucleotide
taatacgactcactatagggcagggggttggccgcggggttacagggggaaacagaggagatcccccatgaaccccgcgaacctggcggcagcgcaaaagatg

SEQ ID NO: 121724 - DNA, 103 bp, Artificial Sequence
  Synthetic Polynucleotide
taatacgactcactatagggggctgccggacagggggttggccgcggggtaacagaggagaaccccgatgccaacccccaacctggcggcagcgcaaaagatg

SEQ ID NO: 121725 - DNA, 103 bp, Artificial Sequence
  Synthetic Polynucleotide
taatacgactcactatagggttggccttggacgggccggacgacgcggggaacagaggagaccccgcatggtccggcccaacctggcggcagcgcaaaagatg

SEQ ID NO: 121726 - DNA, 103 bp, Artificial Sequence
  Synthetic Polynucleotide
taatacgactcactatagggtgcgtggagaggctgccggacagggggttgaacagaggagacaacccatggtccggcagaacctggcggcagcgcaaaagatg

SEQ ID NO: 121727 - DNA, 103 bp, Artificial Sequence
  Synthetic Polynucleotide
taatacgactcactatagggctccagggagtgcgtggagaggctgccggaaacagaggagatccggcatgctctccacgaacctggcggcagcgcaaaagatg

SEQ ID NO: 121728 - DNA, 103 bp, Artificial Sequence
  Synthetic Polynucleotide
taatacgactcactataggggatacggctgctccagggagtgcgtggagaaacagaggagatctccaatgactccctggaacctggcggcagcgcaaaagatg

SEQ ID NO: 121729 - DNA, 103 bp, Artificial Sequence
  Synthetic Polynucleotide
taatacgactcactatagggttctggtgcagatacggctgctccagggagaacagaggagactccctatggcagccgtaaacctggcggcagcgcaaaagatg

SEQ ID NO: 121730 - DNA, 103 bp, Artificial Sequence
  Synthetic Polynucleotide
taatacgactcactataggggttgtggctgttctggtgcagatacggctgaacagaggagacagccgatgctgcaccagaacctggcggcagcgcaaaagatg

SEQ ID NO: 121731 - DNA, 103 bp, Artificial Sequence
  Synthetic Polynucleotide
taatacgactcactatagggcggctggggcgttgtggctgttctggtgcaaacagaggagatgcaccatgacagccacaaacctggcggcagcgcaaaagatg

SEQ ID NO: 121732 - DNA, 103 bp, Artificial Sequence
  Synthetic Polynucleotide
taatacgactcactatagggccttgcagctcggctggggcgttgtggctgaacagaggagacagccaatgcgccccagcaacctggcggcagcgcaaaagatg

SEQ ID NO: 121733 - DNA, 103 bp, Artificial Sequence
  Synthetic Polynucleotide
taatacgactcactatagggccgcgggatgccttgcagctcggctggggcaacagaggagagccccaatggagctgcaaaacctggcggcagcgcaaaagatg

SEQ ID NO: 121734 - DNA, 103 bp, Artificial Sequence
  Synthetic Polynucleotide
taatacgactcactataggggcgagtgataccgcgggatgccttgcagctaacagaggagaagctgcatggcatcccgcaacctggcggcagcgcaaaagatg

SEQ ID NO: 121735 - DNA, 103 bp, Artificial Sequence
  Synthetic Polynucleotide
taatacgactcactatagggctgggcgactgcgagtgataccgcgggatgaacagaggagacatcccatggtatcactcaacctggcggcagcgcaaaagatg

SEQ ID NO: 121736 - DNA, 103 bp, Artificial Sequence
  Synthetic Polynucleotide
taatacgactcactatagggggccggcggcggcccgccctcggtggtcataacagaggagaatgaccatggagggcgggaacctggcggcagcgcaaaagatg

SEQ ID NO: 121737 - DNA, 103 bp, Artificial Sequence
  Synthetic Polynucleotide
taatacgactcactatagggggcggcggcggcggcggcggcggcgggcggaacagaggagaccgcccatggccgccgccaacctggcggcagcgcaaaagatg

SEQ ID NO: 121738 - DNA, 103 bp, Artificial Sequence
  Synthetic Polynucleotide
taatacgactcactatagggccagtgcgccgcagggctcgtgtagggcgaaacagaggagatcgcccatgacgagccctaacctggcggcagcgcaaaagatg

SEQ ID NO: 121739 - DNA, 103 bp, Artificial Sequence
  Synthetic Polynucleotide
taatacgactcactatagggcaggcgagctccagtgcgccgcagggctcgaacagaggagacgagccatgcggcgcactaacctggcggcagcgcaaaagatg

SEQ ID NO: 121740 - DNA, 103 bp, Artificial Sequence
  Synthetic Polynucleotide
taatacgactcactatagggggcgaggcgccaggcgagctccagtgcgccaacagaggagaggcgcaatggagctcgccaacctggcggcagcgcaaaagatg

SEQ ID NO: 121741 - DNA, 103 bp, Artificial Sequence
  Synthetic Polynucleotide
taatacgactcactatagggcttgaggtaaggcgaggcgccaggcgagctaacagaggagaagctcgatgggcgcctcgaacctggcggcagcgcaaaagatg

SEQ ID NO: 121742 - DNA, 103 bp, Artificial Sequence
  Synthetic Polynucleotide
taatacgactcactatagggcaggcggctgcttgaggtaaggcgaggcgcaacagaggagagcgcctatgcttacctcaaacctggcggcagcgcaaaagatg

SEQ ID NO: 121743 - DNA, 103 bp, Artificial Sequence
  Synthetic Polynucleotide
taatacgactcactatagggggcgtcagggcaggcggctgcttgaggtaaaacagaggagattacctatggcagccgccaacctggcggcagcgcaaaagatg

SEQ ID NO: 121744 - DNA, 103 bp, Artificial Sequence
  Synthetic Polynucleotide
taatacgactcactataggggttgctgctgggcgtcagggcaggcggctgaacagaggagacagccgatggccctgacgaacctggcggcagcgcaaaagatg

SEQ ID NO: 121745 - DNA, 103 bp, Artificial Sequence
  Synthetic Polynucleotide
taatacgactcactatagggaggcggcggggttgctgctgggcgtcagggaacagaggagaccctgaatgccagcagcaaacctggcggcagcgcaaaagatg

SEQ ID NO: 121746 - DNA, 103 bp, Artificial Sequence
  Synthetic Polynucleotide
taatacgactcactatagggaggcctgccgaggcggcggggttgctgctgaacagaggagacagcagatgccccgccgcaacctggcggcagcgcaaaagatg

SEQ ID NO: 121747 - DNA, 103 bp, Artificial Sequence
  Synthetic Polynucleotide
taatacgactcactataggggctggagtgcaggcctgccgaggcggcgggaacagaggagacccgccatgtcggcaggcaacctggcggcagcgcaaaagatg

SEQ ID NO: 121748 - DNA, 103 bp, Artificial Sequence
  Synthetic Polynucleotide
taatacgactcactatagggtctccggggcggcggcggcggcggcggcggaacagaggagaccgccgatgccgccgccgaacctggcggcagcgcaaaagatg

SEQ ID NO: 121749 - DNA, 103 bp, Artificial Sequence
  Synthetic Polynucleotide
taatacgactcactatagggaggaggacatgctggagtgcaggcctgccgaacagaggagacggcagatgtgcactccaaacctggcggcagcgcaaaagatg

SEQ ID NO: 121750 - DNA, 103 bp, Artificial Sequence
  Synthetic Polynucleotide
taatacgactcactatagggtccagcgagtaggaggacatgctggagtgcaacagaggagagcactcatgcatgtcctcaacctggcggcagcgcaaaagatg

SEQ ID NO: 121751 - DNA, 103 bp, Artificial Sequence
  Synthetic Polynucleotide
taatacgactcactataggggtagctctgctccagcgagtaggaggacataacagaggagaatgtccatgtactcgctgaacctggcggcagcgcaaaagatg

SEQ ID NO: 121752 - DNA, 103 bp, Artificial Sequence
  Synthetic Polynucleotide
taatacgactcactatagggtctggtgcaagtagctctgctccagcgagtaacagaggagaactcgcatgagcagagctaacctggcggcagcgcaaaagatg

SEQ ID NO: 121753 - DNA, 103 bp, Artificial Sequence
  Synthetic Polynucleotide
taatacgactcactatagggtcgcgagcgttctggtgcaagtagctctgcaacagaggagagcagagatgcttgcaccaaacctggcggcagcgcaaaagatg

SEQ ID NO: 121754 - DNA, 103 bp, Artificial Sequence
  Synthetic Polynucleotide
taatacgactcactatagggtgagaggtcctcgcgagcgttctggtgcaaaacagaggagattgcacatgaacgctcgcaacctggcggcagcgcaaaagatg

SEQ ID NO: 121755 - DNA, 103 bp, Artificial Sequence
  Synthetic Polynucleotide
taatacgactcactataggggcagtcccactgagaggtcctcgcgagcgtaacagaggagaacgctcatgaggacctctaacctggcggcagcgcaaaagatg

SEQ ID NO: 121756 - DNA, 103 bp, Artificial Sequence
  Synthetic Polynucleotide
taatacgactcactatagggtggtaacggggcagtcccactgagaggtccaacagaggagaggacctatgagtgggactaacctggcggcagcgcaaaagatg

SEQ ID NO: 121757 - DNA, 103 bp, Artificial Sequence
  Synthetic Polynucleotide
taatacgactcactatagggagagtgatgctggtaacggggcagtcccacaacagaggagagtgggaatgccccgttacaacctggcggcagcgcaaaagatg

SEQ ID NO: 121758 - DNA, 103 bp, Artificial Sequence
  Synthetic Polynucleotide
taatacgactcactatagggacactggagtagagtgatgctggtaacgggaacagaggagacccgttatgagcatcactaacctggcggcagcgcaaaagatg

SEQ ID NO: 121759 - DNA, 103 bp, Artificial Sequence
  Synthetic Polynucleotide
taatacgactcactataggggaggaggtggtctccggggcggcggcggcgaacagaggagacgccgcatgcgccccggaaacctggcggcagcgcaaaagatg

SEQ ID NO: 121760 - DNA, 103 bp, Artificial Sequence
  Synthetic Polynucleotide
taatacgactcactatagggtttctgtcacacactggagtagagtgatgcaacagaggagagcatcaatgtactccagtaacctggcggcagcgcaaaagatg

SEQ ID NO: 121761 - DNA, 103 bp, Artificial Sequence
  Synthetic Polynucleotide
taatacgactcactataggggacgaaatcttttctgtcacacactggagtaacagaggagaactccaatgtgtgacagaaacctggcggcagcgcaaaagatg

SEQ ID NO: 121762 - DNA, 103 bp, Artificial Sequence
  Synthetic Polynucleotide
taatacgactcactatagggtgaagttgaggacgaaatcttttctgtcacaacagaggagagtgacaatgaagatttcgaacctggcggcagcgcaaaagatg

SEQ ID NO: 121763 - DNA, 103 bp, Artificial Sequence
  Synthetic Polynucleotide
taatacgactcactataggggaaatcccattgaagttgaggacgaaatctaacagaggagaagatttatgcctcaacttaacctggcggcagcgcaaaagatg

SEQ ID NO: 121764 - DNA, 103 bp, Artificial Sequence
  Synthetic Polynucleotide
taatacgactcactatagggatggaaagaagaaatcccattgaagttgagaacagaggagactcaacatgaatgggattaacctggcggcagcgcaaaagatg

SEQ ID NO: 121765 - DNA, 103 bp, Artificial Sequence
  Synthetic Polynucleotide
taatacgactcactatagggtagctgagggatggaaagaagaaatcccataacagaggagaatgggaatgcttctttccaacctggcggcagcgcaaaagatg

SEQ ID NO: 121766 - DNA, 103 bp, Artificial Sequence
  Synthetic Polynucleotide
taatacgactcactatagggtacgacccgctagctgagggatggaaagaaaacagaggagattctttatgtccctcagcaacctggcggcagcgcaaaagatg

SEQ ID NO: 121767 - DNA, 103 bp, Artificial Sequence
  Synthetic Polynucleotide
taatacgactcactatagggatggtgataatacgacccgctagctgagggaacagaggagaccctcaatgagcgggtcgaacctggcggcagcgcaaaagatg

SEQ ID NO: 121768 - DNA, 103 bp, Artificial Sequence
  Synthetic Polynucleotide
taatacgactcactatagggtctggtggtgatggtgataatacgacccgcaacagaggagagcgggtatgattatcaccaacctggcggcagcgcaaaagatg

SEQ ID NO: 121769 - DNA, 103 bp, Artificial Sequence
  Synthetic Polynucleotide
taatacgactcactatagggtgacagacgctctggtggtgatggtgataaaacagaggagattatcaatgtcaccaccaaacctggcggcagcgcaaaagatg

SEQ ID NO: 121770 - DNA, 103 bp, Artificial Sequence
  Synthetic Polynucleotide
taatacgactcactatagggcgacgaggaggaggaggtggtctccggggcaacagaggagagccccgatgaccacctccaacctggcggcagcgcaaaagatg

SEQ ID NO: 121771 - DNA, 103 bp, Artificial Sequence
  Synthetic Polynucleotide
taatacgactcactatagggcttaatatcctgacagacgctctggtggtgaacagaggagacaccacatgagcgtctgtaacctggcggcagcgcaaaagatg

SEQ ID NO: 121772 - DNA, 103 bp, Artificial Sequence
  Synthetic Polynucleotide
taatacgactcactatagggtgacgcagggcttaatatcctgacagacgcaacagaggagagcgtctatgaggatattaaacctggcggcagcgcaaaagatg

SEQ ID NO: 121773 - DNA, 103 bp, Artificial Sequence
  Synthetic Polynucleotide
taatacgactcactatagggcggaggacgacgacgaggaggaggaggtggaacagaggagaccacctatgcctcctcgtaacctggcggcagcgcaaaagatg

SEQ ID NO: 121774 - DNA, 103 bp, Artificial Sequence
  Synthetic Polynucleotide
taatacgactcactataggggcgcaggaggcggaggacgacgacgaggagaacagaggagactcctcatggtcgtcctcaacctggcggcagcgcaaaagatg

SEQ ID NO: 121775 - DNA, 103 bp, Artificial Sequence
  Synthetic Polynucleotide
taatacgactcactatagggcgaggacgaggcgcaggaggcggaggacgaaacagaggagatcgtccatggcctcctgcaacctggcggcagcgcaaaagatg

SEQ ID NO: 121776 - DNA, 103 bp, Artificial Sequence
  Synthetic Polynucleotide
taatacgactcactatagggtggaggaggacgaggacgaggcgcaggaggaacagaggagacctcctatgcctcgtcctaacctggcggcagcgcaaaagatg

SEQ ID NO: 121777 - DNA, 103 bp, Artificial Sequence
  Synthetic Polynucleotide
taatacgactcactatagggctggccgaattggaggaggacgaggacgagaacagaggagactcgtcatggtcctcctcaacctggcggcagcgcaaaagatg

SEQ ID NO: 121778 - DNA, 103 bp, Artificial Sequence
  Synthetic Polynucleotide
taatacgactcactatagggcgagggggcgctggccgaattggaggaggaaacagaggagatcctccatgaattcggccaacctggcggcagcgcaaaagatg

SEQ ID NO: 121779 - DNA, 103 bp, Artificial Sequence
  Synthetic Polynucleotide
taatacgactcactatagggggcggagcggggccggcggcggcccgccctaacagaggagaagggcgatgcgccgccggaacctggcggcagcgcaaaagatg

SEQ ID NO: 121780 - DNA, 103 bp, Artificial Sequence
  Synthetic Polynucleotide
taatacgactcactatagggtgcaggcagccgagggggcgctggccgaataacagaggagaattcggatggcgccccctaacctggcggcagcgcaaaagatg

SEQ ID NO: 121781 - DNA, 103 bp, Artificial Sequence
  Synthetic Polynucleotide
taatacgactcactatagggcccgcgctcttgcaggcagccgagggggcgaacagaggagacgccccatgggctgcctgaacctggcggcagcgcaaaagatg

SEQ ID NO: 121782 - DNA, 103 bp, Artificial Sequence
  Synthetic Polynucleotide
taatacgactcactataggggccgccgccgcccgcgctcttgcaggcagcaacagaggagagctgccatgaagagcgcgaacctggcggcagcgcaaaagatg

SEQ ID NO: 121783 - DNA, 103 bp, Artificial Sequence
  Synthetic Polynucleotide
taatacgactcactatagggcggcgcccgcgccgccgccgcccgcgctctaacagaggagaagagcgatggcggcggcgaacctggcggcagcgcaaaagatg

SEQ ID NO: 121784 - DNA, 103 bp, Artificial Sequence
  Synthetic Polynucleotide
taatacgactcactatagggcccccgctcccggcgcccgcgccgccgccgaacagaggagacggcggatgcgcgggcgcaacctggcggcagcgcaaaagatg

SEQ ID NO: 121785 - DNA, 103 bp, Artificial Sequence
  Synthetic Polynucleotide
taatacgactcactatagggcttcttggcgcccccgctcccggcgcccgcaacagaggagagcgggcatggggagcgggaacctggcggcagcgcaaaagatg

SEQ ID NO: 121786 - DNA, 103 bp, Artificial Sequence
  Synthetic Polynucleotide
taatacgactcactatagggccgagctcgccttcttggcgcccccgctccaacagaggagaggagcgatggcgccaagaaacctggcggcagcgcaaaagatg

SEQ ID NO: 121787 - DNA, 103 bp, Artificial Sequence
  Synthetic Polynucleotide
taatacgactcactatagggcgccgcagccccgagctcgccttcttggcgaacagaggagacgccaaatgggcgagctcaacctggcggcagcgcaaaagatg

SEQ ID NO: 121788 - DNA, 103 bp, Artificial Sequence
  Synthetic Polynucleotide
taatacgactcactatagggcttctcgggccgccgcagccccgagctcgcaacagaggagagcgagcatggggctgcggaacctggcggcagcgcaaaagatg

SEQ ID NO: 121789 - DNA, 103 bp, Artificial Sequence
  Synthetic Polynucleotide
taatacgactcactatagggagtagggcggcttctcgggccgccgcagccaacagaggagaggctgcatgggcccgagaaacctggcggcagcgcaaaagatg

SEQ ID NO: 121790 - DNA, 103 bp, Artificial Sequence
  Synthetic Polynucleotide
taatacgactcactatagggctgcacgcgcggcggagcggggccggcggcaacagaggagagccgccatgcccgctccgaacctggcggcagcgcaaaagatg

SEQ ID NO: 121791 - DNA, 103 bp, Artificial Sequence
  Synthetic Polynucleotide
taatacgactcactataggggcgatgtacgagtagggcggcttctcgggcaacagaggagagcccgaatggccgccctaaacctggcggcagcgcaaaagatg

SEQ ID NO: 121792 - DNA, 103 bp, Artificial Sequence
  Synthetic Polynucleotide
taatacgactcactataggggacgatgagcgcgatgtacgagtagggcggaacagaggagaccgcccatgtcgtacatcaacctggcggcagcgcaaaagatg

SEQ ID NO: 121793 - DNA, 103 bp, Artificial Sequence
  Synthetic Polynucleotide
taatacgactcactatagggggatggccatgacgatgagcgcgatgtacgaacagaggagacgtacaatgcgctcatcgaacctggcggcagcgcaaaagatg

SEQ ID NO: 121794 - DNA, 103 bp, Artificial Sequence
  Synthetic Polynucleotide
taatacgactcactatagggggcgagctctggatggccatgacgatgagcaacagaggagagctcatatgcatggccataacctggcggcagcgcaaaagatg

SEQ ID NO: 121795 - DNA, 103 bp, Artificial Sequence
  Synthetic Polynucleotide
taatacgactcactataggggcgcttgctgggcgagctctggatggccataacagaggagaatggccatgcagagctcgaacctggcggcagcgcaaaagatg

SEQ ID NO: 121796 - DNA, 103 bp, Artificial Sequence
  Synthetic Polynucleotide
taatacgactcactatagggtgagcgtcaggcgcttgctgggcgagctctaacagaggagaagagctatgccagcaagcaacctggcggcagcgcaaaagatg

SEQ ID NO: 121797 - DNA, 103 bp, Artificial Sequence
  Synthetic Polynucleotide
taatacgactcactatagggtagatctcgctgagcgtcaggcgcttgctgaacagaggagacagcaaatgcctgacgctaacctggcggcagcgcaaaagatg

SEQ ID NO: 121798 - DNA, 103 bp, Artificial Sequence
  Synthetic Polynucleotide
taatacgactcactatagggcaggaactggtagatctcgctgagcgtcagaacagaggagactgacgatgagcgagatcaacctggcggcagcgcaaaagatg

SEQ ID NO: 121799 - DNA, 103 bp, Artificial Sequence
  Synthetic Polynucleotide
taatacgactcactatagggagcgcgcctgcaggaactggtagatctcgcaacagaggagagcgagaatgaccagttccaacctggcggcagcgcaaaagatg

SEQ ID NO: 121800 - DNA, 103 bp, Artificial Sequence
  Synthetic Polynucleotide
taatacgactcactatagggaagaaggggaagcgcgcctgcaggaactggaacagaggagaccagttatggcaggcgcgaacctggcggcagcgcaaaagatg

SEQ ID NO: 121801 - DNA, 103 bp, Artificial Sequence
  Synthetic Polynucleotide
taatacgactcactatagggggggaccgggctgcacgcgcggcggagcggaacagaggagaccgctcatgcgcgcgtgcaacctggcggcagcgcaaaagatg

SEQ ID NO: 121802 - DNA, 103 bp, Artificial Sequence
  Synthetic Polynucleotide
taatacgactcactatagggggcgccgcggaagaaggggaagcgcgcctgaacagaggagacaggcgatgttccccttcaacctggcggcagcgcaaaagatg

SEQ ID NO: 121803 - DNA, 103 bp, Artificial Sequence
  Synthetic Polynucleotide
taatacgactcactatagggagccctggtaggcgccgcggaagaaggggaaacagaggagatcccctatgtccgcggcgaacctggcggcagcgcaaaagatg

SEQ ID NO: 121804 - DNA, 103 bp, Artificial Sequence
  Synthetic Polynucleotide
taatacgactcactataggggagttcttccagccctggtaggcgccgcggaacagaggagaccgcggatgctaccagggaacctggcggcagcgcaaaagatg

SEQ ID NO: 121805 - DNA, 103 bp, Artificial Sequence
  Synthetic Polynucleotide
taatacgactcactataggggtggcgcaccgagttcttccagccctggtaaacagaggagataccagatgtggaagaacaacctggcggcagcgcaaaagatg

SEQ ID NO: 121806 - DNA, 103 bp, Artificial Sequence
  Synthetic Polynucleotide
taatacgactcactataggggcgagagattgtggcgcaccgagttcttccaacagaggagaggaagaatgcggtgcgccaacctggcggcagcgcaaaagatg

SEQ ID NO: 121807 - DNA, 103 bp, Artificial Sequence
  Synthetic Polynucleotide
taatacgactcactatagggcactcgttgagcgagagattgtggcgcaccaacagaggagaggtgcgatgcaatctctcaacctggcggcagcgcaaaagatg

SEQ ID NO: 121808 - DNA, 103 bp, Artificial Sequence
  Synthetic Polynucleotide
taatacgactcactatagggcttgatgaagcactcgttgagcgagagattaacagaggagaaatctcatgctcaacgagaacctggcggcagcgcaaaagatg

SEQ ID NO: 121809 - DNA, 103 bp, Artificial Sequence
  Synthetic Polynucleotide
taatacgactcactatagggccttaggcagcttgatgaagcactcgttgaaacagaggagatcaacgatggcttcatcaaacctggcggcagcgcaaaagatg

SEQ ID NO: 121810 - DNA, 103 bp, Artificial Sequence
  Synthetic Polynucleotide
taatacgactcactatagggcgcccgaggcccttaggcagcttgatgaagaacagaggagacttcatatggctgcctaaaacctggcggcagcgcaaaagatg

SEQ ID NO: 121811 - DNA, 103 bp, Artificial Sequence
  Synthetic Polynucleotide
taatacgactcactatagggcttgccgggccgcccgaggcccttaggcagaacagaggagactgcctatgggcctcgggaacctggcggcagcgcaaaagatg

SEQ ID NO: 121812 - DNA, 103 bp, Artificial Sequence
  Synthetic Polynucleotide
taatacgactcactatagggggagcgcgccggggaccgggctgcacgcgcaacagaggagagcgcgtatggcccggtccaacctggcggcagcgcaaaagatg

SEQ ID NO: 121813 - DNA, 103 bp, Artificial Sequence
  Synthetic Polynucleotide
taatacgactcactatagggagtagtggcccttgccgggccgcccgaggcaacagaggagagcctcgatgggcccggcaaacctggcggcagcgcaaaagatg

SEQ ID NO: 121814 - DNA, 103 bp, Artificial Sequence
  Synthetic Polynucleotide
taatacgactcactatagggtcgatggtccagtagtggcccttgccgggcaacagaggagagcccggatggggccactaaacctggcggcagcgcaaaagatg

SEQ ID NO: 121815 - DNA, 103 bp, Artificial Sequence
  Synthetic Polynucleotide
taatacgactcactataggggctggccgggtcgatggtccagtagtggccaacagaggagaggccacatgtggaccatcaacctggcggcagcgcaaaagatg

SEQ ID NO: 121816 - DNA, 103 bp, Artificial Sequence
  Synthetic Polynucleotide
taatacgactcactatagggacatgaactcgctggccgggtcgatggtccaacagaggagaggaccaatgacccggccaaacctggcggcagcgcaaaagatg

SEQ ID NO: 121817 - DNA, 103 bp, Artificial Sequence
  Synthetic Polynucleotide
taatacgactcactatagggccctcctcgaacatgaactcgctggccgggaacagaggagacccggcatgcgagttcataacctggcggcagcgcaaaagatg

SEQ ID NO: 121818 - DNA, 103 bp, Artificial Sequence
  Synthetic Polynucleotide
taatacgactcactataggggcggaacgagccctcctcgaacatgaactcaacagaggagagagttcatgttcgaggagaacctggcggcagcgcaaaagatg

SEQ ID NO: 121819 - DNA, 103 bp, Artificial Sequence
  Synthetic Polynucleotide
taatacgactcactataggggcggccggcggcggaacgagccctcctcgaaacagaggagatcgaggatggctcgttccaacctggcggcagcgcaaaagatg

SEQ ID NO: 121820 - DNA, 103 bp, Artificial Sequence
  Synthetic Polynucleotide
taatacgactcactatagggctgaagccgcgcggccggcggcggaacgagaacagaggagactcgttatgccgccggccaacctggcggcagcgcaaaagatg

SEQ ID NO: 121821 - DNA, 103 bp, Artificial Sequence
  Synthetic Polynucleotide
taatacgactcactataggggcacttccgcctgaagccgcgcggccggcgaacagaggagacgccggatgcgcggcttcaacctggcggcagcgcaaaagatg

SEQ ID NO: 121822 - DNA, 103 bp, Artificial Sequence
  Synthetic Polynucleotide
taatacgactcactatagggtgagcgcctggcacttccgcctgaagccgcaacagaggagagcggctatgggcggaagtaacctggcggcagcgcaaaagatg

SEQ ID NO: 121823 - DNA, 103 bp, Artificial Sequence
  Synthetic Polynucleotide
taatacgactcactatagggagggcggcctggagcgcgccggggaccgggaacagaggagacccggtatgcggcgcgctaacctggcggcagcgcaaaagatg

SEQ ID NO: 121824 - DNA, 103 bp, Artificial Sequence
  Synthetic Polynucleotide
taatacgactcactatagggtacatgggcttgagcgcctggcacttccgcaacagaggagagcggaaatgccaggcgctaacctggcggcagcgcaaaagatg

SEQ ID NO: 121825 - DNA, 103 bp, Artificial Sequence
  Synthetic Polynucleotide
taatacgactcactatagggcacgcggtggtacatgggcttgagcgcctgaacagaggagacaggcgatgaagcccatgaacctggcggcagcgcaaaagatg

SEQ ID NO: 121826 - DNA, 103 bp, Artificial Sequence
  Synthetic Polynucleotide
taatacgactcactatagggagccgctcaccacgcggtggtacatgggctaacagaggagaagcccaatgaccaccgcgaacctggcggcagcgcaaaagatg

SEQ ID NO: 121827 - DNA, 103 bp, Artificial Sequence
  Synthetic Polynucleotide
taatacgactcactatagggccgaagcccaagccgctcaccacgcggtggaacagaggagaccaccgatgggtgagcggaacctggcggcagcgcaaaagatg

SEQ ID NO: 121828 - DNA, 103 bp, Artificial Sequence
  Synthetic Polynucleotide
taatacgactcactatagggcagcgacgccccgaagcccaagccgctcacaacagaggagagtgagcatgttgggcttcaacctggcggcagcgcaaaagatg

SEQ ID NO: 121829 - DNA, 103 bp, Artificial Sequence
  Synthetic Polynucleotide
taatacgactcactatagggcctggggcagcagcgacgccccgaagcccaaacagaggagatgggctatggggcgtcgcaacctggcggcagcgcaaaagatg

SEQ ID NO: 121830 - DNA, 103 bp, Artificial Sequence
  Synthetic Polynucleotide
taatacgactcactatagggaagtcgaagccctggggcagcagcgacgccaacagaggagaggcgtcatggctgccccaaacctggcggcagcgcaaaagatg

SEQ ID NO: 121831 - DNA, 103 bp, Artificial Sequence
  Synthetic Polynucleotide
taatacgactcactataggggggcgcctggaagtcgaagccctggggcagaacagaggagactgcccatgggcttcgacaacctggcggcagcgcaaaagatg

SEQ ID NO: 121832 - DNA, 103 bp, Artificial Sequence
  Synthetic Polynucleotide
taatacgactcactataggggcgccgacgggggcgcctggaagtcgaagcaacagaggagagcttcgatgtccaggcgcaacctggcggcagcgcaaaagatg

SEQ ID NO: 121833 - DNA, 103 bp, Artificial Sequence
  Synthetic Polynucleotide
taatacgactcactatagggcagccgagcggcgccgacgggggcgcctggaacagaggagaccaggcatgcccgtcggcaacctggcggcagcgcaaaagatg

SEQ ID NO: 121834 - DNA, 103 bp, Artificial Sequence
  Synthetic Polynucleotide
taatacgactcactatagggcgggctcatcagggcggcctggagcgcgccaacagaggagaggcgcgatgcaggccgccaacctggcggcagcgcaaaagatg

SEQ ID NO: 121835 - DNA, 103 bp, Artificial Sequence
  Synthetic Polynucleotide
taatacgactcactatagggctggctgtggcagccgagcggcgccgacggaacagaggagaccgtcgatgccgctcggcaacctggcggcagcgcaaaagatg

SEQ ID NO: 121836 - DNA, 103 bp, Artificial Sequence
  Synthetic Polynucleotide
taatacgactcactatagggcgtagccgccctggctgtggcagccgagcgaacagaggagacgctcgatggccacagccaacctggcggcagcgcaaaagatg

SEQ ID NO: 121837 - DNA, 103 bp, Artificial Sequence
  Synthetic Polynucleotide
taatacgactcactatagggtcgaggccgccgtagccgccctggctgtggaacagaggagaccacagatggggcggctaaacctggcggcagcgcaaaagatg

SEQ ID NO: 121838 - DNA, 103 bp, Artificial Sequence
  Synthetic Polynucleotide
taatacgactcactataggggggcatcatgtcgaggccgccgtagccgccaacagaggagaggcggcatgggcggcctcaacctggcggcagcgcaaaagatg

SEQ ID NO: 121839 - DNA, 103 bp, Artificial Sequence
  Synthetic Polynucleotide
taatacgactcactatagggcgtagcccgcgggcatcatgtcgaggccgcaacagaggagagcggccatgacatgatgcaacctggcggcagcgcaaaagatg

SEQ ID NO: 121840 - DNA, 103 bp, Artificial Sequence
  Synthetic Polynucleotide
taatacgactcactataggggcgccggcgtcgtagcccgcgggcatcatgaacagaggagacatgatatgcgcgggctaaacctggcggcagcgcaaaagatg

SEQ ID NO: 121841 - DNA, 103 bp, Artificial Sequence
  Synthetic Polynucleotide
taatacgactcactataggggggggcgcccgcgccggcgtcgtagcccgcaacagaggagagcgggcatggacgccggcaacctggcggcagcgcaaaagatg

SEQ ID NO: 121842 - DNA, 103 bp, Artificial Sequence
  Synthetic Polynucleotide
taatacgactcactataggggcgcgtggctgggggcgcccgcgccggcgtaacagaggagaacgccgatgcgggcgcccaacctggcggcagcgcaaaagatg

SEQ ID NO: 121843 - DNA, 103 bp, Artificial Sequence
  Synthetic Polynucleotide
taatacgactcactatagggtggtgagggtgcgcgtggctgggggcgcccaacagaggagagggcgcatgcagccacgcaacctggcggcagcgcaaaagatg

SEQ ID NO: 121844 - DNA, 103 bp, Artificial Sequence
  Synthetic Polynucleotide
taatacgactcactataggggtggtggtggtggtgagggtgcgcgtggctaacagaggagaagccacatgcaccctcacaacctggcggcagcgcaaaagatg

SEQ ID NO: 121845 - DNA, 103 bp, Artificial Sequence
  Synthetic Polynucleotide
taatacgactcactatagggcggcgggcggcgggctcatcagggcggcctaacagaggagaaggccgatgtgatgagccaacctggcggcagcgcaaaagatg

SEQ ID NO: 121846 - DNA, 103 bp, Artificial Sequence
  Synthetic Polynucleotide
taatacgactcactatagggggacgtggtggtggtggtggtggtgagggtaacagaggagaaccctcatgaccaccaccaacctggcggcagcgcaaaagatg

SEQ ID NO: 121847 - DNA, 103 bp, Artificial Sequence
  Synthetic Polynucleotide
taatacgactcactataggggacatgtgcgggacgtggtggtggtggtggaacagaggagaccaccaatgccaccacgtaacctggcggcagcgcaaaagatg

SEQ ID NO: 121848 - DNA, 103 bp, Artificial Sequence
  Synthetic Polynucleotide
taatacgactcactatagggcgggttgggcgacatgtgcgggacgtggtgaacagaggagacaccacatgccgcacatgaacctggcggcagcgcaaaagatg

SEQ ID NO: 121849 - DNA, 103 bp, Artificial Sequence
  Synthetic Polynucleotide
taatacgactcactatagggaggtggaacccgggttgggcgacatgtgcgaacagaggagacgcacaatgcgcccaaccaacctggcggcagcgcaaaagatg

SEQ ID NO: 121850 - DNA, 103 bp, Artificial Sequence
  Synthetic Polynucleotide
taatacgactcactatagggctggccatgtaggtggaacccgggttgggcaacagaggagagcccaaatggggttccacaacctggcggcagcgcaaaagatg

SEQ ID NO: 121851 - DNA, 103 bp, Artificial Sequence
  Synthetic Polynucleotide
taatacgactcactatagggcaccgggcagctggccatgtaggtggaaccaacagaggagaggttccatgtacatggccaacctggcggcagcgcaaaagatg

SEQ ID NO: 121852 - DNA, 103 bp, Artificial Sequence
  Synthetic Polynucleotide
taatacgactcactataggggtcccgcgggcaccgggcagctggccatgtaacagaggagaacatggatggctgcccggaacctggcggcagcgcaaaagatg

SEQ ID NO: 121853 - DNA, 103 bp, Artificial Sequence
  Synthetic Polynucleotide
taatacgactcactatagggacgcccccgggtcccgcgggcaccgggcagaacagaggagactgcccatggcccgcgggaacctggcggcagcgcaaaagatg

SEQ ID NO: 121854 - DNA, 103 bp, Artificial Sequence
  Synthetic Polynucleotide
taatacgactcactatagggggccgcaccgacgcccccgggtcccgcgggaacagaggagacccgcgatgcccgggggcaacctggcggcagcgcaaaagatg

SEQ ID NO: 121855 - DNA, 103 bp, Artificial Sequence
  Synthetic Polynucleotide
taatacgactcactatagggcgccgcccccggccgcaccgacgcccccggaacagaggagaccggggatgtcggtgcggaacctggcggcagcgcaaaagatg

SEQ ID NO: 121856 - DNA, 103 bp, Artificial Sequence
  Synthetic Polynucleotide
taatacgactcactataggggcggcggcggcggcgggcggcgggctcatcaacagaggagagatgagatggccgcccgcaacctggcggcagcgcaaaagatg

SEQ ID NO: 121857 - DNA, 103 bp, Artificial Sequence
  Synthetic Polynucleotide
taatacgactcactatagggtcgccgccgccgccgcccccggccgcaccgaacagaggagacggtgcatgcgggggcggaacctggcggcagcgcaaaagatg

SEQ ID NO: 121858 - DNA, 103 bp, Artificial Sequence
  Synthetic Polynucleotide
taatacgactcactatagggcggcccgtagtcgccgccgccgccgcccccaacagaggagagggggcatgggcggcggcaacctggcggcagcgcaaaagatg

SEQ ID NO: 121859 - DNA, 103 bp, Artificial Sequence
  Synthetic Polynucleotide
taatacgactcactatagggtgctgctgtccggcccgtagtcgccgccgcaacagaggagagcggcgatgactacgggcaacctggcggcagcgcaaaagatg

SEQ ID NO: 121860 - DNA, 103 bp, Artificial Sequence
  Synthetic Polynucleotide
taatacgactcactatagggaccgggctgctgctgctgtccggcccgtagaacagaggagactacggatgggacagcagaacctggcggcagcgcaaaagatg

SEQ ID NO: 121861 - DNA, 103 bp, Artificial Sequence
  Synthetic Polynucleotide
taatacgactcactatagggggacgagggtaccgggctgctgctgctgtcaacagaggagagacagcatgagcagcccgaacctggcggcagcgcaaaagatg

SEQ ID NO: 121862 - DNA, 103 bp, Artificial Sequence
  Synthetic Polynucleotide
taatacgactcactatagggccatggccggggacgagggtaccgggctgcaacagaggagagcagccatgtaccctcgtaacctggcggcagcgcaaaagatg

SEQ ID NO: 121863 - DNA, 103 bp, Artificial Sequence
  Synthetic Polynucleotide
taatacgactcactatagggatggcgctcgccatggccggggacgagggtaacagaggagaaccctcatgcccggccataacctggcggcagcgcaaaagatg

SEQ ID NO: 121864 - DNA, 103 bp, Artificial Sequence
  Synthetic Polynucleotide
taatacgactcactataggggtggcattcgatggcgctcgccatggccggaacagaggagaccggccatggcgagcgccaacctggcggcagcgcaaaagatg

SEQ ID NO: 121865 - DNA, 103 bp, Artificial Sequence
  Synthetic Polynucleotide
taatacgactcactatagggtgtagggcgagtggcattcgatggcgctcgaacagaggagacgagcgatgtcgaatgccaacctggcggcagcgcaaaagatg

SEQ ID NO: 121866 - DNA, 103 bp, Artificial Sequence
  Synthetic Polynucleotide
taatacgactcactataggggcagggctcgtgtagggcgagtggcattcgaacagaggagacgaatgatgctcgccctaaacctggcggcagcgcaaaagatg

SEQ ID NO: 121867 - DNA, 103 bp, Artificial Sequence
  Synthetic Polynucleotide
taatacgactcactatagggccccaggcgggagccgctgcagggccccataacagaggagaatggggatgtgcagcggcaacctggcggcagcgcaaaagatg

SEQ ID NO: 121868 - DNA, 103 bp, Artificial Sequence
  Synthetic Polynucleotide
taatacgactcactatagggggccaagtaggtgtaggggggcttgtcatgaacagaggagacatgacatgcccccctacaacctggcggcagcgcaaaagatg

SEQ ID NO: 121869 - DNA, 103 bp, Artificial Sequence
  Synthetic Polynucleotide
taatacgactcactataggggatgcttttgttgggtggcaccccttggaaaacagaggagattccaaatggtgccacccaacctggcggcagcgcaaaagatg

SEQ ID NO: 121870 - DNA, 103 bp, Artificial Sequence
  Synthetic Polynucleotide
taatacgactcactatagggaaacgtcgtagatgcttttgttgggtggcaaacagaggagatgccacatgacaaaagcaaacctggcggcagcgcaaaagatg

SEQ ID NO: 121871 - DNA, 103 bp, Artificial Sequence
  Synthetic Polynucleotide
taatacgactcactatagggtggctgacccaaacgtcgtagatgcttttgaacagaggagacaaaagatgctacgacgtaacctggcggcagcgcaaaagatg

SEQ ID NO: 121872 - DNA, 103 bp, Artificial Sequence
  Synthetic Polynucleotide
taatacgactcactataggggtcccgagggtggctgacccaaacgtcgtaaacagaggagatacgacatgtgggtcagcaacctggcggcagcgcaaaagatg

SEQ ID NO: 121873 - DNA, 103 bp, Artificial Sequence
  Synthetic Polynucleotide
taatacgactcactataggggggccgccaggtcccgagggtggctgacccaacagaggagagggtcaatgaccctcgggaacctggcggcagcgcaaaagatg

SEQ ID NO: 121874 - DNA, 103 bp, Artificial Sequence
  Synthetic Polynucleotide
taatacgactcactatagggcctgggccaggggccgccaggtcccgagggaacagaggagaccctcgatgcctggcggcaacctggcggcagcgcaaaagatg

SEQ ID NO: 121875 - DNA, 103 bp, Artificial Sequence
  Synthetic Polynucleotide
taatacgactcactataggggagcagccagcctgggccaggggccgccagaacagaggagactggcgatgcctggcccaaacctggcggcagcgcaaaagatg

SEQ ID NO: 121876 - DNA, 103 bp, Artificial Sequence
  Synthetic Polynucleotide
taatacgactcactatagggtgcaccaggagagcagccagcctgggccagaacagaggagactggccatggctggctgcaacctggcggcagcgcaaaagatg

SEQ ID NO: 121877 - DNA, 103 bp, Artificial Sequence
  Synthetic Polynucleotide
taatacgactcactatagggaggcgatcatggccaagtaggtgtagggggaacagaggagaccccctatgcctacttggaacctggcggcagcgcaaaagatg

SEQ ID NO: 121878 - DNA, 103 bp, Artificial Sequence
  Synthetic Polynucleotide
taatacgactcactatagggtgaatcaccaaggcgatcatggccaagtagaacagaggagactacttatgcatgatcgcaacctggcggcagcgcaaaagatg

SEQ ID NO: 121879 - DNA, 103 bp, Artificial Sequence
  Synthetic Polynucleotide
taatacgactcactataggggggagcggcctgaatcaccaaggcgatcataacagaggagaatgatcatgttggtgattaacctggcggcagcgcaaaagatg

SEQ ID NO: 121880 - DNA, 103 bp, Artificial Sequence
  Synthetic Polynucleotide
taatacgactcactataggggtctgcgggagggagcggcctgaatcaccaaacagaggagatggtgaatgaggccgctcaacctggcggcagcgcaaaagatg

SEQ ID NO: 121881 - DNA, 103 bp, Artificial Sequence
  Synthetic Polynucleotide
taatacgactcactataggggccagcttcagtctgcgggagggagcggccaacagaggagaggccgcatgctcccgcagaacctggcggcagcgcaaaagatg

SEQ ID NO: 121882 - DNA, 103 bp, Artificial Sequence
  Synthetic Polynucleotide
taatacgactcactataggggatgatctgggccagcttcagtctgcgggaaacagaggagatcccgcatgctgaagctgaacctggcggcagcgcaaaagatg

SEQ ID NO: 121883 - DNA, 103 bp, Artificial Sequence
  Synthetic Polynucleotide
taatacgactcactatagggggacctgacggatgatctgggccagcttcaaacagaggagatgaagcatgcccagatcaaacctggcggcagcgcaaaagatg

SEQ ID NO: 121884 - DNA, 103 bp, Artificial Sequence
  Synthetic Polynucleotide
taatacgactcactatagggaacacggcctggacctgacggatgatctggaacagaggagaccagatatgccgtcaggtaacctggcggcagcgcaaaagatg

SEQ ID NO: 121885 - DNA, 103 bp, Artificial Sequence
  Synthetic Polynucleotide
taatacgactcactataggggaagaaggggaacacggcctggacctgacgaacagaggagacgtcagatgcaggccgtgaacctggcggcagcgcaaaagatg

SEQ ID NO: 121886 - DNA, 103 bp, Artificial Sequence
  Synthetic Polynucleotide
taatacgactcactatagggcctctgggggccccaggcgggagccgctgcaacagaggagagcagcgatgcccgcctggaacctggcggcagcgcaaaagatg

SEQ ID NO: 121887 - DNA, 103 bp, Artificial Sequence
  Synthetic Polynucleotide
taatacgactcactatagggagtcttccctgaagaaggggaacacggcctaacagaggagaaggccgatgtccccttctaacctggcggcagcgcaaaagatg

SEQ ID NO: 121888 - DNA, 103 bp, Artificial Sequence
  Synthetic Polynucleotide
taatacgactcactatagggcagccctcgtagtcttccctgaagaaggggaacagaggagaccccttatgcagggaagaaacctggcggcagcgcaaaagatg

SEQ ID NO: 121889 - DNA, 103 bp, Artificial Sequence
  Synthetic Polynucleotide
taatacgactcactatagggggagtctttccagccctcgtagtcttccctaacagaggagaagggaaatgtacgagggcaacctggcggcagcgcaaaagatg

SEQ ID NO: 121890 - DNA, 103 bp, Artificial Sequence
  Synthetic Polynucleotide
taatacgactcactatagggtgtggcgaatggagtctttccagccctcgtaacagaggagaacgaggatgggaaagactaacctggcggcagcgcaaaagatg

SEQ ID NO: 121891 - DNA, 103 bp, Artificial Sequence
  Synthetic Polynucleotide
taatacgactcactataggggaggaaaggttgtggcgaatggagtctttcaacagaggagagaaagaatgcattcgccaaacctggcggcagcgcaaaagatg

SEQ ID NO: 121892 - DNA, 103 bp, Artificial Sequence
  Synthetic Polynucleotide
taatacgactcactataggggcatcggttggaggaaaggttgtggcgaataacagaggagaattcgcatgaacctttccaacctggcggcagcgcaaaagatg

SEQ ID NO: 121893 - DNA, 103 bp, Artificial Sequence
  Synthetic Polynucleotide
taatacgactcactatagggccttgcggaagcatcggttggaggaaaggtaacagaggagaacctttatgccaaccgataacctggcggcagcgcaaaagatg

SEQ ID NO: 121894 - DNA, 103 bp, Artificial Sequence
  Synthetic Polynucleotide
taatacgactcactatagggtccttgggcaccttgcggaagcatcggttgaacagaggagacaaccgatgcttccgcaaaacctggcggcagcgcaaaagatg

SEQ ID NO: 121895 - DNA, 103 bp, Artificial Sequence
  Synthetic Polynucleotide
taatacgactcactatagggctttgcagggtccttgggcaccttgcggaaaacagaggagattccgcatggtgcccaagaacctggcggcagcgcaaaagatg

SEQ ID NO: 121896 - DNA, 103 bp, Artificial Sequence
  Synthetic Polynucleotide
taatacgactcactatagggtggcctggggctttgcagggtccttgggcaaacagaggagatgcccaatgaccctgcaaaacctggcggcagcgcaaaagatg

SEQ ID NO: 121897 - DNA, 103 bp, Artificial Sequence
  Synthetic Polynucleotide
taatacgactcactatagggggcgactctgcctctgggggccccaggcggaacagaggagaccgcctatggcccccagaaacctggcggcagcgcaaaagatg

SEQ ID NO: 121898 - DNA, 103 bp, Artificial Sequence
  Synthetic Polynucleotide
taatacgactcactatagggaagttgcccttggcctggggctttgcagggaacagaggagaccctgcatggccccaggcaacctggcggcagcgcaaaagatg

SEQ ID NO: 121899 - DNA, 103 bp, Artificial Sequence
  Synthetic Polynucleotide
taatacgactcactataggggaccgcccagaagttgcccttggcctggggaacagaggagaccccagatgaagggcaacaacctggcggcagcgcaaaagatg

SEQ ID NO: 121900 - DNA, 103 bp, Artificial Sequence
  Synthetic Polynucleotide
taatacgactcactatagggggctcacgtcgaccgcccagaagttgccctaacagaggagaagggcaatgtctgggcggaacctggcggcagcgcaaaagatg

SEQ ID NO: 121901 - DNA, 103 bp, Artificial Sequence
  Synthetic Polynucleotide
taatacgactcactataggggctgggatcaggctcacgtcgaccgcccagaacagaggagactgggcatgcgacgtgagaacctggcggcagcgcaaaagatg

SEQ ID NO: 121902 - DNA, 103 bp, Artificial Sequence
  Synthetic Polynucleotide
taatacgactcactataggggagcgcctcagctgggatcaggctcacgtcaacagaggagagacgtgatgctgatcccaaacctggcggcagcgcaaaagatg

SEQ ID NO: 121903 - DNA, 103 bp, Artificial Sequence
  Synthetic Polynucleotide
taatacgactcactatagggtctgcagccggagcgcctcagctgggatcaaacagaggagatgatccatgctgaggcgcaacctggcggcagcgcaaaagatg

SEQ ID NO: 121904 - DNA, 103 bp, Artificial Sequence
  Synthetic Polynucleotide
taatacgactcactatagggagggcggtgttctgcagccggagcgcctcaaacagaggagatgaggcatgccggctgcaaacctggcggcagcgcaaaagatg

SEQ ID NO: 121905 - DNA, 103 bp, Artificial Sequence
  Synthetic Polynucleotide
taatacgactcactataggggcgccggcacagggcggtgttctgcagccgaacagaggagacggctgatgaacaccgccaacctggcggcagcgcaaaagatg

SEQ ID NO: 121906 - DNA, 103 bp, Artificial Sequence
  Synthetic Polynucleotide
taatacgactcactatagggcgttctgccagcgccggcacagggcggtgtaacagaggagaacaccgatgtgtgccggcaacctggcggcagcgcaaaagatg

SEQ ID NO: 121907 - DNA, 103 bp, Artificial Sequence
  Synthetic Polynucleotide
taatacgactcactatagggcgcgcacctccgttctgccagcgccggcacaacagaggagagtgccgatgctggcagaaaacctggcggcagcgcaaaagatg

SEQ ID NO: 121908 - DNA, 103 bp, Artificial Sequence
  Synthetic Polynucleotide
taatacgactcactataggggggctgggagggcgactctgcctctgggggaacagaggagacccccaatggcagagtcgaacctggcggcagcgcaaaagatg

SEQ ID NO: 121909 - DNA, 103 bp, Artificial Sequence
  Synthetic Polynucleotide
taatacgactcactataggggaaggctccacgcgcacctccgttctgccaaacagaggagatggcagatgggaggtgcgaacctggcggcagcgcaaaagatg

SEQ ID NO: 121910 - DNA, 103 bp, Artificial Sequence
  Synthetic Polynucleotide
taatacgactcactatagggggtccttggcgaaggctccacgcgcacctcaacagaggagagaggtgatggtggagcctaacctggcggcagcgcaaaagatg

SEQ ID NO: 121911 - DNA, 103 bp, Artificial Sequence
  Synthetic Polynucleotide
taatacgactcactatagggtaggggcccaggtccttggcgaaggctccaaacagaggagatggagcatgcgccaaggaaacctggcggcagcgcaaaagatg

SEQ ID NO: 121912 - DNA, 103 bp, Artificial Sequence
  Synthetic Polynucleotide
taatacgactcactataggggtgcagcacgtaggggcccaggtccttggcaacagaggagagccaagatgctgggccccaacctggcggcagcgcaaaagatg

SEQ ID NO: 121913 - DNA, 103 bp, Artificial Sequence
  Synthetic Polynucleotide
taatacgactcactatagggatggccggccgtgcagcacgtaggggcccaaacagaggagatgggccatgacgtgctgcaacctggcggcagcgcaaaagatg

SEQ ID NO: 121914 - DNA, 103 bp, Artificial Sequence
  Synthetic Polynucleotide
taatacgactcactatagggggcggccggtatggccggccgtgcagcacgaacagaggagacgtgctatgcggccggccaacctggcggcagcgcaaaagatg

SEQ ID NO: 121915 - DNA, 103 bp, Artificial Sequence
  Synthetic Polynucleotide
taatacgactcactatagggcgggggactgggcggccggtatggccggccaacagaggagaggccggatgtaccggccgaacctggcggcagcgcaaaagatg

SEQ ID NO: 121916 - DNA, 103 bp, Artificial Sequence
  Synthetic Polynucleotide
taatacgactcactatagggtgggtggtggcgggggactgggcggccggtaacagaggagaaccggcatgccagtccccaacctggcggcagcgcaaaagatg

SEQ ID NO: 121917 - DNA, 103 bp, Artificial Sequence
  Synthetic Polynucleotide
taatacgactcactatagggaagccctcactgggtggtggcgggggactgaacagaggagacagtccatggccaccaccaacctggcggcagcgcaaaagatg

SEQ ID NO: 121918 - DNA, 103 bp, Artificial Sequence
  Synthetic Polynucleotide
taatacgactcactatagggcttgatgctgaagccctcactgggtggtggaacagaggagaccaccaatgagtgagggcaacctggcggcagcgcaaaagatg

SEQ ID NO: 121919 - DNA, 103 bp, Artificial Sequence
  Synthetic Polynucleotide
taatacgactcactatagggtcctcttagggggctgggagggcgactctgaacagaggagacagagtatgcctcccagcaacctggcggcagcgcaaaagatg

SEQ ID NO: 121920 - DNA, 103 bp, Artificial Sequence
  Synthetic Polynucleotide
taatacgactcactatagggctagcagggacttgatgctgaagccctcacaacagaggagagtgaggatgtcagcatcaaacctggcggcagcgcaaaagatg

SEQ ID NO: 121921 - DNA, 103 bp, Artificial Sequence
  Synthetic Polynucleotide
taatacgactcactatagggccggaccctcctagcagggacttgatgctgaacagaggagacagcatatggtccctgctaacctggcggcagcgcaaaagatg

SEQ ID NO: 121922 - DNA, 103 bp, Artificial Sequence
  Synthetic Polynucleotide
taatacgactcactatagggtgccccctccccggaccctcctagcagggaaacagaggagatccctgatgggagggtccaacctggcggcagcgcaaaagatg

SEQ ID NO: 121923 - DNA, 103 bp, Artificial Sequence
  Synthetic Polynucleotide
taatacgactcactatagggccggccagggtgccccctccccggaccctcaacagaggagagagggtatggggagggggaacctggcggcagcgcaaaagatg

SEQ ID NO: 121924 - DNA, 103 bp, Artificial Sequence
  Synthetic Polynucleotide
taatacgactcactatagggggagctagccccggccagggtgccccctccaacagaggagaggagggatgaccctggccaacctggcggcagcgcaaaagatg

SEQ ID NO: 121925 - DNA, 103 bp, Artificial Sequence
  Synthetic Polynucleotide
taatacgactcactataggggctgctctgtggagctagccccggccagggaacagaggagaccctggatggggctagctaacctggcggcagcgcaaaagatg

SEQ ID NO: 121926 - DNA, 103 bp, Artificial Sequence
  Synthetic Polynucleotide
taatacgactcactatagggcaggaactgggctgctctgtggagctagccaacagaggagaggctagatgcacagagcaaacctggcggcagcgcaaaagatg

SEQ ID NO: 121927 - DNA, 103 bp, Artificial Sequence
  Synthetic Polynucleotide
taatacgactcactatagggcctgtgcctgcaggaactgggctgctctgtaacagaggagaacagagatgcccagttccaacctggcggcagcgcaaaagatg

SEQ ID NO: 121928 - DNA, 103 bp, Artificial Sequence
  Synthetic Polynucleotide
taatacgactcactatagggcccactgttccctgtgcctgcaggaactggaacagaggagaccagttatggcaggcacaaacctggcggcagcgcaaaagatg

SEQ ID NO: 121929 - DNA, 103 bp, Artificial Sequence
  Synthetic Polynucleotide
taatacgactcactatagggccgcctcctccccactgttccctgtgcctgaacagaggagacaggcaatgggaacagtgaacctggcggcagcgcaaaagatg

SEQ ID NO: 121930 - DNA, 103 bp, Artificial Sequence
  Synthetic Polynucleotide
taatacgactcactatagggctcttcttcctcctcttagggggctgggagaacagaggagactcccaatgccctaagagaacctggcggcagcgcaaaagatg

SEQ ID NO: 121931 - DNA, 103 bp, Artificial Sequence
  Synthetic Polynucleotide
taatacgactcactatagggggggtgggcaccgcctcctccccactgttcaacagaggagagaacagatgggaggaggcaacctggcggcagcgcaaaagatg

SEQ ID NO: 121932 - DNA, 103 bp, Artificial Sequence
  Synthetic Polynucleotide
taatacgactcactataggggggaaggggtggggtgggcaccgcctcctcaacagaggagagaggagatggtgcccaccaacctggcggcagcgcaaaagatg

SEQ ID NO: 121933 - DNA, 103 bp, Artificial Sequence
  Synthetic Polynucleotide
taatacgactcactatagggtctcagaagagggaaggggtggggtgggcaaacagaggagatgcccaatgcaccccttcaacctggcggcagcgcaaaagatg

SEQ ID NO: 121934 - DNA, 103 bp, Artificial Sequence
  Synthetic Polynucleotide
taatacgactcactatagggcacagaggcctctcagaagagggaaggggtaacagaggagaacccctatgctcttctgaaacctggcggcagcgcaaaagatg

SEQ ID NO: 121935 - DNA, 103 bp, Artificial Sequence
  Synthetic Polynucleotide
taatacgactcactataggggcagaggggccacagaggcctctcagaagaaacagaggagatcttctatgaggcctctgaacctggcggcagcgcaaaagatg

SEQ ID NO: 121936 - DNA, 103 bp, Artificial Sequence
  Synthetic Polynucleotide
taatacgactcactatagggcaggaagggggcagaggggccacagaggccaacagaggagaggcctcatgggcccctctaacctggcggcagcgcaaaagatg

SEQ ID NO: 121937 - DNA, 103 bp, Artificial Sequence
  Synthetic Polynucleotide
taatacgactcactatagggctcgtggggccaggaagggggcagaggggcaacagaggagagcccctatgcccccttccaacctggcggcagcgcaaaagatg

SEQ ID NO: 121938 - DNA, 103 bp, Artificial Sequence
  Synthetic Polynucleotide
taatacgactcactatagggcccctccactctcgtggggccaggaaggggaacagaggagaccccttatgggccccacgaacctggcggcagcgcaaaagatg

SEQ ID NO: 121939 - DNA, 103 bp, Artificial Sequence
  Synthetic Polynucleotide
taatacgactcactataggggcacagtctccccctccactctcgtggggcaacagaggagagccccaatggagtggaggaacctggcggcagcgcaaaagatg

SEQ ID NO: 121940 - DNA, 103 bp, Artificial Sequence
  Synthetic Polynucleotide
taatacgactcactataggggctcccccctgcacagtctccccctccactaacagaggagaagtggaatgggagactgtaacctggcggcagcgcaaaagatg

SEQ ID NO: 121941 - DNA, 103 bp, Artificial Sequence
  Synthetic Polynucleotide
taatacgactcactatagggtcgcaggtacctcttcttcctcctcttaggaacagaggagacctaagatgaggaagaagaacctggcggcagcgcaaaagatg

SEQ ID NO: 121942 - DNA, 103 bp, Artificial Sequence
  Synthetic Polynucleotide
taatacgactcactataggggggcccgatggctcccccctgcacagtctcaacagaggagagagactatgcaggggggaaacctggcggcagcgcaaaagatg

SEQ ID NO: 121943 - DNA, 103 bp, Artificial Sequence
  Synthetic Polynucleotide
taatacgactcactatagggagagggttgagggcccgatggctcccccctaacagaggagaagggggatgccatcgggcaacctggcggcagcgcaaaagatg

SEQ ID NO: 121944 - DNA, 103 bp, Artificial Sequence
  Synthetic Polynucleotide
taatacgactcactatagggggctctggggagagggttgagggcccgatgaacagaggagacatcggatgctcaaccctaacctggcggcagcgcaaaagatg

SEQ ID NO: 121945 - DNA, 103 bp, Artificial Sequence
  Synthetic Polynucleotide
taatacgactcactatagggccaggccctaggctctggggagagggttgaaacagaggagatcaaccatgtccccagagaacctggcggcagcgcaaaagatg

SEQ ID NO: 121946 - DNA, 103 bp, Artificial Sequence
  Synthetic Polynucleotide
taatacgactcactatagggagtggagaggccaggccctaggctctggggaacagaggagaccccagatgctagggcctaacctggcggcagcgcaaaagatg

SEQ ID NO: 121947 - DNA, 103 bp, Artificial Sequence
  Synthetic Polynucleotide
taatacgactcactatagggccctgcagtaagtggagaggccaggccctaaacagaggagatagggcatggcctctccaaacctggcggcagcgcaaaagatg

SEQ ID NO: 121948 - DNA, 103 bp, Artificial Sequence
  Synthetic Polynucleotide
taatacgactcactatagggaactgcggtgccctgcagtaagtggagaggaacagaggagacctctcatgttactgcagaacctggcggcagcgcaaaagatg

SEQ ID NO: 121949 - DNA, 103 bp, Artificial Sequence
  Synthetic Polynucleotide
taatacgactcactataggggtcccccaggaactgcggtgccctgcagtaaacagaggagatactgcatggcaccgcagaacctggcggcagcgcaaaagatg

SEQ ID NO: 121950 - DNA, 103 bp, Artificial Sequence
  Synthetic Polynucleotide
taatacgactcactatagggccgctggaccgtcccccaggaactgcggtgaacagaggagacaccgcatgtcctgggggaacctggcggcagcgcaaaagatg

SEQ ID NO: 121951 - DNA, 103 bp, Artificial Sequence
  Synthetic Polynucleotide
taatacgactcactatagggcctgtgtcccccgctggaccgtcccccaggaacagaggagacctgggatgcggtccagcaacctggcggcagcgcaaaagatg

SEQ ID NO: 121952 - DNA, 103 bp, Artificial Sequence
  Synthetic Polynucleotide
taatacgactcactataggggcttgtcatgtcgcaggtacctcttcttccaacagaggagaggaagaatgggtacctgcaacctggcggcagcgcaaaagatg

SEQ ID NO: 121953 - DNA, 103 bp, Artificial Sequence
  Synthetic Polynucleotide
taatacgactcactatagggagagggaggccctgtgtcccccgctggaccaacagaggagaggtccaatgggggacacaaacctggcggcagcgcaaaagatg

SEQ ID NO: 121954 - DNA, 103 bp, Artificial Sequence
  Synthetic Polynucleotide
taatacgactcactatagggagctgcccccagagggaggccctgtgtcccaacagaggagagggacaatgggcctccctaacctggcggcagcgcaaaagatg

SEQ ID NO: 121955 - DNA, 103 bp, Artificial Sequence
  Synthetic Polynucleotide
taatacgactcactatagggggaggtgggcagctgcccccagagggaggcaacagaggagagcctccatgtgggggcagaacctggcggcagcgcaaaagatg

SEQ ID NO: 121956 - DNA, 103 bp, Artificial Sequence
  Synthetic Polynucleotide
taatacgactcactatagggtaggcaagtaggaggtgggcagctgcccccaacagaggagagggggcatgtgcccacctaacctggcggcagcgcaaaagatg

SEQ ID NO: 121957 - DNA, 103 bp, Artificial Sequence
  Synthetic Polynucleotide
taatacgactcactatagggggagtgtagataggcaagtaggaggtgggcaacagaggagagcccacatgctacttgccaacctggcggcagcgcaaaagatg

SEQ ID NO: 121958 - DNA, 103 bp, Artificial Sequence
  Synthetic Polynucleotide
taatacgactcactatagggtaccacattgggagtgtagataggcaagtaaacagaggagatacttgatgatctacactaacctggcggcagcgcaaaagatg

SEQ ID NO: 121959 - DNA, 103 bp, Artificial Sequence
  Synthetic Polynucleotide
taatacgactcactatagggccaagggcattaccacattgggagtgtagaaacagaggagatctacaatgccaatgtggaacctggcggcagcgcaaaagatg

SEQ ID NO: 121960 - DNA, 103 bp, Artificial Sequence
  Synthetic Polynucleotide
taatacgactcactatagggggtggtggtgccaagggcattaccacattgaacagaggagacaatgtatgaatgcccttaacctggcggcagcgcaaaagatg

SEQ ID NO: 121961 - DNA, 103 bp, Artificial Sequence
  Synthetic Polynucleotide
taatacgactcactatagggacaggaggtgggtggtggtgccaagggcataacagaggagaatgcccatggcaccaccaaacctggcggcagcgcaaaagatg

SEQ ID NO: 121962 - DNA, 103 bp, Artificial Sequence
  Synthetic Polynucleotide
taatacgactcactataggggacactggggacaggaggtgggtggtggtgaacagaggagacaccacatgccacctcctaacctggcggcagcgcaaaagatg

SEQ ID NO: 121963 - DNA, 103 bp, Artificial Sequence
  Synthetic Polynucleotide
taatacgactcactataggggtgtaggggggcttgtcatgtcgcaggtacaacagaggagagtacctatgacatgacaaaacctggcggcagcgcaaaagatg

SEQ ID NO: 121964 - DNA, 103 bp, Artificial Sequence
  Synthetic Polynucleotide
taatacgactcactatagggctggttgacggacactggggacaggaggtgaacagaggagacacctcatgtccccagtgaacctggcggcagcgcaaaagatg

SEQ ID NO: 121965 - DNA, 103 bp, Artificial Sequence
  Synthetic Polynucleotide
taatacgactcactataggggtaggcagggctggttgacggacactggggaacagaggagaccccagatgccgtcaaccaacctggcggcagcgcaaaagatg

SEQ ID NO: 121966 - DNA, 103 bp, Artificial Sequence
  Synthetic Polynucleotide
taatacgactcactatagggccaccccccagtaggcagggctggttgacgaacagaggagacgtcaaatggccctgcctaacctggcggcagcgcaaaagatg

SEQ ID NO: 121967 - DNA, 103 bp, Artificial Sequence
  Synthetic Polynucleotide
taatacgactcactataggggtttcaggggccaccccccagtaggcagggaacagaggagaccctgcatgctggggggtaacctggcggcagcgcaaaagatg

SEQ ID NO: 121968 - DNA, 103 bp, Artificial Sequence
  Synthetic Polynucleotide
taatacgactcactataggggggccctcgggtttcaggggccaccccccaaacagaggagatgggggatggcccctgaaaacctggcggcagcgcaaaagatg

SEQ ID NO: 121969 - DNA, 103 bp, Artificial Sequence
  Synthetic Polynucleotide
taatacgactcactataggggcagccctgggggccctcgggtttcaggggaacagaggagacccctgatgcccgagggcaacctggcggcagcgcaaaagatg

SEQ ID NO: 121970 - DNA, 103 bp, Artificial Sequence
  Synthetic Polynucleotide
taatacgactcactatagggagatcgcagagcagccctgggggccctcggaacagaggagaccgaggatgcccagggctaacctggcggcagcgcaaaagatg

SEQ ID NO: 121971 - DNA, 103 bp, Artificial Sequence
  Synthetic Polynucleotide
taatacgactcactataggggagggcgtctagatcgcagagcagccctggaacagaggagaccagggatgctctgcgataacctggcggcagcgcaaaagatg

SEQ ID NO: 121972 - DNA, 103 bp, Artificial Sequence
  Synthetic Polynucleotide
taatacgactcactatagggccccttggaagagggcgtctagatcgcagaaacagaggagatctgcgatgtagacgcccaacctggcggcagcgcaaaagatg

SEQ ID NO: 121973 - DNA, 103 bp, Artificial Sequence
  Synthetic Polynucleotide
taatacgactcactatagggttgggtggcaccccttggaagagggcgtctaacagaggagaagacgcatgcttccaaggaacctggcggcagcgcaaaagatg

SEQ ID NO: 121974 - DNA, 103 bp, Artificial Sequence
  Synthetic Polynucleotide
taatacgactcactatagggggagggcgccggcaggtcgaaggagctcataacagaggagaatgagcatgttcgacctgaacctggcggcagcgcaaaagatg

SEQ ID NO: 121975 - DNA, 103 bp, Artificial Sequence
  Synthetic Polynucleotide
taatacgactcactataggggccctgtgggtggaagaagttctcatagtaaacagaggagatactatatgaacttcttcaacctggcggcagcgcaaaagatg

SEQ ID NO: 121976 - DNA, 103 bp, Artificial Sequence
  Synthetic Polynucleotide
taatacgactcactatagggggggttcgcccagtcacccccaccgctgtgaacagaggagacacagcatggggggtgacaacctggcggcagcgcaaaagatg

SEQ ID NO: 121977 - DNA, 103 bp, Artificial Sequence
  Synthetic Polynucleotide
taatacgactcactatagggtggtgggcatggggttcgcccagtcaccccaacagaggagaggggtgatggggcgaaccaacctggcggcagcgcaaaagatg

SEQ ID NO: 121978 - DNA, 103 bp, Artificial Sequence
  Synthetic Polynucleotide
taatacgactcactatagggctgagcatgttggtgggcatggggttcgccaacagaggagaggcgaaatgcatgcccacaacctggcggcagcgcaaaagatg

SEQ ID NO: 121979 - DNA, 103 bp, Artificial Sequence
  Synthetic Polynucleotide
taatacgactcactatagggtcctccatagctgagcatgttggtgggcataacagaggagaatgcccatgaacatgctcaacctggcggcagcgcaaaagatg

SEQ ID NO: 121980 - DNA, 103 bp, Artificial Sequence
  Synthetic Polynucleotide
taatacgactcactatagggtgagcacagatcctccatagctgagcatgtaacagaggagaacatgcatggctatggagaacctggcggcagcgcaaaagatg

SEQ ID NO: 121981 - DNA, 103 bp, Artificial Sequence
  Synthetic Polynucleotide
taatacgactcactatagggctgaattggctgagcacagatcctccatagaacagaggagactatggatgatctgtgctaacctggcggcagcgcaaaagatg

SEQ ID NO: 121982 - DNA, 103 bp, Artificial Sequence
  Synthetic Polynucleotide
taatacgactcactataggggaagtgagggctgaattggctgagcacagaaacagaggagatctgtgatgagccaattcaacctggcggcagcgcaaaagatg

SEQ ID NO: 121983 - DNA, 103 bp, Artificial Sequence
  Synthetic Polynucleotide
taatacgactcactatagggcactgttgtagaagtgagggctgaattggcaacagaggagagccaatatggccctcactaacctggcggcagcgcaaaagatg

SEQ ID NO: 121984 - DNA, 103 bp, Artificial Sequence
  Synthetic Polynucleotide
taatacgactcactatagggctggtgttgacactgttgtagaagtgagggaacagaggagaccctcaatgctacaacagaacctggcggcagcgcaaaagatg

SEQ ID NO: 121985 - DNA, 103 bp, Artificial Sequence
  Synthetic Polynucleotide
taatacgactcactataggggaggacaccactggtgttgacactgttgtaaacagaggagatacaacatggtcaacaccaacctggcggcagcgcaaaagatg

SEQ ID NO: 121986 - DNA, 103 bp, Artificial Sequence
  Synthetic Polynucleotide
taatacgactcactatagggggctgggcacgccctgtgggtggaagaagtaacagaggagaacttctatgacccacaggaacctggcggcagcgcaaaagatg

SEQ ID NO: 121987 - DNA, 103 bp, Artificial Sequence
  Synthetic Polynucleotide
taatacgactcactatagggccctggggtagaggacaccactggtgttgaaacagaggagatcaacaatggtggtgtccaacctggcggcagcgcaaaagatg

SEQ ID NO: 121988 - DNA, 103 bp, Artificial Sequence
  Synthetic Polynucleotide
taatacgactcactatagggtcggtgccctccctggggtagaggacaccaaacagaggagatggtgtatgctaccccagaacctggcggcagcgcaaaagatg

SEQ ID NO: 121989 - DNA, 103 bp, Artificial Sequence
  Synthetic Polynucleotide
taatacgactcactatagggggccgctgagggctgggcacgccctgtgggaacagaggagacccacaatgcgtgcccagaacctggcggcagcgcaaaagatg

SEQ ID NO: 121990 - DNA, 103 bp, Artificial Sequence
  Synthetic Polynucleotide
taatacgactcactatagggctcgaaggagggccgctgagggctgggcacaacagaggagagtgcccatgcctcagcggaacctggcggcagcgcaaaagatg

SEQ ID NO: 121991 - DNA, 103 bp, Artificial Sequence
  Synthetic Polynucleotide
taatacgactcactatagggcgccgcccccctcgaaggagggccgctgagaacagaggagactcagcatgcctccttcgaacctggcggcagcgcaaaagatg

SEQ ID NO: 121992 - DNA, 103 bp, Artificial Sequence
  Synthetic Polynucleotide
taatacgactcactataggggccccatactcgccgcccccctcgaaggagaacagaggagactccttatgggggggcggaacctggcggcagcgcaaaagatg

SEQ ID NO: 121993 - DNA, 103 bp, Artificial Sequence
  Synthetic Polynucleotide
taatacgactcactataggggttgggggtggccccatactcgccgcccccaacagaggagagggggcatggagtatgggaacctggcggcagcgcaaaagatg

SEQ ID NO: 121994 - DNA, 103 bp, Artificial Sequence
  Synthetic Polynucleotide
taatacgactcactatagggagaggtaggggttgggggtggccccatactaacagaggagaagtatgatgccacccccaaacctggcggcagcgcaaaagatg

SEQ ID NO: 121995 - DNA, 103 bp, Artificial Sequence
  Synthetic Polynucleotide
taatacgactcactatagggccgttgaaccagaggtaggggttgggggtgaacagaggagacaccccatgcccctacctaacctggcggcagcgcaaaagatg

SEQ ID NO: 121996 - DNA, 103 bp, Artificial Sequence
  Synthetic Polynucleotide
taatacgactcactatagggcatggtgggcccgttgaaccagaggtagggaacagaggagaccctacatgtggttcaacaacctggcggcagcgcaaaagatg

SEQ ID NO: 121997 - DNA, 103 bp, Artificial Sequence
  Synthetic Polynucleotide
taatacgactcactatagggagcgaggtggggagggcgccggcaggtcgaaacagaggagatcgaccatgcggcgccctaacctggcggcagcgcaaaagatg

SEQ ID NO: 121998 - DNA, 103 bp, Artificial Sequence
  Synthetic Polynucleotide
taatacgactcactataggggtggcggggtcatggtgggcccgttgaaccaacagaggagaggttcaatgggcccaccaaacctggcggcagcgcaaaagatg

SEQ ID NO: 121999 - DNA, 103 bp, Artificial Sequence
  Synthetic Polynucleotide
taatacgactcactatagggggcaggtagggtggcggggtcatggtgggcaacagaggagagcccacatggaccccgccaacctggcggcagcgcaaaagatg

SEQ ID NO: 122000 - DNA, 103 bp, Artificial Sequence
  Synthetic Polynucleotide
taatacgactcactataggggttggggccgggcaggtagggtggcggggtaacagaggagaaccccgatgccctacctgaacctggcggcagcgcaaaagatg

SEQ ID NO: 122001 - DNA, 103 bp, Artificial Sequence
  Synthetic Polynucleotide
taatacgactcactatagggaggggctggcgttggggccgggcaggtaggaacagaggagacctaccatgccggccccaaacctggcggcagcgcaaaagatg

SEQ ID NO: 122002 - DNA, 103 bp, Artificial Sequence
  Synthetic Polynucleotide
taatacgactcactatagggtggggcaggaaggggctggcgttggggccgaacagaggagacggcccatgcgccagcccaacctggcggcagcgcaaaagatg

SEQ ID NO: 122003 - DNA, 103 bp, Artificial Sequence
  Synthetic Polynucleotide
taatacgactcactatagggtccataggcctggggcaggaaggggctggcaacagaggagagccagcatgttcctgcccaacctggcggcagcgcaaaagatg

SEQ ID NO: 122004 - DNA, 103 bp, Artificial Sequence
  Synthetic Polynucleotide
taatacgactcactataggggcctctgcactccataggcctggggcaggaaacagaggagatcctgcatgaggcctatgaacctggcggcagcgcaaaagatg

SEQ ID NO: 122005 - DNA, 103 bp, Artificial Sequence
  Synthetic Polynucleotide
taatacgactcactatagggggcagcagcggcctctgcactccataggccaacagaggagaggcctaatgagtgcagagaacctggcggcagcgcaaaagatg

SEQ ID NO: 122006 - DNA, 103 bp, Artificial Sequence
  Synthetic Polynucleotide
taatacgactcactatagggcgacacgctgggcagcagcggcctctgcacaacagaggagagtgcagatgccgctgctgaacctggcggcagcgcaaaagatg

SEQ ID NO: 122007 - DNA, 103 bp, Artificial Sequence
  Synthetic Polynucleotide
taatacgactcactatagggccccaagccccgacacgctgggcagcagcgaacagaggagacgctgcatgccagcgtgtaacctggcggcagcgcaaaagatg

SEQ ID NO: 122008 - DNA, 103 bp, Artificial Sequence
  Synthetic Polynucleotide
taatacgactcactatagggtgggggctgcagcgaggtggggagggcgccaacagaggagaggcgccatgcccacctcgaacctggcggcagcgcaaaagatg

SEQ ID NO: 122009 - DNA, 103 bp, Artificial Sequence
  Synthetic Polynucleotide
taatacgactcactatagggaggtcgctccccccaagccccgacacgctgaacagaggagacagcgtatgggggcttggaacctggcggcagcgcaaaagatg

SEQ ID NO: 122010 - DNA, 103 bp, Artificial Sequence
  Synthetic Polynucleotide
taatacgactcactatagggcagccagcccaggtcgctccccccaagcccaacagaggagagggcttatggggagcgacaacctggcggcagcgcaaaagatg

SEQ ID NO: 122011 - DNA, 103 bp, Artificial Sequence
  Synthetic Polynucleotide
taatacgactcactatagggaggggatgggcagccagcccaggtcgctccaacagaggagaggagcgatgtgggctggcaacctggcggcagcgcaaaagatg

SEQ ID NO: 122012 - DNA, 103 bp, Artificial Sequence
  Synthetic Polynucleotide
taatacgactcactatagggtcctcctgcgaggggatgggcagccagcccaacagaggagagggctgatggcccatcccaacctggcggcagcgcaaaagatg

SEQ ID NO: 122013 - DNA, 103 bp, Artificial Sequence
  Synthetic Polynucleotide
taatacgactcactatagggcttcatcagctcctcctgcgaggggatgggaacagaggagacccatcatgtcgcaggagaacctggcggcagcgcaaaagatg

SEQ ID NO: 122014 - DNA, 103 bp, Artificial Sequence
  Synthetic Polynucleotide
taatacgactcactataggggccgcaccagcttcatcagctcctcctgcgaacagaggagacgcaggatgagctgatgaaacctggcggcagcgcaaaagatg

SEQ ID NO: 122015 - DNA, 103 bp, Artificial Sequence
  Synthetic Polynucleotide
taatacgactcactataggggaatagggtggccgcaccagcttcatcagcaacagaggagagctgatatggctggtgcgaacctggcggcagcgcaaaagatg

SEQ ID NO: 122016 - DNA, 103 bp, Artificial Sequence
  Synthetic Polynucleotide
taatacgactcactatagggagccgagtaggaatagggtggccgcaccagaacagaggagactggtgatgccaccctataacctggcggcagcgcaaaagatg

SEQ ID NO: 122017 - DNA, 103 bp, Artificial Sequence
  Synthetic Polynucleotide
taatacgactcactatagggtggcgatgagagccgagtaggaatagggtgaacagaggagacaccctatgcctactcggaacctggcggcagcgcaaaagatg

SEQ ID NO: 122018 - DNA, 103 bp, Artificial Sequence
  Synthetic Polynucleotide
taatacgactcactatagggtggatggccatggcgatgagagccgagtagaacagaggagactactcatgtctcatcgcaacctggcggcagcgcaaaagatg

SEQ ID NO: 122019 - DNA, 103 bp, Artificial Sequence
  Synthetic Polynucleotide
taatacgactcactataggggctggggaactgggggctgcagcgaggtggaacagaggagaccacctatgtgcagccccaacctggcggcagcgcaaaagatg

SEQ ID NO: 122020 - DNA, 103 bp, Artificial Sequence
  Synthetic Polynucleotide
taatacgactcactataggggggtgccccgtggatggccatggcgatgagaacagaggagactcatcatgatggccatcaacctggcggcagcgcaaaagatg

SEQ ID NO: 122021 - DNA, 103 bp, Artificial Sequence
  Synthetic Polynucleotide
taatacgactcactatagggggcgcttgtcgggtgccccgtggatggccaaacagaggagatggccaatgacggggcacaacctggcggcagcgcaaaagatg

SEQ ID NO: 122022 - DNA, 103 bp, Artificial Sequence
  Synthetic Polynucleotide
taatacgactcactatagggctgagagtgaggcgcttgtcgggtgccccgaacagaggagacggggcatgcgacaagcgaacctggcggcagcgcaaaagatg

SEQ ID NO: 122023 - DNA, 103 bp, Artificial Sequence
  Synthetic Polynucleotide
taatacgactcactataggggtagatctggctgagagtgaggcgcttgtcaacagaggagagacaagatgctcactctcaacctggcggcagcgcaaaagatg

SEQ ID NO: 122024 - DNA, 103 bp, Artificial Sequence
  Synthetic Polynucleotide
taatacgactcactatagggccacgtactggtagatctggctgagagtgaaacagaggagatcactcatggccagatctaacctggcggcagcgcaaaagatg

SEQ ID NO: 122025 - DNA, 103 bp, Artificial Sequence
  Synthetic Polynucleotide
taatacgactcactatagggaagttgtcggccacgtactggtagatctggaacagaggagaccagatatgccagtacgtaacctggcggcagcgcaaaagatg

SEQ ID NO: 122026 - DNA, 103 bp, Artificial Sequence
  Synthetic Polynucleotide
taatacgactcactataggggtagaaggggaagttgtcggccacgtactgaacagaggagacagtacatggccgacaacaacctggcggcagcgcaaaagatg

SEQ ID NO: 122027 - DNA, 103 bp, Artificial Sequence
  Synthetic Polynucleotide
taatacgactcactatagggtgctcttgttgtagaaggggaagttgtcggaacagaggagaccgacaatgtccccttctaacctggcggcagcgcaaaagatg

SEQ ID NO: 122028 - DNA, 103 bp, Artificial Sequence
  Synthetic Polynucleotide
taatacgactcactatagggcagccggccttgctcttgttgtagaaggggaacagaggagaccccttatgcaacaagagaacctggcggcagcgcaaaagatg

SEQ ID NO: 122029 - DNA, 103 bp, Artificial Sequence
  Synthetic Polynucleotide
taatacgactcactatagggggagttctgccagccggccttgctcttgttaacagaggagaaacaagatgaaggccggcaacctggcggcagcgcaaaagatg

SEQ ID NO: 122030 - DNA, 103 bp, Artificial Sequence
  Synthetic Polynucleotide
taatacgactcactatagggcctggccgatgctggggaactgggggctgcaacagaggagagcagccatgagttccccaaacctggcggcagcgcaaaagatg

SEQ ID NO: 122031 - DNA, 103 bp, Artificial Sequence
  Synthetic Polynucleotide
taatacgactcactatagggtgtggcggatggagttctgccagccggcctaacagaggagaaggccgatgggcagaactaacctggcggcagcgcaaaagatg

SEQ ID NO: 122032 - DNA, 103 bp, Artificial Sequence
  Synthetic Polynucleotide
taatacgactcactatagggagcgacaggttgtggcggatggagttctgcaacagaggagagcagaaatgcatccgccaaacctggcggcagcgcaaaagatg

SEQ ID NO: 122033 - DNA, 103 bp, Artificial Sequence
  Synthetic Polynucleotide
taatacgactcactataggggcagtcgttgagcgacaggttgtggcggataacagaggagaatccgcatgaacctgtcgaacctggcggcagcgcaaaagatg

SEQ ID NO: 122034 - DNA, 103 bp, Artificial Sequence
  Synthetic Polynucleotide
taatacgactcactatagggccttcttgaagcagtcgttgagcgacaggtaacagaggagaacctgtatgtcaacgactaacctggcggcagcgcaaaagatg

SEQ ID NO: 122035 - DNA, 103 bp, Artificial Sequence
  Synthetic Polynucleotide
taatacgactcactatagggtcgcggggcaccttcttgaagcagtcgttgaacagaggagacaacgaatgcttcaagaaaacctggcggcagcgcaaaagatg

SEQ ID NO: 122036 - DNA, 103 bp, Artificial Sequence
  Synthetic Polynucleotide
taatacgactcactataggggtcgtcctcgtcgcggggcaccttcttgaaaacagaggagattcaagatggtgccccgcaacctggcggcagcgcaaaagatg

SEQ ID NO: 122037 - DNA, 103 bp, Artificial Sequence
  Synthetic Polynucleotide
taatacgactcactatagggctttgcccgggtcgtcctcgtcgcggggcaaacagaggagatgccccatgacgaggacgaacctggcggcagcgcaaaagatg

SEQ ID NO: 122038 - DNA, 103 bp, Artificial Sequence
  Synthetic Polynucleotide
taatacgactcactatagggcagtaattccctttgcccgggtcgtcctcgaacagaggagacgaggaatgcccgggcaaaacctggcggcagcgcaaaagatg

SEQ ID NO: 122039 - DNA, 103 bp, Artificial Sequence
  Synthetic Polynucleotide
taatacgactcactataggggtccagggtccagtaattccctttgcccggaacagaggagaccgggcatggggaattacaacctggcggcagcgcaaaagatg

SEQ ID NO: 122040 - DNA, 103 bp, Artificial Sequence
  Synthetic Polynucleotide
taatacgactcactatagggcacagttggggtccagggtccagtaattccaacagaggagaggaattatgggaccctggaacctggcggcagcgcaaaagatg

SEQ ID NO: 122041 - DNA, 103 bp, Artificial Sequence
  Synthetic Polynucleotide
taatacgactcactatagggtcggggggctcctggccgatgctggggaacaacagaggagagttcccatgcatcggccaaacctggcggcagcgcaaaagatg

SEQ ID NO: 122042 - DNA, 103 bp, Artificial Sequence
  Synthetic Polynucleotide
taatacgactcactatagggaacattttctcacagttggggtccagggtcaacagaggagagaccctatgccccaactgaacctggcggcagcgcaaaagatg

SEQ ID NO: 122043 - DNA, 103 bp, Artificial Sequence
  Synthetic Polynucleotide
taatacgactcactatagggtccattgtcgaacattttctcacagttgggaacagaggagacccaacatggagaaaatgaacctggcggcagcgcaaaagatg

SEQ ID NO: 122044 - DNA, 103 bp, Artificial Sequence
  Synthetic Polynucleotide
taatacgactcactatagggtgcggaaatttccattgtcgaacattttctaacagaggagaagaaaaatgtcgacaatgaacctggcggcagcgcaaaagatg

SEQ ID NO: 122045 - DNA, 103 bp, Artificial Sequence
  Synthetic Polynucleotide
taatacgactcactatagggttccttttcctgcggaaatttccattgtcgaacagaggagacgacaaatgaaatttccgaacctggcggcagcgcaaaagatg

SEQ ID NO: 122046 - DNA, 103 bp, Artificial Sequence
  Synthetic Polynucleotide
taatacgactcactatagggtgattttctcttccttttcctgcggaaattaacagaggagaaatttcatgaggaaaaggaacctggcggcagcgcaaaagatg

SEQ ID NO: 122047 - DNA, 103 bp, Artificial Sequence
  Synthetic Polynucleotide
taatacgactcactatagggaggaaacatctgattttctcttccttttccaacagaggagaggaaaaatgagagaaaataacctggcggcagcgcaaaagatg

SEQ ID NO: 122048 - DNA, 103 bp, Artificial Sequence
  Synthetic Polynucleotide
taatacgactcactataggggctgtgctagaggaaacatctgattttctcaacagaggagagagaaaatgagatgtttcaacctggcggcagcgcaaaagatg

SEQ ID NO: 122049 - DNA, 103 bp, Artificial Sequence
  Synthetic Polynucleotide
taatacgactcactatagggggccaaggaggctgtgctagaggaaacatcaacagaggagagatgttatgtctagcacaaacctggcggcagcgcaaaagatg

SEQ ID NO: 122050 - DNA, 103 bp, Artificial Sequence
  Synthetic Polynucleotide
taatacgactcactatagggtcttctctaaggccaaggaggctgtgctagaacagaggagactagcaatgcctccttggaacctggcggcagcgcaaaagatg

SEQ ID NO: 122051 - DNA, 103 bp, Artificial Sequence
  Synthetic Polynucleotide
taatacgactcactatagggctgctctctgtcttctctaaggccaaggagaacagaggagactccttatgcttagagaaaacctggcggcagcgcaaaagatg

SEQ ID NO: 122052 - DNA, 103 bp, Artificial Sequence
  Synthetic Polynucleotide
taatacgactcactataggggaggttcatctcggggggctcctggccgataacagaggagaatcggcatggagccccccaacctggcggcagcgcaaaagatg

SEQ ID NO: 122053 - DNA, 103 bp, Artificial Sequence
  Synthetic Polynucleotide
taatacgactcactatagggcaccgggagactgctctctgtcttctctaaaacagaggagattagagatgacagagagcaacctggcggcagcgcaaaagatg

SEQ ID NO: 122054 - DNA, 103 bp, Artificial Sequence
  Synthetic Polynucleotide
taatacgactcactatagggtggggctgtccaccgggagactgctctctgaacagaggagacagagaatggtctcccggaacctggcggcagcgcaaaagatg

SEQ ID NO: 122055 - DNA, 103 bp, Artificial Sequence
  Synthetic Polynucleotide
taatacgactcactatagggtccgtggtcttggggctgtccaccgggagaaacagaggagatctcccatgggacagcccaacctggcggcagcgcaaaagatg

SEQ ID NO: 122056 - DNA, 103 bp, Artificial Sequence
  Synthetic Polynucleotide
taatacgactcactataggggtcctgaggctccgtggtcttggggctgtcaacagaggagagacagcatgaagaccacgaacctggcggcagcgcaaaagatg

SEQ ID NO: 122057 - DNA, 103 bp, Artificial Sequence
  Synthetic Polynucleotide
taatacgactcactatagggcatccaagatgtcctgaggctccgtggtctaacagaggagaagaccaatgagcctcaggaacctggcggcagcgcaaaagatg

SEQ ID NO: 122058 - DNA, 103 bp, Artificial Sequence
  Synthetic Polynucleotide
taatacgactcactatagggggtgaggctccatccaagatgtcctgaggcaacagaggagagcctcaatgcatcttggaaacctggcggcagcgcaaaagatg

SEQ ID NO: 122059 - DNA, 103 bp, Artificial Sequence
  Synthetic Polynucleotide
taatacgactcactatagggggtgccccctggtgaggctccatccaagataacagaggagaatcttgatgggagcctcaaacctggcggcagcgcaaaagatg

SEQ ID NO: 122060 - DNA, 103 bp, Artificial Sequence
  Synthetic Polynucleotide
taatacgactcactataggggggagctggtggtgccccctggtgaggctcaacagaggagagagcctatgcagggggcaaacctggcggcagcgcaaaagatg

SEQ ID NO: 122061 - DNA, 103 bp, Artificial Sequence
  Synthetic Polynucleotide
taatacgactcactatagggcgcttctctggggagctggtggtgccccctaacagaggagaagggggatgcaccagctcaacctggcggcagcgcaaaagatg

SEQ ID NO: 122062 - DNA, 103 bp, Artificial Sequence
  Synthetic Polynucleotide
taatacgactcactatagggaggggagggccgcttctctggggagctggtaacagaggagaaccagcatgccagagaagaacctggcggcagcgcaaaagatg

SEQ ID NO: 122063 - DNA, 103 bp, Artificial Sequence
  Synthetic Polynucleotide
taatacgactcactatagggtctcatagtagaggttcatctcggggggctaacagaggagaagccccatgagatgaaccaacctggcggcagcgcaaaagatg

SEQ ID NO: 122064 - DNA, 103 bp, Artificial Sequence
  Synthetic Polynucleotide
taatacgactcactatagggctgatgggggaggggagggccgcttctctgaacagaggagacagagaatgggccctcccaacctggcggcagcgcaaaagatg

SEQ ID NO: 122065 - DNA, 103 bp, Artificial Sequence
  Synthetic Polynucleotide
taatacgactcactatagggcaaggggcgcctgatgggggaggggagggcaacagaggagagccctcatgtcccccatcaacctggcggcagcgcaaaagatg

SEQ ID NO: 122066 - DNA, 103 bp, Artificial Sequence
  Synthetic Polynucleotide
taatacgactcactataggggctgttaaggcaaggggcgcctgatgggggaacagaggagacccccaatgggcgcccctaacctggcggcagcgcaaaagatg

SEQ ID NO: 122067 - DNA, 103 bp, Artificial Sequence
  Synthetic Polynucleotide
taatacgactcactatagggaggaaaggaagctgttaaggcaaggggcgcaacagaggagagcgcccatggccttaacaaacctggcggcagcgcaaaagatg

SEQ ID NO: 122068 - DNA, 103 bp, Artificial Sequence
  Synthetic Polynucleotide
taatacgactcactataggggctgtcatagaggaaaggaagctgttaaggaacagaggagaccttaaatgcttcctttcaacctggcggcagcgcaaaagatg

SEQ ID NO: 122069 - DNA, 103 bp, Artificial Sequence
  Synthetic Polynucleotide
taatacgactcactataggggctcacataggctgtcatagaggaaaggaaaacagaggagattccttatgtctatgacaaacctggcggcagcgcaaaagatg

SEQ ID NO: 122070 - DNA, 103 bp, Artificial Sequence
  Synthetic Polynucleotide
taatacgactcactatagggggctccccccgctcacataggctgtcatagaacagaggagactatgaatgcctatgtgaaacctggcggcagcgcaaaagatg

SEQ ID NO: 122071 - DNA, 103 bp, Artificial Sequence
  Synthetic Polynucleotide
taatacgactcactatagggtggctcgtggggctccccccgctcacatagaacagaggagactatgtatgcggggggagaacctggcggcagcgcaaaagatg

SEQ ID NO: 122072 - DNA, 103 bp, Artificial Sequence
  Synthetic Polynucleotide
taatacgactcactataggggaccaaggggtggctcgtggggctccccccaacagaggagaggggggatgcccacgagcaacctggcggcagcgcaaaagatg

SEQ ID NO: 122073 - DNA, 103 bp, Artificial Sequence
  Synthetic Polynucleotide
taatacgactcactataggggtcctggtgtgaccaaggggtggctcgtggaacagaggagaccacgaatgaccccttggaacctggcggcagcgcaaaagatg

SEQ ID NO: 122074 - DNA, 103 bp, Artificial Sequence
  Synthetic Polynucleotide
taatacgactcactatagggtggaagaagttctcatagtagaggttcatcaacagaggagagatgaaatgctactatgaaacctggcggcagcgcaaaagatg

SEQ ID NO: 122075 - DNA, 103 bp, Artificial Sequence
  Synthetic Polynucleotide
taatacgactcactatagggtcagggctcagtcctggtgtgaccaaggggaacagaggagaccccttatgcacaccaggaacctggcggcagcgcaaaagatg

SEQ ID NO: 122076 - DNA, 103 bp, Artificial Sequence
  Synthetic Polynucleotide
taatacgactcactataggggtcactgggctcagggctcagtcctggtgtaacagaggagaacaccaatgctgagccctaacctggcggcagcgcaaaagatg

SEQ ID NO: 122077 - DNA, 103 bp, Artificial Sequence
  Synthetic Polynucleotide
taatacgactcactataggggccccgtcttgtcactgggctcagggctcaaacagaggagatgagccatgagcccagtgaacctggcggcagcgcaaaagatg

SEQ ID NO: 122078 - DNA, 103 bp, Artificial Sequence
  Synthetic Polynucleotide
taatacgactcactatagggagtgagttctgccccgtcttgtcactgggcaacagaggagagcccagatgcaagacgggaacctggcggcagcgcaaaagatg

SEQ ID NO: 122079 - DNA, 103 bp, Artificial Sequence
  Synthetic Polynucleotide
taatacgactcactataggggttgaaggtcagtgagttctgccccgtcttaacagaggagaaagacgatgcagaactcaaacctggcggcagcgcaaaagatg

SEQ ID NO: 122080 - DNA, 103 bp, Artificial Sequence
  Synthetic Polynucleotide
taatacgactcactataggggggagaaggagttgaaggtcagtgagttctaacagaggagaagaactatgtgaccttcaaacctggcggcagcgcaaaagatg

SEQ ID NO: 122081 - DNA, 103 bp, Artificial Sequence
  Synthetic Polynucleotide
taatacgactcactatagggttggtgagcggggagaaggagttgaaggtcaacagaggagagaccttatgctccttctcaacctggcggcagcgcaaaagatg

SEQ ID NO: 122082 - DNA, 103 bp, Artificial Sequence
  Synthetic Polynucleotide
taatacgactcactataggggttgctgaggttggtgagcggggagaaggaaacagaggagatccttcatgccgctcaccaacctggcggcagcgcaaaagatg

SEQ ID NO: 122083 - DNA, 103 bp, Artificial Sequence
  Synthetic Polynucleotide
taatacgactcactatagggcaccgctgtggttgctgaggttggtgagcgaacagaggagacgctcaatgacctcagcaaacctggcggcagcgcaaaagatg

SEQ ID NO: 122084 - DNA, 103 bp, Artificial Sequence
  Synthetic Polynucleotide
taatacgactcactatagggcagtcacccccaccgctgtggttgctgaggaacagaggagacctcagatgccacagcggaacctggcggcagcgcaaaagatg

SEQ ID NO: 122085 - DNA, 103 bp, Artificial Sequence
  Synthetic Polynucleotide
taatacgactcactatagggtcccgagaggcgcagccagctctccgccataacagaggagaatggcgatgagctggctgaacctggcggcagcgcaaaagatg

SEQ ID NO: 122086 - DNA, 103 bp, Artificial Sequence
  Synthetic Polynucleotide
taatacgactcactatagggctgcagccactgcaggctggtcaggctgtcaacagaggagagacagcatgaccagcctgaacctggcggcagcgcaaaagatg

SEQ ID NO: 122087 - DNA, 103 bp, Artificial Sequence
  Synthetic Polynucleotide
taatacgactcactatagggtgaggcggggctcagaggcgggctcagctcaacagaggagagagctgatgccgcctctgaacctggcggcagcgcaaaagatg

SEQ ID NO: 122088 - DNA, 103 bp, Artificial Sequence
  Synthetic Polynucleotide
taatacgactcactatagggcgtccacgtgtgaggcggggctcagaggcgaacagaggagacgcctcatggccccgcctaacctggcggcagcgcaaaagatg

SEQ ID NO: 122089 - DNA, 103 bp, Artificial Sequence
  Synthetic Polynucleotide
taatacgactcactataggggtgaggtccacgtccacgtgtgaggcggggaacagaggagaccccgcatgacacgtggaaacctggcggcagcgcaaaagatg

SEQ ID NO: 122090 - DNA, 103 bp, Artificial Sequence
  Synthetic Polynucleotide
taatacgactcactataggggccgtggatggtgaggtccacgtccacgtgaacagaggagacacgtgatggtggacctcaacctggcggcagcgcaaaagatg

SEQ ID NO: 122091 - DNA, 103 bp, Artificial Sequence
  Synthetic Polynucleotide
taatacgactcactatagggcgatgtggcggccgtggatggtgaggtccaaacagaggagatggaccatgccatccacgaacctggcggcagcgcaaaagatg

SEQ ID NO: 122092 - DNA, 103 bp, Artificial Sequence
  Synthetic Polynucleotide
taatacgactcactataggggcagggcagtcgatgtggcggccgtggatgaacagaggagacatccaatgccgccacataacctggcggcagcgcaaaagatg

SEQ ID NO: 122093 - DNA, 103 bp, Artificial Sequence
  Synthetic Polynucleotide
taatacgactcactatagggcccccaggtggcagggcagtcgatgtggcgaacagaggagacgccacatggactgccctaacctggcggcagcgcaaaagatg

SEQ ID NO: 122094 - DNA, 103 bp, Artificial Sequence
  Synthetic Polynucleotide
taatacgactcactatagggccaccgaaggcccccaggtggcagggcagtaacagaggagaactgccatgccacctgggaacctggcggcagcgcaaaagatg

SEQ ID NO: 122095 - DNA, 103 bp, Artificial Sequence
  Synthetic Polynucleotide
taatacgactcactataggggcagcctgctccaccgaaggcccccaggtgaacagaggagacacctgatggccttcggtaacctggcggcagcgcaaaagatg

SEQ ID NO: 122096 - DNA, 103 bp, Artificial Sequence
  Synthetic Polynucleotide
taatacgactcactatagggcaggctgtcggcagcctgctccaccgaaggaacagaggagaccttcgatggagcaggctaacctggcggcagcgcaaaagatg

SEQ ID NO: 122097 - DNA, 103 bp, Artificial Sequence
  Synthetic Polynucleotide
taatacgactcactatagggtggagaattcctgcagccactgcaggctggaacagaggagaccagccatgagtggctgcaacctggcggcagcgcaaaagatg

SEQ ID NO: 122098 - DNA, 103 bp, Artificial Sequence
  Synthetic Polynucleotide
taatacgactcactatagggcatcgaagtccaggctgtcggcagcctgctaacagaggagaagcaggatgccgacagccaacctggcggcagcgcaaaagatg

SEQ ID NO: 122099 - DNA, 103 bp, Artificial Sequence
  Synthetic Polynucleotide
taatacgactcactatagggaggaaggtctcatcgaagtccaggctgtcgaacagaggagacgacagatgggacttcgaaacctggcggcagcgcaaaagatg

SEQ ID NO: 122100 - DNA, 103 bp, Artificial Sequence
  Synthetic Polynucleotide
taatacgactcactatagggggatgtggccaggaaggtctcatcgaagtcaacagaggagagacttcatggagaccttcaacctggcggcagcgcaaaagatg

SEQ ID NO: 122101 - DNA, 103 bp, Artificial Sequence
  Synthetic Polynucleotide
taatacgactcactataggggctgcaggaaggatgtggccaggaaggtctaacagaggagaagacctatgtggccacataacctggcggcagcgcaaaagatg

SEQ ID NO: 122102 - DNA, 103 bp, Artificial Sequence
  Synthetic Polynucleotide
taatacgactcactatagggtcccaggggtgctgcaggaaggatgtggccaacagaggagaggccacatgcttcctgcaaacctggcggcagcgcaaaagatg

SEQ ID NO: 122103 - DNA, 103 bp, Artificial Sequence
  Synthetic Polynucleotide
taatacgactcactataggggccgctctcgtcccaggggtgctgcaggaaaacagaggagattcctgatgcacccctggaacctggcggcagcgcaaaagatg

SEQ ID NO: 122104 - DNA, 103 bp, Artificial Sequence
  Synthetic Polynucleotide
taatacgactcactatagggggcagccactgccgctctcgtcccaggggtaacagaggagaacccctatgacgagagcgaacctggcggcagcgcaaaagatg

SEQ ID NO: 122105 - DNA, 103 bp, Artificial Sequence
  Synthetic Polynucleotide
taatacgactcactatagggtccgggggcaggcagccactgccgctctcgaacagaggagacgagagatgcagtggctgaacctggcggcagcgcaaaagatg

SEQ ID NO: 122106 - DNA, 103 bp, Artificial Sequence
  Synthetic Polynucleotide
taatacgactcactatagggaaagaggggctccgggggcaggcagccactaacagaggagaagtggcatgctgcccccgaacctggcggcagcgcaaaagatg

SEQ ID NO: 122107 - DNA, 103 bp, Artificial Sequence
  Synthetic Polynucleotide
taatacgactcactatagggccccagcctcaaagaggggctccgggggcaaacagaggagatgccccatgagcccctctaacctggcggcagcgcaaaagatg

SEQ ID NO: 122108 - DNA, 103 bp, Artificial Sequence
  Synthetic Polynucleotide
taatacgactcactataggggcgttgagaatggagaattcctgcagccacaacagaggagagtggctatgggaattctcaacctggcggcagcgcaaaagatg

SEQ ID NO: 122109 - DNA, 103 bp, Artificial Sequence
  Synthetic Polynucleotide
taatacgactcactatagggagggtggcatccccagcctcaaagaggggcaacagaggagagcccctatgtgaggctggaacctggcggcagcgcaaaagatg

SEQ ID NO: 122110 - DNA, 103 bp, Artificial Sequence
  Synthetic Polynucleotide
taatacgactcactataggggtcggaggccagggtggcatccccagcctcaacagaggagagaggctatggatgccaccaacctggcggcagcgcaaaagatg

SEQ ID NO: 122111 - DNA, 103 bp, Artificial Sequence
  Synthetic Polynucleotide
taatacgactcactatagggagtcctgcaggtcggaggccagggtggcataacagaggagaatgccaatgtggcctccgaacctggcggcagcgcaaaagatg

SEQ ID NO: 122112 - DNA, 103 bp, Artificial Sequence
  Synthetic Polynucleotide
taatacgactcactatagggacgctggcccagtcctgcaggtcggaggccaacagaggagaggcctcatgcctgcaggaaacctggcggcagcgcaaaagatg

SEQ ID NO: 122113 - DNA, 103 bp, Artificial Sequence
  Synthetic Polynucleotide
taatacgactcactataggggaaggcccccacgctggcccagtcctgcagaacagaggagactgcagatgtgggccagcaacctggcggcagcgcaaaagatg

SEQ ID NO: 122114 - DNA, 103 bp, Artificial Sequence
  Synthetic Polynucleotide
taatacgactcactataggggggggccttggcgttgagaatggagaattcaacagaggagagaattcatgattctcaacaacctggcggcagcgcaaaagatg

SEQ ID NO: 122115 - DNA, 103 bp, Artificial Sequence
  Synthetic Polynucleotide
taatacgactcactatagggggggcagggcgggggccttggcgttgagaaaacagaggagattctcaatgccaaggcccaacctggcggcagcgcaaaagatg

SEQ ID NO: 122116 - DNA, 103 bp, Artificial Sequence
  Synthetic Polynucleotide
taatacgactcactataggggtgccccccgggggcagggcgggggccttgaacagaggagacaaggcatgcgccctgccaacctggcggcagcgcaaaagatg

SEQ ID NO: 122117 - DNA, 103 bp, Artificial Sequence
  Synthetic Polynucleotide
taatacgactcactataggggtgggggtcggtgccccccgggggcagggcaacagaggagagccctgatgccggggggcaacctggcggcagcgcaaaagatg

SEQ ID NO: 122118 - DNA, 103 bp, Artificial Sequence
  Synthetic Polynucleotide
taatacgactcactatagggggtggtagccgtgggggtcggtgccccccgaacagaggagacgggggatgccgacccccaacctggcggcagcgcaaaagatg

SEQ ID NO: 122119 - DNA, 103 bp, Artificial Sequence
  Synthetic Polynucleotide
taatacgactcactatagggcctggcacctggtggtagccgtgggggtcgaacagaggagacgacccatgcggctaccaaacctggcggcagcgcaaaagatg

SEQ ID NO: 122120 - DNA, 103 bp, Artificial Sequence
  Synthetic Polynucleotide
taatacgactcactatagggcgccgctgaacctggcacctggtggtagccaacagaggagaggctacatgcaggtgccaaacctggcggcagcgcaaaagatg

SEQ ID NO: 122121 - DNA, 103 bp, Artificial Sequence
  Synthetic Polynucleotide
taatacgactcactatagggccggcccggctcccgagaggcgcagccagcaacagaggagagctggcatggcctctcggaacctggcggcagcgcaaaagatg

SEQ ID NO: 122122 - DNA, 103 bp, Artificial Sequence
  Synthetic Polynucleotide
taatacgactcactataggggggacccgggcgccgctgaacctggcacctaacagaggagaaggtgcatggttcagcggaacctggcggcagcgcaaaagatg

SEQ ID NO: 122123 - DNA, 103 bp, Artificial Sequence
  Synthetic Polynucleotide
taatacgactcactataggggccgccaggggggacccgggcgccgctgaaaacagaggagattcagcatggcccgggtcaacctggcggcagcgcaaaagatg

SEQ ID NO: 122124 - DNA, 103 bp, Artificial Sequence
  Synthetic Polynucleotide
taatacgactcactatagggggcggggtcggccgccaggggggacccgggaacagaggagacccgggatgcccctggcgaacctggcggcagcgcaaaagatg

SEQ ID NO: 122125 - DNA, 103 bp, Artificial Sequence
  Synthetic Polynucleotide
taatacgactcactataggggccccaggcaggcggggtcggccgccagggaacagaggagaccctggatgccgaccccgaacctggcggcagcgcaaaagatg

SEQ ID NO: 122126 - DNA, 103 bp, Artificial Sequence
  Synthetic Polynucleotide
taatacgactcactataggggtgtgtggctgccccaggcaggcggggtcgaacagaggagacgacccatgctgcctgggaacctggcggcagcgcaaaagatg

SEQ ID NO: 122127 - DNA, 103 bp, Artificial Sequence
  Synthetic Polynucleotide
taatacgactcactatagggcttgcccggcgtgtgtggctgccccaggcaaacagaggagatgcctgatgcagccacacaacctggcggcagcgcaaaagatg

SEQ ID NO: 122128 - DNA, 103 bp, Artificial Sequence
  Synthetic Polynucleotide
taatacgactcactatagggacgacgtgggcttgcccggcgtgtgtggctaacagaggagaagccacatgcgccgggcaaacctggcggcagcgcaaaagatg

SEQ ID NO: 122129 - DNA, 103 bp, Artificial Sequence
  Synthetic Polynucleotide
taatacgactcactataggggacgtgcacgacgacgtgggcttgcccggcaacagaggagagccgggatggcccacgtcaacctggcggcagcgcaaaagatg

SEQ ID NO: 122130 - DNA, 103 bp, Artificial Sequence
  Synthetic Polynucleotide
taatacgactcactatagggcgcgctccgcgacgtgcacgacgacgtgggaacagaggagacccacgatgtcgtgcacgaacctggcggcagcgcaaaagatg

SEQ ID NO: 122131 - DNA, 103 bp, Artificial Sequence
  Synthetic Polynucleotide
taatacgactcactataggggccccgggggcgcgctccgcgacgtgcacgaacagaggagacgtgcaatgcgcggagcgaacctggcggcagcgcaaaagatg

SEQ ID NO: 122132 - DNA, 103 bp, Artificial Sequence
  Synthetic Polynucleotide
taatacgactcactataggggcctcctccgccggcccggctcccgagaggaacagaggagacctctcatgagccgggccaacctggcggcagcgcaaaagatg

SEQ ID NO: 122133 - DNA, 103 bp, Artificial Sequence
  Synthetic Polynucleotide
taatacgactcactatagggggggcctgcagccccgggggcgcgctccgcaacagaggagagcggagatggcccccgggaacctggcggcagcgcaaaagatg

SEQ ID NO: 122134 - DNA, 103 bp, Artificial Sequence
  Synthetic Polynucleotide
taatacgactcactataggggtcggggggtggggcctgcagccccgggggaacagaggagacccccgatgctgcaggccaacctggcggcagcgcaaaagatg

SEQ ID NO: 122135 - DNA, 103 bp, Artificial Sequence
  Synthetic Polynucleotide
taatacgactcactatagggagtccacgtcgtcggggggtggggcctgcaaacagaggagatgcaggatgcaccccccgaacctggcggcagcgcaaaagatg

SEQ ID NO: 122136 - DNA, 103 bp, Artificial Sequence
  Synthetic Polynucleotide
taatacgactcactatagggttggtggcgtagtccacgtcgtcggggggtaacagaggagaacccccatgcgacgtggaaacctggcggcagcgcaaaagatg

SEQ ID NO: 122137 - DNA, 103 bp, Artificial Sequence
  Synthetic Polynucleotide
taatacgactcactatagggcacgtgcggattggtggcgtagtccacgtcaacagaggagagacgtgatgtacgccaccaacctggcggcagcgcaaaagatg

SEQ ID NO: 122138 - DNA, 103 bp, Artificial Sequence
  Synthetic Polynucleotide
taatacgactcactatagggagggaggcttcacgtgcggattggtggcgtaacagaggagaacgccaatgatccgcacgaacctggcggcagcgcaaaagatg

SEQ ID NO: 122139 - DNA, 103 bp, Artificial Sequence
  Synthetic Polynucleotide
taatacgactcactataggggcatacgagtagggaggcttcacgtgcggaaacagaggagatccgcaatggaagcctccaacctggcggcagcgcaaaagatg

SEQ ID NO: 122140 - DNA, 103 bp, Artificial Sequence
  Synthetic Polynucleotide
taatacgactcactataggggatgagcgtggcatacgagtagggaggcttaacagaggagaaagcctatgtactcgtataacctggcggcagcgcaaaagatg

SEQ ID NO: 122141 - DNA, 103 bp, Artificial Sequence
  Synthetic Polynucleotide
taatacgactcactatagggtggccatgcagatgagcgtggcatacgagtaacagaggagaactcgtatgccacgctcaaacctggcggcagcgcaaaagatg

SEQ ID NO: 122142 - DNA, 103 bp, Artificial Sequence
  Synthetic Polynucleotide
taatacgactcactatagggctggcctgcatggccatgcagatgagcgtgaacagaggagacacgctatgctgcatggcaacctggcggcagcgcaaaagatg

SEQ ID NO: 122143 - DNA, 103 bp, Artificial Sequence
  Synthetic Polynucleotide
taatacgactcactatagggctccggcccggcctcctccgccggcccggcaacagaggagagccgggatggcggaggagaacctggcggcagcgcaaaagatg

SEQ ID NO: 122144 - DNA, 103 bp, Artificial Sequence
  Synthetic Polynucleotide
taatacgactcactatagggggtggccttgctggcctgcatggccatgcaaacagaggagatgcatgatgatgcaggccaacctggcggcagcgcaaaagatg

SEQ ID NO: 122145 - DNA, 103 bp, Artificial Sequence
  Synthetic Polynucleotide
taatacgactcactataggggggtgatcttggtggccttgctggcctgcaaacagaggagatgcaggatggcaaggccaaacctggcggcagcgcaaaagatg

SEQ ID NO: 122146 - DNA, 103 bp, Artificial Sequence
  Synthetic Polynucleotide
taatacgactcactatagggatggccgacagggtgatcttggtggccttgaacagaggagacaaggcatgcaagatcacaacctggcggcagcgcaaaagatg

SEQ ID NO: 122147 - DNA, 103 bp, Artificial Sequence
  Synthetic Polynucleotide
taatacgactcactatagggccacttgtagatggccgacagggtgatcttaacagaggagaaagatcatgctgtcggccaacctggcggcagcgcaaaagatg

SEQ ID NO: 122148 - DNA, 103 bp, Artificial Sequence
  Synthetic Polynucleotide
taatacgactcactatagggtgtccgtgatccacttgtagatggccgacaaacagaggagatgtcggatgtctacaagtaacctggcggcagcgcaaaagatg

SEQ ID NO: 122149 - DNA, 103 bp, Artificial Sequence
  Synthetic Polynucleotide
taatacgactcactatagggtagcagaagttgtccgtgatccacttgtagaacagaggagactacaaatggatcacggaaacctggcggcagcgcaaaagatg

SEQ ID NO: 122150 - DNA, 103 bp, Artificial Sequence
  Synthetic Polynucleotide
taatacgactcactataggggtggcggaagtagcagaagttgtccgtgataacagaggagaatcacgatgaacttctgcaacctggcggcagcgcaaaagatg

SEQ ID NO: 122151 - DNA, 103 bp, Artificial Sequence
  Synthetic Polynucleotide
taatacgactcactatagggtgggatctgcgtggcggaagtagcagaagtaacagaggagaacttctatgacttccgccaacctggcggcagcgcaaaagatg

SEQ ID NO: 122152 - DNA, 103 bp, Artificial Sequence
  Synthetic Polynucleotide
taatacgactcactatagggttctgccaggtgggatctgcgtggcggaagaacagaggagacttccgatgcgcagatccaacctggcggcagcgcaaaagatg

SEQ ID NO: 122153 - DNA, 103 bp, Artificial Sequence
  Synthetic Polynucleotide
taatacgactcactataggggcggattgaattctgccaggtgggatctgcaacagaggagagcagatatgacctggcagaacctggcggcagcgcaaaagatg

SEQ ID NO: 122154 - DNA, 103 bp, Artificial Sequence
  Synthetic Polynucleotide
taatacgactcactatagggccaggccgccctccggcccggcctcctccgaacagaggagacggaggatgccgggccggaacctggcggcagcgcaaaagatg

SEQ ID NO: 122155 - DNA, 103 bp, Artificial Sequence
  Synthetic Polynucleotide
taatacgactcactatagggacaggttgtggcggattgaattctgccaggaacagaggagacctggcatgattcaatccaacctggcggcagcgcaaaagatg

SEQ ID NO: 122156 - DNA, 103 bp, Artificial Sequence
  Synthetic Polynucleotide
taatacgactcactatagggttgttcagagacaggttgtggcggattgaaaacagaggagattcaatatgccacaacctaacctggcggcagcgcaaaagatg

SEQ ID NO: 122157 - DNA, 103 bp, Artificial Sequence
  Synthetic Polynucleotide
taatacgactcactataggggatgaagcacttgttcagagacaggttgtgaacagaggagacacaacatgtctctgaacaacctggcggcagcgcaaaagatg

SEQ ID NO: 122158 - DNA, 103 bp, Artificial Sequence
  Synthetic Polynucleotide
taatacgactcactataggggaggcactttgatgaagcacttgttcagagaacagaggagactctgaatgagtgcttcaaacctggcggcagcgcaaaagatg

SEQ ID NO: 122159 - DNA, 103 bp, Artificial Sequence
  Synthetic Polynucleotide
taatacgactcactatagggtccttctcccgaggcactttgatgaagcacaacagaggagagtgcttatgcaaagtgccaacctggcggcagcgcaaaagatg

SEQ ID NO: 122160 - DNA, 103 bp, Artificial Sequence
  Synthetic Polynucleotide
taatacgactcactataggggcctggttcgtccttctcccgaggcactttaacagaggagaaaagtgatgcgggagaagaacctggcggcagcgcaaaagatg

SEQ ID NO: 122161 - DNA, 103 bp, Artificial Sequence
  Synthetic Polynucleotide
taatacgactcactatagggagccccccttgcctggttcgtccttctcccaacagaggagagggagaatgacgaaccagaacctggcggcagcgcaaaagatg

SEQ ID NO: 122162 - DNA, 103 bp, Artificial Sequence
  Synthetic Polynucleotide
taatacgactcactatagggatgcgccagaagccccccttgcctggttcgaacagaggagacgaaccatgcaaggggggaacctggcggcagcgcaaaagatg

SEQ ID NO: 122163 - DNA, 103 bp, Artificial Sequence
  Synthetic Polynucleotide
taatacgactcactatagggctgggggtcaatgcgccagaagccccccttaacagaggagaaaggggatgttctggcgcaacctggcggcagcgcaaaagatg

SEQ ID NO: 122164 - DNA, 103 bp, Artificial Sequence
  Synthetic Polynucleotide
taatacgactcactataggggctccgcgtactgggggtcaatgcgccagaaacagaggagatctggcatgttgacccccaacctggcggcagcgcaaaagatg

SEQ ID NO: 122165 - DNA, 103 bp, Artificial Sequence
  Synthetic Polynucleotide
taatacgactcactatagggtcgggctcctccaggccgccctccggcccgaacagaggagacgggccatggggcggcctaacctggcggcagcgcaaaagatg

SEQ ID NO: 122166 - DNA, 103 bp, Artificial Sequence
  Synthetic Polynucleotide
taatacgactcactatagggctcagtagccgctccgcgtactgggggtcaaacagaggagatgacccatggtacgcggaaacctggcggcagcgcaaaagatg

SEQ ID NO: 122167 - DNA, 103 bp, Artificial Sequence
  Synthetic Polynucleotide
taatacgactcactataggggaaagcgccgctcagtagccgctccgcgtaaacagaggagatacgcgatgcggctactgaacctggcggcagcgcaaaagatg

SEQ ID NO: 122168 - DNA, 103 bp, Artificial Sequence
  Synthetic Polynucleotide
taatacgactcactataggggccgcttcttgaaagcgccgctcagtagccaacagaggagaggctacatggcggcgcttaacctggcggcagcgcaaaagatg

SEQ ID NO: 122169 - DNA, 103 bp, Artificial Sequence
  Synthetic Polynucleotide
taatacgactcactataggggggggcagtcgccgcttcttgaaagcgccgaacagaggagacggcgcatgcaagaagcgaacctggcggcagcgcaaaagatg

SEQ ID NO: 122170 - DNA, 103 bp, Artificial Sequence
  Synthetic Polynucleotide
taatacgactcactataggggatgtggacagggggcagtcgccgcttcttaacagaggagaaagaagatgcgactgcccaacctggcggcagcgcaaaagatg

SEQ ID NO: 122171 - DNA, 103 bp, Artificial Sequence
  Synthetic Polynucleotide
taatacgactcactatagggaggctgggtggatgtggacagggggcagtcaacagaggagagactgcatgctgtccacaaacctggcggcagcgcaaaagatg

SEQ ID NO: 122172 - DNA, 103 bp, Artificial Sequence
  Synthetic Polynucleotide
taatacgactcactatagggtggcgggcaaaggctgggtggatgtggacaaacagaggagatgtccaatgccacccagcaacctggcggcagcgcaaaagatg

SEQ ID NO: 122173 - DNA, 103 bp, Artificial Sequence
  Synthetic Polynucleotide
taatacgactcactatagggctgcgcggcctggcgggcaaaggctgggtgaacagaggagacacccaatgtttgcccgcaacctggcggcagcgcaaaagatg

SEQ ID NO: 122174 - DNA, 103 bp, Artificial Sequence
  Synthetic Polynucleotide
taatacgactcactatagggcgctgggctcctgcgcggcctggcgggcaaaacagaggagattgcccatgaggccgcgcaacctggcggcagcgcaaaagatg

SEQ ID NO: 122175 - DNA, 103 bp, Artificial Sequence
  Synthetic Polynucleotide
taatacgactcactatagggcgggggacagcgctgggctcctgcgcggccaacagaggagaggccgcatgggagcccagaacctggcggcagcgcaaaagatg

SEQ ID NO: 122176 - DNA, 103 bp, Artificial Sequence
  Synthetic Polynucleotide
taatacgactcactatagggatccagggcgtcgggctcctccaggccgccaacagaggagaggcggcatggaggagcccaacctggcggcagcgcaaaagatg

SEQ ID NO: 122177 - DNA, 103 bp, Artificial Sequence
  Synthetic Polynucleotide
taatacgactcactatagggcggcccggcccgggggacagcgctgggctcaacagaggagagagcccatggctgtccccaacctggcggcagcgcaaaagatg

SEQ ID NO: 122178 - DNA, 103 bp, Artificial Sequence
  Synthetic Polynucleotide
taatacgactcactatagggtcaccgtcagcggcccggcccgggggacagaacagaggagactgtccatggggccgggcaacctggcggcagcgcaaaagatg

SEQ ID NO: 122179 - DNA, 103 bp, Artificial Sequence
  Synthetic Polynucleotide
taatacgactcactataggggcctcggtattcaccgtcagcggcccggccaacagaggagaggccggatggctgacggtaacctggcggcagcgcaaaagatg

SEQ ID NO: 122180 - DNA, 103 bp, Artificial Sequence
  Synthetic Polynucleotide
taatacgactcactatagggcagctgctgggcctcggtattcaccgtcagaacagaggagactgacgatgaataccgagaacctggcggcagcgcaaaagatg

SEQ ID NO: 122181 - DNA, 103 bp, Artificial Sequence
  Synthetic Polynucleotide
taatacgactcactatagggactcccgcagcagctgctgggcctcggtataacagaggagaataccgatgcccagcagcaacctggcggcagcgcaaaagatg

SEQ ID NO: 122182 - DNA, 103 bp, Artificial Sequence
  Synthetic Polynucleotide
taatacgactcactataggggcctcctcgaactcccgcagcagctgctggaacagaggagaccagcaatggctgcgggaaacctggcggcagcgcaaaagatg

SEQ ID NO: 122183 - DNA, 103 bp, Artificial Sequence
  Synthetic Polynucleotide
taatacgactcactatagggctccccggtggcctcctcgaactcccgcagaacagaggagactgcggatgttcgaggagaacctggcggcagcgcaaaagatg

SEQ ID NO: 122184 - DNA, 103 bp, Artificial Sequence
  Synthetic Polynucleotide
taatacgactcactatagggcccagcccgcctccccggtggcctcctcgaaacagaggagatcgaggatgccaccggggaacctggcggcagcgcaaaagatg

SEQ ID NO: 122185 - DNA, 103 bp, Artificial Sequence
  Synthetic Polynucleotide
taatacgactcactatagggtcgcctgcaccccagcccgcctccccggtgaacagaggagacaccggatgggcgggctgaacctggcggcagcgcaaaagatg

SEQ ID NO: 122186 - DNA, 103 bp, Artificial Sequence
  Synthetic Polynucleotide
taatacgactcactatagggcagcctgccctcgcctgcaccccagcccgcaacagaggagagcgggcatgggtgcaggcaacctggcggcagcgcaaaagatg

SEQ ID NO: 122187 - DNA, 103 bp, Artificial Sequence
  Synthetic Polynucleotide
taatacgactcactatagggtcaggctgtcatccagggcgtcgggctcctaacagaggagaaggagcatgacgccctggaacctggcggcagcgcaaaagatg

SEQ ID NO: 122188 - DNA, 103 bp, Artificial Sequence
  Synthetic Polynucleotide
taatacgactcactataggggcttatgccccagcctgccctcgcctgcacaacagaggagagtgcagatgagggcaggcaacctggcggcagcgcaaaagatg

SEQ ID NO: 122189 - DNA, 103 bp, Artificial Sequence
  Synthetic Polynucleotide
taatacgactcactatagggggctgtttgcgcttatgccccagcctgcccaacagaggagagggcagatgggggcataaaacctggcggcagcgcaaaagatg

SEQ ID NO: 122190 - DNA, 103 bp, Artificial Sequence
  Synthetic Polynucleotide
taatacgactcactatagggcttgggcagcggctgtttgcgcttatgcccaacagaggagagggcatatgcgcaaacagaacctggcggcagcgcaaaagatg

SEQ ID NO: 122191 - DNA, 103 bp, Artificial Sequence
  Synthetic Polynucleotide
taatacgactcactatagggtggccacccgcttgggcagcggctgtttgcaacagaggagagcaaacatgcgctgcccaaacctggcggcagcgcaaaagatg

SEQ ID NO: 122192 - DNA, 103 bp, Artificial Sequence
  Synthetic Polynucleotide
taatacgactcactatagggcgcgggaccttggccacccgcttgggcagcaacagaggagagctgccatggcgggtggcaacctggcggcagcgcaaaagatg

SEQ ID NO: 122193 - DNA, 103 bp, Artificial Sequence
  Synthetic Polynucleotide
taatacgactcactataggggctggggggccgcgggaccttggccacccgaacagaggagacgggtgatgaaggtcccgaacctggcggcagcgcaaaagatg

SEQ ID NO: 122194 - DNA, 103 bp, Artificial Sequence
  Synthetic Polynucleotide
taatacgactcactataggggcagcagggtgctggggggccgcgggacctaacagaggagaaggtccatgggccccccaaacctggcggcagcgcaaaagatg

SEQ ID NO: 122195 - DNA, 103 bp, Artificial Sequence
  Synthetic Polynucleotide
taatacgactcactatagggtccggggtgggcagcagggtgctggggggcaacagaggagagcccccatgcaccctgctaacctggcggcagcgcaaaagatg

SEQ ID NO: 122196 - DNA, 103 bp, Artificial Sequence
  Synthetic Polynucleotide
taatacgactcactatagggaccctgctcctccggggtgggcagcagggtaacagaggagaaccctgatgcccaccccgaacctggcggcagcgcaaaagatg

SEQ ID NO: 122197 - DNA, 103 bp, Artificial Sequence
  Synthetic Polynucleotide
taatacgactcactataggggttccagctcaccctgctcctccggggtggaacagaggagaccacccatgaggagcaggaacctggcggcagcgcaaaagatg

SEQ ID NO: 122198 - DNA, 103 bp, Artificial Sequence
  Synthetic Polynucleotide
taatacgactcactatagggtgcaggctggtcaggctgtcatccagggcgaacagaggagacgccctatgtgacagcctaacctggcggcagcgcaaaagatg

SEQ ID NO: 122199 - DNA, 103 bp, Artificial Sequence
  Synthetic Polynucleotide
taatacgactcactatagggcctttgaggggttccagctcaccctgctccaacagaggagaggagcaatgtgagctggaaacctggcggcagcgcaaaagatg

SEQ ID NO: 122200 - DNA, 103 bp, Artificial Sequence
  Synthetic Polynucleotide
taatacgactcactataggggtcaaagttgcctttgaggggttccagctcaacagaggagagagctgatgcccctcaaaaacctggcggcagcgcaaaagatg

SEQ ID NO: 122201 - DNA, 103 bp, Artificial Sequence
  Synthetic Polynucleotide
taatacgactcactatagggtggcctcccagtcaaagttgcctttgagggaacagaggagaccctcaatggcaactttgaacctggcggcagcgcaaaagatg

SEQ ID NO: 122202 - DNA, 103 bp, Artificial Sequence
  Synthetic Polynucleotide
taatacgactcactataggggcgtcgaagatggcctcccagtcaaagttgaacagaggagacaacttatgctgggaggcaacctggcggcagcgcaaaagatg

SEQ ID NO: 122203 - DNA, 103 bp, Artificial Sequence
  Synthetic Polynucleotide
taatacgactcactatagggcagagtgccggcgtcgaagatggcctcccaaacagaggagatgggagatgatcttcgacaacctggcggcagcgcaaaagatg

SEQ ID NO: 122204 - DNA, 103 bp, Artificial Sequence
  Synthetic Polynucleotide
taatacgactcactataggggctccccgcccagagtgccggcgtcgaagaaacagaggagatcttcgatgccggcactcaacctggcggcagcgcaaaagatg

SEQ ID NO: 122205 - DNA, 103 bp, Artificial Sequence
  Synthetic Polynucleotide
taatacgactcactatagggagtgcacccagctccccgcccagagtgccgaacagaggagacggcacatggggcggggaaacctggcggcagcgcaaaagatg

SEQ ID NO: 122206 - DNA, 103 bp, Artificial Sequence
  Synthetic Polynucleotide
taatacgactcactatagggcagggcctccagtgcacccagctccccgccaacagaggagaggcgggatgctgggtgcaaacctggcggcagcgcaaaagatg

SEQ ID NO: 122207 - DNA, 103 bp, Artificial Sequence
  Synthetic Polynucleotide
taatacgactcactatagggggctcagctccagggcctccagtgcacccaaacagaggagatgggtgatgtggaggcccaacctggcggcagcgcaaaagatg

SEQ ID NO: 122208 - DNA, 103 bp, Artificial Sequence
  Synthetic Polynucleotide
taatacgactcactatagggctcagaggcgggctcagctccagggcctccaacagaggagaggaggcatgggagctgagaacctggcggcagcgcaaaagatg

SEQ ID NO: 122209 - DNA, 103 bp, Artificial Sequence
  Synthetic Polynucleotide
taatacgactcactatagggggtgaggctactctctaggtcagaagccataacagaggagaatggctatggacctagagaacctggcggcagcgcaaaagatg

SEQ ID NO: 122210 - DNA, 103 bp, Artificial Sequence
  Synthetic Polynucleotide
taatacgactcactataggggcggctgctcccgggaggcccagcctgggaaacagaggagatcccagatggggcctcccaacctggcggcagcgcaaaagatg

SEQ ID NO: 122211 - DNA, 103 bp, Artificial Sequence
  Synthetic Polynucleotide
taatacgactcactataggggcttggggtgtgcagtggaggagcacccccaacagaggagagggggtatgcctccactgaacctggcggcagcgcaaaagatg

SEQ ID NO: 122212 - DNA, 103 bp, Artificial Sequence
  Synthetic Polynucleotide
taatacgactcactatagggaaccatctgtgcttggggtgtgcagtggagaacagaggagactccacatgacaccccaaaacctggcggcagcgcaaaagatg

SEQ ID NO: 122213 - DNA, 103 bp, Artificial Sequence
  Synthetic Polynucleotide
taatacgactcactatagggggtggggtacaaccatctgtgcttggggtgaacagaggagacaccccatgcacagatggaacctggcggcagcgcaaaagatg

SEQ ID NO: 122214 - DNA, 103 bp, Artificial Sequence
  Synthetic Polynucleotide
taatacgactcactatagggctttccccctggtggggtacaaccatctgtaacagaggagaacagatatgtgtaccccaaacctggcggcagcgcaaaagatg

SEQ ID NO: 122215 - DNA, 103 bp, Artificial Sequence
  Synthetic Polynucleotide
taatacgactcactatagggccccagcttgctttccccctggtggggtacaacagaggagagtacccatgcagggggaaaacctggcggcagcgcaaaagatg

SEQ ID NO: 122216 - DNA, 103 bp, Artificial Sequence
  Synthetic Polynucleotide
taatacgactcactatagggtagccttccgccccagcttgctttccccctaacagaggagaagggggatggcaagctggaacctggcggcagcgcaaaagatg

SEQ ID NO: 122217 - DNA, 103 bp, Artificial Sequence
  Synthetic Polynucleotide
taatacgactcactataggggggaggcccatagccttccgccccagcttgaacagaggagacaagctatggcggaaggcaacctggcggcagcgcaaaagatg

SEQ ID NO: 122218 - DNA, 103 bp, Artificial Sequence
  Synthetic Polynucleotide
taatacgactcactatagggccattacagggggaggcccatagccttccgaacagaggagacggaagatgatgggcctcaacctggcggcagcgcaaaagatg

SEQ ID NO: 122219 - DNA, 103 bp, Artificial Sequence
  Synthetic Polynucleotide
taatacgactcactatagggggatgcatggccattacagggggaggcccaaacagaggagatgggccatgccctgtaataacctggcggcagcgcaaaagatg

SEQ ID NO: 122220 - DNA, 103 bp, Artificial Sequence
  Synthetic Polynucleotide
taatacgactcactatagggcagcgggggtggatgcatggccattacaggaacagaggagacctgtaatggccatgcataacctggcggcagcgcaaaagatg

SEQ ID NO: 122221 - DNA, 103 bp, Artificial Sequence
  Synthetic Polynucleotide
taatacgactcactataggggtgaacacttgcggctgctcccgggaggccaacagaggagaggcctcatgggagcagccaacctggcggcagcgcaaaagatg

SEQ ID NO: 122222 - DNA, 103 bp, Artificial Sequence
  Synthetic Polynucleotide
taatacgactcactatagggctccatgctgcagcgggggtggatgcatggaacagaggagaccatgcatgcacccccgcaacctggcggcagcgcaaaagatg

SEQ ID NO: 122223 - DNA, 103 bp, Artificial Sequence
  Synthetic Polynucleotide
taatacgactcactataggggggtggtagcctccatgctgcagcgggggtaacagaggagaacccccatggcagcatggaacctggcggcagcgcaaaagatg

SEQ ID NO: 122224 - DNA, 103 bp, Artificial Sequence
  Synthetic Polynucleotide
taatacgactcactataggggtgctgatgagggtggtagcctccatgctgaacagaggagacagcatatgggctaccacaacctggcggcagcgcaaaagatg

SEQ ID NO: 122225 - DNA, 103 bp, Artificial Sequence
  Synthetic Polynucleotide
taatacgactcactatagggagtggggatggtgctgatgagggtggtagcaacagaggagagctaccatgctcatcagcaacctggcggcagcgcaaaagatg

SEQ ID NO: 122226 - DNA, 103 bp, Artificial Sequence
  Synthetic Polynucleotide
taatacgactcactataggggcagggtgggagtggggatggtgctgatgaaacagaggagatcatcaatgccatccccaaacctggcggcagcgcaaaagatg

SEQ ID NO: 122227 - DNA, 103 bp, Artificial Sequence
  Synthetic Polynucleotide
taatacgactcactatagggtggctgctgggcagggtgggagtggggatgaacagaggagacatcccatgtcccaccctaacctggcggcagcgcaaaagatg

SEQ ID NO: 122228 - DNA, 103 bp, Artificial Sequence
  Synthetic Polynucleotide
taatacgactcactataggggtggaggtggtggctgctgggcagggtgggaacagaggagacccaccatgcccagcagcaacctggcggcagcgcaaaagatg

SEQ ID NO: 122229 - DNA, 103 bp, Artificial Sequence
  Synthetic Polynucleotide
taatacgactcactataggggcctgtggctgtggaggtggtggctgctggaacagaggagaccagcaatgaccacctccaacctggcggcagcgcaaaagatg

SEQ ID NO: 122230 - DNA, 103 bp, Artificial Sequence
  Synthetic Polynucleotide
taatacgactcactatagggctggccttgtgcctgtggctgtggaggtggaacagaggagaccacctatgcagccacagaacctggcggcagcgcaaaagatg

SEQ ID NO: 122231 - DNA, 103 bp, Artificial Sequence
  Synthetic Polynucleotide
taatacgactcactatagggtgatgggagcctggccttgtgcctgtggctaacagaggagaagccacatgcacaaggccaacctggcggcagcgcaaaagatg

SEQ ID NO: 122232 - DNA, 103 bp, Artificial Sequence
  Synthetic Polynucleotide
taatacgactcactatagggggtgaccctggtgaacacttgcggctgctcaacagaggagagagcagatgcaagtgttcaacctggcggcagcgcaaaagatg

SEQ ID NO: 122233 - DNA, 103 bp, Artificial Sequence
  Synthetic Polynucleotide
taatacgactcactatagggccagtgttgttgatgggagcctggccttgtaacagaggagaacaaggatgggctcccataacctggcggcagcgcaaaagatg

SEQ ID NO: 122234 - DNA, 103 bp, Artificial Sequence
  Synthetic Polynucleotide
taatacgactcactatagggaaaggcaaagccagtgttgttgatgggagcaacagaggagagctcccatgaacaacactaacctggcggcagcgcaaaagatg

SEQ ID NO: 122235 - DNA, 103 bp, Artificial Sequence
  Synthetic Polynucleotide
taatacgactcactatagggagtcagaaggaaaggcaaagccagtgttgtaacagaggagaacaacaatggctttgcctaacctggcggcagcgcaaaagatg

SEQ ID NO: 122236 - DNA, 103 bp, Artificial Sequence
  Synthetic Polynucleotide
taatacgactcactatagggttagagcaccagtcagaaggaaaggcaaagaacagaggagactttgcatgtccttctgaaacctggcggcagcgcaaaagatg

SEQ ID NO: 122237 - DNA, 103 bp, Artificial Sequence
  Synthetic Polynucleotide
taatacgactcactatagggagagtcaatattagagcaccagtcagaaggaacagaggagaccttctatgtggtgctctaacctggcggcagcgcaaaagatg

SEQ ID NO: 122238 - DNA, 103 bp, Artificial Sequence
  Synthetic Polynucleotide
taatacgactcactatagggtttcctttaaagagtcaatattagagcaccaacagaggagaggtgctatgatattgactaacctggcggcagcgcaaaagatg

SEQ ID NO: 122239 - DNA, 103 bp, Artificial Sequence
  Synthetic Polynucleotide
taatacgactcactatagggatcttgaagctttcctttaaagagtcaataaacagaggagatattgaatgtttaaaggaaacctggcggcagcgcaaaagatg

SEQ ID NO: 122240 - DNA, 103 bp, Artificial Sequence
  Synthetic Polynucleotide
taatacgactcactatagggccgattcaccatcttgaagctttcctttaaaacagaggagattaaagatgagcttcaagaacctggcggcagcgcaaaagatg

SEQ ID NO: 122241 - DNA, 103 bp, Artificial Sequence
  Synthetic Polynucleotide
taatacgactcactatagggaccaattgagccgattcaccatcttgaagcaacagaggagagcttcaatgtggtgaatcaacctggcggcagcgcaaaagatg

SEQ ID NO: 122242 - DNA, 103 bp, Artificial Sequence
  Synthetic Polynucleotide
taatacgactcactatagggtcaatgctggaccaattgagccgattcaccaacagaggagaggtgaaatggctcaattgaacctggcggcagcgcaaaagatg

SEQ ID NO: 122243 - DNA, 103 bp, Artificial Sequence
  Synthetic Polynucleotide
taatacgactcactatagggaggatctgtgggtgaccctggtgaacacttaacagaggagaaagtgtatgccagggtcaaacctggcggcagcgcaaaagatg

SEQ ID NO: 122244 - DNA, 103 bp, Artificial Sequence
  Synthetic Polynucleotide
taatacgactcactatagggttgtgactgctcaatgctggaccaattgagaacagaggagactcaatatgtccagcattaacctggcggcagcgcaaaagatg

SEQ ID NO: 122245 - DNA, 103 bp, Artificial Sequence
  Synthetic Polynucleotide
taatacgactcactataggggttctgagaattgtgactgctcaatgctggaacagaggagaccagcaatgagcagtcacaacctggcggcagcgcaaaagatg

SEQ ID NO: 122246 - DNA, 103 bp, Artificial Sequence
  Synthetic Polynucleotide
taatacgactcactatagggctctccatcagttctgagaattgtgactgcaacagaggagagcagtcatgattctcagaaacctggcggcagcgcaaaagatg

SEQ ID NO: 122247 - DNA, 103 bp, Artificial Sequence
  Synthetic Polynucleotide
taatacgactcactatagggctgtcgtagactctccatcagttctgagaaaacagaggagattctcaatgctgatggagaacctggcggcagcgcaaaagatg

SEQ ID NO: 122248 - DNA, 103 bp, Artificial Sequence
  Synthetic Polynucleotide
taatacgactcactatagggtctgctctgcctgtcgtagactctccatcaaacagaggagatgatggatggtctacgacaacctggcggcagcgcaaaagatg

SEQ ID NO: 122249 - DNA, 103 bp, Artificial Sequence
  Synthetic Polynucleotide
taatacgactcactataggggtccagttcttctgctctgcctgtcgtagaaacagaggagatctacgatgggcagagcaaacctggcggcagcgcaaaagatg

SEQ ID NO: 122250 - DNA, 103 bp, Artificial Sequence
  Synthetic Polynucleotide
taatacgactcactatagggctggtcgagggtccagttcttctgctctgcaacagaggagagcagagatgaagaactggaacctggcggcagcgcaaaagatg

SEQ ID NO: 122251 - DNA, 103 bp, Artificial Sequence
  Synthetic Polynucleotide
taatacgactcactatagggcaatgtgatgctggtcgagggtccagttctaacagaggagaagaactatgccctcgaccaacctggcggcagcgcaaaagatg

SEQ ID NO: 122252 - DNA, 103 bp, Artificial Sequence
  Synthetic Polynucleotide
taatacgactcactatagggcacagattggcaatgtgatgctggtcgaggaacagaggagacctcgaatggcatcacataacctggcggcagcgcaaaagatg

SEQ ID NO: 122253 - DNA, 103 bp, Artificial Sequence
  Synthetic Polynucleotide
taatacgactcactataggggagggagtcacacagattggcaatgtgatgaacagaggagacatcacatggccaatctgaacctggcggcagcgcaaaagatg

SEQ ID NO: 122254 - DNA, 103 bp, Artificial Sequence
  Synthetic Polynucleotide
taatacgactcactataggggggtggcattaggatctgtgggtgaccctgaacagaggagacagggtatgccacagatcaacctggcggcagcgcaaaagatg

SEQ ID NO: 122255 - DNA, 103 bp, Artificial Sequence
  Synthetic Polynucleotide
taatacgactcactatagggggaagtggttgagggagtcacacagattggaacagaggagaccaatcatggtgactcccaacctggcggcagcgcaaaagatg

SEQ ID NO: 122256 - DNA, 103 bp, Artificial Sequence
  Synthetic Polynucleotide
taatacgactcactataggggtctgagtaaggaagtggttgagggagtcaaacagaggagatgactcatgcaaccacttaacctggcggcagcgcaaaagatg

SEQ ID NO: 122257 - DNA, 103 bp, Artificial Sequence
  Synthetic Polynucleotide
taatacgactcactatagggcacgtgaccagtctgagtaaggaagtggttaacagaggagaaaccacatgcttactcagaacctggcggcagcgcaaaagatg

SEQ ID NO: 122258 - DNA, 103 bp, Artificial Sequence
  Synthetic Polynucleotide
taatacgactcactatagggcttgagggggcacgtgaccagtctgagtaaaacagaggagattactcatgctggtcacgaacctggcggcagcgcaaaagatg

SEQ ID NO: 122259 - DNA, 103 bp, Artificial Sequence
  Synthetic Polynucleotide
taatacgactcactatagggtgggtacccccttgagggggcacgtgaccaaacagaggagatggtcaatggccccctcaaacctggcggcagcgcaaaagatg

SEQ ID NO: 122260 - DNA, 103 bp, Artificial Sequence
  Synthetic Polynucleotide
taatacgactcactatagggtggtgggcggtgggtacccccttgagggggaacagaggagaccccctatggggggtaccaacctggcggcagcgcaaaagatg

SEQ ID NO: 122261 - DNA, 103 bp, Artificial Sequence
  Synthetic Polynucleotide
taatacgactcactataggggggcaggggctggtgggcggtgggtaccccaacagaggagaggggtaatgaccgcccacaacctggcggcagcgcaaaagatg

SEQ ID NO: 122262 - DNA, 103 bp, Artificial Sequence
  Synthetic Polynucleotide
taatacgactcactatagggtcagcaatacgggcaggggctggtgggcggaacagaggagaccgcccatgagcccctgcaacctggcggcagcgcaaaagatg

SEQ ID NO: 122263 - DNA, 103 bp, Artificial Sequence
  Synthetic Polynucleotide
taatacgactcactatagggggcacaggagtcagcaatacgggcaggggcaacagaggagagcccctatgcgtattgctaacctggcggcagcgcaaaagatg

SEQ ID NO: 122264 - DNA, 103 bp, Artificial Sequence
  Synthetic Polynucleotide
taatacgactcactatagggcactggtgagggcacaggagtcagcaatacaacagaggagagtattgatgactcctgtgaacctggcggcagcgcaaaagatg

SEQ ID NO: 122265 - DNA, 103 bp, Artificial Sequence
  Synthetic Polynucleotide
taatacgactcactatagggtctttgctcagggtggcattaggatctgtgaacagaggagacacagaatgtaatgccacaacctggcggcagcgcaaaagatg

SEQ ID NO: 122266 - DNA, 103 bp, Artificial Sequence
  Synthetic Polynucleotide
taatacgactcactatagggtcctgtttgccactggtgagggcacaggagaacagaggagactcctgatgcctcaccagaacctggcggcagcgcaaaagatg

SEQ ID NO: 122267 - DNA, 103 bp, Artificial Sequence
  Synthetic Polynucleotide
taatacgactcactatagggcatggctgactcctgtttgccactggtgagaacagaggagactcaccatgggcaaacagaacctggcggcagcgcaaaagatg

SEQ ID NO: 122268 - DNA, 103 bp, Artificial Sequence
  Synthetic Polynucleotide
taatacgactcactatagggtcacttggctcatggctgactcctgtttgcaacagaggagagcaaacatgagtcagccaaacctggcggcagcgcaaaagatg

SEQ ID NO: 122269 - DNA, 103 bp, Artificial Sequence
  Synthetic Polynucleotide
taatacgactcactatagggccataagagttcacttggctcatggctgacaacagaggagagtcagcatggagccaagtaacctggcggcagcgcaaaagatg

SEQ ID NO: 122270 - DNA, 103 bp, Artificial Sequence
  Synthetic Polynucleotide
taatacgactcactatagggttgtgggtgcccataagagttcacttggctaacagaggagaagccaaatgaactcttataacctggcggcagcgcaaaagatg

SEQ ID NO: 122271 - DNA, 103 bp, Artificial Sequence
  Synthetic Polynucleotide
taatacgactcactatagggggtggggagcttgtgggtgcccataagagtaacagaggagaactcttatgggcacccacaacctggcggcagcgcaaaagatg

SEQ ID NO: 122272 - DNA, 103 bp, Artificial Sequence
  Synthetic Polynucleotide
taatacgactcactatagggccagggtagaggtggggagcttgtgggtgcaacagaggagagcacccatgagctccccaaacctggcggcagcgcaaaagatg

SEQ ID NO: 122273 - DNA, 103 bp, Artificial Sequence
  Synthetic Polynucleotide
taatacgactcactatagggtggtgatgggccagggtagaggtggggagcaacagaggagagctcccatgctctaccctaacctggcggcagcgcaaaagatg

SEQ ID NO: 122274 - DNA, 103 bp, Artificial Sequence
  Synthetic Polynucleotide
taatacgactcactatagggttgggtacattggtgatgggccagggtagaaacagaggagatctaccatggcccatcacaacctggcggcagcgcaaaagatg

SEQ ID NO: 122275 - DNA, 103 bp, Artificial Sequence
  Synthetic Polynucleotide
taatacgactcactatagggtgggtggggattgggtacattggtgatgggaacagaggagacccatcatgaatgtacccaacctggcggcagcgcaaaagatg

SEQ ID NO: 122276 - DNA, 103 bp, Artificial Sequence
  Synthetic Polynucleotide
taatacgactcactatagggtgctgcctcgtctttgctcagggtggcattaacagaggagaaatgccatgctgagcaaaaacctggcggcagcgcaaaagatg

SEQ ID NO: 122277 - DNA, 103 bp, Artificial Sequence
  Synthetic Polynucleotide
taatacgactcactatagggtgctgagtcctgggtggggattgggtacataacagaggagaatgtacatgatccccaccaacctggcggcagcgcaaaagatg

SEQ ID NO: 122278 - DNA, 103 bp, Artificial Sequence
  Synthetic Polynucleotide
taatacgactcactataggggattgtatcctgctgagtcctgggtggggaaacagaggagatccccaatgaggactcagaacctggcggcagcgcaaaagatg

SEQ ID NO: 122279 - DNA, 103 bp, Artificial Sequence
  Synthetic Polynucleotide
taatacgactcactatagggtgtgctgggcgattgtatcctgctgagtccaacagaggagaggactcatgaggatacaaaacctggcggcagcgcaaaagatg

SEQ ID NO: 122280 - DNA, 103 bp, Artificial Sequence
  Synthetic Polynucleotide
taatacgactcactataggggaccatatggtgtgctgggcgattgtatccaacagaggagaggatacatgcgcccagcaaacctggcggcagcgcaaaagatg

SEQ ID NO: 122281 - DNA, 103 bp, Artificial Sequence
  Synthetic Polynucleotide
taatacgactcactatagggatggccgagggaccatatggtgtgctgggcaacagaggagagcccagatgaccatatggaacctggcggcagcgcaaaagatg

SEQ ID NO: 122282 - DNA, 103 bp, Artificial Sequence
  Synthetic Polynucleotide
taatacgactcactatagggggtggcactgatggccgagggaccatatggaacagaggagaccatatatgccctcggccaacctggcggcagcgcaaaagatg

SEQ ID NO: 122283 - DNA, 103 bp, Artificial Sequence
  Synthetic Polynucleotide
taatacgactcactatagggggcaccaggaggtggcactgatggccgaggaacagaggagacctcggatgtcagtgccaaacctggcggcagcgcaaaagatg

SEQ ID NO: 122284 - DNA, 103 bp, Artificial Sequence
  Synthetic Polynucleotide
taatacgactcactatagggtctcctcattggcaccaggaggtggcactgaacagaggagacagtgcatgctcctggtgaacctggcggcagcgcaaaagatg

SEQ ID NO: 122285 - DNA, 103 bp, Artificial Sequence
  Synthetic Polynucleotide
taatacgactcactatagggtcatcagggatctcctcattggcaccaggaaacagaggagatcctggatgcaatgaggaaacctggcggcagcgcaaaagatg

SEQ ID NO: 122286 - DNA, 103 bp, Artificial Sequence
  Synthetic Polynucleotide
taatacgactcactatagggccagtcgaagtcatcagggatctcctcattaacagaggagaaatgagatgatccctgataacctggcggcagcgcaaaagatg

SEQ ID NO: 122287 - DNA, 103 bp, Artificial Sequence
  Synthetic Polynucleotide
taatacgactcactatagggcctggtgcactgctgcctcgtctttgctcaaacagaggagatgagcaatgacgaggcagaacctggcggcagcgcaaaagatg

SEQ ID NO: 122288 - DNA, 103 bp, Artificial Sequence
  Synthetic Polynucleotide
taatacgactcactatagggtgatcaagtcccagtcgaagtcatcagggaaacagaggagatccctgatgacttcgactaacctggcggcagcgcaaaagatg

SEQ ID NO: 122289 - DNA, 103 bp, Artificial Sequence
  Synthetic Polynucleotide
taatacgactcactatagggggcttgccgtcctggtgcactgctgcctcgaacagaggagacgaggcatgagtgcaccaaacctggcggcagcgcaaaagatg

SEQ ID NO: 122290 - DNA, 103 bp, Artificial Sequence
  Synthetic Polynucleotide
taatacgactcactataggggctgtatcgtggcttgccgtcctggtgcacaacagaggagagtgcacatggacggcaagaacctggcggcagcgcaaaagatg

SEQ ID NO: 122291 - DNA, 103 bp, Artificial Sequence
  Synthetic Polynucleotide
taatacgactcactatagggagtctatggaggtgaggctactctctaggtaacagaggagaacctagatggtagcctcaaacctggcggcagcgcaaaagatg

SEQ ID NO: 122292 - DNA, 103 bp, Artificial Sequence
  Synthetic Polynucleotide
taatacgactcactataggggagtggcatagctgtatcgtggcttgccgtaacagaggagaacggcaatgcacgatacaaacctggcggcagcgcaaaagatg

SEQ ID NO: 122293 - DNA, 103 bp, Artificial Sequence
  Synthetic Polynucleotide
taatacgactcactatagggtaggtgatgagagtggcatagctgtatcgtaacagaggagaacgataatgctatgccacaacctggcggcagcgcaaaagatg

SEQ ID NO: 122294 - DNA, 103 bp, Artificial Sequence
  Synthetic Polynucleotide
taatacgactcactataggggttgatggcataggtgatgagagtggcataaacagaggagatatgccatgctcatcaccaacctggcggcagcgcaaaagatg

SEQ ID NO: 122295 - DNA, 103 bp, Artificial Sequence
  Synthetic Polynucleotide
taatacgactcactatagggctggagaggagttgatggcataggtgatgaaacagaggagatcatcaatgatgccatcaaacctggcggcagcgcaaaagatg

SEQ ID NO: 122296 - DNA, 103 bp, Artificial Sequence
  Synthetic Polynucleotide
taatacgactcactatagggatcttcttggctggagaggagttgatggcaaacagaggagatgccatatgctcctctccaacctggcggcagcgcaaaagatg

SEQ ID NO: 122297 - DNA, 103 bp, Artificial Sequence
  Synthetic Polynucleotide
taatacgactcactataggggctgagggtcatcttcttggctggagaggaaacagaggagatcctctatggccaagaagaacctggcggcagcgcaaaagatg

SEQ ID NO: 122298 - DNA, 103 bp, Artificial Sequence
  Synthetic Polynucleotide
taatacgactcactatagggggtaaatctcgctgagggtcatcttcttggaacagaggagaccaagaatgtgaccctcaaacctggcggcagcgcaaaagatg

SEQ ID NO: 122299 - DNA, 103 bp, Artificial Sequence
  Synthetic Polynucleotide
taatacgactcactatagggcagatccagcggtaaatctcgctgagggtcaacagaggagagaccctatgcgagatttaaacctggcggcagcgcaaaagatg

SEQ ID NO: 122300 - DNA, 103 bp, Artificial Sequence
  Synthetic Polynucleotide
taatacgactcactataggggaagttatcacagatccagcggtaaatctcaacagaggagagagattatgcgctggatcaacctggcggcagcgcaaaagatg

SEQ ID NO: 122301 - DNA, 103 bp, Artificial Sequence
  Synthetic Polynucleotide
taatacgactcactatagggtgtaataggggaagttatcacagatccagcaacagaggagagctggaatggtgataactaacctggcggcagcgcaaaagatg

SEQ ID NO: 122302 - DNA, 103 bp, Artificial Sequence
  Synthetic Polynucleotide
taatacgactcactatagggtgggggagccagtctatggaggtgaggctaaacagaggagatagcctatgctccatagaaacctggcggcagcgcaaaagatg

SEQ ID NO: 122303 - DNA, 103 bp, Artificial Sequence
  Synthetic Polynucleotide
taatacgactcactatagggccagcattcttgtaataggggaagttatcaaacagaggagatgataaatgcccctattaaacctggcggcagcgcaaaagatg

SEQ ID NO: 122304 - DNA, 103 bp, Artificial Sequence
  Synthetic Polynucleotide
taatacgactcactatagggccaaccaatgccagcattcttgtaatagggaacagaggagaccctatatgaagaatgctaacctggcggcagcgcaaaagatg

SEQ ID NO: 122305 - DNA, 103 bp, Artificial Sequence
  Synthetic Polynucleotide
taatacgactcactatagggttgaattcttccaaccaatgccagcattctaacagaggagaagaatgatggcattggttaacctggcggcagcgcaaaagatg

SEQ ID NO: 122306 - DNA, 103 bp, Artificial Sequence
  Synthetic Polynucleotide
taatacgactcactatagggttgtgccgtattgaattcttccaaccaatgaacagaggagacattggatggaagaattcaacctggcggcagcgcaaaagatg

SEQ ID NO: 122307 - DNA, 103 bp, Artificial Sequence
  Synthetic Polynucleotide
taatacgactcactataggggagagaaaggttgtgccgtattgaattcttaacagaggagaaagaatatgatacggcacaacctggcggcagcgcaaaagatg

SEQ ID NO: 122308 - DNA, 103 bp, Artificial Sequence
  Synthetic Polynucleotide
taatacgactcactatagggaacacttgttgagagaaaggttgtgccgtaaacagaggagatacggcatgacctttctcaacctggcggcagcgcaaaagatg

SEQ ID NO: 122309 - DNA, 103 bp, Artificial Sequence
  Synthetic Polynucleotide
taatacgactcactatagggaccttccggaaacacttgttgagagaaaggaacagaggagacctttcatgcaacaagtgaacctggcggcagcgcaaaagatg

SEQ ID NO: 122310 - DNA, 103 bp, Artificial Sequence
  Synthetic Polynucleotide
taatacgactcactatagggaggtctgggcaccttccggaaacacttgttaacagaggagaaacaagatgttccggaagaacctggcggcagcgcaaaagatg

SEQ ID NO: 122311 - DNA, 103 bp, Artificial Sequence
  Synthetic Polynucleotide
taatacgactcactatagggggtcatcccgaggtctgggcaccttccggaaacagaggagatccggaatgtgcccagacaacctggcggcagcgcaaaagatg

SEQ ID NO: 122312 - DNA, 103 bp, Artificial Sequence
  Synthetic Polynucleotide
taatacgactcactatagggcccttcccagggtcatcccgaggtctgggcaacagaggagagcccagatgtcgggatgaaacctggcggcagcgcaaaagatg

SEQ ID NO: 122313 - DNA, 103 bp, Artificial Sequence
  Synthetic Polynucleotide
taatacgactcactataggggagggtcagctgggggagccagtctatggaaacagaggagatccataatgtggctccccaacctggcggcagcgcaaaagatg

SEQ ID NO: 122314 - DNA, 103 bp, Artificial Sequence
  Synthetic Polynucleotide
taatacgactcactatagggccaataggaacccttcccagggtcatcccgaacagaggagacgggatatgcctgggaagaacctggcggcagcgcaaaagatg

SEQ ID NO: 122315 - DNA, 103 bp, Artificial Sequence
  Synthetic Polynucleotide
taatacgactcactatagggtgtcaattgtccaataggaacccttcccagaacagaggagactgggaatggttcctattaacctggcggcagcgcaaaagatg

SEQ ID NO: 122316 - DNA, 103 bp, Artificial Sequence
  Synthetic Polynucleotide
taatacgactcactatagggtcagggcaggtgtcaattgtccaataggaaaacagaggagattcctaatggacaattgaaacctggcggcagcgcaaaagatg

SEQ ID NO: 122317 - DNA, 103 bp, Artificial Sequence
  Synthetic Polynucleotide
taatacgactcactatagggtcgggaaatgtcagggcaggtgtcaattgtaacagaggagaacaattatgacctgccctaacctggcggcagcgcaaaagatg

SEQ ID NO: 122318 - DNA, 103 bp, Artificial Sequence
  Synthetic Polynucleotide
taatacgactcactataggggtcttctctttcgggaaatgtcagggcaggaacagaggagacctgccatgacatttcccaacctggcggcagcgcaaaagatg

SEQ ID NO: 122319 - DNA, 103 bp, Artificial Sequence
  Synthetic Polynucleotide
taatacgactcactatagggtctggagggtgtcttctctttcgggaaatgaacagaggagacatttcatgaaagagaagaacctggcggcagcgcaaaagatg

SEQ ID NO: 122320 - DNA, 103 bp, Artificial Sequence
  Synthetic Polynucleotide
taatacgactcactatagggcagatcatcatctggagggtgtcttctcttaacagaggagaaagagaatgcaccctccaaacctggcggcagcgcaaaagatg

SEQ ID NO: 122321 - DNA, 103 bp, Artificial Sequence
  Synthetic Polynucleotide
taatacgactcactatagggagtcttgggacagatcatcatctggagggtaacagaggagaaccctcatgatgatgatcaacctggcggcagcgcaaaagatg

SEQ ID NO: 122322 - DNA, 103 bp, Artificial Sequence
  Synthetic Polynucleotide
taatacgactcactatagggtgttctggtgagtcttgggacagatcatcaaacagaggagatgatgaatggtcccaagaaacctggcggcagcgcaaaagatg

SEQ ID NO: 122323 - DNA, 103 bp, Artificial Sequence
  Synthetic Polynucleotide
taatacgactcactataggggcttgcctcctgttctggtgagtcttgggaaacagaggagatcccaaatgtcaccagaaaacctggcggcagcgcaaaagatg

SEQ ID NO: 122324 - DNA, 103 bp, Artificial Sequence
  Synthetic Polynucleotide
taatacgactcactatagggtggtagctcggagggtcagctgggggagccaacagaggagaggctccatgagctgacccaacctggcggcagcgcaaaagatg

SEQ ID NO: 122325 - DNA, 103 bp, Artificial Sequence
  Synthetic Polynucleotide
taatacgactcactataggggtgggctcttgcttgcctcctgttctggtgaacagaggagacaccagatgaggaggcaaaacctggcggcagcgcaaaagatg

SEQ ID NO: 122326 - DNA, 103 bp, Artificial Sequence
  Synthetic Polynucleotide
taatacgactcactatagggacgcctccccgtgggctcttgcttgcctccaacagaggagaggaggcatgcaagagcccaacctggcggcagcgcaaaagatg

SEQ ID NO: 122327 - DNA, 103 bp, Artificial Sequence
  Synthetic Polynucleotide
taatacgactcactatagggactccctgcaacgcctccccgtgggctcttaacagaggagaaagagcatgcggggaggcaacctggcggcagcgcaaaagatg

SEQ ID NO: 122328 - DNA, 103 bp, Artificial Sequence
  Synthetic Polynucleotide
taatacgactcactatagggaggcttctccactccctgcaacgcctccccaacagaggagaggggagatgttgcagggaaacctggcggcagcgcaaaagatg

SEQ ID NO: 122329 - DNA, 103 bp, Artificial Sequence
  Synthetic Polynucleotide
taatacgactcactatagggggaggcagtgaggcttctccactccctgcaaacagaggagatgcaggatgtggagaagcaacctggcggcagcgcaaaagatg

SEQ ID NO: 122330 - DNA, 103 bp, Artificial Sequence
  Synthetic Polynucleotide
taatacgactcactatagggattcccctcaggaggcagtgaggcttctccaacagaggagaggagaaatgtcactgcctaacctggcggcagcgcaaaagatg

SEQ ID NO: 122331 - DNA, 103 bp, Artificial Sequence
  Synthetic Polynucleotide
taatacgactcactatagggacatctgcggattcccctcaggaggcagtgaacagaggagacactgcatgctgaggggaaacctggcggcagcgcaaaagatg

SEQ ID NO: 122332 - DNA, 103 bp, Artificial Sequence
  Synthetic Polynucleotide
taatacgactcactatagggctctgaagtgacatctgcggattcccctcaaacagaggagatgagggatgtccgcagataacctggcggcagcgcaaaagatg

SEQ ID NO: 122333 - DNA, 103 bp, Artificial Sequence
  Synthetic Polynucleotide
taatacgactcactatagggagatgtggggctctgaagtgacatctgcggaacagaggagaccgcagatgtcacttcagaacctggcggcagcgcaaaagatg

SEQ ID NO: 122334 - DNA, 103 bp, Artificial Sequence
  Synthetic Polynucleotide
taatacgactcactatagggagctggctatagatgtggggctctgaagtgaacagaggagacacttcatggccccacataacctggcggcagcgcaaaagatg

SEQ ID NO: 122335 - DNA, 103 bp, Artificial Sequence
  Synthetic Polynucleotide
taatacgactcactatagggagcttctcaatggtagctcggagggtcagcaacagaggagagctgacatgccgagctacaacctggcggcagcgcaaaagatg

SEQ ID NO: 122336 - DNA, 103 bp, Artificial Sequence
  Synthetic Polynucleotide
taatacgactcactatagggccctggctgtagctggctatagatgtggggaacagaggagaccccacatgtatagccagaacctggcggcagcgcaaaagatg

SEQ ID NO: 122337 - DNA, 103 bp, Artificial Sequence
  Synthetic Polynucleotide
taatacgactcactatagggagatcctgtgccctggctgtagctggctataacagaggagaatagccatgtacagccagaacctggcggcagcgcaaaagatg

SEQ ID NO: 122338 - DNA, 103 bp, Artificial Sequence
  Synthetic Polynucleotide
taatacgactcactatagggcaccatccacagatcctgtgccctggctgtaacagaggagaacagccatggcacaggataacctggcggcagcgcaaaagatg

SEQ ID NO: 122339 - DNA, 103 bp, Artificial Sequence
  Synthetic Polynucleotide
taatacgactcactataggggccactgctccaccatccacagatcctgtgaacagaggagacacaggatgtgtggatggaacctggcggcagcgcaaaagatg

SEQ ID NO: 122340 - DNA, 103 bp, Artificial Sequence
  Synthetic Polynucleotide
taatacgactcactatagggagcccctgctgccactgctccaccatccacaacagaggagagtggatatgggagcagtgaacctggcggcagcgcaaaagatg

SEQ ID NO: 122341 - DNA, 103 bp, Artificial Sequence
  Synthetic Polynucleotide
taatacgactcactatagggctcggcctgaagcccctgctgccactgctcaacagaggagagagcagatgcagcaggggaacctggcggcagcgcaaaagatg

SEQ ID NO: 122342 - DNA, 103 bp, Artificial Sequence
  Synthetic Polynucleotide
taatacgactcactatagggtcagcactttctcggcctgaagcccctgctaacagaggagaagcaggatgttcaggccgaacctggcggcagcgcaaaagatg

SEQ ID NO: 122343 - DNA, 103 bp, Artificial Sequence
  Synthetic Polynucleotide
taatacgactcactatagggagggggaccctcagcactttctcggcctgaaacagaggagatcaggcatggaaagtgctaacctggcggcagcgcaaaagatg

SEQ ID NO: 122344 - DNA, 103 bp, Artificial Sequence
  Synthetic Polynucleotide
taatacgactcactatagggtatagaggggagggggaccctcagcactttaacagaggagaaaagtgatgagggtccccaacctggcggcagcgcaaaagatg

SEQ ID NO: 122345 - DNA, 103 bp, Artificial Sequence
  Synthetic Polynucleotide
taatacgactcactatagggtggttggtgttatagaggggagggggacccaacagaggagagggtccatgtcccctctaaacctggcggcagcgcaaaagatg

SEQ ID NO: 122346 - DNA, 103 bp, Artificial Sequence
  Synthetic Polynucleotide
taatacgactcactatagggggcacttccaagcttctcaatggtagctcgaacagaggagacgagctatgattgagaagaacctggcggcagcgcaaaagatg

SEQ ID NO: 122347 - DNA, 103 bp, Artificial Sequence
  Synthetic Polynucleotide
taatacgactcactatagggtttaaagtcatggttggtgttatagaggggaacagaggagacccctcatgaacaccaacaacctggcggcagcgcaaaagatg

SEQ ID NO: 122348 - DNA, 103 bp, Artificial Sequence
  Synthetic Polynucleotide
taatacgactcactatagggagtaggagaatttaaagtcatggttggtgtaacagaggagaacaccaatgatgactttaaacctggcggcagcgcaaaagatg

SEQ ID NO: 122349 - DNA, 103 bp, Artificial Sequence
  Synthetic Polynucleotide
taatacgactcactatagggttgatctctgagtaggagaatttaaagtcaaacagaggagatgacttatgattctcctaaacctggcggcagcgcaaaagatg

SEQ ID NO: 122350 - DNA, 103 bp, Artificial Sequence
  Synthetic Polynucleotide
taatacgactcactatagggatcctgaaagttgatctctgagtaggagaaaacagaggagattctccatgtcagagatcaacctggcggcagcgcaaaagatg

SEQ ID NO: 122351 - DNA, 103 bp, Artificial Sequence
  Synthetic Polynucleotide
taatacgactcactatagggaccagcttagatcctgaaagttgatctctgaacagaggagacagagaatgactttcaggaacctggcggcagcgcaaaagatg

SEQ ID NO: 122352 - DNA, 103 bp, Artificial Sequence
  Synthetic Polynucleotide
taatacgactcactatagggttgcggaaggaccagcttagatcctgaaagaacagaggagactttcaatgtctaagctgaacctggcggcagcgcaaaagatg

SEQ ID NO: 122353 - DNA, 103 bp, Artificial Sequence
  Synthetic Polynucleotide
taatacgactcactatagggcttatagaggttgcggaaggaccagcttagaacagaggagactaagcatgtccttccgcaacctggcggcagcgcaaaagatg

SEQ ID NO: 122354 - DNA, 103 bp, Artificial Sequence
  Synthetic Polynucleotide
taatacgactcactatagggccagcatggacttatagaggttgcggaaggaacagaggagaccttccatgacctctataaacctggcggcagcgcaaaagatg

SEQ ID NO: 122355 - DNA, 103 bp, Artificial Sequence
  Synthetic Polynucleotide
taatacgactcactataggggaggacttctccagcatggacttatagaggaacagaggagacctctaatggtccatgctaacctggcggcagcgcaaaagatg

SEQ ID NO: 122356 - DNA, 103 bp, Artificial Sequence
  Synthetic Polynucleotide
taatacgactcactatagggagaggaggaagaggacttctccagcatggaaacagaggagatccatgatggagaagtccaacctggcggcagcgcaaaagatg

SEQ ID NO: 122357 - DNA, 103 bp, Artificial Sequence
  Synthetic Polynucleotide
taatacgactcactatagggcagcctgggaggcacttccaagcttctcaaaacagaggagattgagaatgttggaagtgaacctggcggcagcgcaaaagatg

SEQ ID NO: 122358 - DNA, 103 bp, Artificial Sequence
  Synthetic Polynucleotide
taatacgactcactatagggagccgtgctgagaggaggaagaggacttctaacagaggagaagaagtatgcttcctcctaacctggcggcagcgcaaaagatg

SEQ ID NO: 122359 - DNA, 103 bp, Artificial Sequence
  Synthetic Polynucleotide
taatacgactcactatagggagagaagaaaagccgtgctgagaggaggaaaacagaggagattcctcatgtcagcacggaacctggcggcagcgcaaaagatg

SEQ ID NO: 122360 - DNA, 103 bp, Artificial Sequence
  Synthetic Polynucleotide
taatacgactcactataggggtcccccaggagagaagaaaagccgtgctgaacagaggagacagcacatgttttcttctaacctggcggcagcgcaaaagatg

SEQ ID NO: 122361 - DNA, 103 bp, Artificial Sequence
  Synthetic Polynucleotide
taatacgactcactatagggagggtgggatgtcccccaggagagaagaaaaacagaggagatttcttatgtcctgggggaacctggcggcagcgcaaaagatg

SEQ ID NO: 122362 - DNA, 103 bp, Artificial Sequence
  Synthetic Polynucleotide
taatacgactcactatagggtagttgttcgagggtgggatgtcccccaggaacagaggagacctgggatgcatcccaccaacctggcggcagcgcaaaagatg

SEQ ID NO: 122363 - DNA, 103 bp, Artificial Sequence
  Synthetic Polynucleotide
taatacgactcactatagggatacatgtagtagttgttcgagggtgggataacagaggagaatcccaatgtcgaacaacaacctggcggcagcgcaaaagatg

SEQ ID NO: 122364 - DNA, 103 bp, Artificial Sequence
  Synthetic Polynucleotide
taatacgactcactataggggctgctgctgatacatgtagtagttgttcgaacagaggagacgaacaatgactacatgtaacctggcggcagcgcaaaagatg

SEQ ID NO: 122365 - DNA, 103 bp, Artificial Sequence
  Synthetic Polynucleotide
taatacgactcactatagggggcggtggctgctgctgctgatacatgtagaacagaggagactacatatgtcagcagcaaacctggcggcagcgcaaaagatg

SEQ ID NO: 122366 - DNA, 103 bp, Artificial Sequence
  Synthetic Polynucleotide
taatacgactcactatagggctgttgaggtggcggtggctgctgctgctgaacagaggagacagcagatgcagccaccgaacctggcggcagcgcaaaagatg

SEQ ID NO: 122367 - DNA, 103 bp, Artificial Sequence
  Synthetic Polynucleotide
taatacgactcactataggggctgctgctgctgttgaggtggcggtggctaacagaggagaagccacatgcacctcaacaacctggcggcagcgcaaaagatg

SEQ ID NO: 122368 - DNA, 103 bp, Artificial Sequence
  Synthetic Polynucleotide
taatacgactcactatagggccgggaggcccagcctgggaggcacttccaaacagaggagatggaagatgctcccaggcaacctggcggcagcgcaaaagatg

SEQ ID NO: 122369 - DNA, 103 bp, Artificial Sequence
  Synthetic Polynucleotide
taatacgactcactatagggggctgctgctgctgctgctgctgttgaggtaacagaggagaacctcaatggcagcagcaaacctggcggcagcgcaaaagatg

SEQ ID NO: 122370 - DNA, 103 bp, Artificial Sequence
  Synthetic Polynucleotide
taatacgactcactatagggtggctgtggcggctgctgctgctgctgctgaacagaggagacagcagatgcagcagcagaacctggcggcagcgcaaaagatg

SEQ ID NO: 122371 - DNA, 103 bp, Artificial Sequence
  Synthetic Polynucleotide
taatacgactcactataggggctggggaggtggctgtggcggctgctgctaacagaggagaagcagcatgcgccacagcaacctggcggcagcgcaaaagatg

SEQ ID NO: 122372 - DNA, 103 bp, Artificial Sequence
  Synthetic Polynucleotide
taatacgactcactatagggggctgggactgctggggaggtggctgtggcaacagaggagagccacaatgacctccccaaacctggcggcagcgcaaaagatg

SEQ ID NO: 122373 - DNA, 103 bp, Artificial Sequence
  Synthetic Polynucleotide
taatacgactcactatagggctgctgctgtggctgggactgctggggaggaacagaggagacctcccatgcagtcccagaacctggcggcagcgcaaaagatg

SEQ ID NO: 122374 - DNA, 103 bp, Artificial Sequence
  Synthetic Polynucleotide
taatacgactcactatagggcaggtgcctgctgctgctgtggctgggactaacagaggagaagtcccatgcacagcagcaacctggcggcagcgcaaaagatg

SEQ ID NO: 122375 - DNA, 103 bp, Artificial Sequence
  Synthetic Polynucleotide
taatacgactcactataggggggccctgggcaggtgcctgctgctgctgtaacagaggagaacagcaatggcaggcaccaacctggcggcagcgcaaaagatg

SEQ ID NO: 122376 - DNA, 103 bp, Artificial Sequence
  Synthetic Polynucleotide
taatacgactcactatagggtacagctgaggggccctgggcaggtgcctgaacagaggagacaggcaatggcccagggcaacctggcggcagcgcaaaagatg

SEQ ID NO: 122377 - DNA, 103 bp, Artificial Sequence
  Synthetic Polynucleotide
taatacgactcactataggggagcaccccctacagctgaggggccctgggaacagaggagacccaggatgcctcagctgaacctggcggcagcgcaaaagatg

SEQ ID NO: 122378 - DNA, 103 bp, Artificial Sequence
  Synthetic Polynucleotide
taatacgactcactatagggtgcagtggaggagcaccccctacagctgagaacagaggagactcagcatgagggggtgcaacctggcggcagcgcaaaagatg

SEQ ID NO: 122379 - DNA, 103 bp, Artificial Sequence
  Synthetic Polynucleotide
taatacgactcactatagggggcgccgctgtcctcgccgacttcggccataacagaggagaatggccatggtcggcgagaacctggcggcagcgcaaaagatg

SEQ ID NO: 122380 - DNA, 103 bp, Artificial Sequence
  Synthetic Polynucleotide
taatacgactcactatagggcgggggtgcggccgcggggaaggcggcggcaacagaggagagccgccatgttccccgcgaacctggcggcagcgcaaaagatg

SEQ ID NO: 122381 - DNA, 103 bp, Artificial Sequence
  Synthetic Polynucleotide
taatacgactcactatagggggggtaatgcttggtgatgtgggcgtagataacagaggagaatctacatgcacatcaccaacctggcggcagcgcaaaagatg

SEQ ID NO: 122382 - DNA, 103 bp, Artificial Sequence
  Synthetic Polynucleotide
taatacgactcactatagggtccggtagtaggggtaatgcttggtgatgtaacagaggagaacatcaatgagcattaccaacctggcggcagcgcaaaagatg

SEQ ID NO: 122383 - DNA, 103 bp, Artificial Sequence
  Synthetic Polynucleotide
taatacgactcactatagggttgtcggccgtccggtagtaggggtaatgcaacagaggagagcattaatgctactaccgaacctggcggcagcgcaaaagatg

SEQ ID NO: 122384 - DNA, 103 bp, Artificial Sequence
  Synthetic Polynucleotide
taatacgactcactatagggctgccagcctttgtcggccgtccggtagtaaacagaggagatactacatgacggccgacaacctggcggcagcgcaaaagatg

SEQ ID NO: 122385 - DNA, 103 bp, Artificial Sequence
  Synthetic Polynucleotide
taatacgactcactatagggggatagaattctgccagcctttgtcggccgaacagaggagacggccgatgaaggctggcaacctggcggcagcgcaaaagatg

SEQ ID NO: 122386 - DNA, 103 bp, Artificial Sequence
  Synthetic Polynucleotide
taatacgactcactatagggaggttgtgccggatagaattctgccagcctaacagaggagaaggctgatggaattctataacctggcggcagcgcaaaagatg

SEQ ID NO: 122387 - DNA, 103 bp, Artificial Sequence
  Synthetic Polynucleotide
taatacgactcactataggggttcaaagagaggttgtgccggatagaattaacagaggagaaattctatgcggcacaacaacctggcggcagcgcaaaagatg

SEQ ID NO: 122388 - DNA, 103 bp, Artificial Sequence
  Synthetic Polynucleotide
taatacgactcactatagggtaaagtaacggttcaaagagaggttgtgccaacagaggagaggcacaatgtctctttgaaacctggcggcagcgcaaaagatg

SEQ ID NO: 122389 - DNA, 103 bp, Artificial Sequence
  Synthetic Polynucleotide
taatacgactcactataggggggactttgataaagtaacggttcaaagagaacagaggagactctttatgccgttacttaacctggcggcagcgcaaaagatg

SEQ ID NO: 122390 - DNA, 103 bp, Artificial Sequence
  Synthetic Polynucleotide
taatacgactcactatagggctgggaacgtgggactttgataaagtaacgaacagaggagacgttacatgatcaaagtcaacctggcggcagcgcaaaagatg

SEQ ID NO: 122391 - DNA, 103 bp, Artificial Sequence
  Synthetic Polynucleotide
taatacgactcactatagggcgggggccggcgggggtgcggccgcggggaaacagaggagatccccgatgccgcaccccaacctggcggcagcgcaaaagatg

SEQ ID NO: 122392 - DNA, 103 bp, Artificial Sequence
  Synthetic Polynucleotide
taatacgactcactatagggcaggctcctcctgggaacgtgggactttgaaacagaggagatcaaagatgcacgttcccaacctggcggcagcgcaaaagatg

SEQ ID NO: 122393 - DNA, 103 bp, Artificial Sequence
  Synthetic Polynucleotide
taatacgactcactataggggaccccttcccaggctcctcctgggaacgtaacagaggagaacgttcatgggaggagccaacctggcggcagcgcaaaagatg

SEQ ID NO: 122394 - DNA, 103 bp, Artificial Sequence
  Synthetic Polynucleotide
taatacgactcactatagggtcgccaaaaggaccccttcccaggctcctcaacagaggagagaggagatggggaaggggaacctggcggcagcgcaaaagatg

SEQ ID NO: 122395 - DNA, 103 bp, Artificial Sequence
  Synthetic Polynucleotide
taatacgactcactatagggcagggtctattcgccaaaaggaccccttccaacagaggagaggaaggatgccttttggcaacctggcggcagcgcaaaagatg

SEQ ID NO: 122396 - DNA, 103 bp, Artificial Sequence
  Synthetic Polynucleotide
taatacgactcactataggggcttcagaggcagggtctattcgccaaaagaacagaggagacttttgatgaatagacccaacctggcggcagcgcaaaagatg

SEQ ID NO: 122397 - DNA, 103 bp, Artificial Sequence
  Synthetic Polynucleotide
taatacgactcactatagggcacgagcttggcttcagaggcagggtctataacagaggagaatagacatggcctctgaaaacctggcggcagcgcaaaagatg

SEQ ID NO: 122398 - DNA, 103 bp, Artificial Sequence
  Synthetic Polynucleotide
taatacgactcactatagggatgcctgttccacgagcttggcttcagaggaacagaggagacctctgatgccaagctcgaacctggcggcagcgcaaaagatg

SEQ ID NO: 122399 - DNA, 103 bp, Artificial Sequence
  Synthetic Polynucleotide
taatacgactcactatagggcgtttccggaatgcctgttccacgagcttgaacagaggagacaagctatgggaacaggcaacctggcggcagcgcaaaagatg

SEQ ID NO: 122400 - DNA, 103 bp, Artificial Sequence
  Synthetic Polynucleotide
taatacgactcactatagggcctctgcctccgtttccggaatgcctgttcaacagaggagagaacagatgttccggaaaaacctggcggcagcgcaaaagatg

SEQ ID NO: 122401 - DNA, 103 bp, Artificial Sequence
  Synthetic Polynucleotide
taatacgactcactatagggaggagacacccctctgcctccgtttccggaaacagaggagatccggaatgggaggcagaaacctggcggcagcgcaaaagatg

SEQ ID NO: 122402 - DNA, 103 bp, Artificial Sequence
  Synthetic Polynucleotide
taatacgactcactatagggtggggctgcgcgggggccggcgggggtgcgaacagaggagacgcaccatggccggccccaacctggcggcagcgcaaaagatg

SEQ ID NO: 122403 - DNA, 103 bp, Artificial Sequence
  Synthetic Polynucleotide
taatacgactcactataggggtgcggaagcaggagacacccctctgcctcaacagaggagagaggcaatggggtgtctcaacctggcggcagcgcaaaagatg

SEQ ID NO: 122404 - DNA, 103 bp, Artificial Sequence
  Synthetic Polynucleotide
taatacgactcactatagggcccgaagggggtgcggaagcaggagacaccaacagaggagaggtgtcatgtgcttccgcaacctggcggcagcgcaaaagatg

SEQ ID NO: 122405 - DNA, 103 bp, Artificial Sequence
  Synthetic Polynucleotide
taatacgactcactatagggaggacagaggcccgaagggggtgcggaagcaacagaggagagcttccatgcccccttcgaacctggcggcagcgcaaaagatg

SEQ ID NO: 122406 - DNA, 103 bp, Artificial Sequence
  Synthetic Polynucleotide
taatacgactcactataggggcgctccttgaggacagaggcccgaaggggaacagaggagaccccttatggcctctgtcaacctggcggcagcgcaaaagatg

SEQ ID NO: 122407 - DNA, 103 bp, Artificial Sequence
  Synthetic Polynucleotide
taatacgactcactatagggcgaagctggagcgctccttgaggacagaggaacagaggagacctctgatgtcaaggagcaacctggcggcagcgcaaaagatg

SEQ ID NO: 122408 - DNA, 103 bp, Artificial Sequence
  Synthetic Polynucleotide
taatacgactcactatagggggtgtgtgggcgaagctggagcgctccttgaacagaggagacaaggaatgctccagcttaacctggcggcagcgcaaaagatg

SEQ ID NO: 122409 - DNA, 103 bp, Artificial Sequence
  Synthetic Polynucleotide
taatacgactcactatagggatcagcccggggtgtgtgggcgaagctggaaacagaggagatccagcatggcccacacaaacctggcggcagcgcaaaagatg

SEQ ID NO: 122410 - DNA, 103 bp, Artificial Sequence
  Synthetic Polynucleotide
taatacgactcactataggggcgaggggacatcagcccggggtgtgtgggaacagaggagacccacaatgcccgggctgaacctggcggcagcgcaaaagatg

SEQ ID NO: 122411 - DNA, 103 bp, Artificial Sequence
  Synthetic Polynucleotide
taatacgactcactatagggggccgccggagcgaggggacatcagcccggaacagaggagaccgggcatgtgtcccctcaacctggcggcagcgcaaaagatg

SEQ ID NO: 122412 - DNA, 103 bp, Artificial Sequence
  Synthetic Polynucleotide
taatacgactcactatagggggggtctgcaggccgccggagcgaggggacaacagaggagagtccccatgctccggcggaacctggcggcagcgcaaaagatg

SEQ ID NO: 122413 - DNA, 103 bp, Artificial Sequence
  Synthetic Polynucleotide
taatacgactcactataggggggcggaggctggggctgcgcgggggccggaacagaggagaccggccatggcgcagcccaacctggcggcagcgcaaaagatg

SEQ ID NO: 122414 - DNA, 103 bp, Artificial Sequence
  Synthetic Polynucleotide
taatacgactcactatagggcaggcactctggggtctgcaggccgccggaaacagaggagatccggcatgctgcagaccaacctggcggcagcgcaaaagatg

SEQ ID NO: 122415 - DNA, 103 bp, Artificial Sequence
  Synthetic Polynucleotide
taatacgactcactatagggcctcccgagacaggcactctggggtctgcaaacagaggagatgcagaatgcagagtgccaacctggcggcagcgcaaaagatg

SEQ ID NO: 122416 - DNA, 103 bp, Artificial Sequence
  Synthetic Polynucleotide
taatacgactcactatagggatgggggagccctcccgagacaggcactctaacagaggagaagagtgatggtctcgggaaacctggcggcagcgcaaaagatg

SEQ ID NO: 122417 - DNA, 103 bp, Artificial Sequence
  Synthetic Polynucleotide
taatacgactcactataggggtcgtgtggaatgggggagccctcccgagaaacagaggagatctcggatgggctcccccaacctggcggcagcgcaaaagatg

SEQ ID NO: 122418 - DNA, 103 bp, Artificial Sequence
  Synthetic Polynucleotide
taatacgactcactatagggcaaactcagggtcgtgtggaatgggggagcaacagaggagagctcccatgttccacacgaacctggcggcagcgcaaaagatg

SEQ ID NO: 122419 - DNA, 103 bp, Artificial Sequence
  Synthetic Polynucleotide
taatacgactcactatagggaacttggacccaaactcagggtcgtgtggaaacagaggagatccacaatgccctgagttaacctggcggcagcgcaaaagatg

SEQ ID NO: 122420 - DNA, 103 bp, Artificial Sequence
  Synthetic Polynucleotide
taatacgactcactataggggacagaagctaacttggacccaaactcaggaacagaggagacctgagatggggtccaagaacctggcggcagcgcaaaagatg

SEQ ID NO: 122421 - DNA, 103 bp, Artificial Sequence
  Synthetic Polynucleotide
taatacgactcactatagggggtactctgggacagaagctaacttggaccaacagaggagaggtccaatgtagcttctgaacctggcggcagcgcaaaagatg

SEQ ID NO: 122422 - DNA, 103 bp, Artificial Sequence
  Synthetic Polynucleotide
taatacgactcactatagggtgggaataccggtactctgggacagaagctaacagaggagaagcttcatgcccagagtaaacctggcggcagcgcaaaagatg

SEQ ID NO: 122423 - DNA, 103 bp, Artificial Sequence
  Synthetic Polynucleotide
taatacgactcactataggggggtgcgctttgggaataccggtactctggaacagaggagaccagagatgcggtattccaacctggcggcagcgcaaaagatg

SEQ ID NO: 122424 - DNA, 103 bp, Artificial Sequence
  Synthetic Polynucleotide
taatacgactcactataggggcggcggcccgggcggaggctggggctgcgaacagaggagacgcagcatgagcctccgcaacctggcggcagcgcaaaagatg

SEQ ID NO: 122425 - DNA, 103 bp, Artificial Sequence
  Synthetic Polynucleotide
taatacgactcactatagggcgggggagccgggtgcgctttgggaataccaacagaggagaggtattatgaaagcgcacaacctggcggcagcgcaaaagatg

SEQ ID NO: 122426 - DNA, 103 bp, Artificial Sequence
  Synthetic Polynucleotide
taatacgactcactatagggtgggcgctgacgggggagccgggtgcgcttaacagaggagaaagcgcatgcggctccccaacctggcggcagcgcaaaagatg

SEQ ID NO: 122427 - DNA, 103 bp, Artificial Sequence
  Synthetic Polynucleotide
taatacgactcactataggggatcactggctgggcgctgacgggggagccaacagaggagaggctccatggtcagcgccaacctggcggcagcgcaaaagatg

SEQ ID NO: 122428 - DNA, 103 bp, Artificial Sequence
  Synthetic Polynucleotide
taatacgactcactataggggcacggccatgatcactggctgggcgctgaaacagaggagatcagcgatgagccagtgaaacctggcggcagcgcaaaagatg

SEQ ID NO: 122429 - DNA, 103 bp, Artificial Sequence
  Synthetic Polynucleotide
taatacgactcactatagggggtcggggaggcacggccatgatcactggcaacagaggagagccagtatgcatggccgtaacctggcggcagcgcaaaagatg

SEQ ID NO: 122430 - DNA, 103 bp, Artificial Sequence
  Synthetic Polynucleotide
taatacgactcactataggggaggctggacggtcggggaggcacggccataacagaggagaatggccatgcctccccgaaacctggcggcagcgcaaaagatg

SEQ ID NO: 122431 - DNA, 103 bp, Artificial Sequence
  Synthetic Polynucleotide
taatacgactcactataggggcttggccacgaggctggacggtcggggagaacagaggagactccccatgcgtccagccaacctggcggcagcgcaaaagatg

SEQ ID NO: 122432 - DNA, 103 bp, Artificial Sequence
  Synthetic Polynucleotide
taatacgactcactatagggtaggccacgggcttggccacgaggctggacaacagaggagagtccagatgcgtggccaaaacctggcggcagcgcaaaagatg

SEQ ID NO: 122433 - DNA, 103 bp, Artificial Sequence
  Synthetic Polynucleotide
taatacgactcactatagggggcgggcatgtaggccacgggcttggccacaacagaggagagtggccatgcccgtggccaacctggcggcagcgcaaaagatg

SEQ ID NO: 122434 - DNA, 103 bp, Artificial Sequence
  Synthetic Polynucleotide
taatacgactcactatagggttacgatggaggcgggcatgtaggccacggaacagaggagaccgtggatgacatgcccgaacctggcggcagcgcaaaagatg

SEQ ID NO: 122435 - DNA, 103 bp, Artificial Sequence
  Synthetic Polynucleotide
taatacgactcactatagggggcggcggcggcggcggcccgggcggaggcaacagaggagagcctccatgcgggccgccaacctggcggcagcgcaaaagatg

SEQ ID NO: 122436 - DNA, 103 bp, Artificial Sequence
  Synthetic Polynucleotide
taatacgactcactatagggtgctgtgaggttacgatggaggcgggcatgaacagaggagacatgccatgctccatcgtaacctggcggcagcgcaaaagatg

SEQ ID NO: 122437 - DNA, 103 bp, Artificial Sequence
  Synthetic Polynucleotide
taatacgactcactataggggcccgcgggctgctgtgaggttacgatggaaacagaggagatccatcatgacctcacagaacctggcggcagcgcaaaagatg

SEQ ID NO: 122438 - DNA, 103 bp, Artificial Sequence
  Synthetic Polynucleotide
taatacgactcactatagggggatggcgtggcccgcgggctgctgtgaggaacagaggagacctcacatgagcccgcggaacctggcggcagcgcaaaagatg

SEQ ID NO: 122439 - DNA, 103 bp, Artificial Sequence
  Synthetic Polynucleotide
taatacgactcactatagggtgcacgacgtggatggcgtggcccgcgggcaacagaggagagcccgcatgccacgccataacctggcggcagcgcaaaagatg

SEQ ID NO: 122440 - DNA, 103 bp, Artificial Sequence
  Synthetic Polynucleotide
taatacgactcactataggggggggcctgctgcacgacgtggatggcgtgaacagaggagacacgccatgcacgtcgtgaacctggcggcagcgcaaaagatg

SEQ ID NO: 122441 - DNA, 103 bp, Artificial Sequence
  Synthetic Polynucleotide
taatacgactcactatagggtggtgacggtgggggcctgctgcacgacgtaacagaggagaacgtcgatgagcaggcccaacctggcggcagcgcaaaagatg

SEQ ID NO: 122442 - DNA, 103 bp, Artificial Sequence
  Synthetic Polynucleotide
taatacgactcactatagggaccctgaccatggtgacggtgggggcctgcaacagaggagagcaggcatgcaccgtcacaacctggcggcagcgcaaaagatg

SEQ ID NO: 122443 - DNA, 103 bp, Artificial Sequence
  Synthetic Polynucleotide
taatacgactcactatagggtgtggtgaccaccctgaccatggtgacggtaacagaggagaaccgtcatgatggtcaggaacctggcggcagcgcaaaagatg

SEQ ID NO: 122444 - DNA, 103 bp, Artificial Sequence
  Synthetic Polynucleotide
taatacgactcactatagggagttggcagatgtggtgaccaccctgaccaaacagaggagatggtcaatgtggtcaccaaacctggcggcagcgcaaaagatg

SEQ ID NO: 122445 - DNA, 103 bp, Artificial Sequence
  Synthetic Polynucleotide
taatacgactcactatagggccgttggccgagttggcagatgtggtgaccaacagaggagaggtcacatgatctgccaaaacctggcggcagcgcaaaagatg

SEQ ID NO: 122446 - DNA, 103 bp, Artificial Sequence
  Synthetic Polynucleotide
taatacgactcactatagggcagcggcggtggcggcggcggcggcggcccaacagaggagagggccgatgccgccgccgaacctggcggcagcgcaaaagatg

SEQ ID NO: 122447 - DNA, 103 bp, Artificial Sequence
  Synthetic Polynucleotide
taatacgactcactataggggaggatgtatccgttggccgagttggcagaaacagaggagatctgccatgtcggccaacaacctggcggcagcgcaaaagatg

SEQ ID NO: 122448 - DNA, 103 bp, Artificial Sequence
  Synthetic Polynucleotide
taatacgactcactatagggcctggctggtgaggatgtatccgttggccgaacagaggagacggccaatggatacatccaacctggcggcagcgcaaaagatg

SEQ ID NO: 122449 - DNA, 103 bp, Artificial Sequence
  Synthetic Polynucleotide
taatacgactcactatagggcccgccgcgccctggctggtgaggatgtataacagaggagaatacatatgcaccagccaaacctggcggcagcgcaaaagatg

SEQ ID NO: 122450 - DNA, 103 bp, Artificial Sequence
  Synthetic Polynucleotide
taatacgactcactatagggatgggagccccccgccgcgccctggctggtaacagaggagaaccagcatgggcgcggcgaacctggcggcagcgcaaaagatg

SEQ ID NO: 122451 - DNA, 103 bp, Artificial Sequence
  Synthetic Polynucleotide
taatacgactcactatagggccgccgcatcatgggagccccccgccgcgcaacagaggagagcgcggatgggggctcccaacctggcggcagcgcaaaagatg

SEQ ID NO: 122452 - DNA, 103 bp, Artificial Sequence
  Synthetic Polynucleotide
taatacgactcactatagggacggctgcgcccgccgcatcatgggagcccaacagaggagagggctcatgtgatgcggcaacctggcggcagcgcaaaagatg

SEQ ID NO: 122453 - DNA, 103 bp, Artificial Sequence
  Synthetic Polynucleotide
taatacgactcactatagggcaggtccagcacggctgcgcccgccgcatcaacagaggagagatgcgatgggcgcagccaacctggcggcagcgcaaaagatg

SEQ ID NO: 122454 - DNA, 103 bp, Artificial Sequence
  Synthetic Polynucleotide
taatacgactcactatagggcctcgctgcccaggtccagcacggctgcgcaacagaggagagcgcagatgtgctggaccaacctggcggcagcgcaaaagatg

SEQ ID NO: 122455 - DNA, 103 bp, Artificial Sequence
  Synthetic Polynucleotide
taatacgactcactatagggaggcctctggcctcgctgcccaggtccagcaacagaggagagctggaatggggcagcgaaacctggcggcagcgcaaaagatg

SEQ ID NO: 122456 - DNA, 103 bp, Artificial Sequence
  Synthetic Polynucleotide
taatacgactcactatagggtttctcctccaggcctctggcctcgctgccaacagaggagaggcagcatggccagaggcaacctggcggcagcgcaaaagatg

SEQ ID NO: 122457 - DNA, 103 bp, Artificial Sequence
  Synthetic Polynucleotide
taatacgactcactatagggcgcccggaggcagcggcggtggcggcggcgaacagaggagacgccgcatgcaccgccgcaacctggcggcagcgcaaaagatg

SEQ ID NO: 122458 - DNA, 103 bp, Artificial Sequence
  Synthetic Polynucleotide
taatacgactcactatagggcaatggtgggtttctcctccaggcctctggaacagaggagaccagagatgtggaggagaaacctggcggcagcgcaaaagatg

SEQ ID NO: 122459 - DNA, 103 bp, Artificial Sequence
  Synthetic Polynucleotide
taatacgactcactataggggtggcaaacgcaatggtgggtttctcctccaacagaggagaggaggaatgacccaccataacctggcggcagcgcaaaagatg

SEQ ID NO: 122460 - DNA, 103 bp, Artificial Sequence
  Synthetic Polynucleotide
taatacgactcactatagggcgcggggattgtggcaaacgcaatggtgggaacagaggagacccaccatggcgtttgccaacctggcggcagcgcaaaagatg

SEQ ID NO: 122461 - DNA, 103 bp, Artificial Sequence
  Synthetic Polynucleotide
taatacgactcactatagggctccaccagccgcggggattgtggcaaacgaacagaggagacgtttgatgcaatccccgaacctggcggcagcgcaaaagatg

SEQ ID NO: 122462 - DNA, 103 bp, Artificial Sequence
  Synthetic Polynucleotide
taatacgactcactataggggtctggatgactccaccagccgcggggattaacagaggagaaatcccatgggctggtggaacctggcggcagcgcaaaagatg

SEQ ID NO: 122463 - DNA, 103 bp, Artificial Sequence
  Synthetic Polynucleotide
taatacgactcactataggggctggccaccgtctggatgactccaccagcaacagaggagagctggtatggtcatccagaacctggcggcagcgcaaaagatg

SEQ ID NO: 122464 - DNA, 103 bp, Artificial Sequence
  Synthetic Polynucleotide
taatacgactcactataggggggccatctggctggccaccgtctggatgaaacagaggagatcatccatgcggtggccaaacctggcggcagcgcaaaagatg

SEQ ID NO: 122465 - DNA, 103 bp, Artificial Sequence
  Synthetic Polynucleotide
taatacgactcactataggggggaccccgggggccatctggctggccaccaacagaggagaggtggcatgccagatggcaacctggcggcagcgcaaaagatg

SEQ ID NO: 122466 - DNA, 103 bp, Artificial Sequence
  Synthetic Polynucleotide
taatacgactcactatagggcgtgtgtccggggaccccgggggccatctgaacagaggagacagatgatgcccggggtcaacctggcggcagcgcaaaagatg

SEQ ID NO: 122467 - DNA, 103 bp, Artificial Sequence
  Synthetic Polynucleotide
taatacgactcactatagggggatggtgaccgtgtgtccggggaccccggaacagaggagaccggggatgccggacacaaacctggcggcagcgcaaaagatg

SEQ ID NO: 122468 - DNA, 103 bp, Artificial Sequence
  Synthetic Polynucleotide
taatacgactcactatagggcccgcgatcgcgcccggaggcagcggcggtaacagaggagaaccgccatggcctccgggaacctggcggcagcgcaaaagatg

SEQ ID NO: 122469 - DNA, 103 bp, Artificial Sequence
  Synthetic Polynucleotide
taatacgactcactataggggcgggctgcaggatggtgaccgtgtgtccgaacagaggagacggacaatgggtcaccataacctggcggcagcgcaaaagatg

SEQ ID NO: 122470 - DNA, 103 bp, Artificial Sequence
  Synthetic Polynucleotide
taatacgactcactatagggcacgggtgtggcgggctgcaggatggtgacaacagaggagagtcaccatgctgcagcccaacctggcggcagcgcaaaagatg

SEQ ID NO: 122471 - DNA, 103 bp, Artificial Sequence
  Synthetic Polynucleotide
taatacgactcactataggggcccgagggtcacgggtgtggcgggctgcaaacagaggagatgcagcatgccacacccgaacctggcggcagcgcaaaagatg

SEQ ID NO: 122472 - DNA, 103 bp, Artificial Sequence
  Synthetic Polynucleotide
taatacgactcactatagggaggtggtgctgcccgagggtcacgggtgtgaacagaggagacacaccatggaccctcggaacctggcggcagcgcaaaagatg

SEQ ID NO: 122473 - DNA, 103 bp, Artificial Sequence
  Synthetic Polynucleotide
taatacgactcactatagggccggactggaaggtggtgctgcccgagggtaacagaggagaaccctcatgcagcaccacaacctggcggcagcgcaaaagatg

SEQ ID NO: 122474 - DNA, 103 bp, Artificial Sequence
  Synthetic Polynucleotide
taatacgactcactataggggggtcacggcccggactggaaggtggtgctaacagaggagaagcaccatgttccagtccaacctggcggcagcgcaaaagatg

SEQ ID NO: 122475 - DNA, 103 bp, Artificial Sequence
  Synthetic Polynucleotide
taatacgactcactatagggtttccgttctgggtcacggcccggactggaaacagaggagatccagtatgggccgtgacaacctggcggcagcgcaaaagatg

SEQ ID NO: 122476 - DNA, 103 bp, Artificial Sequence
  Synthetic Polynucleotide
taatacgactcactatagggaaccgcatgctttccgttctgggtcacggcaacagaggagagccgtgatgcagaacggaaacctggcggcagcgcaaaagatg

SEQ ID NO: 122477 - DNA, 103 bp, Artificial Sequence
  Synthetic Polynucleotide
taatacgactcactatagggtgttcgtgggaaccgcatgctttccgttctaacagaggagaagaacgatgagcatgcggaacctggcggcagcgcaaaagatg

SEQ ID NO: 122478 - DNA, 103 bp, Artificial Sequence
  Synthetic Polynucleotide
taatacgactcactatagggccggctaaactgttcgtgggaaccgcatgcaacagaggagagcatgcatgtcccacgaaaacctggcggcagcgcaaaagatg

SEQ ID NO: 122479 - DNA, 103 bp, Artificial Sequence
  Synthetic Polynucleotide
taatacgactcactatagggggagcccgcgcccgcgatcgcgcccggaggaacagaggagacctccgatggcgatcgcgaacctggcggcagcgcaaaagatg

SEQ ID NO: 122480 - DNA, 103 bp, Artificial Sequence
  Synthetic Polynucleotide
taatacgactcactataggggtaagcgttgccggctaaactgttcgtgggaacagaggagacccacgatgagtttagccaacctggcggcagcgcaaaagatg

SEQ ID NO: 122481 - DNA, 103 bp, Artificial Sequence
  Synthetic Polynucleotide
taatacgactcactatagggtggtgagggcgtaagcgttgccggctaaacaacagaggagagtttagatggcaacgcttaacctggcggcagcgcaaaagatg

SEQ ID NO: 122482 - DNA, 103 bp, Artificial Sequence
  Synthetic Polynucleotide
taatacgactcactatagggtgcaaagggctggtgagggcgtaagcgttgaacagaggagacaacgcatgcgccctcacaacctggcggcagcgcaaaagatg

SEQ ID NO: 122483 - DNA, 103 bp, Artificial Sequence
  Synthetic Polynucleotide
taatacgactcactatagggcgcaaggagctgcaaagggctggtgagggcaacagaggagagccctcatgagccctttgaacctggcggcagcgcaaaagatg

SEQ ID NO: 122484 - DNA, 103 bp, Artificial Sequence
  Synthetic Polynucleotide
taatacgactcactatagggtcgcttgggtcgcaaggagctgcaaagggcaacagaggagagcccttatgagctccttgaacctggcggcagcgcaaaagatg

SEQ ID NO: 122485 - DNA, 103 bp, Artificial Sequence
  Synthetic Polynucleotide
taatacgactcactataggggcggatgaactcgcttgggtcgcaaggagcaacagaggagagctcctatggacccaagcaacctggcggcagcgcaaaagatg

SEQ ID NO: 122486 - DNA, 103 bp, Artificial Sequence
  Synthetic Polynucleotide
taatacgactcactatagggcaccaccggcgcggatgaactcgcttgggtaacagaggagaacccaaatgagttcatccaacctggcggcagcgcaaaagatg

SEQ ID NO: 122487 - DNA, 103 bp, Artificial Sequence
  Synthetic Polynucleotide
taatacgactcactatagggcccgggtgaccaccaccggcgcggatgaacaacagaggagagttcatatgcgccggtggaacctggcggcagcgcaaaagatg

SEQ ID NO: 122488 - DNA, 103 bp, Artificial Sequence
  Synthetic Polynucleotide
taatacgactcactatagggacctcgcacacccgggtgaccaccaccggcaacagaggagagccggtatgggtcacccgaacctggcggcagcgcaaaagatg

SEQ ID NO: 122489 - DNA, 103 bp, Artificial Sequence
  Synthetic Polynucleotide
taatacgactcactatagggcttgggccccacctcgcacacccgggtgacaacagaggagagtcaccatggtgtgcgagaacctggcggcagcgcaaaagatg

SEQ ID NO: 122490 - DNA, 103 bp, Artificial Sequence
  Synthetic Polynucleotide
taatacgactcactataggggcagggcgcgggcgccgctgtcctcgccgaaacagaggagatcggcgatgacagcggcgaacctggcggcagcgcaaaagatg

SEQ ID NO: 122491 - DNA, 103 bp, Artificial Sequence
  Synthetic Polynucleotide
taatacgactcactatagggagcccccggaggagcccgcgcccgcgatcgaacagaggagacgatcgatggcgcgggctaacctggcggcagcgcaaaagatg

SEQ ID NO: 122492 - DNA, 103 bp, Artificial Sequence
  Synthetic Polynucleotide
taatacgactcactatagggctgctggctccttgggccccacctcgcacaaacagaggagatgtgcgatgtggggcccaaacctggcggcagcgcaaaagatg

SEQ ID NO: 122493 - DNA, 103 bp, Artificial Sequence
  Synthetic Polynucleotide
taatacgactcactataggggcgacggctgctgctggctccttgggccccaacagaggagaggggccatgggagccagcaacctggcggcagcgcaaaagatg

SEQ ID NO: 122494 - DNA, 103 bp, Artificial Sequence
  Synthetic Polynucleotide
taatacgactcactatagggggccgtggccgcgacggctgctgctggctcaacagaggagagagccaatggcagccgtcaacctggcggcagcgcaaaagatg

SEQ ID NO: 122495 - DNA, 103 bp, Artificial Sequence
  Synthetic Polynucleotide
taatacgactcactataggggggtggtggtggccgtggccgcgacggctgaacagaggagacagccgatgcggccacggaacctggcggcagcgcaaaagatg

SEQ ID NO: 122496 - DNA, 103 bp, Artificial Sequence
  Synthetic Polynucleotide
taatacgactcactataggggcagtggctggggtggtggtggccgtggccaacagaggagaggccacatgcaccaccacaacctggcggcagcgcaaaagatg

SEQ ID NO: 122497 - DNA, 103 bp, Artificial Sequence
  Synthetic Polynucleotide
taatacgactcactatagggggcggtggtggcagtggctggggtggtggtaacagaggagaaccaccatgccagccactaacctggcggcagcgcaaaagatg

SEQ ID NO: 122498 - DNA, 103 bp, Artificial Sequence
  Synthetic Polynucleotide
taatacgactcactatagggcggaggcagaggcggtggtggcagtggctgaacagaggagacagccaatgccaccaccgaacctggcggcagcgcaaaagatg

SEQ ID NO: 122499 - DNA, 103 bp, Artificial Sequence
  Synthetic Polynucleotide
taatacgactcactataggggtggaagaggcggaggcagaggcggtggtgaacagaggagacaccacatgctctgcctcaacctggcggcagcgcaaaagatg

SEQ ID NO: 122500 - DNA, 103 bp, Artificial Sequence
  Synthetic Polynucleotide
taatacgactcactataggggggctctccagtggaagaggcggaggcagaaacagaggagatctgccatggcctcttccaacctggcggcagcgcaaaagatg

SEQ ID NO: 122501 - DNA, 103 bp, Artificial Sequence
  Synthetic Polynucleotide
taatacgactcactatagggttttgacctcgggctctccagtggaagaggaacagaggagacctcttatgctggagagcaacctggcggcagcgcaaaagatg

SEQ ID NO: 122502 - DNA, 103 bp, Artificial Sequence
  Synthetic Polynucleotide
taatacgactcactatagggaccccggaggagcccccggaggagcccgcgaacagaggagacgcgggatgctccgggggaacctggcggcagcgcaaaagatg

SEQ ID NO: 122503 - DNA, 103 bp, Artificial Sequence
  Synthetic Polynucleotide
taatacgactcactatagggacccgggaccttttgacctcgggctctccaaacagaggagatggagaatgcgaggtcaaaacctggcggcagcgcaaaagatg

SEQ ID NO: 122504 - DNA, 103 bp, Artificial Sequence
  Synthetic Polynucleotide
taatacgactcactataggggggctcctccacccgggaccttttgacctcaacagaggagagaggtcatgaggtcccggaacctggcggcagcgcaaaagatg

SEQ ID NO: 122505 - DNA, 103 bp, Artificial Sequence
  Synthetic Polynucleotide
taatacgactcactatagggcagcaccactgggctcctccacccgggaccaacagaggagaggtcccatgtggaggagcaacctggcggcagcgcaaaagatg

SEQ ID NO: 122506 - DNA, 103 bp, Artificial Sequence
  Synthetic Polynucleotide
taatacgactcactatagggggtgtggttacagcaccactgggctcctccaacagaggagaggaggaatgcagtggtgcaacctggcggcagcgcaaaagatg

SEQ ID NO: 122507 - DNA, 103 bp, Artificial Sequence
  Synthetic Polynucleotide
taatacgactcactatagggcactccagccggtgtggttacagcaccactaacagaggagaagtggtatggtaaccacaaacctggcggcagcgcaaaagatg

SEQ ID NO: 122508 - DNA, 103 bp, Artificial Sequence
  Synthetic Polynucleotide
taatacgactcactatagggcagctgcgatcactccagccggtgtggttaaacagaggagataaccaatgcggctggagaacctggcggcagcgcaaaagatg

SEQ ID NO: 122509 - DNA, 103 bp, Artificial Sequence
  Synthetic Polynucleotide
taatacgactcactatagggtgggggccggcagctgcgatcactccagccaacagaggagaggctggatggatcgcagcaacctggcggcagcgcaaaagatg

SEQ ID NO: 122510 - DNA, 103 bp, Artificial Sequence
  Synthetic Polynucleotide
taatacgactcactataggggcctggcccctgggggccggcagctgcgataacagaggagaatcgcaatggccggccccaacctggcggcagcgcaaaagatg

SEQ ID NO: 122511 - DNA, 103 bp, Artificial Sequence
  Synthetic Polynucleotide
taatacgactcactatagggactccccggtgcctggcccctgggggccggaacagaggagaccggccatgaggggccagaacctggcggcagcgcaaaagatg

SEQ ID NO: 122512 - DNA, 103 bp, Artificial Sequence
  Synthetic Polynucleotide
taatacgactcactataggggtccccggataccccggaggagcccccggaaacagaggagatccgggatgtcctccgggaacctggcggcagcgcaaaagatg

SEQ ID NO: 122513 - DNA, 103 bp, Artificial Sequence
  Synthetic Polynucleotide
taatacgactcactatagggcgaccgcggagtccccggataccccggaggaacagaggagacctccgatgtatccggggaacctggcggcagcgcaaaagatg

SEQ ID NO: 122514 - DNA, 103 bp, Artificial Sequence
  Synthetic Polynucleotide
taatacgactcactataggggccgcgcccgcgaccgcggagtccccggataacagaggagaatccggatgctccgcggtaacctggcggcagcgcaaaagatg

SEQ ID NO: 122515 - DNA, 103 bp, Artificial Sequence
  Synthetic Polynucleotide
taatacgactcactatagggcagggccggcgccgcgcccgcgaccgcggaaacagaggagatccgcgatggcgggcgcgaacctggcggcagcgcaaaagatg

SEQ ID NO: 122516 - DNA, 103 bp, Artificial Sequence
  Synthetic Polynucleotide
taatacgactcactatagggccgcggccaccagggccggcgccgcgcccgaacagaggagacgggcgatgcgccggcccaacctggcggcagcgcaaaagatg

SEQ ID NO: 122517 - DNA, 103 bp, Artificial Sequence
  Synthetic Polynucleotide
taatacgactcactataggggaggcggccgccgcggccaccagggccggcaacagaggagagccggcatgggtggccgcaacctggcggcagcgcaaaagatg

SEQ ID NO: 122518 - DNA, 103 bp, Artificial Sequence
  Synthetic Polynucleotide
taatacgactcactatagggctgccgtaccgaggcggccgccgcggccacaacagaggagagtggccatggcggccgccaacctggcggcagcgcaaaagatg

SEQ ID NO: 122519 - DNA, 103 bp, Artificial Sequence
  Synthetic Polynucleotide
taatacgactcactataggggccccgggctctgccgtaccgaggcggccgaacagaggagacggccgatgcggtacggcaacctggcggcagcgcaaaagatg

SEQ ID NO: 122520 - DNA, 103 bp, Artificial Sequence
  Synthetic Polynucleotide
taatacgactcactatagggcgcagcgcgagcagggcgcgggcgccgctgaacagaggagacagcggatgccgcgccctaacctggcggcagcgcaaaagatg

SEQ ID NO: 122521 - DNA, 103 bp, Artificial Sequence
  Synthetic Polynucleotide
taatacgactcactataggggccagcgccggccccgggctctgccgtaccaacagaggagaggtacgatggagcccgggaacctggcggcagcgcaaaagatg

SEQ ID NO: 122522 - DNA, 103 bp, Artificial Sequence
  Synthetic Polynucleotide
taatacgactcactatagggctccagccgcgccagcgccggccccgggctaacagaggagaagcccgatgccggcgctgaacctggcggcagcgcaaaagatg

SEQ ID NO: 122523 - DNA, 103 bp, Artificial Sequence
  Synthetic Polynucleotide
taatacgactcactatagggactcgcggccctccagccgcgccagcgccgaacagaggagacggcgcatgcgcggctggaacctggcggcagcgcaaaagatg

SEQ ID NO: 122524 - DNA, 103 bp, Artificial Sequence
  Synthetic Polynucleotide
taatacgactcactatagggaggaactcgaactcgcggccctccagccgcaacagaggagagcggctatggggccgcgaaacctggcggcagcgcaaaagatg

SEQ ID NO: 122525 - DNA, 103 bp, Artificial Sequence
  Synthetic Polynucleotide
taatacgactcactatagggctggcgcatgaggaactcgaactcgcggccaacagaggagaggccgcatgttcgagttcaacctggcggcagcgcaaaagatg

SEQ ID NO: 122526 - DNA, 103 bp, Artificial Sequence
  Synthetic Polynucleotide
taatacgactcactatagggtgacgctgggctggcgcatgaggaactcgaaacagaggagatcgagtatgtcatgcgccaacctggcggcagcgcaaaagatg

SEQ ID NO: 122527 - DNA, 103 bp, Artificial Sequence
  Synthetic Polynucleotide
taatacgactcactatagggcggccgatggtgacgctgggctggcgcatgaacagaggagacatgcgatggcccagcgtaacctggcggcagcgcaaaagatg

SEQ ID NO: 122528 - DNA, 103 bp, Artificial Sequence
  Synthetic Polynucleotide
taatacgactcactatagggcgacgagttgcggccgatggtgacgctgggaacagaggagacccagcatgaccatcggcaacctggcggcagcgcaaaagatg

SEQ ID NO: 122529 - DNA, 103 bp, Artificial Sequence
  Synthetic Polynucleotide
taatacgactcactatagggccgagccctgcgacgagttgcggccgatggaacagaggagaccatcgatggcaactcgtaacctggcggcagcgcaaaagatg

SEQ ID NO: 122530 - DNA, 103 bp, Artificial Sequence
  Synthetic Polynucleotide
taatacgactcactatagggctcaagtccaccgagccctgcgacgagttgaacagaggagacaactcatggcagggctcaacctggcggcagcgcaaaagatg

SEQ ID NO: 122531 - DNA, 103 bp, Artificial Sequence
  Synthetic Polynucleotide
taatacgactcactataggggggcgccgagcgcagcgcgagcagggcgcgaacagaggagacgcgccatgctcgcgctgaacctggcggcagcgcaaaagatg

SEQ ID NO: 122532 - DNA, 103 bp, Artificial Sequence
  Synthetic Polynucleotide
taatacgactcactatagggcaggcccatgctcaagtccaccgagccctgaacagaggagacagggcatggtggacttgaacctggcggcagcgcaaaagatg

SEQ ID NO: 122533 - DNA, 103 bp, Artificial Sequence
  Synthetic Polynucleotide
taatacgactcactatagggtgaagctggacaggcccatgctcaagtccaaacagaggagatggactatggcatgggccaacctggcggcagcgcaaaagatg

SEQ ID NO: 122534 - DNA, 103 bp, Artificial Sequence
  Synthetic Polynucleotide
taatacgactcactatagggcgccgcgagatgaagctggacaggcccatgaacagaggagacatgggatggtccagcttaacctggcggcagcgcaaaagatg

SEQ ID NO: 122535 - DNA, 103 bp, Artificial Sequence
  Synthetic Polynucleotide
taatacgactcactatagggctgcaggtggcgccgcgagatgaagctggaaacagaggagatccagcatgatctcgcggaacctggcggcagcgcaaaagatg

SEQ ID NO: 122536 - DNA, 103 bp, Artificial Sequence
  Synthetic Polynucleotide
taatacgactcactatagggggaagctgagctgcaggtggcgccgcgagaaacagaggagatctcgcatggccacctgcaacctggcggcagcgcaaaagatg

SEQ ID NO: 122537 - DNA, 103 bp, Artificial Sequence
  Synthetic Polynucleotide
taatacgactcactatagggtgcggctcctggaagctgagctgcaggtggaacagaggagaccacctatggctcagcttaacctggcggcagcgcaaaagatg

SEQ ID NO: 122538 - DNA, 103 bp, Artificial Sequence
  Synthetic Polynucleotide
taatacgactcactatagggcaggtagaagtgcggctcctggaagctgagaacagaggagactcagcatgcaggagccgaacctggcggcagcgcaaaagatg

SEQ ID NO: 122539 - DNA, 103 bp, Artificial Sequence
  Synthetic Polynucleotide
taatacgactcactatagggcgaggcagcgcaggtagaagtgcggctcctaacagaggagaaggagcatgacttctaccaacctggcggcagcgcaaaagatg

SEQ ID NO: 122540 - DNA, 103 bp, Artificial Sequence
  Synthetic Polynucleotide
taatacgactcactatagggccgttcttgccgaggcagcgcaggtagaagaacagaggagacttctaatggcgctgcctaacctggcggcagcgcaaaagatg

SEQ ID NO: 122541 - DNA, 103 bp, Artificial Sequence
  Synthetic Polynucleotide
taatacgactcactatagggcacgaagacgccgttcttgccgaggcagcgaacagaggagacgctgcatgggcaagaacaacctggcggcagcgcaaaagatg

SEQ ID NO: 122542 - DNA, 103 bp, Artificial Sequence
  Synthetic Polynucleotide
taatacgactcactatagggctgggctgcagggcgccgagcgcagcgcgaaacagaggagatcgcgcatggctcggcgcaacctggcggcagcgcaaaagatg

SEQ ID NO: 122543 - DNA, 103 bp, Artificial Sequence
  Synthetic Polynucleotide
taatacgactcactatagggaggccccgtccacgaagacgccgttcttgcaacagaggagagcaagaatggcgtcttcgaacctggcggcagcgcaaaagatg

SEQ ID NO: 122544 - DNA, 103 bp, Artificial Sequence
  Synthetic Polynucleotide
taatacgactcactatagggcgtctctggaaggccccgtccacgaagacgaacagaggagacgtcttatgggacggggcaacctggcggcagcgcaaaagatg

SEQ ID NO: 122545 - DNA, 103 bp, Artificial Sequence
  Synthetic Polynucleotide
taatacgactcactataggggggcgcgccgcgtctctggaaggccccgtcaacagaggagagacgggatgttccagagaaacctggcggcagcgcaaaagatg

SEQ ID NO: 122546 - DNA, 103 bp, Artificial Sequence
  Synthetic Polynucleotide
taatacgactcactataggggctgcagggcgggcgcgccgcgtctctggaaacagaggagatccagaatggcggcgcgcaacctggcggcagcgcaaaagatg

SEQ ID NO: 122547 - DNA, 103 bp, Artificial Sequence
  Synthetic Polynucleotide
taatacgactcactatagggtgcttgggcagctgcagggcgggcgcgccgaacagaggagacggcgcatgcgccctgcaaacctggcggcagcgcaaaagatg

SEQ ID NO: 122548 - DNA, 103 bp, Artificial Sequence
  Synthetic Polynucleotide
taatacgactcactataggggaaggtacactgcttgggcagctgcagggcaacagaggagagccctgatgctgcccaagaacctggcggcagcgcaaaagatg

SEQ ID NO: 122549 - DNA, 103 bp, Artificial Sequence
  Synthetic Polynucleotide
taatacgactcactatagggtgggaaaccggaaggtacactgcttgggcaaacagaggagatgcccaatgagtgtacctaacctggcggcagcgcaaaagatg

SEQ ID NO: 122550 - DNA, 103 bp, Artificial Sequence
  Synthetic Polynucleotide
taatacgactcactatagggatggccgtgctgggaaaccggaaggtacacaacagaggagagtgtacatgccggtttccaacctggcggcagcgcaaaagatg

SEQ ID NO: 122551 - DNA, 103 bp, Artificial Sequence
  Synthetic Polynucleotide
taatacgactcactatagggctggatcttgatggccgtgctgggaaaccgaacagaggagacggtttatgagcacggccaacctggcggcagcgcaaaagatg

SEQ ID NO: 122552 - DNA, 103 bp, Artificial Sequence
  Synthetic Polynucleotide
taatacgactcactataggggcgacgtgaactggatcttgatggccgtgcaacagaggagagcacggatgtcaagatccaacctggcggcagcgcaaaagatg

SEQ ID NO: 122553 - DNA, 103 bp, Artificial Sequence
  Synthetic Polynucleotide
taatacgactcactataggggcgcacagcactgggctgcagggcgccgagaacagaggagactcggcatgctgcagcccaacctggcggcagcgcaaaagatg

SEQ ID NO: 122554 - DNA, 103 bp, Artificial Sequence
  Synthetic Polynucleotide
taatacgactcactatagggttgtgatagagcgacgtgaactggatcttgaacagaggagacaagatatggttcacgtcaacctggcggcagcgcaaaagatg

SEQ ID NO: 122555 - DNA, 103 bp, Artificial Sequence
  Synthetic Polynucleotide
taatacgactcactatagggggcctcttctttgtgatagagcgacgtgaaaacagaggagattcacgatgctctatcacaacctggcggcagcgcaaaagatg

SEQ ID NO: 122556 - DNA, 103 bp, Artificial Sequence
  Synthetic Polynucleotide
taatacgactcactataggggggaggctggggcctcttctttgtgatagaaacagaggagatctatcatgaagaagaggaacctggcggcagcgcaaaagatg

SEQ ID NO: 122557 - DNA, 103 bp, Artificial Sequence
  Synthetic Polynucleotide
taatacgactcactatagggggccgcagcggggaggctggggcctcttctaacagaggagaagaagaatgcccagcctcaacctggcggcagcgcaaaagatg

SEQ ID NO: 122558 - DNA, 103 bp, Artificial Sequence
  Synthetic Polynucleotide
taatacgactcactatagggggggtacagtggccgcagcggggaggctggaacagaggagaccagccatgccgctgcggaacctggcggcagcgcaaaagatg

SEQ ID NO: 122559 - DNA, 103 bp, Artificial Sequence
  Synthetic Polynucleotide
taatacgactcactataggggggagatctgggggtacagtggccgcagcgaacagaggagacgctgcatgcactgtaccaacctggcggcagcgcaaaagatg

SEQ ID NO: 122560 - DNA, 103 bp, Artificial Sequence
  Synthetic Polynucleotide
taatacgactcactatagggatcttcagaggggagatctgggggtacagtaacagaggagaactgtaatgccagatctcaacctggcggcagcgcaaaagatg

SEQ ID NO: 122561 - DNA, 103 bp, Artificial Sequence
  Synthetic Polynucleotide
taatacgactcactatagggcgggatgtggatcttcagaggggagatctgaacagaggagacagatcatgcctctgaagaacctggcggcagcgcaaaagatg

SEQ ID NO: 122562 - DNA, 103 bp, Artificial Sequence
  Synthetic Polynucleotide
taatacgactcactatagggggtccggctccgggatgtggatcttcagagaacagaggagactctgaatgtccacatccaacctggcggcagcgcaaaagatg

SEQ ID NO: 122563 - DNA, 103 bp, Artificial Sequence
  Synthetic Polynucleotide
taatacgactcactatagggatgctccggaggtccggctccgggatgtggaacagaggagaccacatatgggagccggaaacctggcggcagcgcaaaagatg

SEQ ID NO: 122564 - DNA, 103 bp, Artificial Sequence
  Synthetic Polynucleotide
taatacgactcactatagggggcggctgcggcgcacagcactgggctgcaaacagaggagatgcagcatggtgctgtgcaacctggcggcagcgcaaaagatg

SEQ ID NO: 122565 - DNA, 103 bp, Artificial Sequence
  Synthetic Polynucleotide
taatacgactcactatagggggggctgaccatgctccggaggtccggctcaacagaggagagagccgatgctccggagcaacctggcggcagcgcaaaagatg

SEQ ID NO: 122566 - DNA, 103 bp, Artificial Sequence
  Synthetic Polynucleotide
taatacgactcactataggggggaggggacggggctgaccatgctccggaaacagaggagatccggaatgtggtcagccaacctggcggcagcgcaaaagatg

SEQ ID NO: 122567 - DNA, 103 bp, Artificial Sequence
  Synthetic Polynucleotide
taatacgactcactataggggtgcccgtcggggaggggacggggctgaccaacagaggagaggtcagatgcgtcccctcaacctggcggcagcgcaaaagatg

SEQ ID NO: 122568 - DNA, 103 bp, Artificial Sequence
  Synthetic Polynucleotide
taatacgactcactataggggacactgatggtgcccgtcggggaggggacaacagaggagagtccccatgccgacgggcaacctggcggcagcgcaaaagatg

SEQ ID NO: 122569 - DNA, 103 bp, Artificial Sequence
  Synthetic Polynucleotide
taatacgactcactatagggaggagttggggacactgatggtgcccgtcgaacagaggagacgacggatgccatcagtgaacctggcggcagcgcaaaagatg

SEQ ID NO: 122570 - DNA, 103 bp, Artificial Sequence
  Synthetic Polynucleotide
taatacgactcactatagggctggctgggcaggagttggggacactgatgaacagaggagacatcagatgccccaactcaacctggcggcagcgcaaaagatg

SEQ ID NO: 122571 - DNA, 103 bp, Artificial Sequence
  Synthetic Polynucleotide
taatacgactcactatagggaccgcgtggactggctgggcaggagttgggaacagaggagacccaacatgtgcccagccaacctggcggcagcgcaaaagatg

SEQ ID NO: 122572 - DNA, 103 bp, Artificial Sequence
  Synthetic Polynucleotide
taatacgactcactatagggaggagccggcaccgcgtggactggctgggcaacagaggagagcccagatggtccacgcgaacctggcggcagcgcaaaagatg

SEQ ID NO: 122573 - DNA, 103 bp, Artificial Sequence
  Synthetic Polynucleotide
taatacgactcactatagggcggtaactggaggagccggcaccgcgtggaaacagaggagatccacgatgtgccggctcaacctggcggcagcgcaaaagatg

SEQ ID NO: 122574 - DNA, 103 bp, Artificial Sequence
  Synthetic Polynucleotide
taatacgactcactatagggctgcacaaagcggtaactggaggagccggcaacagaggagagccggcatgtccagttacaacctggcggcagcgcaaaagatg

SEQ ID NO: 122575 - DNA, 103 bp, Artificial Sequence
  Synthetic Polynucleotide
taatacgactcactatagggaggcggcggcggcggctgcggcgcacagcaaacagaggagatgctgtatgccgcagccgaacctggcggcagcgcaaaagatg

SEQ ID NO: 122576 - DNA, 103 bp, Artificial Sequence
  Synthetic Polynucleotide
taatacgactcactatagggaggtcacgttctgcacaaagcggtaactggaacagaggagaccagttatggctttgtgcaacctggcggcagcgcaaaagatg

SEQ ID NO: 122577 - DNA, 103 bp, Artificial Sequence
  Synthetic Polynucleotide
taatacgactcactatagggtgcaggtccgaggtcacgttctgcacaaagaacagaggagactttgtatggaacgtgacaacctggcggcagcgcaaaagatg

SEQ ID NO: 122578 - DNA, 103 bp, Artificial Sequence
  Synthetic Polynucleotide
taatacgactcactatagggtgctgccagctgcaggtccgaggtcacgttaacagaggagaaacgtgatgtcggacctgaacctggcggcagcgcaaaagatg

SEQ ID NO: 122579 - DNA, 103 bp, Artificial Sequence
  Synthetic Polynucleotide
taatacgactcactatagggctgcaaactctgctgccagctgcaggtccgaacagaggagacggaccatgagctggcagaacctggcggcagcgcaaaagatg

SEQ ID NO: 122580 - DNA, 103 bp, Artificial Sequence
  Synthetic Polynucleotide
taatacgactcactataggggcggcctttgctgcaaactctgctgccagcaacagaggagagctggcatgagagtttgcaacctggcggcagcgcaaaagatg

SEQ ID NO: 122581 - DNA, 103 bp, Artificial Sequence
  Synthetic Polynucleotide
taatacgactcactatagggctgctccgacgcggcctttgctgcaaactcaacagaggagagagtttatggcaaaggccaacctggcggcagcgcaaaagatg

SEQ ID NO: 122582 - DNA, 103 bp, Artificial Sequence
  Synthetic Polynucleotide
taatacgactcactatagggtgtctgcctgctgctccgacgcggcctttgaacagaggagacaaaggatgcgtcggagcaacctggcggcagcgcaaaagatg

SEQ ID NO: 122583 - DNA, 103 bp, Artificial Sequence
  Synthetic Polynucleotide
taatacgactcactatagggcctccagacgtgtctgcctgctgctccgacaacagaggagagtcggaatggcaggcagaaacctggcggcagcgcaaaagatg

SEQ ID NO: 122584 - DNA, 103 bp, Artificial Sequence
  Synthetic Polynucleotide
taatacgactcactatagggggggctgtctcctccagacgtgtctgcctgaacagaggagacaggcaatgacgtctggaaacctggcggcagcgcaaaagatg

SEQ ID NO: 122585 - DNA, 103 bp, Artificial Sequence
  Synthetic Polynucleotide
taatacgactcactatagggactcatccttggggctgtctcctccagacgaacagaggagacgtctgatggagacagccaacctggcggcagcgcaaaagatg

SEQ ID NO: 122586 - DNA, 103 bp, Artificial Sequence
  Synthetic Polynucleotide
taatacgactcactataggggccgcggggaaggcggcggcggcggctgcgaacagaggagacgcagcatgcgccgccgcaacctggcggcagcgcaaaagatg

SEQ ID NO: 122587 - DNA, 103 bp, Artificial Sequence
  Synthetic Polynucleotide
taatacgactcactatagggggcggctttgactcatccttggggctgtctaacagaggagaagacagatgcaaggatgaaacctggcggcagcgcaaaagatg

SEQ ID NO: 122588 - DNA, 103 bp, Artificial Sequence
  Synthetic Polynucleotide
taatacgactcactataggggtaggagaacggcggctttgactcatccttaacagaggagaaaggatatgtcaaagccgaacctggcggcagcgcaaaagatg

SEQ ID NO: 122589 - DNA, 103 bp, Artificial Sequence
  Synthetic Polynucleotide
taatacgactcactatagggtcagctgcgcgtaggagaacggcggctttgaacagaggagacaaagcatgcgttctcctaacctggcggcagcgcaaaagatg

SEQ ID NO: 122590 - DNA, 103 bp, Artificial Sequence
  Synthetic Polynucleotide
taatacgactcactataggggcctgcacgatcagctgcgcgtaggagaacaacagaggagagttctcatgcgcgcagctaacctggcggcagcgcaaaagatg

SEQ ID NO: 122591 - DNA, 103 bp, Artificial Sequence
  Synthetic Polynucleotide
taatacgactcactatagggggaggagatggcctgcacgatcagctgcgcaacagaggagagcgcagatgatcgtgcagaacctggcggcagcgcaaaagatg

SEQ ID NO: 122592 - DNA, 103 bp, Artificial Sequence
  Synthetic Polynucleotide
taatacgactcactatagggggtcctgggcggaggagatggcctgcacgaaacagaggagatcgtgcatgccatctcctaacctggcggcagcgcaaaagatg

SEQ ID NO: 122593 - DNA, 103 bp, Artificial Sequence
  Synthetic Polynucleotide
taatacgactcactataggggtcagctgccggtcctgggcggaggagatgaacagaggagacatctcatgcgcccaggaaacctggcggcagcgcaaaagatg

SEQ ID NO: 122594 - DNA, 103 bp, Artificial Sequence
  Synthetic Polynucleotide
taatacgactcactatagggcccgctcagggtcagctgccggtcctgggcaacagaggagagcccagatgcggcagctgaacctggcggcagcgcaaaagatg

SEQ ID NO: 122595 - DNA, 103 bp, Artificial Sequence
  Synthetic Polynucleotide
taatacgactcactataggggggcgtagatcccgctcagggtcagctgccaacagaggagaggcagcatgccctgagcgaacctggcggcagcgcaaaagatg

SEQ ID NO: 122596 - DNA, 103 bp, Artificial Sequence
  Synthetic Polynucleotide
taatacgactcactatagggttggtgatgtgggcgtagatcccgctcaggaacagaggagacctgagatggatctacgcaacctggcggcagcgcaaaagatg

SEQ ID NO: 122597 - DNA, 103 bp, Artificial Sequence
  Synthetic Polynucleotide
taatacgactcactataggggcccgagagcgccgccgcggccgccgccataacagaggagaatggcgatggccgcggcgaacctggcggcagcgcaaaagatg

SEQ ID NO: 122598 - DNA, 103 bp, Artificial Sequence
  Synthetic Polynucleotide
taatacgactcactatagggcaggcgcgccacggcccagccgcccggcggaacagaggagaccgccgatgggctgggccaacctggcggcagcgcaaaagatg

SEQ ID NO: 122599 - DNA, 103 bp, Artificial Sequence
  Synthetic Polynucleotide
taatacgactcactataggggctttcagaggctgggtctatcctccagaaaacagaggagattctggatgatagacccaaacctggcggcagcgcaaaagatg

SEQ ID NO: 122600 - DNA, 103 bp, Artificial Sequence
  Synthetic Polynucleotide
taatacgactcactatagggctattaatttgctttcagaggctgggtctaaacagaggagatagaccatgcctctgaaaaacctggcggcagcgcaaaagatg

SEQ ID NO: 122601 - DNA, 103 bp, Artificial Sequence
  Synthetic Polynucleotide
taatacgactcactatagggaaagcctgttctattaatttgctttcagagaacagaggagactctgaatgcaaattaataacctggcggcagcgcaaaagatg

SEQ ID NO: 122602 - DNA, 103 bp, Artificial Sequence
  Synthetic Polynucleotide
taatacgactcactatagggtcgtttcctaaaagcctgttctattaatttaacagaggagaaaattaatggaacaggctaacctggcggcagcgcaaaagatg

SEQ ID NO: 122603 - DNA, 103 bp, Artificial Sequence
  Synthetic Polynucleotide
taatacgactcactatagggccctaggccgtcgtttcctaaaagcctgttaacagaggagaaacaggatgttaggaaacaacctggcggcagcgcaaaagatg

SEQ ID NO: 122604 - DNA, 103 bp, Artificial Sequence
  Synthetic Polynucleotide
taatacgactcactatagggcagggcacgcccctaggccgtcgtttcctaaacagaggagataggaaatgacggcctagaacctggcggcagcgcaaaagatg

SEQ ID NO: 122605 - DNA, 103 bp, Artificial Sequence
  Synthetic Polynucleotide
taatacgactcactatagggggttctaaagcagggcacgcccctaggccgaacagaggagacggcctatgggcgtgcccaacctggcggcagcgcaaaagatg

SEQ ID NO: 122606 - DNA, 103 bp, Artificial Sequence
  Synthetic Polynucleotide
taatacgactcactataggggtcccagaggggttctaaagcagggcacgcaacagaggagagcgtgcatggctttagaaaacctggcggcagcgcaaaagatg

SEQ ID NO: 122607 - DNA, 103 bp, Artificial Sequence
  Synthetic Polynucleotide
taatacgactcactataggggaagagagcggtcccagaggggttctaaagaacagaggagactttagatgccctctgggaacctggcggcagcgcaaaagatg

SEQ ID NO: 122608 - DNA, 103 bp, Artificial Sequence
  Synthetic Polynucleotide
taatacgactcactatagggggcactcctagaagagagcggtcccagaggaacagaggagacctctgatgccgctctctaacctggcggcagcgcaaaagatg

SEQ ID NO: 122609 - DNA, 103 bp, Artificial Sequence
  Synthetic Polynucleotide
taatacgactcactatagggcgcggccctccaggcgcgccacggcccagcaacagaggagagctgggatgtggcgcgccaacctggcggcagcgcaaaagatg

SEQ ID NO: 122610 - DNA, 103 bp, Artificial Sequence
  Synthetic Polynucleotide
taatacgactcactataggggagaggctggggcactcctagaagagagcgaacagaggagacgctctatgctaggagtgaacctggcggcagcgcaaaagatg

SEQ ID NO: 122611 - DNA, 103 bp, Artificial Sequence
  Synthetic Polynucleotide
taatacgactcactataggggcgtgattgggagaggctggggcactcctaaacagaggagataggagatgcccagcctcaacctggcggcagcgcaaaagatg

SEQ ID NO: 122612 - DNA, 103 bp, Artificial Sequence
  Synthetic Polynucleotide
taatacgactcactatagggcagcactcccgcgtgattgggagaggctggaacagaggagaccagccatgcccaatcacaacctggcggcagcgcaaaagatg

SEQ ID NO: 122613 - DNA, 103 bp, Artificial Sequence
  Synthetic Polynucleotide
taatacgactcactatagggagtgagcagacagcactcccgcgtgattggaacagaggagaccaatcatgcgggagtgcaacctggcggcagcgcaaaagatg

SEQ ID NO: 122614 - DNA, 103 bp, Artificial Sequence
  Synthetic Polynucleotide
taatacgactcactataggggcgccactagagtgagcagacagcactcccaacagaggagagggagtatggtctgctcaaacctggcggcagcgcaaaagatg

SEQ ID NO: 122615 - DNA, 103 bp, Artificial Sequence
  Synthetic Polynucleotide
taatacgactcactatagggaggggtctgggcgccactagagtgagcagaaacagaggagatctgctatgtctagtggcaacctggcggcagcgcaaaagatg

SEQ ID NO: 122616 - DNA, 103 bp, Artificial Sequence
  Synthetic Polynucleotide
taatacgactcactatagggacaggctctcaggggtctgggcgccactagaacagaggagactagtgatgcccagacccaacctggcggcagcgcaaaagatg

SEQ ID NO: 122617 - DNA, 103 bp, Artificial Sequence
  Synthetic Polynucleotide
taatacgactcactatagggccttccctcgacaggctctcaggggtctggaacagaggagaccagacatgtgagagcctaacctggcggcagcgcaaaagatg

SEQ ID NO: 122618 - DNA, 103 bp, Artificial Sequence
  Synthetic Polynucleotide
taatacgactcactatagggggccggcgaaccttccctcgacaggctctcaacagaggagagagagcatgtcgagggaaaacctggcggcagcgcaaaagatg

SEQ ID NO: 122619 - DNA, 103 bp, Artificial Sequence
  Synthetic Polynucleotide
taatacgactcactataggggctccaggggggccggcgaaccttccctcgaacagaggagacgagggatggttcgccggaacctggcggcagcgcaaaagatg

SEQ ID NO: 122620 - DNA, 103 bp, Artificial Sequence
  Synthetic Polynucleotide
taatacgactcactatagggtactcgaactcgcggccctccaggcgcgccaacagaggagaggcgcgatgggagggccgaacctggcggcagcgcaaaagatg

SEQ ID NO: 122621 - DNA, 103 bp, Artificial Sequence
  Synthetic Polynucleotide
taatacgactcactatagggccaggctcaggctccaggggggccggcgaaaacagaggagattcgccatgccccctggaaacctggcggcagcgcaaaagatg

SEQ ID NO: 122622 - DNA, 103 bp, Artificial Sequence
  Synthetic Polynucleotide
taatacgactcactatagggctgtgcagcgccaggctcaggctccaggggaacagaggagacccctgatgcctgagcctaacctggcggcagcgcaaaagatg

SEQ ID NO: 122623 - DNA, 103 bp, Artificial Sequence
  Synthetic Polynucleotide
taatacgactcactatagggcgagtttgggctgtgcagcgccaggctcagaacagaggagactgagcatggcgctgcacaacctggcggcagcgcaaaagatg

SEQ ID NO: 122624 - DNA, 103 bp, Artificial Sequence
  Synthetic Polynucleotide
taatacgactcactatagggtggatgacagcgagtttgggctgtgcagcgaacagaggagacgctgcatggcccaaactaacctggcggcagcgcaaaagatg

SEQ ID NO: 122625 - DNA, 103 bp, Artificial Sequence
  Synthetic Polynucleotide
taatacgactcactatagggccgggcttcctggatgacagcgagtttgggaacagaggagacccaaaatggctgtcatcaacctggcggcagcgcaaaagatg

SEQ ID NO: 122626 - DNA, 103 bp, Artificial Sequence
  Synthetic Polynucleotide
taatacgactcactatagggtctgggcaaaccgggcttcctggatgacagaacagaggagactgtcaatgaggaagcccaacctggcggcagcgcaaaagatg

SEQ ID NO: 122627 - DNA, 103 bp, Artificial Sequence
  Synthetic Polynucleotide
taatacgactcactatagggcctggggcgctctgggcaaaccgggcttccaacagaggagaggaagcatggtttgcccaaacctggcggcagcgcaaaagatg

SEQ ID NO: 122628 - DNA, 103 bp, Artificial Sequence
  Synthetic Polynucleotide
taatacgactcactatagggcagaggtgaccctggggcgctctgggcaaaaacagaggagatttgccatgagcgccccaaacctggcggcagcgcaaaagatg

SEQ ID NO: 122629 - DNA, 103 bp, Artificial Sequence
  Synthetic Polynucleotide
taatacgactcactataggggctgactggacagaggtgaccctggggcgcaacagaggagagcgcccatgggtcacctcaacctggcggcagcgcaaaagatg

SEQ ID NO: 122630 - DNA, 103 bp, Artificial Sequence
  Synthetic Polynucleotide
taatacgactcactatagggattaagactggctgactggacagaggtgacaacagaggagagtcaccatggtccagtcaaacctggcggcagcgcaaaagatg

SEQ ID NO: 122631 - DNA, 103 bp, Artificial Sequence
  Synthetic Polynucleotide
taatacgactcactatagggcttcatcagatactcgaactcgcggccctcaacagaggagagagggcatggagttcgagaacctggcggcagcgcaaaagatg

SEQ ID NO: 122632 - DNA, 103 bp, Artificial Sequence
  Synthetic Polynucleotide
taatacgactcactatagggctggacggtgattaagactggctgactggaaacagaggagatccagtatgccagtcttaaacctggcggcagcgcaaaagatg

SEQ ID NO: 122633 - DNA, 103 bp, Artificial Sequence
  Synthetic Polynucleotide
taatacgactcactataggggtagctgccgctggacggtgattaagactgaacagaggagacagtctatgtcaccgtccaacctggcggcagcgcaaaagatg

SEQ ID NO: 122634 - DNA, 103 bp, Artificial Sequence
  Synthetic Polynucleotide
taatacgactcactatagggatggcctgtggtagctgccgctggacggtgaacagaggagacaccgtatggcggcagctaacctggcggcagcgcaaaagatg

SEQ ID NO: 122635 - DNA, 103 bp, Artificial Sequence
  Synthetic Polynucleotide
taatacgactcactataggggacaggcttgatggcctgtggtagctgccgaacagaggagacggcagatgccacaggccaacctggcggcagcgcaaaagatg

SEQ ID NO: 122636 - DNA, 103 bp, Artificial Sequence
  Synthetic Polynucleotide
taatacgactcactatagggcagtgtaggtgacaggcttgatggcctgtgaacagaggagacacaggatgtcaagcctgaacctggcggcagcgcaaaagatg

SEQ ID NO: 122637 - DNA, 103 bp, Artificial Sequence
  Synthetic Polynucleotide
taatacgactcactatagggggggtggccacagtgtaggtgacaggcttgaacagaggagacaagccatgcacctacacaacctggcggcagcgcaaaagatg

SEQ ID NO: 122638 - DNA, 103 bp, Artificial Sequence
  Synthetic Polynucleotide
taatacgactcactatagggggtggtcactggggtggccacagtgtaggtaacagaggagaacctacatggtggccaccaacctggcggcagcgcaaaagatg

SEQ ID NO: 122639 - DNA, 103 bp, Artificial Sequence
  Synthetic Polynucleotide
taatacgactcactataggggggaggtcgaggtggtcactggggtggccaaacagaggagatggccaatgcagtgaccaaacctggcggcagcgcaaaagatg

SEQ ID NO: 122640 - DNA, 103 bp, Artificial Sequence
  Synthetic Polynucleotide
taatacgactcactatagggacgggtggctgggaggtcgaggtggtcactaacagaggagaagtgacatgctcgacctcaacctggcggcagcgcaaaagatg

SEQ ID NO: 122641 - DNA, 103 bp, Artificial Sequence
  Synthetic Polynucleotide
taatacgactcactatagggcgtctgcacgacgggtggctgggaggtcgaaacagaggagatcgaccatgcagccacccaacctggcggcagcgcaaaagatg

SEQ ID NO: 122642 - DNA, 103 bp, Artificial Sequence
  Synthetic Polynucleotide
taatacgactcactatagggccgagcgcttcttcatcagatactcgaactaacagaggagaagttcgatgatctgatgaaacctggcggcagcgcaaaagatg

SEQ ID NO: 122643 - DNA, 103 bp, Artificial Sequence
  Synthetic Polynucleotide
taatacgactcactatagggcgacgtgaaccgtctgcacgacgggtggctaacagaggagaagccacatgtcgtgcagaaacctggcggcagcgcaaaagatg

SEQ ID NO: 122644 - DNA, 103 bp, Artificial Sequence
  Synthetic Polynucleotide
taatacgactcactatagggatctggtggacgacgtgaaccgtctgcacgaacagaggagacgtgcaatgggttcacgtaacctggcggcagcgcaaaagatg

SEQ ID NO: 122645 - DNA, 103 bp, Artificial Sequence
  Synthetic Polynucleotide
taatacgactcactatagggcaccgctgggatctggtggacgacgtgaacaacagaggagagttcacatggtccaccagaacctggcggcagcgcaaaagatg

SEQ ID NO: 122646 - DNA, 103 bp, Artificial Sequence
  Synthetic Polynucleotide
taatacgactcactatagggtggtgaccgacaccgctgggatctggtggaaacagaggagatccaccatgtcccagcggaacctggcggcagcgcaaaagatg

SEQ ID NO: 122647 - DNA, 103 bp, Artificial Sequence
  Synthetic Polynucleotide
taatacgactcactatagggccggccacactggtgaccgacaccgctgggaacagaggagacccagcatggtcggtcacaacctggcggcagcgcaaaagatg

SEQ ID NO: 122648 - DNA, 103 bp, Artificial Sequence
  Synthetic Polynucleotide
taatacgactcactatagggtggggccagtccggccacactggtgaccgaaacagaggagatcggtcatgagtgtggccaacctggcggcagcgcaaaagatg

SEQ ID NO: 122649 - DNA, 103 bp, Artificial Sequence
  Synthetic Polynucleotide
taatacgactcactatagggacgtgttcgctggggccagtccggccacacaacagaggagagtgtggatggactggcccaacctggcggcagcgcaaaagatg

SEQ ID NO: 122650 - DNA, 103 bp, Artificial Sequence
  Synthetic Polynucleotide
taatacgactcactataggggagacagtgtacgtgttcgctggggccagtaacagaggagaactggcatgagcgaacacaacctggcggcagcgcaaaagatg

SEQ ID NO: 122651 - DNA, 103 bp, Artificial Sequence
  Synthetic Polynucleotide
taatacgactcactatagggagcttgtccagagacagtgtacgtgttcgcaacagaggagagcgaacatgtacactgtcaacctggcggcagcgcaaaagatg

SEQ ID NO: 122652 - DNA, 103 bp, Artificial Sequence
  Synthetic Polynucleotide
taatacgactcactataggggggtgaccacagcttgtccagagacagtgtaacagaggagaacactgatgctggacaagaacctggcggcagcgcaaaagatg

SEQ ID NO: 122653 - DNA, 103 bp, Artificial Sequence
  Synthetic Polynucleotide
taatacgactcactatagggccgatggtcaccgagcgcttcttcatcagaaacagaggagatctgatatggaagcgctcaacctggcggcagcgcaaaagatg

SEQ ID NO: 122654 - DNA, 103 bp, Artificial Sequence
  Synthetic Polynucleotide
taatacgactcactatagggacggctgccggggtgaccacagcttgtccaaacagaggagatggacaatgtgtggtcacaacctggcggcagcgcaaaagatg

SEQ ID NO: 122655 - DNA, 103 bp, Artificial Sequence
  Synthetic Polynucleotide
taatacgactcactatagggaggggccagcacggctgccggggtgaccacaacagaggagagtggtcatgccggcagccaacctggcggcagcgcaaaagatg

SEQ ID NO: 122656 - DNA, 103 bp, Artificial Sequence
  Synthetic Polynucleotide
taatacgactcactatagggctgccttaggaggggccagcacggctgccgaacagaggagacggcagatgtgctggcccaacctggcggcagcgcaaaagatg

SEQ ID NO: 122657 - DNA, 103 bp, Artificial Sequence
  Synthetic Polynucleotide
taatacgactcactatagggtcctgggcctctgccttaggaggggccagcaacagaggagagctggcatgtcctaaggcaacctggcggcagcgcaaaagatg

SEQ ID NO: 122658 - DNA, 103 bp, Artificial Sequence
  Synthetic Polynucleotide
taatacgactcactataggggtctccattctcctgggcctctgccttaggaacagaggagacctaagatggaggcccagaacctggcggcagcgcaaaagatg

SEQ ID NO: 122659 - DNA, 103 bp, Artificial Sequence
  Synthetic Polynucleotide
taatacgactcactatagggcttccctgtggtctccattctcctgggcctaacagaggagaaggcccatgagaatggagaacctggcggcagcgcaaaagatg

SEQ ID NO: 122660 - DNA, 103 bp, Artificial Sequence
  Synthetic Polynucleotide
taatacgactcactatagggttcactttgacttccctgtggtctccattcaacagaggagagaatggatgccacagggaaacctggcggcagcgcaaaagatg

SEQ ID NO: 122661 - DNA, 103 bp, Artificial Sequence
  Synthetic Polynucleotide
taatacgactcactatagggaggctctactttcactttgacttccctgtgaacagaggagacacaggatggtcaaagtgaacctggcggcagcgcaaaagatg

SEQ ID NO: 122662 - DNA, 103 bp, Artificial Sequence
  Synthetic Polynucleotide
taatacgactcactatagggtggcgggaataggctctactttcactttgaaacagaggagatcaaagatgaagtagagcaacctggcggcagcgcaaaagatg

SEQ ID NO: 122663 - DNA, 103 bp, Artificial Sequence
  Synthetic Polynucleotide
taatacgactcactataggggcgtggccaatggcgggaataggctctactaacagaggagaagtagaatgtattcccgcaacctggcggcagcgcaaaagatg

SEQ ID NO: 122664 - DNA, 103 bp, Artificial Sequence
  Synthetic Polynucleotide
taatacgactcactatagggcgagttgcggccgatggtcaccgagcgcttaacagaggagaaagcgcatggtgaccatcaacctggcggcagcgcaaaagatg

SEQ ID NO: 122665 - DNA, 103 bp, Artificial Sequence
  Synthetic Polynucleotide
taatacgactcactataggggccgagcgtggcgtggccaatggcgggaataacagaggagaattcccatgattggccacaacctggcggcagcgcaaaagatg

SEQ ID NO: 122666 - DNA, 103 bp, Artificial Sequence
  Synthetic Polynucleotide
taatacgactcactatagggggctggcagtgccgagcgtggcgtggccaaaacagaggagattggccatgccacgctcgaacctggcggcagcgcaaaagatg

SEQ ID NO: 122667 - DNA, 103 bp, Artificial Sequence
  Synthetic Polynucleotide
taatacgactcactatagggtgaatgatccggctggcagtgccgagcgtgaacagaggagacacgctatgcactgccagaacctggcggcagcgcaaaagatg

SEQ ID NO: 122668 - DNA, 103 bp, Artificial Sequence
  Synthetic Polynucleotide
taatacgactcactatagggctgtgccgtctgaatgatccggctggcagtaacagaggagaactgccatgcggatcattaacctggcggcagcgcaaaagatg

SEQ ID NO: 122669 - DNA, 103 bp, Artificial Sequence
  Synthetic Polynucleotide
taatacgactcactatagggccggggtggtctgtgccgtctgaatgatccaacagaggagaggatcaatgagacggcacaacctggcggcagcgcaaaagatg

SEQ ID NO: 122670 - DNA, 103 bp, Artificial Sequence
  Synthetic Polynucleotide
taatacgactcactatagggaccgtctggaccggggtggtctgtgccgtcaacagaggagagacggcatggaccaccccaacctggcggcagcgcaaaagatg

SEQ ID NO: 122671 - DNA, 103 bp, Artificial Sequence
  Synthetic Polynucleotide
taatacgactcactatagggtactatggtcaccgtctggaccggggtggtaacagaggagaaccaccatggtccagacgaacctggcggcagcgcaaaagatg

SEQ ID NO: 122672 - DNA, 103 bp, Artificial Sequence
  Synthetic Polynucleotide
taatacgactcactataggggtgcctgttgtactatggtcaccgtctggaaacagaggagatccagaatgtgaccatagaacctggcggcagcgcaaaagatg

SEQ ID NO: 122673 - DNA, 103 bp, Artificial Sequence
  Synthetic Polynucleotide
taatacgactcactatagggtgacctagaggtgcctgttgtactatggtcaacagaggagagaccatatgacaacaggcaacctggcggcagcgcaaaagatg

SEQ ID NO: 122674 - DNA, 103 bp, Artificial Sequence
  Synthetic Polynucleotide
taatacgactcactatagggtagctggtgttgacctagaggtgcctgttgaacagaggagacaacagatgcctctaggtaacctggcggcagcgcaaaagatg

SEQ ID NO: 122675 - DNA, 103 bp, Artificial Sequence
  Synthetic Polynucleotide
taatacgactcactatagggagccctgcgacgagttgcggccgatggtcaaacagaggagatgaccaatggccgcaactaacctggcggcagcgcaaaagatg

SEQ ID NO: 122676 - DNA, 103 bp, Artificial Sequence
  Synthetic Polynucleotide
taatacgactcactatagggtttttattggtagctggtgttgacctagagaacagaggagactctagatgaacaccagcaacctggcggcagcgcaaaagatg

SEQ ID NO: 122677 - DNA, 103 bp, Artificial Sequence
  Synthetic Polynucleotide
taatacgactcactatagggtgtgttacagtttttattggtagctggtgtaacagaggagaacaccaatgaccaataaaaacctggcggcagcgcaaaagatg

SEQ ID NO: 122678 - DNA, 103 bp, Artificial Sequence
  Synthetic Polynucleotide
taatacgactcactatagggagtgccgttttgtgttacagtttttattggaacagaggagaccaataatgactgtaacaaacctggcggcagcgcaaaagatg

SEQ ID NO: 122679 - DNA, 103 bp, Artificial Sequence
  Synthetic Polynucleotide
taatacgactcactatagggatgccacgtgagtgccgttttgtgttacagaacagaggagactgtaaatgaaaacggcaaacctggcggcagcgcaaaagatg

SEQ ID NO: 122680 - DNA, 103 bp, Artificial Sequence
  Synthetic Polynucleotide
taatacgactcactataggggtggggactgatgccacgtgagtgccgtttaacagaggagaaaacggatgtcacgtggcaacctggcggcagcgcaaaagatg

SEQ ID NO: 122681 - DNA, 103 bp, Artificial Sequence
  Synthetic Polynucleotide
taatacgactcactataggggtggaccgcagtggggactgatgccacgtgaacagaggagacacgtgatgtcagtccccaacctggcggcagcgcaaaagatg

SEQ ID NO: 122682 - DNA, 103 bp, Artificial Sequence
  Synthetic Polynucleotide
taatacgactcactatagggtcacctggccgtggaccgcagtggggactgaacagaggagacagtccatgctgcggtccaacctggcggcagcgcaaaagatg

SEQ ID NO: 122683 - DNA, 103 bp, Artificial Sequence
  Synthetic Polynucleotide
taatacgactcactataggggcggcattgttcacctggccgtggaccgcaaacagaggagatgcggtatgcggccaggtaacctggcggcagcgcaaaagatg

SEQ ID NO: 122684 - DNA, 103 bp, Artificial Sequence
  Synthetic Polynucleotide
taatacgactcactatagggaggactcgccgcggcattgttcacctggccaacagaggagaggccagatgaacaatgccaacctggcggcagcgcaaaagatg

SEQ ID NO: 122685 - DNA, 103 bp, Artificial Sequence
  Synthetic Polynucleotide
taatacgactcactatagggacatgtgcaaaggactcgccgcggcattgtaacagaggagaacaatgatgcggcgagtcaacctggcggcagcgcaaaagatg

SEQ ID NO: 122686 - DNA, 103 bp, Artificial Sequence
  Synthetic Polynucleotide
taatacgactcactatagggacgtccaccgagccctgcgacgagttgcggaacagaggagaccgcaaatggtcgcagggaacctggcggcagcgcaaaagatg

SEQ ID NO: 122687 - DNA, 103 bp, Artificial Sequence
  Synthetic Polynucleotide
taatacgactcactatagggtgtgttgccaacatgtgcaaaggactcgccaacagaggagaggcgagatgtttgcacataacctggcggcagcgcaaaagatg

SEQ ID NO: 122688 - DNA, 103 bp, Artificial Sequence
  Synthetic Polynucleotide
taatacgactcactatagggtgcggatgcgtgtgttgccaacatgtgcaaaacagaggagattgcacatgttggcaacaaacctggcggcagcgcaaaagatg

SEQ ID NO: 122689 - DNA, 103 bp, Artificial Sequence
  Synthetic Polynucleotide
taatacgactcactataggggggaggccgatgcggatgcgtgtgttgccaaacagaggagatggcaaatgacgcatccgaacctggcggcagcgcaaaagatg

SEQ ID NO: 122690 - DNA, 103 bp, Artificial Sequence
  Synthetic Polynucleotide
taatacgactcactatagggtttgtgggcagggaggccgatgcggatgcgaacagaggagacgcatcatgatcggcctcaacctggcggcagcgcaaaagatg

SEQ ID NO: 122691 - DNA, 103 bp, Artificial Sequence
  Synthetic Polynucleotide
taatacgactcactataggggttgtggcgctttgtgggcagggaggccgaaacagaggagatcggccatgctgcccacaaacctggcggcagcgcaaaagatg

SEQ ID NO: 122692 - DNA, 103 bp, Artificial Sequence
  Synthetic Polynucleotide
taatacgactcactataggggctggtcaccgttgtggcgctttgtgggcaaacagaggagatgcccaatgagcgccacaaacctggcggcagcgcaaaagatg

SEQ ID NO: 122693 - DNA, 103 bp, Artificial Sequence
  Synthetic Polynucleotide
taatacgactcactatagggggctgctccggctggtcaccgttgtggcgcaacagaggagagcgccaatgcggtgaccaaacctggcggcagcgcaaaagatg

SEQ ID NO: 122694 - DNA, 103 bp, Artificial Sequence
  Synthetic Polynucleotide
taatacgactcactatagggcttcagctccggctgctccggctggtcaccaacagaggagaggtgacatgccggagcagaacctggcggcagcgcaaaagatg

SEQ ID NO: 122695 - DNA, 103 bp, Artificial Sequence
  Synthetic Polynucleotide
taatacgactcactatagggtcttgatccgcttcagctccggctgctccgaacagaggagacggagcatgcggagctgaaacctggcggcagcgcaaaagatg

SEQ ID NO: 122696 - DNA, 103 bp, Artificial Sequence
  Synthetic Polynucleotide
taatacgactcactatagggccgtcttctgtcttgatccgcttcagctccaacagaggagaggagctatggcggatcaaaacctggcggcagcgcaaaagatg

SEQ ID NO: 122697 - DNA, 103 bp, Artificial Sequence
  Synthetic Polynucleotide
taatacgactcactataggggcccatgctcacgtccaccgagccctgcgaaacagaggagatcgcagatgtcggtggacaacctggcggcagcgcaaaagatg

SEQ ID NO: 122698 - DNA, 103 bp, Artificial Sequence
  Synthetic Polynucleotide
taatacgactcactataggggatgccctcgccgtcttctgtcttgatccgaacagaggagacggatcatgacagaagacaacctggcggcagcgcaaaagatg

SEQ ID NO: 122699 - DNA, 103 bp, Artificial Sequence
  Synthetic Polynucleotide
taatacgactcactataggggggcaatgacgatgccctcgccgtcttctgaacagaggagacagaagatggcgagggcaaacctggcggcagcgcaaaagatg

SEQ ID NO: 122700 - DNA, 103 bp, Artificial Sequence
  Synthetic Polynucleotide
taatacgactcactatagggtccacgctcagggcaatgacgatgccctcgaacagaggagacgagggatgcgtcattgcaacctggcggcagcgcaaaagatg

SEQ ID NO: 122701 - DNA, 103 bp, Artificial Sequence
  Synthetic Polynucleotide
taatacgactcactatagggcggtggcgtgtccacgctcagggcaatgacaacagaggagagtcattatgctgagcgtgaacctggcggcagcgcaaaagatg

SEQ ID NO: 122702 - DNA, 103 bp, Artificial Sequence
  Synthetic Polynucleotide
taatacgactcactatagggttacggctgccggtggcgtgtccacgctcaaacagaggagatgagcgatgacacgccacaacctggcggcagcgcaaaagatg

SEQ ID NO: 122703 - DNA, 103 bp, Artificial Sequence
  Synthetic Polynucleotide
taatacgactcactatagggcccttttcccttacggctgccggtggcgtgaacagaggagacacgccatgggcagccgtaacctggcggcagcgcaaaagatg

SEQ ID NO: 122704 - DNA, 103 bp, Artificial Sequence
  Synthetic Polynucleotide
taatacgactcactataggggttctggacacccttttcccttacggctgcaacagaggagagcagccatgagggaaaagaacctggcggcagcgcaaaagatg

SEQ ID NO: 122705 - DNA, 103 bp, Artificial Sequence
  Synthetic Polynucleotide
taatacgactcactataggggcgtgcccgcgcccgagagcgccgccgcggaacagaggagaccgcggatgcgctctcggaacctggcggcagcgcaaaagatg

SEQ ID NO: 122706 - DNA, 103 bp, Artificial Sequence
  Synthetic Polynucleotide
taatacgactcactatagggagctcgagtggcccatgctcacgtccaccgaacagaggagacggtggatgtgagcatggaacctggcggcagcgcaaaagatg

SEQ ID NO: 122707 - DNA, 103 bp, Artificial Sequence
  Synthetic Polynucleotide
taatacgactcactatagggcgggagatgaagctcgagtggcccatgctcaacagaggagagagcatatgccactcgagaacctggcggcagcgcaaaagatg

SEQ ID NO: 122708 - DNA, 103 bp, Artificial Sequence
  Synthetic Polynucleotide
taatacgactcactataggggaggtggcgccgggagatgaagctcgagtgaacagaggagacactcgatgttcatctccaacctggcggcagcgcaaaagatg

SEQ ID NO: 122709 - DNA, 103 bp, Artificial Sequence
  Synthetic Polynucleotide
taatacgactcactatagggtgaagatctcgaggtggcgccgggagatgaaacagaggagatcatctatgggcgccaccaacctggcggcagcgcaaaagatg

SEQ ID NO: 122710 - DNA, 103 bp, Artificial Sequence
  Synthetic Polynucleotide
taatacgactcactatagggcccgggggcgtgaagatctcgaggtggcgcaacagaggagagcgccaatgcgagatcttaacctggcggcagcgcaaaagatg

SEQ ID NO: 122711 - DNA, 103 bp, Artificial Sequence
  Synthetic Polynucleotide
taatacgactcactataggggccgccgccgcccgggggcgtgaagatctcaacagaggagagagatcatgacgcccccgaacctggcggcagcgcaaaagatg

SEQ ID NO: 122712 - DNA, 103 bp, Artificial Sequence
  Synthetic Polynucleotide
taatacgactcactatagggccccgccatggccgccgccgcccgggggcgaacagaggagacgccccatggcggcggcgaacctggcggcagcgcaaaagatg

SEQ ID NO: 122713 - DNA, 103 bp, Artificial Sequence
  Synthetic Polynucleotide
taatacgactcactatagggtccggagcggccccgccatggccgccgccgaacagaggagacggcggatgccatggcggaacctggcggcagcgcaaaagatg

SEQ ID NO: 122714 - DNA, 103 bp, Artificial Sequence
  Synthetic Polynucleotide
taatacgactcactataggggggcggcagctccggagcggccccgccatgaacagaggagacatggcatggccgctccgaacctggcggcagcgcaaaagatg

SEQ ID NO: 122715 - DNA, 103 bp, Artificial Sequence
  Synthetic Polynucleotide
taatacgactcactatagggtgggctgcgcgggcggcagctccggagcggaacagaggagaccgctcatgagctgccgcaacctggcggcagcgcaaaagatg

SEQ ID NO: 122716 - DNA, 103 bp, Artificial Sequence
  Synthetic Polynucleotide
taatacgactcactatagggcccgcgggtggcgtgcccgcgcccgagagcaacagaggagagctctcatgcgcgggcacaacctggcggcagcgcaaaagatg

SEQ ID NO: 122717 - DNA, 103 bp, Artificial Sequence
  Synthetic Polynucleotide
taatacgactcactataggggcgtcgggcctgggctgcgcgggcggcagcaacagaggagagctgccatgcgcgcagccaacctggcggcagcgcaaaagatg

SEQ ID NO: 122718 - DNA, 103 bp, Artificial Sequence
  Synthetic Polynucleotide
taatacgactcactataggggtcgccgccggcgtcgggcctgggctgcgcaacagaggagagcgcagatgaggcccgacaacctggcggcagcgcaaaagatg

SEQ ID NO: 122719 - DNA, 103 bp, Artificial Sequence
  Synthetic Polynucleotide
taatacgactcactataggggcaggtagaagtcgccgccggcgtcgggccaacagaggagaggcccgatgccggcggcgaacctggcggcagcgcaaaagatg

SEQ ID NO: 122720 - DNA, 103 bp, Artificial Sequence
  Synthetic Polynucleotide
taatacgactcactatagggcccaagcagcgcaggtagaagtcgccgccgaacagaggagacggcggatgcttctacctaacctggcggcagcgcaaaagatg

SEQ ID NO: 122721 - DNA, 103 bp, Artificial Sequence
  Synthetic Polynucleotide
taatacgactcactatagggcccgttcttgcccaagcagcgcaggtagaaaacagaggagattctacatgcgctgcttgaacctggcggcagcgcaaaagatg

SEQ ID NO: 122722 - DNA, 103 bp, Artificial Sequence
  Synthetic Polynucleotide
taatacgactcactatagggccacgaataccccgttcttgcccaagcagcaacagaggagagctgctatggcaagaacgaacctggcggcagcgcaaaagatg

SEQ ID NO: 122723 - DNA, 103 bp, Artificial Sequence
  Synthetic Polynucleotide
taatacgactcactatagggaacacgccgtccacgaataccccgttcttgaacagaggagacaagaaatgggtattcgtaacctggcggcagcgcaaaagatg

SEQ ID NO: 122724 - DNA, 103 bp, Artificial Sequence
  Synthetic Polynucleotide
taatacgactcactataggggcgcctctggaacacgccgtccacgaatacaacagaggagagtattcatggacggcgtgaacctggcggcagcgcaaaagatg

SEQ ID NO: 122725 - DNA, 103 bp, Artificial Sequence
  Synthetic Polynucleotide
taatacgactcactataggggcggcgccccgcgcctctggaacacgccgtaacagaggagaacggcgatgtccagaggcaacctggcggcagcgcaaaagatg

SEQ ID NO: 122726 - DNA, 103 bp, Artificial Sequence
  Synthetic Polynucleotide
taatacgactcactatagggagctgcagcggcggcgccccgcgcctctggaacagaggagaccagagatgcggggcgccaacctggcggcagcgcaaaagatg

SEQ ID NO: 122727 - DNA, 103 bp, Artificial Sequence
  Synthetic Polynucleotide
taatacgactcactatagggggccccgccgcccgcgggtggcgtgcccgcaacagaggagagcgggcatgccacccgcgaacctggcggcagcgcaaaagatg

SEQ ID NO: 122728 - DNA, 103 bp, Artificial Sequence
  Synthetic Polynucleotide
taatacgactcactatagggcacgcgcggcagctgcagcggcggcgccccaacagaggagaggggcgatgccgctgcagaacctggcggcagcgcaaaagatg

SEQ ID NO: 122729 - DNA, 103 bp, Artificial Sequence
  Synthetic Polynucleotide
taatacgactcactatagggtgaatgtgcacacgcgcggcagctgcagcgaacagaggagacgctgcatgtgccgcgcgaacctggcggcagcgcaaaagatg

SEQ ID NO: 122730 - DNA, 103 bp, Artificial Sequence
  Synthetic Polynucleotide
taatacgactcactatagggctcgggaacctgaatgtgcacacgcgcggcaacagaggagagccgcgatggtgcacattaacctggcggcagcgcaaaagatg

SEQ ID NO: 122731 - DNA, 103 bp, Artificial Sequence
  Synthetic Polynucleotide
taatacgactcactataggggatgtttgtgctcgggaacctgaatgtgcaaacagaggagatgcacaatgaggttcccgaacctggcggcagcgcaaaagatg

SEQ ID NO: 122732 - DNA, 103 bp, Artificial Sequence
  Synthetic Polynucleotide
taatacgactcactatagggacgttatcttgatgtttgtgctcgggaaccaacagaggagaggttccatggcacaaacaaacctggcggcagcgcaaaagatg

SEQ ID NO: 122733 - DNA, 103 bp, Artificial Sequence
  Synthetic Polynucleotide
taatacgactcactatagggagggcagtgaacgttatcttgatgtttgtgaacagaggagacacaaaatgcaagataacaacctggcggcagcgcaaaagatg

SEQ ID NO: 122734 - DNA, 103 bp, Artificial Sequence
  Synthetic Polynucleotide
taatacgactcactatagggctcgctggacagggcagtgaacgttatcttaacagaggagaaagataatgttcactgccaacctggcggcagcgcaaaagatg

SEQ ID NO: 122735 - DNA, 103 bp, Artificial Sequence
  Synthetic Polynucleotide
taatacgactcactatagggtctctctcttctcgctggacagggcagtgaaacagaggagatcactgatgtgtccagcgaacctggcggcagcgcaaaagatg

SEQ ID NO: 122736 - DNA, 103 bp, Artificial Sequence
  Synthetic Polynucleotide
taatacgactcactataggggcctcctgcttctctctcttctcgctggacaacagaggagagtccagatggaagagagaaacctggcggcagcgcaaaagatg

SEQ ID NO: 122737 - DNA, 103 bp, Artificial Sequence
  Synthetic Polynucleotide
taatacgactcactatagggagactcagacgcctcctgcttctctctcttaacagaggagaaagagaatgaagcaggagaacctggcggcagcgcaaaagatg

SEQ ID NO: 122738 - DNA, 103 bp, Artificial Sequence
  Synthetic Polynucleotide
taatacgactcactatagggcgccgcccccggccccgccgcccgcgggtgaacagaggagacacccgatggcggcggggaacctggcggcagcgcaaaagatg

SEQ ID NO: 122739 - DNA, 103 bp, Artificial Sequence
  Synthetic Polynucleotide
taatacgactcactatagggccttcactggagactcagacgcctcctgctaacagaggagaagcaggatgcgtctgagtaacctggcggcagcgcaaaagatg

SEQ ID NO: 122740 - DNA, 103 bp, Artificial Sequence
  Synthetic Polynucleotide
taatacgactcactatagggggctgtacggccttcactggagactcagacaacagaggagagtctgaatgtccagtgaaaacctggcggcagcgcaaaagatg

SEQ ID NO: 122741 - DNA, 103 bp, Artificial Sequence
  Synthetic Polynucleotide
taatacgactcactatagggcgagatgtgtggctgtacggccttcactggaacagaggagaccagtgatggccgtacagaacctggcggcagcgcaaaagatg

SEQ ID NO: 122742 - DNA, 103 bp, Artificial Sequence
  Synthetic Polynucleotide
taatacgactcactatagggtggtcaggggcgagatgtgtggctgtacggaacagaggagaccgtacatgcacacatctaacctggcggcagcgcaaaagatg

SEQ ID NO: 122743 - DNA, 103 bp, Artificial Sequence
  Synthetic Polynucleotide
taatacgactcactatagggggaatgttgatggtcaggggcgagatgtgtaacagaggagaacacatatggcccctgacaacctggcggcagcgcaaaagatg

SEQ ID NO: 122744 - DNA, 103 bp, Artificial Sequence
  Synthetic Polynucleotide
taatacgactcactatagggcatggtgtctggaatgttgatggtcaggggaacagaggagacccctgatgatcaacattaacctggcggcagcgcaaaagatg

SEQ ID NO: 122745 - DNA, 103 bp, Artificial Sequence
  Synthetic Polynucleotide
taatacgactcactatagggtgaggtgggccatggtgtctggaatgttgaaacagaggagatcaacaatgcagacaccaaacctggcggcagcgcaaaagatg

SEQ ID NO: 122746 - DNA, 103 bp, Artificial Sequence
  Synthetic Polynucleotide
taatacgactcactatagggagagggctgatgaggtgggccatggtgtctaacagaggagaagacacatgggcccacctaacctggcggcagcgcaaaagatg

SEQ ID NO: 122747 - DNA, 103 bp, Artificial Sequence
  Synthetic Polynucleotide
taatacgactcactataggggggggagggcagagggctgatgaggtgggcaacagaggagagcccacatgatcagccctaacctggcggcagcgcaaaagatg

SEQ ID NO: 122748 - DNA, 103 bp, Artificial Sequence
  Synthetic Polynucleotide
taatacgactcactatagggtggttcccgtgggggagggcagagggctgaaacagaggagatcagccatgtgccctcccaacctggcggcagcgcaaaagatg

SEQ ID NO: 122749 - DNA, 103 bp, Artificial Sequence
  Synthetic Polynucleotide
taatacgactcactatagggcccccggccccgccgcccccggccccgccgaacagaggagacggcggatgcgggggcggaacctggcggcagcgcaaaagatg

SEQ ID NO: 122750 - DNA, 103 bp, Artificial Sequence
  Synthetic Polynucleotide
taatacgactcactataggggcagcgctgatggttcccgtgggggagggcaacagaggagagccctcatgcacgggaacaacctggcggcagcgcaaaagatg

SEQ ID NO: 122751 - DNA, 103 bp, Artificial Sequence
  Synthetic Polynucleotide
taatacgactcactataggggcaggagtttgcagcgctgatggttcccgtaacagaggagaacgggaatgatcagcgctaacctggcggcagcgcaaaagatg

SEQ ID NO: 122752 - DNA, 103 bp, Artificial Sequence
  Synthetic Polynucleotide
taatacgactcactatagggggctggaggggcaggagtttgcagcgctgaaacagaggagatcagcgatgcaaactcctaacctggcggcagcgcaaaagatg

SEQ ID NO: 122753 - DNA, 103 bp, Artificial Sequence
  Synthetic Polynucleotide
taatacgactcactataggggctccccgggggctggaggggcaggagtttaacagaggagaaaactcatgcccctccagaacctggcggcagcgcaaaagatg

SEQ ID NO: 122754 - DNA, 103 bp, Artificial Sequence
  Synthetic Polynucleotide
taatacgactcactatagggtgaagaccccgctccccgggggctggagggaacagaggagaccctccatgccccggggaaacctggcggcagcgcaaaagatg

SEQ ID NO: 122755 - DNA, 103 bp, Artificial Sequence
  Synthetic Polynucleotide
taatacgactcactatagggccttgtaccctgaagaccccgctccccgggaacagaggagacccgggatgcggggtcttaacctggcggcagcgcaaaagatg

SEQ ID NO: 122756 - DNA, 103 bp, Artificial Sequence
  Synthetic Polynucleotide
taatacgactcactatagggactcggcccaccttgtaccctgaagaccccaacagaggagaggggtcatgagggtacaaaacctggcggcagcgcaaaagatg

SEQ ID NO: 122757 - DNA, 103 bp, Artificial Sequence
  Synthetic Polynucleotide
taatacgactcactatagggagatggcatcactcggcccaccttgtacccaacagaggagagggtacatggtgggccgaaacctggcggcagcgcaaaagatg

SEQ ID NO: 122758 - DNA, 103 bp, Artificial Sequence
  Synthetic Polynucleotide
taatacgactcactatagggaattgaggtcagatggcatcactcggcccaaacagaggagatgggccatgtgatgccataacctggcggcagcgcaaaagatg

SEQ ID NO: 122759 - DNA, 103 bp, Artificial Sequence
  Synthetic Polynucleotide
taatacgactcactatagggtcagccattaaattgaggtcagatggcatcaacagaggagagatgccatgtgacctcaaaacctggcggcagcgcaaaagatg

SEQ ID NO: 122760 - DNA, 103 bp, Artificial Sequence
  Synthetic Polynucleotide
taatacgactcactatagggggacccgccgcccccggccccgccgcccccaacagaggagagggggcatgggggccgggaacctggcggcagcgcaaaagatg

SEQ ID NO: 122761 - DNA, 103 bp, Artificial Sequence
  Synthetic Polynucleotide
taatacgactcactatagggctgtgagttgtcagccattaaattgaggtcaacagaggagagacctcatgttaatggctaacctggcggcagcgcaaaagatg

SEQ ID NO: 122762 - DNA, 103 bp, Artificial Sequence
  Synthetic Polynucleotide
taatacgactcactatagggcattttcaggctgtgagttgtcagccattaaacagaggagataatggatgacaactcacaacctggcggcagcgcaaaagatg

SEQ ID NO: 122763 - DNA, 103 bp, Artificial Sequence
  Synthetic Polynucleotide
taatacgactcactataggggcttccttttcattttcaggctgtgagttgaacagaggagacaactcatggcctgaaaaaacctggcggcagcgcaaaagatg

SEQ ID NO: 122764 - DNA, 103 bp, Artificial Sequence
  Synthetic Polynucleotide
taatacgactcactatagggtccacctgaagcttccttttcattttcaggaacagaggagacctgaaatggaaaaggaaaacctggcggcagcgcaaaagatg

SEQ ID NO: 122765 - DNA, 103 bp, Artificial Sequence
  Synthetic Polynucleotide
taatacgactcactatagggtcgggctgtctccacctgaagcttccttttaacagaggagaaaaaggatgcttcaggtgaacctggcggcagcgcaaaagatg

SEQ ID NO: 122766 - DNA, 103 bp, Artificial Sequence
  Synthetic Polynucleotide
taatacgactcactataggggaatcatccttcgggctgtctccacctgaaaacagaggagattcaggatgagacagcccaacctggcggcagcgcaaaagatg

SEQ ID NO: 122767 - DNA, 103 bp, Artificial Sequence
  Synthetic Polynucleotide
taatacgactcactatagggaggcggctttgaatcatccttcgggctgtcaacagaggagagacagcatgaaggatgataacctggcggcagcgcaaaagatg

SEQ ID NO: 122768 - DNA, 103 bp, Artificial Sequence
  Synthetic Polynucleotide
taatacgactcactatagggcgtaggagtaaggcggctttgaatcatcctaacagaggagaaggatgatgcaaagccgcaacctggcggcagcgcaaaagatg

SEQ ID NO: 122769 - DNA, 103 bp, Artificial Sequence
  Synthetic Polynucleotide
taatacgactcactatagggatcagctgcgcgtaggagtaaggcggctttaacagaggagaaaagccatgttactcctaaacctggcggcagcgcaaaagatg

SEQ ID NO: 122770 - DNA, 103 bp, Artificial Sequence
  Synthetic Polynucleotide
taatacgactcactatagggcgcctgaactatcagctgcgcgtaggagtaaacagaggagatactccatggcgcagctgaacctggcggcagcgcaaaagatg

SEQ ID NO: 122771 - DNA, 103 bp, Artificial Sequence
  Synthetic Polynucleotide
taatacgactcactatagggcgcccggcggggacccgccgcccccggcccaacagaggagagggccgatggcggcgggtaacctggcggcagcgcaaaagatg

SEQ ID NO: 122772 - DNA, 103 bp, Artificial Sequence
  Synthetic Polynucleotide
taatacgactcactatagggccatcgtaatcgcctgaactatcagctgcgaacagaggagacgcagcatgtagttcaggaacctggcggcagcgcaaaagatg

SEQ ID NO: 122773 - DNA, 103 bp, Artificial Sequence
  Synthetic Polynucleotide
taatacgactcactatagggttgtcgggagccatcgtaatcgcctgaactaacagaggagaagttcaatggattacgataacctggcggcagcgcaaaagatg

SEQ ID NO: 122774 - DNA, 103 bp, Artificial Sequence
  Synthetic Polynucleotide
taatacgactcactatagggggtgagctgtttgtcgggagccatcgtaataacagaggagaattacgatggctcccgacaacctggcggcagcgcaaaagatg

SEQ ID NO: 122775 - DNA, 103 bp, Artificial Sequence
  Synthetic Polynucleotide
taatacgactcactatagggtcccgttcagggtgagctgtttgtcgggagaacagaggagactcccgatgaacagctcaaacctggcggcagcgcaaaagatg

SEQ ID NO: 122776 - DNA, 103 bp, Artificial Sequence
  Synthetic Polynucleotide
taatacgactcactatagggtgtgtataaatcccgttcagggtgagctgtaacagaggagaacagctatgcctgaacggaacctggcggcagcgcaaaagatg

SEQ ID NO: 122777 - DNA, 103 bp, Artificial Sequence
  Synthetic Polynucleotide
taatacgactcactatagggtttagtgatgtgtgtataaatcccgttcagaacagaggagactgaacatgatttatacaaacctggcggcagcgcaaaagatg

SEQ ID NO: 122778 - DNA, 103 bp, Artificial Sequence
  Synthetic Polynucleotide
taatacgactcactatagggagggataatttttagtgatgtgtgtataaaaacagaggagatttataatgacatcactaaacctggcggcagcgcaaaagatg

SEQ ID NO: 122779 - DNA, 103 bp, Artificial Sequence
  Synthetic Polynucleotide
taatacgactcactataggggtcctgtagtagggataatttttagtgatgaacagaggagacatcacatgaaattatccaacctggcggcagcgcaaaagatg

SEQ ID NO: 122780 - DNA, 103 bp, Artificial Sequence
  Synthetic Polynucleotide
taatacgactcactatagggcttgtccgcagtcctgtagtagggataattaacagaggagaaattatatgtactacaggaacctggcggcagcgcaaaagatg

SEQ ID NO: 122781 - DNA, 103 bp, Artificial Sequence
  Synthetic Polynucleotide
taatacgactcactatagggtctgccagcccttgtccgcagtcctgtagtaacagaggagaactacaatgctgcggacaaacctggcggcagcgcaaaagatg

SEQ ID NO: 122782 - DNA, 103 bp, Artificial Sequence
  Synthetic Polynucleotide
taatacgactcactatagggacggcccagccgcccggcggggacccgccgaacagaggagacggcggatgcccgccgggaacctggcggcagcgcaaaagatg

SEQ ID NO: 122783 - DNA, 103 bp, Artificial Sequence
  Synthetic Polynucleotide
taatacgactcactatagggcgaattgaattctgccagcccttgtccgcaaacagaggagatgcggaatggggctggcaaacctggcggcagcgcaaaagatg

SEQ ID NO: 122784 - DNA, 103 bp, Artificial Sequence
  Synthetic Polynucleotide
taatacgactcactataggggagattgtggcgaattgaattctgccagccaacagaggagaggctggatgaattcaattaacctggcggcagcgcaaaagatg

SEQ ID NO: 122785 - DNA, 103 bp, Artificial Sequence
  Synthetic Polynucleotide
taatacgactcactataggggattcagagagagattgtggcgaattgaataacagaggagaattcaaatggccacaatcaacctggcggcagcgcaaaagatg

SEQ ID NO: 122786 - DNA, 103 bp, Artificial Sequence
  Synthetic Polynucleotide
taatacgactcactatagggatgaaataacgattcagagagagattgtggaacagaggagaccacaaatgctctctgaaaacctggcggcagcgcaaaagatg

SEQ ID NO: 122787 - DNA, 103 bp, Artificial Sequence
  Synthetic Polynucleotide
taatacgactcactatagggcggcactttgatgaaataacgattcagagaaacagaggagatctctgatgcgttatttcaacctggcggcagcgcaaaagatg

SEQ ID NO: 122788 - DNA, 103 bp, Artificial Sequence
  Synthetic Polynucleotide
taatacgactcactatagggcctgggaacgcggcactttgatgaaataacaacagaggagagttattatgtcaaagtgcaacctggcggcagcgcaaaagatg

SEQ ID NO: 122789 - DNA, 103 bp, Artificial Sequence
  Synthetic Polynucleotide
taatacgactcactatagggcctggttcttcctgggaacgcggcactttgaacagaggagacaaagtatggcgttcccaaacctggcggcagcgcaaaagatg

SEQ ID NO: 122790 - DNA, 103 bp, Artificial Sequence
  Synthetic Polynucleotide
taatacgactcactatagggcgagcctttgcctggttcttcctgggaacgaacagaggagacgttccatggaagaaccaaacctggcggcagcgcaaaagatg

SEQ ID NO: 122791 - DNA, 103 bp, Artificial Sequence
  Synthetic Polynucleotide
taatacgactcactatagggtcctccagaacgagcctttgcctggttcttaacagaggagaaagaacatggcaaaggctaacctggcggcagcgcaaaagatg

SEQ ID NO: 122792 - DNA, 103 bp, Artificial Sequence
  Synthetic Polynucleotide
taatacgactcactataggggctgggtctatcctccagaacgagcctttgaacagaggagacaaaggatggttctggagaacctggcggcagcgcaaaagatg

SEQ ID NO: 122793 - DNA, 103 bp, Artificial Sequence
  Synthetic Polynucleotide
taatacgactcactataggggtcctcgggctcggggtagctggccatcataacagaggagaatgatgatgagctaccccaacctggcggcagcgcaaaagatg

SEQ ID NO: 122794 - DNA, 103 bp, Artificial Sequence
  Synthetic Polynucleotide
taatacgactcactatagggacccccaccgcccttgcctgggctcggcggaacagaggagaccgccgatgccaggcaagaacctggcggcagcgcaaaagatg

SEQ ID NO: 122795 - DNA, 103 bp, Artificial Sequence
  Synthetic Polynucleotide
taatacgactcactatagggcgcactggtgggcgcgggcgccgggggcgcaacagaggagagcgcccatggcgcccgcgaacctggcggcagcgcaaaagatg

SEQ ID NO: 122796 - DNA, 103 bp, Artificial Sequence
  Synthetic Polynucleotide
taatacgactcactataggggcaggcccggcgcactggtgggcgcgggcgaacagaggagacgcccgatgccaccagtgaacctggcggcagcgcaaaagatg

SEQ ID NO: 122797 - DNA, 103 bp, Artificial Sequence
  Synthetic Polynucleotide
taatacgactcactatagggcaagcgaactgcaggcccggcgcactggtgaacagaggagacaccagatggccgggcctaacctggcggcagcgcaaaagatg

SEQ ID NO: 122798 - DNA, 103 bp, Artificial Sequence
  Synthetic Polynucleotide
taatacgactcactatagggctgccgggcacaagcgaactgcaggcccggaacagaggagaccgggcatgcagttcgctaacctggcggcagcgcaaaagatg

SEQ ID NO: 122799 - DNA, 103 bp, Artificial Sequence
  Synthetic Polynucleotide
taatacgactcactatagggcgagctcgggctgccgggcacaagcgaactaacagaggagaagttcgatggtgcccggcaacctggcggcagcgcaaaagatg

SEQ ID NO: 122800 - DNA, 103 bp, Artificial Sequence
  Synthetic Polynucleotide
taatacgactcactatagggtgcatcatggcgagctcgggctgccgggcaaacagaggagatgcccgatggcccgagctaacctggcggcagcgcaaaagatg

SEQ ID NO: 122801 - DNA, 103 bp, Artificial Sequence
  Synthetic Polynucleotide
taatacgactcactataggggtaagagcaatgcatcatggcgagctcgggaacagaggagacccgagatggccatgatgaacctggcggcagcgcaaaagatg

SEQ ID NO: 122802 - DNA, 103 bp, Artificial Sequence
  Synthetic Polynucleotide
taatacgactcactatagggcgtggtcccagtaagagcaatgcatcatggaacagaggagaccatgaatgattgctcttaacctggcggcagcgcaaaagatg

SEQ ID NO: 122803 - DNA, 103 bp, Artificial Sequence
  Synthetic Polynucleotide
taatacgactcactataggggtcttgctgtcgtggtcccagtaagagcaaaacagaggagattgctcatgctgggaccaaacctggcggcagcgcaaaagatg

SEQ ID NO: 122804 - DNA, 103 bp, Artificial Sequence
  Synthetic Polynucleotide
taatacgactcactatagggcagcgcgccggtcttgctgtcgtggtcccaaacagaggagatgggacatggacagcaagaacctggcggcagcgcaaaagatg

SEQ ID NO: 122805 - DNA, 103 bp, Artificial Sequence
  Synthetic Polynucleotide
taatacgactcactatagggtcccgccgccacccccaccgcccttgcctgaacagaggagacaggcaatggcggtggggaacctggcggcagcgcaaaagatg

SEQ ID NO: 122806 - DNA, 103 bp, Artificial Sequence
  Synthetic Polynucleotide
taatacgactcactatagggggcgcgaatgcagcgcgccggtcttgctgtaacagaggagaacagcaatgccggcgcgcaacctggcggcagcgcaaaagatg

SEQ ID NO: 122807 - DNA, 103 bp, Artificial Sequence
  Synthetic Polynucleotide
taatacgactcactatagggcagagatcgaggcgcgaatgcagcgcgccgaacagaggagacggcgcatggcattcgcgaacctggcggcagcgcaaaagatg

SEQ ID NO: 122808 - DNA, 103 bp, Artificial Sequence
  Synthetic Polynucleotide
taatacgactcactatagggtccggggctgtcccgccgccacccccaccgaacagaggagacggtggatgtggcggcggaacctggcggcagcgcaaaagatg

SEQ ID NO: 122809 - DNA, 103 bp, Artificial Sequence
  Synthetic Polynucleotide
taatacgactcactataggggtccggcttctccggggctgtcccgccgccaacagaggagaggcggcatgacagccccgaacctggcggcagcgcaaaagatg

SEQ ID NO: 122810 - DNA, 103 bp, Artificial Sequence
  Synthetic Polynucleotide
taatacgactcactatagggtctgcgccgggtccggcttctccggggctgaacagaggagacagcccatgagaagccggaacctggcggcagcgcaaaagatg

SEQ ID NO: 122811 - DNA, 103 bp, Artificial Sequence
  Synthetic Polynucleotide
taatacgactcactatagggtacgggggcttctgcgccgggtccggcttcaacagaggagagaagccatgcccggcgcaaacctggcggcagcgcaaaagatg

SEQ ID NO: 122812 - DNA, 103 bp, Artificial Sequence
  Synthetic Polynucleotide
taatacgactcactatagggcacgtacgagtacgggggcttctgcgccggaacagaggagaccggcgatgaagcccccgaacctggcggcagcgcaaaagatg

SEQ ID NO: 122813 - DNA, 103 bp, Artificial Sequence
  Synthetic Polynucleotide
taatacgactcactatagggcgatgagcgccacgtacgagtacgggggctaacagaggagaagccccatgactcgtacgaacctggcggcagcgcaaaagatg

SEQ ID NO: 122814 - DNA, 103 bp, Artificial Sequence
  Synthetic Polynucleotide
taatacgactcactatagggatcgccatggcgatgagcgccacgtacgagaacagaggagactcgtaatgggcgctcataacctggcggcagcgcaaaagatg

SEQ ID NO: 122815 - DNA, 103 bp, Artificial Sequence
  Synthetic Polynucleotide
taatacgactcactataggggctctcgcggatcgccatggcgatgagcgcaacagaggagagcgctcatggccatggcgaacctggcggcagcgcaaaagatg

SEQ ID NO: 122816 - DNA, 103 bp, Artificial Sequence
  Synthetic Polynucleotide
taatacgactcactatagggcccccgccgcgtcctcgggctcggggtagcaacagaggagagctaccatgagcccgaggaacctggcggcagcgcaaaagatg

SEQ ID NO: 122817 - DNA, 103 bp, Artificial Sequence
  Synthetic Polynucleotide
taatacgactcactatagggtcttctccgcgctctcgcggatcgccatggaacagaggagaccatggatgtccgcgagaaacctggcggcagcgcaaaagatg

SEQ ID NO: 122818 - DNA, 103 bp, Artificial Sequence
  Synthetic Polynucleotide
taatacgactcactatagggagcgtgagcctcttctccgcgctctcgcggaacagaggagaccgcgaatgcgcggagaaaacctggcggcagcgcaaaagatg

SEQ ID NO: 122819 - DNA, 103 bp, Artificial Sequence
  Synthetic Polynucleotide
taatacgactcactataggggatgccggacagcgtgagcctcttctccgcaacagaggagagcggagatgaggctcacgaacctggcggcagcgcaaaagatg

SEQ ID NO: 122820 - DNA, 103 bp, Artificial Sequence
  Synthetic Polynucleotide
taatacgactcactatagggtgtactggtagatgccggacagcgtgagccaacagaggagaggctcaatgtgtccggcaaacctggcggcagcgcaaaagatg

SEQ ID NO: 122821 - DNA, 103 bp, Artificial Sequence
  Synthetic Polynucleotide
taatacgactcactatagggttcgcgatgatgtactggtagatgccggacaacagaggagagtccggatgctaccagtaaacctggcggcagcgcaaaagatg

SEQ ID NO: 122822 - DNA, 103 bp, Artificial Sequence
  Synthetic Polynucleotide
taatacgactcactataggggaacgggaacttcgcgatgatgtactggtaaacagaggagataccagatgatcatcgcgaacctggcggcagcgcaaaagatg

SEQ ID NO: 122823 - DNA, 103 bp, Artificial Sequence
  Synthetic Polynucleotide
taatacgactcactatagggtcttctcgtagaacgggaacttcgcgatgaaacagaggagatcatcgatgagttcccgtaacctggcggcagcgcaaaagatg

SEQ ID NO: 122824 - DNA, 103 bp, Artificial Sequence
  Synthetic Polynucleotide
taatacgactcactatagggcccttcttattcttctcgtagaacgggaacaacagaggagagttcccatgctacgagaaaacctggcggcagcgcaaaagatg

SEQ ID NO: 122825 - DNA, 103 bp, Artificial Sequence
  Synthetic Polynucleotide
taatacgactcactatagggattttgccagcccttcttattcttctcgtaaacagaggagatacgagatgaataagaagaacctggcggcagcgcaaaagatg

SEQ ID NO: 122826 - DNA, 103 bp, Artificial Sequence
  Synthetic Polynucleotide
taatacgactcactatagggggcggatgctattttgccagcccttcttataacagaggagaataagaatggctggcaaaaacctggcggcagcgcaaaagatg

SEQ ID NO: 122827 - DNA, 103 bp, Artificial Sequence
  Synthetic Polynucleotide
taatacgactcactataggggccagcagggcccccgccgcgtcctcgggcaacagaggagagcccgaatgcgcggcgggaacctggcggcagcgcaaaagatg

SEQ ID NO: 122828 - DNA, 103 bp, Artificial Sequence
  Synthetic Polynucleotide
taatacgactcactatagggctgaggttgtggcggatgctattttgccagaacagaggagactggcaatgtagcatccgaacctggcggcagcgcaaaagatg

SEQ ID NO: 122829 - DNA, 103 bp, Artificial Sequence
  Synthetic Polynucleotide
taatacgactcactatagggctcgttgaggctgaggttgtggcggatgctaacagaggagaagcatcatgcacaacctcaacctggcggcagcgcaaaagatg

SEQ ID NO: 122830 - DNA, 103 bp, Artificial Sequence
  Synthetic Polynucleotide
taatacgactcactatagggtgatgaagcactcgttgaggctgaggttgtaacagaggagaacaaccatggcctcaacgaacctggcggcagcgcaaaagatg

SEQ ID NO: 122831 - DNA, 103 bp, Artificial Sequence
  Synthetic Polynucleotide
taatacgactcactatagggcgcggcaccttgatgaagcactcgttgaggaacagaggagacctcaaatggtgcttcataacctggcggcagcgcaaaagatg

SEQ ID NO: 122832 - DNA, 103 bp, Artificial Sequence
  Synthetic Polynucleotide
taatacgactcactataggggccgccctcgcgcggcaccttgatgaagcaaacagaggagatgcttcatgaaggtgccgaacctggcggcagcgcaaaagatg

SEQ ID NO: 122833 - DNA, 103 bp, Artificial Sequence
  Synthetic Polynucleotide
taatacgactcactatagggtgcgctcgccgccgccctcgcgcggcacctaacagaggagaaggtgcatggcgagggcgaacctggcggcagcgcaaaagatg

SEQ ID NO: 122834 - DNA, 103 bp, Artificial Sequence
  Synthetic Polynucleotide
taatacgactcactatagggtagttgcccttgcgctcgccgccgccctcgaacagaggagacgagggatgcggcgagcgaacctggcggcagcgcaaaagatg

SEQ ID NO: 122835 - DNA, 103 bp, Artificial Sequence
  Synthetic Polynucleotide
taatacgactcactatagggcagcgtccagtagttgcccttgcgctcgccaacagaggagaggcgagatgaagggcaacaacctggcggcagcgcaaaagatg

SEQ ID NO: 122836 - DNA, 103 bp, Artificial Sequence
  Synthetic Polynucleotide
taatacgactcactatagggaggccgggtccagcgtccagtagttgccctaacagaggagaagggcaatgactggacgcaacctggcggcagcgcaaaagatg

SEQ ID NO: 122837 - DNA, 103 bp, Artificial Sequence
  Synthetic Polynucleotide
taatacgactcactatagggatgtcttcgcaggccgggtccagcgtccagaacagaggagactggacatgggacccggcaacctggcggcagcgcaaaagatg

SEQ ID NO: 122838 - DNA, 103 bp, Artificial Sequence
  Synthetic Polynucleotide
taatacgactcactatagggggtctctggggccagcagggcccccgccgcaacagaggagagcggcgatggccctgctgaacctggcggcagcgcaaaagatg

SEQ ID NO: 122839 - DNA, 103 bp, Artificial Sequence
  Synthetic Polynucleotide
taatacgactcactatagggcttctcgaacatgtcttcgcaggccgggtcaacagaggagagacccgatgtgcgaagacaacctggcggcagcgcaaaagatg

SEQ ID NO: 122840 - DNA, 103 bp, Artificial Sequence
  Synthetic Polynucleotide
taatacgactcactatagggggtagttgcccttctcgaacatgtcttcgcaacagaggagagcgaagatgtgttcgagaaacctggcggcagcgcaaaagatg

SEQ ID NO: 122841 - DNA, 103 bp, Artificial Sequence
  Synthetic Polynucleotide
taatacgactcactatagggcggcggcgccggtagttgcccttctcgaacaacagaggagagttcgaatggggcaactaaacctggcggcagcgcaaaagatg

SEQ ID NO: 122842 - DNA, 103 bp, Artificial Sequence
  Synthetic Polynucleotide
taatacgactcactatagggcttcatgcggcggcggcgccggtagttgccaacagaggagaggcaacatgcggcgccgcaacctggcggcagcgcaaaagatg

SEQ ID NO: 122843 - DNA, 103 bp, Artificial Sequence
  Synthetic Polynucleotide
taatacgactcactatagggggaagggcctcttcatgcggcggcggcgccaacagaggagaggcgccatggccgcatgaaacctggcggcagcgcaaaagatg

SEQ ID NO: 122844 - DNA, 103 bp, Artificial Sequence
  Synthetic Polynucleotide
taatacgactcactatagggggcggcggccggaagggcctcttcatgcggaacagaggagaccgcatatggaggcccttaacctggcggcagcgcaaaagatg

SEQ ID NO: 122845 - DNA, 103 bp, Artificial Sequence
  Synthetic Polynucleotide
taatacgactcactataggggaagtgcgcgggcggcggccggaagggcctaacagaggagaaggcccatgcggccgccgaacctggcggcagcgcaaaagatg

SEQ ID NO: 122846 - DNA, 103 bp, Artificial Sequence
  Synthetic Polynucleotide
taatacgactcactatagggtgccgggctggaagtgcgcgggcggcggccaacagaggagaggccgcatgccgcgcactaacctggcggcagcgcaaaagatg

SEQ ID NO: 122847 - DNA, 103 bp, Artificial Sequence
  Synthetic Polynucleotide
taatacgactcactatagggaagagccccttgccgggctggaagtgcgcgaacagaggagacgcgcaatgccagcccggaacctggcggcagcgcaaaagatg

SEQ ID NO: 122848 - DNA, 103 bp, Artificial Sequence
  Synthetic Polynucleotide
taatacgactcactatagggtccggccccgaagagccccttgccgggctgaacagaggagacagcccatgaaggggctcaacctggcggcagcgcaaaagatg

SEQ ID NO: 122849 - DNA, 103 bp, Artificial Sequence
  Synthetic Polynucleotide
taatacgactcactatagggctgtgcgaccggtctctggggccagcagggaacagaggagaccctgcatgccccagagaaacctggcggcagcgcaaaagatg

SEQ ID NO: 122850 - DNA, 103 bp, Artificial Sequence
  Synthetic Polynucleotide
taatacgactcactatagggctgcggcgcctccggccccgaagagcccctaacagaggagaaggggcatgtcggggccgaacctggcggcagcgcaaaagatg

SEQ ID NO: 122851 - DNA, 103 bp, Artificial Sequence
  Synthetic Polynucleotide
taatacgactcactatagggccgcacccgcctgcggcgcctccggccccgaacagaggagacggggcatgaggcgccgcaacctggcggcagcgcaaaagatg

SEQ ID NO: 122852 - DNA, 103 bp, Artificial Sequence
  Synthetic Polynucleotide
taatacgactcactataggggcccgccacgccgcacccgcctgcggcgccaacagaggagaggcgccatgggcgggtgcaacctggcggcagcgcaaaagatg

SEQ ID NO: 122853 - DNA, 103 bp, Artificial Sequence
  Synthetic Polynucleotide
taatacgactcactatagggcggccccggcgcccgccacgccgcacccgcaacagaggagagcgggtatggcgtggcggaacctggcggcagcgcaaaagatg

SEQ ID NO: 122854 - DNA, 103 bp, Artificial Sequence
  Synthetic Polynucleotide
taatacgactcactatagggccgtagccgtcggccccggcgcccgccacgaacagaggagacgtggcatgcgccggggcaacctggcggcagcgcaaaagatg

SEQ ID NO: 122855 - DNA, 103 bp, Artificial Sequence
  Synthetic Polynucleotide
taatacgactcactatagggcgccaggtagccgtagccgtcggccccggcaacagaggagagccgggatggacggctacaacctggcggcagcgcaaaagatg

SEQ ID NO: 122856 - DNA, 103 bp, Artificial Sequence
  Synthetic Polynucleotide
taatacgactcactatagggacttggggggcgccaggtagccgtagccgtaacagaggagaacggctatggctacctggaacctggcggcagcgcaaaagatg

SEQ ID NO: 122857 - DNA, 103 bp, Artificial Sequence
  Synthetic Polynucleotide
taatacgactcactataggggactgcaggtacttggggggcgccaggtagaacagaggagactacctatggccccccaaaacctggcggcagcgcaaaagatg

SEQ ID NO: 122858 - DNA, 103 bp, Artificial Sequence
  Synthetic Polynucleotide
taatacgactcactataggggaggaagccagactgcaggtacttggggggaacagaggagaccccccatgtacctgcagaacctggcggcagcgcaaaagatg

SEQ ID NO: 122859 - DNA, 103 bp, Artificial Sequence
  Synthetic Polynucleotide
taatacgactcactatagggacgagttgttgaggaagccagactgcaggtaacagaggagaacctgcatgctggcttccaacctggcggcagcgcaaaagatg

SEQ ID NO: 122860 - DNA, 103 bp, Artificial Sequence
  Synthetic Polynucleotide
taatacgactcactatagggggctccttgactgtgcgaccggtctctgggaacagaggagacccagaatgcggtcgcacaacctggcggcagcgcaaaagatg

SEQ ID NO: 122861 - DNA, 103 bp, Artificial Sequence
  Synthetic Polynucleotide
taatacgactcactatagggggtagcggccacgagttgttgaggaagccaaacagaggagatggcttatgcaacaactcaacctggcggcagcgcaaaagatg

SEQ ID NO: 122862 - DNA, 103 bp, Artificial Sequence
  Synthetic Polynucleotide
taatacgactcactataggggggaggctgcggtagcggccacgagttgttaacagaggagaaacaacatgtggccgctaaacctggcggcagcgcaaaagatg

SEQ ID NO: 122863 - DNA, 103 bp, Artificial Sequence
  Synthetic Polynucleotide
taatacgactcactataggggcatgggtgagggaggctgcggtagcggccaacagaggagaggccgcatgcgcagcctcaacctggcggcagcgcaaaagatg

SEQ ID NO: 122864 - DNA, 103 bp, Artificial Sequence
  Synthetic Polynucleotide
taatacgactcactataggggaggcatagggcatgggtgagggaggctgcaacagaggagagcagccatgctcacccataacctggcggcagcgcaaaagatg

SEQ ID NO: 122865 - DNA, 103 bp, Artificial Sequence
  Synthetic Polynucleotide
taatacgactcactatagggcatctggcaggaggcatagggcatgggtgaaacagaggagatcacccatgccctatgccaacctggcggcagcgcaaaagatg

SEQ ID NO: 122866 - DNA, 103 bp, Artificial Sequence
  Synthetic Polynucleotide
taatacgactcactatagggcggctgccgccatctggcaggaggcataggaacagaggagacctatgatgcctgccagaaacctggcggcagcgcaaaagatg

SEQ ID NO: 122867 - DNA, 103 bp, Artificial Sequence
  Synthetic Polynucleotide
taatacgactcactataggggcagccgctgcggctgccgccatctggcagaacagaggagactgccaatgggcggcagcaacctggcggcagcgcaaaagatg

SEQ ID NO: 122868 - DNA, 103 bp, Artificial Sequence
  Synthetic Polynucleotide
taatacgactcactatagggcgcagctgctgcagccgctgcggctgccgcaacagaggagagcggcaatggcagcggctaacctggcggcagcgcaaaagatg

SEQ ID NO: 122869 - DNA, 103 bp, Artificial Sequence
  Synthetic Polynucleotide
taatacgactcactatagggcggctgcagccgcagctgctgcagccgctgaacagaggagacagcggatgcagcagctgaacctggcggcagcgcaaaagatg

SEQ ID NO: 122870 - DNA, 103 bp, Artificial Sequence
  Synthetic Polynucleotide
taatacgactcactatagggccggggcccgcggctgcagccgcagctgctaacagaggagaagcagcatgggctgcagcaacctggcggcagcgcaaaagatg

SEQ ID NO: 122871 - DNA, 103 bp, Artificial Sequence
  Synthetic Polynucleotide
taatacgactcactatagggcggcccttctggctccttgactgtgcgaccaacagaggagaggtcgcatggtcaaggagaacctggcggcagcgcaaaagatg

SEQ ID NO: 122872 - DNA, 103 bp, Artificial Sequence
  Synthetic Polynucleotide
taatacgactcactataggggccagggctaccggggcccgcggctgcagcaacagaggagagctgcaatggcgggccccaacctggcggcagcgcaaaagatg

SEQ ID NO: 122873 - DNA, 103 bp, Artificial Sequence
  Synthetic Polynucleotide
taatacgactcactatagggcagcggccgcgccagggctaccggggcccgaacagaggagacgggccatggtagccctgaacctggcggcagcgcaaaagatg

SEQ ID NO: 122874 - DNA, 103 bp, Artificial Sequence
  Synthetic Polynucleotide
taatacgactcactatagggcccttgaccacagcggccgcgccagggctaaacagaggagatagcccatgcgcggccgcaacctggcggcagcgcaaaagatg

SEQ ID NO: 122875 - DNA, 103 bp, Artificial Sequence
  Synthetic Polynucleotide
taatacgactcactataggggcccgccagccccttgaccacagcggccgcaacagaggagagcggccatggtggtcaagaacctggcggcagcgcaaaagatg

SEQ ID NO: 122876 - DNA, 103 bp, Artificial Sequence
  Synthetic Polynucleotide
taatacgactcactatagggaggcggccgggcccgccagccccttgaccaaacagaggagatggtcaatgggctggcggaacctggcggcagcgcaaaagatg

SEQ ID NO: 122877 - DNA, 103 bp, Artificial Sequence
  Synthetic Polynucleotide
taatacgactcactatagggggcccgtacgaggcggccgggcccgccagcaacagaggagagctggcatgcccggccgcaacctggcggcagcgcaaaagatg

SEQ ID NO: 122878 - DNA, 103 bp, Artificial Sequence
  Synthetic Polynucleotide
taatacgactcactataggggcgtgtgtacggcccgtacgaggcggccggaacagaggagaccggccatgtcgtacgggaacctggcggcagcgcaaaagatg

SEQ ID NO: 122879 - DNA, 103 bp, Artificial Sequence
  Synthetic Polynucleotide
taatacgactcactatagggtgctctgcacgcgtgtgtacggcccgtacgaacagaggagacgtacgatgcgtacacacaacctggcggcagcgcaaaagatg

SEQ ID NO: 122880 - DNA, 103 bp, Artificial Sequence
  Synthetic Polynucleotide
taatacgactcactatagggggcagcgccatgctctgcacgcgtgtgtacaacagaggagagtacacatgcgtgcagagaacctggcggcagcgcaaaagatg

SEQ ID NO: 122881 - DNA, 103 bp, Artificial Sequence
  Synthetic Polynucleotide
taatacgactcactatagggtacgccggggggcagcgccatgctctgcacaacagaggagagtgcagatgatggcgctgaacctggcggcagcgcaaaagatg

SEQ ID NO: 122882 - DNA, 103 bp, Artificial Sequence
  Synthetic Polynucleotide
taatacgactcactatagggggctcggcggcggcccttctggctccttgaaacagaggagatcaaggatgcagaagggcaacctggcggcagcgcaaaagatg

SEQ ID NO: 122883 - DNA, 103 bp, Artificial Sequence
  Synthetic Polynucleotide
taatacgactcactatagggacgagttcactacgccggggggcagcgccaaacagaggagatggcgcatgcccccggcgaacctggcggcagcgcaaaagatg

SEQ ID NO: 122884 - DNA, 103 bp, Artificial Sequence
  Synthetic Polynucleotide
taatacgactcactatagggaggccattgtacgagttcactacgccggggaacagaggagaccccggatgagtgaactcaacctggcggcagcgcaaaagatg

SEQ ID NO: 122885 - DNA, 103 bp, Artificial Sequence
  Synthetic Polynucleotide
taatacgactcactatagggcgggcctcccaggccattgtacgagttcacaacagaggagagtgaacatgtacaatggcaacctggcggcagcgcaaaagatg

SEQ ID NO: 122886 - DNA, 103 bp, Artificial Sequence
  Synthetic Polynucleotide
taatacgactcactataggggtgcggccggcgggcctcccaggccattgtaacagaggagaacaatgatgtgggaggccaacctggcggcagcgcaaaagatg

SEQ ID NO: 122887 - DNA, 103 bp, Artificial Sequence
  Synthetic Polynucleotide
taatacgactcactatagggggaggcgggggtgcggccggcgggcctcccaacagaggagagggaggatggccggccgcaacctggcggcagcgcaaaagatg

SEQ ID NO: 122888 - DNA, 103 bp, Artificial Sequence
  Synthetic Polynucleotide
taatacgactcactatagggggggtgcggcggaggcgggggtgcggccggaacagaggagaccggccatgcccccgcctaacctggcggcagcgcaaaagatg

SEQ ID NO: 122889 - DNA, 103 bp, Artificial Sequence
  Synthetic Polynucleotide
taatacgactcactataggggatgcgggtgggggtgcggcggaggcggggaacagaggagaccccgcatgcgccgcaccaacctggcggcagcgcaaaagatg

SEQ ID NO: 122890 - DNA, 103 bp, Artificial Sequence
  Synthetic Polynucleotide
taatacgactcactatagggtgtgcgtgcggatgcgggtgggggtgcggcaacagaggagagccgcaatgccacccgcaaacctggcggcagcgcaaaagatg

SEQ ID NO: 122891 - DNA, 103 bp, Artificial Sequence
  Synthetic Polynucleotide
taatacgactcactataggggtgcagatggtgtgcgtgcggatgcgggtgaacagaggagacacccgatgccgcacgcaaacctggcggcagcgcaaaagatg

SEQ ID NO: 122892 - DNA, 103 bp, Artificial Sequence
  Synthetic Polynucleotide
taatacgactcactatagggcggcggccgcgtgcagatggtgtgcgtgcgaacagaggagacgcacgatgaccatctgcaacctggcggcagcgcaaaagatg

SEQ ID NO: 122893 - DNA, 103 bp, Artificial Sequence
  Synthetic Polynucleotide
taatacgactcactatagggcccttgcctgggctcggcggcggcccttctaacagaggagaagaaggatggccgccgagaacctggcggcagcgcaaaagatg

SEQ ID NO: 122894 - DNA, 103 bp, Artificial Sequence
  Synthetic Polynucleotide
taatacgactcactatagggggcggcggtgcggcggccgcgtgcagatggaacagaggagaccatctatgcgcggccgcaacctggcggcagcgcaaaagatg

SEQ ID NO: 122895 - DNA, 103 bp, Artificial Sequence
  Synthetic Polynucleotide
taatacgactcactatagggcggtggggcaggcggcggtgcggcggccgcaacagaggagagcggccatggcaccgccgaacctggcggcagcgcaaaagatg

SEQ ID NO: 122896 - DNA, 103 bp, Artificial Sequence
  Synthetic Polynucleotide
taatacgactcactatagggccccgtggtgcggtggggcaggcggcggtgaacagaggagacaccgcatgctgccccacaacctggcggcagcgcaaaagatg

SEQ ID NO: 122897 - DNA, 103 bp, Artificial Sequence
  Synthetic Polynucleotide
taatacgactcactatagggggcgcggcggccccgtggtgcggtggggcaaacagaggagatgccccatggcaccacggaacctggcggcagcgcaaaagatg

SEQ ID NO: 122898 - DNA, 103 bp, Artificial Sequence
  Synthetic Polynucleotide
taatacgactcactataggggcccggcggcggcgcggcggccccgtggtgaacagaggagacaccacatggccgccgcgaacctggcggcagcgcaaaagatg

SEQ ID NO: 122899 - DNA, 103 bp, Artificial Sequence
  Synthetic Polynucleotide
taatacgactcactatagggggctgagctggcccggcggcggcgcggcggaacagaggagaccgccgatgcgccgccggaacctggcggcagcgcaaaagatg

SEQ ID NO: 122900 - DNA, 103 bp, Artificial Sequence
  Synthetic Polynucleotide
taatacgactcactataggggggctggcagggctgagctggcccggcggcaacagaggagagccgccatgccagctcagaacctggcggcagcgcaaaagatg

SEQ ID NO: 122901 - DNA, 103 bp, Artificial Sequence
  Synthetic Polynucleotide
taatacgactcactatagggggcggtggctgggctggcagggctgagctgaacagaggagacagctcatgcctgccagcaacctggcggcagcgcaaaagatg

SEQ ID NO: 122902 - DNA, 103 bp, Artificial Sequence
  Synthetic Polynucleotide
taatacgactcactatagggccgggggcgcggcggtggctgggctggcagaacagaggagactgccaatgcagccaccgaacctggcggcagcgcaaaagatg

SEQ ID NO: 122903 - DNA, 103 bp, Artificial Sequence
  Synthetic Polynucleotide
taatacgactcactatagggggcgcgggcgccgggggcgcggcggtggctaacagaggagaagccacatgcgcgcccccaacctggcggcagcgcaaaagatg

SEQ ID NO: 122904 - DNA, 103 bp, Artificial Sequence
  Synthetic Polynucleotide
taatacgactcactatagggaatcagtggccgacgggggctagttttcataacagaggagaatgaaaatgagcccccgtaacctggcggcagcgcaaaagatg

SEQ ID NO: 122905 - DNA, 103 bp, Artificial Sequence
  Synthetic Polynucleotide
taatacgactcactatagggctcctgttgggcaggggatctcttaggttcaacagaggagagaacctatgagatcccctaacctggcggcagcgcaaaagatg

SEQ ID NO: 122906 - DNA, 103 bp, Artificial Sequence
  Synthetic Polynucleotide
taatacgactcactatagggtgattccaagtgctcgggcaattgtggagaaacagaggagatctccaatgttgcccgagaacctggcggcagcgcaaaagatg

SEQ ID NO: 122907 - DNA, 103 bp, Artificial Sequence
  Synthetic Polynucleotide
taatacgactcactataggggtttctgctgtgattccaagtgctcgggcaaacagaggagatgcccgatgacttggaataacctggcggcagcgcaaaagatg

SEQ ID NO: 122908 - DNA, 103 bp, Artificial Sequence
  Synthetic Polynucleotide
taatacgactcactatagggggattcggtcgtttctgctgtgattccaagaacagaggagacttggaatgacagcagaaaacctggcggcagcgcaaaagatg

SEQ ID NO: 122909 - DNA, 103 bp, Artificial Sequence
  Synthetic Polynucleotide
taatacgactcactataggggcggagctctggattcggtcgtttctgctgaacagaggagacagcagatgcgaccgaataacctggcggcagcgcaaaagatg

SEQ ID NO: 122910 - DNA, 103 bp, Artificial Sequence
  Synthetic Polynucleotide
taatacgactcactatagggtcatgttccggcggagctctggattcggtcaacagaggagagaccgaatgcagagctccaacctggcggcagcgcaaaagatg

SEQ ID NO: 122911 - DNA, 103 bp, Artificial Sequence
  Synthetic Polynucleotide
taatacgactcactataggggttttgatggtcatgttccggcggagctctaacagaggagaagagctatgccggaacataacctggcggcagcgcaaaagatg

SEQ ID NO: 122912 - DNA, 103 bp, Artificial Sequence
  Synthetic Polynucleotide
taatacgactcactatagggggggagttcggttttgatggtcatgttccgaacagaggagacggaacatgaccatcaaaaacctggcggcagcgcaaaagatg

SEQ ID NO: 122913 - DNA, 103 bp, Artificial Sequence
  Synthetic Polynucleotide
taatacgactcactataggggtgcgcccagggggagttcggttttgatggaacagaggagaccatcaatgccgaactccaacctggcggcagcgcaaaagatg

SEQ ID NO: 122914 - DNA, 103 bp, Artificial Sequence
  Synthetic Polynucleotide
taatacgactcactatagggatcttccgccgtgcgcccagggggagttcgaacagaggagacgaactatgcctgggcgcaacctggcggcagcgcaaaagatg

SEQ ID NO: 122915 - DNA, 103 bp, Artificial Sequence
  Synthetic Polynucleotide
taatacgactcactatagggcagtggcttcatcttccgccgtgcgcccagaacagaggagactgggcatgcggcggaagaacctggcggcagcgcaaaagatg

SEQ ID NO: 122916 - DNA, 103 bp, Artificial Sequence
  Synthetic Polynucleotide
taatacgactcactatagggcttgattagactcctgttgggcaggggatcaacagaggagagatcccatgcccaacaggaacctggcggcagcgcaaaagatg

SEQ ID NO: 122917 - DNA, 103 bp, Artificial Sequence
  Synthetic Polynucleotide
taatacgactcactatagggcccgtggtagcagtggcttcatcttccgccaacagaggagaggcggaatgtgaagccacaacctggcggcagcgcaaaagatg

SEQ ID NO: 122918 - DNA, 103 bp, Artificial Sequence
  Synthetic Polynucleotide
taatacgactcactatagggtatgagctgacccgtggtagcagtggcttcaacagaggagagaagccatggctaccacgaacctggcggcagcgcaaaagatg

SEQ ID NO: 122919 - DNA, 103 bp, Artificial Sequence
  Synthetic Polynucleotide
taatacgactcactatagggaggtaccaggtatgagctgacccgtggtagaacagaggagactaccaatggtcagctcaaacctggcggcagcgcaaaagatg

SEQ ID NO: 122920 - DNA, 103 bp, Artificial Sequence
  Synthetic Polynucleotide
taatacgactcactatagggggaactggataggtaccaggtatgagctgaaacagaggagatcagctatgacctggtacaacctggcggcagcgcaaaagatg

SEQ ID NO: 122921 - DNA, 103 bp, Artificial Sequence
  Synthetic Polynucleotide
taatacgactcactatagggtggttcaccgggaactggataggtaccaggaacagaggagacctggtatgtatccagttaacctggcggcagcgcaaaagatg

SEQ ID NO: 122922 - DNA, 103 bp, Artificial Sequence
  Synthetic Polynucleotide
taatacgactcactatagggcaccagtgactggttcaccgggaactggataacagaggagaatccagatgccggtgaacaacctggcggcagcgcaaaagatg

SEQ ID NO: 122923 - DNA, 103 bp, Artificial Sequence
  Synthetic Polynucleotide
taatacgactcactatagggagggctgcaacaccagtgactggttcaccgaacagaggagacggtgaatgagtcactggaacctggcggcagcgcaaaagatg

SEQ ID NO: 122924 - DNA, 103 bp, Artificial Sequence
  Synthetic Polynucleotide
taatacgactcactatagggaccttcaccgagggctgcaacaccagtgacaacagaggagagtcactatggttgcagccaacctggcggcagcgcaaaagatg

SEQ ID NO: 122925 - DNA, 103 bp, Artificial Sequence
  Synthetic Polynucleotide
taatacgactcactataggggggcaatggcaccttcaccgagggctgcaaaacagaggagattgcagatgtcggtgaagaacctggcggcagcgcaaaagatg

SEQ ID NO: 122926 - DNA, 103 bp, Artificial Sequence
  Synthetic Polynucleotide
taatacgactcactatagggaagccgccaggggcaatggcaccttcaccgaacagaggagacggtgaatgtgccattgcaacctggcggcagcgcaaaagatg

SEQ ID NO: 122927 - DNA, 103 bp, Artificial Sequence
  Synthetic Polynucleotide
taatacgactcactataggggaggcctctgcttgattagactcctgttggaacagaggagaccaacaatggtctaatcaaacctggcggcagcgcaaaagatg

SEQ ID NO: 122928 - DNA, 103 bp, Artificial Sequence
  Synthetic Polynucleotide
taatacgactcactatagggctcatgagggaagccgccaggggcaatggcaacagaggagagccattatgcctggcggcaacctggcggcagcgcaaaagatg

SEQ ID NO: 122929 - DNA, 103 bp, Artificial Sequence
  Synthetic Polynucleotide
taatacgactcactatagggaagctctgagctcatgagggaagccgccagaacagaggagactggcgatgtccctcatgaacctggcggcagcgcaaaagatg

SEQ ID NO: 122930 - DNA, 103 bp, Artificial Sequence
  Synthetic Polynucleotide
taatacgactcactatagggtatggcgggcaagctctgagctcatgagggaacagaggagaccctcaatggctcagagcaacctggcggcagcgcaaaagatg

SEQ ID NO: 122931 - DNA, 103 bp, Artificial Sequence
  Synthetic Polynucleotide
taatacgactcactatagggactcgcttgctatggcgggcaagctctgagaacagaggagactcagaatgtgcccgccaaacctggcggcagcgcaaaagatg

SEQ ID NO: 122932 - DNA, 103 bp, Artificial Sequence
  Synthetic Polynucleotide
taatacgactcactatagggggcaatgcggactcgcttgctatggcgggcaacagaggagagcccgcatgagcaagcgaaacctggcggcagcgcaaaagatg

SEQ ID NO: 122933 - DNA, 103 bp, Artificial Sequence
  Synthetic Polynucleotide
taatacgactcactatagggaaaccttgggggcaatgcggactcgcttgcaacagaggagagcaagcatgtccgcattgaacctggcggcagcgcaaaagatg

SEQ ID NO: 122934 - DNA, 103 bp, Artificial Sequence
  Synthetic Polynucleotide
taatacgactcactatagggtgttccccaaaaaccttgggggcaatgcggaacagaggagaccgcatatgccccaaggtaacctggcggcagcgcaaaagatg

SEQ ID NO: 122935 - DNA, 103 bp, Artificial Sequence
  Synthetic Polynucleotide
taatacgactcactatagggaaacaccacctgttccccaaaaaccttgggaacagaggagacccaagatgtttggggaaaacctggcggcagcgcaaaagatg

SEQ ID NO: 122936 - DNA, 103 bp, Artificial Sequence
  Synthetic Polynucleotide
taatacgactcactatagggtcatgtaaccaaacaccacctgttccccaaaacagaggagattggggatgaggtggtgtaacctggcggcagcgcaaaagatg

SEQ ID NO: 122937 - DNA, 103 bp, Artificial Sequence
  Synthetic Polynucleotide
taatacgactcactatagggaagaacttactcatgtaaccaaacaccaccaacagaggagaggtggtatgtggttacataacctggcggcagcgcaaaagatg

SEQ ID NO: 122938 - DNA, 103 bp, Artificial Sequence
  Synthetic Polynucleotide
taatacgactcactatagggcacttccttggaggcctctgcttgattagaaacagaggagatctaatatggcagaggccaacctggcggcagcgcaaaagatg

SEQ ID NO: 122939 - DNA, 103 bp, Artificial Sequence
  Synthetic Polynucleotide
taatacgactcactatagggatcgccactaaagaacttactcatgtaaccaacagaggagaggttacatgagtaagttcaacctggcggcagcgcaaaagatg

SEQ ID NO: 122940 - DNA, 103 bp, Artificial Sequence
  Synthetic Polynucleotide
taatacgactcactatagggaatctcgcagatcgccactaaagaacttacaacagaggagagtaagtatgttagtggcgaacctggcggcagcgcaaaagatg

SEQ ID NO: 122941 - DNA, 103 bp, Artificial Sequence
  Synthetic Polynucleotide
taatacgactcactatagggggtgtaccaaaatctcgcagatcgccactaaacagaggagatagtggatgtctgcgagaaacctggcggcagcgcaaaagatg

SEQ ID NO: 122942 - DNA, 103 bp, Artificial Sequence
  Synthetic Polynucleotide
taatacgactcactataggggctggtgatgggtgtaccaaaatctcgcagaacagaggagactgcgaatgtttggtacaaacctggcggcagcgcaaaagatg

SEQ ID NO: 122943 - DNA, 103 bp, Artificial Sequence
  Synthetic Polynucleotide
taatacgactcactatagggaattaaacaagctggtgatgggtgtaccaaaacagaggagattggtaatgccatcaccaaacctggcggcagcgcaaaagatg

SEQ ID NO: 122944 - DNA, 103 bp, Artificial Sequence
  Synthetic Polynucleotide
taatacgactcactatagggagaaagataaaattaaacaagctggtgatgaacagaggagacatcacatgcttgtttaaaacctggcggcagcgcaaaagatg

SEQ ID NO: 122945 - DNA, 103 bp, Artificial Sequence
  Synthetic Polynucleotide
taatacgactcactatagggtgataaacaaagaaagataaaattaaacaaaacagaggagattgtttatgtttatctttaacctggcggcagcgcaaaagatg

SEQ ID NO: 122946 - DNA, 103 bp, Artificial Sequence
  Synthetic Polynucleotide
taatacgactcactatagggctagcagcactgataaacaaagaaagataaaacagaggagattatctatgtttgtttataacctggcggcagcgcaaaagatg

SEQ ID NO: 122947 - DNA, 103 bp, Artificial Sequence
  Synthetic Polynucleotide
taatacgactcactatagggccctcctcagctagcagcactgataaacaaaacagaggagattgtttatgagtgctgctaacctggcggcagcgcaaaagatg

SEQ ID NO: 122948 - DNA, 103 bp, Artificial Sequence
  Synthetic Polynucleotide
taatacgactcactatagggaggagctatcccctcctcagctagcagcacaacagaggagagtgctgatggctgaggagaacctggcggcagcgcaaaagatg

SEQ ID NO: 122949 - DNA, 103 bp, Artificial Sequence
  Synthetic Polynucleotide
taatacgactcactatagggtggactctgccacttccttggaggcctctgaacagaggagacagaggatgccaaggaagaacctggcggcagcgcaaaagatg

SEQ ID NO: 122950 - DNA, 103 bp, Artificial Sequence
  Synthetic Polynucleotide
taatacgactcactatagggcagaagaaagaggagctatcccctcctcagaacagaggagactgaggatgggatagctcaacctggcggcagcgcaaaagatg

SEQ ID NO: 122951 - DNA, 103 bp, Artificial Sequence
  Synthetic Polynucleotide
taatacgactcactatagggcctggtcctgcagaagaaagaggagctatcaacagaggagagatagcatgtctttcttcaacctggcggcagcgcaaaagatg

SEQ ID NO: 122952 - DNA, 103 bp, Artificial Sequence
  Synthetic Polynucleotide
taatacgactcactatagggctcctctttccctggtcctgcagaagaaagaacagaggagactttctatggcaggaccaaacctggcggcagcgcaaaagatg

SEQ ID NO: 122953 - DNA, 103 bp, Artificial Sequence
  Synthetic Polynucleotide
taatacgactcactatagggacaggagtttctcctctttccctggtcctgaacagaggagacaggacatgggaaagaggaacctggcggcagcgcaaaagatg

SEQ ID NO: 122954 - DNA, 103 bp, Artificial Sequence
  Synthetic Polynucleotide
taatacgactcactatagggccttctccaaacaggagtttctcctctttcaacagaggagagaaagaatggaaactcctaacctggcggcagcgcaaaagatg

SEQ ID NO: 122955 - DNA, 103 bp, Artificial Sequence
  Synthetic Polynucleotide
taatacgactcactatagggaggagaaaacccttctccaaacaggagtttaacagaggagaaaactcatgtttggagaaaacctggcggcagcgcaaaagatg

SEQ ID NO: 122956 - DNA, 103 bp, Artificial Sequence
  Synthetic Polynucleotide
taatacgactcactatagggctggaagcaaaggagaaaacccttctccaaaacagaggagattggagatgggttttctcaacctggcggcagcgcaaaagatg

SEQ ID NO: 122957 - DNA, 103 bp, Artificial Sequence
  Synthetic Polynucleotide
taatacgactcactatagggatagtctgaactggaagcaaaggagaaaacaacagaggagagttttcatgtttgcttccaacctggcggcagcgcaaaagatg

SEQ ID NO: 122958 - DNA, 103 bp, Artificial Sequence
  Synthetic Polynucleotide
taatacgactcactatagggttcctccttgatagtctgaactggaagcaaaacagaggagattgcttatggttcagactaacctggcggcagcgcaaaagatg

SEQ ID NO: 122959 - DNA, 103 bp, Artificial Sequence
  Synthetic Polynucleotide
taatacgactcactataggggctggatttcttcctccttgatagtctgaaaacagaggagattcagaatgtcaaggaggaacctggcggcagcgcaaaagatg

SEQ ID NO: 122960 - DNA, 103 bp, Artificial Sequence
  Synthetic Polynucleotide
taatacgactcactatagggttgcaagagttggactctgccacttccttgaacagaggagacaaggaatgggcagagtcaacctggcggcagcgcaaaagatg

SEQ ID NO: 122961 - DNA, 103 bp, Artificial Sequence
  Synthetic Polynucleotide
taatacgactcactatagggtcctccccaggctggatttcttcctccttgaacagaggagacaaggaatgagaaatccaaacctggcggcagcgcaaaagatg

SEQ ID NO: 122962 - DNA, 103 bp, Artificial Sequence
  Synthetic Polynucleotide
taatacgactcactataggggtgtggcatttcctccccaggctggatttcaacagaggagagaaatcatgcctggggagaacctggcggcagcgcaaaagatg

SEQ ID NO: 122963 - DNA, 103 bp, Artificial Sequence
  Synthetic Polynucleotide
taatacgactcactataggggtctcgctaagtgtggcatttcctccccagaacagaggagactggggatgaaatgccacaacctggcggcagcgcaaaagatg

SEQ ID NO: 122964 - DNA, 103 bp, Artificial Sequence
  Synthetic Polynucleotide
taatacgactcactatagggactttgatgggtctcgctaagtgtggcattaacagaggagaaatgccatgcttagcgagaacctggcggcagcgcaaaagatg

SEQ ID NO: 122965 - DNA, 103 bp, Artificial Sequence
  Synthetic Polynucleotide
taatacgactcactatagggagggctctccactttgatgggtctcgctaaaacagaggagattagcgatgcccatcaaaaacctggcggcagcgcaaaagatg

SEQ ID NO: 122966 - DNA, 103 bp, Artificial Sequence
  Synthetic Polynucleotide
taatacgactcactatagggcttccaagggagggctctccactttgatggaacagaggagaccatcaatgtggagagccaacctggcggcagcgcaaaagatg

SEQ ID NO: 122967 - DNA, 103 bp, Artificial Sequence
  Synthetic Polynucleotide
taatacgactcactataggggagggccactcttccaagggagggctctccaacagaggagaggagagatgtcccttggaaacctggcggcagcgcaaaagatg

SEQ ID NO: 122968 - DNA, 103 bp, Artificial Sequence
  Synthetic Polynucleotide
taatacgactcactatagggtggggccggggagggccactcttccaagggaacagaggagacccttgatggagtggcccaacctggcggcagcgcaaaagatg

SEQ ID NO: 122969 - DNA, 103 bp, Artificial Sequence
  Synthetic Polynucleotide
taatacgactcactatagggctttgaaagatggggccggggagggccactaacagaggagaagtggcatgccccggcccaacctggcggcagcgcaaaagatg

SEQ ID NO: 122970 - DNA, 103 bp, Artificial Sequence
  Synthetic Polynucleotide
taatacgactcactataggggatgattcctctttgaaagatggggccgggaacagaggagacccggcatgatctttcaaaacctggcggcagcgcaaaagatg

SEQ ID NO: 122971 - DNA, 103 bp, Artificial Sequence
  Synthetic Polynucleotide
taatacgactcactatagggagctggaaacttgcaagagttggactctgcaacagaggagagcagagatgaactcttgcaacctggcggcagcgcaaaagatg

SEQ ID NO: 122972 - DNA, 103 bp, Artificial Sequence
  Synthetic Polynucleotide
taatacgactcactatagggccaggagtgagatgattcctctttgaaagaaacagaggagatctttcatggaggaatcaaacctggcggcagcgcaaaagatg

SEQ ID NO: 122973 - DNA, 103 bp, Artificial Sequence
  Synthetic Polynucleotide
taatacgactcactatagggacgaatcctcccaggagtgagatgattcctaacagaggagaaggaatatgctcactcctaacctggcggcagcgcaaaagatg

SEQ ID NO: 122974 - DNA, 103 bp, Artificial Sequence
  Synthetic Polynucleotide
taatacgactcactatagggggagattgggacgaatcctcccaggagtgaaacagaggagatcactcatgggaggattcaacctggcggcagcgcaaaagatg

SEQ ID NO: 122975 - DNA, 103 bp, Artificial Sequence
  Synthetic Polynucleotide
taatacgactcactatagggtcttggggtgggagattgggacgaatcctcaacagaggagagaggatatgtcccaatctaacctggcggcagcgcaaaagatg

SEQ ID NO: 122976 - DNA, 103 bp, Artificial Sequence
  Synthetic Polynucleotide
taatacgactcactatagggacttcttgggtcttggggtgggagattgggaacagaggagacccaatatgccaccccaaaacctggcggcagcgcaaaagatg

SEQ ID NO: 122977 - DNA, 103 bp, Artificial Sequence
  Synthetic Polynucleotide
taatacgactcactatagggccactgtaggacttcttgggtcttggggtgaacagaggagacaccccatgacccaagaaaacctggcggcagcgcaaaagatg

SEQ ID NO: 122978 - DNA, 103 bp, Artificial Sequence
  Synthetic Polynucleotide
taatacgactcactatagggggacctaagcccactgtaggacttcttgggaacagaggagacccaagatgtcctacagtaacctggcggcagcgcaaaagatg

SEQ ID NO: 122979 - DNA, 103 bp, Artificial Sequence
  Synthetic Polynucleotide
taatacgactcactatagggaccgggttggggacctaagcccactgtaggaacagaggagacctacaatgggcttaggtaacctggcggcagcgcaaaagatg

SEQ ID NO: 122980 - DNA, 103 bp, Artificial Sequence
  Synthetic Polynucleotide
taatacgactcactatagggtccgagacacaccgggttggggacctaagcaacagaggagagcttagatgcccaacccgaacctggcggcagcgcaaaagatg

SEQ ID NO: 122981 - DNA, 103 bp, Artificial Sequence
  Synthetic Polynucleotide
taatacgactcactatagggcacaagcatttccgagacacaccgggttggaacagaggagaccaaccatgtgtgtctcgaacctggcggcagcgcaaaagatg

SEQ ID NO: 122982 - DNA, 103 bp, Artificial Sequence
  Synthetic Polynucleotide
taatacgactcactatagggtcttgatcccagctggaaacttgcaagagtaacagaggagaactcttatgagtttccagaacctggcggcagcgcaaaagatg

SEQ ID NO: 122983 - DNA, 103 bp, Artificial Sequence
  Synthetic Polynucleotide
taatacgactcactatagggtgtgttgaatcacaagcatttccgagacacaacagaggagagtgtctatgaaatgcttgaacctggcggcagcgcaaaagatg

SEQ ID NO: 122984 - DNA, 103 bp, Artificial Sequence
  Synthetic Polynucleotide
taatacgactcactatagggctcctctccctgtgttgaatcacaagcattaacagaggagaaatgctatggattcaacaaacctggcggcagcgcaaaagatg

SEQ ID NO: 122985 - DNA, 103 bp, Artificial Sequence
  Synthetic Polynucleotide
taatacgactcactataggggctcctctccctcctctccctgtgttgaataacagaggagaattcaaatgagggagaggaacctggcggcagcgcaaaagatg

SEQ ID NO: 122986 - DNA, 103 bp, Artificial Sequence
  Synthetic Polynucleotide
taatacgactcactatagggtccgagaccggctcctctccctcctctcccaacagaggagagggagaatggggagaggaaacctggcggcagcgcaaaagatg

SEQ ID NO: 122987 - DNA, 103 bp, Artificial Sequence
  Synthetic Polynucleotide
taatacgactcactatagggtgctgttttctccgagaccggctcctctccaacagaggagaggagagatgccggtctcgaacctggcggcagcgcaaaagatg

SEQ ID NO: 122988 - DNA, 103 bp, Artificial Sequence
  Synthetic Polynucleotide
taatacgactcactatagggaggcagtagatgctgttttctccgagaccgaacagaggagacggtctatgagaaaacagaacctggcggcagcgcaaaagatg

SEQ ID NO: 122989 - DNA, 103 bp, Artificial Sequence
  Synthetic Polynucleotide
taatacgactcactatagggccacacagggaggcagtagatgctgttttcaacagaggagagaaaacatgatctactgcaacctggcggcagcgcaaaagatg

SEQ ID NO: 122990 - DNA, 103 bp, Artificial Sequence
  Synthetic Polynucleotide
taatacgactcactatagggtccggctcatccacacagggaggcagtagaaacagaggagatctactatgtccctgtgtaacctggcggcagcgcaaaagatg

SEQ ID NO: 122991 - DNA, 103 bp, Artificial Sequence
  Synthetic Polynucleotide
taatacgactcactataggggaagagcagctccggctcatccacacagggaacagaggagaccctgtatggatgagccgaacctggcggcagcgcaaaagatg

SEQ ID NO: 122992 - DNA, 103 bp, Artificial Sequence
  Synthetic Polynucleotide
taatacgactcactataggggcccctctgagaagagcagctccggctcataacagaggagaatgagcatgagctgctctaacctggcggcagcgcaaaagatg

SEQ ID NO: 122993 - DNA, 103 bp, Artificial Sequence
  Synthetic Polynucleotide
taatacgactcactatagggtggttaataatcttgatcccagctggaaacaacagaggagagtttccatgtgggatcaaaacctggcggcagcgcaaaagatg

SEQ ID NO: 122994 - DNA, 103 bp, Artificial Sequence
  Synthetic Polynucleotide
taatacgactcactataggggaagtactgggcccctctgagaagagcagcaacagaggagagctgctatgctcagagggaacctggcggcagcgcaaaagatg

SEQ ID NO: 122995 - DNA, 103 bp, Artificial Sequence
  Synthetic Polynucleotide
taatacgactcactatagggggcccagcgggaagtactgggcccctctgaaacagaggagatcagagatgcccagtactaacctggcggcagcgcaaaagatg

SEQ ID NO: 122996 - DNA, 103 bp, Artificial Sequence
  Synthetic Polynucleotide
taatacgactcactatagggggagctctgcggcccagcgggaagtactggaacagaggagaccagtaatgcccgctgggaacctggcggcagcgcaaaagatg

SEQ ID NO: 122997 - DNA, 103 bp, Artificial Sequence
  Synthetic Polynucleotide
taatacgactcactataggggctgggaacgggagctctgcggcccagcggaacagaggagaccgctgatgcgcagagctaacctggcggcagcgcaaaagatg

SEQ ID NO: 122998 - DNA, 103 bp, Artificial Sequence
  Synthetic Polynucleotide
taatacgactcactatagggagaggagtctgctgggaacgggagctctgcaacagaggagagcagagatgccgttcccaaacctggcggcagcgcaaaagatg

SEQ ID NO: 122999 - DNA, 103 bp, Artificial Sequence
  Synthetic Polynucleotide
taatacgactcactatagggaggcagggtcagaggagtctgctgggaacgaacagaggagacgttccatgcagactcctaacctggcggcagcgcaaaagatg

SEQ ID NO: 123000 - DNA, 103 bp, Artificial Sequence
  Synthetic Polynucleotide
taatacgactcactatagggctgagctgggaggcagggtcagaggagtctaacagaggagaagactcatgtgaccctgcaacctggcggcagcgcaaaagatg

SEQ ID NO: 123001 - DNA, 103 bp, Artificial Sequence
  Synthetic Polynucleotide
taatacgactcactatagggctgggagtagctgagctgggaggcagggtcaacagaggagagaccctatgtcccagctcaacctggcggcagcgcaaaagatg

SEQ ID NO: 123002 - DNA, 103 bp, Artificial Sequence
  Synthetic Polynucleotide
taatacgactcactatagggctcccacttcctgggagtagctgagctgggaacagaggagacccagcatggctactcccaacctggcggcagcgcaaaagatg

SEQ ID NO: 123003 - DNA, 103 bp, Artificial Sequence
  Synthetic Polynucleotide
taatacgactcactatagggttaaaaggtcctcccacttcctgggagtagaacagaggagactactcatgggaagtgggaacctggcggcagcgcaaaagatg

SEQ ID NO: 123004 - DNA, 103 bp, Artificial Sequence
  Synthetic Polynucleotide
taatacgactcactatagggcatggtggggtggttaataatcttgatcccaacagaggagagggatcatgattattaacaacctggcggcagcgcaaaagatg

SEQ ID NO: 123005 - DNA, 103 bp, Artificial Sequence
  Synthetic Polynucleotide
taatacgactcactatagggaatgggtgtcttaaaaggtcctcccacttcaacagaggagagaagtgatgggaccttttaacctggcggcagcgcaaaagatg

SEQ ID NO: 123006 - DNA, 103 bp, Artificial Sequence
  Synthetic Polynucleotide
taatacgactcactataggggcgtttccttaatgggtgtcttaaaaggtcaacagaggagagaccttatgagacacccaaacctggcggcagcgcaaaagatg

SEQ ID NO: 123007 - DNA, 103 bp, Artificial Sequence
  Synthetic Polynucleotide
taatacgactcactataggggagatgggcagcgtttccttaatgggtgtcaacagaggagagacaccatgtaaggaaacaacctggcggcagcgcaaaagatg

SEQ ID NO: 123008 - DNA, 103 bp, Artificial Sequence
  Synthetic Polynucleotide
taatacgactcactatagggcggggtggaggagatgggcagcgtttccttaacagaggagaaaggaaatgctgcccatcaacctggcggcagcgcaaaagatg

SEQ ID NO: 123009 - DNA, 103 bp, Artificial Sequence
  Synthetic Polynucleotide
taatacgactcactatagggcagatttgctcggggtggaggagatgggcaaacagaggagatgcccaatgcctccacccaacctggcggcagcgcaaaagatg

SEQ ID NO: 123010 - DNA, 103 bp, Artificial Sequence
  Synthetic Polynucleotide
taatacgactcactatagggctggggaggacagatttgctcggggtggagaacagaggagactccacatggagcaaatcaacctggcggcagcgcaaaagatg

SEQ ID NO: 123011 - DNA, 103 bp, Artificial Sequence
  Synthetic Polynucleotide
taatacgactcactatagggttcaggggttctggggaggacagatttgctaacagaggagaagcaaaatggtcctccccaacctggcggcagcgcaaaagatg

SEQ ID NO: 123012 - DNA, 103 bp, Artificial Sequence
  Synthetic Polynucleotide
taatacgactcactataggggcctccaggattcaggggttctggggaggaaacagaggagatcctccatggaacccctgaacctggcggcagcgcaaaagatg

SEQ ID NO: 123013 - DNA, 103 bp, Artificial Sequence
  Synthetic Polynucleotide
taatacgactcactataggggggggcgtgagcctccaggattcaggggttaacagaggagaaaccccatgatcctggagaacctggcggcagcgcaaaagatg

SEQ ID NO: 123014 - DNA, 103 bp, Artificial Sequence
  Synthetic Polynucleotide
taatacgactcactatagggtactttggctgggggcgtgagcctccaggaaacagaggagatcctggatgctcacgcccaacctggcggcagcgcaaaagatg

SEQ ID NO: 123015 - DNA, 103 bp, Artificial Sequence
  Synthetic Polynucleotide
taatacgactcactataggggtcttttgagaatcagtggccgacgggggcaacagaggagagcccccatgggccactgaaacctggcggcagcgcaaaagatg

SEQ ID NO: 123016 - DNA, 103 bp, Artificial Sequence
  Synthetic Polynucleotide
taatacgactcactataggggcgtgttgggcatggtggggtggttaataaaacagaggagattattaatgaccccaccaaacctggcggcagcgcaaaagatg

SEQ ID NO: 123017 - DNA, 103 bp, Artificial Sequence
  Synthetic Polynucleotide
taatacgactcactatagggccagtccccctactttggctgggggcgtgaaacagaggagatcacgcatgcagccaaagaacctggcggcagcgcaaaagatg

SEQ ID NO: 123018 - DNA, 103 bp, Artificial Sequence
  Synthetic Polynucleotide
taatacgactcactataggggggctgaaatccagtccccctactttggctaacagaggagaagccaaatgagggggactaacctggcggcagcgcaaaagatg

SEQ ID NO: 123019 - DNA, 103 bp, Artificial Sequence
  Synthetic Polynucleotide
taatacgactcactatagggggtttgtactgggctgaaatccagtcccccaacagaggagagggggaatggatttcagcaacctggcggcagcgcaaaagatg

SEQ ID NO: 123020 - DNA, 103 bp, Artificial Sequence
  Synthetic Polynucleotide
taatacgactcactatagggcaccctgggaggtttgtactgggctgaaataacagaggagaatttcaatgcagtacaaaaacctggcggcagcgcaaaagatg

SEQ ID NO: 123021 - DNA, 103 bp, Artificial Sequence
  Synthetic Polynucleotide
taatacgactcactataggggggtcagaggcaccctgggaggtttgtactaacagaggagaagtacaatgctcccagggaacctggcggcagcgcaaaagatg

SEQ ID NO: 123022 - DNA, 103 bp, Artificial Sequence
  Synthetic Polynucleotide
taatacgactcactataggggtcaggcaaggggtcagaggcaccctgggaaacagaggagatcccagatggcctctgacaacctggcggcagcgcaaaagatg

SEQ ID NO: 123023 - DNA, 103 bp, Artificial Sequence
  Synthetic Polynucleotide
taatacgactcactataggggccccagggggtcaggcaaggggtcagaggaacagaggagacctctgatgccttgcctgaacctggcggcagcgcaaaagatg

SEQ ID NO: 123024 - DNA, 103 bp, Artificial Sequence
  Synthetic Polynucleotide
taatacgactcactatagggagatccatcagccccagggggtcaggcaagaacagaggagacttgccatgccccctgggaacctggcggcagcgcaaaagatg

SEQ ID NO: 123025 - DNA, 103 bp, Artificial Sequence
  Synthetic Polynucleotide
taatacgactcactatagggagtggtgctgagatccatcagccccaggggaacagaggagacccctgatgctgatggataacctggcggcagcgcaaaagatg

SEQ ID NO: 123026 - DNA, 103 bp, Artificial Sequence
  Synthetic Polynucleotide
taatacgactcactatagggtttgcaagggagtggtgctgagatccatcaaacagaggagatgatggatgtcagcaccaaacctggcggcagcgcaaaagatg

SEQ ID NO: 123027 - DNA, 103 bp, Artificial Sequence
  Synthetic Polynucleotide
taatacgactcactataggggccactacttgcgtgttgggcatggtggggaacagaggagaccccacatggcccaacacaacctggcggcagcgcaaaagatg

SEQ ID NO: 123028 - DNA, 103 bp, Artificial Sequence
  Synthetic Polynucleotide
taatacgactcactataggggggggagcactttgcaagggagtggtgctgaacagaggagacagcacatgtcccttgcaaacctggcggcagcgcaaaagatg

SEQ ID NO: 123029 - DNA, 103 bp, Artificial Sequence
  Synthetic Polynucleotide
taatacgactcactatagggtgattcaagggggggagcactttgcaagggaacagaggagacccttgatgagtgctcccaacctggcggcagcgcaaaagatg

SEQ ID NO: 123030 - DNA, 103 bp, Artificial Sequence
  Synthetic Polynucleotide
taatacgactcactataggggcctttgcggtgattcaagggggggagcacaacagaggagagtgctcatgcccttgaataacctggcggcagcgcaaaagatg

SEQ ID NO: 123031 - DNA, 103 bp, Artificial Sequence
  Synthetic Polynucleotide
taatacgactcactataggggaactgaggagcctttgcggtgattcaaggaacagaggagaccttgaatgaccgcaaagaacctggcggcagcgcaaaagatg

SEQ ID NO: 123032 - DNA, 103 bp, Artificial Sequence
  Synthetic Polynucleotide
taatacgactcactatagggtaagggttctgaactgaggagcctttgcggaacagaggagaccgcaaatgctcctcagtaacctggcggcagcgcaaaagatg

SEQ ID NO: 123033 - DNA, 103 bp, Artificial Sequence
  Synthetic Polynucleotide
taatacgactcactatagggagatgaggtctaagggttctgaactgaggaaacagaggagatcctcaatgcagaaccctaacctggcggcagcgcaaaagatg

SEQ ID NO: 123034 - DNA, 103 bp, Artificial Sequence
  Synthetic Polynucleotide
taatacgactcactatagggaaggggacggagatgaggtctaagggttctaacagaggagaagaaccatgagacctcataacctggcggcagcgcaaaagatg

SEQ ID NO: 123035 - DNA, 103 bp, Artificial Sequence
  Synthetic Polynucleotide
taatacgactcactatagggagagttgccaaaggggacggagatgaggtcaacagaggagagacctcatgtccgtccccaacctggcggcagcgcaaaagatg

SEQ ID NO: 123036 - DNA, 103 bp, Artificial Sequence
  Synthetic Polynucleotide
taatacgactcactatagggctgagggagaagagttgccaaaggggacggaacagaggagaccgtccatgttggcaactaacctggcggcagcgcaaaagatg

SEQ ID NO: 123037 - DNA, 103 bp, Artificial Sequence
  Synthetic Polynucleotide
taatacgactcactatagggacgtctatatctgagggagaagagttgccaaacagaggagatggcaaatgttctccctcaacctggcggcagcgcaaaagatg

SEQ ID NO: 123038 - DNA, 103 bp, Artificial Sequence
  Synthetic Polynucleotide
taatacgactcactataggggttggggatggccactacttgcgtgttgggaacagaggagacccaacatgcaagtagtgaacctggcggcagcgcaaaagatg

SEQ ID NO: 123039 - DNA, 103 bp, Artificial Sequence
  Synthetic Polynucleotide
taatacgactcactatagggtggcttggggacgtctatatctgagggagaaacagaggagatctcccatggatatagacaacctggcggcagcgcaaaagatg

SEQ ID NO: 123040 - DNA, 103 bp, Artificial Sequence
  Synthetic Polynucleotide
taatacgactcactatagggccggggagcctggcttggggacgtctatataacagaggagaatatagatgtccccaagcaacctggcggcagcgcaaaagatg

SEQ ID NO: 123041 - DNA, 103 bp, Artificial Sequence
  Synthetic Polynucleotide
taatacgactcactatagggacctgtggctccggggagcctggcttggggaacagaggagaccccaaatgaggctccccaacctggcggcagcgcaaaagatg

SEQ ID NO: 123042 - DNA, 103 bp, Artificial Sequence
  Synthetic Polynucleotide
taatacgactcactatagggaaggccagaaacctgtggctccggggagccaacagaggagaggctccatggagccacagaacctggcggcagcgcaaaagatg

SEQ ID NO: 123043 - DNA, 103 bp, Artificial Sequence
  Synthetic Polynucleotide
taatacgactcactataggggattggctgcaaggccagaaacctgtggctaacagaggagaagccacatgtttctggccaacctggcggcagcgcaaaagatg

SEQ ID NO: 123044 - DNA, 103 bp, Artificial Sequence
  Synthetic Polynucleotide
taatacgactcactataggggtcagagaacgattggctgcaaggccagaaaacagaggagattctggatgtgcagccaaaacctggcggcagcgcaaaagatg

SEQ ID NO: 123045 - DNA, 103 bp, Artificial Sequence
  Synthetic Polynucleotide
taatacgactcactatagggcaggccttctgtcagagaacgattggctgcaacagaggagagcagccatgcgttctctgaacctggcggcagcgcaaaagatg

SEQ ID NO: 123046 - DNA, 103 bp, Artificial Sequence
  Synthetic Polynucleotide
taatacgactcactatagggtgtccaggaccaggccttctgtcagagaacaacagaggagagttctcatgcagaaggccaacctggcggcagcgcaaaagatg

SEQ ID NO: 123047 - DNA, 103 bp, Artificial Sequence
  Synthetic Polynucleotide
taatacgactcactatagggtcattcattgtgtccaggaccaggccttctaacagaggagaagaaggatgggtcctggaaacctggcggcagcgcaaaagatg

SEQ ID NO: 123048 - DNA, 103 bp, Artificial Sequence
  Synthetic Polynucleotide
taatacgactcactataggggctgaggctgtcattcattgtgtccaggacaacagaggagagtcctgatgacaatgaataacctggcggcagcgcaaaagatg

SEQ ID NO: 123049 - DNA, 103 bp, Artificial Sequence
  Synthetic Polynucleotide
taatacgactcactatagggtattagcattgttggggatggccactacttaacagaggagaaagtagatgccatccccaaacctggcggcagcgcaaaagatg

SEQ ID NO: 123050 - DNA, 103 bp, Artificial Sequence
  Synthetic Polynucleotide
taatacgactcactataggggcaggatcttgctgaggctgtcattcattgaacagaggagacaatgaatgacagcctcaaacctggcggcagcgcaaaagatg

SEQ ID NO: 123051 - DNA, 103 bp, Artificial Sequence
  Synthetic Polynucleotide
taatacgactcactatagggctgatgtccagcaggatcttgctgaggctgaacagaggagacagcctatgcaagatcctaacctggcggcagcgcaaaagatg

SEQ ID NO: 123052 - DNA, 103 bp, Artificial Sequence
  Synthetic Polynucleotide
taatacgactcactataggggccaggaaagctgatgtccagcaggatcttaacagaggagaaagatcatgctggacatcaacctggcggcagcgcaaaagatg

SEQ ID NO: 123053 - DNA, 103 bp, Artificial Sequence
  Synthetic Polynucleotide
taatacgactcactatagggcctcgtccaggccaggaaagctgatgtccaaacagaggagatggacaatggctttcctgaacctggcggcagcgcaaaagatg

SEQ ID NO: 123054 - DNA, 103 bp, Artificial Sequence
  Synthetic Polynucleotide
taatacgactcactatagggcccagtgggtcctcgtccaggccaggaaagaacagaggagactttccatgcctggacgaaacctggcggcagcgcaaaagatg

SEQ ID NO: 123055 - DNA, 103 bp, Artificial Sequence
  Synthetic Polynucleotide
taatacgactcactataggggttgtcagggcccagtgggtcctcgtccagaacagaggagactggacatggacccactgaacctggcggcagcgcaaaagatg

SEQ ID NO: 123056 - DNA, 103 bp, Artificial Sequence
  Synthetic Polynucleotide
taatacgactcactatagggaccagttgatgttgtcagggcccagtgggtaacagaggagaacccacatggccctgacaaacctggcggcagcgcaaaagatg

SEQ ID NO: 123057 - DNA, 103 bp, Artificial Sequence
  Synthetic Polynucleotide
taatacgactcactatagggataaactgggaccagttgatgttgtcagggaacagaggagaccctgaatgcatcaactgaacctggcggcagcgcaaaagatg

SEQ ID NO: 123058 - DNA, 103 bp, Artificial Sequence
  Synthetic Polynucleotide
taatacgactcactatagggtagctcaggaataaactgggaccagttgataacagaggagaatcaacatgtcccagtttaacctggcggcagcgcaaaagatg

SEQ ID NO: 123059 - DNA, 103 bp, Artificial Sequence
  Synthetic Polynucleotide
taatacgactcactatagggatgctgtgaatattagcattgttggggatgaacagaggagacatcccatgcaatgctaaaacctggcggcagcgcaaaagatg

SEQ ID NO: 123060 - DNA, 103 bp, Artificial Sequence
  Synthetic Polynucleotide
taatacgactcactatagggtgctgtgatgatgctgtgaatattagcattaacagaggagaaatgctatgattcacagcaacctggcggcagcgcaaaagatg

SEQ ID NO: 123061 - DNA, 103 bp, Artificial Sequence
  Synthetic Polynucleotide
taatacgactcactatagggtggcagtcagtgctgtgatgatgctgtgaaaacagaggagattcacaatgtcatcacagaacctggcggcagcgcaaaagatg

SEQ ID NO: 123062 - DNA, 103 bp, Artificial Sequence
  Synthetic Polynucleotide
taatacgactcactatagggtcttttcccttggcagtcagtgctgtgatgaacagaggagacatcacatgactgactgcaacctggcggcagcgcaaaagatg

SEQ ID NO: 123063 - DNA, 103 bp, Artificial Sequence
  Synthetic Polynucleotide
taatacgactcactatagggactgccactctcttttcccttggcagtcagaacagaggagactgactatgaagggaaaaaacctggcggcagcgcaaaagatg

SEQ ID NO: 123064 - DNA, 103 bp, Artificial Sequence
  Synthetic Polynucleotide
taatacgactcactatagggtgggcccactactgccactctcttttccctaacagaggagaagggaaatgagagtggcaaacctggcggcagcgcaaaagatg

SEQ ID NO: 123065 - DNA, 103 bp, Artificial Sequence
  Synthetic Polynucleotide
taatacgactcactatagggggcagcctccgtcttttgagaatcagtggcaacagaggagagccactatgtctcaaaagaacctggcggcagcgcaaaagatg

SEQ ID NO: 123066 - DNA, 103 bp, Artificial Sequence
  Synthetic Polynucleotide
taatacgactcactatagggatgaatttgttgggcccactactgccactcaacagaggagagagtggatgtagtgggccaacctggcggcagcgcaaaagatg

SEQ ID NO: 123067 - DNA, 103 bp, Artificial Sequence
  Synthetic Polynucleotide
taatacgactcactataggggctgatgaggatgaatttgttgggcccactaacagaggagaagtgggatgaacaaattcaacctggcggcagcgcaaaagatg

SEQ ID NO: 123068 - DNA, 103 bp, Artificial Sequence
  Synthetic Polynucleotide
taatacgactcactatagggctcccccacagctgatgaggatgaatttgtaacagaggagaacaaatatgtcctcatcaaacctggcggcagcgcaaaagatg

SEQ ID NO: 123069 - DNA, 103 bp, Artificial Sequence
  Synthetic Polynucleotide
taatacgactcactatagggtgagttggggctcccccacagctgatgaggaacagaggagacctcatatgctgtgggggaacctggcggcagcgcaaaagatg

SEQ ID NO: 123070 - DNA, 103 bp, Artificial Sequence
  Synthetic Polynucleotide
taatacgactcactatagggtcctggaggctgagttggggctcccccacaaacagaggagatgtgggatggccccaactaacctggcggcagcgcaaaagatg

SEQ ID NO: 123071 - DNA, 103 bp, Artificial Sequence
  Synthetic Polynucleotide
taatacgactcactataggggaggccggagtcctggaggctgagttggggaacagaggagaccccaaatgagcctccagaacctggcggcagcgcaaaagatg

SEQ ID NO: 123072 - DNA, 103 bp, Artificial Sequence
  Synthetic Polynucleotide
taatacgactcactataggggtttgggtttgaggccggagtcctggaggcaacagaggagagcctccatgactccggccaacctggcggcagcgcaaaagatg

SEQ ID NO: 123073 - DNA, 103 bp, Artificial Sequence
  Synthetic Polynucleotide
taatacgactcactatagggatcatagctggtttgggtttgaggccggagaacagaggagactccggatgcaaacccaaaacctggcggcagcgcaaaagatg

SEQ ID NO: 123074 - DNA, 103 bp, Artificial Sequence
  Synthetic Polynucleotide
taatacgactcactatagggtccttttggcatcatagctggtttgggtttaacagaggagaaaacccatgccagctatgaacctggcggcagcgcaaaagatg

SEQ ID NO: 123075 - DNA, 103 bp, Artificial Sequence
  Synthetic Polynucleotide
taatacgactcactataggggtcacttctgtccttttggcatcatagctgaacagaggagacagctaatgtgccaaaagaacctggcggcagcgcaaaagatg

SEQ ID NO: 123076 - DNA, 103 bp, Artificial Sequence
  Synthetic Polynucleotide
taatacgactcactatagggaacaggaaggggcagcctccgtcttttgagaacagaggagactcaaaatgcggaggctgaacctggcggcagcgcaaaagatg

SEQ ID NO: 123077 - DNA, 103 bp, Artificial Sequence
  Synthetic Polynucleotide
taatacgactcactatagggggtctccagggtcacttctgtccttttggcaacagaggagagccaaaatgacagaagtgaacctggcggcagcgcaaaagatg

SEQ ID NO: 123078 - DNA, 103 bp, Artificial Sequence
  Synthetic Polynucleotide
taatacgactcactatagggttggtcccaaggtctccagggtcacttctgaacagaggagacagaagatgccctggagaaacctggcggcagcgcaaaagatg

SEQ ID NO: 123079 - DNA, 103 bp, Artificial Sequence
  Synthetic Polynucleotide
taatacgactcactataggggctgcaggttttggtcccaaggtctccaggaacagaggagacctggaatgcttgggaccaacctggcggcagcgcaaaagatg

SEQ ID NO: 123080 - DNA, 103 bp, Artificial Sequence
  Synthetic Polynucleotide
taatacgactcactatagggcacatccctagctgcaggttttggtcccaaaacagaggagattgggaatgaaacctgcaaacctggcggcagcgcaaaagatg

SEQ ID NO: 123081 - DNA, 103 bp, Artificial Sequence
  Synthetic Polynucleotide
taatacgactcactatagggtaggaagattcacatccctagctgcaggttaacagaggagaaacctgatgctagggatgaacctggcggcagcgcaaaagatg

SEQ ID NO: 123082 - DNA, 103 bp, Artificial Sequence
  Synthetic Polynucleotide
taatacgactcactatagggccaggtggtctaggaagattcacatccctaaacagaggagatagggaatggaatcttccaacctggcggcagcgcaaaagatg

SEQ ID NO: 123083 - DNA, 103 bp, Artificial Sequence
  Synthetic Polynucleotide
taatacgactcactataggggcaaagggctccaggtggtctaggaagattaacagaggagaaatcttatgagaccacctaacctggcggcagcgcaaaagatg

SEQ ID NO: 123084 - DNA, 103 bp, Artificial Sequence
  Synthetic Polynucleotide
taatacgactcactataggggtttctgctcgcaaagggctccaggtggtcaacagaggagagaccacatggagccctttaacctggcggcagcgcaaaagatg

SEQ ID NO: 123085 - DNA, 103 bp, Artificial Sequence
  Synthetic Polynucleotide
taatacgactcactatagggcaggtctcccgtttctgctcgcaaagggctaacagaggagaagccctatgcgagcagaaaacctggcggcagcgcaaaagatg

SEQ ID NO: 123086 - DNA, 103 bp, Artificial Sequence
  Synthetic Polynucleotide
taatacgactcactatagggaccatctgcacaggtctcccgtttctgctcaacagaggagagagcagatgcgggagaccaacctggcggcagcgcaaaagatg

SEQ ID NO: 123087 - DNA, 103 bp, Artificial Sequence
  Synthetic Polynucleotide
taatacgactcactataggggggcattttgaacaggaaggggcagcctccaacagaggagaggaggcatgcccttcctgaacctggcggcagcgcaaaagatg

SEQ ID NO: 123088 - DNA, 103 bp, Artificial Sequence
  Synthetic Polynucleotide
taatacgactcactatagggctgctgcctcaccatctgcacaggtctcccaacagaggagagggagaatggtgcagatgaacctggcggcagcgcaaaagatg

SEQ ID NO: 123089 - DNA, 103 bp, Artificial Sequence
  Synthetic Polynucleotide
taatacgactcactatagggatagtgcagcctgctgcctcaccatctgcaaacagaggagatgcagaatgtgaggcagcaacctggcggcagcgcaaaagatg

SEQ ID NO: 123090 - DNA, 103 bp, Artificial Sequence
  Synthetic Polynucleotide
taatacgactcactataggggctattgttgatagtgcagcctgctgcctcaacagaggagagaggcaatgggctgcactaacctggcggcagcgcaaaagatg

SEQ ID NO: 123091 - DNA, 103 bp, Artificial Sequence
  Synthetic Polynucleotide
taatacgactcactatagggtgttggataggctattgttgatagtgcagcaacagaggagagctgcaatgtcaacaataaacctggcggcagcgcaaaagatg

SEQ ID NO: 123092 - DNA, 103 bp, Artificial Sequence
  Synthetic Polynucleotide
taatacgactcactatagggagccactggatgttggataggctattgttgaacagaggagacaacaaatgcctatccaaaacctggcggcagcgcaaaagatg

SEQ ID NO: 123093 - DNA, 103 bp, Artificial Sequence
  Synthetic Polynucleotide
taatacgactcactatagggcatctttcgaagccactggatgttggatagaacagaggagactatccatgatccagtggaacctggcggcagcgcaaaagatg

SEQ ID NO: 123094 - DNA, 103 bp, Artificial Sequence
  Synthetic Polynucleotide
taatacgactcactatagggcatcagaactcatctttcgaagccactggaaacagaggagatccagtatgttcgaaagaaacctggcggcagcgcaaaagatg

SEQ ID NO: 123095 - DNA, 103 bp, Artificial Sequence
  Synthetic Polynucleotide
taatacgactcactataggggagcccagtccatcagaactcatctttcgaaacagaggagatcgaaaatggagttctgaaacctggcggcagcgcaaaagatg

SEQ ID NO: 123096 - DNA, 103 bp, Artificial Sequence
  Synthetic Polynucleotide
taatacgactcactataggggatgctgcgggagcccagtccatcagaactaacagaggagaagttctatgggactgggcaacctggcggcagcgcaaaagatg

SEQ ID NO: 123097 - DNA, 103 bp, Artificial Sequence
  Synthetic Polynucleotide
taatacgactcactatagggtctcttgcttgatgctgcgggagcccagtcaacagaggagagactggatgcccgcagcaaacctggcggcagcgcaaaagatg

SEQ ID NO: 123098 - DNA, 103 bp, Artificial Sequence
  Synthetic Polynucleotide
taatacgactcactataggggtttcacttggggcattttgaacaggaaggaacagaggagaccttccatgtcaaaatgcaacctggcggcagcgcaaaagatg

SEQ ID NO: 123099 - DNA, 103 bp, Artificial Sequence
  Synthetic Polynucleotide
taatacgactcactatagggttttcctccatctcttgcttgatgctgcggaacagaggagaccgcagatgcaagcaagaaacctggcggcagcgcaaaagatg

SEQ ID NO: 123100 - DNA, 103 bp, Artificial Sequence
  Synthetic Polynucleotide
taatacgactcactatagggacaattctccttttcctccatctcttgcttaacagaggagaaagcaaatgatggaggaaaacctggcggcagcgcaaaagatg

SEQ ID NO: 123101 - DNA, 103 bp, Artificial Sequence
  Synthetic Polynucleotide
taatacgactcactataggggctccaggtgacaattctccttttcctccaaacagaggagatggaggatgaggagaattaacctggcggcagcgcaaaagatg

SEQ ID NO: 123102 - DNA, 103 bp, Artificial Sequence
  Synthetic Polynucleotide
taatacgactcactatagggacctgtcgctgctccaggtgacaattctccaacagaggagaggagaaatgtcacctggaaacctggcggcagcgcaaaagatg

SEQ ID NO: 123103 - DNA, 103 bp, Artificial Sequence
  Synthetic Polynucleotide
taatacgactcactatagggctcaaccttaacctgtcgctgctccaggtgaacagaggagacacctgatgcagcgacagaacctggcggcagcgcaaaagatg

SEQ ID NO: 123104 - DNA, 103 bp, Artificial Sequence
  Synthetic Polynucleotide
taatacgactcactatagggtcgaaggctcctcaaccttaacctgtcgctaacagaggagaagcgacatgttaaggttgaacctggcggcagcgcaaaagatg

SEQ ID NO: 123105 - DNA, 103 bp, Artificial Sequence
  Synthetic Polynucleotide
taatacgactcactataggggctgatggtctcgaaggctcctcaaccttaaacagaggagataaggtatgggagccttcaacctggcggcagcgcaaaagatg

SEQ ID NO: 123106 - DNA, 103 bp, Artificial Sequence
  Synthetic Polynucleotide
taatacgactcactatagggctgccaggacgctgatggtctcgaaggctcaacagaggagagagcctatgagaccatcaaacctggcggcagcgcaaaagatg

SEQ ID NO: 123107 - DNA, 103 bp, Artificial Sequence
  Synthetic Polynucleotide
taatacgactcactatagggacacagagttctgccaggacgctgatggtcaacagaggagagaccatatgcgtcctggcaacctggcggcagcgcaaaagatg

SEQ ID NO: 123108 - DNA, 103 bp, Artificial Sequence
  Synthetic Polynucleotide
taatacgactcactatagggggccgctcagacacagagttctgccaggacaacagaggagagtcctgatggaactctgtaacctggcggcagcgcaaaagatg

SEQ ID NO: 123109 - DNA, 103 bp, Artificial Sequence
  Synthetic Polynucleotide
taatacgactcactatagggctcctctgatgtttcacttggggcattttgaacagaggagacaaaatatgccaagtgaaaacctggcggcagcgcaaaagatg

SEQ ID NO: 123110 - DNA, 103 bp, Artificial Sequence
  Synthetic Polynucleotide
taatacgactcactatagggagagtagggtggccgctcagacacagagttaacagaggagaaactctatgtctgagcggaacctggcggcagcgcaaaagatg

SEQ ID NO: 123111 - DNA, 103 bp, Artificial Sequence
  Synthetic Polynucleotide
taatacgactcactatagggtggccatgtaagagtagggtggccgctcagaacagaggagactgagcatgcaccctactaacctggcggcagcgcaaaagatg

SEQ ID NO: 123112 - DNA, 103 bp, Artificial Sequence
  Synthetic Polynucleotide
taatacgactcactatagggaattgtatcatggccatgtaagagtagggtaacagaggagaaccctaatgttacatggcaacctggcggcagcgcaaaagatg

SEQ ID NO: 123113 - DNA, 103 bp, Artificial Sequence
  Synthetic Polynucleotide
taatacgactcactataggggttgatggcgaattgtatcatggccatgtaaacagaggagatacatgatgatgatacaaaacctggcggcagcgcaaaagatg

SEQ ID NO: 123114 - DNA, 103 bp, Artificial Sequence
  Synthetic Polynucleotide
taatacgactcactatagggtctcagtgctgttgatggcgaattgtatcaaacagaggagatgatacatgtcgccatcaaacctggcggcagcgcaaaagatg

SEQ ID NO: 123115 - DNA, 103 bp, Artificial Sequence
  Synthetic Polynucleotide
taatacgactcactatagggatgcgcttcctctcagtgctgttgatggcgaacagaggagacgccatatgcagcactgaaacctggcggcagcgcaaaagatg

SEQ ID NO: 123116 - DNA, 103 bp, Artificial Sequence
  Synthetic Polynucleotide
taatacgactcactatagggtttcaaagtcatgcgcttcctctcagtgctaacagaggagaagcactatgaggaagcgcaacctggcggcagcgcaaaagatg

SEQ ID NO: 123117 - DNA, 103 bp, Artificial Sequence
  Synthetic Polynucleotide
taatacgactcactatagggtatagatgtctttcaaagtcatgcgcttccaacagaggagaggaagcatgtgactttgaaacctggcggcagcgcaaaagatg

SEQ ID NO: 123118 - DNA, 103 bp, Artificial Sequence
  Synthetic Polynucleotide
taatacgactcactatagggtcaatccacgtatagatgtctttcaaagtcaacagaggagagactttatgagacatctaaacctggcggcagcgcaaaagatg

SEQ ID NO: 123119 - DNA, 103 bp, Artificial Sequence
  Synthetic Polynucleotide
taatacgactcactatagggaaagtggtcctcaatccacgtatagatgtcaacagaggagagacatcatgacgtggattaacctggcggcagcgcaaaagatg

SEQ ID NO: 123120 - DNA, 103 bp, Artificial Sequence
  Synthetic Polynucleotide
taatacgactcactatagggtcttaggttcctcctctgatgtttcacttgaacagaggagacaagtgatgcatcagaggaacctggcggcagcgcaaaagatg

SEQ ID NO: 123121 - DNA, 103 bp, Artificial Sequence
  Synthetic Polynucleotide
taatacgactcactatagggtaaagtagggaaagtggtcctcaatccacgaacagaggagacgtggaatgaggaccactaacctggcggcagcgcaaaagatg

SEQ ID NO: 123122 - DNA, 103 bp, Artificial Sequence
  Synthetic Polynucleotide
taatacgactcactataggggcaatgtgcttaaagtagggaaagtggtccaacagaggagaggaccaatgtccctacttaacctggcggcagcgcaaaagatg

SEQ ID NO: 123123 - DNA, 103 bp, Artificial Sequence
  Synthetic Polynucleotide
taatacgactcactataggggcctggcttggcaatgtgcttaaagtagggaacagaggagaccctacatgaagcacattaacctggcggcagcgcaaaagatg

SEQ ID NO: 123124 - DNA, 103 bp, Artificial Sequence
  Synthetic Polynucleotide
taatacgactcactatagggagttcttccagcctggcttggcaatgtgctaacagaggagaagcacaatgccaagccagaacctggcggcagcgcaaaagatg

SEQ ID NO: 123125 - DNA, 103 bp, Artificial Sequence
  Synthetic Polynucleotide
taatacgactcactatagggtggcggatggagttcttccagcctggcttgaacagaggagacaagccatgctggaagaaaacctggcggcagcgcaaaagatg

SEQ ID NO: 123126 - DNA, 103 bp, Artificial Sequence
  Synthetic Polynucleotide
taatacgactcactatagggggaaaggttgtggcggatggagttcttccaaacagaggagatggaagatgtccatccgcaacctggcggcagcgcaaaagatg

SEQ ID NO: 123127 - DNA, 103 bp, Artificial Sequence
  Synthetic Polynucleotide
taatacgactcactatagggtgtcgtgcagggaaaggttgtggcggatggaacagaggagaccatccatgacaacctttaacctggcggcagcgcaaaagatg

SEQ ID NO: 123128 - DNA, 103 bp, Artificial Sequence
  Synthetic Polynucleotide
taatacgactcactatagggcggacaaacatgtcgtgcagggaaaggttgaacagaggagacaacctatgcctgcacgaaacctggcggcagcgcaaaagatg

SEQ ID NO: 123129 - DNA, 103 bp, Artificial Sequence
  Synthetic Polynucleotide
taatacgactcactatagggagacgtctcccggacaaacatgtcgtgcagaacagaggagactgcacatgatgtttgtcaacctggcggcagcgcaaaagatg

SEQ ID NO: 123130 - DNA, 103 bp, Artificial Sequence
  Synthetic Polynucleotide
taatacgactcactatagggtgccattggcagacgtctcccggacaaacaaacagaggagatgtttgatggggagacgtaacctggcggcagcgcaaaagatg

SEQ ID NO: 123131 - DNA, 103 bp, Artificial Sequence
  Synthetic Polynucleotide
taatacgactcactataggggcaggggatctcttaggttcctcctctgataacagaggagaatcagaatgggaacctaaaacctggcggcagcgcaaaagatg

SEQ ID NO: 123132 - DNA, 103 bp, Artificial Sequence
  Synthetic Polynucleotide
taatacgactcactatagggaaggagaccttgccattggcagacgtctccaacagaggagaggagacatgtgccaatggaacctggcggcagcgcaaaagatg

SEQ ID NO: 123133 - DNA, 103 bp, Artificial Sequence
  Synthetic Polynucleotide
taatacgactcactatagggaatggtccagaaggagaccttgccattggcaacagaggagagccaatatgaaggtctccaacctggcggcagcgcaaaagatg

SEQ ID NO: 123134 - DNA, 103 bp, Artificial Sequence
  Synthetic Polynucleotide
taatacgactcactatagggcactggggtgaatggtccagaaggagacctaacagaggagaaggtctatgtctggaccaaacctggcggcagcgcaaaagatg

SEQ ID NO: 123135 - DNA, 103 bp, Artificial Sequence
  Synthetic Polynucleotide
taatacgactcactatagggtagcggttggcactggggtgaatggtccagaacagaggagactggacatgtcaccccagaacctggcggcagcgcaaaagatg

SEQ ID NO: 123136 - DNA, 103 bp, Artificial Sequence
  Synthetic Polynucleotide
taatacgactcactatagggcaatgtcaagtagcggttggcactggggtgaacagaggagacaccccatggccaaccgcaacctggcggcagcgcaaaagatg

SEQ ID NO: 123137 - DNA, 103 bp, Artificial Sequence
  Synthetic Polynucleotide
taatacgactcactatagggacacctggtccaatgtcaagtagcggttggaacagaggagaccaaccatgacttgacataacctggcggcagcgcaaaagatg

SEQ ID NO: 123138 - DNA, 103 bp, Artificial Sequence
  Synthetic Polynucleotide
taatacgactcactatagggagtggcttaaacacctggtccaatgtcaagaacagaggagacttgacatgggaccaggtaacctggcggcagcgcaaaagatg

SEQ ID NO: 123139 - DNA, 103 bp, Artificial Sequence
  Synthetic Polynucleotide
taatacgactcactatagggccctgggtccagtggcttaaacacctggtcaacagaggagagaccagatgtttaagccaaacctggcggcagcgcaaaagatg

SEQ ID NO: 123140 - DNA, 103 bp, Artificial Sequence
  Synthetic Polynucleotide
taatacgactcactatagggattgtggagaccctgggtccagtggcttaaaacagaggagattaagcatgtggacccagaacctggcggcagcgcaaaagatg

SEQ ID NO: 123141 - DNA, 103 bp, Artificial Sequence
  Synthetic Polynucleotide
taatacgactcactatagggtgctcgggcaattgtggagaccctgggtccaacagaggagaggacccatggtctccacaaacctggcggcagcgcaaaagatg

SEQ ID NO: 123142 - DNA, 103 bp, Artificial Sequence
  Synthetic Polynucleotide
taatacgactcactatagggcattatggatgaggtgtcactttctatcataacagaggagaatgataatgagtgacaccaacctggcggcagcgcaaaagatg

SEQ ID NO: 123143 - DNA, 103 bp, Artificial Sequence
  Synthetic Polynucleotide
taatacgactcactataggggggaaggtcatcatcgctggtggtggctagaacagaggagactagccatgaccagcgataacctggcggcagcgcaaaagatg

SEQ ID NO: 123144 - DNA, 103 bp, Artificial Sequence
  Synthetic Polynucleotide
taatacgactcactataggggcagccatgcgccacggccactgtggtggcaacagaggagagccaccatggtggccgtgaacctggcggcagcgcaaaagatg

SEQ ID NO: 123145 - DNA, 103 bp, Artificial Sequence
  Synthetic Polynucleotide
taatacgactcactatagggagacagccaggcagccatgcgccacggccaaacagaggagatggccgatgcgcatggctaacctggcggcagcgcaaaagatg

SEQ ID NO: 123146 - DNA, 103 bp, Artificial Sequence
  Synthetic Polynucleotide
taatacgactcactataggggggagctgggagacagccaggcagccatgcaacagaggagagcatggatgcctggctgtaacctggcggcagcgcaaaagatg

SEQ ID NO: 123147 - DNA, 103 bp, Artificial Sequence
  Synthetic Polynucleotide
taatacgactcactatagggtggctggggtgggagctgggagacagccagaacagaggagactggctatgtcccagctcaacctggcggcagcgcaaaagatg

SEQ ID NO: 123148 - DNA, 103 bp, Artificial Sequence
  Synthetic Polynucleotide
taatacgactcactataggggggtcatcagtggctggggtgggagctgggaacagaggagacccagcatgcaccccagcaacctggcggcagcgcaaaagatg

SEQ ID NO: 123149 - DNA, 103 bp, Artificial Sequence
  Synthetic Polynucleotide
taatacgactcactatagggtgcagggacagggtcatcagtggctggggtaacagaggagaaccccaatgactgatgacaacctggcggcagcgcaaaagatg

SEQ ID NO: 123150 - DNA, 103 bp, Artificial Sequence
  Synthetic Polynucleotide
taatacgactcactatagggggggactgactgcagggacagggtcatcagaacagaggagactgatgatgctgtccctgaacctggcggcagcgcaaaagatg

SEQ ID NO: 123151 - DNA, 103 bp, Artificial Sequence
  Synthetic Polynucleotide
taatacgactcactatagggggtggtgcagggggactgactgcagggacaaacagaggagatgtcccatgagtcagtccaacctggcggcagcgcaaaagatg

SEQ ID NO: 123152 - DNA, 103 bp, Artificial Sequence
  Synthetic Polynucleotide
taatacgactcactatagggggctggacctggtggtgcagggggactgacaacagaggagagtcagtatgcctgcaccaaacctggcggcagcgcaaaagatg

SEQ ID NO: 123153 - DNA, 103 bp, Artificial Sequence
  Synthetic Polynucleotide
taatacgactcactatagggatgtgcctggggctggacctggtggtgcagaacagaggagactgcacatgcaggtccagaacctggcggcagcgcaaaagatg

SEQ ID NO: 123154 - DNA, 103 bp, Artificial Sequence
  Synthetic Polynucleotide
taatacgactcactataggggcaggtccccgggaaggtcatcatcgctggaacagaggagaccagcgatgatgaccttcaacctggcggcagcgcaaaagatg

SEQ ID NO: 123155 - DNA, 103 bp, Artificial Sequence
  Synthetic Polynucleotide
taatacgactcactatagggctggagcaagatgtgcctggggctggacctaacagaggagaaggtccatgcccaggcacaacctggcggcagcgcaaaagatg

SEQ ID NO: 123156 - DNA, 103 bp, Artificial Sequence
  Synthetic Polynucleotide
taatacgactcactataggggctggagagtctggagcaagatgtgcctggaacagaggagaccaggcatgtcttgctccaacctggcggcagcgcaaaagatg

SEQ ID NO: 123157 - DNA, 103 bp, Artificial Sequence
  Synthetic Polynucleotide
taatacgactcactatagggctgggctggtgctggagagtctggagcaagaacagaggagacttgctatggactctccaaacctggcggcagcgcaaaagatg

SEQ ID NO: 123158 - DNA, 103 bp, Artificial Sequence
  Synthetic Polynucleotide
taatacgactcactataggggtggcggggtctgggctggtgctggagagtaacagaggagaactctcatgcaccagcccaacctggcggcagcgcaaaagatg

SEQ ID NO: 123159 - DNA, 103 bp, Artificial Sequence
  Synthetic Polynucleotide
taatacgactcactatagggagggcgtgcagtggcggggtctgggctggtaacagaggagaaccagcatggaccccgccaacctggcggcagcgcaaaagatg

SEQ ID NO: 123160 - DNA, 103 bp, Artificial Sequence
  Synthetic Polynucleotide
taatacgactcactataggggaggtccggcagggcgtgcagtggcggggtaacagaggagaaccccgatgctgcacgccaacctggcggcagcgcaaaagatg

SEQ ID NO: 123161 - DNA, 103 bp, Artificial Sequence
  Synthetic Polynucleotide
taatacgactcactatagggggctggggctgaggtccggcagggcgtgcaaacagaggagatgcacgatgtgccggaccaacctggcggcagcgcaaaagatg

SEQ ID NO: 123162 - DNA, 103 bp, Artificial Sequence
  Synthetic Polynucleotide
taatacgactcactatagggtgggggagcgggctggggctgaggtccggcaacagaggagagccggaatgcagccccagaacctggcggcagcgcaaaagatg

SEQ ID NO: 123163 - DNA, 103 bp, Artificial Sequence
  Synthetic Polynucleotide
taatacgactcactatagggcatggcggggtgggggagcgggctggggctaacagaggagaagccccatgccgctccccaacctggcggcagcgcaaaagatg

SEQ ID NO: 123164 - DNA, 103 bp, Artificial Sequence
  Synthetic Polynucleotide
taatacgactcactataggggagcccttcccatggcggggtgggggagcgaacagaggagacgctccatgaccccgccaaacctggcggcagcgcaaaagatg

SEQ ID NO: 123165 - DNA, 103 bp, Artificial Sequence
  Synthetic Polynucleotide
taatacgactcactataggggacagcgactgcaggtccccgggaaggtcaaacagaggagatgacctatgcggggacctaacctggcggcagcgcaaaagatg

SEQ ID NO: 123166 - DNA, 103 bp, Artificial Sequence
  Synthetic Polynucleotide
taatacgactcactatagggaagtctacaggagcccttcccatggcggggaacagaggagaccccgcatggggaagggcaacctggcggcagcgcaaaagatg

SEQ ID NO: 123167 - DNA, 103 bp, Artificial Sequence
  Synthetic Polynucleotide
taatacgactcactataggggatgttgatgaagtctacaggagcccttccaacagaggagaggaaggatgcctgtagacaacctggcggcagcgcaaaagatg

SEQ ID NO: 123168 - DNA, 103 bp, Artificial Sequence
  Synthetic Polynucleotide
taatacgactcactatagggtgtcggtgctgatgttgatgaagtctacagaacagaggagactgtagatgtcatcaacaaacctggcggcagcgcaaaagatg

SEQ ID NO: 123169 - DNA, 103 bp, Artificial Sequence
  Synthetic Polynucleotide
taatacgactcactatagggtcagtgttcatgtcggtgctgatgttgatgaacagaggagacatcaaatgcagcaccgaaacctggcggcagcgcaaaagatg

SEQ ID NO: 123170 - DNA, 103 bp, Artificial Sequence
  Synthetic Polynucleotide
taatacgactcactatagggggcatccacctcagtgttcatgtcggtgctaacagaggagaagcaccatgatgaacactaacctggcggcagcgcaaaagatg

SEQ ID NO: 123171 - DNA, 103 bp, Artificial Sequence
  Synthetic Polynucleotide
taatacgactcactatagggtcgggtcgagggcatccacctcagtgttcaaacagaggagatgaacaatgaggtggatgaacctggcggcagcgcaaaagatg

SEQ ID NO: 123172 - DNA, 103 bp, Artificial Sequence
  Synthetic Polynucleotide
taatacgactcactatagggtccatgatgctcgggtcgagggcatccaccaacagaggagaggtggaatgcctcgacccaacctggcggcagcgcaaaagatg

SEQ ID NO: 123173 - DNA, 103 bp, Artificial Sequence
  Synthetic Polynucleotide
taatacgactcactatagggcagagcgaagtccatgatgctcgggtcgagaacagaggagactcgacatgagcatcatgaacctggcggcagcgcaaaagatg

SEQ ID NO: 123174 - DNA, 103 bp, Artificial Sequence
  Synthetic Polynucleotide
taatacgactcactatagggggttcccctgcagagcgaagtccatgatgcaacagaggagagcatcaatgacttcgctcaacctggcggcagcgcaaaagatg

SEQ ID NO: 123175 - DNA, 103 bp, Artificial Sequence
  Synthetic Polynucleotide
taatacgactcactatagggtcctcccacaggttcccctgcagagcgaagaacagaggagacttcgcatggcaggggaaaacctggcggcagcgcaaaagatg

SEQ ID NO: 123176 - DNA, 103 bp, Artificial Sequence
  Synthetic Polynucleotide
taatacgactcactatagggcgtgagccacgacagcgactgcaggtccccaacagaggagaggggacatgcagtcgctgaacctggcggcagcgcaaaagatg

SEQ ID NO: 123177 - DNA, 103 bp, Artificial Sequence
  Synthetic Polynucleotide
taatacgactcactatagggatccttcatctcctcccacaggttcccctgaacagaggagacaggggatgctgtgggagaacctggcggcagcgcaaaagatg

SEQ ID NO: 123178 - DNA, 103 bp, Artificial Sequence
  Synthetic Polynucleotide
taatacgactcactatagggtgaatccctcatccttcatctcctcccacaaacagaggagatgtgggatgagatgaaggaacctggcggcagcgcaaaagatg

SEQ ID NO: 123179 - DNA, 103 bp, Artificial Sequence
  Synthetic Polynucleotide
taatacgactcactataggggtgtccaagctgaatccctcatccttcatcaacagaggagagatgaaatgtgagggattaacctggcggcagcgcaaaagatg

SEQ ID NO: 123180 - DNA, 103 bp, Artificial Sequence
  Synthetic Polynucleotide
taatacgactcactatagggggcgcccagtgtgtccaagctgaatccctcaacagaggagagagggaatgagcttggacaacctggcggcagcgcaaaagatg

SEQ ID NO: 123181 - DNA, 103 bp, Artificial Sequence
  Synthetic Polynucleotide
taatacgactcactatagggagtctgcaaaggcgcccagtgtgtccaagcaacagaggagagcttggatgcactgggcgaacctggcggcagcgcaaaagatg

SEQ ID NO: 123182 - DNA, 103 bp, Artificial Sequence
  Synthetic Polynucleotide
taatacgactcactatagggccaagcggggagtctgcaaaggcgcccagtaacagaggagaactgggatgctttgcagaaacctggcggcagcgcaaaagatg

SEQ ID NO: 123183 - DNA, 103 bp, Artificial Sequence
  Synthetic Polynucleotide
taatacgactcactatagggcaggtcacagccaagcggggagtctgcaaaaacagaggagatttgcaatgtccccgcttaacctggcggcagcgcaaaagatg

SEQ ID NO: 123184 - DNA, 103 bp, Artificial Sequence
  Synthetic Polynucleotide
taatacgactcactatagggctgaggcccccaggtcacagccaagcggggaacagaggagaccccgcatggctgtgaccaacctggcggcagcgcaaaagatg

SEQ ID NO: 123185 - DNA, 103 bp, Artificial Sequence
  Synthetic Polynucleotide
taatacgactcactatagggggggttaggcctgaggcccccaggtcacagaacagaggagactgtgaatggggggcctcaacctggcggcagcgcaaaagatg

SEQ ID NO: 123186 - DNA, 103 bp, Artificial Sequence
  Synthetic Polynucleotide
taatacgactcactatagggacccgaggcaggggttaggcctgaggccccaacagaggagaggggccatgggcctaaccaacctggcggcagcgcaaaagatg

SEQ ID NO: 123187 - DNA, 103 bp, Artificial Sequence
  Synthetic Polynucleotide
taatacgactcactatagggcatccaccgccgtgagccacgacagcgactaacagaggagaagtcgcatgcgtggctcaaacctggcggcagcgcaaaagatg

SEQ ID NO: 123188 - DNA, 103 bp, Artificial Sequence
  Synthetic Polynucleotide
taatacgactcactatagggggtcgctgccacccgaggcaggggttaggcaacagaggagagcctaaatgctgcctcggaacctggcggcagcgcaaaagatg

SEQ ID NO: 123189 - DNA, 103 bp, Artificial Sequence
  Synthetic Polynucleotide
taatacgactcactataggggggaaggactggtcgctgccacccgaggcaaacagaggagatgcctcatgtggcagcgaaacctggcggcagcgcaaaagatg

SEQ ID NO: 123190 - DNA, 103 bp, Artificial Sequence
  Synthetic Polynucleotide
taatacgactcactatagggctgcaagtctgggaaggactggtcgctgccaacagaggagaggcagcatgcagtccttcaacctggcggcagcgcaaaagatg

SEQ ID NO: 123191 - DNA, 103 bp, Artificial Sequence
  Synthetic Polynucleotide
taatacgactcactataggggacccgtcacctgcaagtctgggaaggactaacagaggagaagtcctatgcagacttgcaacctggcggcagcgcaaaagatg

SEQ ID NO: 123192 - DNA, 103 bp, Artificial Sequence
  Synthetic Polynucleotide
taatacgactcactataggggctgtgtagagacccgtcacctgcaagtctaacagaggagaagacttatgggtgacgggaacctggcggcagcgcaaaagatg

SEQ ID NO: 123193 - DNA, 103 bp, Artificial Sequence
  Synthetic Polynucleotide
taatacgactcactatagggagtggagtacgctgtgtagagacccgtcacaacagaggagagtgacgatgctctacacaaacctggcggcagcgcaaaagatg

SEQ ID NO: 123194 - DNA, 103 bp, Artificial Sequence
  Synthetic Polynucleotide
taatacgactcactatagggcactgtccggagtggagtacgctgtgtagaaacagaggagatctacaatgcgtactccaaacctggcggcagcgcaaaagatg

SEQ ID NO: 123195 - DNA, 103 bp, Artificial Sequence
  Synthetic Polynucleotide
taatacgactcactataggggatgcagccacactgtccggagtggagtacaacagaggagagtactcatgtccggacagaacctggcggcagcgcaaaagatg

SEQ ID NO: 123196 - DNA, 103 bp, Artificial Sequence
  Synthetic Polynucleotide
taatacgactcactataggggctggtgcccgatgcagccacactgtccggaacagaggagaccggacatggtggctgcaaacctggcggcagcgcaaaagatg

SEQ ID NO: 123197 - DNA, 103 bp, Artificial Sequence
  Synthetic Polynucleotide
taatacgactcactataggggggaggaggagctggtgcccgatgcagccaaacagaggagatggctgatgcgggcaccaaacctggcggcagcgcaaaagatg

SEQ ID NO: 123198 - DNA, 103 bp, Artificial Sequence
  Synthetic Polynucleotide
taatacgactcactatagggagccgaggcacatccaccgccgtgagccacaacagaggagagtggctatgggcggtggaaacctggcggcagcgcaaaagatg

SEQ ID NO: 123199 - DNA, 103 bp, Artificial Sequence
  Synthetic Polynucleotide
taatacgactcactatagggcccaggtactgggaggaggagctggtgcccaacagaggagagggcacatgctcctcctcaacctggcggcagcgcaaaagatg

SEQ ID NO: 123200 - DNA, 103 bp, Artificial Sequence
  Synthetic Polynucleotide
taatacgactcactatagggcccctgtgcacccaggtactgggaggaggaaacagaggagatcctccatgcagtacctgaacctggcggcagcgcaaaagatg

SEQ ID NO: 123201 - DNA, 103 bp, Artificial Sequence
  Synthetic Polynucleotide
taatacgactcactatagggtaggcttgttcccctgtgcacccaggtactaacagaggagaagtaccatggtgcacaggaacctggcggcagcgcaaaagatg

SEQ ID NO: 123202 - DNA, 103 bp, Artificial Sequence
  Synthetic Polynucleotide
taatacgactcactatagggagcagggctataggcttgttcccctgtgcaaacagaggagatgcacaatggaacaagccaacctggcggcagcgcaaaagatg

SEQ ID NO: 123203 - DNA, 103 bp, Artificial Sequence
  Synthetic Polynucleotide
taatacgactcactatagggcatctgctgcagccgaggcacatccaccgcaacagaggagagcggtgatggtgcctcggaacctggcggcagcgcaaaagatg

SEQ ID NO: 123204 - DNA, 103 bp, Artificial Sequence
  Synthetic Polynucleotide
taatacgactcactatagggggccacttgccatctgctgcagccgaggcaaacagaggagatgcctcatgtgcagcagaaacctggcggcagcgcaaaagatg

SEQ ID NO: 123205 - DNA, 103 bp, Artificial Sequence
  Synthetic Polynucleotide
taatacgactcactatagggaggtccacgcggccacttgccatctgctgcaacagaggagagcagcaatgggcaagtggaacctggcggcagcgcaaaagatg

SEQ ID NO: 123206 - DNA, 103 bp, Artificial Sequence
  Synthetic Polynucleotide
taatacgactcactatagggggggccacccaggtccacgcggccacttgcaacagaggagagcaagtatgcgcgtggacaacctggcggcagcgcaaaagatg

SEQ ID NO: 123207 - DNA, 103 bp, Artificial Sequence
  Synthetic Polynucleotide
taatacgactcactatagggtaattcctgacattatggatgaggtgtcacaacagaggagagtgacaatgcatccataaaacctggcggcagcgcaaaagatg

SEQ ID NO: 123208 - DNA, 103 bp, Artificial Sequence
  Synthetic Polynucleotide
taatacgactcactataggggtggcacgcaggggccacccaggtccacgcaacagaggagagcgtggatgtgggtggccaacctggcggcagcgcaaaagatg

SEQ ID NO: 123209 - DNA, 103 bp, Artificial Sequence
  Synthetic Polynucleotide
taatacgactcactataggggggtgtggatgtggcacgcaggggccacccaacagaggagagggtggatgctgcgtgccaacctggcggcagcgcaaaagatg

SEQ ID NO: 123210 - DNA, 103 bp, Artificial Sequence
  Synthetic Polynucleotide
taatacgactcactatagggcaaggcacctgggtgtggatgtggcacgcaaacagaggagatgcgtgatgcatccacacaacctggcggcagcgcaaaagatg

SEQ ID NO: 123211 - DNA, 103 bp, Artificial Sequence
  Synthetic Polynucleotide
taatacgactcactatagggccaccccagccaaggcacctgggtgtggataacagaggagaatccacatgcaggtgcctaacctggcggcagcgcaaaagatg

SEQ ID NO: 123212 - DNA, 103 bp, Artificial Sequence
  Synthetic Polynucleotide
taatacgactcactatagggtgcaggtcggccaccccagccaaggcacctaacagaggagaaggtgcatgggctggggtaacctggcggcagcgcaaaagatg

SEQ ID NO: 123213 - DNA, 103 bp, Artificial Sequence
  Synthetic Polynucleotide
taatacgactcactatagggggctcccacatgcaggtcggccaccccagcaacagaggagagctgggatggccgacctgaacctggcggcagcgcaaaagatg

SEQ ID NO: 123214 - DNA, 103 bp, Artificial Sequence
  Synthetic Polynucleotide
taatacgactcactataggggacttggagtggctcccacatgcaggtcggaacagaggagaccgaccatgatgtgggagaacctggcggcagcgcaaaagatg

SEQ ID NO: 123215 - DNA, 103 bp, Artificial Sequence
  Synthetic Polynucleotide
taatacgactcactatagggtggagaaggggacttggagtggctcccacaaacagaggagatgtgggatgcactccaagaacctggcggcagcgcaaaagatg

SEQ ID NO: 123216 - DNA, 103 bp, Artificial Sequence
  Synthetic Polynucleotide
taatacgactcactatagggtgctgggccatggagaaggggacttggagtaacagaggagaactccaatgccccttctcaacctggcggcagcgcaaaagatg

SEQ ID NO: 123217 - DNA, 103 bp, Artificial Sequence
  Synthetic Polynucleotide
taatacgactcactataggggggccatgcctgctgggccatggagaagggaacagaggagacccttcatgatggcccagaacctggcggcagcgcaaaagatg

SEQ ID NO: 123218 - DNA, 103 bp, Artificial Sequence
  Synthetic Polynucleotide
taatacgactcactataggggagtttcgaataattcctgacattatggataacagaggagaatccatatggtcaggaataacctggcggcagcgcaaaagatg

SEQ ID NO: 123219 - DNA, 103 bp, Artificial Sequence
  Synthetic Polynucleotide
taatacgactcactatagggatgcctcggggggccatgcctgctgggccaaacagaggagatggcccatgaggcatggcaacctggcggcagcgcaaaagatg

SEQ ID NO: 123220 - DNA, 103 bp, Artificial Sequence
  Synthetic Polynucleotide
taatacgactcactatagggcagacctggcatgcctcggggggccatgccaacagaggagaggcatgatgccccgaggcaacctggcggcagcgcaaaagatg

SEQ ID NO: 123221 - DNA, 103 bp, Artificial Sequence
  Synthetic Polynucleotide
taatacgactcactatagggttatggggcccagacctggcatgcctcgggaacagaggagacccgagatgtgccaggtcaacctggcggcagcgcaaaagatg

SEQ ID NO: 123222 - DNA, 103 bp, Artificial Sequence
  Synthetic Polynucleotide
taatacgactcactatagggctgtggccagttatggggcccagacctggcaacagaggagagccaggatggggccccataacctggcggcagcgcaaaagatg

SEQ ID NO: 123223 - DNA, 103 bp, Artificial Sequence
  Synthetic Polynucleotide
taatacgactcactatagggcatgctgtctctgtggccagttatggggccaacagaggagaggccccatgactggccacaacctggcggcagcgcaaaagatg

SEQ ID NO: 123224 - DNA, 103 bp, Artificial Sequence
  Synthetic Polynucleotide
taatacgactcactatagggggaactggctcatgctgtctctgtggccagaacagaggagactggccatggagacagcaaacctggcggcagcgcaaaagatg

SEQ ID NO: 123225 - DNA, 103 bp, Artificial Sequence
  Synthetic Polynucleotide
taatacgactcactatagggccccccacggggaactggctcatgctgtctaacagaggagaagacagatggagccagttaacctggcggcagcgcaaaagatg

SEQ ID NO: 123226 - DNA, 103 bp, Artificial Sequence
  Synthetic Polynucleotide
taatacgactcactatagggtgagggctggccccccacggggaactggctaacagaggagaagccagatgcccgtggggaacctggcggcagcgcaaaagatg

SEQ ID NO: 123227 - DNA, 103 bp, Artificial Sequence
  Synthetic Polynucleotide
taatacgactcactataggggcaggccagatgagggctggccccccacggaacagaggagaccgtggatggccagccctaacctggcggcagcgcaaaagatg

SEQ ID NO: 123228 - DNA, 103 bp, Artificial Sequence
  Synthetic Polynucleotide
taatacgactcactatagggggcgggtcctgcaggccagatgagggctggaacagaggagaccagccatgatctggcctaacctggcggcagcgcaaaagatg

SEQ ID NO: 123229 - DNA, 103 bp, Artificial Sequence
  Synthetic Polynucleotide
taatacgactcactatagggattttgccctgagtttcgaataattcctgaaacagaggagatcaggaatgattcgaaacaacctggcggcagcgcaaaagatg

SEQ ID NO: 123230 - DNA, 103 bp, Artificial Sequence
  Synthetic Polynucleotide
taatacgactcactataggggtacagatgcggcgggtcctgcaggccagaaacagaggagatctggcatgcaggacccgaacctggcggcagcgcaaaagatg

SEQ ID NO: 123231 - DNA, 103 bp, Artificial Sequence
  Synthetic Polynucleotide
taatacgactcactatagggtggcaggtgagtacagatgcggcgggtcctaacagaggagaaggaccatgcgcatctgtaacctggcggcagcgcaaaagatg

SEQ ID NO: 123232 - DNA, 103 bp, Artificial Sequence
  Synthetic Polynucleotide
taatacgactcactatagggtgtggttgggtggcaggtgagtacagatgcaacagaggagagcatctatgctcacctgcaacctggcggcagcgcaaaagatg

SEQ ID NO: 123233 - DNA, 103 bp, Artificial Sequence
  Synthetic Polynucleotide
taatacgactcactataggggagcgggaactgtggttgggtggcaggtgaaacagaggagatcacctatgacccaaccaaacctggcggcagcgcaaaagatg

SEQ ID NO: 123234 - DNA, 103 bp, Artificial Sequence
  Synthetic Polynucleotide
taatacgactcactatagggcacccggggggagcgggaactgtggttgggaacagaggagacccaacatgagttcccgcaacctggcggcagcgcaaaagatg

SEQ ID NO: 123235 - DNA, 103 bp, Artificial Sequence
  Synthetic Polynucleotide
taatacgactcactatagggcactgctgggcacccggggggagcgggaacaacagaggagagttcccatgccccccgggaacctggcggcagcgcaaaagatg

SEQ ID NO: 123236 - DNA, 103 bp, Artificial Sequence
  Synthetic Polynucleotide
taatacgactcactatagggcacaggagggcactgctgggcacccgggggaacagaggagacccccgatggcccagcagaacctggcggcagcgcaaaagatg

SEQ ID NO: 123237 - DNA, 103 bp, Artificial Sequence
  Synthetic Polynucleotide
taatacgactcactatagggcatagaggcccacaggagggcactgctgggaacagaggagacccagcatggccctcctgaacctggcggcagcgcaaaagatg

SEQ ID NO: 123238 - DNA, 103 bp, Artificial Sequence
  Synthetic Polynucleotide
taatacgactcactatagggaatggggggccatagaggcccacaggagggaacagaggagaccctccatggggcctctaaacctggcggcagcgcaaaagatg

SEQ ID NO: 123239 - DNA, 103 bp, Artificial Sequence
  Synthetic Polynucleotide
taatacgactcactatagggccgcaccccaaatggggggccatagaggccaacagaggagaggcctcatgggccccccaaacctggcggcagcgcaaaagatg

SEQ ID NO: 123240 - DNA, 103 bp, Artificial Sequence
  Synthetic Polynucleotide
taatacgactcactatagggaggggtggtgattttgccctgagtttcgaaaacagaggagattcgaaatgcagggcaaaaacctggcggcagcgcaaaagatg

SEQ ID NO: 123241 - DNA, 103 bp, Artificial Sequence
  Synthetic Polynucleotide
taatacgactcactatagggggtaggggggccgcaccccaaatggggggcaacagaggagagcccccatgttggggtgcaacctggcggcagcgcaaaagatg

SEQ ID NO: 123242 - DNA, 103 bp, Artificial Sequence
  Synthetic Polynucleotide
taatacgactcactatagggtggggctgggggtaggggggccgcaccccaaacagaggagatggggtatggcccccctaaacctggcggcagcgcaaaagatg

SEQ ID NO: 123243 - DNA, 103 bp, Artificial Sequence
  Synthetic Polynucleotide
taatacgactcactatagggcacagccacgtggggctgggggtaggggggaacagaggagaccccccatgccccagcccaacctggcggcagcgcaaaagatg

SEQ ID NO: 123244 - DNA, 103 bp, Artificial Sequence
  Synthetic Polynucleotide
taatacgactcactataggggagatgaatgcacagccacgtggggctgggaacagaggagacccagcatgacgtggctgaacctggcggcagcgcaaaagatg

SEQ ID NO: 123245 - DNA, 103 bp, Artificial Sequence
  Synthetic Polynucleotide
taatacgactcactatagggtgcagttcttgagatgaatgcacagccacgaacagaggagacgtggcatggcattcatcaacctggcggcagcgcaaaagatg

SEQ ID NO: 123246 - DNA, 103 bp, Artificial Sequence
  Synthetic Polynucleotide
taatacgactcactataggggtgtttggggtgcagttcttgagatgaatgaacagaggagacattcaatgcaagaactgaacctggcggcagcgcaaaagatg

SEQ ID NO: 123247 - DNA, 103 bp, Artificial Sequence
  Synthetic Polynucleotide
taatacgactcactataggggcttggggtagtgtttggggtgcagttcttaacagaggagaaagaacatgaccccaaacaacctggcggcagcgcaaaagatg

SEQ ID NO: 123248 - DNA, 103 bp, Artificial Sequence
  Synthetic Polynucleotide
taatacgactcactataggggagtagatgggcttggggtagtgtttggggaacagaggagaccccaaatgctaccccaaaacctggcggcagcgcaaaagatg

SEQ ID NO: 123249 - DNA, 103 bp, Artificial Sequence
  Synthetic Polynucleotide
taatacgactcactatagggacagctgtacgagtagatgggcttggggtaaacagaggagataccccatgcccatctacaacctggcggcagcgcaaaagatg

SEQ ID NO: 123250 - DNA, 103 bp, Artificial Sequence
  Synthetic Polynucleotide
taatacgactcactatagggtggcgatcagacagctgtacgagtagatggaacagaggagaccatctatgcgtacagctaacctggcggcagcgcaaaagatg

SEQ ID NO: 123251 - DNA, 103 bp, Artificial Sequence
  Synthetic Polynucleotide
taatacgactcactatagggtcctgtggagaggggtggtgattttgccctaacagaggagaagggcaatgtcaccacccaacctggcggcagcgcaaaagatg

SEQ ID NO: 123252 - DNA, 103 bp, Artificial Sequence
  Synthetic Polynucleotide
taatacgactcactatagggttcagggccatggcgatcagacagctgtacaacagaggagagtacagatgtctgatcgcaacctggcggcagcgcaaaagatg

SEQ ID NO: 123253 - DNA, 103 bp, Artificial Sequence
  Synthetic Polynucleotide
taatacgactcactatagggcttgctgttcttcagggccatggcgatcagaacagaggagactgatcatgatggccctgaacctggcggcagcgcaaaagatg

SEQ ID NO: 123254 - DNA, 103 bp, Artificial Sequence
  Synthetic Polynucleotide
taatacgactcactatagggggctgcctgtcttgctgttcttcagggccaaacagaggagatggcccatgagaacagcaaacctggcggcagcgcaaaagatg

SEQ ID NO: 123255 - DNA, 103 bp, Artificial Sequence
  Synthetic Polynucleotide
taatacgactcactatagggctcacaggcaggctgcctgtcttgctgttcaacagaggagagaacagatggacaggcagaacctggcggcagcgcaaaagatg

SEQ ID NO: 123256 - DNA, 103 bp, Artificial Sequence
  Synthetic Polynucleotide
taatacgactcactataggggtagatctcgctcacaggcaggctgcctgtaacagaggagaacaggcatgctgcctgtgaacctggcggcagcgcaaaagatg

SEQ ID NO: 123257 - DNA, 103 bp, Artificial Sequence
  Synthetic Polynucleotide
taatacgactcactatagggtcatgaagctgtagatctcgctcacaggcaaacagaggagatgcctgatggcgagatctaacctggcggcagcgcaaaagatg

SEQ ID NO: 123258 - DNA, 103 bp, Artificial Sequence
  Synthetic Polynucleotide
taatacgactcactatagggaagtgctccttcatgaagctgtagatctcgaacagaggagacgagatatgcagcttcataacctggcggcagcgcaaaagatg

SEQ ID NO: 123259 - DNA, 103 bp, Artificial Sequence
  Synthetic Polynucleotide
taatacgactcactataggggaagtaggggaagtgctccttcatgaagctaacagaggagaagcttcatgaaggagcacaacctggcggcagcgcaaaagatg

SEQ ID NO: 123260 - DNA, 103 bp, Artificial Sequence
  Synthetic Polynucleotide
taatacgactcactataggggggccgtcttgaagtaggggaagtgctcctaacagaggagaaggagcatgtcccctactaacctggcggcagcgcaaaagatg

SEQ ID NO: 123261 - DNA, 103 bp, Artificial Sequence
  Synthetic Polynucleotide
taatacgactcactatagggcacccgtcgggggccgtcttgaagtaggggaacagaggagacccctaatgcaagacggcaacctggcggcagcgcaaaagatg

SEQ ID NO: 123262 - DNA, 103 bp, Artificial Sequence
  Synthetic Polynucleotide
taatacgactcactatagggaagcctgtattcctgtggagaggggtggtgaacagaggagacaccacatgtctccacagaacctggcggcagcgcaaaagatg

SEQ ID NO: 123263 - DNA, 103 bp, Artificial Sequence
  Synthetic Polynucleotide
taatacgactcactatagggcgagttcttccacccgtcgggggccgtcttaacagaggagaaagacgatgcccgacgggaacctggcggcagcgcaaaagatg

SEQ ID NO: 123264 - DNA, 103 bp, Artificial Sequence
  Synthetic Polynucleotide
taatacgactcactatagggtgtgccgcaccgagttcttccacccgtcggaacagaggagaccgacgatgggaagaactaacctggcggcagcgcaaaagatg

SEQ ID NO: 123265 - DNA, 103 bp, Artificial Sequence
  Synthetic Polynucleotide
taatacgactcactatagggagagacaggttgtgccgcaccgagttcttcaacagaggagagaagaaatgggtgcggcaaacctggcggcagcgcaaaagatg

SEQ ID NO: 123266 - DNA, 103 bp, Artificial Sequence
  Synthetic Polynucleotide
taatacgactcactataggggcacttgttcagagacaggttgtgccgcacaacagaggagagtgcggatgaacctgtctaacctggcggcagcgcaaaagatg

SEQ ID NO: 123267 - DNA, 103 bp, Artificial Sequence
  Synthetic Polynucleotide
taatacgactcactatagggccttctcgaagcacttgttcagagacaggtaacagaggagaacctgtatgtgaacaagtaacctggcggcagcgcaaaagatg

SEQ ID NO: 123268 - DNA, 103 bp, Artificial Sequence
  Synthetic Polynucleotide
taatacgactcactatagggttgttctccaccttctcgaagcacttgttcaacagaggagagaacaaatgcttcgagaaaacctggcggcagcgcaaaagatg

SEQ ID NO: 123269 - DNA, 103 bp, Artificial Sequence
  Synthetic Polynucleotide
taatacgactcactataggggccgctcatcttgttctccaccttctcgaaaacagaggagattcgagatggtggagaacaacctggcggcagcgcaaaagatg

SEQ ID NO: 123270 - DNA, 103 bp, Artificial Sequence
  Synthetic Polynucleotide
taatacgactcactatagggtgcgggaggagccgctcatcttgttctccaaacagaggagatggagaatgagatgagcgaacctggcggcagcgcaaaagatg

SEQ ID NO: 123271 - DNA, 103 bp, Artificial Sequence
  Synthetic Polynucleotide
taatacgactcactatagggaggcagcccttgcgggaggagccgctcatcaacagaggagagatgagatgctcctcccgaacctggcggcagcgcaaaagatg

SEQ ID NO: 123272 - DNA, 103 bp, Artificial Sequence
  Synthetic Polynucleotide
taatacgactcactatagggcagagcccacaggcagcccttgcgggaggaaacagaggagatcctccatgaagggctgcaacctggcggcagcgcaaaagatg

SEQ ID NO: 123273 - DNA, 103 bp, Artificial Sequence
  Synthetic Polynucleotide
taatacgactcactatagggtggtggctagaagcctgtattcctgtggagaacagaggagactccacatgaatacaggcaacctggcggcagcgcaaaagatg

SEQ ID NO: 123274 - DNA, 103 bp, Artificial Sequence
  Synthetic Polynucleotide
taatacgactcactataggggggccaggttcagagcccacaggcagccctaacagaggagaagggctatgtgtgggctcaacctggcggcagcgcaaaagatg

SEQ ID NO: 123275 - DNA, 103 bp, Artificial Sequence
  Synthetic Polynucleotide
taatacgactcactatagggttgtcgatgcgggccaggttcagagcccacaacagaggagagtgggcatggaacctggcaacctggcggcagcgcaaaagatg

SEQ ID NO: 123276 - DNA, 103 bp, Artificial Sequence
  Synthetic Polynucleotide
taatacgactcactatagggctcctccatcttgtcgatgcgggccaggttaacagaggagaaacctgatgcgcatcgacaacctggcggcagcgcaaaagatg

SEQ ID NO: 123277 - DNA, 103 bp, Artificial Sequence
  Synthetic Polynucleotide
taatacgactcactatagggtgtgcatctcctcctccatcttgtcgatgcaacagaggagagcatcgatgagatggaggaacctggcggcagcgcaaaagatg

SEQ ID NO: 123278 - DNA, 103 bp, Artificial Sequence
  Synthetic Polynucleotide
taatacgactcactatagggctcttccacttgtgcatctcctcctccatcaacagaggagagatggaatgggagatgcaaacctggcggcagcgcaaaagatg

SEQ ID NO: 123279 - DNA, 103 bp, Artificial Sequence
  Synthetic Polynucleotide
taatacgactcactatagggcaggtccttcctcttccacttgtgcatctcaacagaggagagagatgatgaagtggaagaacctggcggcagcgcaaaagatg

SEQ ID NO: 123280 - DNA, 103 bp, Artificial Sequence
  Synthetic Polynucleotide
taatacgactcactatagggggatggcagccaggtccttcctcttccactaacagaggagaagtggaatgggaaggaccaacctggcggcagcgcaaaagatg

SEQ ID NO: 123281 - DNA, 103 bp, Artificial Sequence
  Synthetic Polynucleotide
taatacgactcactatagggatactccggtggatggcagccaggtccttcaacagaggagagaaggaatgggctgccataacctggcggcagcgcaaaagatg

SEQ ID NO: 123282 - DNA, 103 bp, Artificial Sequence
  Synthetic Polynucleotide
taatacgactcactatagggagggttggccatactccggtggatggcagcaacagaggagagctgccatgcaccggagtaacctggcggcagcgcaaaagatg

SEQ ID NO: 123283 - DNA, 103 bp, Artificial Sequence
  Synthetic Polynucleotide
taatacgactcactatagggccaactcctcagggttggccatactccggtaacagaggagaaccggaatgtggccaaccaacctggcggcagcgcaaaagatg

SEQ ID NO: 123284 - DNA, 103 bp, Artificial Sequence
  Synthetic Polynucleotide
taatacgactcactatagggtcatcgctggtggtggctagaagcctgtataacagaggagaatacagatgtctagccacaacctggcggcagcgcaaaagatg

SEQ ID NO: 123285 - DNA, 103 bp, Artificial Sequence
  Synthetic Polynucleotide
taatacgactcactatagggatcagcttgtccaactcctcagggttggccaacagaggagaggccaaatgtgaggagttaacctggcggcagcgcaaaagatg

SEQ ID NO: 123286 - DNA, 103 bp, Artificial Sequence
  Synthetic Polynucleotide
taatacgactcactatagggccggtcggagatcagcttgtccaactcctcaacagaggagagaggagatggacaagctgaacctggcggcagcgcaaaagatg

SEQ ID NO: 123287 - DNA, 103 bp, Artificial Sequence
  Synthetic Polynucleotide
taatacgactcactatagggagctttcaggccggtcggagatcagcttgtaacagaggagaacaagcatgtctccgaccaacctggcggcagcgcaaaagatg

SEQ ID NO: 123288 - DNA, 103 bp, Artificial Sequence
  Synthetic Polynucleotide
taatacgactcactataggggggcgccggcagctttcaggccggtcggagaacagaggagactccgaatggcctgaaagaacctggcggcagcgcaaaagatg

SEQ ID NO: 123289 - DNA, 103 bp, Artificial Sequence
  Synthetic Polynucleotide
taatacgactcactatagggcggtttgccggggcgccggcagctttcaggaacagaggagacctgaaatgtgccggcgcaacctggcggcagcgcaaaagatg

SEQ ID NO: 123290 - DNA, 103 bp, Artificial Sequence
  Synthetic Polynucleotide
taatacgactcactatagggctggttcccccggtttgccggggcgccggcaacagaggagagccggcatgccggcaaacaacctggcggcagcgcaaaagatg

SEQ ID NO: 123291 - DNA, 103 bp, Artificial Sequence
  Synthetic Polynucleotide
taatacgactcactatagggacgggggcctctggttcccccggtttgccgaacagaggagacggcaaatggggggaaccaacctggcggcagcgcaaaagatg

SEQ ID NO: 123292 - DNA, 103 bp, Artificial Sequence
  Synthetic Polynucleotide
taatacgactcactataggggtgagtcagcacgggggcctctggttccccaacagaggagaggggaaatggaggcccccaacctggcggcagcgcaaaagatg

SEQ ID NO: 123293 - DNA, 103 bp, Artificial Sequence
  Synthetic Polynucleotide
taatacgactcactatagggctgtggtggcgtgagtcagcacgggggcctaacagaggagaaggcccatgtgctgactcaacctggcggcagcgcaaaagatg

SEQ ID NO: 123294 - DNA, 103 bp, Artificial Sequence
  Synthetic Polynucleotide
taatacgactcactataggggccacggccactgtggtggcgtgagtcagcaacagaggagagctgacatgcgccaccacaacctggcggcagcgcaaaagatg

SEQ ID NO: 123295 - DNA, 103 bp, Artificial Sequence
  Synthetic Polynucleotide
taatacgactcactatagggcggggccggggaagccggtgcctctgccataacagaggagaatggcaatggcaccggctaacctggcggcagcgcaaaagatg

SEQ ID NO: 123296 - DNA, 103 bp, Artificial Sequence
  Synthetic Polynucleotide
taatacgactcactataggggagctccggcctttgcaggggccacgtacaaacagaggagatgtacgatgcccctgcaaaacctggcggcagcgcaaaagatg

SEQ ID NO: 123297 - DNA, 103 bp, Artificial Sequence
  Synthetic Polynucleotide
taatacgactcactatagggatcatcgtcctggacttcatccaactctgtaacagaggagaacagagatggatgaagtcaacctggcggcagcgcaaaagatg

SEQ ID NO: 123298 - DNA, 103 bp, Artificial Sequence
  Synthetic Polynucleotide
taatacgactcactatagggagagaggcgcatcatcgtcctggacttcataacagaggagaatgaagatgaggacgatgaacctggcggcagcgcaaaagatg

SEQ ID NO: 123299 - DNA, 103 bp, Artificial Sequence
  Synthetic Polynucleotide
taatacgactcactatagggagcatgggcgagagaggcgcatcatcgtccaacagaggagaggacgaatgtgcgcctctaacctggcggcagcgcaaaagatg

SEQ ID NO: 123300 - DNA, 103 bp, Artificial Sequence
  Synthetic Polynucleotide
taatacgactcactataggggctgctgtagagcatgggcgagagaggcgcaacagaggagagcgcctatgtcgcccatgaacctggcggcagcgcaaaagatg

SEQ ID NO: 123301 - DNA, 103 bp, Artificial Sequence
  Synthetic Polynucleotide
taatacgactcactatagggggctggctgagctgctgtagagcatgggcgaacagaggagacgcccaatgtctacagcaaacctggcggcagcgcaaaagatg

SEQ ID NO: 123302 - DNA, 103 bp, Artificial Sequence
  Synthetic Polynucleotide
taatacgactcactataggggaaggtgacaggctggctgagctgctgtagaacagaggagactacagatgctcagccagaacctggcggcagcgcaaaagatg

SEQ ID NO: 123303 - DNA, 103 bp, Artificial Sequence
  Synthetic Polynucleotide
taatacgactcactatagggcttgcttactgaaggtgacaggctggctgaaacagaggagatcagccatgctgtcacctaacctggcggcagcgcaaaagatg

SEQ ID NO: 123304 - DNA, 103 bp, Artificial Sequence
  Synthetic Polynucleotide
taatacgactcactatagggccgtgcacggcttgcttactgaaggtgacaaacagaggagatgtcacatgcagtaagcaaacctggcggcagcgcaaaagatg

SEQ ID NO: 123305 - DNA, 103 bp, Artificial Sequence
  Synthetic Polynucleotide
taatacgactcactatagggggcagttccaccgtgcacggcttgcttactaacagaggagaagtaagatggccgtgcacaacctggcggcagcgcaaaagatg

SEQ ID NO: 123306 - DNA, 103 bp, Artificial Sequence
  Synthetic Polynucleotide
taatacgactcactatagggagtcagccgtggcagttccaccgtgcacggaacagaggagaccgtgcatggtggaactgaacctggcggcagcgcaaaagatg

SEQ ID NO: 123307 - DNA, 103 bp, Artificial Sequence
  Synthetic Polynucleotide
taatacgactcactatagggggctcgcttggagctccggcctttgcagggaacagaggagaccctgcatgggccggagcaacctggcggcagcgcaaaagatg

SEQ ID NO: 123308 - DNA, 103 bp, Artificial Sequence
  Synthetic Polynucleotide
taatacgactcactatagggctgccatatcagtcagccgtggcagttccaaacagaggagatggaacatgcacggctgaaacctggcggcagcgcaaaagatg

SEQ ID NO: 123309 - DNA, 103 bp, Artificial Sequence
  Synthetic Polynucleotide
taatacgactcactatagggttcatggtgcctgccatatcagtcagccgtaacagaggagaacggctatgtgatatggcaacctggcggcagcgcaaaagatg

SEQ ID NO: 123310 - DNA, 103 bp, Artificial Sequence
  Synthetic Polynucleotide
taatacgactcactatagggatcattcagattcatggtgcctgccatatcaacagaggagagatatgatgggcaccatgaacctggcggcagcgcaaaagatg

SEQ ID NO: 123311 - DNA, 103 bp, Artificial Sequence
  Synthetic Polynucleotide
taatacgactcactatagggcagtcagcccatcattcagattcatggtgcaacagaggagagcaccaatgatctgaatgaacctggcggcagcgcaaaagatg

SEQ ID NO: 123312 - DNA, 103 bp, Artificial Sequence
  Synthetic Polynucleotide
taatacgactcactatagggatgaggttttcagtcagcccatcattcagaaacagaggagatctgaaatgtgggctgacaacctggcggcagcgcaaaagatg

SEQ ID NO: 123313 - DNA, 103 bp, Artificial Sequence
  Synthetic Polynucleotide
taatacgactcactatagggcaggtcgtccatgaggttttcagtcagcccaacagaggagagggctgatggaaaacctcaacctggcggcagcgcaaaagatg

SEQ ID NO: 123314 - DNA, 103 bp, Artificial Sequence
  Synthetic Polynucleotide
taatacgactcactatagggtgttatccagcaggtcgtccatgaggttttaacagaggagaaaaaccatgtggacgaccaacctggcggcagcgcaaaagatg

SEQ ID NO: 123315 - DNA, 103 bp, Artificial Sequence
  Synthetic Polynucleotide
taatacgactcactataggggggagcgtgatgttatccagcaggtcgtccaacagaggagaggacgaatggctggataaaacctggcggcagcgcaaaagatg

SEQ ID NO: 123316 - DNA, 103 bp, Artificial Sequence
  Synthetic Polynucleotide
taatacgactcactatagggctgggatggcgggagcgtgatgttatccagaacagaggagactggatatgatcacgctcaacctggcggcagcgcaaaagatg

SEQ ID NO: 123317 - DNA, 103 bp, Artificial Sequence
  Synthetic Polynucleotide
taatacgactcactatagggtgggcgatggctgggatggcgggagcgtgaaacagaggagatcacgcatgcgccatcccaacctggcggcagcgcaaaagatg

SEQ ID NO: 123318 - DNA, 103 bp, Artificial Sequence
  Synthetic Polynucleotide
taatacgactcactatagggggcttggcagggctcgcttggagctccggcaacagaggagagccggaatgccaagcgagaacctggcggcagcgcaaaagatg

SEQ ID NO: 123319 - DNA, 103 bp, Artificial Sequence
  Synthetic Polynucleotide
taatacgactcactatagggagtcccccagtgggcgatggctgggatggcaacagaggagagccatcatggccatcgccaacctggcggcagcgcaaaagatg

SEQ ID NO: 123320 - DNA, 103 bp, Artificial Sequence
  Synthetic Polynucleotide
taatacgactcactatagggccgctgcatgagtcccccagtgggcgatggaacagaggagaccatcgatgactgggggaaacctggcggcagcgcaaaagatg

SEQ ID NO: 123321 - DNA, 103 bp, Artificial Sequence
  Synthetic Polynucleotide
taatacgactcactatagggagctagagctccgctgcatgagtcccccagaacagaggagactggggatgtcatgcagcaacctggcggcagcgcaaaagatg

SEQ ID NO: 123322 - DNA, 103 bp, Artificial Sequence
  Synthetic Polynucleotide
taatacgactcactataggggtatacgggaagctagagctccgctgcatgaacagaggagacatgcaatggagctctagaacctggcggcagcgcaaaagatg

SEQ ID NO: 123323 - DNA, 103 bp, Artificial Sequence
  Synthetic Polynucleotide
taatacgactcactataggggcccttggtggtatacgggaagctagagctaacagaggagaagctctatgttcccgtataacctggcggcagcgcaaaagatg

SEQ ID NO: 123324 - DNA, 103 bp, Artificial Sequence
  Synthetic Polynucleotide
taatacgactcactatagggccaggcccgagcccttggtggtatacgggaaacagaggagatcccgtatgccaccaaggaacctggcggcagcgcaaaagatg

SEQ ID NO: 123325 - DNA, 103 bp, Artificial Sequence
  Synthetic Polynucleotide
taatacgactcactataggggttggggagcccaggcccgagcccttggtgaacagaggagacaccaaatgctcgggcctaacctggcggcagcgcaaaagatg

SEQ ID NO: 123326 - DNA, 103 bp, Artificial Sequence
  Synthetic Polynucleotide
taatacgactcactatagggaaaggagctggttggggagcccaggcccgaaacagaggagatcgggcatgggctccccaaacctggcggcagcgcaaaagatg

SEQ ID NO: 123327 - DNA, 103 bp, Artificial Sequence
  Synthetic Polynucleotide
taatacgactcactatagggccgtgctgttaaaggagctggttggggagcaacagaggagagctcccatgccagctcctaacctggcggcagcgcaaaagatg

SEQ ID NO: 123328 - DNA, 103 bp, Artificial Sequence
  Synthetic Polynucleotide
taatacgactcactatagggggtccgaacaccgtgctgttaaaggagctgaacagaggagacagctcatgtaacagcacaacctggcggcagcgcaaaagatg

SEQ ID NO: 123329 - DNA, 103 bp, Artificial Sequence
  Synthetic Polynucleotide
taatacgactcactatagggctcccccgagggcttggcagggctcgcttgaacagaggagacaagcgatgcctgccaagaacctggcggcagcgcaaaagatg

SEQ ID NO: 123330 - DNA, 103 bp, Artificial Sequence
  Synthetic Polynucleotide
taatacgactcactatagggcagagatgaaggtccgaacaccgtgctgttaacagaggagaaacagcatggtgttcggaaacctggcggcagcgcaaaagatg

SEQ ID NO: 123331 - DNA, 103 bp, Artificial Sequence
  Synthetic Polynucleotide
taatacgactcactataggggtagggagttcagagatgaaggtccgaacaaacagaggagatgttcgatgcttcatctcaacctggcggcagcgcaaaagatg

SEQ ID NO: 123332 - DNA, 103 bp, Artificial Sequence
  Synthetic Polynucleotide
taatacgactcactatagggggagactggcgtagggagttcagagatgaaaacagaggagattcatcatggaactccctaacctggcggcagcgcaaaagatg

SEQ ID NO: 123333 - DNA, 103 bp, Artificial Sequence
  Synthetic Polynucleotide
taatacgactcactatagggggtctgcatgggagactggcgtagggagttaacagaggagaaactccatgcgccagtctaacctggcggcagcgcaaaagatg

SEQ ID NO: 123334 - DNA, 103 bp, Artificial Sequence
  Synthetic Polynucleotide
taatacgactcactatagggtctcttggatggtctgcatgggagactggcaacagaggagagccagtatgccatgcagaaacctggcggcagcgcaaaagatg

SEQ ID NO: 123335 - DNA, 103 bp, Artificial Sequence
  Synthetic Polynucleotide
taatacgactcactataggggctggcttgttctcttggatggtctgcatgaacagaggagacatgcaatgcatccaagaaacctggcggcagcgcaaaagatg

SEQ ID NO: 123336 - DNA, 103 bp, Artificial Sequence
  Synthetic Polynucleotide
taatacgactcactatagggagagaaggtagctggcttgttctcttggataacagaggagaatccaaatgaacaagccaaacctggcggcagcgcaaaagatg

SEQ ID NO: 123337 - DNA, 103 bp, Artificial Sequence
  Synthetic Polynucleotide
taatacgactcactataggggtgacatggaagagaaggtagctggcttgtaacagaggagaacaagcatgctaccttctaacctggcggcagcgcaaaagatg

SEQ ID NO: 123338 - DNA, 103 bp, Artificial Sequence
  Synthetic Polynucleotide
taatacgactcactatagggttaccatagtgtgacatggaagagaaggtaaacagaggagataccttatgttccatgtcaacctggcggcagcgcaaaagatg

SEQ ID NO: 123339 - DNA, 103 bp, Artificial Sequence
  Synthetic Polynucleotide
taatacgactcactataggggagtgtctggttaccatagtgtgacatggaaacagaggagatccatgatgcactatggtaacctggcggcagcgcaaaagatg

SEQ ID NO: 123340 - DNA, 103 bp, Artificial Sequence
  Synthetic Polynucleotide
taatacgactcactatagggcggcggccgtctcccccgagggcttggcagaacagaggagactgccaatgcctcgggggaacctggcggcagcgcaaaagatg

SEQ ID NO: 123341 - DNA, 103 bp, Artificial Sequence
  Synthetic Polynucleotide
taatacgactcactataggggcaggtcctggagtgtctggttaccatagtaacagaggagaactatgatgaccagacacaacctggcggcagcgcaaaagatg

SEQ ID NO: 123342 - DNA, 103 bp, Artificial Sequence
  Synthetic Polynucleotide
taatacgactcactatagggtccgaagtgagcaggtcctggagtgtctggaacagaggagaccagacatgccaggacctaacctggcggcagcgcaaaagatg

SEQ ID NO: 123343 - DNA, 103 bp, Artificial Sequence
  Synthetic Polynucleotide
taatacgactcactataggggctaagtgagtccgaagtgagcaggtcctgaacagaggagacaggacatgctcacttcgaacctggcggcagcgcaaaagatg

SEQ ID NO: 123344 - DNA, 103 bp, Artificial Sequence
  Synthetic Polynucleotide
taatacgactcactatagggcatcgctgtggctaagtgagtccgaagtgaaacagaggagatcacttatgactcacttaaacctggcggcagcgcaaaagatg

SEQ ID NO: 123345 - DNA, 103 bp, Artificial Sequence
  Synthetic Polynucleotide
taatacgactcactataggggtcatcatgacatcgctgtggctaagtgagaacagaggagactcactatgccacagcgaaacctggcggcagcgcaaaagatg

SEQ ID NO: 123346 - DNA, 103 bp, Artificial Sequence
  Synthetic Polynucleotide
taatacgactcactataggggtccgactgtgtcatcatgacatcgctgtgaacagaggagacacagcatggtcatgatgaacctggcggcagcgcaaaagatg

SEQ ID NO: 123347 - DNA, 103 bp, Artificial Sequence
  Synthetic Polynucleotide
taatacgactcactatagggacatcaaggggtccgactgtgtcatcatgaaacagaggagatcatgaatgcacagtcggaacctggcggcagcgcaaaagatg

SEQ ID NO: 123348 - DNA, 103 bp, Artificial Sequence
  Synthetic Polynucleotide
taatacgactcactatagggctggcctgagacatcaaggggtccgactgtaacagaggagaacagtcatgccccttgataacctggcggcagcgcaaaagatg

SEQ ID NO: 123349 - DNA, 103 bp, Artificial Sequence
  Synthetic Polynucleotide
taatacgactcactatagggcacagcggtgctggcctgagacatcaagggaacagaggagacccttgatgtctcaggccaacctggcggcagcgcaaaagatg

SEQ ID NO: 123350 - DNA, 103 bp, Artificial Sequence
  Synthetic Polynucleotide
taatacgactcactatagggtctgggcagacacagcggtgctggcctgagaacagaggagactcaggatggcaccgctgaacctggcggcagcgcaaaagatg

SEQ ID NO: 123351 - DNA, 103 bp, Artificial Sequence
  Synthetic Polynucleotide
taatacgactcactatagggatcatggagtcggcggccgtctcccccgagaacagaggagactcgggatggacggccgcaacctggcggcagcgcaaaagatg

SEQ ID NO: 123352 - DNA, 103 bp, Artificial Sequence
  Synthetic Polynucleotide
taatacgactcactatagggcggcgggaattctgggcagacacagcggtgaacagaggagacaccgcatggtctgcccaaacctggcggcagcgcaaaagatg

SEQ ID NO: 123353 - DNA, 103 bp, Artificial Sequence
  Synthetic Polynucleotide
taatacgactcactatagggcatcacgttccggcgggaattctgggcagaaacagaggagatctgccatgaattcccgcaacctggcggcagcgcaaaagatg

SEQ ID NO: 123354 - DNA, 103 bp, Artificial Sequence
  Synthetic Polynucleotide
taatacgactcactatagggcattgcgaagcatcacgttccggcgggaataacagaggagaattcccatgggaacgtgaaacctggcggcagcgcaaaagatg

SEQ ID NO: 123355 - DNA, 103 bp, Artificial Sequence
  Synthetic Polynucleotide
taatacgactcactatagggatcatcggatcattgcgaagcatcacgttcaacagaggagagaacgtatggcttcgcaaaacctggcggcagcgcaaaagatg

SEQ ID NO: 123356 - DNA, 103 bp, Artificial Sequence
  Synthetic Polynucleotide
taatacgactcactatagggagcaaaggacatcatcggatcattgcgaagaacagaggagacttcgcatggatccgatgaacctggcggcagcgcaaaagatg

SEQ ID NO: 123357 - DNA, 103 bp, Artificial Sequence
  Synthetic Polynucleotide
taatacgactcactatagggtaggctgggcagcaaaggacatcatcggataacagaggagaatccgaatgtgtcctttgaacctggcggcagcgcaaaagatg

SEQ ID NO: 123358 - DNA, 103 bp, Artificial Sequence
  Synthetic Polynucleotide
taatacgactcactatagggcttccctggttaggctgggcagcaaaggacaacagaggagagtccttatgtgcccagccaacctggcggcagcgcaaaagatg

SEQ ID NO: 123359 - DNA, 103 bp, Artificial Sequence
  Synthetic Polynucleotide
taatacgactcactatagggattgaccaaacttccctggttaggctgggcaacagaggagagcccagatgaaccagggaaacctggcggcagcgcaaaagatg

SEQ ID NO: 123360 - DNA, 103 bp, Artificial Sequence
  Synthetic Polynucleotide
taatacgactcactataggggcaagttctgattgaccaaacttccctggtaacagaggagaaccaggatggtttggtcaaacctggcggcagcgcaaaagatg

SEQ ID NO: 123361 - DNA, 103 bp, Artificial Sequence
  Synthetic Polynucleotide
taatacgactcactatagggtggtggtggagcaagttctgattgaccaaaaacagaggagatttggtatgtcagaacttaacctggcggcagcgcaaaagatg

SEQ ID NO: 123362 - DNA, 103 bp, Artificial Sequence
  Synthetic Polynucleotide
taatacgactcactatagggctcctcggggatcatggagtcggcggccgtaacagaggagaacggccatggactccatgaacctggcggcagcgcaaaagatg

SEQ ID NO: 123363 - DNA, 103 bp, Artificial Sequence
  Synthetic Polynucleotide
taatacgactcactatagggggtttggtgctggtggtggagcaagttctgaacagaggagacagaacatgctccaccacaacctggcggcagcgcaaaagatg

SEQ ID NO: 123364 - DNA, 103 bp, Artificial Sequence
  Synthetic Polynucleotide
taatacgactcactataggggagcgccctgggtttggtgctggtggtggaaacagaggagatccaccatgagcaccaaaaacctggcggcagcgcaaaagatg

SEQ ID NO: 123365 - DNA, 103 bp, Artificial Sequence
  Synthetic Polynucleotide
taatacgactcactatagggctgccaccaagagcgccctgggtttggtgcaacagaggagagcaccaatgccagggcgcaacctggcggcagcgcaaaagatg

SEQ ID NO: 123366 - DNA, 103 bp, Artificial Sequence
  Synthetic Polynucleotide
taatacgactcactatagggcaaggcacggctgccaccaagagcgccctgaacagaggagacagggcatgcttggtggcaacctggcggcagcgcaaaagatg

SEQ ID NO: 123367 - DNA, 103 bp, Artificial Sequence
  Synthetic Polynucleotide
taatacgactcactatagggcagaattcgacaaggcacggctgccaccaaaacagaggagattggtgatggccgtgcctaacctggcggcagcgcaaaagatg

SEQ ID NO: 123368 - DNA, 103 bp, Artificial Sequence
  Synthetic Polynucleotide
taatacgactcactatagggatgttgctgacagaattcgacaaggcacggaacagaggagaccgtgcatggtcgaattcaacctggcggcagcgcaaaagatg

SEQ ID NO: 123369 - DNA, 103 bp, Artificial Sequence
  Synthetic Polynucleotide
taatacgactcactatagggactcaagcccatgttgctgacagaattcgaaacagaggagatcgaatatggtcagcaacaacctggcggcagcgcaaaagatg

SEQ ID NO: 123370 - DNA, 103 bp, Artificial Sequence
  Synthetic Polynucleotide
taatacgactcactatagggtgctggactcactcaagcccatgttgctgaaacagaggagatcagcaatgtgggcttgaaacctggcggcagcgcaaaagatg

SEQ ID NO: 123371 - DNA, 103 bp, Artificial Sequence
  Synthetic Polynucleotide
taatacgactcactataggggacccaaggctgctggactcactcaagcccaacagaggagagggcttatgtgagtccagaacctggcggcagcgcaaaagatg

SEQ ID NO: 123372 - DNA, 103 bp, Artificial Sequence
  Synthetic Polynucleotide
taatacgactcactataggggtgtttggctgacccaaggctgctggactcaacagaggagagagtccatgagccttgggaacctggcggcagcgcaaaagatg

SEQ ID NO: 123373 - DNA, 103 bp, Artificial Sequence
  Synthetic Polynucleotide
taatacgactcactatagggcatcgtcctcctcctcggggatcatggagtaacagaggagaactccaatgtccccgaggaacctggcggcagcgcaaaagatg

SEQ ID NO: 123374 - DNA, 103 bp, Artificial Sequence
  Synthetic Polynucleotide
taatacgactcactatagggactgctgctggtgtttggctgacccaaggcaacagaggagagccttgatgcagccaaacaacctggcggcagcgcaaaagatg

SEQ ID NO: 123375 - DNA, 103 bp, Artificial Sequence
  Synthetic Polynucleotide
taatacgactcactatagggctgacaggagactgctgctggtgtttggctaacagaggagaagccaaatgccagcagcaaacctggcggcagcgcaaaagatg

SEQ ID NO: 123376 - DNA, 103 bp, Artificial Sequence
  Synthetic Polynucleotide
taatacgactcactatagggcatagactggctgacaggagactgctgctgaacagaggagacagcagatgtctcctgtcaacctggcggcagcgcaaaagatg

SEQ ID NO: 123377 - DNA, 103 bp, Artificial Sequence
  Synthetic Polynucleotide
taatacgactcactatagggagagggtttgcatagactggctgacaggagaacagaggagactcctgatggccagtctaaacctggcggcagcgcaaaagatg

SEQ ID NO: 123378 - DNA, 103 bp, Artificial Sequence
  Synthetic Polynucleotide
taatacgactcactatagggagagagtccgagagggtttgcatagactggaacagaggagaccagtcatggcaaaccctaacctggcggcagcgcaaaagatg

SEQ ID NO: 123379 - DNA, 103 bp, Artificial Sequence
  Synthetic Polynucleotide
taatacgactcactatagggggagcctgagagagagtccgagagggtttgaacagaggagacaaaccatgtcggactctaacctggcggcagcgcaaaagatg

SEQ ID NO: 123380 - DNA, 103 bp, Artificial Sequence
  Synthetic Polynucleotide
taatacgactcactatagggagtacaaggaggagcctgagagagagtccgaacagaggagacggactatgtctcaggctaacctggcggcagcgcaaaagatg

SEQ ID NO: 123381 - DNA, 103 bp, Artificial Sequence
  Synthetic Polynucleotide
taatacgactcactataggggcactagttgagtacaaggaggagcctgagaacagaggagactcaggatgctccttgtaaacctggcggcagcgcaaaagatg

SEQ ID NO: 123382 - DNA, 103 bp, Artificial Sequence
  Synthetic Polynucleotide
taatacgactcactataggggggcaggtttgcactagttgagtacaaggaaacagaggagatccttgatgtcaactagtaacctggcggcagcgcaaaagatg

SEQ ID NO: 123383 - DNA, 103 bp, Artificial Sequence
  Synthetic Polynucleotide
taatacgactcactatagggggcccatgacgggcaggtttgcactagttgaacagaggagacaactaatgcaaacctgcaacctggcggcagcgcaaaagatg

SEQ ID NO: 123384 - DNA, 103 bp, Artificial Sequence
  Synthetic Polynucleotide
taatacgactcactatagggtcgtcgtcttcatcgtcctcctcctcggggaacagaggagaccccgaatgggaggacgaaacctggcggcagcgcaaaagatg

SEQ ID NO: 123385 - DNA, 103 bp, Artificial Sequence
  Synthetic Polynucleotide
taatacgactcactatagggaacttctcatggcccatgacgggcaggtttaacagaggagaaaacctatgcgtcatgggaacctggcggcagcgcaaaagatg

SEQ ID NO: 123386 - DNA, 103 bp, Artificial Sequence
  Synthetic Polynucleotide
taatacgactcactataggggtcgctggggaacttctcatggcccatgacaacagaggagagtcatgatgcatgagaagaacctggcggcagcgcaaaagatg

SEQ ID NO: 123387 - DNA, 103 bp, Artificial Sequence
  Synthetic Polynucleotide
taatacgactcactatagggccaggtccaagtcgctggggaacttctcataacagaggagaatgagaatgtccccagcgaacctggcggcagcgcaaaagatg

SEQ ID NO: 123388 - DNA, 103 bp, Artificial Sequence
  Synthetic Polynucleotide
taatacgactcactatagggttgaacatgtccaggtccaagtcgctggggaacagaggagaccccagatgcttggacctaacctggcggcagcgcaaaagatg

SEQ ID NO: 123389 - DNA, 103 bp, Artificial Sequence
  Synthetic Polynucleotide
taatacgactcactatagggcaagctcccattgaacatgtccaggtccaaaacagaggagattggacatggacatgttcaacctggcggcagcgcaaaagatg

SEQ ID NO: 123390 - DNA, 103 bp, Artificial Sequence
  Synthetic Polynucleotide
taatacgactcactatagggtgtcacattccaagctcccattgaacatgtaacagaggagaacatgtatgatgggagctaacctggcggcagcgcaaaagatg

SEQ ID NO: 123391 - DNA, 103 bp, Artificial Sequence
  Synthetic Polynucleotide
taatacgactcactatagggatggactccatgtcacattccaagctcccaaacagaggagatgggagatgggaatgtgaaacctggcggcagcgcaaaagatg

SEQ ID NO: 123392 - DNA, 103 bp, Artificial Sequence
  Synthetic Polynucleotide
taatacgactcactatagggactacggataatggactccatgtcacattcaacagaggagagaatgtatgatggagtccaacctggcggcagcgcaaaagatg

SEQ ID NO: 123393 - DNA, 103 bp, Artificial Sequence
  Synthetic Polynucleotide
taatacgactcactatagggccatgagttcactacggataatggactccaaacagaggagatggagtatgttatccgtaaacctggcggcagcgcaaaagatg

SEQ ID NO: 123394 - DNA, 103 bp, Artificial Sequence
  Synthetic Polynucleotide
taatacgactcactatagggccatcagcatccatgagttcactacggataaacagaggagatatccgatgtgaactcataacctggcggcagcgcaaaagatg

SEQ ID NO: 123395 - DNA, 103 bp, Artificial Sequence
  Synthetic Polynucleotide
taatacgactcactatagggcccgccgtcctcgtcgtcttcatcgtcctcaacagaggagagaggacatggaagacgacaacctggcggcagcgcaaaagatg

SEQ ID NO: 123396 - DNA, 103 bp, Artificial Sequence
  Synthetic Polynucleotide
taatacgactcactatagggaaaatccaacccatcagcatccatgagttcaacagaggagagaactcatggatgctgataacctggcggcagcgcaaaagatg

SEQ ID NO: 123397 - DNA, 103 bp, Artificial Sequence
  Synthetic Polynucleotide
taatacgactcactatagggaatcaaagttaaaatccaacccatcagcataacagaggagaatgctgatgggttggattaacctggcggcagcgcaaaagatg

SEQ ID NO: 123398 - DNA, 103 bp, Artificial Sequence
  Synthetic Polynucleotide
taatacgactcactataggggagatgagggaatcaaagttaaaatccaacaacagaggagagttggaatgtaactttgaaacctggcggcagcgcaaaagatg

SEQ ID NO: 123399 - DNA, 103 bp, Artificial Sequence
  Synthetic Polynucleotide
taatacgactcactatagggattctgtgtggagatgagggaatcaaagttaacagaggagaaactttatgtccctcatcaacctggcggcagcgcaaaagatg

SEQ ID NO: 123400 - DNA, 103 bp, Artificial Sequence
  Synthetic Polynucleotide
taatacgactcactatagggaaccaacaacattctgtgtggagatgagggaacagaggagaccctcaatgccacacagaaacctggcggcagcgcaaaagatg

SEQ ID NO: 123401 - DNA, 103 bp, Artificial Sequence
  Synthetic Polynucleotide
taatacgactcactatagggcccacgttcaaaccaacaacattctgtgtgaacagaggagacacacaatgtgttgttggaacctggcggcagcgcaaaagatg

SEQ ID NO: 123402 - DNA, 103 bp, Artificial Sequence
  Synthetic Polynucleotide
taatacgactcactatagggagtgaagttccccacgttcaaaccaacaacaacagaggagagttgttatgttgaacgtgaacctggcggcagcgcaaaagatg

SEQ ID NO: 123403 - DNA, 103 bp, Artificial Sequence
  Synthetic Polynucleotide
taatacgactcactataggggcttagcaccagtgaagttccccacgttcaaacagaggagatgaacgatgggaacttcaaacctggcggcagcgcaaaagatg

SEQ ID NO: 123404 - DNA, 103 bp, Artificial Sequence
  Synthetic Polynucleotide
taatacgactcactataggggatgaggcctgcttagcaccagtgaagttcaacagaggagagaacttatgtggtgctaaaacctggcggcagcgcaaaagatg

SEQ ID NO: 123405 - DNA, 103 bp, Artificial Sequence
  Synthetic Polynucleotide
taatacgactcactatagggccagctctgagatgaggcctgcttagcaccaacagaggagaggtgctatgcaggcctcaaacctggcggcagcgcaaaagatg

SEQ ID NO: 123406 - DNA, 103 bp, Artificial Sequence
  Synthetic Polynucleotide
taatacgactcactataggggcggagagagcggggccggggaagccggtgaacagaggagacaccggatgccccggcccaacctggcggcagcgcaaaagatg

SEQ ID NO: 123407 - DNA, 103 bp, Artificial Sequence
  Synthetic Polynucleotide
taatacgactcactatagggcggcccgtcccccgccgtcctcgtcgtcttaacagaggagaaagacgatgaggacggcgaacctggcggcagcgcaaaagatg

SEQ ID NO: 123408 - DNA, 103 bp, Artificial Sequence
  Synthetic Polynucleotide
taatacgactcactatagggagcctggcacccagctctgagatgaggcctaacagaggagaaggcctatgctcagagctaacctggcggcagcgcaaaagatg

SEQ ID NO: 123409 - DNA, 103 bp, Artificial Sequence
  Synthetic Polynucleotide
taatacgactcactatagggatggccgagccggcccgtcccccgccgtccaacagaggagaggacggatggggacgggcaacctggcggcagcgcaaaagatg

SEQ ID NO: 123410 - DNA, 103 bp, Artificial Sequence
  Synthetic Polynucleotide
taatacgactcactataggggccgatcgccatggccgagccggcccgtccaacagaggagaggacggatgggctcggccaacctggcggcagcgcaaaagatg

SEQ ID NO: 123411 - DNA, 103 bp, Artificial Sequence
  Synthetic Polynucleotide
taatacgactcactatagggcgccgccgccgccgatcgccatggccgagcaacagaggagagctcggatgtggcgatcgaacctggcggcagcgcaaaagatg

SEQ ID NO: 123412 - DNA, 103 bp, Artificial Sequence
  Synthetic Polynucleotide
taatacgactcactataggggtgccgctcccgccgccgccgccgatcgccaacagaggagaggcgatatgcggcggcggaacctggcggcagcgcaaaagatg

SEQ ID NO: 123413 - DNA, 103 bp, Artificial Sequence
  Synthetic Polynucleotide
taatacgactcactatagggggagcccagcgtgccgctcccgccgccgccaacagaggagaggcggcatggggagcggcaacctggcggcagcgcaaaagatg

SEQ ID NO: 123414 - DNA, 103 bp, Artificial Sequence
  Synthetic Polynucleotide
taatacgactcactatagggggagcagcccggagcccagcgtgccgctccaacagaggagaggagcgatgcgctgggctaacctggcggcagcgcaaaagatg

SEQ ID NO: 123415 - DNA, 103 bp, Artificial Sequence
  Synthetic Polynucleotide
taatacgactcactataggggagtcctcaaggagcagcccggagcccagcaacagaggagagctgggatgcgggctgctaacctggcggcagcgcaaaagatg

SEQ ID NO: 123416 - DNA, 103 bp, Artificial Sequence
  Synthetic Polynucleotide
taatacgactcactatagggcacccgggccgagtcctcaaggagcagcccaacagaggagagggctgatgcttgaggacaacctggcggcagcgcaaaagatg

SEQ ID NO: 123417 - DNA, 103 bp, Artificial Sequence
  Synthetic Polynucleotide
taatacgactcactatagggcgggtgccagcacccgggccgagtcctcaaaacagaggagattgaggatgcggcccgggaacctggcggcagcgcaaaagatg

SEQ ID NO: 123418 - DNA, 103 bp, Artificial Sequence
  Synthetic Polynucleotide
taatacgactcactatagggtccacttcgagcggagagagcggggccgggaacagaggagacccggcatggctctctccaacctggcggcagcgcaaaagatg

SEQ ID NO: 123419 - DNA, 103 bp, Artificial Sequence
  Synthetic Polynucleotide
taatacgactcactatagggtcttgccctccgggtgccagcacccgggccaacagaggagaggcccgatggctggcaccaacctggcggcagcgcaaaagatg

SEQ ID NO: 123420 - DNA, 103 bp, Artificial Sequence
  Synthetic Polynucleotide
taatacgactcactatagggagacccggggtcttgccctccgggtgccagaacagaggagactggcaatgggagggcaaaacctggcggcagcgcaaaagatg

SEQ ID NO: 123421 - DNA, 103 bp, Artificial Sequence
  Synthetic Polynucleotide
taatacgactcactatagggtggctggcccagacccggggtcttgccctcaacagaggagagagggcatgaccccgggtaacctggcggcagcgcaaaagatg

SEQ ID NO: 123422 - DNA, 103 bp, Artificial Sequence
  Synthetic Polynucleotide
taatacgactcactatagggcccgccgcggtggctggcccagacccggggaacagaggagaccccggatgtgggccagcaacctggcggcagcgcaaaagatg

SEQ ID NO: 123423 - DNA, 103 bp, Artificial Sequence
  Synthetic Polynucleotide
taatacgactcactataggggctcagcccgcccgccgcggtggctggcccaacagaggagagggccaatgaccgcggcgaacctggcggcagcgcaaaagatg

SEQ ID NO: 123424 - DNA, 103 bp, Artificial Sequence
  Synthetic Polynucleotide
taatacgactcactataggggtgtacccccgctcagcccgcccgccgcggaacagaggagaccgcggatggcgggctgaaacctggcggcagcgcaaaagatg

SEQ ID NO: 123425 - DNA, 103 bp, Artificial Sequence
  Synthetic Polynucleotide
taatacgactcactatagggagcagcgcctgtgtacccccgctcagcccgaacagaggagacgggctatgcgggggtacaacctggcggcagcgcaaaagatg

SEQ ID NO: 123426 - DNA, 103 bp, Artificial Sequence
  Synthetic Polynucleotide
taatacgactcactatagggctgaggctgcagcagcgcctgtgtacccccaacagaggagagggggtatgcaggcgctgaacctggcggcagcgcaaaagatg

SEQ ID NO: 123427 - DNA, 103 bp, Artificial Sequence
  Synthetic Polynucleotide
taatacgactcactataggggcagcggttgctgaggctgcagcagcgcctaacagaggagaaggcgcatgtgcagcctcaacctggcggcagcgcaaaagatg

SEQ ID NO: 123428 - DNA, 103 bp, Artificial Sequence
  Synthetic Polynucleotide
taatacgactcactatagggtgcggcggtggcagcggttgctgaggctgcaacagaggagagcagccatggcaaccgctaacctggcggcagcgcaaaagatg

SEQ ID NO: 123429 - DNA, 103 bp, Artificial Sequence
  Synthetic Polynucleotide
taatacgactcactatagggcgggtccagctccacttcgagcggagagagaacagaggagactctctatgctcgaagtgaacctggcggcagcgcaaaagatg

SEQ ID NO: 123430 - DNA, 103 bp, Artificial Sequence
  Synthetic Polynucleotide
taatacgactcactatagggcgcccccggctgcggcggtggcagcggttgaacagaggagacaaccgatgccaccgccgaacctggcggcagcgcaaaagatg

SEQ ID NO: 123431 - DNA, 103 bp, Artificial Sequence
  Synthetic Polynucleotide
taatacgactcactatagggagcccccagccgcccccggctgcggcggtgaacagaggagacaccgcatgagccgggggaacctggcggcagcgcaaaagatg

SEQ ID NO: 123432 - DNA, 103 bp, Artificial Sequence
  Synthetic Polynucleotide
taatacgactcactatagggggctgcccggagcccccagccgcccccggcaacagaggagagccgggatgggctgggggaacctggcggcagcgcaaaagatg

SEQ ID NO: 123433 - DNA, 103 bp, Artificial Sequence
  Synthetic Polynucleotide
taatacgactcactatagggacatttcctcggctgcccggagcccccagcaacagaggagagctgggatgtccgggcagaacctggcggcagcgcaaaagatg

SEQ ID NO: 123434 - DNA, 103 bp, Artificial Sequence
  Synthetic Polynucleotide
taatacgactcactataggggccgcgacgaacatttcctcggctgcccggaacagaggagaccgggcatgcgaggaaataacctggcggcagcgcaaaagatg

SEQ ID NO: 123435 - DNA, 103 bp, Artificial Sequence
  Synthetic Polynucleotide
taatacgactcactatagggcaggcgttccgccgcgacgaacatttcctcaacagaggagagaggaaatgttcgtcgcgaacctggcggcagcgcaaaagatg

SEQ ID NO: 123436 - DNA, 103 bp, Artificial Sequence
  Synthetic Polynucleotide
taatacgactcactatagggcaggtttccccaggcgttccgccgcgacgaaacagaggagatcgtcgatgcggaacgccaacctggcggcagcgcaaaagatg

SEQ ID NO: 123437 - DNA, 103 bp, Artificial Sequence
  Synthetic Polynucleotide
taatacgactcactatagggccgcgtaggacaggtttccccaggcgttccaacagaggagaggaacgatgggggaaaccaacctggcggcagcgcaaaagatg

SEQ ID NO: 123438 - DNA, 103 bp, Artificial Sequence
  Synthetic Polynucleotide
taatacgactcactataggggtgatcaggtccgcgtaggacaggtttcccaacagaggagagggaaaatggtcctacgcaacctggcggcagcgcaaaagatg

SEQ ID NO: 123439 - DNA, 103 bp, Artificial Sequence
  Synthetic Polynucleotide
taatacgactcactataggggatggcgcgggtgatcaggtccgcgtaggaaacagaggagatcctacatggacctgatcaacctggcggcagcgcaaaagatg

SEQ ID NO: 123440 - DNA, 103 bp, Artificial Sequence
  Synthetic Polynucleotide
taatacgactcactataggggctcgaactccgggtccagctccacttcgaaacagaggagatcgaagatgagctggaccaacctggcggcagcgcaaaagatg

SEQ ID NO: 123441 - DNA, 103 bp, Artificial Sequence
  Synthetic Polynucleotide
taatacgactcactataggggggagctctcgatggcgcgggtgatcaggtaacagaggagaacctgaatgcccgcgccaaacctggcggcagcgcaaaagatg

SEQ ID NO: 123442 - DNA, 103 bp, Artificial Sequence
  Synthetic Polynucleotide
taatacgactcactatagggcgtttgtccggggagctctcgatggcgcggaacagaggagaccgcgcatgcgagagctcaacctggcggcagcgcaaaagatg

SEQ ID NO: 123443 - DNA, 103 bp, Artificial Sequence
  Synthetic Polynucleotide
taatacgactcactatagggcagagtgagccgtttgtccggggagctctcaacagaggagagagagcatgccggacaaaaacctggcggcagcgcaaaagatg

SEQ ID NO: 123444 - DNA, 103 bp, Artificial Sequence
  Synthetic Polynucleotide
taatacgactcactatagggagatctgggacagagtgagccgtttgtccgaacagaggagacggacaatgggctcactcaacctggcggcagcgcaaaagatg

SEQ ID NO: 123445 - DNA, 103 bp, Artificial Sequence
  Synthetic Polynucleotide
taatacgactcactatagggatccactcgtagatctgggacagagtgagcaacagaggagagctcacatggtcccagataacctggcggcagcgcaaaagatg

SEQ ID NO: 123446 - DNA, 103 bp, Artificial Sequence
  Synthetic Polynucleotide
taatacgactcactataggggcaacgcaccatccactcgtagatctgggaaacagaggagatcccagatgtacgagtggaacctggcggcagcgcaaaagatg

SEQ ID NO: 123447 - DNA, 103 bp, Artificial Sequence
  Synthetic Polynucleotide
taatacgactcactatagggagtagggcacgcaacgcaccatccactcgtaacagaggagaacgagtatgtggtgcgttaacctggcggcagcgcaaaagatg

SEQ ID NO: 123448 - DNA, 103 bp, Artificial Sequence
  Synthetic Polynucleotide
taatacgactcactatagggttatccttgaagtagggcacgcaacgcaccaacagaggagaggtgcgatgcgtgccctaaacctggcggcagcgcaaaagatg

SEQ ID NO: 123449 - DNA, 103 bp, Artificial Sequence
  Synthetic Polynucleotide
taatacgactcactataggggctgtcgcccttatccttgaagtagggcacaacagaggagagtgcccatgttcaaggataacctggcggcagcgcaaaagatg

SEQ ID NO: 123450 - DNA, 103 bp, Artificial Sequence
  Synthetic Polynucleotide
taatacgactcactatagggcagagctgttgctgtcgcccttatccttgaaacagaggagatcaaggatgagggcgacaaacctggcggcagcgcaaaagatg

SEQ ID NO: 123451 - DNA, 103 bp, Artificial Sequence
  Synthetic Polynucleotide
taatacgactcactatagggcggctctggggctcgaactccgggtccagcaacagaggagagctggaatgggagttcgaaacctggcggcagcgcaaaagatg

SEQ ID NO: 123452 - DNA, 103 bp, Artificial Sequence
  Synthetic Polynucleotide
taatacgactcactatagggttccagccggcagagctgttgctgtcgcccaacagaggagagggcgaatgcaacagctcaacctggcggcagcgcaaaagatg

SEQ ID NO: 123453 - DNA, 103 bp, Artificial Sequence
  Synthetic Polynucleotide
taatacgactcactataggggatggagttcttccagccggcagagctgttaacagaggagaaacagcatggccggctggaacctggcggcagcgcaaaagatg

SEQ ID NO: 123454 - DNA, 103 bp, Artificial Sequence
  Synthetic Polynucleotide
taatacgactcactatagggggttgtgccggatggagttcttccagccggaacagaggagaccggctatgagaactccaaacctggcggcagcgcaaaagatg

SEQ ID NO: 123455 - DNA, 103 bp, Artificial Sequence
  Synthetic Polynucleotide
taatacgactcactatagggtgcagtgacaggttgtgccggatggagttcaacagaggagagaactcatgccggcacaaaacctggcggcagcgcaaaagatg

SEQ ID NO: 123456 - DNA, 103 bp, Artificial Sequence
  Synthetic Polynucleotide
taatacgactcactataggggaatcgactatgcagtgacaggttgtgccgaacagaggagacggcacatgctgtcactgaacctggcggcagcgcaaaagatg

SEQ ID NO: 123457 - DNA, 103 bp, Artificial Sequence
  Synthetic Polynucleotide
taatacgactcactatagggggacccgcatgaatcgactatgcagtgacaaacagaggagatgtcacatgatagtcgataacctggcggcagcgcaaaagatg

SEQ ID NO: 123458 - DNA, 103 bp, Artificial Sequence
  Synthetic Polynucleotide
taatacgactcactatagggccctcattctggacccgcatgaatcgactaaacagaggagatagtcgatgcatgcgggtaacctggcggcagcgcaaaagatg

SEQ ID NO: 123459 - DNA, 103 bp, Artificial Sequence
  Synthetic Polynucleotide
taatacgactcactatagggcttgccagttccctcattctggacccgcataacagaggagaatgcggatgcagaatgagaacctggcggcagcgcaaaagatg

SEQ ID NO: 123460 - DNA, 103 bp, Artificial Sequence
  Synthetic Polynucleotide
taatacgactcactatagggaccaagagctcttgccagttccctcattctaacagaggagaagaatgatggaactggcaaacctggcggcagcgcaaaagatg

SEQ ID NO: 123461 - DNA, 103 bp, Artificial Sequence
  Synthetic Polynucleotide
taatacgactcactatagggttgatgatccaccaagagctcttgccagttaacagaggagaaactggatggagctcttgaacctggcggcagcgcaaaagatg

SEQ ID NO: 123462 - DNA, 103 bp, Artificial Sequence
  Synthetic Polynucleotide
taatacgactcactatagggggatcgcggacggctctggggctcgaactcaacagaggagagagttcatgccccagagcaacctggcggcagcgcaaaagatg

SEQ ID NO: 123463 - DNA, 103 bp, Artificial Sequence
  Synthetic Polynucleotide
taatacgactcactatagggcccatcagggttgatgatccaccaagagctaacagaggagaagctctatgtggatcatcaacctggcggcagcgcaaaagatg

SEQ ID NO: 123464 - DNA, 103 bp, Artificial Sequence
  Synthetic Polynucleotide
taatacgactcactatagggcgctcttccccccatcagggttgatgatccaacagaggagaggatcaatgaccctgatgaacctggcggcagcgcaaaagatg

SEQ ID NO: 123465 - DNA, 103 bp, Artificial Sequence
  Synthetic Polynucleotide
taatacgactcactatagggggggcttttccgctcttccccccatcagggaacagaggagaccctgaatgggggaagagaacctggcggcagcgcaaaagatg

SEQ ID NO: 123466 - DNA, 103 bp, Artificial Sequence
  Synthetic Polynucleotide
taatacgactcactatagggccgccgccggggggcttttccgctcttcccaacagaggagagggaagatgggaaaagccaacctggcggcagcgcaaaagatg

SEQ ID NO: 123467 - DNA, 103 bp, Artificial Sequence
  Synthetic Polynucleotide
taatacgactcactatagggtggagacagcccgccgccggggggcttttcaacagaggagagaaaagatgcccggcggcaacctggcggcagcgcaaaagatg

SEQ ID NO: 123468 - DNA, 103 bp, Artificial Sequence
  Synthetic Polynucleotide
taatacgactcactatagggctattgtccatggagacagcccgccgccggaacagaggagaccggcgatgggctgtctcaacctggcggcagcgcaaaagatg

SEQ ID NO: 123469 - DNA, 103 bp, Artificial Sequence
  Synthetic Polynucleotide
taatacgactcactatagggatacttgttgctattgtccatggagacagcaacagaggagagctgtcatgatggacaataacctggcggcagcgcaaaagatg

SEQ ID NO: 123470 - DNA, 103 bp, Artificial Sequence
  Synthetic Polynucleotide
taatacgactcactatagggggctcttggtatacttgttgctattgtccaaacagaggagatggacaatggcaacaagtaacctggcggcagcgcaaaagatg

SEQ ID NO: 123471 - DNA, 103 bp, Artificial Sequence
  Synthetic Polynucleotide
taatacgactcactataggggcgcggccacggctcttggtatacttgttgaacagaggagacaacaaatgtaccaagagaacctggcggcagcgcaaaagatg

SEQ ID NO: 123472 - DNA, 103 bp, Artificial Sequence
  Synthetic Polynucleotide
taatacgactcactatagggcttcttggctgcgcggccacggctcttggtaacagaggagaaccaagatgcgtggccgcaacctggcggcagcgcaaaagatg

SEQ ID NO: 123473 - DNA, 103 bp, Artificial Sequence
  Synthetic Polynucleotide
taatacgactcactataggggccacgtacaggatcgcggacggctctgggaacagaggagacccagaatggtccgcgataacctggcggcagcgcaaaagatg

SEQ ID NO: 123474 - DNA, 103 bp, Artificial Sequence
  Synthetic Polynucleotide
taatacgactcactataggggggctgccttcttcttggctgcgcggccacaacagaggagagtggccatgcagccaagaaacctggcggcagcgcaaaagatg

SEQ ID NO: 123475 - DNA, 103 bp, Artificial Sequence
  Synthetic Polynucleotide
taatacgactcactataggggctgtctgcagggctgccttcttcttggctaacagaggagaagccaaatggaaggcagcaacctggcggcagcgcaaaagatg

SEQ ID NO: 123476 - DNA, 103 bp, Artificial Sequence
  Synthetic Polynucleotide
taatacgactcactatagggtgattcgggggctgtctgcagggctgccttaacagaggagaaaggcaatgctgcagacaaacctggcggcagcgcaaaagatg

SEQ ID NO: 123477 - DNA, 103 bp, Artificial Sequence
  Synthetic Polynucleotide
taatacgactcactatagggtgtcgtcagctgattcgggggctgtctgcaaacagaggagatgcagaatgcccccgaataacctggcggcagcgcaaaagatg

SEQ ID NO: 123478 - DNA, 103 bp, Artificial Sequence
  Synthetic Polynucleotide
taatacgactcactatagggtgggagggactgtcgtcagctgattcggggaacagaggagaccccgaatgagctgacgaaacctggcggcagcgcaaaagatg

SEQ ID NO: 123479 - DNA, 103 bp, Artificial Sequence
  Synthetic Polynucleotide
taatacgactcactatagggcttggagagctgggagggactgtcgtcagcaacagaggagagctgacatgagtccctccaacctggcggcagcgcaaaagatg

SEQ ID NO: 123480 - DNA, 103 bp, Artificial Sequence
  Synthetic Polynucleotide
taatacgactcactatagggtgccaggccacttggagagctgggagggacaacagaggagagtccctatgagctctccaaacctggcggcagcgcaaaagatg

SEQ ID NO: 123481 - DNA, 103 bp, Artificial Sequence
  Synthetic Polynucleotide
taatacgactcactataggggacgtggggctgccaggccacttggagagcaacagaggagagctctcatggtggcctggaacctggcggcagcgcaaaagatg

SEQ ID NO: 123482 - DNA, 103 bp, Artificial Sequence
  Synthetic Polynucleotide
taatacgactcactatagggactgctgcgtgacgtggggctgccaggccaaacagaggagatggcctatgagccccacgaacctggcggcagcgcaaaagatg

SEQ ID NO: 123483 - DNA, 103 bp, Artificial Sequence
  Synthetic Polynucleotide
taatacgactcactatagggccagctcatcactgctgcgtgacgtggggcaacagaggagagccccaatgcacgcagcaaacctggcggcagcgcaaaagatg

SEQ ID NO: 123484 - DNA, 103 bp, Artificial Sequence
  Synthetic Polynucleotide
taatacgactcactatagggctttgcaggggccacgtacaggatcgcggaaacagaggagatccgcgatgctgtacgtgaacctggcggcagcgcaaaagatg

SEQ ID NO: 123485 - DNA, 103 bp, Artificial Sequence
  Synthetic Polynucleotide
taatacgactcactataggggtccacgcatccagctcatcactgctgcgtaacagaggagaacgcagatgtgatgagctaacctggcggcagcgcaaaagatg

SEQ ID NO: 123486 - DNA, 103 bp, Artificial Sequence
  Synthetic Polynucleotide
taatacgactcactatagggacggaagtccgtccacgcatccagctcatcaacagaggagagatgagatggatgcgtggaacctggcggcagcgcaaaagatg

SEQ ID NO: 123487 - DNA, 103 bp, Artificial Sequence
  Synthetic Polynucleotide
taatacgactcactatagggtggtgcgtgaacggaagtccgtccacgcataacagaggagaatgcgtatgcggacttccaacctggcggcagcgcaaaagatg

SEQ ID NO: 123488 - DNA, 103 bp, Artificial Sequence
  Synthetic Polynucleotide
taatacgactcactataggggcgttagaattggtgcgtgaacggaagtccaacagaggagaggacttatgttcacgcacaacctggcggcagcgcaaaagatg

SEQ ID NO: 123489 - DNA, 103 bp, Artificial Sequence
  Synthetic Polynucleotide
taatacgactcactataggggactgtgctggcgttagaattggtgcgtgaaacagaggagatcacgcatgaattctaacaacctggcggcagcgcaaaagatg

SEQ ID NO: 123490 - DNA, 103 bp, Artificial Sequence
  Synthetic Polynucleotide
taatacgactcactatagggggcggccactgactgtgctggcgttagaataacagaggagaattctaatgccagcacagaacctggcggcagcgcaaaagatg

SEQ ID NO: 123491 - DNA, 103 bp, Artificial Sequence
  Synthetic Polynucleotide
taatacgactcactatagggatgggcgacaggcggccactgactgtgctgaacagaggagacagcacatgcagtggccgaacctggcggcagcgcaaaagatg

SEQ ID NO: 123492 - DNA, 103 bp, Artificial Sequence
  Synthetic Polynucleotide
taatacgactcactataggggcttgccatgatgggcgacaggcggccactaacagaggagaagtggcatgctgtcgcccaacctggcggcagcgcaaaagatg

SEQ ID NO: 123493 - DNA, 103 bp, Artificial Sequence
  Synthetic Polynucleotide
taatacgactcactatagggccaactctgtgcttgccatgatgggcgacaaacagaggagatgtcgcatgtcatggcaaaacctggcggcagcgcaaaagatg

SEQ ID NO: 123494 - DNA, 103 bp, Artificial Sequence
  Synthetic Polynucleotide
taatacgactcactatagggtggacttcatccaactctgtgcttgccatgaacagaggagacatggcatgcacagagttaacctggcggcagcgcaaaagatg

SEQ ID NO: 123495 - DNA, 103 bp, Artificial Sequence
  Synthetic Polynucleotide
taatacgactcactatagggtattgtctctgtcgcagattcctgcatcataacagaggagaatgatgatggaatctgcgaacctggcggcagcgcaaaagatg

SEQ ID NO: 123496 - DNA, 103 bp, Artificial Sequence
  Synthetic Polynucleotide
taatacgactcactatagggggtgtcaccacttgatcttccatctctgctaacagaggagaagcagaatgggaagatcaaacctggcggcagcgcaaaagatg

SEQ ID NO: 123497 - DNA, 103 bp, Artificial Sequence
  Synthetic Polynucleotide
taatacgactcactatagggggaatgatgagttattggtggtgatgctttaacagaggagaaaagcaatgccaccaataaacctggcggcagcgcaaaagatg

SEQ ID NO: 123498 - DNA, 103 bp, Artificial Sequence
  Synthetic Polynucleotide
taatacgactcactatagggcattcactatggaatgatgagttattggtgaacagaggagacaccaaatgctcatcattaacctggcggcagcgcaaaagatg

SEQ ID NO: 123499 - DNA, 103 bp, Artificial Sequence
  Synthetic Polynucleotide
taatacgactcactataggggaagactgtccattcactatggaatgatgaaacagaggagatcatcaatgcatagtgaaaacctggcggcagcgcaaaagatg

SEQ ID NO: 123500 - DNA, 103 bp, Artificial Sequence
  Synthetic Polynucleotide
taatacgactcactatagggacttagaactgaagactgtccattcactataacagaggagaatagtgatgggacagtctaacctggcggcagcgcaaaagatg

SEQ ID NO: 123501 - DNA, 103 bp, Artificial Sequence
  Synthetic Polynucleotide
taatacgactcactatagggctcgtcttgcacttagaactgaagactgtcaacagaggagagacagtatgcagttctaaaacctggcggcagcgcaaaagatg

SEQ ID NO: 123502 - DNA, 103 bp, Artificial Sequence
  Synthetic Polynucleotide
taatacgactcactataggggacgagctgtctcgtcttgcacttagaactaacagaggagaagttctatgtgcaagacgaacctggcggcagcgcaaaagatg

SEQ ID NO: 123503 - DNA, 103 bp, Artificial Sequence
  Synthetic Polynucleotide
taatacgactcactatagggctcctcatgtgacgagctgtctcgtcttgcaacagaggagagcaagaatggacagctcgaacctggcggcagcgcaaaagatg

SEQ ID NO: 123504 - DNA, 103 bp, Artificial Sequence
  Synthetic Polynucleotide
taatacgactcactatagggaggccccagtctcctcatgtgacgagctgtaacagaggagaacagctatgcacatgaggaacctggcggcagcgcaaaagatg

SEQ ID NO: 123505 - DNA, 103 bp, Artificial Sequence
  Synthetic Polynucleotide
taatacgactcactatagggagagtgtgagaggccccagtctcctcatgtaacagaggagaacatgaatggactggggcaacctggcggcagcgcaaaagatg

SEQ ID NO: 123506 - DNA, 103 bp, Artificial Sequence
  Synthetic Polynucleotide
taatacgactcactatagggatggccatagagagtgtgagaggccccagtaacagaggagaactgggatgtctcacactaacctggcggcagcgcaaaagatg

SEQ ID NO: 123507 - DNA, 103 bp, Artificial Sequence
  Synthetic Polynucleotide
taatacgactcactatagggcttcagagctggtgtcaccacttgatcttcaacagaggagagaagatatggtggtgacaaacctggcggcagcgcaaaagatg

SEQ ID NO: 123508 - DNA, 103 bp, Artificial Sequence
  Synthetic Polynucleotide
taatacgactcactatagggtgcaaactccatggccatagagagtgtgagaacagaggagactcacaatgtctatggccaacctggcggcagcgcaaaagatg

SEQ ID NO: 123509 - DNA, 103 bp, Artificial Sequence
  Synthetic Polynucleotide
taatacgactcactatagggcctggccatttgcaaactccatggccatagaacagaggagactatggatgtggagtttgaacctggcggcagcgcaaaagatg

SEQ ID NO: 123510 - DNA, 103 bp, Artificial Sequence
  Synthetic Polynucleotide
taatacgactcactataggggctttcacagcctggccatttgcaaactccaacagaggagaggagttatgaaatggccaaacctggcggcagcgcaaaagatg

SEQ ID NO: 123511 - DNA, 103 bp, Artificial Sequence
  Synthetic Polynucleotide
taatacgactcactatagggcttcacaaatgctttcacagcctggccattaacagaggagaaatggcatggctgtgaaaaacctggcggcagcgcaaaagatg

SEQ ID NO: 123512 - DNA, 103 bp, Artificial Sequence
  Synthetic Polynucleotide
taatacgactcactatagggtgtccaaaatcttcacaaatgctttcacagaacagaggagactgtgaatgcatttgtgaaacctggcggcagcgcaaaagatg

SEQ ID NO: 123513 - DNA, 103 bp, Artificial Sequence
  Synthetic Polynucleotide
taatacgactcactatagggctttaaaaactgtccaaaatcttcacaaataacagaggagaatttgtatggattttggaaacctggcggcagcgcaaaagatg

SEQ ID NO: 123514 - DNA, 103 bp, Artificial Sequence
  Synthetic Polynucleotide
taatacgactcactatagggtgttaaggtgctttaaaaactgtccaaaataacagaggagaattttgatgagtttttaaaacctggcggcagcgcaaaagatg

SEQ ID NO: 123515 - DNA, 103 bp, Artificial Sequence
  Synthetic Polynucleotide
taatacgactcactataggggcgtgttcattgttaaggtgctttaaaaacaacagaggagagtttttatggcaccttaaaacctggcggcagcgcaaaagatg

SEQ ID NO: 123516 - DNA, 103 bp, Artificial Sequence
  Synthetic Polynucleotide
taatacgactcactataggggtcatccaatgcgtgttcattgttaaggtgaacagaggagacaccttatgaatgaacacaacctggcggcagcgcaaaagatg

SEQ ID NO: 123517 - DNA, 103 bp, Artificial Sequence
  Synthetic Polynucleotide
taatacgactcactatagggcagtgcttcggtcatccaatgcgtgttcataacagaggagaatgaacatgcattggatgaacctggcggcagcgcaaaagatg

SEQ ID NO: 123518 - DNA, 103 bp, Artificial Sequence
  Synthetic Polynucleotide
taatacgactcactatagggactgtgcttacttcagagctggtgtcaccaaacagaggagatggtgaatgcagctctgaaacctggcggcagcgcaaaagatg

SEQ ID NO: 123519 - DNA, 103 bp, Artificial Sequence
  Synthetic Polynucleotide
taatacgactcactatagggcgacactgagcagtgcttcggtcatccaataacagaggagaattggaatgccgaagcacaacctggcggcagcgcaaaagatg

SEQ ID NO: 123520 - DNA, 103 bp, Artificial Sequence
  Synthetic Polynucleotide
taatacgactcactatagggcatttgcactcgacactgagcagtgcttcgaacagaggagacgaagcatggctcagtgtaacctggcggcagcgcaaaagatg

SEQ ID NO: 123521 - DNA, 103 bp, Artificial Sequence
  Synthetic Polynucleotide
taatacgactcactataggggcaccacctgcatttgcactcgacactgagaacagaggagactcagtatggagtgcaaaaacctggcggcagcgcaaaagatg

SEQ ID NO: 123522 - DNA, 103 bp, Artificial Sequence
  Synthetic Polynucleotide
taatacgactcactatagggtctaactgttgcaccacctgcatttgcactaacagaggagaagtgcaatggcaggtggtaacctggcggcagcgcaaaagatg

SEQ ID NO: 123523 - DNA, 103 bp, Artificial Sequence
  Synthetic Polynucleotide
taatacgactcactatagggaagctgtatttctaactgttgcaccacctgaacagaggagacaggtgatgcaacagttaaacctggcggcagcgcaaaagatg

SEQ ID NO: 123524 - DNA, 103 bp, Artificial Sequence
  Synthetic Polynucleotide
taatacgactcactataggggttctttagaaagctgtatttctaactgttaacagaggagaaacagtatgaaatacagcaacctggcggcagcgcaaaagatg

SEQ ID NO: 123525 - DNA, 103 bp, Artificial Sequence
  Synthetic Polynucleotide
taatacgactcactatagggagacgttcgcgttctttagaaagctgtattaacagaggagaaatacaatgttctaaagaaacctggcggcagcgcaaaagatg

SEQ ID NO: 123526 - DNA, 103 bp, Artificial Sequence
  Synthetic Polynucleotide
taatacgactcactatagggcattgcttgaagacgttcgcgttctttagaaacagaggagatctaaaatgcgcgaacgtaacctggcggcagcgcaaaagatg

SEQ ID NO: 123527 - DNA, 103 bp, Artificial Sequence
  Synthetic Polynucleotide
taatacgactcactatagggagtgggtcatcattgcttgaagacgttcgcaacagaggagagcgaacatgttcaagcaaaacctggcggcagcgcaaaagatg

SEQ ID NO: 123528 - DNA, 103 bp, Artificial Sequence
  Synthetic Polynucleotide
taatacgactcactatagggcgcatgtgcaagtgggtcatcattgcttgaaacagaggagatcaagcatggatgacccaaacctggcggcagcgcaaaagatg

SEQ ID NO: 123529 - DNA, 103 bp, Artificial Sequence
  Synthetic Polynucleotide
taatacgactcactatagggcagcagttctactgtgcttacttcagagctaacagaggagaagctctatggtaagcacaaacctggcggcagcgcaaaagatg

SEQ ID NO: 123530 - DNA, 103 bp, Artificial Sequence
  Synthetic Polynucleotide
taatacgactcactatagggctctgagggtcgcatgtgcaagtgggtcataacagaggagaatgaccatgttgcacatgaacctggcggcagcgcaaaagatg

SEQ ID NO: 123531 - DNA, 103 bp, Artificial Sequence
  Synthetic Polynucleotide
taatacgactcactatagggatggtttgggctctgagggtcgcatgtgcaaacagaggagatgcacaatggaccctcagaacctggcggcagcgcaaaagatg

SEQ ID NO: 123532 - DNA, 103 bp, Artificial Sequence
  Synthetic Polynucleotide
taatacgactcactatagggggtttgggagatggtttgggctctgagggtaacagaggagaaccctcatggcccaaaccaacctggcggcagcgcaaaagatg

SEQ ID NO: 123533 - DNA, 103 bp, Artificial Sequence
  Synthetic Polynucleotide
taatacgactcactatagggcagatttagaggtttgggagatggtttgggaacagaggagacccaaaatgtctcccaaaaacctggcggcagcgcaaaagatg

SEQ ID NO: 123534 - DNA, 103 bp, Artificial Sequence
  Synthetic Polynucleotide
taatacgactcactatagggcactagacaccagatttagaggtttgggagaacagaggagactcccaatgctctaaatcaacctggcggcagcgcaaaagatg

SEQ ID NO: 123535 - DNA, 103 bp, Artificial Sequence
  Synthetic Polynucleotide
taatacgactcactataggggacatggtgacactagacaccagatttagaaacagaggagatctaaaatgggtgtctagaacctggcggcagcgcaaaagatg

SEQ ID NO: 123536 - DNA, 103 bp, Artificial Sequence
  Synthetic Polynucleotide
taatacgactcactatagggcatattcttcgacatggtgacactagacacaacagaggagagtgtctatggtcaccatgaacctggcggcagcgcaaaagatg

SEQ ID NO: 123537 - DNA, 103 bp, Artificial Sequence
  Synthetic Polynucleotide
taatacgactcactatagggatgtctccaacatattcttcgacatggtgaaacagaggagatcaccaatgcgaagaataaacctggcggcagcgcaaaagatg

SEQ ID NO: 123538 - DNA, 103 bp, Artificial Sequence
  Synthetic Polynucleotide
taatacgactcactatagggctctgtggggatgtctccaacatattcttcaacagaggagagaagaaatggttggagacaacctggcggcagcgcaaaagatg

SEQ ID NO: 123539 - DNA, 103 bp, Artificial Sequence
  Synthetic Polynucleotide
taatacgactcactatagggttgaggtaagctctgtggggatgtctccaaaacagaggagattggagatgtccccacagaacctggcggcagcgcaaaagatg

SEQ ID NO: 123540 - DNA, 103 bp, Artificial Sequence
  Synthetic Polynucleotide
taatacgactcactataggggttgcagatgcagcagttctactgtgcttaaacagaggagataagcaatgtagaactgcaacctggcggcagcgcaaaagatg

SEQ ID NO: 123541 - DNA, 103 bp, Artificial Sequence
  Synthetic Polynucleotide
taatacgactcactatagggtggtaggggtttgaggtaagctctgtggggaacagaggagaccccacatggcttacctcaacctggcggcagcgcaaaagatg

SEQ ID NO: 123542 - DNA, 103 bp, Artificial Sequence
  Synthetic Polynucleotide
taatacgactcactataggggccgttggtgtggtaggggtttgaggtaagaacagaggagacttaccatgaacccctacaacctggcggcagcgcaaaagatg

SEQ ID NO: 123543 - DNA, 103 bp, Artificial Sequence
  Synthetic Polynucleotide
taatacgactcactatagggggtgactggggccgttggtgtggtaggggtaacagaggagaacccctatgacaccaacgaacctggcggcagcgcaaaagatg

SEQ ID NO: 123544 - DNA, 103 bp, Artificial Sequence
  Synthetic Polynucleotide
taatacgactcactataggggggtaatcggggtgactggggccgttggtgaacagaggagacaccaaatgccccagtcaaacctggcggcagcgcaaaagatg

SEQ ID NO: 123545 - DNA, 103 bp, Artificial Sequence
  Synthetic Polynucleotide
taatacgactcactataggggagggtccctgggtaatcggggtgactgggaacagaggagacccagtatgcccgattacaacctggcggcagcgcaaaagatg

SEQ ID NO: 123546 - DNA, 103 bp, Artificial Sequence
  Synthetic Polynucleotide
taatacgactcactatagggggtgattactgagggtccctgggtaatcggaacagaggagaccgattatgcagggacccaacctggcggcagcgcaaaagatg

SEQ ID NO: 123547 - DNA, 103 bp, Artificial Sequence
  Synthetic Polynucleotide
taatacgactcactatagggcactggctggggtgattactgagggtccctaacagaggagaagggacatgcagtaatcaaacctggcggcagcgcaaaagatg

SEQ ID NO: 123548 - DNA, 103 bp, Artificial Sequence
  Synthetic Polynucleotide
taatacgactcactatagggacattgggcacactggctggggtgattactaacagaggagaagtaatatgcccagccagaacctggcggcagcgcaaaagatg

SEQ ID NO: 123549 - DNA, 103 bp, Artificial Sequence
  Synthetic Polynucleotide
taatacgactcactatagggtatggctcccacattgggcacactggctggaacagaggagaccagccatggtgcccaataacctggcggcagcgcaaaagatg

SEQ ID NO: 123550 - DNA, 103 bp, Artificial Sequence
  Synthetic Polynucleotide
taatacgactcactataggggtcgccttcgtatggctcccacattgggcaaacagaggagatgcccaatgtgggagccaaacctggcggcagcgcaaaagatg

SEQ ID NO: 123551 - DNA, 103 bp, Artificial Sequence
  Synthetic Polynucleotide
taatacgactcactataggggcctgctgttgttgcagatgcagcagttctaacagaggagaagaactatggcatctgcaaacctggcggcagcgcaaaagatg

SEQ ID NO: 123552 - DNA, 103 bp, Artificial Sequence
  Synthetic Polynucleotide
taatacgactcactatagggttgtctgaatgtcgccttcgtatggctcccaacagaggagagggagcatgacgaaggcgaacctggcggcagcgcaaaagatg

SEQ ID NO: 123553 - DNA, 103 bp, Artificial Sequence
  Synthetic Polynucleotide
taatacgactcactatagggaatgttgtatttgtctgaatgtcgccttcgaacagaggagacgaaggatgcattcagacaacctggcggcagcgcaaaagatg

SEQ ID NO: 123554 - DNA, 103 bp, Artificial Sequence
  Synthetic Polynucleotide
taatacgactcactatagggatgacatgggaatgttgtatttgtctgaataacagaggagaattcagatgaatacaacaaacctggcggcagcgcaaaagatg

SEQ ID NO: 123555 - DNA, 103 bp, Artificial Sequence
  Synthetic Polynucleotide
taatacgactcactataggggcaatttctgatgacatgggaatgttgtataacagaggagaatacaaatgtcccatgtcaacctggcggcagcgcaaaagatg

SEQ ID NO: 123556 - DNA, 103 bp, Artificial Sequence
  Synthetic Polynucleotide
taatacgactcactatagggatagtttggggcaatttctgatgacatgggaacagaggagacccatgatgtcagaaattaacctggcggcagcgcaaaagatg

SEQ ID NO: 123557 - DNA, 103 bp, Artificial Sequence
  Synthetic Polynucleotide
taatacgactcactatagggtataaaattcatagtttggggcaatttctgaacagaggagacagaaaatgccccaaactaacctggcggcagcgcaaaagatg

SEQ ID NO: 123558 - DNA, 103 bp, Artificial Sequence
  Synthetic Polynucleotide
taatacgactcactatagggtctgcatttttataaaattcatagtttgggaacagaggagacccaaaatgtgaattttaaacctggcggcagcgcaaaagatg

SEQ ID NO: 123559 - DNA, 103 bp, Artificial Sequence
  Synthetic Polynucleotide
taatacgactcactatagggaggtctgacatctgcatttttataaaattcaacagaggagagaatttatgaaaaatgcaaacctggcggcagcgcaaaagatg

SEQ ID NO: 123560 - DNA, 103 bp, Artificial Sequence
  Synthetic Polynucleotide
taatacgactcactatagggaagtaaatggaggtctgacatctgcattttaacagaggagaaaaatgatgatgtcagacaacctggcggcagcgcaaaagatg

SEQ ID NO: 123561 - DNA, 103 bp, Artificial Sequence
  Synthetic Polynucleotide
taatacgactcactatagggagagttgcataagtaaatggaggtctgacaaacagaggagatgtcagatgtccatttacaacctggcggcagcgcaaaagatg

SEQ ID NO: 123562 - DNA, 103 bp, Artificial Sequence
  Synthetic Polynucleotide
taatacgactcactatagggtgcctggagagcctgctgttgttgcagatgaacagaggagacatctgatgcaacagcagaacctggcggcagcgcaaaagatg

SEQ ID NO: 123563 - DNA, 103 bp, Artificial Sequence
  Synthetic Polynucleotide
taatacgactcactatagggctgccttatgagagttgcataagtaaatggaacagaggagaccatttatgtatgcaactaacctggcggcagcgcaaaagatg

SEQ ID NO: 123564 - DNA, 103 bp, Artificial Sequence
  Synthetic Polynucleotide
taatacgactcactatagggccatgatagcctgccttatgagagttgcataacagaggagaatgcaaatgtcataaggcaacctggcggcagcgcaaaagatg

SEQ ID NO: 123565 - DNA, 103 bp, Artificial Sequence
  Synthetic Polynucleotide
taatacgactcactatagggtcagatgactccatgatagcctgccttatgaacagaggagacataagatgggctatcataacctggcggcagcgcaaaagatg

SEQ ID NO: 123566 - DNA, 103 bp, Artificial Sequence
  Synthetic Polynucleotide
taatacgactcactatagggtaactgcctgtcagatgactccatgatagcaacagaggagagctatcatggagtcatctaacctggcggcagcgcaaaagatg

SEQ ID NO: 123567 - DNA, 103 bp, Artificial Sequence
  Synthetic Polynucleotide
taatacgactcactatagggcattaagtgttaactgcctgtcagatgactaacagaggagaagtcatatgacaggcagtaacctggcggcagcgcaaaagatg

SEQ ID NO: 123568 - DNA, 103 bp, Artificial Sequence
  Synthetic Polynucleotide
taatacgactcactatagggctgtaaatttcattaagtgttaactgcctgaacagaggagacaggcaatgaacacttaaaacctggcggcagcgcaaaagatg

SEQ ID NO: 123569 - DNA, 103 bp, Artificial Sequence
  Synthetic Polynucleotide
taatacgactcactatagggtgtaaaccagctgtaaatttcattaagtgtaacagaggagaacacttatggaaatttacaacctggcggcagcgcaaaagatg

SEQ ID NO: 123570 - DNA, 103 bp, Artificial Sequence
  Synthetic Polynucleotide
taatacgactcactatagggcaaatgtccgtgtaaaccagctgtaaatttaacagaggagaaaatttatggctggtttaaacctggcggcagcgcaaaagatg

SEQ ID NO: 123571 - DNA, 103 bp, Artificial Sequence
  Synthetic Polynucleotide
taatacgactcactatagggctgaagtaagcaaatgtccgtgtaaaccagaacagaggagactggttatgacggacattaacctggcggcagcgcaaaagatg

SEQ ID NO: 123572 - DNA, 103 bp, Artificial Sequence
  Synthetic Polynucleotide
taatacgactcactatagggtgcattacgcctgaagtaagcaaatgtccgaacagaggagacggacaatggcttacttcaacctggcggcagcgcaaaagatg

SEQ ID NO: 123573 - DNA, 103 bp, Artificial Sequence
  Synthetic Polynucleotide
taatacgactcactataggggttgtcttgctgcctggagagcctgctgttaacagaggagaaacagcatgctctccaggaacctggcggcagcgcaaaagatg

SEQ ID NO: 123574 - DNA, 103 bp, Artificial Sequence
  Synthetic Polynucleotide
taatacgactcactatagggtccaagttgctgcattacgcctgaagtaagaacagaggagacttactatgggcgtaatgaacctggcggcagcgcaaaagatg

SEQ ID NO: 123575 - DNA, 103 bp, Artificial Sequence
  Synthetic Polynucleotide
taatacgactcactatagggactgcattcttccaagttgctgcattacgcaacagaggagagcgtaaatgagcaacttgaacctggcggcagcgcaaaagatg

SEQ ID NO: 123576 - DNA, 103 bp, Artificial Sequence
  Synthetic Polynucleotide
taatacgactcactatagggattatgacgtactgcattcttccaagttgcaacagaggagagcaactatgaagaatgcaaacctggcggcagcgcaaaagatg

SEQ ID NO: 123577 - DNA, 103 bp, Artificial Sequence
  Synthetic Polynucleotide
taatacgactcactataggggcaggctaagattatgacgtactgcattctaacagaggagaagaatgatgtacgtcataaacctggcggcagcgcaaaagatg

SEQ ID NO: 123578 - DNA, 103 bp, Artificial Sequence
  Synthetic Polynucleotide
taatacgactcactatagggaaacacttgtgcaggctaagattatgacgtaacagaggagaacgtcaatgtcttagcctaacctggcggcagcgcaaaagatg

SEQ ID NO: 123579 - DNA, 103 bp, Artificial Sequence
  Synthetic Polynucleotide
taatacgactcactatagggtactcgaacaaaacacttgtgcaggctaagaacagaggagacttagcatgcacaagtgtaacctggcggcagcgcaaaagatg

SEQ ID NO: 123580 - DNA, 103 bp, Artificial Sequence
  Synthetic Polynucleotide
taatacgactcactatagggtaacattttctactcgaacaaaacacttgtaacagaggagaacaagtatgttgttcgagaacctggcggcagcgcaaaagatg

SEQ ID NO: 123581 - DNA, 103 bp, Artificial Sequence
  Synthetic Polynucleotide
taatacgactcactatagggactgctcctttaacattttctactcgaacaaacagaggagatgttcgatgagaaaatgtaacctggcggcagcgcaaaagatg

SEQ ID NO: 123582 - DNA, 103 bp, Artificial Sequence
  Synthetic Polynucleotide
taatacgactcactatagggcacagtccatactgctcctttaacattttcaacagaggagagaaaatatgaaaggagcaaacctggcggcagcgcaaaagatg

SEQ ID NO: 123583 - DNA, 103 bp, Artificial Sequence
  Synthetic Polynucleotide
taatacgactcactatagggctacttcatccacagtccatactgctccttaacagaggagaaaggagatgtatggactgaacctggcggcagcgcaaaagatg

SEQ ID NO: 123584 - DNA, 103 bp, Artificial Sequence
  Synthetic Polynucleotide
taatacgactcactatagggtgtaaaagaagttgtcttgctgcctggagaaacagaggagatctccaatgagcaagacaaacctggcggcagcgcaaaagatg

SEQ ID NO: 123585 - DNA, 103 bp, Artificial Sequence
  Synthetic Polynucleotide
taatacgactcactatagggttctggtattctacttcatccacagtccataacagaggagaatggacatgggatgaagtaacctggcggcagcgcaaaagatg

SEQ ID NO: 123586 - DNA, 103 bp, Artificial Sequence
  Synthetic Polynucleotide
taatacgactcactatagggtgaccttcgcttctggtattctacttcatcaacagaggagagatgaaatggaataccagaacctggcggcagcgcaaaagatg

SEQ ID NO: 123587 - DNA, 103 bp, Artificial Sequence
  Synthetic Polynucleotide
taatacgactcactatagggttatcttttgtgaccttcgcttctggtattaacagaggagaaataccatgagcgaaggtaacctggcggcagcgcaaaagatg

SEQ ID NO: 123588 - DNA, 103 bp, Artificial Sequence
  Synthetic Polynucleotide
taatacgactcactatagggggacttcctgttatcttttgtgaccttcgcaacagaggagagcgaagatgacaaaagataacctggcggcagcgcaaaagatg

SEQ ID NO: 123589 - DNA, 103 bp, Artificial Sequence
  Synthetic Polynucleotide
taatacgactcactatagggtactaaggttggacttcctgttatcttttgaacagaggagacaaaagatgacaggaagtaacctggcggcagcgcaaaagatg

SEQ ID NO: 123590 - DNA, 103 bp, Artificial Sequence
  Synthetic Polynucleotide
taatacgactcactataggggtatattttttactaaggttggacttcctgaacagaggagacaggaaatgcaaccttagaacctggcggcagcgcaaaagatg

SEQ ID NO: 123591 - DNA, 103 bp, Artificial Sequence
  Synthetic Polynucleotide
taatacgactcactatagggaaactggtaggtatattttttactaaggttaacagaggagaaaccttatgaaaaaatataacctggcggcagcgcaaaagatg

SEQ ID NO: 123592 - DNA, 103 bp, Artificial Sequence
  Synthetic Polynucleotide
taatacgactcactatagggtccatagcctaaactggtaggtatatttttaacagaggagaaaaaatatgcctaccagtaacctggcggcagcgcaaaagatg

SEQ ID NO: 123593 - DNA, 103 bp, Artificial Sequence
  Synthetic Polynucleotide
taatacgactcactatagggtaagagctgctccatagcctaaactggtagaacagaggagactaccaatgtaggctatgaacctggcggcagcgcaaaagatg

SEQ ID NO: 123594 - DNA, 103 bp, Artificial Sequence
  Synthetic Polynucleotide
taatacgactcactatagggaaactggcattaagagctgctccatagcctaacagaggagaaggctaatgagcagctctaacctggcggcagcgcaaaagatg

SEQ ID NO: 123595 - DNA, 103 bp, Artificial Sequence
  Synthetic Polynucleotide
taatacgactcactatagggtgtttgctgctgtaaaagaagttgtcttgcaacagaggagagcaagaatgcttcttttaaacctggcggcagcgcaaaagatg

SEQ ID NO: 123596 - DNA, 103 bp, Artificial Sequence
  Synthetic Polynucleotide
taatacgactcactatagggggcagcctgcaaactggcattaagagctgcaacagaggagagcagctatgaatgccagtaacctggcggcagcgcaaaagatg

SEQ ID NO: 123597 - DNA, 103 bp, Artificial Sequence
  Synthetic Polynucleotide
taatacgactcactatagggtctctgccaaggcagcctgcaaactggcataacagaggagaatgccaatgtgcaggctgaacctggcggcagcgcaaaagatg

SEQ ID NO: 123598 - DNA, 103 bp, Artificial Sequence
  Synthetic Polynucleotide
taatacgactcactatagggggtaaactgctctctgccaaggcagcctgcaacagaggagagcaggcatgcttggcagaaacctggcggcagcgcaaaagatg

SEQ ID NO: 123599 - DNA, 103 bp, Artificial Sequence
  Synthetic Polynucleotide
taatacgactcactatagggacttagcaaaggtaaactgctctctgccaaaacagaggagattggcaatgagcagtttaaacctggcggcagcgcaaaagatg

SEQ ID NO: 123600 - DNA, 103 bp, Artificial Sequence
  Synthetic Polynucleotide
taatacgactcactataggggtccaggattacttagcaaaggtaaactgcaacagaggagagcagttatgctttgctaaaacctggcggcagcgcaaaagatg

SEQ ID NO: 123601 - DNA, 103 bp, Artificial Sequence
  Synthetic Polynucleotide
taatacgactcactatagggttatttatcagtccaggattacttagcaaaaacagaggagatttgctatgtaatcctggaacctggcggcagcgcaaaagatg

SEQ ID NO: 123602 - DNA, 103 bp, Artificial Sequence
  Synthetic Polynucleotide
taatacgactcactatagggactggatgcattatttatcagtccaggattaacagaggagaaatcctatgctgataaataacctggcggcagcgcaaaagatg

SEQ ID NO: 123603 - DNA, 103 bp, Artificial Sequence
  Synthetic Polynucleotide
taatacgactcactataggggcagtaggccactggatgcattatttatcaaacagaggagatgataaatgatgcatccaaacctggcggcagcgcaaaagatg

SEQ ID NO: 123604 - DNA, 103 bp, Artificial Sequence
  Synthetic Polynucleotide
taatacgactcactatagggtggacggcctgcagtaggccactggatgcaaacagaggagatgcatcatgtggcctactaacctggcggcagcgcaaaagatg

SEQ ID NO: 123605 - DNA, 103 bp, Artificial Sequence
  Synthetic Polynucleotide
taatacgactcactataggggaggtcttcgtggacggcctgcagtaggccaacagaggagaggcctaatgcaggccgtcaacctggcggcagcgcaaaagatg

SEQ ID NO: 123606 - DNA, 103 bp, Artificial Sequence
  Synthetic Polynucleotide
taatacgactcactatagggaactgttgcttattgtctctgtcgcagattaacagaggagaaatctgatgcagagacaaaacctggcggcagcgcaaaagatg

SEQ ID NO: 123607 - DNA, 103 bp, Artificial Sequence
  Synthetic Polynucleotide
taatacgactcactatagggtcaatccacttgtttgctgctgtaaaagaaaacagaggagattctttatgagcagcaaaaacctggcggcagcgcaaaagatg

SEQ ID NO: 123608 - DNA, 103 bp, Artificial Sequence
  Synthetic Polynucleotide
taatacgactcactataggggagaaccattgaggtcttcgtggacggcctaacagaggagaaggccgatgacgaagaccaacctggcggcagcgcaaaagatg

SEQ ID NO: 123609 - DNA, 103 bp, Artificial Sequence
  Synthetic Polynucleotide
taatacgactcactatagggatgtgatccagagaaccattgaggtcttcgaacagaggagacgaagaatgcaatggttcaacctggcggcagcgcaaaagatg

SEQ ID NO: 123610 - DNA, 103 bp, Artificial Sequence
  Synthetic Polynucleotide
taatacgactcactatagggattgctgtcaatgtgatccagagaaccattaacagaggagaaatggtatgctggatcacaacctggcggcagcgcaaaagatg

SEQ ID NO: 123611 - DNA, 103 bp, Artificial Sequence
  Synthetic Polynucleotide
taatacgactcactatagggtactgtttccattgctgtcaatgtgatccaaacagaggagatggatcatgttgacagcaaacctggcggcagcgcaaaagatg

SEQ ID NO: 123612 - DNA, 103 bp, Artificial Sequence
  Synthetic Polynucleotide
taatacgactcactatagggcagcccggactactgtttccattgctgtcaaacagaggagatgacagatgtggaaacagaacctggcggcagcgcaaaagatg

SEQ ID NO: 123613 - DNA, 103 bp, Artificial Sequence
  Synthetic Polynucleotide
taatacgactcactatagggctgaggtgagcagcccggactactgtttccaacagaggagaggaaacatgagtccgggcaacctggcggcagcgcaaaagatg

SEQ ID NO: 123614 - DNA, 103 bp, Artificial Sequence
  Synthetic Polynucleotide
taatacgactcactataggggtatgtgcggctgaggtgagcagcccggacaacagaggagagtccggatggctcacctcaacctggcggcagcgcaaaagatg

SEQ ID NO: 123615 - DNA, 103 bp, Artificial Sequence
  Synthetic Polynucleotide
taatacgactcactatagggtggattgaatgtatgtgcggctgaggtgagaacagaggagactcaccatggccgcacataacctggcggcagcgcaaaagatg

SEQ ID NO: 123616 - DNA, 103 bp, Artificial Sequence
  Synthetic Polynucleotide
taatacgactcactatagggttccttgacgtggattgaatgtatgtgcggaacagaggagaccgcacatgcattcaatcaacctggcggcagcgcaaaagatg

SEQ ID NO: 123617 - DNA, 103 bp, Artificial Sequence
  Synthetic Polynucleotide
taatacgactcactatagggtcactggctcttccttgacgtggattgaataacagaggagaattcaaatgacgtcaaggaacctggcggcagcgcaaaagatg

SEQ ID NO: 123618 - DNA, 103 bp, Artificial Sequence
  Synthetic Polynucleotide
taatacgactcactatagggttaggagatttcaatccacttgtttgctgcaacagaggagagcagcaatgaagtggattaacctggcggcagcgcaaaagatg

SEQ ID NO: 123619 - DNA, 103 bp, Artificial Sequence
  Synthetic Polynucleotide
taatacgactcactatagggtcctctgcaatcactggctcttccttgacgaacagaggagacgtcaaatgagagccagtaacctggcggcagcgcaaaagatg

SEQ ID NO: 123620 - DNA, 103 bp, Artificial Sequence
  Synthetic Polynucleotide
taatacgactcactataggggcagtcttcatcctctgcaatcactggctcaacagaggagagagccaatgattgcagagaacctggcggcagcgcaaaagatg

SEQ ID NO: 123621 - DNA, 103 bp, Artificial Sequence
  Synthetic Polynucleotide
taatacgactcactatagggaggacattgggcagtcttcatcctctgcaaaacagaggagattgcagatgatgaagactaacctggcggcagcgcaaaagatg

SEQ ID NO: 123622 - DNA, 103 bp, Artificial Sequence
  Synthetic Polynucleotide
taatacgactcactataggggttgtcactaaggacattgggcagtcttcaaacagaggagatgaagaatgcccaatgtcaacctggcggcagcgcaaaagatg

SEQ ID NO: 123623 - DNA, 103 bp, Artificial Sequence
  Synthetic Polynucleotide
taatacgactcactataggggtgattagctgttgtcactaaggacattggaacagaggagaccaatgatgttagtgacaaacctggcggcagcgcaaaagatg

SEQ ID NO: 123624 - DNA, 103 bp, Artificial Sequence
  Synthetic Polynucleotide
taatacgactcactatagggattctggactgtgattagctgttgtcactaaacagaggagatagtgaatgcagctaatcaacctggcggcagcgcaaaagatg

SEQ ID NO: 123625 - DNA, 103 bp, Artificial Sequence
  Synthetic Polynucleotide
taatacgactcactatagggtcgtcttctaattctggactgtgattagctaacagaggagaagctaaatgcagtccagaaacctggcggcagcgcaaaagatg

SEQ ID NO: 123626 - DNA, 103 bp, Artificial Sequence
  Synthetic Polynucleotide
taatacgactcactatagggaatctctctgtcgtcttctaattctggactaacagaggagaagtccaatgttagaagacaacctggcggcagcgcaaaagatg

SEQ ID NO: 123627 - DNA, 103 bp, Artificial Sequence
  Synthetic Polynucleotide
taatacgactcactataggggctcttcttcaatctctctgtcgtcttctaaacagaggagatagaagatgacagagagaaacctggcggcagcgcaaaagatg

SEQ ID NO: 123628 - DNA, 103 bp, Artificial Sequence
  Synthetic Polynucleotide
taatacgactcactatagggtcagataaaggctcttcttcaatctctctgaacagaggagacagagaatgtgaagaagaaacctggcggcagcgcaaaagatg

SEQ ID NO: 123629 - DNA, 103 bp, Artificial Sequence
  Synthetic Polynucleotide
taatacgactcactatagggatcactgctcttaggagatttcaatccactaacagaggagaagtggaatgaaatctcctaacctggcggcagcgcaaaagatg

SEQ ID NO: 123630 - DNA, 103 bp, Artificial Sequence
  Synthetic Polynucleotide
taatacgactcactatagggttccagatcttcagataaaggctcttcttcaacagaggagagaagaaatgcctttatctaacctggcggcagcgcaaaagatg

SEQ ID NO: 123631 - DNA, 103 bp, Artificial Sequence
  Synthetic Polynucleotide
taatacgactcactataggggtctctgtttatcactgctcttaggagattaacagaggagaaatctcatgagagcagtgaacctggcggcagcgcaaaagatg

SEQ ID NO: 123632 - DNA, 103 bp, Artificial Sequence
  Synthetic Polynucleotide
taatacgactcactatagggtcctgcagtggtctctgtttatcactgctcaacagaggagagagcagatgtaaacagagaacctggcggcagcgcaaaagatg

SEQ ID NO: 123633 - DNA, 103 bp, Artificial Sequence
  Synthetic Polynucleotide
taatacgactcactatagggtggaagcaattcctgcagtggtctctgtttaacagaggagaaaacagatgccactgcagaacctggcggcagcgcaaaagatg

SEQ ID NO: 123634 - DNA, 103 bp, Artificial Sequence
  Synthetic Polynucleotide
taatacgactcactatagggattttgtttctggaagcaattcctgcagtgaacagaggagacactgcatgaattgcttcaacctggcggcagcgcaaaagatg

SEQ ID NO: 123635 - DNA, 103 bp, Artificial Sequence
  Synthetic Polynucleotide
taatacgactcactatagggcagatacataattttgtttctggaagcaataacagaggagaattgctatgagaaacaaaaacctggcggcagcgcaaaagatg

SEQ ID NO: 123636 - DNA, 103 bp, Artificial Sequence
  Synthetic Polynucleotide
taatacgactcactatagggagagtggccacagatacataattttgtttcaacagaggagagaaacaatgttatgtatcaacctggcggcagcgcaaaagatg

SEQ ID NO: 123637 - DNA, 103 bp, Artificial Sequence
  Synthetic Polynucleotide
taatacgactcactatagggcatcaccagaagagtggccacagatacataaacagaggagatatgtaatggtggccactaacctggcggcagcgcaaaagatg

SEQ ID NO: 123638 - DNA, 103 bp, Artificial Sequence
  Synthetic Polynucleotide
taatacgactcactatagggtgattcattgaactgttgcttattgtctctaacagaggagaagagacatgaagcaacagaacctggcggcagcgcaaaagatg

SEQ ID NO: 123639 - DNA, 103 bp, Artificial Sequence
  Synthetic Polynucleotide
taatacgactcactatagggtgaggatgcccatcaccagaagagtggccaaacagaggagatggccaatgttctggtgaaacctggcggcagcgcaaaagatg

SEQ ID NO: 123640 - DNA, 103 bp, Artificial Sequence
  Synthetic Polynucleotide
taatacgactcactatagggaaatgtgttgtgaggatgcccatcaccagaaacagaggagatctggtatggggcatcctaacctggcggcagcgcaaaagatg

SEQ ID NO: 123641 - DNA, 103 bp, Artificial Sequence
  Synthetic Polynucleotide
taatacgactcactatagggcaggcactgcaaatgtgttgtgaggatgccaacagaggagaggcatcatgacaacacataacctggcggcagcgcaaaagatg

SEQ ID NO: 123642 - DNA, 103 bp, Artificial Sequence
  Synthetic Polynucleotide
taatacgactcactataggggccactgacacaggcactgcaaatgtgttgaacagaggagacaacacatgtgcagtgccaacctggcggcagcgcaaaagatg

SEQ ID NO: 123643 - DNA, 103 bp, Artificial Sequence
  Synthetic Polynucleotide
taatacgactcactatagggagtcatcatggccactgacacaggcactgcaacagaggagagcagtgatggtgtcagtgaacctggcggcagcgcaaaagatg

SEQ ID NO: 123644 - DNA, 103 bp, Artificial Sequence
  Synthetic Polynucleotide
taatacgactcactatagggtcacctggggagtcatcatggccactgacaaacagaggagatgtcagatgccatgatgaaacctggcggcagcgcaaaagatg

SEQ ID NO: 123645 - DNA, 103 bp, Artificial Sequence
  Synthetic Polynucleotide
taatacgactcactatagggtgaggggtgatcacctggggagtcatcatgaacagaggagacatgatatgtccccaggtaacctggcggcagcgcaaaagatg

SEQ ID NO: 123646 - DNA, 103 bp, Artificial Sequence
  Synthetic Polynucleotide
taatacgactcactatagggctgcatttgctgaggggtgatcacctggggaacagaggagaccccagatgatcacccctaacctggcggcagcgcaaaagatg

SEQ ID NO: 123647 - DNA, 103 bp, Artificial Sequence
  Synthetic Polynucleotide
taatacgactcactataggggaaggatctgctgcatttgctgaggggtgaaacagaggagatcacccatgagcaaatgcaacctggcggcagcgcaaaagatg

SEQ ID NO: 123648 - DNA, 103 bp, Artificial Sequence
  Synthetic Polynucleotide
taatacgactcactatagggacttgttgctgaaggatctgctgcatttgcaacagaggagagcaaatatggcagatcctaacctggcggcagcgcaaaagatg

SEQ ID NO: 123649 - DNA, 103 bp, Artificial Sequence
  Synthetic Polynucleotide
taatacgactcactatagggcattccattttgattcattgaactgttgctaacagaggagaagcaacatgtcaatgaataacctggcggcagcgcaaaagatg

SEQ ID NO: 123650 - DNA, 103 bp, Artificial Sequence
  Synthetic Polynucleotide
taatacgactcactatagggaggagacaggacttgttgctgaaggatctgaacagaggagacagatcatgcagcaacaaaacctggcggcagcgcaaaagatg

SEQ ID NO: 123651 - DNA, 103 bp, Artificial Sequence
  Synthetic Polynucleotide
taatacgactcactataggggtagctgctgaggagacaggacttgttgctaacagaggagaagcaacatgtcctgtctcaacctggcggcagcgcaaaagatg

SEQ ID NO: 123652 - DNA, 103 bp, Artificial Sequence
  Synthetic Polynucleotide
taatacgactcactatagggagaagggcttgtagctgctgaggagacaggaacagaggagacctgtcatgtcagcagctaacctggcggcagcgcaaaagatg

SEQ ID NO: 123653 - DNA, 103 bp, Artificial Sequence
  Synthetic Polynucleotide
taatacgactcactatagggctgttgttggagaagggcttgtagctgctgaacagaggagacagcagatgcaagcccttaacctggcggcagcgcaaaagatg

SEQ ID NO: 123654 - DNA, 103 bp, Artificial Sequence
  Synthetic Polynucleotide
taatacgactcactatagggtgacagcctgctgttgttggagaagggcttaacagaggagaaagcccatgtccaacaacaacctggcggcagcgcaaaagatg

SEQ ID NO: 123655 - DNA, 103 bp, Artificial Sequence
  Synthetic Polynucleotide
taatacgactcactatagggtgctgcagcatgacagcctgctgttgttggaacagaggagaccaacaatggcaggctgtaacctggcggcagcgcaaaagatg

SEQ ID NO: 123656 - DNA, 103 bp, Artificial Sequence
  Synthetic Polynucleotide
taatacgactcactatagggtagttgttgctgctgcagcatgacagcctgaacagaggagacaggctatgatgctgcagaacctggcggcagcgcaaaagatg

SEQ ID NO: 123657 - DNA, 103 bp, Artificial Sequence
  Synthetic Polynucleotide
taatacgactcactatagggaaaactcttgtagttgttgctgctgcagcaaacagaggagatgctgcatgagcaacaacaacctggcggcagcgcaaaagatg

SEQ ID NO: 123658 - DNA, 103 bp, Artificial Sequence
  Synthetic Polynucleotide
taatacgactcactatagggtgtttcttgtaaaactcttgtagttgttgcaacagaggagagcaacaatgacaagagttaacctggcggcagcgcaaaagatg

SEQ ID NO: 123659 - DNA, 103 bp, Artificial Sequence
  Synthetic Polynucleotide
taatacgactcactatagggctgctcttgctgtttcttgtaaaactcttgaacagaggagacaagagatgtacaagaaaaacctggcggcagcgcaaaagatg

SEQ ID NO: 123660 - DNA, 103 bp, Artificial Sequence
  Synthetic Polynucleotide
taatacgactcactatagggttagagtgctcattccattttgattcattgaacagaggagacaatgaatgaaaatggaaaacctggcggcagcgcaaaagatg

SEQ ID NO: 123661 - DNA, 103 bp, Artificial Sequence
  Synthetic Polynucleotide
taatacgactcactataggggaagatgtaactgctcttgctgtttcttgtaacagaggagaacaagaatgagcaagagcaacctggcggcagcgcaaaagatg

SEQ ID NO: 123662 - DNA, 103 bp, Artificial Sequence
  Synthetic Polynucleotide
taatacgactcactatagggtgcaaaagctgaagatgtaactgctcttgcaacagaggagagcaagaatggttacatctaacctggcggcagcgcaaaagatg

SEQ ID NO: 123663 - DNA, 103 bp, Artificial Sequence
  Synthetic Polynucleotide
taatacgactcactatagggctgctgctgctgcaaaagctgaagatgtaaaacagaggagattacatatgcagcttttgaacctggcggcagcgcaaaagatg

SEQ ID NO: 123664 - DNA, 103 bp, Artificial Sequence
  Synthetic Polynucleotide
taatacgactcactataggggctgctgttgctgctgctgctgcaaaagctaacagaggagaagctttatgagcagcagcaacctggcggcagcgcaaaagatg

SEQ ID NO: 123665 - DNA, 103 bp, Artificial Sequence
  Synthetic Polynucleotide
taatacgactcactatagggtgttgctgctgctgctgttgctgctgctgcaacagaggagagcagcaatggcaacagcaaacctggcggcagcgcaaaagatg

SEQ ID NO: 123666 - DNA, 103 bp, Artificial Sequence
  Synthetic Polynucleotide
taatacgactcactatagggttgctgctgttgttgctgctgctgctgttgaacagaggagacaacagatgcagcagcaaaacctggcggcagcgcaaaagatg

SEQ ID NO: 123667 - DNA, 103 bp, Artificial Sequence
  Synthetic Polynucleotide
taatacgactcactataggggctgctgttgttgctgctgttgttgctgctaacagaggagaagcagcatgaacagcagcaacctggcggcagcgcaaaagatg

SEQ ID NO: 123668 - DNA, 103 bp, Artificial Sequence
  Synthetic Polynucleotide
taatacgactcactatagggtgttgttgctgctgctgttgttgctgctgtaacagaggagaacagcaatgacaacagcaaacctggcggcagcgcaaaagatg

SEQ ID NO: 123669 - DNA, 103 bp, Artificial Sequence
  Synthetic Polynucleotide
taatacgactcactatagggctgttgttgttgttgttgctgctgctgttgaacagaggagacaacagatgcagcaacaaaacctggcggcagcgcaaaagatg

SEQ ID NO: 123670 - DNA, 103 bp, Artificial Sequence
  Synthetic Polynucleotide
taatacgactcactataggggttgttgctgctgttgttgttgttgttgctaacagaggagaagcaacatgaacaacaacaacctggcggcagcgcaaaagatg

SEQ ID NO: 123671 - DNA, 103 bp, Artificial Sequence
  Synthetic Polynucleotide
taatacgactcactatagggaattggctgcttagagtgctcattccatttaacagaggagaaaatggatggagcactctaacctggcggcagcgcaaaagatg

SEQ ID NO: 123672 - DNA, 103 bp, Artificial Sequence
  Synthetic Polynucleotide
taatacgactcactatagggtgctgctgctgttgttgctgctgttgttgtaacagaggagaacaacaatggcagcaacaaacctggcggcagcgcaaaagatg

SEQ ID NO: 123673 - DNA, 103 bp, Artificial Sequence
  Synthetic Polynucleotide
taatacgactcactatagggctgttgctgctgctgctgctgttgttgctgaacagaggagacagcaaatgcagcagcagaacctggcggcagcgcaaaagatg

SEQ ID NO: 123674 - DNA, 103 bp, Artificial Sequence
  Synthetic Polynucleotide
taatacgactcactataggggctgctgctgctgttgctgctgctgctgctaacagaggagaagcagcatgagcagcaacaacctggcggcagcgcaaaagatg

SEQ ID NO: 123675 - DNA, 103 bp, Artificial Sequence
  Synthetic Polynucleotide
taatacgactcactatagggtgctgttgctgctgctgctgctgttgctgcaacagaggagagcagcaatggcagcagcaaacctggcggcagcgcaaaagatg

SEQ ID NO: 123676 - DNA, 103 bp, Artificial Sequence
  Synthetic Polynucleotide
taatacgactcactatagggctttccaggatgctgttgctgctgctgctgaacagaggagacagcagatgcagcaacagaacctggcggcagcgcaaaagatg

SEQ ID NO: 123677 - DNA, 103 bp, Artificial Sequence
  Synthetic Polynucleotide
taatacgactcactatagggctttcgcttgctttccaggatgctgttgctaacagaggagaagcaacatgatcctggaaaacctggcggcagcgcaaaagatg

SEQ ID NO: 123678 - DNA, 103 bp, Artificial Sequence
  Synthetic Polynucleotide
taatacgactcactatagggtgctgctgctctttcgcttgctttccaggaaacagaggagatcctggatggcaagcgaaaacctggcggcagcgcaaaagatg

SEQ ID NO: 123679 - DNA, 103 bp, Artificial Sequence
  Synthetic Polynucleotide
taatacgactcactatagggctgctgctgctgctgctgctctttcgcttgaacagaggagacaagcgatggagcagcagaacctggcggcagcgcaaaagatg

SEQ ID NO: 123680 - DNA, 103 bp, Artificial Sequence
  Synthetic Polynucleotide
taatacgactcactataggggctgttgctgctgctgctgctgctgctgctaacagaggagaagcagcatgagcagcagcaacctggcggcagcgcaaaagatg

SEQ ID NO: 123681 - DNA, 103 bp, Artificial Sequence
  Synthetic Polynucleotide
taatacgactcactataggggctgccaattgctgttgctgctgctgctgcaacagaggagagcagcaatggcagcaacaaacctggcggcagcgcaaaagatg

SEQ ID NO: 123682 - DNA, 103 bp, Artificial Sequence
  Synthetic Polynucleotide
taatacgactcactataggggccagcatctaattggctgcttagagtgctaacagaggagaagcactatgagcagccaaaacctggcggcagcgcaaaagatg

SEQ ID NO: 123683 - DNA, 103 bp, Artificial Sequence
  Synthetic Polynucleotide
taatacgactcactatagggaagctgctgggctgccaattgctgttgctgaacagaggagacagcaaatgcaattggcaaacctggcggcagcgcaaaagatg

SEQ ID NO: 123684 - DNA, 103 bp, Artificial Sequence
  Synthetic Polynucleotide
taatacgactcactataggggctggaagacaagctgctgggctgccaattaacagaggagaaattggatgcccagcagcaacctggcggcagcgcaaaagatg

SEQ ID NO: 123685 - DNA, 103 bp, Artificial Sequence
  Synthetic Polynucleotide
taatacgactcactatagggagaagctgctgctggaagacaagctgctggaacagaggagaccagcaatgtgtcttccaaacctggcggcagcgcaaaagatg

SEQ ID NO: 123686 - DNA, 103 bp, Artificial Sequence
  Synthetic Polynucleotide
taatacgactcactatagggttgcatctggagaagctgctgctggaagacaacagaggagagtcttcatgcagcagcttaacctggcggcagcgcaaaagatg

SEQ ID NO: 123687 - DNA, 103 bp, Artificial Sequence
  Synthetic Polynucleotide
taatacgactcactataggggctggagttgttgcatctggagaagctgctaacagaggagaagcagcatgtccagatgcaacctggcggcagcgcaaaagatg

SEQ ID NO: 123688 - DNA, 103 bp, Artificial Sequence
  Synthetic Polynucleotide
taatacgactcactatagggtgctgctgctgctggagttgttgcatctggaacagaggagaccagatatgacaactccaaacctggcggcagcgcaaaagatg

SEQ ID NO: 123689 - DNA, 103 bp, Artificial Sequence
  Synthetic Polynucleotide
taatacgactcactataggggctgagcagatgctgctgctgctggagttgaacagaggagacaactcatgcagcagcagaacctggcggcagcgcaaaagatg

SEQ ID NO: 123690 - DNA, 103 bp, Artificial Sequence
  Synthetic Polynucleotide
taatacgactcactataggggacgctgaaggctgagcagatgctgctgctaacagaggagaagcagcatgatctgctcaaacctggcggcagcgcaaaagatg

SEQ ID NO: 123691 - DNA, 103 bp, Artificial Sequence
  Synthetic Polynucleotide
taatacgactcactatagggatgagtccctgacgctgaaggctgagcagaaacagaggagatctgctatgccttcagcgaacctggcggcagcgcaaaagatg

SEQ ID NO: 123692 - DNA, 103 bp, Artificial Sequence
  Synthetic Polynucleotide
taatacgactcactatagggtggaatggagatgagtccctgacgctgaagaacagaggagacttcagatgcagggactcaacctggcggcagcgcaaaagatg

SEQ ID NO: 123693 - DNA, 103 bp, Artificial Sequence
  Synthetic Polynucleotide
taatacgactcactatagggcatctctgctgccagcatctaattggctgcaacagaggagagcagccatgtagatgctgaacctggcggcagcgcaaaagatg

SEQ ID NO: 123694 - DNA, 103 bp, Artificial Sequence
  Synthetic Polynucleotide
taatacgactcactatagggcctggccaggtggaatggagatgagtccctaacagaggagaagggacatgtctccattcaacctggcggcagcgcaaaagatg

SEQ ID NO: 123695 - DNA, 103 bp, Artificial Sequence
  Synthetic Polynucleotide
taatacgactcactatagggggaagtgctgcctggccaggtggaatggagaacagaggagactccatatgacctggccaaacctggcggcagcgcaaaagatg

SEQ ID NO: 123696 - DNA, 103 bp, Artificial Sequence
  Synthetic Polynucleotide
taatacgactcactatagggcgattggacaggaagtgctgcctggccaggaacagaggagacctggcatggcagcacttaacctggcggcagcgcaaaagatg

SEQ ID NO: 123697 - DNA, 103 bp, Artificial Sequence
  Synthetic Polynucleotide
taatacgactcactatagggcttgaggcagcgattggacaggaagtgctgaacagaggagacagcacatgctgtccaataacctggcggcagcgcaaaagatg

SEQ ID NO: 123698 - DNA, 103 bp, Artificial Sequence
  Synthetic Polynucleotide
taatacgactcactatagggcttaagccagcttgaggcagcgattggacaaacagaggagatgtccaatggctgcctcaaacctggcggcagcgcaaaagatg

SEQ ID NO: 123699 - DNA, 103 bp, Artificial Sequence
  Synthetic Polynucleotide
taatacgactcactatagggctcagcaggacttaagccagcttgaggcagaacagaggagactgcctatggctggcttaaacctggcggcagcgcaaaagatg

SEQ ID NO: 123700 - DNA, 103 bp, Artificial Sequence
  Synthetic Polynucleotide
taatacgactcactatagggactgctgaatctcagcaggacttaagccagaacagaggagactggctatggtcctgctgaacctggcggcagcgcaaaagatg

SEQ ID NO: 123701 - DNA, 103 bp, Artificial Sequence
  Synthetic Polynucleotide
taatacgactcactatagggtctttccataactgctgaatctcagcaggaaacagaggagatcctgcatggattcagcaaacctggcggcagcgcaaaagatg

SEQ ID NO: 123702 - DNA, 103 bp, Artificial Sequence
  Synthetic Polynucleotide
taatacgactcactatagggtccagtcacttctttccataactgctgaataacagaggagaattcagatgttatggaaaaacctggcggcagcgcaaaagatg

SEQ ID NO: 123703 - DNA, 103 bp, Artificial Sequence
  Synthetic Polynucleotide
taatacgactcactatagggtactgtgaactccagtcacttctttccataaacagaggagatatggaatgaagtgactgaacctggcggcagcgcaaaagatg

SEQ ID NO: 123704 - DNA, 103 bp, Artificial Sequence
  Synthetic Polynucleotide
taatacgactcactatagggcttgatcttccatctctgctgccagcatctaacagaggagaagatgcatgcagcagagaaacctggcggcagcgcaaaagatg

SEQ ID NO: 123705 - DNA, 103 bp, Artificial Sequence
  Synthetic Polynucleotide
taatacgactcactatagggttgtcttccatactgtgaactccagtcactaacagaggagaagtgacatgagttcacagaacctggcggcagcgcaaaagatg

SEQ ID NO: 123706 - DNA, 103 bp, Artificial Sequence
  Synthetic Polynucleotide
taatacgactcactatagggtttaatgccattgtcttccatactgtgaacaacagaggagagttcacatgatggaagacaacctggcggcagcgcaaaagatg

SEQ ID NO: 123707 - DNA, 103 bp, Artificial Sequence
  Synthetic Polynucleotide
taatacgactcactataggggccctccatgtttaatgccattgtcttccaaacagaggagatggaagatgatggcattaaacctggcggcagcgcaaaagatg

SEQ ID NO: 123708 - DNA, 103 bp, Artificial Sequence
  Synthetic Polynucleotide
taatacgactcactataggggtgaggtctagccctccatgtttaatgccaaacagaggagatggcatatgacatggaggaacctggcggcagcgcaaaagatg

SEQ ID NO: 123709 - DNA, 103 bp, Artificial Sequence
  Synthetic Polynucleotide
taatacgactcactatagggattgttagtagtgaggtctagccctccatgaacagaggagacatggaatgctagacctcaacctggcggcagcgcaaaagatg

SEQ ID NO: 123710 - DNA, 103 bp, Artificial Sequence
  Synthetic Polynucleotide
taatacgactcactatagggtcgaggaggaattgttagtagtgaggtctaaacagaggagatagaccatgctactaacaaacctggcggcagcgcaaaagatg

SEQ ID NO: 123711 - DNA, 103 bp, Artificial Sequence
  Synthetic Polynucleotide
taatacgactcactataggggaggaggtagtcgaggaggaattgttagtaaacagaggagatactaaatgttcctcctcaacctggcggcagcgcaaaagatg

SEQ ID NO: 123712 - DNA, 103 bp, Artificial Sequence
  Synthetic Polynucleotide
taatacgactcactatagggggaagtgttggaggaggtagtcgaggaggaaacagaggagatcctccatgactacctccaacctggcggcagcgcaaaagatg

SEQ ID NO: 123713 - DNA, 103 bp, Artificial Sequence
  Synthetic Polynucleotide
taatacgactcactataggggtgatgctttggaagtgttggaggaggtagaacagaggagactacctatgccaacacttaacctggcggcagcgcaaaagatg

SEQ ID NO: 123714 - DNA, 103 bp, Artificial Sequence
  Synthetic Polynucleotide
taatacgactcactataggggttattggtggtgatgctttggaagtgttgaacagaggagacaacacatgcaaagcatcaacctggcggcagcgcaaaagatg

SEQ ID NO: 123715 - DNA, 103 bp, Artificial Sequence
  Synthetic Polynucleotide
taatacgactcactatagggcgagggcttgccaggcctggggttgggcataacagaggagaatgcccatgcccaggcctaacctggcggcagcgcaaaagatg

SEQ ID NO: 123716 - DNA, 103 bp, Artificial Sequence
  Synthetic Polynucleotide
taatacgactcactataggggccccgggcccccagcaggtctgaggctttaacagaggagaaaagccatggacctgctgaacctggcggcagcgcaaaagatg

SEQ ID NO: 123717 - DNA, 103 bp, Artificial Sequence
  Synthetic Polynucleotide
taatacgactcactataggggaaagggggtcgcatgttgtggaacttgaaaacagaggagattcaagatgcacaacatgaacctggcggcagcgcaaaagatg

SEQ ID NO: 123718 - DNA, 103 bp, Artificial Sequence
  Synthetic Polynucleotide
taatacgactcactatagggtggcgtaggtgaaagggggtcgcatgttgtaacagaggagaacaacaatggacccccttaacctggcggcagcgcaaaagatg

SEQ ID NO: 123719 - DNA, 103 bp, Artificial Sequence
  Synthetic Polynucleotide
taatacgactcactatagggcggatgagcgtggcgtaggtgaaagggggtaacagaggagaacccccatgcacctacgcaacctggcggcagcgcaaaagatg

SEQ ID NO: 123720 - DNA, 103 bp, Artificial Sequence
  Synthetic Polynucleotide
taatacgactcactataggggatggcccagcggatgagcgtggcgtaggtaacagaggagaacctacatgacgctcatcaacctggcggcagcgcaaaagatg

SEQ ID NO: 123721 - DNA, 103 bp, Artificial Sequence
  Synthetic Polynucleotide
taatacgactcactataggggagcctccaggatggcccagcggatgagcgaacagaggagacgctcaatggctgggccaaacctggcggcagcgcaaaagatg

SEQ ID NO: 123722 - DNA, 103 bp, Artificial Sequence
  Synthetic Polynucleotide
taatacgactcactatagggtgcttctctggagcctccaggatggcccagaacagaggagactgggcatgcctggaggcaacctggcggcagcgcaaaagatg

SEQ ID NO: 123723 - DNA, 103 bp, Artificial Sequence
  Synthetic Polynucleotide
taatacgactcactataggggagtgtccgctgcttctctggagcctccagaacagaggagactggagatgccagagaagaacctggcggcagcgcaaaagatg

SEQ ID NO: 123724 - DNA, 103 bp, Artificial Sequence
  Synthetic Polynucleotide
taatacgactcactatagggagatctcattgagtgtccgctgcttctctgaacagaggagacagagaatgagcggacacaacctggcggcagcgcaaaagatg

SEQ ID NO: 123725 - DNA, 103 bp, Artificial Sequence
  Synthetic Polynucleotide
taatacgactcactatagggaaccagtggtagatctcattgagtgtccgcaacagaggagagcggacatgcaatgagataacctggcggcagcgcaaaagatg

SEQ ID NO: 123726 - DNA, 103 bp, Artificial Sequence
  Synthetic Polynucleotide
taatacgactcactatagggcatgcgtgtgaaccagtggtagatctcattaacagaggagaaatgagatgtaccactggaacctggcggcagcgcaaaagatg

SEQ ID NO: 123727 - DNA, 103 bp, Artificial Sequence
  Synthetic Polynucleotide
taatacgactcactatagggttccccctgggccccgggcccccagcaggtaacagaggagaacctgcatggggcccgggaacctggcggcagcgcaaaagatg

SEQ ID NO: 123728 - DNA, 103 bp, Artificial Sequence
  Synthetic Polynucleotide
taatacgactcactatagggagaaggcaaacatgcgtgtgaaccagtggtaacagaggagaaccactatgtcacacgcaaacctggcggcagcgcaaaagatg

SEQ ID NO: 123729 - DNA, 103 bp, Artificial Sequence
  Synthetic Polynucleotide
taatacgactcactatagggtggtttctgaagaaggcaaacatgcgtgtgaacagaggagacacacgatggtttgccttaacctggcggcagcgcaaaagatg

SEQ ID NO: 123730 - DNA, 103 bp, Artificial Sequence
  Synthetic Polynucleotide
taatacgactcactatagggggtggcaggatggtttctgaagaaggcaaaaacagaggagatttgccatgttcagaaacaacctggcggcagcgcaaaagatg

SEQ ID NO: 123731 - DNA, 103 bp, Artificial Sequence
  Synthetic Polynucleotide
taatacgactcactatagggcgttcttccaggtggcaggatggtttctgaaacagaggagatcagaaatgatcctgccaaacctggcggcagcgcaaaagatg

SEQ ID NO: 123732 - DNA, 103 bp, Artificial Sequence
  Synthetic Polynucleotide
taatacgactcactatagggtggcggatggcgttcttccaggtggcaggaaacagaggagatcctgcatgctggaagaaaacctggcggcagcgcaaaagatg

SEQ ID NO: 123733 - DNA, 103 bp, Artificial Sequence
  Synthetic Polynucleotide
taatacgactcactatagggactcaggttgtggcggatggcgttcttccaaacagaggagatggaagatggccatccgcaacctggcggcagcgcaaaagatg

SEQ ID NO: 123734 - DNA, 103 bp, Artificial Sequence
  Synthetic Polynucleotide
taatacgactcactatagggacttgtgcagactcaggttgtggcggatggaacagaggagaccatccatgacaacctgaaacctggcggcagcgcaaaagatg

SEQ ID NO: 123735 - DNA, 103 bp, Artificial Sequence
  Synthetic Polynucleotide
taatacgactcactatagggcgcacaaagcacttgtgcagactcaggttgaacagaggagacaacctatgtctgcacaaaacctggcggcagcgcaaaagatg

SEQ ID NO: 123736 - DNA, 103 bp, Artificial Sequence
  Synthetic Polynucleotide
taatacgactcactataggggctctccacccgcacaaagcacttgtgcagaacagaggagactgcacatgtgctttgtgaacctggcggcagcgcaaaagatg

SEQ ID NO: 123737 - DNA, 103 bp, Artificial Sequence
  Synthetic Polynucleotide
taatacgactcactatagggcccccttctcgctctccacccgcacaaagcaacagaggagagctttgatggggtggagaaacctggcggcagcgcaaaagatg

SEQ ID NO: 123738 - DNA, 103 bp, Artificial Sequence
  Synthetic Polynucleotide
taatacgactcactatagggccctggaaggttccccctgggccccgggccaacagaggagaggcccgatgcccagggggaacctggcggcagcgcaaaagatg

SEQ ID NO: 123739 - DNA, 103 bp, Artificial Sequence
  Synthetic Polynucleotide
taatacgactcactataggggtccacacagcccccttctcgctctccaccaacagaggagaggtggaatgcgagaagggaacctggcggcagcgcaaaagatg

SEQ ID NO: 123740 - DNA, 103 bp, Artificial Sequence
  Synthetic Polynucleotide
taatacgactcactatagggctcatccacggtccacacagcccccttctcaacagaggagagagaagatggctgtgtggaacctggcggcagcgcaaaagatg

SEQ ID NO: 123741 - DNA, 103 bp, Artificial Sequence
  Synthetic Polynucleotide
taatacgactcactatagggggaactccagctcatccacggtccacacagaacagaggagactgtgtatgccgtggatgaacctggcggcagcgcaaaagatg

SEQ ID NO: 123742 - DNA, 103 bp, Artificial Sequence
  Synthetic Polynucleotide
taatacgactcactatagggcgtttcttgcggaactccagctcatccacgaacagaggagacgtggaatggctggagttaacctggcggcagcgcaaaagatg

SEQ ID NO: 123743 - DNA, 103 bp, Artificial Sequence
  Synthetic Polynucleotide
taatacgactcactatagggcctctggctccgtttcttgcggaactccagaacagaggagactggagatgcgcaagaaaaacctggcggcagcgcaaaagatg

SEQ ID NO: 123744 - DNA, 103 bp, Artificial Sequence
  Synthetic Polynucleotide
taatacgactcactatagggacctgctgggcctctggctccgtttcttgcaacagaggagagcaagaatgggagccagaaacctggcggcagcgcaaaagatg

SEQ ID NO: 123745 - DNA, 103 bp, Artificial Sequence
  Synthetic Polynucleotide
taatacgactcactataggggggttggaacacctgctgggcctctggctcaacagaggagagagccaatggcccagcagaacctggcggcagcgcaaaagatg

SEQ ID NO: 123746 - DNA, 103 bp, Artificial Sequence
  Synthetic Polynucleotide
taatacgactcactataggggccaggtgtagggttggaacacctgctgggaacagaggagacccagcatgtgttccaacaacctggcggcagcgcaaaagatg

SEQ ID NO: 123747 - DNA, 103 bp, Artificial Sequence
  Synthetic Polynucleotide
taatacgactcactatagggaagatctcggccctggaaggttccccctggaacagaggagaccagggatgaccttccagaacctggcggcagcgcaaaagatg

SEQ ID NO: 123748 - DNA, 103 bp, Artificial Sequence
  Synthetic Polynucleotide
taatacgactcactatagggccccgcctcgaagatctcggccctggaaggaacagaggagaccttccatggccgagatcaacctggcggcagcgcaaaagatg

SEQ ID NO: 123749 - DNA, 103 bp, Artificial Sequence
  Synthetic Polynucleotide
taatacgactcactataggggaggcatgggccccgcctcgaagatctcggaacagaggagaccgagaatgtcgaggcggaacctggcggcagcgcaaaagatg

SEQ ID NO: 123750 - DNA, 103 bp, Artificial Sequence
  Synthetic Polynucleotide
taatacgactcactatagggggaagaagaggaggcatgggccccgcctcgaacagaggagacgaggcatggcccatgccaacctggcggcagcgcaaaagatg

SEQ ID NO: 123751 - DNA, 103 bp, Artificial Sequence
  Synthetic Polynucleotide
taatacgactcactatagggtggggttcaaggaagaagaggaggcatgggaacagaggagacccatgatgcctcttcttaacctggcggcagcgcaaaagatg

SEQ ID NO: 123752 - DNA, 103 bp, Artificial Sequence
  Synthetic Polynucleotide
taatacgactcactataggggatggtggcatggggttcaaggaagaagagaacagaggagactcttcatgcttgaacccaacctggcggcagcgcaaaagatg

SEQ ID NO: 123753 - DNA, 103 bp, Artificial Sequence
  Synthetic Polynucleotide
taatacgactcactatagggctgcagctgcgatggtggcatggggttcaaaacagaggagattgaacatgatgccaccaaacctggcggcagcgcaaaagatg

SEQ ID NO: 123754 - DNA, 103 bp, Artificial Sequence
  Synthetic Polynucleotide
taatacgactcactatagggaggaaggggccgagggcttgccaggcctggaacagaggagaccaggcatggcaagccctaacctggcggcagcgcaaaagatg

SEQ ID NO: 123755 - DNA, 103 bp, Artificial Sequence
  Synthetic Polynucleotide
taatacgactcactataggggtgtgggcagctgcagctgcgatggtggcaaacagaggagatgccacatgcgcagctgcaacctggcggcagcgcaaaagatg

SEQ ID NO: 123756 - DNA, 103 bp, Artificial Sequence
  Synthetic Polynucleotide
taatacgactcactatagggactaggggcagtgtgggcagctgcagctgcaacagaggagagcagctatggctgcccacaacctggcggcagcgcaaaagatg

SEQ ID NO: 123757 - DNA, 103 bp, Artificial Sequence
  Synthetic Polynucleotide
taatacgactcactatagggtgccaccatgactaggggcagtgtgggcagaacagaggagactgcccatgctgcccctaaacctggcggcagcgcaaaagatg

SEQ ID NO: 123758 - DNA, 103 bp, Artificial Sequence
  Synthetic Polynucleotide
taatacgactcactatagggccccggagggtgccaccatgactaggggcaaacagaggagatgccccatgtcatggtggaacctggcggcagcgcaaaagatg

SEQ ID NO: 123759 - DNA, 103 bp, Artificial Sequence
  Synthetic Polynucleotide
taatacgactcactatagggcccagccgtgccccggagggtgccaccatgaacagaggagacatggtatgaccctccggaacctggcggcagcgcaaaagatg

SEQ ID NO: 123760 - DNA, 103 bp, Artificial Sequence
  Synthetic Polynucleotide
taatacgactcactataggggggcaaggggcccagccgtgccccggagggaacagaggagaccctccatggcacggctgaacctggcggcagcgcaaaagatg

SEQ ID NO: 123761 - DNA, 103 bp, Artificial Sequence
  Synthetic Polynucleotide
taatacgactcactatagggcctgtaagtggggcaaggggcccagccgtgaacagaggagacacggcatggccccttgcaacctggcggcagcgcaaaagatg

SEQ ID NO: 123762 - DNA, 103 bp, Artificial Sequence
  Synthetic Polynucleotide
taatacgactcactatagggtggaggagtgcctgtaagtggggcaaggggaacagaggagaccccttatgccacttacaaacctggcggcagcgcaaaagatg

SEQ ID NO: 123763 - DNA, 103 bp, Artificial Sequence
  Synthetic Polynucleotide
taatacgactcactatagggtggcctgtcctggaggagtgcctgtaagtgaacagaggagacacttaatggcactcctcaacctggcggcagcgcaaaagatg

SEQ ID NO: 123764 - DNA, 103 bp, Artificial Sequence
  Synthetic Polynucleotide
taatacgactcactataggggcatgaaatgtggcctgtcctggaggagtgaacagaggagacactccatgaggacaggcaacctggcggcagcgcaaaagatg

SEQ ID NO: 123765 - DNA, 103 bp, Artificial Sequence
  Synthetic Polynucleotide
taatacgactcactatagggccaagggccaaggaaggggccgagggcttgaacagaggagacaagccatgggccccttcaacctggcggcagcgcaaaagatg

SEQ ID NO: 123766 - DNA, 103 bp, Artificial Sequence
  Synthetic Polynucleotide
taatacgactcactataggggagagctggtgcatgaaatgtggcctgtccaacagaggagaggacagatgacatttcataacctggcggcagcgcaaaagatg

SEQ ID NO: 123767 - DNA, 103 bp, Artificial Sequence
  Synthetic Polynucleotide
taatacgactcactatagggatccaccgttgagagctggtgcatgaaatgaacagaggagacatttcatgcaccagctcaacctggcggcagcgcaaaagatg

SEQ ID NO: 123768 - DNA, 103 bp, Artificial Sequence
  Synthetic Polynucleotide
taatacgactcactataggggggcgtgggcatccaccgttgagagctggtaacagaggagaaccagcatgcaacggtggaacctggcggcagcgcaaaagatg

SEQ ID NO: 123769 - DNA, 103 bp, Artificial Sequence
  Synthetic Polynucleotide
taatacgactcactatagggacaggggtccgggcgtgggcatccaccgttaacagaggagaaacggtatgtgcccacgcaacctggcggcagcgcaaaagatg

SEQ ID NO: 123770 - DNA, 103 bp, Artificial Sequence
  Synthetic Polynucleotide
taatacgactcactatagggcacctgcagcacaggggtccgggcgtgggcaacagaggagagcccacatgcggacccctaacctggcggcagcgcaaaagatg

SEQ ID NO: 123771 - DNA, 103 bp, Artificial Sequence
  Synthetic Polynucleotide
taatacgactcactatagggccagggggtgcacctgcagcacaggggtccaacagaggagaggacccatgtgctgcaggaacctggcggcagcgcaaaagatg

SEQ ID NO: 123772 - DNA, 103 bp, Artificial Sequence
  Synthetic Polynucleotide
taatacgactcactataggggctgggctctccagggggtgcacctgcagcaacagaggagagctgcaatggcaccccctaacctggcggcagcgcaaaagatg

SEQ ID NO: 123773 - DNA, 103 bp, Artificial Sequence
  Synthetic Polynucleotide
taatacgactcactataggggctgatcatggctgggctctccagggggtgaacagaggagacaccccatggagagcccaaacctggcggcagcgcaaaagatg

SEQ ID NO: 123774 - DNA, 103 bp, Artificial Sequence
  Synthetic Polynucleotide
taatacgactcactataggggtggtgtgaggctgatcatggctgggctctaacagaggagaagagccatgccatgatcaaacctggcggcagcgcaaaagatg

SEQ ID NO: 123775 - DNA, 103 bp, Artificial Sequence
  Synthetic Polynucleotide
taatacgactcactataggggcggtggtgggtggtgtgaggctgatcatgaacagaggagacatgatatgcctcacaccaacctggcggcagcgcaaaagatg

SEQ ID NO: 123776 - DNA, 103 bp, Artificial Sequence
  Synthetic Polynucleotide
taatacgactcactatagggtggggatgggccaagggccaaggaaggggcaacagaggagagcccctatgttggcccttaacctggcggcagcgcaaaagatg

SEQ ID NO: 123777 - DNA, 103 bp, Artificial Sequence
  Synthetic Polynucleotide
taatacgactcactataggggaccccagtggcggtggtgggtggtgtgagaacagaggagactcacaatgcccaccaccaacctggcggcagcgcaaaagatg

SEQ ID NO: 123778 - DNA, 103 bp, Artificial Sequence
  Synthetic Polynucleotide
taatacgactcactatagggtgagggagaagaccccagtggcggtggtggaacagaggagaccaccaatgccactggggaacctggcggcagcgcaaaagatg

SEQ ID NO: 123779 - DNA, 103 bp, Artificial Sequence
  Synthetic Polynucleotide
taatacgactcactatagggggccgggccttgagggagaagaccccagtgaacagaggagacactggatgcttctccctaacctggcggcagcgcaaaagatg

SEQ ID NO: 123780 - DNA, 103 bp, Artificial Sequence
  Synthetic Polynucleotide
taatacgactcactatagggtgggaggccaggccgggccttgagggagaaaacagaggagattctccatgaaggcccggaacctggcggcagcgcaaaagatg

SEQ ID NO: 123781 - DNA, 103 bp, Artificial Sequence
  Synthetic Polynucleotide
taatacgactcactatagggtgatcccaggtgggaggccaggccgggcctaacagaggagaaggcccatgctggcctccaacctggcggcagcgcaaaagatg

SEQ ID NO: 123782 - DNA, 103 bp, Artificial Sequence
  Synthetic Polynucleotide
taatacgactcactatagggctggccacgttgatcccaggtgggaggccaaacagaggagatggcctatgacctgggataacctggcggcagcgcaaaagatg

SEQ ID NO: 123783 - DNA, 103 bp, Artificial Sequence
  Synthetic Polynucleotide
taatacgactcactatagggccattccaggctggccacgttgatcccaggaacagaggagacctgggatgaacgtggccaacctggcggcagcgcaaaagatg

SEQ ID NO: 123784 - DNA, 103 bp, Artificial Sequence
  Synthetic Polynucleotide
taatacgactcactatagggccctggacacccattccaggctggccacgtaacagaggagaacgtggatggcctggaataacctggcggcagcgcaaaagatg

SEQ ID NO: 123785 - DNA, 103 bp, Artificial Sequence
  Synthetic Polynucleotide
taatacgactcactatagggagtgccggctccctggacacccattccaggaacagaggagacctggaatgggtgtccagaacctggcggcagcgcaaaagatg

SEQ ID NO: 123786 - DNA, 103 bp, Artificial Sequence
  Synthetic Polynucleotide
taatacgactcactatagggggtgcagagcagtgccggctccctggacacaacagaggagagtgtccatggagccggcaaacctggcggcagcgcaaaagatg

SEQ ID NO: 123787 - DNA, 103 bp, Artificial Sequence
  Synthetic Polynucleotide
taatacgactcactataggggcgaggctcctggggatgggccaagggccaaacagaggagatggcccatggcccatcccaacctggcggcagcgcaaaagatg

SEQ ID NO: 123788 - DNA, 103 bp, Artificial Sequence
  Synthetic Polynucleotide
taatacgactcactataggggatttgggaaggtgcagagcagtgccggctaacagaggagaagccggatgtgctctgcaaacctggcggcagcgcaaaagatg

SEQ ID NO: 123789 - DNA, 103 bp, Artificial Sequence
  Synthetic Polynucleotide
taatacgactcactatagggggtgcactgggatttgggaaggtgcagagcaacagaggagagctctgatgcttcccaaaaacctggcggcagcgcaaaagatg

SEQ ID NO: 123790 - DNA, 103 bp, Artificial Sequence
  Synthetic Polynucleotide
taatacgactcactataggggtccttcctgggtgcactgggatttgggaaaacagaggagattcccaatgcccagtgcaaacctggcggcagcgcaaaagatg

SEQ ID NO: 123791 - DNA, 103 bp, Artificial Sequence
  Synthetic Polynucleotide
taatacgactcactatagggaaagggtgctgtccttcctgggtgcactggaacagaggagaccagtgatgccaggaaggaacctggcggcagcgcaaaagatg

SEQ ID NO: 123792 - DNA, 103 bp, Artificial Sequence
  Synthetic Polynucleotide
taatacgactcactatagggggcacagccgaaagggtgctgtccttcctgaacagaggagacaggaaatgcagcaccctaacctggcggcagcgcaaaagatg

SEQ ID NO: 123793 - DNA, 103 bp, Artificial Sequence
  Synthetic Polynucleotide
taatacgactcactatagggggagctctggggcacagccgaaagggtgctaacagaggagaagcaccatgtcggctgtgaacctggcggcagcgcaaaagatg

SEQ ID NO: 123794 - DNA, 103 bp, Artificial Sequence
  Synthetic Polynucleotide
taatacgactcactataggggcagtgggtaggagctctggggcacagccgaacagaggagacggctgatgcccagagctaacctggcggcagcgcaaaagatg

SEQ ID NO: 123795 - DNA, 103 bp, Artificial Sequence
  Synthetic Polynucleotide
taatacgactcactatagggccatttgccagcagtgggtaggagctctggaacagaggagaccagagatgctacccactaacctggcggcagcgcaaaagatg

SEQ ID NO: 123796 - DNA, 103 bp, Artificial Sequence
  Synthetic Polynucleotide
taatacgactcactatagggcttgcagacaccatttgccagcagtgggtaaacagaggagatacccaatgctggcaaataacctggcggcagcgcaaaagatg

SEQ ID NO: 123797 - DNA, 103 bp, Artificial Sequence
  Synthetic Polynucleotide
taatacgactcactatagggatccgggccacttgcagacaccatttgccaaacagaggagatggcaaatggtgtctgcaaacctggcggcagcgcaaaagatg

SEQ ID NO: 123798 - DNA, 103 bp, Artificial Sequence
  Synthetic Polynucleotide
taatacgactcactatagggctccagctgggcgaggctcctggggatgggaacagaggagacccatcatgaggagcctcaacctggcggcagcgcaaaagatg

SEQ ID NO: 123799 - DNA, 103 bp, Artificial Sequence
  Synthetic Polynucleotide
taatacgactcactatagggaccttctcacatccgggccacttgcagacaaacagaggagatgtctgatggtggcccggaacctggcggcagcgcaaaagatg

SEQ ID NO: 123800 - DNA, 103 bp, Artificial Sequence
  Synthetic Polynucleotide
taatacgactcactatagggctcttcgaagaccttctcacatccgggccaaacagaggagatggcccatgtgtgagaagaacctggcggcagcgcaaaagatg

SEQ ID NO: 123801 - DNA, 103 bp, Artificial Sequence
  Synthetic Polynucleotide
taatacgactcactatagggagtcctctggctcttcgaagaccttctcacaacagaggagagtgagaatgtcttcgaagaacctggcggcagcgcaaaagatg

SEQ ID NO: 123802 - DNA, 103 bp, Artificial Sequence
  Synthetic Polynucleotide
taatacgactcactatagggtgcttgaggaagtcctctggctcttcgaagaacagaggagacttcgaatggccagaggaaacctggcggcagcgcaaaagatg

SEQ ID NO: 123803 - DNA, 103 bp, Artificial Sequence
  Synthetic Polynucleotide
taatacgactcactatagggcgcctggcagtgcttgaggaagtcctctggaacagaggagaccagagatgttcctcaagaacctggcggcagcgcaaaagatg

SEQ ID NO: 123804 - DNA, 103 bp, Artificial Sequence
  Synthetic Polynucleotide
taatacgactcactataggggaagatggtccgcctggcagtgcttgaggaaacagaggagatcctcaatgactgccaggaacctggcggcagcgcaaaagatg

SEQ ID NO: 123805 - DNA, 103 bp, Artificial Sequence
  Synthetic Polynucleotide
taatacgactcactatagggttctcatccagaagatggtccgcctggcagaacagaggagactgccaatgggaccatctaacctggcggcagcgcaaaagatg

SEQ ID NO: 123806 - DNA, 103 bp, Artificial Sequence
  Synthetic Polynucleotide
taatacgactcactatagggtgccctgcccttctcatccagaagatggtcaacagaggagagaccatatgctggatgagaacctggcggcagcgcaaaagatg

SEQ ID NO: 123807 - DNA, 103 bp, Artificial Sequence
  Synthetic Polynucleotide
taatacgactcactatagggggagacattgtgccctgcccttctcatccaaacagaggagatggatgatgagggcagggaacctggcggcagcgcaaaagatg

SEQ ID NO: 123808 - DNA, 103 bp, Artificial Sequence
  Synthetic Polynucleotide
taatacgactcactatagggtctctctggaggagacattgtgccctgcccaacagaggagagggcagatgacaatgtctaacctggcggcagcgcaaaagatg

SEQ ID NO: 123809 - DNA, 103 bp, Artificial Sequence
  Synthetic Polynucleotide
taatacgactcactataggggggtgcagccctccagctgggcgaggctccaacagaggagaggagccatgcccagctggaacctggcggcagcgcaaaagatg

SEQ ID NO: 123810 - DNA, 103 bp, Artificial Sequence
  Synthetic Polynucleotide
taatacgactcactatagggctgtaccatctctctctggaggagacattgaacagaggagacaatgtatgctccagagaaacctggcggcagcgcaaaagatg

SEQ ID NO: 123811 - DNA, 103 bp, Artificial Sequence
  Synthetic Polynucleotide
taatacgactcactataggggctccagagactgtaccatctctctctggaaacagaggagatccagaatgagatggtacaacctggcggcagcgcaaaagatg

SEQ ID NO: 123812 - DNA, 103 bp, Artificial Sequence
  Synthetic Polynucleotide
taatacgactcactatagggaccagctgctgctccagagactgtaccatcaacagaggagagatggtatggtctctggaaacctggcggcagcgcaaaagatg

SEQ ID NO: 123813 - DNA, 103 bp, Artificial Sequence
  Synthetic Polynucleotide
taatacgactcactatagggcttctccagcaccagctgctgctccagagaaacagaggagatctctgatgcagcagctgaacctggcggcagcgcaaaagatg

SEQ ID NO: 123814 - DNA, 103 bp, Artificial Sequence
  Synthetic Polynucleotide
taatacgactcactatagggtcagcttctccttctccagcaccagctgctaacagaggagaagcagcatgtgctggagaaacctggcggcagcgcaaaagatg

SEQ ID NO: 123815 - DNA, 103 bp, Artificial Sequence
  Synthetic Polynucleotide
taatacgactcactatagggtgcatggcactcagcttctccttctccagcaacagaggagagctggaatgggagaagctaacctggcggcagcgcaaaagatg

SEQ ID NO: 123816 - DNA, 103 bp, Artificial Sequence
  Synthetic Polynucleotide
taatacgactcactatagggcaggtgggcctgcatggcactcagcttctcaacagaggagagagaagatgagtgccatgaacctggcggcagcgcaaaagatg

SEQ ID NO: 123817 - DNA, 103 bp, Artificial Sequence
  Synthetic Polynucleotide
taatacgactcactatagggttttcccagccaggtgggcctgcatggcacaacagaggagagtgccaatgaggcccaccaacctggcggcagcgcaaaagatg

SEQ ID NO: 123818 - DNA, 103 bp, Artificial Sequence
  Synthetic Polynucleotide
taatacgactcactataggggtcagtgccattttcccagccaggtgggccaacagaggagaggcccaatgggctgggaaaacctggcggcagcgcaaaagatg

SEQ ID NO: 123819 - DNA, 103 bp, Artificial Sequence
  Synthetic Polynucleotide
taatacgactcactatagggtgaagccttggtcagtgccattttcccagcaacagaggagagctgggatgatggcactgaacctggcggcagcgcaaaagatg

SEQ ID NO: 123820 - DNA, 103 bp, Artificial Sequence
  Synthetic Polynucleotide
taatacgactcactatagggctgaggctttgggtgcagccctccagctggaacagaggagaccagctatggggctgcacaacctggcggcagcgcaaaagatg

SEQ ID NO: 123821 - DNA, 103 bp, Artificial Sequence
  Synthetic Polynucleotide
taatacgactcactatagggatgccacagatgaagccttggtcagtgccaaacagaggagatggcacatgccaaggcttaacctggcggcagcgcaaaagatg

SEQ ID NO: 123822 - DNA, 103 bp, Artificial Sequence
  Synthetic Polynucleotide
taatacgactcactatagggttgtcggatgatgccacagatgaagccttgaacagaggagacaaggcatgatctgtggcaacctggcggcagcgcaaaagatg

SEQ ID NO: 123823 - DNA, 103 bp, Artificial Sequence
  Synthetic Polynucleotide
taatacgactcactataggggcaggagcccttgtcggatgatgccacagaaacagaggagatctgtgatgtcatccgacaacctggcggcagcgcaaaagatg

SEQ ID NO: 123824 - DNA, 103 bp, Artificial Sequence
  Synthetic Polynucleotide
taatacgactcactatagggctacgatgcagcaggagcccttgtcggatgaacagaggagacatccgatgagggctcctaacctggcggcagcgcaaaagatg

SEQ ID NO: 123825 - DNA, 103 bp, Artificial Sequence
  Synthetic Polynucleotide
taatacgactcactatagggctgccagcagctacgatgcagcaggagcccaacagaggagagggctcatgctgcatcgtaacctggcggcagcgcaaaagatg

SEQ ID NO: 123826 - DNA, 103 bp, Artificial Sequence
  Synthetic Polynucleotide
taatacgactcactatagggagggccttggctgccagcagctacgatgcaaacagaggagatgcatcatggctgctggcaacctggcggcagcgcaaaagatg

SEQ ID NO: 123827 - DNA, 103 bp, Artificial Sequence
  Synthetic Polynucleotide
taatacgactcactatagggctgggacgacagggccttggctgccagcagaacagaggagactgctgatggccaaggccaacctggcggcagcgcaaaagatg

SEQ ID NO: 123828 - DNA, 103 bp, Artificial Sequence
  Synthetic Polynucleotide
taatacgactcactatagggccagaccaggctgggacgacagggccttggaacagaggagaccaaggatgtgtcgtcccaacctggcggcagcgcaaaagatg

SEQ ID NO: 123829 - DNA, 103 bp, Artificial Sequence
  Synthetic Polynucleotide
taatacgactcactatagggctcccgggggccagaccaggctgggacgacaacagaggagagtcgtcatggcctggtctaacctggcggcagcgcaaaagatg

SEQ ID NO: 123830 - DNA, 103 bp, Artificial Sequence
  Synthetic Polynucleotide
taatacgactcactatagggtgtcaggggcctcccgggggccagaccaggaacagaggagacctggtatggcccccgggaacctggcggcagcgcaaaagatg

SEQ ID NO: 123831 - DNA, 103 bp, Artificial Sequence
  Synthetic Polynucleotide
taatacgactcactatagggcccagcaggtctgaggctttgggtgcagccaacagaggagaggctgcatgcaaagcctcaacctggcggcagcgcaaaagatg

SEQ ID NO: 123832 - DNA, 103 bp, Artificial Sequence
  Synthetic Polynucleotide
taatacgactcactataggggcaaacaggctgtcaggggcctcccgggggaacagaggagacccccgatgggcccctgaaacctggcggcagcgcaaaagatg

SEQ ID NO: 123833 - DNA, 103 bp, Artificial Sequence
  Synthetic Polynucleotide
taatacgactcactatagggcctccggacagcaaacaggctgtcaggggcaacagaggagagcccctatgagcctgtttaacctggcggcagcgcaaaagatg

SEQ ID NO: 123834 - DNA, 103 bp, Artificial Sequence
  Synthetic Polynucleotide
taatacgactcactatagggcccacaggtgcctccggacagcaaacaggcaacagaggagagcctgtatgctgtccggaaacctggcggcagcgcaaaagatg

SEQ ID NO: 123835 - DNA, 103 bp, Artificial Sequence
  Synthetic Polynucleotide
taatacgactcactatagggccatggctaccccacaggtgcctccggacaaacagaggagatgtccgatggcacctgtgaacctggcggcagcgcaaaagatg

SEQ ID NO: 123836 - DNA, 103 bp, Artificial Sequence
  Synthetic Polynucleotide
taatacgactcactatagggtgtgctgtttccatggctaccccacaggtgaacagaggagacacctgatgggtagccataacctggcggcagcgcaaaagatg

SEQ ID NO: 123837 - DNA, 103 bp, Artificial Sequence
  Synthetic Polynucleotide
taatacgactcactatagggactctgggaatgtgctgtttccatggctacaacagaggagagtagccatggaaacagcaaacctggcggcagcgcaaaagatg

SEQ ID NO: 123838 - DNA, 103 bp, Artificial Sequence
  Synthetic Polynucleotide
taatacgactcactatagggttgtggaggaactctgggaatgtgctgtttaacagaggagaaaacagatgattcccagaaacctggcggcagcgcaaaagatg

SEQ ID NO: 123839 - DNA, 103 bp, Artificial Sequence
  Synthetic Polynucleotide
taatacgactcactataggggtagtccatgttgtggaggaactctgggaaaacagaggagattcccaatgttcctccacaacctggcggcagcgcaaaagatg

SEQ ID NO: 123840 - DNA, 103 bp, Artificial Sequence
  Synthetic Polynucleotide
taatacgactcactatagggggaacttgaagtagtccatgttgtggaggaaacagaggagatcctccatgacatggactaacctggcggcagcgcaaaagatg

SEQ ID NO: 123841 - DNA, 103 bp, Artificial Sequence
  Synthetic Polynucleotide
taatacgactcactatagggcgcatgttgtggaacttgaagtagtccatgaacagaggagacatggaatgcttcaagttaacctggcggcagcgcaaaagatg

SEQ ID NO: 123842 - DNA, 103 bp, Artificial Sequence
  Synthetic Polynucleotide
taatacgactcactatagggcgcgcgagggacgaacacctccaacttcataacagaggagaatgaagatggaggtgttcaacctggcggcagcgcaaaagatg

SEQ ID NO: 123843 - DNA, 103 bp, Artificial Sequence
  Synthetic Polynucleotide
taatacgactcactatagggcagggagtcgtctcccgccgccgacagcggaacagaggagaccgctgatggcggcgggaaacctggcggcagcgcaaaagatg

SEQ ID NO: 123844 - DNA, 103 bp, Artificial Sequence
  Synthetic Polynucleotide
taatacgactcactatagggctcggcctcgcgcgcgcccagccgcgccggaacagaggagaccggcgatgctgggcgcgaacctggcggcagcgcaaaagatg

SEQ ID NO: 123845 - DNA, 103 bp, Artificial Sequence
  Synthetic Polynucleotide
taatacgactcactatagggtcggtggcacctcggcctcgcgcgcgcccaaacagaggagatgggcgatggcgaggccgaacctggcggcagcgcaaaagatg

SEQ ID NO: 123846 - DNA, 103 bp, Artificial Sequence
  Synthetic Polynucleotide
taatacgactcactatagggggcggcgcggtcggtggcacctcggcctcgaacagaggagacgaggcatgggtgccaccaacctggcggcagcgcaaaagatg

SEQ ID NO: 123847 - DNA, 103 bp, Artificial Sequence
  Synthetic Polynucleotide
taatacgactcactatagggaagcaggaggggcggcgcggtcggtggcacaacagaggagagtgccaatgaccgcgccgaacctggcggcagcgcaaaagatg

SEQ ID NO: 123848 - DNA, 103 bp, Artificial Sequence
  Synthetic Polynucleotide
taatacgactcactatagggggagaggtgcaagcaggaggggcggcgcggaacagaggagaccgcgcatgccctcctgcaacctggcggcagcgcaaaagatg

SEQ ID NO: 123849 - DNA, 103 bp, Artificial Sequence
  Synthetic Polynucleotide
taatacgactcactataggggccgccgccgggagaggtgcaagcaggaggaacagaggagacctcctatgtgcacctctaacctggcggcagcgcaaaagatg

SEQ ID NO: 123850 - DNA, 103 bp, Artificial Sequence
  Synthetic Polynucleotide
taatacgactcactatagggcttggcgggggccgccgccgggagaggtgcaacagaggagagcacctatgccggcggcgaacctggcggcagcgcaaaagatg

SEQ ID NO: 123851 - DNA, 103 bp, Artificial Sequence
  Synthetic Polynucleotide
taatacgactcactatagggctcggagtggcttggcgggggccgccgccgaacagaggagacggcggatgcccccgccaaacctggcggcagcgcaaaagatg

SEQ ID NO: 123852 - DNA, 103 bp, Artificial Sequence
  Synthetic Polynucleotide
taatacgactcactataggggccgccgggcctcggagtggcttggcggggaacagaggagaccccgcatggccactccgaacctggcggcagcgcaaaagatg

SEQ ID NO: 123853 - DNA, 103 bp, Artificial Sequence
  Synthetic Polynucleotide
taatacgactcactatagggcgcgccgccggccgccgggcctcggagtggaacagaggagaccactcatgggcccggcgaacctggcggcagcgcaaaagatg

SEQ ID NO: 123854 - DNA, 103 bp, Artificial Sequence
  Synthetic Polynucleotide
taatacgactcactatagggcatctgagcccagggagtcgtctcccgccgaacagaggagacggcggatgacgactcccaacctggcggcagcgcaaaagatg

SEQ ID NO: 123855 - DNA, 103 bp, Artificial Sequence
  Synthetic Polynucleotide
taatacgactcactatagggagtacaggtgcgcgccgccggccgccgggcaacagaggagagcccggatgccggcggcgaacctggcggcagcgcaaaagatg

SEQ ID NO: 123856 - DNA, 103 bp, Artificial Sequence
  Synthetic Polynucleotide
taatacgactcactatagggcgcagggggcagtacaggtgcgcgccgccgaacagaggagacggcggatggcacctgtaaacctggcggcagcgcaaaagatg

SEQ ID NO: 123857 - DNA, 103 bp, Artificial Sequence
  Synthetic Polynucleotide
taatacgactcactatagggtgcgggcagccgcagggggcagtacaggtgaacagaggagacacctgatgtgccccctgaacctggcggcagcgcaaaagatg

SEQ ID NO: 123858 - DNA, 103 bp, Artificial Sequence
  Synthetic Polynucleotide
taatacgactcactatagggcctgcagggctgcgggcagccgcagggggcaacagaggagagcccccatgggctgcccgaacctggcggcagcgcaaaagatg

SEQ ID NO: 123859 - DNA, 103 bp, Artificial Sequence
  Synthetic Polynucleotide
taatacgactcactatagggactgaggccgcctgcagggctgcgggcagcaacagaggagagctgccatgagccctgcaaacctggcggcagcgcaaaagatg

SEQ ID NO: 123860 - DNA, 103 bp, Artificial Sequence
  Synthetic Polynucleotide
taatacgactcactatagggagggcggcggactgaggccgcctgcagggcaacagaggagagccctgatggcggcctcaaacctggcggcagcgcaaaagatg

SEQ ID NO: 123861 - DNA, 103 bp, Artificial Sequence
  Synthetic Polynucleotide
taatacgactcactatagggggtgcgggccagggcggcggactgaggccgaacagaggagacggcctatgtccgccgccaacctggcggcagcgcaaaagatg

SEQ ID NO: 123862 - DNA, 103 bp, Artificial Sequence
  Synthetic Polynucleotide
taatacgactcactataggggggtacggcaggtgcgggccagggcggcggaacagaggagaccgccgatgtggcccgcaaacctggcggcagcgcaaaagatg

SEQ ID NO: 123863 - DNA, 103 bp, Artificial Sequence
  Synthetic Polynucleotide
taatacgactcactatagggcgtctccaccgggtacggcaggtgcgggccaacagaggagaggcccgatgctgccgtacaacctggcggcagcgcaaaagatg

SEQ ID NO: 123864 - DNA, 103 bp, Artificial Sequence
  Synthetic Polynucleotide
taatacgactcactatagggaggctaggagcgtctccaccgggtacggcaaacagaggagatgccgtatgcggtggagaaacctggcggcagcgcaaaagatg

SEQ ID NO: 123865 - DNA, 103 bp, Artificial Sequence
  Synthetic Polynucleotide
taatacgactcactataggggcgcagtccccatctgagcccagggagtcgaacagaggagacgactcatggggctcagaaacctggcggcagcgcaaaagatg

SEQ ID NO: 123866 - DNA, 103 bp, Artificial Sequence
  Synthetic Polynucleotide
taatacgactcactataggggctgttggccgcgcagtccccatctgagccaacagaggagaggctcaatgggggactgcaacctggcggcagcgcaaaagatg

SEQ ID NO: 123867 - DNA, 103 bp, Artificial Sequence
  Synthetic Polynucleotide
taatacgactcactatagggccgcggccgggctgttggccgcgcagtcccaacagaggagagggactatgcggccaacaaacctggcggcagcgcaaaagatg

SEQ ID NO: 123868 - DNA, 103 bp, Artificial Sequence
  Synthetic Polynucleotide
taatacgactcactataggggcgccgccgcccgcggccgggctgttggccaacagaggagaggccaaatgcccggccgcaacctggcggcagcgcaaaagatg

SEQ ID NO: 123869 - DNA, 103 bp, Artificial Sequence
  Synthetic Polynucleotide
taatacgactcactatagggcgtatctctggcgccgccgcccgcggccggaacagaggagaccggccatgggcggcggcaacctggcggcagcgcaaaagatg

SEQ ID NO: 123870 - DNA, 103 bp, Artificial Sequence
  Synthetic Polynucleotide
taatacgactcactatagggcgtcgccctgcgtatctctggcgccgccgcaacagaggagagcggcgatgccagagataaacctggcggcagcgcaaaagatg

SEQ ID NO: 123871 - DNA, 103 bp, Artificial Sequence
  Synthetic Polynucleotide
taatacgactcactatagggctctgttcgccgtcgccctgcgtatctctgaacagaggagacagagaatggcagggcgaaacctggcggcagcgcaaaagatg

SEQ ID NO: 123872 - DNA, 103 bp, Artificial Sequence
  Synthetic Polynucleotide
taatacgactcactataggggcctcccgcactctgttcgccgtcgccctgaacagaggagacagggcatgggcgaacagaacctggcggcagcgcaaaagatg

SEQ ID NO: 123873 - DNA, 103 bp, Artificial Sequence
  Synthetic Polynucleotide
taatacgactcactatagggccccgtgggccgcgcgagggacgaacacctaacagaggagaaggtgtatgtccctcgcgaacctggcggcagcgcaaaagatg

SEQ ID NO: 123874 - DNA, 103 bp, Artificial Sequence
  Synthetic Polynucleotide
taatacgactcactatagggcgcccggcccgcctcccgcactctgttcgcaacagaggagagcgaacatggtgcgggagaacctggcggcagcgcaaaagatg

SEQ ID NO: 123875 - DNA, 103 bp, Artificial Sequence
  Synthetic Polynucleotide
taatacgactcactataggggcctcctccgcgcccggcccgcctcccgcaaacagaggagatgcgggatgcgggccgggaacctggcggcagcgcaaaagatg

SEQ ID NO: 123876 - DNA, 103 bp, Artificial Sequence
  Synthetic Polynucleotide
taatacgactcactatagggtgccgggatcgcctcctccgcgcccggcccaacagaggagagggccgatggcggaggagaacctggcggcagcgcaaaagatg

SEQ ID NO: 123877 - DNA, 103 bp, Artificial Sequence
  Synthetic Polynucleotide
taatacgactcactatagggcagcagctgctgccgggatcgcctcctccgaacagaggagacggaggatgcgatcccggaacctggcggcagcgcaaaagatg

SEQ ID NO: 123878 - DNA, 103 bp, Artificial Sequence
  Synthetic Polynucleotide
taatacgactcactatagggaccaccgctgcagcagctgctgccgggatcaacagaggagagatcccatgagcagctgcaacctggcggcagcgcaaaagatg

SEQ ID NO: 123879 - DNA, 103 bp, Artificial Sequence
  Synthetic Polynucleotide
taatacgactcactataggggccctccgccaccaccgctgcagcagctgcaacagaggagagcagctatggcagcggtgaacctggcggcagcgcaaaagatg

SEQ ID NO: 123880 - DNA, 103 bp, Artificial Sequence
  Synthetic Polynucleotide
taatacgactcactatagggcggcctccgcgccctccgccaccaccgctgaacagaggagacagcggatgtggcggaggaacctggcggcagcgcaaaagatg

SEQ ID NO: 123881 - DNA, 103 bp, Artificial Sequence
  Synthetic Polynucleotide
taatacgactcactatagggcccgccgccccggcctccgcgccctccgccaacagaggagaggcggaatgcgcggaggcaacctggcggcagcgcaaaagatg

SEQ ID NO: 123882 - DNA, 103 bp, Artificial Sequence
  Synthetic Polynucleotide
taatacgactcactatagggcgcgcctggccccgccgccccggcctccgcaacagaggagagcggagatgggggcggcgaacctggcggcagcgcaaaagatg

SEQ ID NO: 123883 - DNA, 103 bp, Artificial Sequence
  Synthetic Polynucleotide
taatacgactcactatagggccgcgccgcccgcgcctggccccgccgcccaacagaggagagggcggatgggccaggcgaacctggcggcagcgcaaaagatg

SEQ ID NO: 123884 - DNA, 103 bp, Artificial Sequence
  Synthetic Polynucleotide
taatacgactcactatagggccctgcttgtccccgtgggccgcgcgagggaacagaggagaccctcgatgggcccacggaacctggcggcagcgcaaaagatg

SEQ ID NO: 123885 - DNA, 103 bp, Artificial Sequence
  Synthetic Polynucleotide
taatacgactcactatagggtcgccgctccccgcgccgcccgcgcctggcaacagaggagagccaggatggggcggcgcaacctggcggcagcgcaaaagatg

SEQ ID NO: 123886 - DNA, 103 bp, Artificial Sequence
  Synthetic Polynucleotide
taatacgactcactataggggcgtgcaccctcgccgctccccgcgccgccaacagaggagaggcggcatggggagcggcaacctggcggcagcgcaaaagatg

SEQ ID NO: 123887 - DNA, 103 bp, Artificial Sequence
  Synthetic Polynucleotide
taatacgactcactatagggatggcttgctgcgtgcaccctcgccgctccaacagaggagaggagcgatgagggtgcacaacctggcggcagcgcaaaagatg

SEQ ID NO: 123888 - DNA, 103 bp, Artificial Sequence
  Synthetic Polynucleotide
taatacgactcactatagggcgccgcgtatatggcttgctgcgtgcacccaacagaggagagggtgcatgcagcaagccaacctggcggcagcgcaaaagatg

SEQ ID NO: 123889 - DNA, 103 bp, Artificial Sequence
  Synthetic Polynucleotide
taatacgactcactataggggggcttgggccgccgcgtatatggcttgctaacagaggagaagcaagatgtatacgcggaacctggcggcagcgcaaaagatg

SEQ ID NO: 123890 - DNA, 103 bp, Artificial Sequence
  Synthetic Polynucleotide
taatacgactcactatagggacgagtaggggggcttgggccgccgcgtataacagaggagaatacgcatgggcccaagcaacctggcggcagcgcaaaagatg

SEQ ID NO: 123891 - DNA, 103 bp, Artificial Sequence
  Synthetic Polynucleotide
taatacgactcactatagggagcgcgatgtacgagtaggggggcttgggcaacagaggagagcccaaatgcccctactcaacctggcggcagcgcaaaagatg

SEQ ID NO: 123892 - DNA, 103 bp, Artificial Sequence
  Synthetic Polynucleotide
taatacgactcactatagggcatggcgatgagcgcgatgtacgagtagggaacagaggagaccctacatgtacatcgcgaacctggcggcagcgcaaaagatg

SEQ ID NO: 123893 - DNA, 103 bp, Artificial Sequence
  Synthetic Polynucleotide
taatacgactcactatagggcgcggatggccatggcgatgagcgcgatgtaacagaggagaacatcgatgtcatcgccaaacctggcggcagcgcaaaagatg

SEQ ID NO: 123894 - DNA, 103 bp, Artificial Sequence
  Synthetic Polynucleotide
taatacgactcactatagggcccgccgagtcgcggatggccatggcgatgaacagaggagacatcgcatgggccatccgaacctggcggcagcgcaaaagatg

SEQ ID NO: 123895 - DNA, 103 bp, Artificial Sequence
  Synthetic Polynucleotide
taatacgactcactatagggcaggtcactgccctgcttgtccccgtgggcaacagaggagagcccacatggacaagcagaacctggcggcagcgcaaaagatg

SEQ ID NO: 123896 - DNA, 103 bp, Artificial Sequence
  Synthetic Polynucleotide
taatacgactcactatagggcaagcgcccgcccgccgagtcgcggatggcaacagaggagagccatcatggactcggcgaacctggcggcagcgcaaaagatg

SEQ ID NO: 123897 - DNA, 103 bp, Artificial Sequence
  Synthetic Polynucleotide
taatacgactcactatagggccgccagcgtcaagcgcccgcccgccgagtaacagaggagaactcggatggcgggcgctaacctggcggcagcgcaaaagatg

SEQ ID NO: 123898 - DNA, 103 bp, Artificial Sequence
  Synthetic Polynucleotide
taatacgactcactatagggtcgttgatctccgccagcgtcaagcgcccgaacagaggagacgggcgatggacgctggcaacctggcggcagcgcaaaagatg

SEQ ID NO: 123899 - DNA, 103 bp, Artificial Sequence
  Synthetic Polynucleotide
taatacgactcactatagggcatgaggtactcgttgatctccgccagcgtaacagaggagaacgctgatggagatcaacaacctggcggcagcgcaaaagatg

SEQ ID NO: 123900 - DNA, 103 bp, Artificial Sequence
  Synthetic Polynucleotide
taatacgactcactatagggggaacttgcccatgaggtactcgttgatctaacagaggagaagatcaatgagtacctcaaacctggcggcagcgcaaaagatg

SEQ ID NO: 123901 - DNA, 103 bp, Artificial Sequence
  Synthetic Polynucleotide
taatacgactcactatagggcggaaaaaggggaacttgcccatgaggtacaacagaggagagtacctatggggcaagttaacctggcggcagcgcaaaagatg

SEQ ID NO: 123902 - DNA, 103 bp, Artificial Sequence
  Synthetic Polynucleotide
taatacgactcactataggggtagctgccgcggaaaaaggggaacttgccaacagaggagaggcaagatgccctttttcaacctggcggcagcgcaaaagatg

SEQ ID NO: 123903 - DNA, 103 bp, Artificial Sequence
  Synthetic Polynucleotide
taatacgactcactataggggccagcccgtgtagctgccgcggaaaaaggaacagaggagaccttttatggcggcagctaacctggcggcagcgcaaaagatg

SEQ ID NO: 123904 - DNA, 103 bp, Artificial Sequence
  Synthetic Polynucleotide
taatacgactcactatagggacggagttgcgccagcccgtgtagctgccgaacagaggagacggcagatgcacgggctgaacctggcggcagcgcaaaagatg

SEQ ID NO: 123905 - DNA, 103 bp, Artificial Sequence
  Synthetic Polynucleotide
taatacgactcactataggggttgtggcgcacggagttgcgccagcccgtaacagaggagaacgggcatgcgcaactccaacctggcggcagcgcaaaagatg

SEQ ID NO: 123906 - DNA, 103 bp, Artificial Sequence
  Synthetic Polynucleotide
taatacgactcactatagggccgcgccctccaggtcactgccctgcttgtaacagaggagaacaagcatggcagtgaccaacctggcggcagcgcaaaagatg

SEQ ID NO: 123907 - DNA, 103 bp, Artificial Sequence
  Synthetic Polynucleotide
taatacgactcactatagggtgagcgaaaggttgtggcgcacggagttgcaacagaggagagcaactatgtgcgccacaaacctggcggcagcgcaaaagatg

SEQ ID NO: 123908 - DNA, 103 bp, Artificial Sequence
  Synthetic Polynucleotide
taatacgactcactatagggaagcagtcgttgagcgaaaggttgtggcgcaacagaggagagcgccaatgcctttcgctaacctggcggcagcgcaaaagatg

SEQ ID NO: 123909 - DNA, 103 bp, Artificial Sequence
  Synthetic Polynucleotide
taatacgactcactatagggcaccttgacgaagcagtcgttgagcgaaagaacagaggagactttcgatgaacgactgcaacctggcggcagcgcaaaagatg

SEQ ID NO: 123910 - DNA, 103 bp, Artificial Sequence
  Synthetic Polynucleotide
taatacgactcactatagggggtcgcgcagcaccttgacgaagcagtcgtaacagaggagaacgactatgtcgtcaaggaacctggcggcagcgcaaaagatg

SEQ ID NO: 123911 - DNA, 103 bp, Artificial Sequence
  Synthetic Polynucleotide
taatacgactcactatagggggccgcgaggggtcgcgcagcaccttgacgaacagaggagacgtcaaatggctgcgcgaaacctggcggcagcgcaaaagatg

SEQ ID NO: 123912 - DNA, 103 bp, Artificial Sequence
  Synthetic Polynucleotide
taatacgactcactatagggcttgccccagggccgcgaggggtcgcgcagaacagaggagactgcgcatgccctcgcggaacctggcggcagcgcaaaagatg

SEQ ID NO: 123913 - DNA, 103 bp, Artificial Sequence
  Synthetic Polynucleotide
taatacgactcactatagggagtagttgtccttgccccagggccgcgaggaacagaggagacctcgcatgcctggggcaaacctggcggcagcgcaaaagatg

SEQ ID NO: 123914 - DNA, 103 bp, Artificial Sequence
  Synthetic Polynucleotide
taatacgactcactatagggttgagcatccagtagttgtccttgccccagaacagaggagactggggatgggacaactaaacctggcggcagcgcaaaagatg

SEQ ID NO: 123915 - DNA, 103 bp, Artificial Sequence
  Synthetic Polynucleotide
taatacgactcactataggggctgttggggttgagcatccagtagttgtcaacagaggagagacaacatgtggatgctcaacctggcggcagcgcaaaagatg

SEQ ID NO: 123916 - DNA, 103 bp, Artificial Sequence
  Synthetic Polynucleotide
taatacgactcactatagggaggtgtactcgctgttggggttgagcatccaacagaggagaggatgcatgaccccaacaaacctggcggcagcgcaaaagatg

SEQ ID NO: 123917 - DNA, 103 bp, Artificial Sequence
  Synthetic Polynucleotide
taatacgactcactatagggtcgctgccgcccgcgccctccaggtcactgaacagaggagacagtgaatgggagggcgcaacctggcggcagcgcaaaagatg

SEQ ID NO: 123918 - DNA, 103 bp, Artificial Sequence
  Synthetic Polynucleotide
taatacgactcactatagggccgtcggcgaaggtgtactcgctgttggggaacagaggagaccccaaatgcgagtacacaacctggcggcagcgcaaaagatg

SEQ ID NO: 123919 - DNA, 103 bp, Artificial Sequence
  Synthetic Polynucleotide
taatacgactcactataggggcggaagaccccgtcggcgaaggtgtactcaacagaggagagagtacatgttcgccgacaacctggcggcagcgcaaaagatg

SEQ ID NO: 123920 - DNA, 103 bp, Artificial Sequence
  Synthetic Polynucleotide
taatacgactcactatagggtgcggcggcggcggaagaccccgtcggcgaaacagaggagatcgccgatggggtcttccaacctggcggcagcgcaaaagatg

SEQ ID NO: 123921 - DNA, 103 bp, Artificial Sequence
  Synthetic Polynucleotide
taatacgactcactatagggctgaggcgcttgcggcggcggcggaagaccaacagaggagaggtcttatgccgccgccgaacctggcggcagcgcaaaagatg

SEQ ID NO: 123922 - DNA, 103 bp, Artificial Sequence
  Synthetic Polynucleotide
taatacgactcactatagggcgcgcggtggctgaggcgcttgcggcggcgaacagaggagacgccgcatgaagcgcctcaacctggcggcagcgcaaaagatg

SEQ ID NO: 123923 - DNA, 103 bp, Artificial Sequence
  Synthetic Polynucleotide
taatacgactcactatagggcggggaccggcgcgcggtggctgaggcgctaacagaggagaagcgccatggccaccgcgaacctggcggcagcgcaaaagatg

SEQ ID NO: 123924 - DNA, 103 bp, Artificial Sequence
  Synthetic Polynucleotide
taatacgactcactatagggagcccgggcgcggggaccggcgcgcggtggaacagaggagaccaccgatggccggtcccaacctggcggcagcgcaaaagatg

SEQ ID NO: 123925 - DNA, 103 bp, Artificial Sequence
  Synthetic Polynucleotide
taatacgactcactatagggctcgggccgcagcccgggcgcggggaccggaacagaggagaccggtcatggcgcccgggaacctggcggcagcgcaaaagatg

SEQ ID NO: 123926 - DNA, 103 bp, Artificial Sequence
  Synthetic Polynucleotide
taatacgactcactatagggccggggcctcctcgggccgcagcccgggcgaacagaggagacgcccgatgtgcggcccgaacctggcggcagcgcaaaagatg

SEQ ID NO: 123927 - DNA, 103 bp, Artificial Sequence
  Synthetic Polynucleotide
taatacgactcactataggggcggggaggcccggggcctcctcgggccgcaacagaggagagcggccatgggaggccccaacctggcggcagcgcaaaagatg

SEQ ID NO: 123928 - DNA, 103 bp, Artificial Sequence
  Synthetic Polynucleotide
taatacgactcactatagggggacggcgcgtcgctgccgcccgcgccctcaacagaggagagagggcatgggcggcagcaacctggcggcagcgcaaaagatg

SEQ ID NO: 123929 - DNA, 103 bp, Artificial Sequence
  Synthetic Polynucleotide
taatacgactcactatagggcggcggggcggcggggaggcccggggcctcaacagaggagagaggccatgggcctccccaacctggcggcagcgcaaaagatg

SEQ ID NO: 123930 - DNA, 103 bp, Artificial Sequence
  Synthetic Polynucleotide
taatacgactcactatagggcgggcgcgggcggcggggcggcggggaggcaacagaggagagcctccatgccgccccgcaacctggcggcagcgcaaaagatg

SEQ ID NO: 123931 - DNA, 103 bp, Artificial Sequence
  Synthetic Polynucleotide
taatacgactcactataggggccggggcggcgggcgcgggcggcggggcgaacagaggagacgccccatggcccgcgccaacctggcggcagcgcaaaagatg

SEQ ID NO: 123932 - DNA, 103 bp, Artificial Sequence
  Synthetic Polynucleotide
taatacgactcactataggggcggggcgaggccggggcggcgggcgcgggaacagaggagacccgcgatggccgccccgaacctggcggcagcgcaaaagatg

SEQ ID NO: 123933 - DNA, 103 bp, Artificial Sequence
  Synthetic Polynucleotide
taatacgactcactataggggcgagcgcatgcggggcgaggccggggcggaacagaggagaccgcccatgcctcgccccaacctggcggcagcgcaaaagatg

SEQ ID NO: 123934 - DNA, 103 bp, Artificial Sequence
  Synthetic Polynucleotide
taatacgactcactatagggtggcgggcgggcgagcgcatgcggggcgagaacagaggagactcgccatgcatgcgctcaacctggcggcagcgcaaaagatg

SEQ ID NO: 123935 - DNA, 103 bp, Artificial Sequence
  Synthetic Polynucleotide
taatacgactcactataggggcgctcctcctggcgggcgggcgagcgcataacagaggagaatgcgcatgcccgcccgcaacctggcggcagcgcaaaagatg

SEQ ID NO: 123936 - DNA, 103 bp, Artificial Sequence
  Synthetic Polynucleotide
taatacgactcactatagggcggggctggcgcgctcctcctggcgggcggaacagaggagaccgcccatgaggaggagcaacctggcggcagcgcaaaagatg

SEQ ID NO: 123937 - DNA, 103 bp, Artificial Sequence
  Synthetic Polynucleotide
taatacgactcactatagggaacttgcccgcggggctggcgcgctcctccaacagaggagaggaggaatgcgccagcccaacctggcggcagcgcaaaagatg

SEQ ID NO: 123938 - DNA, 103 bp, Artificial Sequence
  Synthetic Polynucleotide
taatacgactcactatagggggagctggagaacttgcccgcggggctggcaacagaggagagccagcatggcgggcaagaacctggcggcagcgcaaaagatg

SEQ ID NO: 123939 - DNA, 103 bp, Artificial Sequence
  Synthetic Polynucleotide
taatacgactcactatagggccgacagcggggacggcgcgtcgctgccgcaacagaggagagcggcaatgacgcgccgtaacctggcggcagcgcaaaagatg

SEQ ID NO: 123940 - DNA, 103 bp, Artificial Sequence
  Synthetic Polynucleotide
taatacgactcactatagggcgatggcgaaggagctggagaacttgcccgaacagaggagacgggcaatgtctccagctaacctggcggcagcgcaaaagatg

SEQ ID NO: 123941 - DNA, 103 bp, Artificial Sequence
  Synthetic Polynucleotide
taatacgactcactatagggaggatgctgtcgatggcgaaggagctggagaacagaggagactccagatgcttcgccataacctggcggcagcgcaaaagatg

SEQ ID NO: 123942 - DNA, 103 bp, Artificial Sequence
  Synthetic Polynucleotide
taatacgactcactataggggggcttgcgcaggatgctgtcgatggcgaaaacagaggagattcgccatggacagcatcaacctggcggcagcgcaaaagatg

SEQ ID NO: 123943 - DNA, 103 bp, Artificial Sequence
  Synthetic Polynucleotide
taatacgactcactatagggggctgcggaagggcttgcgcaggatgctgtaacagaggagaacagcaatgtgcgcaagcaacctggcggcagcgcaaaagatg

SEQ ID NO: 123944 - DNA, 103 bp, Artificial Sequence
  Synthetic Polynucleotide
taatacgactcactatagggctgaggcggcggctgcggaagggcttgcgcaacagaggagagcgcaaatgcttccgcagaacctggcggcagcgcaaaagatg

SEQ ID NO: 123945 - DNA, 103 bp, Artificial Sequence
  Synthetic Polynucleotide
taatacgactcactatagggggccgtgtccctgaggcggcggctgcggaaaacagaggagattccgcatgcgccgcctcaacctggcggcagcgcaaaagatg

SEQ ID NO: 123946 - DNA, 103 bp, Artificial Sequence
  Synthetic Polynucleotide
taatacgactcactatagggtcgtcccgggggccgtgtccctgaggcggcaacagaggagagccgccatggggacacggaacctggcggcagcgcaaaagatg

SEQ ID NO: 123947 - DNA, 103 bp, Artificial Sequence
  Synthetic Polynucleotide
taatacgactcactatagggcactgaagcgtcgtcccgggggccgtgtccaacagaggagaggacacatgccccgggacaacctggcggcagcgcaaaagatg

SEQ ID NO: 123948 - DNA, 103 bp, Artificial Sequence
  Synthetic Polynucleotide
taatacgactcactatagggcgcggcgccccactgaagcgtcgtcccgggaacagaggagacccgggatgacgcttcagaacctggcggcagcgcaaaagatg

SEQ ID NO: 123949 - DNA, 103 bp, Artificial Sequence
  Synthetic Polynucleotide
taatacgactcactataggggcgggcagggcgcggcgccccactgaagcgaacagaggagacgcttcatgggggcgccgaacctggcggcagcgcaaaagatg

SEQ ID NO: 123950 - DNA, 103 bp, Artificial Sequence
  Synthetic Polynucleotide
taatacgactcactatagggtctcccgccgccgacagcggggacggcgcgaacagaggagacgcgccatgcccgctgtcaacctggcggcagcgcaaaagatg

SEQ ID NO: 123951 - DNA, 103 bp, Artificial Sequence
  Synthetic Polynucleotide
taatacgactcactataggggcgggcagcggcgggcagggcgcggcgcccaacagaggagagggcgcatggccctgcccaacctggcggcagcgcaaaagatg

SEQ ID NO: 123952 - DNA, 103 bp, Artificial Sequence
  Synthetic Polynucleotide
taatacgactcactatagggcgcggggaacgcgggcagcggcgggcagggaacagaggagaccctgcatgccgctgcccaacctggcggcagcgcaaaagatg

SEQ ID NO: 123953 - DNA, 103 bp, Artificial Sequence
  Synthetic Polynucleotide
taatacgactcactatagggcggggaggagcgcggggaacgcgggcagcgaacagaggagacgctgcatgcgttccccgaacctggcggcagcgcaaaagatg

SEQ ID NO: 123954 - DNA, 103 bp, Artificial Sequence
  Synthetic Polynucleotide
taatacgactcactatagggcagggcgccgcggggaggagcgcggggaacaacagaggagagttcccatggctcctcccaacctggcggcagcgcaaaagatg

SEQ ID NO: 123955 - DNA, 103 bp, Artificial Sequence
  Synthetic Polynucleotide
taatacgactcactatagggcagggccctgcagggcgccgcggggaggagaacagaggagactcctcatggcggcgcccaacctggcggcagcgcaaaagatg

SEQ ID NO: 123956 - DNA, 103 bp, Artificial Sequence
  Synthetic Polynucleotide
taatacgactcactatagggagagcggcagcagggccctgcagggcgccgaacagaggagacggcgcatggcagggcccaacctggcggcagcgcaaaagatg

SEQ ID NO: 123957 - DNA, 103 bp, Artificial Sequence
  Synthetic Polynucleotide
taatacgactcactatagggccgtacgcgcagagcggcagcagggccctgaacagaggagacagggcatggctgccgctaacctggcggcagcgcaaaagatg

SEQ ID NO: 123958 - DNA, 103 bp, Artificial Sequence
  Synthetic Polynucleotide
taatacgactcactatagggctcgcccgcgccgtacgcgcagagcggcagaacagaggagactgccgatgtgcgcgtacaacctggcggcagcgcaaaagatg

SEQ ID NO: 123959 - DNA, 103 bp, Artificial Sequence
  Synthetic Polynucleotide
taatacgactcactataggggccgcgccggctcgcccgcgccgtacgcgcaacagaggagagcgcgtatggcgcgggcgaacctggcggcagcgcaaaagatg

SEQ ID NO: 123960 - DNA, 103 bp, Artificial Sequence
  Synthetic Polynucleotide
taatacgactcactatagggcgcgcgcccagccgcgccggctcgcccgcgaacagaggagacgcgggatggccggcgcgaacctggcggcagcgcaaaagatg

SEQ ID NO: 123961 - DNA, 103 bp, Artificial Sequence
  Synthetic Polynucleotide
taatacgactcactataggggccaggcccgggcagaggctgctgctgcataacagaggagaatgcagatgcagcctctgaacctggcggcagcgcaaaagatg

SEQ ID NO: 123962 - DNA, 103 bp, Artificial Sequence
  Synthetic Polynucleotide
taatacgactcactatagggggtggcccgctgccccggtgagctctggataacagaggagaatccagatgtcaccggggaacctggcggcagcgcaaaagatg

SEQ ID NO: 123963 - DNA, 103 bp, Artificial Sequence
  Synthetic Polynucleotide
taatacgactcactatagggtgccactgagggtggcccgctgccccggtgaacagaggagacaccggatgagcgggccaaacctggcggcagcgcaaaagatg

SEQ ID NO: 123964 - DNA, 103 bp, Artificial Sequence
  Synthetic Polynucleotide
taatacgactcactatagggtagcggtagatgccactgagggtggcccgcaacagaggagagcgggcatgcctcagtggaacctggcggcagcgcaaaagatg

SEQ ID NO: 123965 - DNA, 103 bp, Artificial Sequence
  Synthetic Polynucleotide
taatacgactcactataggggcccatgatgtagcggtagatgccactgagaacagaggagactcagtatgatctaccgcaacctggcggcagcgcaaaagatg

SEQ ID NO: 123966 - DNA, 103 bp, Artificial Sequence
  Synthetic Polynucleotide
taatacgactcactatagggaggcgaatcggcccatgatgtagcggtagaaacagaggagatctaccatgacatcatggaacctggcggcagcgcaaaagatg

SEQ ID NO: 123967 - DNA, 103 bp, Artificial Sequence
  Synthetic Polynucleotide
taatacgactcactatagggtggcggtagaaggcgaatcggcccatgatgaacagaggagacatcatatgccgattcgcaacctggcggcagcgcaaaagatg

SEQ ID NO: 123968 - DNA, 103 bp, Artificial Sequence
  Synthetic Polynucleotide
taatacgactcactataggggggccggttgtggcggtagaaggcgaatcgaacagaggagacgattcatgttctaccgcaacctggcggcagcgcaaaagatg

SEQ ID NO: 123969 - DNA, 103 bp, Artificial Sequence
  Synthetic Polynucleotide
taatacgactcactatagggtctgccagccgggccggttgtggcggtagaaacagaggagatctaccatgacaaccggcaacctggcggcagcgcaaaagatg

SEQ ID NO: 123970 - DNA, 103 bp, Artificial Sequence
  Synthetic Polynucleotide
taatacgactcactatagggcggatgctgttctgccagccgggccggttgaacagaggagacaaccgatgcggctggcaaacctggcggcagcgcaaaagatg

SEQ ID NO: 123971 - DNA, 103 bp, Artificial Sequence
  Synthetic Polynucleotide
taatacgactcactatagggcaggttgtggcggatgctgttctgccagccaacagaggagaggctggatgaacagcatcaacctggcggcagcgcaaaagatg

SEQ ID NO: 123972 - DNA, 103 bp, Artificial Sequence
  Synthetic Polynucleotide
taatacgactcactatagggttgtgggggcgccaggcccgggcagaggctaacagaggagaagcctcatgccgggcctgaacctggcggcagcgcaaaagatg

SEQ ID NO: 123973 - DNA, 103 bp, Artificial Sequence
  Synthetic Polynucleotide
taatacgactcactatagggcgttgagtgacaggttgtggcggatgctgtaacagaggagaacagcaatggccacaaccaacctggcggcagcgcaaaagatg

SEQ ID NO: 123974 - DNA, 103 bp, Artificial Sequence
  Synthetic Polynucleotide
taatacgactcactatagggacaaagcactcgttgagtgacaggttgtggaacagaggagaccacaaatggtcactcaaaacctggcggcagcgcaaaagatg

SEQ ID NO: 123975 - DNA, 103 bp, Artificial Sequence
  Synthetic Polynucleotide
taatacgactcactataggggggcaccttgacaaagcactcgttgagtgaaacagaggagatcactcatggagtgctttaacctggcggcagcgcaaaagatg

SEQ ID NO: 123976 - DNA, 103 bp, Artificial Sequence
  Synthetic Polynucleotide
taatacgactcactatagggggtcatcgcggggcaccttgacaaagcactaacagaggagaagtgctatgtcaaggtgcaacctggcggcagcgcaaaagatg

SEQ ID NO: 123977 - DNA, 103 bp, Artificial Sequence
  Synthetic Polynucleotide
taatacgactcactatagggcctggcttgcggtcatcgcggggcaccttgaacagaggagacaaggtatgccgcgatgaaacctggcggcagcgcaaaagatg

SEQ ID NO: 123978 - DNA, 103 bp, Artificial Sequence
  Synthetic Polynucleotide
taatacgactcactataggggctgcccttgcctggcttgcggtcatcgcgaacagaggagacgcgatatgcgcaagccaaacctggcggcagcgcaaaagatg

SEQ ID NO: 123979 - DNA, 103 bp, Artificial Sequence
  Synthetic Polynucleotide
taatacgactcactataggggcgtccagtagctgcccttgcctggcttgcaacagaggagagcaagcatggcaagggcaaacctggcggcagcgcaaaagatg

SEQ ID NO: 123980 - DNA, 103 bp, Artificial Sequence
  Synthetic Polynucleotide
taatacgactcactatagggtcagggtccagcgtccagtagctgcccttgaacagaggagacaagggatgctactggacaacctggcggcagcgcaaaagatg

SEQ ID NO: 123981 - DNA, 103 bp, Artificial Sequence
  Synthetic Polynucleotide
taatacgactcactataggggtcgtggcagtcagggtccagcgtccagtaaacagaggagatactggatgctggaccctaacctggcggcagcgcaaaagatg

SEQ ID NO: 123982 - DNA, 103 bp, Artificial Sequence
  Synthetic Polynucleotide
taatacgactcactataggggctcaaacatgtcgtggcagtcagggtccaaacagaggagatggaccatgactgccacgaacctggcggcagcgcaaaagatg

SEQ ID NO: 123983 - DNA, 103 bp, Artificial Sequence
  Synthetic Polynucleotide
taatacgactcactataggggttggctcagttgtgggggcgccaggcccgaacagaggagacgggccatgcgcccccacaacctggcggcagcgcaaaagatg

SEQ ID NO: 123984 - DNA, 103 bp, Artificial Sequence
  Synthetic Polynucleotide
taatacgactcactatagggaagctgccgtgctcaaacatgtcgtggcagaacagaggagactgccaatgcatgtttgaaacctggcggcagcgcaaaagatg

SEQ ID NO: 123985 - DNA, 103 bp, Artificial Sequence
  Synthetic Polynucleotide
taatacgactcactataggggcggcgtaggaagctgccgtgctcaaacataacagaggagaatgtttatgcacggcagcaacctggcggcagcgcaaaagatg

SEQ ID NO: 123986 - DNA, 103 bp, Artificial Sequence
  Synthetic Polynucleotide
taatacgactcactatagggagcggcggcggcggcgtaggaagctgccgtaacagaggagaacggcaatgtcctacgccaacctggcggcagcgcaaaagatg

SEQ ID NO: 123987 - DNA, 103 bp, Artificial Sequence
  Synthetic Polynucleotide
taatacgactcactatagggtgccgggtgaagcggcggcggcggcgtaggaacagaggagacctacgatgccgccgccgaacctggcggcagcgcaaaagatg

SEQ ID NO: 123988 - DNA, 103 bp, Artificial Sequence
  Synthetic Polynucleotide
taatacgactcactatagggagcacctgtctgccgggtgaagcggcggcgaacagaggagacgccgcatgttcacccggaacctggcggcagcgcaaaagatg

SEQ ID NO: 123989 - DNA, 103 bp, Artificial Sequence
  Synthetic Polynucleotide
taatacgactcactataggggggtgccctcagcacctgtctgccgggtgaaacagaggagatcacccatgagacaggtgaacctggcggcagcgcaaaagatg

SEQ ID NO: 123990 - DNA, 103 bp, Artificial Sequence
  Synthetic Polynucleotide
taatacgactcactataggggcggggccccgggtgccctcagcacctgtcaacagaggagagacaggatgtgagggcacaacctggcggcagcgcaaaagatg

SEQ ID NO: 123991 - DNA, 103 bp, Artificial Sequence
  Synthetic Polynucleotide
taatacgactcactataggggcgtgccttggcggggccccgggtgccctcaacagaggagagagggcatgcggggccccaacctggcggcagcgcaaaagatg

SEQ ID NO: 123992 - DNA, 103 bp, Artificial Sequence
  Synthetic Polynucleotide
taatacgactcactatagggggggtccacggcgtgccttggcggggccccaacagaggagaggggccatgccaaggcacaacctggcggcagcgcaaaagatg

SEQ ID NO: 123993 - DNA, 103 bp, Artificial Sequence
  Synthetic Polynucleotide
taatacgactcactataggggtcgccctgaggggtccacggcgtgccttgaacagaggagacaaggcatgccgtggaccaacctggcggcagcgcaaaagatg

SEQ ID NO: 123994 - DNA, 103 bp, Artificial Sequence
  Synthetic Polynucleotide
taatacgactcactataggggggaggcttggttggctcagttgtgggggcaacagaggagagcccccatgactgagccaaacctggcggcagcgcaaaagatg

SEQ ID NO: 123995 - DNA, 103 bp, Artificial Sequence
  Synthetic Polynucleotide
taatacgactcactataggggtcctggctggtcgccctgaggggtccacgaacagaggagacgtggaatgctcagggcgaacctggcggcagcgcaaaagatg

SEQ ID NO: 123996 - DNA, 103 bp, Artificial Sequence
  Synthetic Polynucleotide
taatacgactcactatagggggactcctgggtcctggctggtcgccctgaaacagaggagatcagggatgccagccaggaacctggcggcagcgcaaaagatg

SEQ ID NO: 123997 - DNA, 103 bp, Artificial Sequence
  Synthetic Polynucleotide
taatacgactcactataggggtggcgttggggactcctgggtcctggctgaacagaggagacagccaatgcccaggagtaacctggcggcagcgcaaaagatg

SEQ ID NO: 123998 - DNA, 103 bp, Artificial Sequence
  Synthetic Polynucleotide
taatacgactcactatagggcctgccggtcgtggcgttggggactcctggaacagaggagaccaggaatgcccaacgccaacctggcggcagcgcaaaagatg

SEQ ID NO: 123999 - DNA, 103 bp, Artificial Sequence
  Synthetic Polynucleotide
taatacgactcactatagggatgagcactgcctgccggtcgtggcgttggaacagaggagaccaacgatgcgaccggcaaacctggcggcagcgcaaaagatg

SEQ ID NO: 124000 - DNA, 103 bp, Artificial Sequence
  Synthetic Polynucleotide
taatacgactcactatagggtctggtgggaatgagcactgcctgccggtcaacagaggagagaccggatggcagtgctcaacctggcggcagcgcaaaagatg

SEQ ID NO: 124001 - DNA, 103 bp, Artificial Sequence
  Synthetic Polynucleotide
taatacgactcactatagggatctggcagctctggtgggaatgagcactgaacagaggagacagtgcatgttcccaccaaacctggcggcagcgcaaaagatg

SEQ ID NO: 124002 - DNA, 103 bp, Artificial Sequence
  Synthetic Polynucleotide
taatacgactcactatagggggcccttgggatctggcagctctggtgggaaacagaggagatcccacatgagctgccagaacctggcggcagcgcaaaagatg

SEQ ID NO: 124003 - DNA, 103 bp, Artificial Sequence
  Synthetic Polynucleotide
taatacgactcactatagggccaaagcttaggcccttgggatctggcagcaacagaggagagctgccatgtcccaagggaacctggcggcagcgcaaaagatg

SEQ ID NO: 124004 - DNA, 103 bp, Artificial Sequence
  Synthetic Polynucleotide
taatacgactcactatagggcaccagacccccaaagcttaggcccttgggaacagaggagacccaagatgctaagctttaacctggcggcagcgcaaaagatg

SEQ ID NO: 124005 - DNA, 103 bp, Artificial Sequence
  Synthetic Polynucleotide
taatacgactcactatagggtgtagctgtagggaggcttggttggctcagaacagaggagactgagcatgccaagcctcaacctggcggcagcgcaaaagatg

SEQ ID NO: 124006 - DNA, 103 bp, Artificial Sequence
  Synthetic Polynucleotide
taatacgactcactataggggcatggcccccaccagacccccaaagcttaaacagaggagataagctatgggggtctggaacctggcggcagcgcaaaagatg

SEQ ID NO: 124007 - DNA, 103 bp, Artificial Sequence
  Synthetic Polynucleotide
taatacgactcactatagggatactggctggcatggcccccaccagacccaacagaggagagggtctatggggggccataacctggcggcagcgcaaaagatg

SEQ ID NO: 124008 - DNA, 103 bp, Artificial Sequence
  Synthetic Polynucleotide
taatacgactcactatagggtgctgggcacatactggctggcatggccccaacagaggagaggggccatgccagccagtaacctggcggcagcgcaaaagatg

SEQ ID NO: 124009 - DNA, 103 bp, Artificial Sequence
  Synthetic Polynucleotide
taatacgactcactatagggcatcagtggttgctgggcacatactggctgaacagaggagacagccaatgtgtgcccagaacctggcggcagcgcaaaagatg

SEQ ID NO: 124010 - DNA, 103 bp, Artificial Sequence
  Synthetic Polynucleotide
taatacgactcactatagggcgaggcctgccatcagtggttgctgggcacaacagaggagagtgcccatgaaccactgaaacctggcggcagcgcaaaagatg

SEQ ID NO: 124011 - DNA, 103 bp, Artificial Sequence
  Synthetic Polynucleotide
taatacgactcactatagggcatgggtggccgaggcctgccatcagtggtaacagaggagaaccactatgggcaggcctaacctggcggcagcgcaaaagatg

SEQ ID NO: 124012 - DNA, 103 bp, Artificial Sequence
  Synthetic Polynucleotide
taatacgactcactatagggctttgggctccatgggtggccgaggcctgcaacagaggagagcaggcatgggccacccaaacctggcggcagcgcaaaagatg

SEQ ID NO: 124013 - DNA, 103 bp, Artificial Sequence
  Synthetic Polynucleotide
taatacgactcactataggggtggaaatctctttgggctccatgggtggcaacagaggagagccaccatgggagcccaaaacctggcggcagcgcaaaagatg

SEQ ID NO: 124014 - DNA, 103 bp, Artificial Sequence
  Synthetic Polynucleotide
taatacgactcactatagggaggcttgggcgtggaaatctctttgggctcaacagaggagagagcccatggagatttccaacctggcggcagcgcaaaagatg

SEQ ID NO: 124015 - DNA, 103 bp, Artificial Sequence
  Synthetic Polynucleotide
taatacgactcactatagggctgggcatgcaggcttgggcgtggaaatctaacagaggagaagatttatgcgcccaagcaacctggcggcagcgcaaaagatg

SEQ ID NO: 124016 - DNA, 103 bp, Artificial Sequence
  Synthetic Polynucleotide
taatacgactcactatagggataagggcgatgtagctgtagggaggcttgaacagaggagacaagccatgctacagctaaacctggcggcagcgcaaaagatg

SEQ ID NO: 124017 - DNA, 103 bp, Artificial Sequence
  Synthetic Polynucleotide
taatacgactcactataggggggagctcccctgggcatgcaggcttgggcaacagaggagagcccaaatgtgcatgcccaacctggcggcagcgcaaaagatg

SEQ ID NO: 124018 - DNA, 103 bp, Artificial Sequence
  Synthetic Polynucleotide
taatacgactcactatagggggtggccacggggagctcccctgggcatgcaacagaggagagcatgcatgggggagctcaacctggcggcagcgcaaaagatg

SEQ ID NO: 124019 - DNA, 103 bp, Artificial Sequence
  Synthetic Polynucleotide
taatacgactcactatagggaggaagatgaggtggccacggggagctcccaacagaggagagggagcatgccgtggccaaacctggcggcagcgcaaaagatg

SEQ ID NO: 124020 - DNA, 103 bp, Artificial Sequence
  Synthetic Polynucleotide
taatacgactcactataggggctgggcatgaggaagatgaggtggccacgaacagaggagacgtggcatgctcatcttcaacctggcggcagcgcaaaagatg

SEQ ID NO: 124021 - DNA, 103 bp, Artificial Sequence
  Synthetic Polynucleotide
taatacgactcactatagggaaagccaaacgctgggcatgaggaagatgaaacagaggagatcatctatgtcatgcccaaacctggcggcagcgcaaaagatg

SEQ ID NO: 124022 - DNA, 103 bp, Artificial Sequence
  Synthetic Polynucleotide
taatacgactcactatagggagccggcaggaaagccaaacgctgggcatgaacagaggagacatgccatgcgtttggctaacctggcggcagcgcaaaagatg

SEQ ID NO: 124023 - DNA, 103 bp, Artificial Sequence
  Synthetic Polynucleotide
taatacgactcactataggggcctctgagaagccggcaggaaagccaaacaacagaggagagtttggatgtcctgccggaacctggcggcagcgcaaaagatg

SEQ ID NO: 124024 - DNA, 103 bp, Artificial Sequence
  Synthetic Polynucleotide
taatacgactcactatagggaaaactctcagcctctgagaagccggcaggaacagaggagacctgccatgttctcagagaacctggcggcagcgcaaaagatg

SEQ ID NO: 124025 - DNA, 103 bp, Artificial Sequence
  Synthetic Polynucleotide
taatacgactcactataggggggccttattaaaactctcagcctctgagaaacagaggagatctcagatgctgagagttaacctggcggcagcgcaaaagatg

SEQ ID NO: 124026 - DNA, 103 bp, Artificial Sequence
  Synthetic Polynucleotide
taatacgactcactatagggacgggcgtaggggccttattaaaactctcaaacagaggagatgagagatgtaataaggcaacctggcggcagcgcaaaagatg

SEQ ID NO: 124027 - DNA, 103 bp, Artificial Sequence
  Synthetic Polynucleotide
taatacgactcactatagggggccatagcaataagggcgatgtagctgtaaacagaggagatacagcatgatcgcccttaacctggcggcagcgcaaaagatg

SEQ ID NO: 124028 - DNA, 103 bp, Artificial Sequence
  Synthetic Polynucleotide
taatacgactcactatagggcggggacaagacgggcgtaggggccttattaacagaggagaaataagatgcctacgcccaacctggcggcagcgcaaaagatg

SEQ ID NO: 124029 - DNA, 103 bp, Artificial Sequence
  Synthetic Polynucleotide
taatacgactcactatagggtgcctgattccggggacaagacgggcgtagaacagaggagactacgcatgtcttgtcccaacctggcggcagcgcaaaagatg

SEQ ID NO: 124030 - DNA, 103 bp, Artificial Sequence
  Synthetic Polynucleotide
taatacgactcactatagggctgctcccgatgcctgattccggggacaagaacagaggagacttgtcatgggaatcaggaacctggcggcagcgcaaaagatg

SEQ ID NO: 124031 - DNA, 103 bp, Artificial Sequence
  Synthetic Polynucleotide
taatacgactcactatagggacactggtagctgctcccgatgcctgattcaacagaggagagaatcaatgatcgggagcaacctggcggcagcgcaaaagatg

SEQ ID NO: 124032 - DNA, 103 bp, Artificial Sequence
  Synthetic Polynucleotide
taatacgactcactatagggcctgcagccgacactggtagctgctcccgaaacagaggagatcgggaatggctaccagtaacctggcggcagcgcaaaagatg

SEQ ID NO: 124033 - DNA, 103 bp, Artificial Sequence
  Synthetic Polynucleotide
taatacgactcactatagggaaattcagtgcctgcagccgacactggtagaacagaggagactaccaatgtcggctgcaaacctggcggcagcgcaaaagatg

SEQ ID NO: 124034 - DNA, 103 bp, Artificial Sequence
  Synthetic Polynucleotide
taatacgactcactatagggccccatgcaaaaattcagtgcctgcagccgaacagaggagacggctgatggcactgaataacctggcggcagcgcaaaagatg

SEQ ID NO: 124035 - DNA, 103 bp, Artificial Sequence
  Synthetic Polynucleotide
taatacgactcactatagggctgggtcagcccccatgcaaaaattcagtgaacagaggagacactgaatgtttgcatggaacctggcggcagcgcaaaagatg

SEQ ID NO: 124036 - DNA, 103 bp, Artificial Sequence
  Synthetic Polynucleotide
taatacgactcactatagggtgctcaaggcctgggtcagcccccatgcaaaacagaggagattgcatatgggctgacccaacctggcggcagcgcaaaagatg

SEQ ID NO: 124037 - DNA, 103 bp, Artificial Sequence
  Synthetic Polynucleotide
taatacgactcactatagggggccaagaggtgctcaaggcctgggtcagcaacagaggagagctgacatgggccttgagaacctggcggcagcgcaaaagatg

SEQ ID NO: 124038 - DNA, 103 bp, Artificial Sequence
  Synthetic Polynucleotide
taatacgactcactatagggagctctggatggccatagcaataagggcgaaacagaggagatcgcccatgttgctatggaacctggcggcagcgcaaaagatg

SEQ ID NO: 124039 - DNA, 103 bp, Artificial Sequence
  Synthetic Polynucleotide
taatacgactcactataggggggctgctgaggccaagaggtgctcaaggcaacagaggagagccttgatgacctcttggaacctggcggcagcgcaaaagatg

SEQ ID NO: 124040 - DNA, 103 bp, Artificial Sequence
  Synthetic Polynucleotide
taatacgactcactataggggcaggggagggggctgctgaggccaagaggaacagaggagacctcttatgctcagcagcaacctggcggcagcgcaaaagatg

SEQ ID NO: 124041 - DNA, 103 bp, Artificial Sequence
  Synthetic Polynucleotide
taatacgactcactatagggggtgggtggtgcaggggagggggctgctgaaacagaggagatcagcaatgccctcccctaacctggcggcagcgcaaaagatg

SEQ ID NO: 124042 - DNA, 103 bp, Artificial Sequence
  Synthetic Polynucleotide
taatacgactcactatagggagcctggaggggtgggtggtgcaggggaggaacagaggagacctcccatgcaccacccaaacctggcggcagcgcaaaagatg

SEQ ID NO: 124043 - DNA, 103 bp, Artificial Sequence
  Synthetic Polynucleotide
taatacgactcactataggggcccggagtgagcctggaggggtgggtggtaacagaggagaaccaccatgccctccaggaacctggcggcagcgcaaaagatg

SEQ ID NO: 124044 - DNA, 103 bp, Artificial Sequence
  Synthetic Polynucleotide
taatacgactcactataggggggcagtggggcccggagtgagcctggaggaacagaggagacctccaatgtcactccggaacctggcggcagcgcaaaagatg

SEQ ID NO: 124045 - DNA, 103 bp, Artificial Sequence
  Synthetic Polynucleotide
taatacgactcactatagggcagttggcaggggcagtggggcccggagtgaacagaggagacactccatgccccactgcaacctggcggcagcgcaaaagatg

SEQ ID NO: 124046 - DNA, 103 bp, Artificial Sequence
  Synthetic Polynucleotide
taatacgactcactatagggtccttgtggtcagttggcaggggcagtgggaacagaggagacccactatgcctgccaacaacctggcggcagcgcaaaagatg

SEQ ID NO: 124047 - DNA, 103 bp, Artificial Sequence
  Synthetic Polynucleotide
taatacgactcactatagggaacccagggttccttgtggtcagttggcagaacagaggagactgccaatggaccacaagaacctggcggcagcgcaaaagatg

SEQ ID NO: 124048 - DNA, 103 bp, Artificial Sequence
  Synthetic Polynucleotide
taatacgactcactatagggagccacctgcaacccagggttccttgtggtaacagaggagaaccacaatgaaccctgggaacctggcggcagcgcaaaagatg

SEQ ID NO: 124049 - DNA, 103 bp, Artificial Sequence
  Synthetic Polynucleotide
taatacgactcactatagggtgccccggtgagctctggatggccatagcaaacagaggagatgctatatgcatccagagaacctggcggcagcgcaaaagatg

SEQ ID NO: 124050 - DNA, 103 bp, Artificial Sequence
  Synthetic Polynucleotide
taatacgactcactatagggtggacagggaagccacctgcaacccagggtaacagaggagaaccctgatgtgcaggtggaacctggcggcagcgcaaaagatg

SEQ ID NO: 124051 - DNA, 103 bp, Artificial Sequence
  Synthetic Polynucleotide
taatacgactcactatagggggagcctccctggacagggaagccacctgcaacagaggagagcaggtatgttccctgtcaacctggcggcagcgcaaaagatg

SEQ ID NO: 124052 - DNA, 103 bp, Artificial Sequence
  Synthetic Polynucleotide
taatacgactcactatagggatgggtagccggagcctccctggacagggaaacagaggagatccctgatgagggaggctaacctggcggcagcgcaaaagatg

SEQ ID NO: 124053 - DNA, 103 bp, Artificial Sequence
  Synthetic Polynucleotide
taatacgactcactataggggtcagccccaatgggtagccggagcctcccaacagaggagagggaggatgcggctacccaacctggcggcagcgcaaaagatg

SEQ ID NO: 124054 - DNA, 103 bp, Artificial Sequence
  Synthetic Polynucleotide
taatacgactcactatagggtaggcagggggtcagccccaatgggtagccaacagaggagaggctacatgttggggctgaacctggcggcagcgcaaaagatg

SEQ ID NO: 124055 - DNA, 103 bp, Artificial Sequence
  Synthetic Polynucleotide
taatacgactcactataggggcgtccggtataggcagggggtcagccccaaacagaggagatggggcatgccccctgccaacctggcggcagcgcaaaagatg

SEQ ID NO: 124056 - DNA, 103 bp, Artificial Sequence
  Synthetic Polynucleotide
taatacgactcactatagggaacattcctggcgtccggtataggcaggggaacagaggagacccctgatgataccggacaacctggcggcagcgcaaaagatg

SEQ ID NO: 124057 - DNA, 103 bp, Artificial Sequence
  Synthetic Polynucleotide
taatacgactcactatagggctcaaagaagaacattcctggcgtccggtaaacagaggagataccggatgccaggaatgaacctggcggcagcgcaaaagatg

SEQ ID NO: 124058 - DNA, 103 bp, Artificial Sequence
  Synthetic Polynucleotide
taatacgactcactatagggagcgctctgcccctgcaccagctccgccataacagaggagaatggcgatgctggtgcagaacctggcggcagcgcaaaagatg

SEQ ID NO: 124059 - DNA, 103 bp, Artificial Sequence
  Synthetic Polynucleotide
taatacgactcactatagggattcaagtgaggaattgaatcaattttagcaacagaggagagctaaaatggattcaattaacctggcggcagcgcaaaagatg

SEQ ID NO: 124060 - DNA, 103 bp, Artificial Sequence
  Synthetic Polynucleotide
taatacgactcactatagggacctcttcctctggctgctgccaggcctccaacagaggagaggaggcatggcagcagccaacctggcggcagcgcaaaagatg

SEQ ID NO: 124061 - DNA, 103 bp, Artificial Sequence
  Synthetic Polynucleotide
taatacgactcactatagggcacggccacgacctcttcctctggctgctgaacagaggagacagcagatggaggaagagaacctggcggcagcgcaaaagatg

SEQ ID NO: 124062 - DNA, 103 bp, Artificial Sequence
  Synthetic Polynucleotide
taatacgactcactatagggctccagtcgccacggccacgacctcttcctaacagaggagaaggaagatgtcgtggccgaacctggcggcagcgcaaaagatg

SEQ ID NO: 124063 - DNA, 103 bp, Artificial Sequence
  Synthetic Polynucleotide
taatacgactcactatagggggctcccacgctccagtcgccacggccacgaacagaggagacgtggcatgggcgactggaacctggcggcagcgcaaaagatg

SEQ ID NO: 124064 - DNA, 103 bp, Artificial Sequence
  Synthetic Polynucleotide
taatacgactcactatagggcgccaccaggggctcccacgctccagtcgcaacagaggagagcgactatggcgtgggagaacctggcggcagcgcaaaagatg

SEQ ID NO: 124065 - DNA, 103 bp, Artificial Sequence
  Synthetic Polynucleotide
taatacgactcactatagggatctcctggacgccaccaggggctcccacgaacagaggagacgtgggatgccctggtggaacctggcggcagcgcaaaagatg

SEQ ID NO: 124066 - DNA, 103 bp, Artificial Sequence
  Synthetic Polynucleotide
taatacgactcactatagggcgtgtatgttatctcctggacgccaccaggaacagaggagacctggtatggtccaggagaacctggcggcagcgcaaaagatg

SEQ ID NO: 124067 - DNA, 103 bp, Artificial Sequence
  Synthetic Polynucleotide
taatacgactcactatagggcggctggcaccgtgtatgttatctcctggaaacagaggagatccaggatgtaacatacaaacctggcggcagcgcaaaagatg

SEQ ID NO: 124068 - DNA, 103 bp, Artificial Sequence
  Synthetic Polynucleotide
taatacgactcactatagggccacacttatcggctggcaccgtgtatgttaacagaggagaaacataatgggtgccagcaacctggcggcagcgcaaaagatg

SEQ ID NO: 124069 - DNA, 103 bp, Artificial Sequence
  Synthetic Polynucleotide
taatacgactcactatagggtatgacgaggccacacttatcggctggcacaacagaggagagtgccaatggataagtgtaacctggcggcagcgcaaaagatg

SEQ ID NO: 124070 - DNA, 103 bp, Artificial Sequence
  Synthetic Polynucleotide
taatacgactcactataggggtgtggaattattcaagtgaggaattgaataacagaggagaattcaaatgctcacttgaaacctggcggcagcgcaaaagatg

SEQ ID NO: 124071 - DNA, 103 bp, Artificial Sequence
  Synthetic Polynucleotide
taatacgactcactatagggcccctttgcctatgacgaggccacacttataacagaggagaataagtatggcctcgtcaaacctggcggcagcgcaaaagatg

SEQ ID NO: 124072 - DNA, 103 bp, Artificial Sequence
  Synthetic Polynucleotide
taatacgactcactatagggatgttctcaccccctttgcctatgacgaggaacagaggagacctcgtatgaggcaaaggaacctggcggcagcgcaaaagatg

SEQ ID NO: 124073 - DNA, 103 bp, Artificial Sequence
  Synthetic Polynucleotide
taatacgactcactataggggatgcttttgatgttctcaccccctttgccaacagaggagaggcaaaatgggtgagaacaacctggcggcagcgcaaaagatg

SEQ ID NO: 124074 - DNA, 103 bp, Artificial Sequence
  Synthetic Polynucleotide
taatacgactcactatagggactgctggttgatgcttttgatgttctcacaacagaggagagtgagaatgtcaaaagcaaacctggcggcagcgcaaaagatg

SEQ ID NO: 124075 - DNA, 103 bp, Artificial Sequence
  Synthetic Polynucleotide
taatacgactcactatagggtgcgcccctgactgctggttgatgcttttgaacagaggagacaaaagatgcaaccagcaaacctggcggcagcgcaaaagatg

SEQ ID NO: 124076 - DNA, 103 bp, Artificial Sequence
  Synthetic Polynucleotide
taatacgactcactatagggaagctccacgtgcgcccctgactgctggttaacagaggagaaaccagatgtcaggggcgaacctggcggcagcgcaaaagatg

SEQ ID NO: 124077 - DNA, 103 bp, Artificial Sequence
  Synthetic Polynucleotide
taatacgactcactatagggggttcctctgaagctccacgtgcgcccctgaacagaggagacaggggatgacgtggagcaacctggcggcagcgcaaaagatg

SEQ ID NO: 124078 - DNA, 103 bp, Artificial Sequence
  Synthetic Polynucleotide
taatacgactcactatagggttgggaggggggttcctctgaagctccacgaacagaggagacgtggaatgtcagaggaaaacctggcggcagcgcaaaagatg

SEQ ID NO: 124079 - DNA, 103 bp, Artificial Sequence
  Synthetic Polynucleotide
taatacgactcactatagggggggtcgctgttgggaggggggttcctctgaacagaggagacagaggatgccccctcccaacctggcggcagcgcaaaagatg

SEQ ID NO: 124080 - DNA, 103 bp, Artificial Sequence
  Synthetic Polynucleotide
taatacgactcactatagggtccgcaggttggggtcgctgttgggaggggaacagaggagacccctcatgacagcgaccaacctggcggcagcgcaaaagatg

SEQ ID NO: 124081 - DNA, 103 bp, Artificial Sequence
  Synthetic Polynucleotide
taatacgactcactatagggtccactagaggtgtggaattattcaagtgaaacagaggagatcacttatgtaattccacaacctggcggcagcgcaaaagatg

SEQ ID NO: 124082 - DNA, 103 bp, Artificial Sequence
  Synthetic Polynucleotide
taatacgactcactatagggatggtgaatctccgcaggttggggtcgctgaacagaggagacagcgaatgcaacctgcgaacctggcggcagcgcaaaagatg

SEQ ID NO: 124083 - DNA, 103 bp, Artificial Sequence
  Synthetic Polynucleotide
taatacgactcactatagggaacccccctgatggtgaatctccgcaggttaacagaggagaaacctgatgagattcaccaacctggcggcagcgcaaaagatg

SEQ ID NO: 124084 - DNA, 103 bp, Artificial Sequence
  Synthetic Polynucleotide
taatacgactcactatagggtctgctggggaacccccctgatggtgaatcaacagaggagagattcaatgtcaggggggaacctggcggcagcgcaaaagatg

SEQ ID NO: 124085 - DNA, 103 bp, Artificial Sequence
  Synthetic Polynucleotide
taatacgactcactataggggccacctcgatctgctggggaacccccctgaacagaggagacaggggatgtccccagcaaacctggcggcagcgcaaaagatg

SEQ ID NO: 124086 - DNA, 103 bp, Artificial Sequence
  Synthetic Polynucleotide
taatacgactcactataggggagctgcctggccacctcgatctgctggggaacagaggagaccccagatgatcgaggtgaacctggcggcagcgcaaaagatg

SEQ ID NO: 124087 - DNA, 103 bp, Artificial Sequence
  Synthetic Polynucleotide
taatacgactcactatagggtctcatctatgagctgcctggccacctcgaaacagaggagatcgaggatgccaggcagcaacctggcggcagcgcaaaagatg

SEQ ID NO: 124088 - DNA, 103 bp, Artificial Sequence
  Synthetic Polynucleotide
taatacgactcactatagggccgccaactttctcatctatgagctgcctgaacagaggagacaggcaatgcatagatgaaacctggcggcagcgcaaaagatg

SEQ ID NO: 124089 - DNA, 103 bp, Artificial Sequence
  Synthetic Polynucleotide
taatacgactcactataggggagattggtcccgccaactttctcatctataacagaggagaatagatatgaaagttggcaacctggcggcagcgcaaaagatg

SEQ ID NO: 124090 - DNA, 103 bp, Artificial Sequence
  Synthetic Polynucleotide
taatacgactcactatagggcaggtgctccgagattggtcccgccaacttaacagaggagaaagttgatgggaccaatcaacctggcggcagcgcaaaagatg

SEQ ID NO: 124091 - DNA, 103 bp, Artificial Sequence
  Synthetic Polynucleotide
taatacgactcactatagggccgaaggctccaggtgctccgagattggtcaacagaggagagaccaaatgcggagcaccaacctggcggcagcgcaaaagatg

SEQ ID NO: 124092 - DNA, 103 bp, Artificial Sequence
  Synthetic Polynucleotide
taatacgactcactatagggtactgaggggtccactagaggtgtggaattaacagaggagaaattccatgcctctagtgaacctggcggcagcgcaaaagatg

SEQ ID NO: 124093 - DNA, 103 bp, Artificial Sequence
  Synthetic Polynucleotide
taatacgactcactatagggtggactctgtccgaaggctccaggtgctccaacagaggagaggagcaatgggagccttcaacctggcggcagcgcaaaagatg

SEQ ID NO: 124094 - DNA, 103 bp, Artificial Sequence
  Synthetic Polynucleotide
taatacgactcactataggggctggctgaatggactctgtccgaaggctcaacagaggagagagcctatggacagagtcaacctggcggcagcgcaaaagatg

SEQ ID NO: 124095 - DNA, 103 bp, Artificial Sequence
  Synthetic Polynucleotide
taatacgactcactatagggggggcaggtggctggctgaatggactctgtaacagaggagaacagagatgattcagccaaacctggcggcagcgcaaaagatg

SEQ ID NO: 124096 - DNA, 103 bp, Artificial Sequence
  Synthetic Polynucleotide
taatacgactcactatagggttgatgaggtggggcaggtggctggctgaaaacagaggagattcagcatgccacctgccaacctggcggcagcgcaaaagatg

SEQ ID NO: 124097 - DNA, 103 bp, Artificial Sequence
  Synthetic Polynucleotide
taatacgactcactataggggaaaggtattttgatgaggtggggcaggtgaacagaggagacacctgatgcacctcatcaacctggcggcagcgcaaaagatg

SEQ ID NO: 124098 - DNA, 103 bp, Artificial Sequence
  Synthetic Polynucleotide
taatacgactcactatagggctccttggaggaaaggtattttgatgaggtaacagaggagaacctcaatgaaataccttaacctggcggcagcgcaaaagatg

SEQ ID NO: 124099 - DNA, 103 bp, Artificial Sequence
  Synthetic Polynucleotide
taatacgactcactataggggcacccggagctccttggaggaaaggtattaacagaggagaaataccatgcctccaaggaacctggcggcagcgcaaaagatg

SEQ ID NO: 124100 - DNA, 103 bp, Artificial Sequence
  Synthetic Polynucleotide
taatacgactcactatagggtgtttgggaagcacccggagctccttggagaacagaggagactccaaatggctccgggtaacctggcggcagcgcaaaagatg

SEQ ID NO: 124101 - DNA, 103 bp, Artificial Sequence
  Synthetic Polynucleotide
taatacgactcactatagggttggcagccatgtttgggaagcacccggagaacagaggagactccggatgcttcccaaaaacctggcggcagcgcaaaagatg

SEQ ID NO: 124102 - DNA, 103 bp, Artificial Sequence
  Synthetic Polynucleotide
taatacgactcactatagggcccattcaccttggcagccatgtttgggaaaacagaggagattcccaatgatggctgccaacctggcggcagcgcaaaagatg

SEQ ID NO: 124103 - DNA, 103 bp, Artificial Sequence
  Synthetic Polynucleotide
taatacgactcactatagggcgtatccatatactgaggggtccactagagaacagaggagactctagatgacccctcagaacctggcggcagcgcaaaagatg

SEQ ID NO: 124104 - DNA, 103 bp, Artificial Sequence
  Synthetic Polynucleotide
taatacgactcactatagggtgtgggggttcccattcaccttggcagccaaacagaggagatggctgatgaggtgaatgaacctggcggcagcgcaaaagatg

SEQ ID NO: 124105 - DNA, 103 bp, Artificial Sequence
  Synthetic Polynucleotide
taatacgactcactatagggacaggggtgctgtgggggttcccattcaccaacagaggagaggtgaaatggaacccccaaacctggcggcagcgcaaaagatg

SEQ ID NO: 124106 - DNA, 103 bp, Artificial Sequence
  Synthetic Polynucleotide
taatacgactcactatagggaggaccactcacaggggtgctgtgggggttaacagaggagaaaccccatgagcacccctaacctggcggcagcgcaaaagatg

SEQ ID NO: 124107 - DNA, 103 bp, Artificial Sequence
  Synthetic Polynucleotide
taatacgactcactataggggaaaggccggaggaccactcacaggggtgcaacagaggagagcacccatgtgagtggtcaacctggcggcagcgcaaaagatg

SEQ ID NO: 124108 - DNA, 103 bp, Artificial Sequence
  Synthetic Polynucleotide
taatacgactcactatagggccctgggtcagaaaggccggaggaccactcaacagaggagagagtggatgtccggccttaacctggcggcagcgcaaaagatg

SEQ ID NO: 124109 - DNA, 103 bp, Artificial Sequence
  Synthetic Polynucleotide
taatacgactcactataggggctgccccagccctgggtcagaaaggccggaacagaggagaccggccatgctgacccagaacctggcggcagcgcaaaagatg

SEQ ID NO: 124110 - DNA, 103 bp, Artificial Sequence
  Synthetic Polynucleotide
taatacgactcactatagggcctggtaggtgctgccccagccctgggtcaaacagaggagatgacccatggctggggcaaacctggcggcagcgcaaaagatg

SEQ ID NO: 124111 - DNA, 103 bp, Artificial Sequence
  Synthetic Polynucleotide
taatacgactcactatagggtgctgccacgcctggtaggtgctgccccagaacagaggagactggggatgcacctaccaaacctggcggcagcgcaaaagatg

SEQ ID NO: 124112 - DNA, 103 bp, Artificial Sequence
  Synthetic Polynucleotide
taatacgactcactatagggctgtgtgggctgctgccacgcctggtaggtaacagaggagaacctacatggcgtggcagaacctggcggcagcgcaaaagatg

SEQ ID NO: 124113 - DNA, 103 bp, Artificial Sequence
  Synthetic Polynucleotide
taatacgactcactatagggttgggacctgctgtgtgggctgctgccacgaacagaggagacgtggcatgagcccacacaacctggcggcagcgcaaaagatg

SEQ ID NO: 124114 - DNA, 103 bp, Artificial Sequence
  Synthetic Polynucleotide
taatacgactcactatagggttttgtactccgtatccatatactgaggggaacagaggagacccctcatgatatggataaacctggcggcagcgcaaaagatg

SEQ ID NO: 124115 - DNA, 103 bp, Artificial Sequence
  Synthetic Polynucleotide
taatacgactcactatagggctctgctggcttgggacctgctgtgtgggcaacagaggagagcccacatggcaggtcccaacctggcggcagcgcaaaagatg

SEQ ID NO: 124116 - DNA, 103 bp, Artificial Sequence
  Synthetic Polynucleotide
taatacgactcactatagggctgcggctggctctgctggcttgggacctgaacagaggagacaggtcatgagccagcagaacctggcggcagcgcaaaagatg

SEQ ID NO: 124117 - DNA, 103 bp, Artificial Sequence
  Synthetic Polynucleotide
taatacgactcactataggggctggctgctctgcggctggctctgctggcaacagaggagagccagcatggccagccgcaacctggcggcagcgcaaaagatg

SEQ ID NO: 124118 - DNA, 103 bp, Artificial Sequence
  Synthetic Polynucleotide
taatacgactcactatagggctgtagttgggctggctgctctgcggctggaacagaggagaccagccatggagcagccaaacctggcggcagcgcaaaagatg

SEQ ID NO: 124119 - DNA, 103 bp, Artificial Sequence
  Synthetic Polynucleotide
taatacgactcactatagggccaggccttgctgtagttgggctggctgctaacagaggagaagcagcatgcccaactacaacctggcggcagcgcaaaagatg

SEQ ID NO: 124120 - DNA, 103 bp, Artificial Sequence
  Synthetic Polynucleotide
taatacgactcactatagggaatagtcttcccaggccttgctgtagttggaacagaggagaccaactatggcaaggcctaacctggcggcagcgcaaaagatg

SEQ ID NO: 124121 - DNA, 103 bp, Artificial Sequence
  Synthetic Polynucleotide
taatacgactcactatagggtgttttttgtaatagtcttcccaggccttgaacagaggagacaaggcatgggaagactaaacctggcggcagcgcaaaagatg

SEQ ID NO: 124122 - DNA, 103 bp, Artificial Sequence
  Synthetic Polynucleotide
taatacgactcactatagggggcgtgactctgttttttgtaatagtcttcaacagaggagagaagacatgtacaaaaaaaacctggcggcagcgcaaaagatg

SEQ ID NO: 124123 - DNA, 103 bp, Artificial Sequence
  Synthetic Polynucleotide
taatacgactcactatagggcagcgctggcggcgtgactctgttttttgtaacagaggagaacaaaaatgagagtcacgaacctggcggcagcgcaaaagatg

SEQ ID NO: 124124 - DNA, 103 bp, Artificial Sequence
  Synthetic Polynucleotide
taatacgactcactataggggcctgaggagcagcgctggcggcgtgactcaacagaggagagagtcaatgcgccagcgcaacctggcggcagcgcaaaagatg

SEQ ID NO: 124125 - DNA, 103 bp, Artificial Sequence
  Synthetic Polynucleotide
taatacgactcactatagggcaagggccgtttttgtactccgtatccataaacagaggagatatggaatgggagtacaaaacctggcggcagcgcaaaagatg

SEQ ID NO: 124126 - DNA, 103 bp, Artificial Sequence
  Synthetic Polynucleotide
taatacgactcactatagggtggggagctggcctgaggagcagcgctggcaacagaggagagccagcatggctcctcagaacctggcggcagcgcaaaagatg

SEQ ID NO: 124127 - DNA, 103 bp, Artificial Sequence
  Synthetic Polynucleotide
taatacgactcactatagggtgtagtccggtggggagctggcctgaggagaacagaggagactcctcatgccagctcccaacctggcggcagcgcaaaagatg

SEQ ID NO: 124128 - DNA, 103 bp, Artificial Sequence
  Synthetic Polynucleotide
taatacgactcactatagggcaggccattgtgtagtccggtggggagctgaacagaggagacagctcatgaccggactaaacctggcggcagcgcaaaagatg

SEQ ID NO: 124129 - DNA, 103 bp, Artificial Sequence
  Synthetic Polynucleotide
taatacgactcactatagggatattctgcccaggccattgtgtagtccggaacagaggagaccggacatgacaatggccaacctggcggcagcgcaaaagatg

SEQ ID NO: 124130 - DNA, 103 bp, Artificial Sequence
  Synthetic Polynucleotide
taatacgactcactataggggctgtctgtaatattctgcccaggccattgaacagaggagacaatggatggggcagaataacctggcggcagcgcaaaagatg

SEQ ID NO: 124131 - DNA, 103 bp, Artificial Sequence
  Synthetic Polynucleotide
taatacgactcactatagggaaagcgacctgctgtctgtaatattctgccaacagaggagaggcagaatgttacagacaaacctggcggcagcgcaaaagatg

SEQ ID NO: 124132 - DNA, 103 bp, Artificial Sequence
  Synthetic Polynucleotide
taatacgactcactatagggctgtccgtagaaagcgacctgctgtctgtaaacagaggagatacagaatgcaggtcgctaacctggcggcagcgcaaaagatg

SEQ ID NO: 124133 - DNA, 103 bp, Artificial Sequence
  Synthetic Polynucleotide
taatacgactcactataggggccctaacgtctgtccgtagaaagcgacctaacagaggagaaggtcgatgtctacggacaacctggcggcagcgcaaaagatg

SEQ ID NO: 124134 - DNA, 103 bp, Artificial Sequence
  Synthetic Polynucleotide
taatacgactcactataggggcctgcgcctgccctaacgtctgtccgtagaacagaggagactacggatggacgttaggaacctggcggcagcgcaaaagatg

SEQ ID NO: 124135 - DNA, 103 bp, Artificial Sequence
  Synthetic Polynucleotide
taatacgactcactatagggctggctgtgggcctgcgcctgccctaacgtaacagaggagaacgttaatgcaggcgcagaacctggcggcagcgcaaaagatg

SEQ ID NO: 124136 - DNA, 103 bp, Artificial Sequence
  Synthetic Polynucleotide
taatacgactcactatagggctccatcatccaagggccgtttttgtactcaacagaggagagagtacatgaacggccctaacctggcggcagcgcaaaagatg

SEQ ID NO: 124137 - DNA, 103 bp, Artificial Sequence
  Synthetic Polynucleotide
taatacgactcactatagggtggttacctactccatcatccaagggccgtaacagaggagaacggccatgggatgatggaacctggcggcagcgcaaaagatg

SEQ ID NO: 124138 - DNA, 103 bp, Artificial Sequence
  Synthetic Polynucleotide
taatacgactcactatagggggcccctaactggttacctactccatcatcaacagaggagagatgatatggtaggtaacaacctggcggcagcgcaaaagatg

SEQ ID NO: 124139 - DNA, 103 bp, Artificial Sequence
  Synthetic Polynucleotide
taatacgactcactatagggtccccacaggagcgctctgcccctgcaccaaacagaggagatggtgcatgggcagagcgaacctggcggcagcgcaaaagatg

SEQ ID NO: 124140 - DNA, 103 bp, Artificial Sequence
  Synthetic Polynucleotide
taatacgactcactataggggatgtaccaaggcccctaactggttacctaaacagaggagataggtaatgagttaggggaacctggcggcagcgcaaaagatg

SEQ ID NO: 124141 - DNA, 103 bp, Artificial Sequence
  Synthetic Polynucleotide
taatacgactcactatagggaccgtcctttgatgtaccaaggcccctaacaacagaggagagttaggatgcttggtacaaacctggcggcagcgcaaaagatg

SEQ ID NO: 124142 - DNA, 103 bp, Artificial Sequence
  Synthetic Polynucleotide
taatacgactcactatagggttccgttattaccgtcctttgatgtaccaaaacagaggagattggtaatgcaaaggacgaacctggcggcagcgcaaaagatg

SEQ ID NO: 124143 - DNA, 103 bp, Artificial Sequence
  Synthetic Polynucleotide
taatacgactcactatagggctttgaattcttccgttattaccgtcctttaacagaggagaaaaggaatgtaataacggaacctggcggcagcgcaaaagatg

SEQ ID NO: 124144 - DNA, 103 bp, Artificial Sequence
  Synthetic Polynucleotide
taatacgactcactatagggttgtcaggcactttgaattcttccgttattaacagaggagaaataacatgagaattcaaaacctggcggcagcgcaaaagatg

SEQ ID NO: 124145 - DNA, 103 bp, Artificial Sequence
  Synthetic Polynucleotide
taatacgactcactatagggtccaaccattttgtcaggcactttgaattcaacagaggagagaattcatggtgcctgacaacctggcggcagcgcaaaagatg

SEQ ID NO: 124146 - DNA, 103 bp, Artificial Sequence
  Synthetic Polynucleotide
taatacgactcactatagggcgataataaatccaaccattttgtcaggcaaacagaggagatgcctgatgaaatggttgaacctggcggcagcgcaaaagatg

SEQ ID NO: 124147 - DNA, 103 bp, Artificial Sequence
  Synthetic Polynucleotide
taatacgactcactatagggcctcccctgccgataataaatccaaccattaacagaggagaaatggtatgatttattataacctggcggcagcgcaaaagatg

SEQ ID NO: 124148 - DNA, 103 bp, Artificial Sequence
  Synthetic Polynucleotide
taatacgactcactatagggaatctgctcacctcccctgccgataataaaaacagaggagatttattatgggcaggggaaacctggcggcagcgcaaaagatg

SEQ ID NO: 124149 - DNA, 103 bp, Artificial Sequence
  Synthetic Polynucleotide
taatacgactcactataggggaatccgtgaaatctgctcacctcccctgcaacagaggagagcagggatggtgagcagaaacctggcggcagcgcaaaagatg

SEQ ID NO: 124150 - DNA, 103 bp, Artificial Sequence
  Synthetic Polynucleotide
taatacgactcactatagggtcggccttcatccccacaggagcgctctgcaacagaggagagcagagatgtcctgtgggaacctggcggcagcgcaaaagatg

SEQ ID NO: 124151 - DNA, 103 bp, Artificial Sequence
  Synthetic Polynucleotide
taatacgactcactataggggattctgcttgaatccgtgaaatctgctcaaacagaggagatgagcaatgttcacggataacctggcggcagcgcaaaagatg

SEQ ID NO: 124152 - DNA, 103 bp, Artificial Sequence
  Synthetic Polynucleotide
taatacgactcactatagggtttgcaaccagattctgcttgaatccgtgaaacagaggagatcacggatgcaagcagaaaacctggcggcagcgcaaaagatg

SEQ ID NO: 124153 - DNA, 103 bp, Artificial Sequence
  Synthetic Polynucleotide
taatacgactcactatagggcaatctgaattttgcaaccagattctgcttaacagaggagaaagcagatgctggttgcaaacctggcggcagcgcaaaagatg

SEQ ID NO: 124154 - DNA, 103 bp, Artificial Sequence
  Synthetic Polynucleotide
taatacgactcactatagggctctctgaagcaatctgaattttgcaaccaaacagaggagatggttgatgaattcagataacctggcggcagcgcaaaagatg

SEQ ID NO: 124155 - DNA, 103 bp, Artificial Sequence
  Synthetic Polynucleotide
taatacgactcactatagggaatcccagaactctctgaagcaatctgaataacagaggagaattcagatggcttcagagaacctggcggcagcgcaaaagatg

SEQ ID NO: 124156 - DNA, 103 bp, Artificial Sequence
  Synthetic Polynucleotide
taatacgactcactataggggcctctctggaatcccagaactctctgaagaacagaggagacttcagatggttctgggaaacctggcggcagcgcaaaagatg

SEQ ID NO: 124157 - DNA, 103 bp, Artificial Sequence
  Synthetic Polynucleotide
taatacgactcactatagggagtacacagggcctctctggaatcccagaaaacagaggagattctggatgtccagagagaacctggcggcagcgcaaaagatg

SEQ ID NO: 124158 - DNA, 103 bp, Artificial Sequence
  Synthetic Polynucleotide
taatacgactcactatagggggttccggtaagtacacagggcctctctggaacagaggagaccagagatgccctgtgtaaacctggcggcagcgcaaaagatg

SEQ ID NO: 124159 - DNA, 103 bp, Artificial Sequence
  Synthetic Polynucleotide
taatacgactcactatagggtactttctggggttccggtaagtacacaggaacagaggagacctgtgatgttaccggaaaacctggcggcagcgcaaaagatg

SEQ ID NO: 124160 - DNA, 103 bp, Artificial Sequence
  Synthetic Polynucleotide
taatacgactcactataggggcttgttcaatactttctggggttccggtaaacagaggagataccggatgcccagaaagaacctggcggcagcgcaaaagatg

SEQ ID NO: 124161 - DNA, 103 bp, Artificial Sequence
  Synthetic Polynucleotide
taatacgactcactatagggcacgaagccctcggccttcatccccacaggaacagaggagacctgtgatgatgaaggccaacctggcggcagcgcaaaagatg

SEQ ID NO: 124162 - DNA, 103 bp, Artificial Sequence
  Synthetic Polynucleotide
taatacgactcactataggggagccgtttggcttgttcaatactttctggaacagaggagaccagaaatgattgaacaaaacctggcggcagcgcaaaagatg

SEQ ID NO: 124163 - DNA, 103 bp, Artificial Sequence
  Synthetic Polynucleotide
taatacgactcactatagggtctgtcccaggagccgtttggcttgttcaaaacagaggagattgaacatgccaaacggcaacctggcggcagcgcaaaagatg

SEQ ID NO: 124164 - DNA, 103 bp, Artificial Sequence
  Synthetic Polynucleotide
taatacgactcactatagggcggtccacaatctgtcccaggagccgtttgaacagaggagacaaacgatgcctgggacaaacctggcggcagcgcaaaagatg

SEQ ID NO: 124165 - DNA, 103 bp, Artificial Sequence
  Synthetic Polynucleotide
taatacgactcactatagggatttcgacagcggtccacaatctgtcccagaacagaggagactgggaatgattgtggacaacctggcggcagcgcaaaagatg

SEQ ID NO: 124166 - DNA, 103 bp, Artificial Sequence
  Synthetic Polynucleotide
taatacgactcactatagggagccaggtccatttcgacagcggtccacaaaacagaggagattgtggatggctgtcgaaaacctggcggcagcgcaaaagatg

SEQ ID NO: 124167 - DNA, 103 bp, Artificial Sequence
  Synthetic Polynucleotide
taatacgactcactatagggtcattatgaaagccaggtccatttcgacagaacagaggagactgtcgatgtggacctggaacctggcggcagcgcaaaagatg

SEQ ID NO: 124168 - DNA, 103 bp, Artificial Sequence
  Synthetic Polynucleotide
taatacgactcactataggggctgtctatgtcattatgaaagccaggtccaacagaggagaggacctatgtttcataataacctggcggcagcgcaaaagatg

SEQ ID NO: 124169 - DNA, 103 bp, Artificial Sequence
  Synthetic Polynucleotide
taatacgactcactatagggttgtgctgttgctgtctatgtcattatgaaaacagaggagattcataatgacatagacaaacctggcggcagcgcaaaagatg

SEQ ID NO: 124170 - DNA, 103 bp, Artificial Sequence
  Synthetic Polynucleotide
taatacgactcactatagggatctcctggattgtgctgttgctgtctatgaacagaggagacatagaatgcaacagcacaacctggcggcagcgcaaaagatg

SEQ ID NO: 124171 - DNA, 103 bp, Artificial Sequence
  Synthetic Polynucleotide
taatacgactcactataggggggaatgagaatctcctggattgtgctgttaacagaggagaaacagcatgatccaggagaacctggcggcagcgcaaaagatg

SEQ ID NO: 124172 - DNA, 103 bp, Artificial Sequence
  Synthetic Polynucleotide
taatacgactcactataggggcagggcatccacgaagccctcggccttcaaacagaggagatgaaggatgagggcttcgaacctggcggcagcgcaaaagatg

SEQ ID NO: 124173 - DNA, 103 bp, Artificial Sequence
  Synthetic Polynucleotide
taatacgactcactatagggctttagatgcgggaatgagaatctcctggaaacagaggagatccaggatgttctcattcaacctggcggcagcgcaaaagatg

SEQ ID NO: 124174 - DNA, 103 bp, Artificial Sequence
  Synthetic Polynucleotide
taatacgactcactatagggaccagacccactttagatgcgggaatgagaaacagaggagatctcatatgcgcatctaaaacctggcggcagcgcaaaagatg

SEQ ID NO: 124175 - DNA, 103 bp, Artificial Sequence
  Synthetic Polynucleotide
taatacgactcactatagggtctgccgatgaccagacccactttagatgcaacagaggagagcatctatggtgggtctgaacctggcggcagcgcaaaagatg

SEQ ID NO: 124176 - DNA, 103 bp, Artificial Sequence
  Synthetic Polynucleotide
taatacgactcactatagggtttcccctcctctgccgatgaccagacccaaacagaggagatgggtcatgtcatcggcaaacctggcggcagcgcaaaagatg

SEQ ID NO: 124177 - DNA, 103 bp, Artificial Sequence
  Synthetic Polynucleotide
taatacgactcactatagggtgcttgattgtttcccctcctctgccgatgaacagaggagacatcggatgaggaggggaaacctggcggcagcgcaaaagatg

SEQ ID NO: 124178 - DNA, 103 bp, Artificial Sequence
  Synthetic Polynucleotide
taatacgactcactatagggctcctgcaactgcttgattgtttcccctccaacagaggagaggagggatgacaatcaagaacctggcggcagcgcaaaagatg

SEQ ID NO: 124179 - DNA, 103 bp, Artificial Sequence
  Synthetic Polynucleotide
taatacgactcactatagggcccctgtccgctcctgcaactgcttgattgaacagaggagacaatcaatgagttgcaggaacctggcggcagcgcaaaagatg

SEQ ID NO: 124180 - DNA, 103 bp, Artificial Sequence
  Synthetic Polynucleotide
taatacgactcactatagggaccatcttcacccctgtccgctcctgcaacaacagaggagagttgcaatggcggacaggaacctggcggcagcgcaaaagatg

SEQ ID NO: 124181 - DNA, 103 bp, Artificial Sequence
  Synthetic Polynucleotide
taatacgactcactatagggctggatcatgaccatcttcacccctgtccgaacagaggagacggacaatggtgaagatgaacctggcggcagcgcaaaagatg

SEQ ID NO: 124182 - DNA, 103 bp, Artificial Sequence
  Synthetic Polynucleotide
taatacgactcactatagggatgggccatcctggatcatgaccatcttcaaacagaggagatgaagaatgtcatgatccaacctggcggcagcgcaaaagatg

SEQ ID NO: 124183 - DNA, 103 bp, Artificial Sequence
  Synthetic Polynucleotide
taatacgactcactatagggcggacccggtgcagggcatccacgaagcccaacagaggagagggcttatgggatgccctaacctggcggcagcgcaaaagatg

SEQ ID NO: 124184 - DNA, 103 bp, Artificial Sequence
  Synthetic Polynucleotide
taatacgactcactatagggcccgtgggcaatgggccatcctggatcatgaacagaggagacatgatatgggatggcccaacctggcggcagcgcaaaagatg

SEQ ID NO: 124185 - DNA, 103 bp, Artificial Sequence
  Synthetic Polynucleotide
taatacgactcactatagggcttgtctgctcccgtgggcaatgggccatcaacagaggagagatggcatgttgcccacgaacctggcggcagcgcaaaagatg

SEQ ID NO: 124186 - DNA, 103 bp, Artificial Sequence
  Synthetic Polynucleotide
taatacgactcactatagggtacgaagaggcttgtctgctcccgtgggcaaacagaggagatgcccaatggagcagacaaacctggcggcagcgcaaaagatg

SEQ ID NO: 124187 - DNA, 103 bp, Artificial Sequence
  Synthetic Polynucleotide
taatacgactcactatagggtctccagtgatacgaagaggcttgtctgctaacagaggagaagcagaatggcctcttcgaacctggcggcagcgcaaaagatg

SEQ ID NO: 124188 - DNA, 103 bp, Artificial Sequence
  Synthetic Polynucleotide
taatacgactcactatagggtttaaatgcatctccagtgatacgaagaggaacagaggagacctcttatgatcactggaaacctggcggcagcgcaaaagatg

SEQ ID NO: 124189 - DNA, 103 bp, Artificial Sequence
  Synthetic Polynucleotide
taatacgactcactatagggcttgctgtactttaaatgcatctccagtgaaacagaggagatcactgatgatgcatttaaacctggcggcagcgcaaaagatg

SEQ ID NO: 124190 - DNA, 103 bp, Artificial Sequence
  Synthetic Polynucleotide
taatacgactcactatagggatttctcttgcttgctgtactttaaatgcaaacagaggagatgcattatgagtacagcaaacctggcggcagcgcaaaagatg

SEQ ID NO: 124191 - DNA, 103 bp, Artificial Sequence
  Synthetic Polynucleotide
taatacgactcactatagggctctagtaccatttctcttgcttgctgtacaacagaggagagtacagatggcaagagaaaacctggcggcagcgcaaaagatg

SEQ ID NO: 124192 - DNA, 103 bp, Artificial Sequence
  Synthetic Polynucleotide
taatacgactcactatagggctcggataatctctagtaccatttctcttgaacagaggagacaagagatgtggtactagaacctggcggcagcgcaaaagatg

SEQ ID NO: 124193 - DNA, 103 bp, Artificial Sequence
  Synthetic Polynucleotide
taatacgactcactatagggtggtctttttctcggataatctctagtaccaacagaggagaggtactatggattatccgaacctggcggcagcgcaaaagatg

SEQ ID NO: 124194 - DNA, 103 bp, Artificial Sequence
  Synthetic Polynucleotide
taatacgactcactatagggagcaatctgccggacccggtgcagggcatcaacagaggagagatgccatgcaccgggtcaacctggcggcagcgcaaaagatg

SEQ ID NO: 124195 - DNA, 103 bp, Artificial Sequence
  Synthetic Polynucleotide
taatacgactcactatagggaaagtcagcttggtctttttctcggataataacagaggagaattatcatggaaaaagacaacctggcggcagcgcaaaagatg

SEQ ID NO: 124196 - DNA, 103 bp, Artificial Sequence
  Synthetic Polynucleotide
taatacgactcactataggggtacaccccgaaagtcagcttggtctttttaacagaggagaaaaaagatgaagctgactaacctggcggcagcgcaaaagatg

SEQ ID NO: 124197 - DNA, 103 bp, Artificial Sequence
  Synthetic Polynucleotide
taatacgactcactatagggaaatcgccgcgtacaccccgaaagtcagctaacagaggagaagctgaatgtcggggtgtaacctggcggcagcgcaaaagatg

SEQ ID NO: 124198 - DNA, 103 bp, Artificial Sequence
  Synthetic Polynucleotide
taatacgactcactatagggtcgagagttgaaatcgccgcgtacaccccgaacagaggagacggggtatgcgcggcgataacctggcggcagcgcaaaagatg

SEQ ID NO: 124199 - DNA, 103 bp, Artificial Sequence
  Synthetic Polynucleotide
taatacgactcactatagggctcctcccattcgagagttgaaatcgccgcaacagaggagagcggcgatgtcaactctcaacctggcggcagcgcaaaagatg

SEQ ID NO: 124200 - DNA, 103 bp, Artificial Sequence
  Synthetic Polynucleotide
taatacgactcactatagggtctatactgcctcctcccattcgagagttgaacagaggagacaactcatgaatgggaggaacctggcggcagcgcaaaagatg

SEQ ID NO: 124201 - DNA, 103 bp, Artificial Sequence
  Synthetic Polynucleotide
taatacgactcactatagggcacagatacctctatactgcctcctcccataacagaggagaatgggaatgggcagtataaacctggcggcagcgcaaaagatg

SEQ ID NO: 124202 - DNA, 103 bp, Artificial Sequence
  Synthetic Polynucleotide
taatacgactcactatagggcaaacctaggcacagatacctctatactgcaacagaggagagcagtaatgaggtatctgaacctggcggcagcgcaaaagatg

SEQ ID NO: 124203 - DNA, 103 bp, Artificial Sequence
  Synthetic Polynucleotide
taatacgactcactatagggatccccacagcaaacctaggcacagataccaacagaggagaggtatcatggcctaggttaacctggcggcagcgcaaaagatg

SEQ ID NO: 124204 - DNA, 103 bp, Artificial Sequence
  Synthetic Polynucleotide
taatacgactcactatagggtcctattacaatccccacagcaaacctaggaacagaggagacctaggatggctgtggggaacctggcggcagcgcaaaagatg

SEQ ID NO: 124205 - DNA, 103 bp, Artificial Sequence
  Synthetic Polynucleotide
taatacgactcactatagggcaattttagcagcaatctgccggacccggtaacagaggagaaccgggatgggcagattgaacctggcggcagcgcaaaagatg

SEQ ID NO: 124206 - DNA, 103 bp, Artificial Sequence
  Synthetic Polynucleotide
taatacgactcactatagggccccgtttcttcctattacaatccccacagaacagaggagactgtggatgttgtaatagaacctggcggcagcgcaaaagatg

SEQ ID NO: 124207 - DNA, 103 bp, Artificial Sequence
  Synthetic Polynucleotide
taatacgactcactatagggttgatcatttccccgtttcttcctattacaaacagaggagatgtaatatgaagaaacggaacctggcggcagcgcaaaagatg

SEQ ID NO: 124208 - DNA, 103 bp, Artificial Sequence
  Synthetic Polynucleotide
taatacgactcactatagggctggatctttttgatcatttccccgtttctaacagaggagaagaaacatggaaatgatcaacctggcggcagcgcaaaagatg

SEQ ID NO: 124209 - DNA, 103 bp, Artificial Sequence
  Synthetic Polynucleotide
taatacgactcactatagggcagcatcattctggatctttttgatcatttaacagaggagaaaatgaatgaaaagatccaacctggcggcagcgcaaaagatg

SEQ ID NO: 124210 - DNA, 103 bp, Artificial Sequence
  Synthetic Polynucleotide
taatacgactcactatagggatcctcacaccagcatcattctggatctttaacagaggagaaaagatatggaatgatgcaacctggcggcagcgcaaaagatg

SEQ ID NO: 124211 - DNA, 103 bp, Artificial Sequence
  Synthetic Polynucleotide
taatacgactcactatagggtttaaactgaatcctcacaccagcatcattaacagaggagaaatgatatgggtgtgaggaacctggcggcagcgcaaaagatg

SEQ ID NO: 124212 - DNA, 103 bp, Artificial Sequence
  Synthetic Polynucleotide
taatacgactcactatagggcatcatctggtttaaactgaatcctcacacaacagaggagagtgtgaatgttcagtttaaacctggcggcagcgcaaaagatg

SEQ ID NO: 124213 - DNA, 103 bp, Artificial Sequence
  Synthetic Polynucleotide
taatacgactcactatagggggactaatcccatcatctggtttaaactgaaacagaggagatcagttatgaccagatgaaacctggcggcagcgcaaaagatg

SEQ ID NO: 124214 - DNA, 103 bp, Artificial Sequence
  Synthetic Polynucleotide
taatacgactcactatagggagctctttctggactaatcccatcatctggaacagaggagaccagatatggggattagtaacctggcggcagcgcaaaagatg

SEQ ID NO: 124215 - DNA, 103 bp, Artificial Sequence
  Synthetic Polynucleotide
taatacgactcactatagggtgacctgggcagctctttctggactaatccaacagaggagaggattaatgcagaaagagaacctggcggcagcgcaaaagatg

SEQ ID NO: 124216 - DNA, 103 bp, Artificial Sequence
  Synthetic Polynucleotide
taatacgactcactatagggggaattgaatcaattttagcagcaatctgcaacagaggagagcagatatgtgctaaaataacctggcggcagcgcaaaagatg

SEQ ID NO: 124217 - DNA, 103 bp, Artificial Sequence
  Synthetic Polynucleotide
taatacgactcactatagggggagggcccatgacctgggcagctctttctaacagaggagaagaaagatgtgcccaggtaacctggcggcagcgcaaaagatg

SEQ ID NO: 124218 - DNA, 103 bp, Artificial Sequence
  Synthetic Polynucleotide
taatacgactcactatagggacaccgatccggagggcccatgacctgggcaacagaggagagcccagatgatgggccctaacctggcggcagcgcaaaagatg

SEQ ID NO: 124219 - DNA, 103 bp, Artificial Sequence
  Synthetic Polynucleotide
taatacgactcactatagggctgcatgctgacaccgatccggagggcccaaacagaggagatgggccatgcggatcggtaacctggcggcagcgcaaaagatg

SEQ ID NO: 124220 - DNA, 103 bp, Artificial Sequence
  Synthetic Polynucleotide
taatacgactcactatagggatgatatgcgctgcatgctgacaccgatccaacagaggagaggatcgatgtcagcatgcaacctggcggcagcgcaaaagatg

SEQ ID NO: 124221 - DNA, 103 bp, Artificial Sequence
  Synthetic Polynucleotide
taatacgactcactatagggcagctcgctgatgatatgcgctgcatgctgaacagaggagacagcatatggcgcatatcaacctggcggcagcgcaaaagatg

SEQ ID NO: 124222 - DNA, 103 bp, Artificial Sequence
  Synthetic Polynucleotide
taatacgactcactatagggctgtaagaatcagctcgctgatgatatgcgaacagaggagacgcataatgtcagcgagcaacctggcggcagcgcaaaagatg

SEQ ID NO: 124223 - DNA, 103 bp, Artificial Sequence
  Synthetic Polynucleotide
taatacgactcactatagggctttcctgggctgtaagaatcagctcgctgaacagaggagacagcgaatggattcttacaacctggcggcagcgcaaaagatg

SEQ ID NO: 124224 - DNA, 103 bp, Artificial Sequence
  Synthetic Polynucleotide
taatacgactcactatagggaaagccgtctctttcctgggctgtaagaataacagaggagaattcttatggcccaggaaaacctggcggcagcgcaaaagatg

SEQ ID NO: 124225 - DNA, 103 bp, Artificial Sequence
  Synthetic Polynucleotide
taatacgactcactatagggccaggcctccaaagccgtctctttcctgggaacagaggagacccaggatggagacggctaacctggcggcagcgcaaaagatg

SEQ ID NO: 124226 - DNA, 103 bp, Artificial Sequence
  Synthetic Polynucleotide
taatacgactcactatagggctggctgctgccaggcctccaaagccgtctaacagaggagaagacggatgtggaggcctaacctggcggcagcgcaaaagatg

SEQ ID NO: 124227 - DNA, 103 bp, Artificial Sequence
  Synthetic Polynucleotide
taatacgactcactatagggtatcagctcctctgcttctcttttagtcataacagaggagaatgactatgagagaagcaaacctggcggcagcgcaaaagatg

SEQ ID NO: 124228 - DNA, 103 bp, Artificial Sequence
  Synthetic Polynucleotide
taatacgactcactatagggctggcttacacattcagctggcgcgtaggtaacagaggagaacctacatgccagctgaaaacctggcggcagcgcaaaagatg

SEQ ID NO: 124229 - DNA, 103 bp, Artificial Sequence
  Synthetic Polynucleotide
taatacgactcactatagggagaaatgcagtctcgagcgtccttatcagtaacagaggagaactgatatggacgctcgaaacctggcggcagcgcaaaagatg

SEQ ID NO: 124230 - DNA, 103 bp, Artificial Sequence
  Synthetic Polynucleotide
taatacgactcactatagggcaccaacccaagaaatgcagtctcgagcgtaacagaggagaacgctcatgactgcatttaacctggcggcagcgcaaaagatg

SEQ ID NO: 124231 - DNA, 103 bp, Artificial Sequence
  Synthetic Polynucleotide
taatacgactcactatagggtcaccttcatcaccaacccaagaaatgcagaacagaggagactgcatatgttgggttggaacctggcggcagcgcaaaagatg

SEQ ID NO: 124232 - DNA, 103 bp, Artificial Sequence
  Synthetic Polynucleotide
taatacgactcactatagggtagcttaaattcaccttcatcaccaacccaaacagaggagatgggttatggatgaaggtaacctggcggcagcgcaaaagatg

SEQ ID NO: 124233 - DNA, 103 bp, Artificial Sequence
  Synthetic Polynucleotide
taatacgactcactatagggcaggctgatttagcttaaattcaccttcataacagaggagaatgaagatgaatttaagcaacctggcggcagcgcaaaagatg

SEQ ID NO: 124234 - DNA, 103 bp, Artificial Sequence
  Synthetic Polynucleotide
taatacgactcactataggggcaaccagttcaggctgatttagcttaaataacagaggagaatttaaatgaaatcagccaacctggcggcagcgcaaaagatg

SEQ ID NO: 124235 - DNA, 103 bp, Artificial Sequence
  Synthetic Polynucleotide
taatacgactcactatagggccatttctgtgcaaccagttcaggctgattaacagaggagaaatcagatggaactggttaacctggcggcagcgcaaaagatg

SEQ ID NO: 124236 - DNA, 103 bp, Artificial Sequence
  Synthetic Polynucleotide
taatacgactcactatagggtacgctgtccccatttctgtgcaaccagttaacagaggagaaactggatgcacagaaataacctggcggcagcgcaaaagatg

SEQ ID NO: 124237 - DNA, 103 bp, Artificial Sequence
  Synthetic Polynucleotide
taatacgactcactatagggggcttatttttacgctgtccccatttctgtaacagaggagaacagaaatggggacagcgaacctggcggcagcgcaaaagatg

SEQ ID NO: 124238 - DNA, 103 bp, Artificial Sequence
  Synthetic Polynucleotide
taatacgactcactataggggttcatcgtaggcttatttttacgctgtccaacagaggagaggacagatgaaaaataagaacctggcggcagcgcaaaagatg

SEQ ID NO: 124239 - DNA, 103 bp, Artificial Sequence
  Synthetic Polynucleotide
taatacgactcactatagggtgtctatggcctggcttacacattcagctgaacagaggagacagctgatggtgtaagccaacctggcggcagcgcaaaagatg

SEQ ID NO: 124240 - DNA, 103 bp, Artificial Sequence
  Synthetic Polynucleotide
taatacgactcactataggggtttctcatagttcatcgtaggcttattttaacagaggagaaaaataatgctacgatgaaacctggcggcagcgcaaaagatg

SEQ ID NO: 124241 - DNA, 103 bp, Artificial Sequence
  Synthetic Polynucleotide
taatacgactcactataggggcacgactgagtttctcatagttcatcgtaaacagaggagatacgatatgctatgagaaaacctggcggcagcgcaaaagatg

SEQ ID NO: 124242 - DNA, 103 bp, Artificial Sequence
  Synthetic Polynucleotide
taatacgactcactatagggatatcttaatgcacgactgagtttctcataaacagaggagatatgagatgctcagtcgtaacctggcggcagcgcaaaagatg

SEQ ID NO: 124243 - DNA, 103 bp, Artificial Sequence
  Synthetic Polynucleotide
taatacgactcactatagggcatcgtaataatatcttaatgcacgactgaaacagaggagatcagtcatgcattaagataacctggcggcagcgcaaaagatg

SEQ ID NO: 124244 - DNA, 103 bp, Artificial Sequence
  Synthetic Polynucleotide
taatacgactcactatagggatcatgtccccatcgtaataatatcttaataacagaggagaattaagatgttattacgaaacctggcggcagcgcaaaagatg

SEQ ID NO: 124245 - DNA, 103 bp, Artificial Sequence
  Synthetic Polynucleotide
taatacgactcactatagggaactttacaaatcatgtccccatcgtaataaacagaggagatattacatgggggacatgaacctggcggcagcgcaaaagatg

SEQ ID NO: 124246 - DNA, 103 bp, Artificial Sequence
  Synthetic Polynucleotide
taatacgactcactatagggtcttgccttgaactttacaaatcatgtcccaacagaggagagggacaatgtttgtaaagaacctggcggcagcgcaaaagatg

SEQ ID NO: 124247 - DNA, 103 bp, Artificial Sequence
  Synthetic Polynucleotide
taatacgactcactatagggtacacaaatctcttgccttgaactttacaaaacagaggagattgtaaatgtcaaggcaaaacctggcggcagcgcaaaagatg

SEQ ID NO: 124248 - DNA, 103 bp, Artificial Sequence
  Synthetic Polynucleotide
taatacgactcactataggggacaaacttgtacacaaatctcttgccttgaacagaggagacaaggcatgagatttgtgaacctggcggcagcgcaaaagatg

SEQ ID NO: 124249 - DNA, 103 bp, Artificial Sequence
  Synthetic Polynucleotide
taatacgactcactatagggtcaagtcacagacaaacttgtacacaaatcaacagaggagagatttgatgacaagtttgaacctggcggcagcgcaaaagatg

SEQ ID NO: 124250 - DNA, 103 bp, Artificial Sequence
  Synthetic Polynucleotide
taatacgactcactatagggggttcattgatgtctatggcctggcttacaaacagaggagatgtaagatgggccatagaaacctggcggcagcgcaaaagatg

SEQ ID NO: 124251 - DNA, 103 bp, Artificial Sequence
  Synthetic Polynucleotide
taatacgactcactatagggataagagtcttcaagtcacagacaaacttgaacagaggagacaagttatgctgtgacttaacctggcggcagcgcaaaagatg

SEQ ID NO: 124252 - DNA, 103 bp, Artificial Sequence
  Synthetic Polynucleotide
taatacgactcactatagggactgtatccaataagagtcttcaagtcacaaacagaggagatgtgacatgaagactcttaacctggcggcagcgcaaaagatg

SEQ ID NO: 124253 - DNA, 103 bp, Artificial Sequence
  Synthetic Polynucleotide
taatacgactcactatagggactccgctgcactgtatccaataagagtctaacagaggagaagactcatgttggatacaaacctggcggcagcgcaaaagatg

SEQ ID NO: 124254 - DNA, 103 bp, Artificial Sequence
  Synthetic Polynucleotide
taatacgactcactatagggaaacggttcaactccgctgcactgtatccaaacagaggagatggataatgtgcagcggaaacctggcggcagcgcaaaagatg

SEQ ID NO: 124255 - DNA, 103 bp, Artificial Sequence
  Synthetic Polynucleotide
taatacgactcactatagggttctgtgaccaaacggttcaactccgctgcaacagaggagagcagcgatgttgaaccgtaacctggcggcagcgcaaaagatg

SEQ ID NO: 124256 - DNA, 103 bp, Artificial Sequence
  Synthetic Polynucleotide
taatacgactcactatagggtctgttcacattctgtgaccaaacggttcaaacagaggagatgaaccatgtggtcacagaacctggcggcagcgcaaaagatg

SEQ ID NO: 124257 - DNA, 103 bp, Artificial Sequence
  Synthetic Polynucleotide
taatacgactcactataggggcaagtttcttctgttcacattctgtgaccaacagaggagaggtcacatgatgtgaacaaacctggcggcagcgcaaaagatg

SEQ ID NO: 124258 - DNA, 103 bp, Artificial Sequence
  Synthetic Polynucleotide
taatacgactcactatagggctgcatctttgcaagtttcttctgttcacaaacagaggagatgtgaaatgaagaaacttaacctggcggcagcgcaaaagatg

SEQ ID NO: 124259 - DNA, 103 bp, Artificial Sequence
  Synthetic Polynucleotide
taatacgactcactatagggttccatggagctgcatctttgcaagtttctaacagaggagaagaaacatgcaaagatgcaacctggcggcagcgcaaaagatg

SEQ ID NO: 124260 - DNA, 103 bp, Artificial Sequence
  Synthetic Polynucleotide
taatacgactcactatagggggctgggcaattccatggagctgcatctttaacagaggagaaaagatatggctccatggaacctggcggcagcgcaaaagatg

SEQ ID NO: 124261 - DNA, 103 bp, Artificial Sequence
  Synthetic Polynucleotide
taatacgactcactatagggattgcctattggttcattgatgtctatggcaacagaggagagccataatgatcaatgaaaacctggcggcagcgcaaaagatg

SEQ ID NO: 124262 - DNA, 103 bp, Artificial Sequence
  Synthetic Polynucleotide
taatacgactcactatagggtgctgtgactggctgggcaattccatggagaacagaggagactccatatgattgcccagaacctggcggcagcgcaaaagatg

SEQ ID NO: 124263 - DNA, 103 bp, Artificial Sequence
  Synthetic Polynucleotide
taatacgactcactatagggccagagctactgctgtgactggctgggcaaaacagaggagattgcccatgcagtcacagaacctggcggcagcgcaaaagatg

SEQ ID NO: 124264 - DNA, 103 bp, Artificial Sequence
  Synthetic Polynucleotide
taatacgactcactataggggaagcagtagccagagctactgctgtgactaacagaggagaagtcacatgagtagctctaacctggcggcagcgcaaaagatg

SEQ ID NO: 124265 - DNA, 103 bp, Artificial Sequence
  Synthetic Polynucleotide
taatacgactcactatagggcgtttgcagagaagcagtagccagagctacaacagaggagagtagctatggctactgctaacctggcggcagcgcaaaagatg

SEQ ID NO: 124266 - DNA, 103 bp, Artificial Sequence
  Synthetic Polynucleotide
taatacgactcactatagggtatccttttccgtttgcagagaagcagtagaacagaggagactactgatgctctgcaaaaacctggcggcagcgcaaaagatg

SEQ ID NO: 124267 - DNA, 103 bp, Artificial Sequence
  Synthetic Polynucleotide
taatacgactcactataggggtttctttaaattgcctattggttcattgaaacagaggagatcaatgatgcaataggcaaacctggcggcagcgcaaaagatg

SEQ ID NO: 124268 - DNA, 103 bp, Artificial Sequence
  Synthetic Polynucleotide
taatacgactcactatagggggttctagcagtttctttaaattgcctattaacagaggagaaataggatgtttaaagaaaacctggcggcagcgcaaaagatg

SEQ ID NO: 124269 - DNA, 103 bp, Artificial Sequence
  Synthetic Polynucleotide
taatacgactcactatagggctgtagtcttggttctagcagtttctttaaaacagaggagattaaagatgctgctagaaaacctggcggcagcgcaaaagatg

SEQ ID NO: 124270 - DNA, 103 bp, Artificial Sequence
  Synthetic Polynucleotide
taatacgactcactatagggccaaagaacactgtagtcttggttctagcaaacagaggagatgctagatgcaagactacaacctggcggcagcgcaaaagatg

SEQ ID NO: 124271 - DNA, 103 bp, Artificial Sequence
  Synthetic Polynucleotide
taatacgactcactatagggtcatgagcatccaaagaacactgtagtcttaacagaggagaaagactatggtgttctttaacctggcggcagcgcaaaagatg

SEQ ID NO: 124272 - DNA, 103 bp, Artificial Sequence
  Synthetic Polynucleotide
taatacgactcactatagggcagacaaatttcatgagcatccaaagaacaaacagaggagatgttctatggatgctcataacctggcggcagcgcaaaagatg

SEQ ID NO: 124273 - DNA, 103 bp, Artificial Sequence
  Synthetic Polynucleotide
taatacgactcactatagggtctcaatttctatcagctcctctgcttctcaacagaggagagagaagatgaggagctgaaacctggcggcagcgcaaaagatg

SEQ ID NO: 124274 - DNA, 103 bp, Artificial Sequence
  Synthetic Polynucleotide
taatacgactcactatagggggatatcttgcagacaaatttcatgagcataacagaggagaatgctcatgaaatttgtcaacctggcggcagcgcaaaagatg

SEQ ID NO: 124275 - DNA, 103 bp, Artificial Sequence
  Synthetic Polynucleotide
taatacgactcactatagggggatccagctggatatcttgcagacaaattaacagaggagaaatttgatggcaagatataacctggcggcagcgcaaaagatg

SEQ ID NO: 124276 - DNA, 103 bp, Artificial Sequence
  Synthetic Polynucleotide
taatacgactcactatagggacttcgttctggatccagctggatatcttgaacagaggagacaagatatgcagctggataacctggcggcagcgcaaaagatg

SEQ ID NO: 124277 - DNA, 103 bp, Artificial Sequence
  Synthetic Polynucleotide
taatacgactcactatagggggtcaaataaacttcgttctggatccagctaacagaggagaagctggatgcagaacgaaaacctggcggcagcgcaaaagatg

SEQ ID NO: 124278 - DNA, 103 bp, Artificial Sequence
  Synthetic Polynucleotide
taatacgactcactatagggtttactccttggtcaaataaacttcgttctaacagaggagaagaacgatgtttatttgaaacctggcggcagcgcaaaagatg

SEQ ID NO: 124279 - DNA, 103 bp, Artificial Sequence
  Synthetic Polynucleotide
taatacgactcactatagggtccatctgtttttactccttggtcaaataaaacagaggagattatttatgcaaggagtaaacctggcggcagcgcaaaagatg

SEQ ID NO: 124280 - DNA, 103 bp, Artificial Sequence
  Synthetic Polynucleotide
taatacgactcactataggggctgtacagttccatctgtttttactccttaacagaggagaaaggagatgaaacagatgaacctggcggcagcgcaaaagatg

SEQ ID NO: 124281 - DNA, 103 bp, Artificial Sequence
  Synthetic Polynucleotide
taatacgactcactatagggtgtacactaagctgtacagttccatctgttaacagaggagaaacagaatgaactgtacaaacctggcggcagcgcaaaagatg

SEQ ID NO: 124282 - DNA, 103 bp, Artificial Sequence
  Synthetic Polynucleotide
taatacgactcactatagggagaaattacctgtacactaagctgtacagtaacagaggagaactgtaatgcttagtgtaaacctggcggcagcgcaaaagatg

SEQ ID NO: 124283 - DNA, 103 bp, Artificial Sequence
  Synthetic Polynucleotide
taatacgactcactatagggttccttggtaagaaattacctgtacactaaaacagaggagattagtgatgaggtaatttaacctggcggcagcgcaaaagatg

SEQ ID NO: 124284 - DNA, 103 bp, Artificial Sequence
  Synthetic Polynucleotide
taatacgactcactataggggttccatcaatctcaatttctatcagctccaacagaggagaggagctatgagaaattgaaacctggcggcagcgcaaaagatg

SEQ ID NO: 124285 - DNA, 103 bp, Artificial Sequence
  Synthetic Polynucleotide
taatacgactcactatagggtttggttcaattccttggtaagaaattaccaacagaggagaggtaatatgttaccaaggaacctggcggcagcgcaaaagatg

SEQ ID NO: 124286 - DNA, 103 bp, Artificial Sequence
  Synthetic Polynucleotide
taatacgactcactataggggatgtttaactttggttcaattccttggtaaacagaggagataccaaatgattgaaccaaacctggcggcagcgcaaaagatg

SEQ ID NO: 124287 - DNA, 103 bp, Artificial Sequence
  Synthetic Polynucleotide
taatacgactcactatagggcaatttcaaggatgtttaactttggttcaaaacagaggagattgaacatgagttaaacaaacctggcggcagcgcaaaagatg

SEQ ID NO: 124288 - DNA, 103 bp, Artificial Sequence
  Synthetic Polynucleotide
taatacgactcactataggggcaggtttaacaatttcaaggatgtttaacaacagaggagagttaaaatgccttgaaataacctggcggcagcgcaaaagatg

SEQ ID NO: 124289 - DNA, 103 bp, Artificial Sequence
  Synthetic Polynucleotide
taatacgactcactatagggaacagtgtccgcaggtttaacaatttcaagaacagaggagacttgaaatggttaaacctaacctggcggcagcgcaaaagatg

SEQ ID NO: 124290 - DNA, 103 bp, Artificial Sequence
  Synthetic Polynucleotide
taatacgactcactatagggtaacaacctcaacagtgtccgcaggtttaaaacagaggagattaaacatgcggacactgaacctggcggcagcgcaaaagatg

SEQ ID NO: 124291 - DNA, 103 bp, Artificial Sequence
  Synthetic Polynucleotide
taatacgactcactatagggtctggatcaataacaacctcaacagtgtccaacagaggagaggacacatgtgaggttgtaacctggcggcagcgcaaaagatg

SEQ ID NO: 124292 - DNA, 103 bp, Artificial Sequence
  Synthetic Polynucleotide
taatacgactcactatagggatggtgggcatctggatcaataacaacctcaacagaggagagaggttatgattgatccaaacctggcggcagcgcaaaagatg

SEQ ID NO: 124293 - DNA, 103 bp, Artificial Sequence
  Synthetic Polynucleotide
taatacgactcactatagggctgattcagcatggtgggcatctggatcaaaacagaggagattgatcatgatgcccaccaacctggcggcagcgcaaaagatg

SEQ ID NO: 124294 - DNA, 103 bp, Artificial Sequence
  Synthetic Polynucleotide
taatacgactcactatagggagatgtgcttctgattcagcatggtgggcaaacagaggagatgcccaatgtgctgaatcaacctggcggcagcgcaaaagatg

SEQ ID NO: 124295 - DNA, 103 bp, Artificial Sequence
  Synthetic Polynucleotide
taatacgactcactatagggtgctttctctgttccatcaatctcaatttcaacagaggagagaaattatgattgatggaaacctggcggcagcgcaaaagatg

SEQ ID NO: 124296 - DNA, 103 bp, Artificial Sequence
  Synthetic Polynucleotide
taatacgactcactatagggttcttcaacaagatgtgcttctgattcagcaacagaggagagctgaaatggaagcacataacctggcggcagcgcaaaagatg

SEQ ID NO: 124297 - DNA, 103 bp, Artificial Sequence
  Synthetic Polynucleotide
taatacgactcactatagggtcacttgagcttcttcaacaagatgtgcttaacagaggagaaagcacatgttgttgaagaacctggcggcagcgcaaaagatg

SEQ ID NO: 124298 - DNA, 103 bp, Artificial Sequence
  Synthetic Polynucleotide
taatacgactcactatagggtcaagagttatcacttgagcttcttcaacaaacagaggagatgttgaatgagctcaagtaacctggcggcagcgcaaaagatg

SEQ ID NO: 124299 - DNA, 103 bp, Artificial Sequence
  Synthetic Polynucleotide
taatacgactcactatagggttttgtgccatcaagagttatcacttgagcaacagaggagagctcaaatgataactcttaacctggcggcagcgcaaaagatg

SEQ ID NO: 124300 - DNA, 103 bp, Artificial Sequence
  Synthetic Polynucleotide
taatacgactcactatagggttgtgatgtgttttgtgccatcaagagttaaacagaggagataactcatgatggcacaaaacctggcggcagcgcaaaagatg

SEQ ID NO: 124301 - DNA, 103 bp, Artificial Sequence
  Synthetic Polynucleotide
taatacgactcactatagggtctgaaatggttgtgatgtgttttgtgccaaacagaggagatggcacatgacacatcacaacctggcggcagcgcaaaagatg

SEQ ID NO: 124302 - DNA, 103 bp, Artificial Sequence
  Synthetic Polynucleotide
taatacgactcactatagggtgaagtttcatctgaaatggttgtgatgtgaacagaggagacacatcatgaccatttcaaacctggcggcagcgcaaaagatg

SEQ ID NO: 124303 - DNA, 103 bp, Artificial Sequence
  Synthetic Polynucleotide
taatacgactcactatagggtcacttgttctgaagtttcatctgaaatggaacagaggagaccatttatgatgaaacttaacctggcggcagcgcaaaagatg

SEQ ID NO: 124304 - DNA, 103 bp, Artificial Sequence
  Synthetic Polynucleotide
taatacgactcactataggggcccatcttgtcacttgttctgaagtttcaaacagaggagatgaaacatgagaacaagtaacctggcggcagcgcaaaagatg

SEQ ID NO: 124305 - DNA, 103 bp, Artificial Sequence
  Synthetic Polynucleotide
taatacgactcactatagggcagtgcagcagcccatcttgtcacttgttcaacagaggagagaacaaatgacaagatggaacctggcggcagcgcaaaagatg

SEQ ID NO: 124306 - DNA, 103 bp, Artificial Sequence
  Synthetic Polynucleotide
taatacgactcactatagggctgtgcactctgctttctctgttccatcaaaacagaggagattgatgatgcagagaaagaacctggcggcagcgcaaaagatg

SEQ ID NO: 124307 - DNA, 103 bp, Artificial Sequence
  Synthetic Polynucleotide
taatacgactcactatagggtatagccttccagtgcagcagcccatcttgaacagaggagacaagatatgctgctgcacaacctggcggcagcgcaaaagatg

SEQ ID NO: 124308 - DNA, 103 bp, Artificial Sequence
  Synthetic Polynucleotide
taatacgactcactatagggtgttctttcctatagccttccagtgcagcaaacagaggagatgctgcatgggaaggctaaacctggcggcagcgcaaaagatg

SEQ ID NO: 124309 - DNA, 103 bp, Artificial Sequence
  Synthetic Polynucleotide
taatacgactcactatagggaaggcgttcttgttctttcctatagccttcaacagaggagagaaggcatgaggaaagaaaacctggcggcagcgcaaaagatg

SEQ ID NO: 124310 - DNA, 103 bp, Artificial Sequence
  Synthetic Polynucleotide
taatacgactcactatagggagggtatcccaaggcgttcttgttctttccaacagaggagaggaaagatgaagaacgccaacctggcggcagcgcaaaagatg

SEQ ID NO: 124311 - DNA, 103 bp, Artificial Sequence
  Synthetic Polynucleotide
taatacgactcactatagggatgggatcatagggtatcccaaggcgttctaacagaggagaagaacgatgtgggataccaacctggcggcagcgcaaaagatg

SEQ ID NO: 124312 - DNA, 103 bp, Artificial Sequence
  Synthetic Polynucleotide
taatacgactcactatagggggaccactgtatgggatcatagggtatcccaacagaggagagggataatgtatgatcccaacctggcggcagcgcaaaagatg

SEQ ID NO: 124313 - DNA, 103 bp, Artificial Sequence
  Synthetic Polynucleotide
taatacgactcactatagggcttggtctgtggaccactgtatgggatcataacagaggagaatgatcatgtacagtggtaacctggcggcagcgcaaaagatg

SEQ ID NO: 124314 - DNA, 103 bp, Artificial Sequence
  Synthetic Polynucleotide
taatacgactcactatagggcaatgcaggacttggtctgtggaccactgtaacagaggagaacagtgatgcacagaccaaacctggcggcagcgcaaaagatg

SEQ ID NO: 124315 - DNA, 103 bp, Artificial Sequence
  Synthetic Polynucleotide
taatacgactcactatagggccaaaccacccaatgcaggacttggtctgtaacagaggagaacagacatggtcctgcataacctggcggcagcgcaaaagatg

SEQ ID NO: 124316 - DNA, 103 bp, Artificial Sequence
  Synthetic Polynucleotide
taatacgactcactatagggccttcattacccaaaccacccaatgcaggaaacagaggagatcctgcatggggtggtttaacctggcggcagcgcaaaagatg

SEQ ID NO: 124317 - DNA, 103 bp, Artificial Sequence
  Synthetic Polynucleotide
taatacgactcactatagggatgctttcttctgtgcactctgctttctctaacagaggagaagagaaatgagagtgcacaacctggcggcagcgcaaaagatg

SEQ ID NO: 124318 - DNA, 103 bp, Artificial Sequence
  Synthetic Polynucleotide
taatacgactcactatagggatgctgaattccttcattacccaaaccaccaacagaggagaggtggtatgggtaatgaaaacctggcggcagcgcaaaagatg

SEQ ID NO: 124319 - DNA, 103 bp, Artificial Sequence
  Synthetic Polynucleotide
taatacgactcactatagggtatatcggtcatgctgaattccttcattacaacagaggagagtaatgatggaattcagcaacctggcggcagcgcaaaagatg

SEQ ID NO: 124320 - DNA, 103 bp, Artificial Sequence
  Synthetic Polynucleotide
taatacgactcactatagggtggtgaggtctatatcggtcatgctgaattaacagaggagaaattcaatgtgaccgataaacctggcggcagcgcaaaagatg

SEQ ID NO: 124321 - DNA, 103 bp, Artificial Sequence
  Synthetic Polynucleotide
taatacgactcactatagggatgttgagtgtggtgaggtctatatcggtcaacagaggagagaccgaatgagacctcacaacctggcggcagcgcaaaagatg

SEQ ID NO: 124322 - DNA, 103 bp, Artificial Sequence
  Synthetic Polynucleotide
taatacgactcactatagggtctccccgaaatgttgagtgtggtgaggtcaacagaggagagacctcatgacactcaacaacctggcggcagcgcaaaagatg

SEQ ID NO: 124323 - DNA, 103 bp, Artificial Sequence
  Synthetic Polynucleotide
taatacgactcactatagggtacataattctctccccgaaatgttgagtgaacagaggagacactcaatgtttcggggaaacctggcggcagcgcaaaagatg

SEQ ID NO: 124324 - DNA, 103 bp, Artificial Sequence
  Synthetic Polynucleotide
taatacgactcactatagggtggttgagactacataattctctccccgaaaacagaggagattcgggatgagaattatgaacctggcggcagcgcaaaagatg

SEQ ID NO: 124325 - DNA, 103 bp, Artificial Sequence
  Synthetic Polynucleotide
taatacgactcactatagggaaaatcttcttggttgagactacataattcaacagaggagagaattaatgagtctcaacaacctggcggcagcgcaaaagatg

SEQ ID NO: 124326 - DNA, 103 bp, Artificial Sequence
  Synthetic Polynucleotide
taatacgactcactatagggcccgctgaaaaaaatcttcttggttgagacaacagaggagagtctcaatgaagaagattaacctggcggcagcgcaaaagatg

SEQ ID NO: 124327 - DNA, 103 bp, Artificial Sequence
  Synthetic Polynucleotide
taatacgactcactatagggccccgaggaacccgctgaaaaaaatcttctaacagaggagaagaagaatgttttcagcgaacctggcggcagcgcaaaagatg

SEQ ID NO: 124328 - DNA, 103 bp, Artificial Sequence
  Synthetic Polynucleotide
taatacgactcactatagggttgttctacaatgctttcttctgtgcactcaacagaggagagagtgcatggaagaaagcaacctggcggcagcgcaaaagatg

SEQ ID NO: 124329 - DNA, 103 bp, Artificial Sequence
  Synthetic Polynucleotide
taatacgactcactataggggagaatttctccccgaggaacccgctgaaaaacagaggagatttcagatggttcctcggaacctggcggcagcgcaaaagatg

SEQ ID NO: 124330 - DNA, 103 bp, Artificial Sequence
  Synthetic Polynucleotide
taatacgactcactataggggatgactccagagaatttctccccgaggaaaacagaggagattcctcatggagaaattcaacctggcggcagcgcaaaagatg

SEQ ID NO: 124331 - DNA, 103 bp, Artificial Sequence
  Synthetic Polynucleotide
taatacgactcactatagggagaagttccagatgactccagagaatttctaacagaggagaagaaatatgctggagtcaaacctggcggcagcgcaaaagatg

SEQ ID NO: 124332 - DNA, 103 bp, Artificial Sequence
  Synthetic Polynucleotide
taatacgactcactatagggatattttcggagaagttccagatgactccaaacagaggagatggagtatgctggaacttaacctggcggcagcgcaaaagatg

SEQ ID NO: 124333 - DNA, 103 bp, Artificial Sequence
  Synthetic Polynucleotide
taatacgactcactatagggttgccaatacatattttcggagaagttccaaacagaggagatggaacatgtccgaaaataacctggcggcagcgcaaaagatg

SEQ ID NO: 124334 - DNA, 103 bp, Artificial Sequence
  Synthetic Polynucleotide
taatacgactcactatagggtgttcttgacttgccaatacatattttcggaacagaggagaccgaaaatgtgtattggcaacctggcggcagcgcaaaagatg

SEQ ID NO: 124335 - DNA, 103 bp, Artificial Sequence
  Synthetic Polynucleotide
taatacgactcactatagggattcatctgttgttcttgacttgccaatacaacagaggagagtattgatgagtcaagaaaacctggcggcagcgcaaaagatg

SEQ ID NO: 124336 - DNA, 103 bp, Artificial Sequence
  Synthetic Polynucleotide
taatacgactcactatagggtaactatttcattcatctgttgttcttgacaacagaggagagtcaagatgaacagatgaaacctggcggcagcgcaaaagatg

SEQ ID NO: 124337 - DNA, 103 bp, Artificial Sequence
  Synthetic Polynucleotide
taatacgactcactatagggtgatcaattgtaactatttcattcatctgtaacagaggagaacagatatgtgaaatagtaacctggcggcagcgcaaaagatg

SEQ ID NO: 124338 - DNA, 103 bp, Artificial Sequence
  Synthetic Polynucleotide
taatacgactcactatagggttgcacaggttgatcaattgtaactatttcaacagaggagagaaataatgacaattgataacctggcggcagcgcaaaagatg

SEQ ID NO: 124339 - DNA, 103 bp, Artificial Sequence
  Synthetic Polynucleotide
taatacgactcactataggggcgcgtaggtttgttctacaatgctttcttaacagaggagaaagaaaatgttgtagaacaacctggcggcagcgcaaaagatg

SEQ ID NO: 124340 - DNA, 103 bp, Artificial Sequence
  Synthetic Polynucleotide
taatacgactcactatagggctggaataatttgcacaggttgatcaattgaacagaggagacaattgatgaacctgtgcaacctggcggcagcgcaaaagatg

SEQ ID NO: 124341 - DNA, 103 bp, Artificial Sequence
  Synthetic Polynucleotide
taatacgactcactatagggtgcactgatgctggaataatttgcacaggtaacagaggagaacctgtatgaattattccaacctggcggcagcgcaaaagatg

SEQ ID NO: 124342 - DNA, 103 bp, Artificial Sequence
  Synthetic Polynucleotide
taatacgactcactatagggtgtagcagattgcactgatgctggaataataacagaggagaattattatggcatcagtgaacctggcggcagcgcaaaagatg

SEQ ID NO: 124343 - DNA, 103 bp, Artificial Sequence
  Synthetic Polynucleotide
taatacgactcactatagggtggtagtaggtgtagcagattgcactgatgaacagaggagacatcagatgaatctgctaaacctggcggcagcgcaaaagatg

SEQ ID NO: 124344 - DNA, 103 bp, Artificial Sequence
  Synthetic Polynucleotide
taatacgactcactatagggataactttaatggtagtaggtgtagcagataacagaggagaatctgcatgacctactacaacctggcggcagcgcaaaagatg

SEQ ID NO: 124345 - DNA, 103 bp, Artificial Sequence
  Synthetic Polynucleotide
taatacgactcactatagggactactatttataactttaatggtagtaggaacagaggagacctactatgattaaagttaacctggcggcagcgcaaaagatg

SEQ ID NO: 124346 - DNA, 103 bp, Artificial Sequence
  Synthetic Polynucleotide
taatacgactcactatagggctgctttcgcactactatttataactttaaaacagaggagattaaagatgtaaatagtaaacctggcggcagcgcaaaagatg

SEQ ID NO: 124347 - DNA, 103 bp, Artificial Sequence
  Synthetic Polynucleotide
taatacgactcactatagggtgtactttggctgctttcgcactactatttaacagaggagaaaatagatgtgcgaaagcaacctggcggcagcgcaaaagatg

SEQ ID NO: 124348 - DNA, 103 bp, Artificial Sequence
  Synthetic Polynucleotide
taatacgactcactatagggcggcgctctttgtactttggctgctttcgcaacagaggagagcgaaaatggccaaagtaaacctggcggcagcgcaaaagatg

SEQ ID NO: 124349 - DNA, 103 bp, Artificial Sequence
  Synthetic Polynucleotide
taatacgactcactatagggctgaaatcctcggcgctctttgtactttggaacagaggagaccaaagatgaaagagcgcaacctggcggcagcgcaaaagatg

SEQ ID NO: 124350 - DNA, 103 bp, Artificial Sequence
  Synthetic Polynucleotide
taatacgactcactatagggcattcagctggcgcgtaggtttgttctacaaacagaggagatgtagaatgaacctacgcaacctggcggcagcgcaaaagatg

SEQ ID NO: 124351 - DNA, 103 bp, Artificial Sequence
  Synthetic Polynucleotide
taatacgactcactatagggctatcttctcctgaaatcctcggcgctcttaacagaggagaaagagcatggaggatttcaacctggcggcagcgcaaaagatg

SEQ ID NO: 124352 - DNA, 103 bp, Artificial Sequence
  Synthetic Polynucleotide
taatacgactcactatagggaggtgagcttctatcttctcctgaaatcctaacagaggagaaggattatgggagaagataacctggcggcagcgcaaaagatg

SEQ ID NO: 124353 - DNA, 103 bp, Artificial Sequence
  Synthetic Polynucleotide
taatacgactcactatagggttctgttcccaggtgagcttctatcttctcaacagaggagagagaagatggaagctcacaacctggcggcagcgcaaaagatg

SEQ ID NO: 124354 - DNA, 103 bp, Artificial Sequence
  Synthetic Polynucleotide
taatacgactcactatagggttgtttcctgttctgttcccaggtgagcttaacagaggagaaagctcatgtgggaacagaacctggcggcagcgcaaaagatg

SEQ ID NO: 124355 - DNA, 103 bp, Artificial Sequence
  Synthetic Polynucleotide
taatacgactcactataggggatttggccattgtttcctgttctgttcccaacagaggagagggaacatgacaggaaacaacctggcggcagcgcaaaagatg

SEQ ID NO: 124356 - DNA, 103 bp, Artificial Sequence
  Synthetic Polynucleotide
taatacgactcactataggggccatagttggatttggccattgtttcctgaacagaggagacaggaaatgatggccaaaaacctggcggcagcgcaaaagatg

SEQ ID NO: 124357 - DNA, 103 bp, Artificial Sequence
  Synthetic Polynucleotide
taatacgactcactatagggagcaaaaactgccatagttggatttggccaaacagaggagatggccaatgccaactatgaacctggcggcagcgcaaaagatg

SEQ ID NO: 124358 - DNA, 103 bp, Artificial Sequence
  Synthetic Polynucleotide
taatacgactcactatagggaagaagttctagcaaaaactgccatagttgaacagaggagacaactaatgcagtttttgaacctggcggcagcgcaaaagatg

SEQ ID NO: 124359 - DNA, 103 bp, Artificial Sequence
  Synthetic Polynucleotide
taatacgactcactatagggccttatcagtaagaagttctagcaaaaactaacagaggagaagttttatgtagaacttcaacctggcggcagcgcaaaagatg

SEQ ID NO: 124360 - DNA, 103 bp, Artificial Sequence
  Synthetic Polynucleotide
taatacgactcactatagggtctcgagcgtccttatcagtaagaagttctaacagaggagaagaactatgtactgataaaacctggcggcagcgcaaaagatg

SEQ ID NO: 124361 - DNA, 103 bp, Artificial Sequence
  Synthetic Polynucleotide
taatacgactcactatagggaagcttctttcccaaatctaccagggacataacagaggagaatgtccatggtagatttgaacctggcggcagcgcaaaagatg

SEQ ID NO: 124362 - DNA, 103 bp, Artificial Sequence
  Synthetic Polynucleotide
taatacgactcactatagggagaagttcccagccagtctgtagtaaagggaacagaggagaccctttatgacagactggaacctggcggcagcgcaaaagatg

SEQ ID NO: 124363 - DNA, 103 bp, Artificial Sequence
  Synthetic Polynucleotide
taatacgactcactatagggttccacccggttttcaattatttcgatacaaacagaggagatgtatcatgataattgaaaacctggcggcagcgcaaaagatg

SEQ ID NO: 124364 - DNA, 103 bp, Artificial Sequence
  Synthetic Polynucleotide
taatacgactcactatagggtttctgcagattccacccggttttcaattaaacagaggagataattgatgaccgggtggaacctggcggcagcgcaaaagatg

SEQ ID NO: 124365 - DNA, 103 bp, Artificial Sequence
  Synthetic Polynucleotide
taatacgactcactatagggctctcttctatttctgcagattccacccggaacagaggagaccgggtatgatctgcagaaacctggcggcagcgcaaaagatg

SEQ ID NO: 124366 - DNA, 103 bp, Artificial Sequence
  Synthetic Polynucleotide
taatacgactcactatagggaagagcttctctctcttctatttctgcagaaacagaggagatctgcaatgatagaagagaacctggcggcagcgcaaaagatg

SEQ ID NO: 124367 - DNA, 103 bp, Artificial Sequence
  Synthetic Polynucleotide
taatacgactcactataggggctgtttctgaagagcttctctctcttctaaacagaggagatagaagatggagaagctcaacctggcggcagcgcaaaagatg

SEQ ID NO: 124368 - DNA, 103 bp, Artificial Sequence
  Synthetic Polynucleotide
taatacgactcactataggggcttcatccagctgtttctgaagagcttctaacagaggagaagaagcatgtcagaaacaaacctggcggcagcgcaaaagatg

SEQ ID NO: 124369 - DNA, 103 bp, Artificial Sequence
  Synthetic Polynucleotide
taatacgactcactatagggttctcgatttgcttcatccagctgtttctgaacagaggagacagaaaatgctggatgaaaacctggcggcagcgcaaaagatg

SEQ ID NO: 124370 - DNA, 103 bp, Artificial Sequence
  Synthetic Polynucleotide
taatacgactcactatagggatttttgtgcttctcgatttgcttcatccaaacagaggagatggatgatgcaaatcgagaacctggcggcagcgcaaaagatg

SEQ ID NO: 124371 - DNA, 103 bp, Artificial Sequence
  Synthetic Polynucleotide
taatacgactcactatagggtgctgtcgatatttttgtgcttctcgatttaacagaggagaaaatcgatgagcacaaaaaacctggcggcagcgcaaaagatg

SEQ ID NO: 124372 - DNA, 103 bp, Artificial Sequence
  Synthetic Polynucleotide
taatacgactcactatagggctttaggagctgctgtcgatatttttgtgcaacagaggagagcacaaatgtatcgacagaacctggcggcagcgcaaaagatg

SEQ ID NO: 124373 - DNA, 103 bp, Artificial Sequence
  Synthetic Polynucleotide
taatacgactcactataggggatgaagtggagaagttcccagccagtctgaacagaggagacagactatgtgggaacttaacctggcggcagcgcaaaagatg

SEQ ID NO: 124374 - DNA, 103 bp, Artificial Sequence
  Synthetic Polynucleotide
taatacgactcactatagggcctgttctttctttaggagctgctgtcgataacagaggagaatcgacatgagctcctaaaacctggcggcagcgcaaaagatg

SEQ ID NO: 124375 - DNA, 103 bp, Artificial Sequence
  Synthetic Polynucleotide
taatacgactcactataggggcctctgcttcctgttctttctttaggagcaacagaggagagctcctatggaaagaacaaacctggcggcagcgcaaaagatg

SEQ ID NO: 124376 - DNA, 103 bp, Artificial Sequence
  Synthetic Polynucleotide
taatacgactcactatagggctgtctgtaggcctctgcttcctgttctttaacagaggagaaaagaaatggaagcagagaacctggcggcagcgcaaaagatg

SEQ ID NO: 124377 - DNA, 103 bp, Artificial Sequence
  Synthetic Polynucleotide
taatacgactcactatagggcttccaacttctgtctgtaggcctctgcttaacagaggagaaagcagatgcctacagacaacctggcggcagcgcaaaagatg

SEQ ID NO: 124378 - DNA, 103 bp, Artificial Sequence
  Synthetic Polynucleotide
taatacgactcactatagggcgagtcatagcttccaacttctgtctgtagaacagaggagactacagatggaagttggaaacctggcggcagcgcaaaagatg

SEQ ID NO: 124379 - DNA, 103 bp, Artificial Sequence
  Synthetic Polynucleotide
taatacgactcactatagggagtctgaagacgagtcatagcttccaacttaacagaggagaaagttgatggctatgactaacctggcggcagcgcaaaagatg

SEQ ID NO: 124380 - DNA, 103 bp, Artificial Sequence
  Synthetic Polynucleotide
taatacgactcactatagggcttctttattagtctgaagacgagtcatagaacagaggagactatgaatggtcttcagaaacctggcggcagcgcaaaagatg

SEQ ID NO: 124381 - DNA, 103 bp, Artificial Sequence
  Synthetic Polynucleotide
taatacgactcactatagggtgtgctgctagatgaagtggagaagttcccaacagaggagagggaacatgtccacttcaaacctggcggcagcgcaaaagatg

SEQ ID NO: 124382 - DNA, 103 bp, Artificial Sequence
  Synthetic Polynucleotide
taatacgactcactatagggatgaccatactgtgctgctagatgaagtggaacagaggagaccacttatgctagcagcaaacctggcggcagcgcaaaagatg

SEQ ID NO: 124383 - DNA, 103 bp, Artificial Sequence
  Synthetic Polynucleotide
taatacgactcactatagggtggtggaataatgaccatactgtgctgctaaacagaggagatagcagatgagtatggtcaacctggcggcagcgcaaaagatg

SEQ ID NO: 124384 - DNA, 103 bp, Artificial Sequence
  Synthetic Polynucleotide
taatacgactcactatagggagtacctctgtggtggaataatgaccatacaacagaggagagtatggatgttattccacaacctggcggcagcgcaaaagatg

SEQ ID NO: 124385 - DNA, 103 bp, Artificial Sequence
  Synthetic Polynucleotide
taatacgactcactatagggagctcgcagcagtacctctgtggtggaataaacagaggagatattccatgacagaggtaaacctggcggcagcgcaaaagatg

SEQ ID NO: 124386 - DNA, 103 bp, Artificial Sequence
  Synthetic Polynucleotide
taatacgactcactatagggtgctcacaccagctcgcagcagtacctctgaacagaggagacagaggatgtgctgcgagaacctggcggcagcgcaaaagatg

SEQ ID NO: 124387 - DNA, 103 bp, Artificial Sequence
  Synthetic Polynucleotide
taatacgactcactatagggctggcatctctgctcacaccagctcgcagcaacagaggagagctgcgatgtggtgtgagaacctggcggcagcgcaaaagatg

SEQ ID NO: 124388 - DNA, 103 bp, Artificial Sequence
  Synthetic Polynucleotide
taatacgactcactatagggcactttggttctggcatctctgctcacaccaacagaggagaggtgtgatgagagatgccaacctggcggcagcgcaaaagatg

SEQ ID NO: 124389 - DNA, 103 bp, Artificial Sequence
  Synthetic Polynucleotide
taatacgactcactatagggccgcttctaaaagcttctttcccaaatctaaacagaggagatagattatggaaagaagcaacctggcggcagcgcaaaagatg

SEQ ID NO: 124390 - DNA, 103 bp, Artificial Sequence
  Synthetic Polynucleotide
taatacgactcactataggggtgttcggtccactttggttctggcatctcaacagaggagagagatgatggaaccaaagaacctggcggcagcgcaaaagatg

SEQ ID NO: 124391 - DNA, 103 bp, Artificial Sequence
  Synthetic Polynucleotide
taatacgactcactatagggatatgtaatggtgttcggtccactttggttaacagaggagaaaccaaatgggaccgaacaacctggcggcagcgcaaaagatg

SEQ ID NO: 124392 - DNA, 103 bp, Artificial Sequence
  Synthetic Polynucleotide
taatacgactcactatagggagaagctgccatatgtaatggtgttcggtcaacagaggagagaccgaatgccattacataacctggcggcagcgcaaaagatg

SEQ ID NO: 124393 - DNA, 103 bp, Artificial Sequence
  Synthetic Polynucleotide
taatacgactcactatagggcatggccctcagaagctgccatatgtaatgaacagaggagacattacatgtggcagcttaacctggcggcagcgcaaaagatg

SEQ ID NO: 124394 - DNA, 103 bp, Artificial Sequence
  Synthetic Polynucleotide
taatacgactcactatagggactatgctggcatggccctcagaagctgccaacagaggagaggcagcatgtgagggccaaacctggcggcagcgcaaaagatg

SEQ ID NO: 124395 - DNA, 103 bp, Artificial Sequence
  Synthetic Polynucleotide
taatacgactcactatagggtaaaacctctactatgctggcatggccctcaacagaggagagagggcatggccagcataaacctggcggcagcgcaaaagatg

SEQ ID NO: 124396 - DNA, 103 bp, Artificial Sequence
  Synthetic Polynucleotide
taatacgactcactatagggcatgcttaagtaaaacctctactatgctggaacagaggagaccagcaatgtagaggtttaacctggcggcagcgcaaaagatg

SEQ ID NO: 124397 - DNA, 103 bp, Artificial Sequence
  Synthetic Polynucleotide
taatacgactcactatagggacatcagcaccatgcttaagtaaaacctctaacagaggagaagaggtatgacttaagcaaacctggcggcagcgcaaaagatg

SEQ ID NO: 124398 - DNA, 103 bp, Artificial Sequence
  Synthetic Polynucleotide
taatacgactcactatagggctttgcattgacatcagcaccatgcttaagaacagaggagacttaagatgggtgctgataacctggcggcagcgcaaaagatg

SEQ ID NO: 124399 - DNA, 103 bp, Artificial Sequence
  Synthetic Polynucleotide
taatacgactcactatagggttaacatgtcctttgcattgacatcagcacaacagaggagagtgctgatgtcaatgcaaaacctggcggcagcgcaaaagatg

SEQ ID NO: 124400 - DNA, 103 bp, Artificial Sequence
  Synthetic Polynucleotide
taatacgactcactatagggcctgctcgtgccgcttctaaaagcttctttaacagaggagaaaagaaatgtttagaagcaacctggcggcagcgcaaaagatg

SEQ ID NO: 124401 - DNA, 103 bp, Artificial Sequence
  Synthetic Polynucleotide
taatacgactcactataggggctgtcatctttaacatgtcctttgcattgaacagaggagacaatgcatgggacatgttaacctggcggcagcgcaaaagatg

SEQ ID NO: 124402 - DNA, 103 bp, Artificial Sequence
  Synthetic Polynucleotide
taatacgactcactatagggccaatggagagctgtcatctttaacatgtcaacagaggagagacatgatgaagatgacaaacctggcggcagcgcaaaagatg

SEQ ID NO: 124403 - DNA, 103 bp, Artificial Sequence
  Synthetic Polynucleotide
taatacgactcactataggggttctgtggcccaatggagagctgtcatctaacagaggagaagatgaatgctctccattaacctggcggcagcgcaaaagatg

SEQ ID NO: 124404 - DNA, 103 bp, Artificial Sequence
  Synthetic Polynucleotide
taatacgactcactatagggtgatgattgtgttctgtggcccaatggagaaacagaggagatctccaatgggccacagaaacctggcggcagcgcaaaagatg

SEQ ID NO: 124405 - DNA, 103 bp, Artificial Sequence
  Synthetic Polynucleotide
taatacgactcactatagggcaccacctcttgatgattgtgttctgtggcaacagaggagagccacaatgcacaatcataacctggcggcagcgcaaaagatg

SEQ ID NO: 124406 - DNA, 103 bp, Artificial Sequence
  Synthetic Polynucleotide
taatacgactcactatagggttaaaagttccaccacctcttgatgattgtaacagaggagaacaatcatgaagaggtggaacctggcggcagcgcaaaagatg

SEQ ID NO: 124407 - DNA, 103 bp, Artificial Sequence
  Synthetic Polynucleotide
taatacgactcactatagggccatatttgattaaaagttccaccacctctaacagaggagaagaggtatgggaacttttaacctggcggcagcgcaaaagatg

SEQ ID NO: 124408 - DNA, 103 bp, Artificial Sequence
  Synthetic Polynucleotide
taatacgactcactatagggtacatcagcaccatatttgattaaaagttcaacagaggagagaacttatgatcaaatataacctggcggcagcgcaaaagatg

SEQ ID NO: 124409 - DNA, 103 bp, Artificial Sequence
  Synthetic Polynucleotide
taatacgactcactatagggtttgcgtgtgtacatcagcaccatatttgaaacagaggagatcaaatatggtgctgatgaacctggcggcagcgcaaaagatg

SEQ ID NO: 124410 - DNA, 103 bp, Artificial Sequence
  Synthetic Polynucleotide
taatacgactcactatagggcaaaatttactttgcgtgtgtacatcagcaaacagaggagatgctgaatgacacacgcaaacctggcggcagcgcaaaagatg

SEQ ID NO: 124411 - DNA, 103 bp, Artificial Sequence
  Synthetic Polynucleotide
taatacgactcactatagggatcatcttgacctgctcgtgccgcttctaaaacagaggagattagaaatggcacgagcaaacctggcggcagcgcaaaagatg

SEQ ID NO: 124412 - DNA, 103 bp, Artificial Sequence
  Synthetic Polynucleotide
taatacgactcactatagggtgcagttttacaaaatttactttgcgtgtgaacagaggagacacacgatgagtaaatttaacctggcggcagcgcaaaagatg

SEQ ID NO: 124413 - DNA, 103 bp, Artificial Sequence
  Synthetic Polynucleotide
taatacgactcactatagggaaatatcaaatgcagttttacaaaatttacaacagaggagagtaaatatggtaaaactgaacctggcggcagcgcaaaagatg

SEQ ID NO: 124414 - DNA, 103 bp, Artificial Sequence
  Synthetic Polynucleotide
taatacgactcactatagggttgtctattgaaatatcaaatgcagttttaaacagaggagataaaacatgatttgatataacctggcggcagcgcaaaagatg

SEQ ID NO: 124415 - DNA, 103 bp, Artificial Sequence
  Synthetic Polynucleotide
taatacgactcactatagggttcatttccattgtctattgaaatatcaaaaacagaggagatttgatatgtcaatagacaacctggcggcagcgcaaaagatg

SEQ ID NO: 124416 - DNA, 103 bp, Artificial Sequence
  Synthetic Polynucleotide
taatacgactcactatagggctgctaaatcttcatttccattgtctattgaacagaggagacaatagatgatggaaatgaacctggcggcagcgcaaaagatg

SEQ ID NO: 124417 - DNA, 103 bp, Artificial Sequence
  Synthetic Polynucleotide
taatacgactcactatagggtgtaatatctctgctaaatcttcatttccaaacagaggagatggaaaatgagatttagcaacctggcggcagcgcaaaagatg

SEQ ID NO: 124418 - DNA, 103 bp, Artificial Sequence
  Synthetic Polynucleotide
taatacgactcactatagggcatagcaatctgtaatatctctgctaaatcaacagaggagagatttaatggagatattaaacctggcggcagcgcaaaagatg

SEQ ID NO: 124419 - DNA, 103 bp, Artificial Sequence
  Synthetic Polynucleotide
taatacgactcactatagggtttggttctgcatagcaatctgtaatatctaacagaggagaagatatatgagattgctaaacctggcggcagcgcaaaagatg

SEQ ID NO: 124420 - DNA, 103 bp, Artificial Sequence
  Synthetic Polynucleotide
taatacgactcactatagggtttgtgttgatttggttctgcatagcaatcaacagaggagagattgcatggcagaaccaaacctggcggcagcgcaaaagatg

SEQ ID NO: 124421 - DNA, 103 bp, Artificial Sequence
  Synthetic Polynucleotide
taatacgactcactatagggactctctgggtttgtgttgatttggttctgaacagaggagacagaacatgatcaacacaaacctggcggcagcgcaaaagatg

SEQ ID NO: 124422 - DNA, 103 bp, Artificial Sequence
  Synthetic Polynucleotide
taatacgactcactatagggtacgaacttcatcatcttgacctgctcgtgaacagaggagacacgagatggtcaagatgaacctggcggcagcgcaaaagatg

SEQ ID NO: 124423 - DNA, 103 bp, Artificial Sequence
  Synthetic Polynucleotide
taatacgactcactatagggcagtgtcaggactctctgggtttgtgttgaaacagaggagatcaacaatgacccagagaaacctggcggcagcgcaaaagatg

SEQ ID NO: 124424 - DNA, 103 bp, Artificial Sequence
  Synthetic Polynucleotide
taatacgactcactatagggtgtattgtcacagtgtcaggactctctgggaacagaggagacccagaatgtcctgacacaacctggcggcagcgcaaaagatg

SEQ ID NO: 124425 - DNA, 103 bp, Artificial Sequence
  Synthetic Polynucleotide
taatacgactcactatagggtgttgcagcatgtattgtcacagtgtcaggaacagaggagacctgacatggtgacaataaacctggcggcagcgcaaaagatg

SEQ ID NO: 124426 - DNA, 103 bp, Artificial Sequence
  Synthetic Polynucleotide
taatacgactcactatagggtaaactgtggtgttgcagcatgtattgtcaaacagaggagatgacaaatgatgctgcaaaacctggcggcagcgcaaaagatg

SEQ ID NO: 124427 - DNA, 103 bp, Artificial Sequence
  Synthetic Polynucleotide
taatacgactcactatagggggtccaatgataaactgtggtgttgcagcaaacagaggagatgctgcatgaccacagttaacctggcggcagcgcaaaagatg

SEQ ID NO: 124428 - DNA, 103 bp, Artificial Sequence
  Synthetic Polynucleotide
taatacgactcactatagggcacccctccaggtccaatgataaactgtggaacagaggagaccacagatgatcattggaaacctggcggcagcgcaaaagatg

SEQ ID NO: 124429 - DNA, 103 bp, Artificial Sequence
  Synthetic Polynucleotide
taatacgactcactatagggttaggttcaccacccctccaggtccaatgaaacagaggagatcattgatgctggaggggaacctggcggcagcgcaaaagatg

SEQ ID NO: 124430 - DNA, 103 bp, Artificial Sequence
  Synthetic Polynucleotide
taatacgactcactatagggaccagacctgttaggttcaccacccctccaaacagaggagatggaggatgggtgaacctaacctggcggcagcgcaaaagatg

SEQ ID NO: 124431 - DNA, 103 bp, Artificial Sequence
  Synthetic Polynucleotide
taatacgactcactatagggttctgaagataccagacctgttaggttcacaacagaggagagtgaacatgacaggtctgaacctggcggcagcgcaaaagatg

SEQ ID NO: 124432 - DNA, 103 bp, Artificial Sequence
  Synthetic Polynucleotide
taatacgactcactatagggtggatgaattttctgaagataccagacctgaacagaggagacaggtcatgtatcttcagaacctggcggcagcgcaaaagatg

SEQ ID NO: 124433 - DNA, 103 bp, Artificial Sequence
  Synthetic Polynucleotide
taatacgactcactataggggccatcaaaatacgaacttcatcatcttgaaacagaggagatcaagaatgtgaagttcgaacctggcggcagcgcaaaagatg

SEQ ID NO: 124434 - DNA, 103 bp, Artificial Sequence
  Synthetic Polynucleotide
taatacgactcactatagggtctgttgccttggatgaattttctgaagataacagaggagaatcttcatgaaattcatcaacctggcggcagcgcaaaagatg

SEQ ID NO: 124435 - DNA, 103 bp, Artificial Sequence
  Synthetic Polynucleotide
taatacgactcactatagggacccgtttcatctgttgccttggatgaattaacagaggagaaattcaatgaaggcaacaaacctggcggcagcgcaaaagatg

SEQ ID NO: 124436 - DNA, 103 bp, Artificial Sequence
  Synthetic Polynucleotide
taatacgactcactatagggcagcagatacacccgtttcatctgttgcctaacagaggagaaggcaaatgatgaaacggaacctggcggcagcgcaaaagatg

SEQ ID NO: 124437 - DNA, 103 bp, Artificial Sequence
  Synthetic Polynucleotide
taatacgactcactatagggccaaactgaacagcagatacacccgtttcaaacagaggagatgaaacatgtgtatctgcaacctggcggcagcgcaaaagatg

SEQ ID NO: 124438 - DNA, 103 bp, Artificial Sequence
  Synthetic Polynucleotide
taatacgactcactatagggagaagagtttccaaactgaacagcagatacaacagaggagagtatctatggttcagtttaacctggcggcagcgcaaaagatg

SEQ ID NO: 124439 - DNA, 103 bp, Artificial Sequence
  Synthetic Polynucleotide
taatacgactcactatagggatactgatgtagaagagtttccaaactgaaaacagaggagattcagtatggaaactcttaacctggcggcagcgcaaaagatg

SEQ ID NO: 124440 - DNA, 103 bp, Artificial Sequence
  Synthetic Polynucleotide
taatacgactcactatagggaatgtagctaatactgatgtagaagagtttaacagaggagaaaactcatgtacatcagtaacctggcggcagcgcaaaagatg

SEQ ID NO: 124441 - DNA, 103 bp, Artificial Sequence
  Synthetic Polynucleotide
taatacgactcactatagggtaaggcagctaatgtagctaatactgatgtaacagaggagaacatcaatgttagctacaaacctggcggcagcgcaaaagatg

SEQ ID NO: 124442 - DNA, 103 bp, Artificial Sequence
  Synthetic Polynucleotide
taatacgactcactatagggatgcttcagctaaggcagctaatgtagctaaacagaggagatagctaatgtagctgcctaacctggcggcagcgcaaaagatg

SEQ ID NO: 124443 - DNA, 103 bp, Artificial Sequence
  Synthetic Polynucleotide
taatacgactcactatagggaatggagcagatgcttcagctaaggcagctaacagaggagaagctgcatgagctgaagcaacctggcggcagcgcaaaagatg

SEQ ID NO: 124444 - DNA, 103 bp, Artificial Sequence
  Synthetic Polynucleotide
taatacgactcactatagggagctccatttgccatcaaaatacgaacttcaacagaggagagaagttatgattttgatgaacctggcggcagcgcaaaagatg

SEQ ID NO: 124445 - DNA, 103 bp, Artificial Sequence
  Synthetic Polynucleotide
taatacgactcactatagggagaattggacaatggagcagatgcttcagcaacagaggagagctgaaatgtctgctccaaacctggcggcagcgcaaaagatg

SEQ ID NO: 124446 - DNA, 103 bp, Artificial Sequence
  Synthetic Polynucleotide
taatacgactcactataggggagtttctgaagaattggacaatggagcagaacagaggagactgctcatgtgtccaattaacctggcggcagcgcaaaagatg

SEQ ID NO: 124447 - DNA, 103 bp, Artificial Sequence
  Synthetic Polynucleotide
taatacgactcactataggggccactactggagtttctgaagaattggacaacagaggagagtccaaatgttcagaaacaacctggcggcagcgcaaaagatg

SEQ ID NO: 124448 - DNA, 103 bp, Artificial Sequence
  Synthetic Polynucleotide
taatacgactcactatagggttcttctgtggccactactggagtttctgaaacagaggagatcagaaatgccagtagtgaacctggcggcagcgcaaaagatg

SEQ ID NO: 124449 - DNA, 103 bp, Artificial Sequence
  Synthetic Polynucleotide
taatacgactcactatagggcagtaactacttcttctgtggccactactgaacagaggagacagtagatgccacagaagaacctggcggcagcgcaaaagatg

SEQ ID NO: 124450 - DNA, 103 bp, Artificial Sequence
  Synthetic Polynucleotide
taatacgactcactatagggacagattctgcagtaactacttcttctgtgaacagaggagacacagaatgagtagttacaacctggcggcagcgcaaaagatg

SEQ ID NO: 124451 - DNA, 103 bp, Artificial Sequence
  Synthetic Polynucleotide
taatacgactcactatagggggcaccatccacagattctgcagtaactacaacagaggagagtagttatggcagaatctaacctggcggcagcgcaaaagatg

SEQ ID NO: 124452 - DNA, 103 bp, Artificial Sequence
  Synthetic Polynucleotide
taatacgactcactatagggcttgctgaatggcaccatccacagattctgaacagaggagacagaatatgtggatggtgaacctggcggcagcgcaaaagatg

SEQ ID NO: 124453 - DNA, 103 bp, Artificial Sequence
  Synthetic Polynucleotide
taatacgactcactataggggaactaactacttgctgaatggcaccatccaacagaggagaggatggatgcattcagcaaacctggcggcagcgcaaaagatg

SEQ ID NO: 124454 - DNA, 103 bp, Artificial Sequence
  Synthetic Polynucleotide
taatacgactcactatagggctgaccccctgaactaactacttgctgaataacagaggagaattcagatggtagttagtaacctggcggcagcgcaaaagatg

SEQ ID NO: 124455 - DNA, 103 bp, Artificial Sequence
  Synthetic Polynucleotide
taatacgactcactatagggtagtaaagggagctccatttgccatcaaaaaacagaggagattttgaatgcaaatggagaacctggcggcagcgcaaaagatg

SEQ ID NO: 124456 - DNA, 103 bp, Artificial Sequence
  Synthetic Polynucleotide
taatacgactcactatagggtgatgacttgctgaccccctgaactaactaaacagaggagatagttaatgcagggggtcaacctggcggcagcgcaaaagatg

SEQ ID NO: 124457 - DNA, 103 bp, Artificial Sequence
  Synthetic Polynucleotide
taatacgactcactataggggtaactattgtgatgacttgctgaccccctaacagaggagaagggggatggcaagtcataacctggcggcagcgcaaaagatg

SEQ ID NO: 124458 - DNA, 103 bp, Artificial Sequence
  Synthetic Polynucleotide
taatacgactcactatagggaattccatctgtaactattgtgatgacttgaacagaggagacaagtcatgacaatagttaacctggcggcagcgcaaaagatg

SEQ ID NO: 124459 - DNA, 103 bp, Artificial Sequence
  Synthetic Polynucleotide
taatacgactcactatagggttccaagctgaattccatctgtaactattgaacagaggagacaatagatgcagatggaaaacctggcggcagcgcaaaagatg

SEQ ID NO: 124460 - DNA, 103 bp, Artificial Sequence
  Synthetic Polynucleotide
taatacgactcactataggggagtgcaaatttccaagctgaattccatctaacagaggagaagatggatgtcagcttggaacctggcggcagcgcaaaagatg

SEQ ID NO: 124461 - DNA, 103 bp, Artificial Sequence
  Synthetic Polynucleotide
taatacgactcactatagggggttggaatagagtgcaaatttccaagctgaacagaggagacagcttatgaatttgcacaacctggcggcagcgcaaaagatg

SEQ ID NO: 124462 - DNA, 103 bp, Artificial Sequence
  Synthetic Polynucleotide
taatacgactcactatagggcaattccactggttggaatagagtgcaaataacagaggagaatttgcatgctattccaaaacctggcggcagcgcaaaagatg

SEQ ID NO: 124463 - DNA, 103 bp, Artificial Sequence
  Synthetic Polynucleotide
taatacgactcactatagggatgggctgaccaattccactggttggaataaacagaggagatattccatgcagtggaataacctggcggcagcgcaaaagatg

SEQ ID NO: 124464 - DNA, 103 bp, Artificial Sequence
  Synthetic Polynucleotide
taatacgactcactatagggggtcacaatgatgggctgaccaattccactaacagaggagaagtggaatgggtcagcccaacctggcggcagcgcaaaagatg

SEQ ID NO: 124465 - DNA, 103 bp, Artificial Sequence
  Synthetic Polynucleotide
taatacgactcactatagggcatctggcatggtcacaatgatgggctgacaacagaggagagtcagcatgtcattgtgaaacctggcggcagcgcaaaagatg

SEQ ID NO: 124466 - DNA, 103 bp, Artificial Sequence
  Synthetic Polynucleotide
taatacgactcactatagggagccagtctgtagtaaagggagctccatttaacagaggagaaaatggatgtccctttacaacctggcggcagcgcaaaagatg

SEQ ID NO: 124467 - DNA, 103 bp, Artificial Sequence
  Synthetic Polynucleotide
taatacgactcactatagggacttgttgtccatctggcatggtcacaatgaacagaggagacattgtatgcatgccagaaacctggcggcagcgcaaaagatg

SEQ ID NO: 124468 - DNA, 103 bp, Artificial Sequence
  Synthetic Polynucleotide
taatacgactcactatagggtactgttaatacttgttgtccatctggcataacagaggagaatgccaatgggacaacaaaacctggcggcagcgcaaaagatg

SEQ ID NO: 124469 - DNA, 103 bp, Artificial Sequence
  Synthetic Polynucleotide
taatacgactcactatagggctgttgctggtactgttaatacttgttgtcaacagaggagagacaacatgtattaacagaacctggcggcagcgcaaaagatg

SEQ ID NO: 124470 - DNA, 103 bp, Artificial Sequence
  Synthetic Polynucleotide
taatacgactcactatagggtcagcaatgtctgttgctggtactgttaataacagaggagaattaacatgaccagcaacaacctggcggcagcgcaaaagatg

SEQ ID NO: 124471 - DNA, 103 bp, Artificial Sequence
  Synthetic Polynucleotide
taatacgactcactatagggaacagtttcttcagcaatgtctgttgctggaacagaggagaccagcaatggacattgctaacctggcggcagcgcaaaagatg

SEQ ID NO: 124472 - DNA, 103 bp, Artificial Sequence
  Synthetic Polynucleotide
taatacgactcactatagggcttcacttataacagtttcttcagcaatgtaacagaggagaacattgatgaagaaactgaacctggcggcagcgcaaaagatg

SEQ ID NO: 124473 - DNA, 103 bp, Artificial Sequence
  Synthetic Polynucleotide
taatacgactcactataggggctggtggttcttcacttataacagtttctaacagaggagaagaaacatgtataagtgaaacctggcggcagcgcaaaagatg

SEQ ID NO: 124474 - DNA, 103 bp, Artificial Sequence
  Synthetic Polynucleotide
taatacgactcactatagggttgtctcttagctggtggttcttcacttataacagaggagaataagtatggaaccaccaaacctggcggcagcgcaaaagatg

SEQ ID NO: 124475 - DNA, 103 bp, Artificial Sequence
  Synthetic Polynucleotide
taatacgactcactatagggtttcgatacattgtctcttagctggtggttaacagaggagaaaccacatgctaagagacaacctggcggcagcgcaaaagatg

SEQ ID NO: 124476 - DNA, 103 bp, Artificial Sequence
  Synthetic Polynucleotide
taatacgactcactatagggttttcaattatttcgatacattgtctcttaaacagaggagataagagatgatgtatcgaaacctggcggcagcgcaaaagatg

SEQ ID NO: 124477 - DNA, 103 bp, Artificial Sequence
  Synthetic Polynucleotide
taatacgactcactatagggcaacctctttcccaagtccaccaaagacataacagaggagaatgtctatggtggacttgaacctggcggcagcgcaaaagatg

SEQ ID NO: 124478 - DNA, 103 bp, Artificial Sequence
  Synthetic Polynucleotide
taatacgactcactatagggtgatgttccaagccagtctgtggtgaatggaacagaggagaccattcatgacagactggaacctggcggcagcgcaaaagatg

SEQ ID NO: 124479 - DNA, 103 bp, Artificial Sequence
  Synthetic Polynucleotide
taatacgactcactatagggctctcctatccttggtttctttgttagtggaacagaggagaccactaatgaagaaaccaaacctggcggcagcgcaaaagatg

SEQ ID NO: 124480 - DNA, 103 bp, Artificial Sequence
  Synthetic Polynucleotide
taatacgactcactatagggtgtttgtcttctctcctatccttggtttctaacagaggagaagaaacatgggataggagaacctggcggcagcgcaaaagatg

SEQ ID NO: 124481 - DNA, 103 bp, Artificial Sequence
  Synthetic Polynucleotide
taatacgactcactatagggtcctccacactgtttgtcttctctcctatcaacagaggagagataggatggaagacaaaaacctggcggcagcgcaaaagatg

SEQ ID NO: 124482 - DNA, 103 bp, Artificial Sequence
  Synthetic Polynucleotide
taatacgactcactatagggttccttgctttcctccacactgtttgtcttaacagaggagaaagacaatgagtgtggagaacctggcggcagcgcaaaagatg

SEQ ID NO: 124483 - DNA, 103 bp, Artificial Sequence
  Synthetic Polynucleotide
taatacgactcactatagggtttcattgccttccttgctttcctccacacaacagaggagagtgtggatgaaagcaaggaacctggcggcagcgcaaaagatg

SEQ ID NO: 124484 - DNA, 103 bp, Artificial Sequence
  Synthetic Polynucleotide
taatacgactcactatagggagtagctctctttcattgccttccttgcttaacagaggagaaagcaaatgaggcaatgaaacctggcggcagcgcaaaagatg

SEQ ID NO: 124485 - DNA, 103 bp, Artificial Sequence
  Synthetic Polynucleotide
taatacgactcactatagggttgttgctgtagtagctctctttcattgccaacagaggagaggcaatatgagagagctaaacctggcggcagcgcaaaagatg

SEQ ID NO: 124486 - DNA, 103 bp, Artificial Sequence
  Synthetic Polynucleotide
taatacgactcactatagggcctcctggagttgttgctgtagtagctctcaacagaggagagagagcatgtacagcaacaacctggcggcagcgcaaaagatg

SEQ ID NO: 124487 - DNA, 103 bp, Artificial Sequence
  Synthetic Polynucleotide
taatacgactcactatagggcttcgattggcctcctggagttgttgctgtaacagaggagaacagcaatgactccaggaaacctggcggcagcgcaaaagatg

SEQ ID NO: 124488 - DNA, 103 bp, Artificial Sequence
  Synthetic Polynucleotide
taatacgactcactatagggttcctgggctcttcgattggcctcctggagaacagaggagactccagatggccaatcgaaacctggcggcagcgcaaaagatg

SEQ ID NO: 124489 - DNA, 103 bp, Artificial Sequence
  Synthetic Polynucleotide
taatacgactcactatagggggtggaggggtgatgttccaagccagtctgaacagaggagacagactatgttggaacataacctggcggcagcgcaaaagatg

SEQ ID NO: 124490 - DNA, 103 bp, Artificial Sequence
  Synthetic Polynucleotide
taatacgactcactatagggggtgtcggtattcctgggctcttcgattggaacagaggagaccaatcatggagcccaggaacctggcggcagcgcaaaagatg

SEQ ID NO: 124491 - DNA, 103 bp, Artificial Sequence
  Synthetic Polynucleotide
taatacgactcactatagggtttaggagctggtgtcggtattcctgggctaacagaggagaagcccaatgataccgacaaacctggcggcagcgcaaaagatg

SEQ ID NO: 124492 - DNA, 103 bp, Artificial Sequence
  Synthetic Polynucleotide
taatacgactcactatagggctgctctttctttaggagctggtgtcggtaaacagaggagataccgaatgcagctcctaaacctggcggcagcgcaaaagatg

SEQ ID NO: 124493 - DNA, 103 bp, Artificial Sequence
  Synthetic Polynucleotide
taatacgactcactataggggttctgcttcctgctctttctttaggagctaacagaggagaagctccatgagaaagagcaacctggcggcagcgcaaaagatg

SEQ ID NO: 124494 - DNA, 103 bp, Artificial Sequence
  Synthetic Polynucleotide
taatacgactcactatagggagacggtactgttctgcttcctgctctttcaacagaggagagaaagaatgggaagcagaaacctggcggcagcgcaaaagatg

SEQ ID NO: 124495 - DNA, 103 bp, Artificial Sequence
  Synthetic Polynucleotide
taatacgactcactatagggctccagcttaagacggtactgttctgcttcaacagaggagagaagcaatgcagtaccgtaacctggcggcagcgcaaaagatg

SEQ ID NO: 124496 - DNA, 103 bp, Artificial Sequence
  Synthetic Polynucleotide
taatacgactcactataggggggctatggcctccagcttaagacggtactaacagaggagaagtaccatgttaagctggaacctggcggcagcgcaaaagatg

SEQ ID NO: 124497 - DNA, 103 bp, Artificial Sequence
  Synthetic Polynucleotide
taatacgactcactatagggggctgctgtcgggctatggcctccagcttaaacagaggagataagctatgggccatagcaacctggcggcagcgcaaaagatg

SEQ ID NO: 124498 - DNA, 103 bp, Artificial Sequence
  Synthetic Polynucleotide
taatacgactcactatagggaactccattgggctgctgtcgggctatggcaacagaggagagccataatgcgacagcagaacctggcggcagcgcaaaagatg

SEQ ID NO: 124499 - DNA, 103 bp, Artificial Sequence
  Synthetic Polynucleotide
taatacgactcactatagggtggtgaaatcaactccattgggctgctgtcaacagaggagagacagcatgccaatggagaacctggcggcagcgcaaaagatg

SEQ ID NO: 124500 - DNA, 103 bp, Artificial Sequence
  Synthetic Polynucleotide
taatacgactcactatagggtgagctgcaaggtggaggggtgatgttccaaacagaggagatggaacatgacccctccaaacctggcggcagcgcaaaagatg

SEQ ID NO: 124501 - DNA, 103 bp, Artificial Sequence
  Synthetic Polynucleotide
taatacgactcactatagggtcttcaaccatggtgaaatcaactccattgaacagaggagacaatggatgtgatttcacaacctggcggcagcgcaaaagatg

SEQ ID NO: 124502 - DNA, 103 bp, Artificial Sequence
  Synthetic Polynucleotide
taatacgactcactatagggctcagccacctcttcaaccatggtgaaatcaacagaggagagatttcatgatggttgaaaacctggcggcagcgcaaaagatg

SEQ ID NO: 124503 - DNA, 103 bp, Artificial Sequence
  Synthetic Polynucleotide
taatacgactcactatagggcagcatctacctcagccacctcttcaaccaaacagaggagatggttgatgaggtggctgaacctggcggcagcgcaaaagatg

SEQ ID NO: 124504 - DNA, 103 bp, Artificial Sequence
  Synthetic Polynucleotide
taatacgactcactataggggtgactactacagcatctacctcagccaccaacagaggagaggtggcatgggtagatgcaacctggcggcagcgcaaaagatg

SEQ ID NO: 124505 - DNA, 103 bp, Artificial Sequence
  Synthetic Polynucleotide
taatacgactcactatagggctccccctctgtgactactacagcatctacaacagaggagagtagatatggtagtagtcaacctggcggcagcgcaaaagatg

SEQ ID NO: 124506 - DNA, 103 bp, Artificial Sequence
  Synthetic Polynucleotide
taatacgactcactatagggtctcttccaactccccctctgtgactactaaacagaggagatagtagatgcagagggggaacctggcggcagcgcaaaagatg

SEQ ID NO: 124507 - DNA, 103 bp, Artificial Sequence
  Synthetic Polynucleotide
taatacgactcactatagggtttgtctctctctcttccaactccccctctaacagaggagaagagggatggttggaagaaacctggcggcagcgcaaaagatg

SEQ ID NO: 124508 - DNA, 103 bp, Artificial Sequence
  Synthetic Polynucleotide
taatacgactcactatagggcccagtcacttttgtctctctctcttccaaaacagaggagattggaaatgagagagacaaacctggcggcagcgcaaaagatg

SEQ ID NO: 124509 - DNA, 103 bp, Artificial Sequence
  Synthetic Polynucleotide
taatacgactcactatagggtccctgctgacccagtcacttttgtctctcaacagaggagagagagaatgaagtgactgaacctggcggcagcgcaaaagatg

SEQ ID NO: 124510 - DNA, 103 bp, Artificial Sequence
  Synthetic Polynucleotide
taatacgactcactatagggggctctgtggtccctgctgacccagtcactaacagaggagaagtgacatggtcagcaggaacctggcggcagcgcaaaagatg

SEQ ID NO: 124511 - DNA, 103 bp, Artificial Sequence
  Synthetic Polynucleotide
taatacgactcactatagggatgaccatattgagctgcaaggtggaggggaacagaggagacccctcatgcttgcagctaacctggcggcagcgcaaaagatg

SEQ ID NO: 124512 - DNA, 103 bp, Artificial Sequence
  Synthetic Polynucleotide
taatacgactcactatagggtctagtgtgaggctctgtggtccctgctgaaacagaggagatcagcaatgaccacagagaacctggcggcagcgcaaaagatg

SEQ ID NO: 124513 - DNA, 103 bp, Artificial Sequence
  Synthetic Polynucleotide
taatacgactcactatagggccatggaaactctagtgtgaggctctgtggaacagaggagaccacagatgctcacactaaacctggcggcagcgcaaaagatg

SEQ ID NO: 124514 - DNA, 103 bp, Artificial Sequence
  Synthetic Polynucleotide
taatacgactcactataggggaaacagttgccatggaaactctagtgtgaaacagaggagatcacacatgagtttccataacctggcggcagcgcaaaagatg

SEQ ID NO: 124515 - DNA, 103 bp, Artificial Sequence
  Synthetic Polynucleotide
taatacgactcactatagggctgtggaataatgaccatattgagctgcaaaacagaggagattgcagatgaatatggtcaacctggcggcagcgcaaaagatg

SEQ ID NO: 124516 - DNA, 103 bp, Artificial Sequence
  Synthetic Polynucleotide
taatacgactcactatagggagtacttctgctgtggaataatgaccatataacagaggagaatatggatgttattccacaacctggcggcagcgcaaaagatg

SEQ ID NO: 124517 - DNA, 103 bp, Artificial Sequence
  Synthetic Polynucleotide
taatacgactcactatagggtgctcgaaggagtacttctgctgtggaataaacagaggagatattccatggcagaagtaaacctggcggcagcgcaaaagatg

SEQ ID NO: 124518 - DNA, 103 bp, Artificial Sequence
  Synthetic Polynucleotide
taatacgactcactatagggtgctaacacctgctcgaaggagtacttctgaacagaggagacagaagatgtccttcgagaacctggcggcagcgcaaaagatg

SEQ ID NO: 124519 - DNA, 103 bp, Artificial Sequence
  Synthetic Polynucleotide
taatacgactcactatagggcgggcatccctgctaacacctgctcgaaggaacagaggagaccttcgatgaggtgttagaacctggcggcagcgcaaaagatg

SEQ ID NO: 124520 - DNA, 103 bp, Artificial Sequence
  Synthetic Polynucleotide
taatacgactcactatagggtactttagtccgggcatccctgctaacaccaacagaggagaggtgttatgagggatgccaacctggcggcagcgcaaaagatg

SEQ ID NO: 124521 - DNA, 103 bp, Artificial Sequence
  Synthetic Polynucleotide
taatacgactcactatagggctgcttctagcaacctctttcccaagtccaaacagaggagatggactatggaaagaggtaacctggcggcagcgcaaaagatg

SEQ ID NO: 124522 - DNA, 103 bp, Artificial Sequence
  Synthetic Polynucleotide
taatacgactcactataggggggtcctgtctactttagtccgggcatcccaacagaggagagggatgatgggactaaagaacctggcggcagcgcaaaagatg

SEQ ID NO: 124523 - DNA, 103 bp, Artificial Sequence
  Synthetic Polynucleotide
taatacgactcactatagggatgtgcaagggggtcctgtctactttagtcaacagaggagagactaaatgagacaggacaacctggcggcagcgcaaaagatg

SEQ ID NO: 124524 - DNA, 103 bp, Artificial Sequence
  Synthetic Polynucleotide
taatacgactcactatagggggctgcagccatgtgcaagggggtcctgtcaacagaggagagacaggatgcccttgcacaacctggcggcagcgcaaaagatg

SEQ ID NO: 124525 - DNA, 103 bp, Artificial Sequence
  Synthetic Polynucleotide
taatacgactcactatagggcatgtccatcggctgcagccatgtgcaaggaacagaggagaccttgcatgtggctgcagaacctggcggcagcgcaaaagatg

SEQ ID NO: 124526 - DNA, 103 bp, Artificial Sequence
  Synthetic Polynucleotide
taatacgactcactatagggacgatgtgcgcatgtccatcggctgcagccaacagaggagaggctgcatgcgatggacaaacctggcggcagcgcaaaagatg

SEQ ID NO: 124527 - DNA, 103 bp, Artificial Sequence
  Synthetic Polynucleotide
taatacgactcactatagggaagcagttccacgatgtgcgcatgtccatcaacagaggagagatggaatggcgcacatcaacctggcggcagcgcaaaagatg

SEQ ID NO: 124528 - DNA, 103 bp, Artificial Sequence
  Synthetic Polynucleotide
taatacgactcactatagggcattccgaacaagcagttccacgatgtgcgaacagaggagacgcacaatgtggaactgcaacctggcggcagcgcaaaagatg

SEQ ID NO: 124529 - DNA, 103 bp, Artificial Sequence
  Synthetic Polynucleotide
taatacgactcactatagggacatctgcaccattccgaacaagcagttccaacagaggagaggaactatgtgttcggaaaacctggcggcagcgcaaaagatg

SEQ ID NO: 124530 - DNA, 103 bp, Artificial Sequence
  Synthetic Polynucleotide
taatacgactcactatagggcttggcattcacatctgcaccattccgaacaacagaggagagttcggatgggtgcagataacctggcggcagcgcaaaagatg

SEQ ID NO: 124531 - DNA, 103 bp, Artificial Sequence
  Synthetic Polynucleotide
taatacgactcactatagggtcagcatgtccttggcattcacatctgcacaacagaggagagtgcagatgtgaatgccaaacctggcggcagcgcaaaagatg

SEQ ID NO: 124532 - DNA, 103 bp, Artificial Sequence
  Synthetic Polynucleotide
taatacgactcactatagggccttttcttgctgcttctagcaacctctttaacagaggagaaaagagatggctagaagcaacctggcggcagcgcaaaagatg

SEQ ID NO: 124533 - DNA, 103 bp, Artificial Sequence
  Synthetic Polynucleotide
taatacgactcactataggggctgtcatcttcagcatgtccttggcattcaacagaggagagaatgcatgggacatgctaacctggcggcagcgcaaaagatg

SEQ ID NO: 124534 - DNA, 103 bp, Artificial Sequence
  Synthetic Polynucleotide
taatacgactcactatagggccaatgcaaagctgtcatcttcagcatgtcaacagaggagagacatgatgaagatgacaaacctggcggcagcgcaaaagatg

SEQ ID NO: 124535 - DNA, 103 bp, Artificial Sequence
  Synthetic Polynucleotide
taatacgactcactataggggctctgtggcccaatgcaaagctgtcatctaacagaggagaagatgaatgctttgcattaacctggcggcagcgcaaaagatg

SEQ ID NO: 124536 - DNA, 103 bp, Artificial Sequence
  Synthetic Polynucleotide
taatacgactcactatagggcgatggtggcgctctgtggcccaatgcaaaaacagaggagatttgcaatgggccacagaaacctggcggcagcgcaaaagatg

SEQ ID NO: 124537 - DNA, 103 bp, Artificial Sequence
  Synthetic Polynucleotide
taatacgactcactatagggtacgacatctcgatggtggcgctctgtggcaacagaggagagccacaatgcgccaccataacctggcggcagcgcaaaagatg

SEQ ID NO: 124538 - DNA, 103 bp, Artificial Sequence
  Synthetic Polynucleotide
taatacgactcactatagggtaagtaactctacgacatctcgatggtggcaacagaggagagccaccatggagatgtcgaacctggcggcagcgcaaaagatg

SEQ ID NO: 124539 - DNA, 103 bp, Artificial Sequence
  Synthetic Polynucleotide
taatacgactcactatagggccatatttgataagtaactctacgacatctaacagaggagaagatgtatgagagttactaacctggcggcagcgcaaaagatg

SEQ ID NO: 124540 - DNA, 103 bp, Artificial Sequence
  Synthetic Polynucleotide
taatacgactcactataggggacatcagctccatatttgataagtaactcaacagaggagagagttaatgatcaaatataacctggcggcagcgcaaaagatg

SEQ ID NO: 124541 - DNA, 103 bp, Artificial Sequence
  Synthetic Polynucleotide
taatacgactcactatagggtgaaagcatggacatcagctccatatttgaaacagaggagatcaaatatggagctgatgaacctggcggcagcgcaaaagatg

SEQ ID NO: 124542 - DNA, 103 bp, Artificial Sequence
  Synthetic Polynucleotide
taatacgactcactatagggtcaaatttgctgaaagcatggacatcagctaacagaggagaagctgaatgccatgctttaacctggcggcagcgcaaaagatg

SEQ ID NO: 124543 - DNA, 103 bp, Artificial Sequence
  Synthetic Polynucleotide
taatacgactcactatagggatcatcttggccttttcttgctgcttctagaacagaggagactagaaatggcaagaaaaaacctggcggcagcgcaaaagatg

SEQ ID NO: 124544 - DNA, 103 bp, Artificial Sequence
  Synthetic Polynucleotide
taatacgactcactatagggggctgatttatcaaatttgctgaaagcatgaacagaggagacatgctatgagcaaatttaacctggcggcagcgcaaaagatg

SEQ ID NO: 124545 - DNA, 103 bp, Artificial Sequence
  Synthetic Polynucleotide
taatacgactcactatagggctatgtcaaaggctgatttatcaaatttgcaacagaggagagcaaatatgataaatcagaacctggcggcagcgcaaaagatg

SEQ ID NO: 124546 - DNA, 103 bp, Artificial Sequence
  Synthetic Polynucleotide
taatacgactcactatagggttctccagagctatgtcaaaggctgatttaaacagaggagataaatcatgctttgacataacctggcggcagcgcaaaagatg

SEQ ID NO: 124547 - DNA, 103 bp, Artificial Sequence
  Synthetic Polynucleotide
taatacgactcactatagggagcattgtttttctccagagctatgtcaaaaacagaggagatttgacatggctctggagaacctggcggcagcgcaaaagatg

SEQ ID NO: 124548 - DNA, 103 bp, Artificial Sequence
  Synthetic Polynucleotide
taatacgactcactatagggccaaaatctcagcattgtttttctccagagaacagaggagactctggatgaaaacaatgaacctggcggcagcgcaaaagatg

SEQ ID NO: 124549 - DNA, 103 bp, Artificial Sequence
  Synthetic Polynucleotide
taatacgactcactatagggtggaggatgaccaaaatctcagcattgtttaacagaggagaaaacaaatgtgagattttaacctggcggcagcgcaaaagatg

SEQ ID NO: 124550 - DNA, 103 bp, Artificial Sequence
  Synthetic Polynucleotide
taatacgactcactatagggcattgcttcctggaggatgaccaaaatctcaacagaggagagagattatggtcatcctcaacctggcggcagcgcaaaagatg

SEQ ID NO: 124551 - DNA, 103 bp, Artificial Sequence
  Synthetic Polynucleotide
taatacgactcactatagggcctgattctgcattgcttcctggaggatgaaacagaggagatcatccatgaggaagcaaaacctggcggcagcgcaaaagatg

SEQ ID NO: 124552 - DNA, 103 bp, Artificial Sequence
  Synthetic Polynucleotide
taatacgactcactatagggttaacattcacctgattctgcattgcttccaacagaggagaggaagcatggcagaatcaaacctggcggcagcgcaaaagatg

SEQ ID NO: 124553 - DNA, 103 bp, Artificial Sequence
  Synthetic Polynucleotide
taatacgactcactatagggtctctctggattaacattcacctgattctgaacagaggagacagaatatggtgaatgttaacctggcggcagcgcaaaagatg

SEQ ID NO: 124554 - DNA, 103 bp, Artificial Sequence
  Synthetic Polynucleotide
taatacgactcactatagggttctcacttcatcatcttggccttttcttgaacagaggagacaagaaatggccaagatgaacctggcggcagcgcaaaagatg

SEQ ID NO: 124555 - DNA, 103 bp, Artificial Sequence
  Synthetic Polynucleotide
taatacgactcactatagggcagggttggctctctctggattaacattcaaacagaggagatgaatgatgatccagagaaacctggcggcagcgcaaaagatg

SEQ ID NO: 124556 - DNA, 103 bp, Artificial Sequence
  Synthetic Polynucleotide
taatacgactcactataggggggtcagtcacagggttggctctctctggaaacagaggagatccagaatgagccaacccaacctggcggcagcgcaaaagatg

SEQ ID NO: 124557 - DNA, 103 bp, Artificial Sequence
  Synthetic Polynucleotide
taatacgactcactatagggcatactcacagggtcagtcacagggttggcaacagaggagagccaacatggtgactgacaacctggcggcagcgcaaaagatg

SEQ ID NO: 124558 - DNA, 103 bp, Artificial Sequence
  Synthetic Polynucleotide
taatacgactcactatagggatggagcagccatactcacagggtcagtcaaacagaggagatgactgatgctgtgagtaaacctggcggcagcgcaaaagatg

SEQ ID NO: 124559 - DNA, 103 bp, Artificial Sequence
  Synthetic Polynucleotide
taatacgactcactataggggtgaagatgaatggagcagccatactcacaaacagaggagatgtgagatgggctgctccaacctggcggcagcgcaaaagatg

SEQ ID NO: 124560 - DNA, 103 bp, Artificial Sequence
  Synthetic Polynucleotide
taatacgactcactatagggctcacccgacgtgaagatgaatggagcagcaacagaggagagctgctatgttcatcttcaacctggcggcagcgcaaaagatg

SEQ ID NO: 124561 - DNA, 103 bp, Artificial Sequence
  Synthetic Polynucleotide
taatacgactcactatagggggttaacaacctcacccgacgtgaagatgaaacagaggagatcatctatgcgtcgggtgaacctggcggcagcgcaaaagatg

SEQ ID NO: 124562 - DNA, 103 bp, Artificial Sequence
  Synthetic Polynucleotide
taatacgactcactatagggaggcttgcgaggttaacaacctcacccgacaacagaggagagtcgggatgggttgttaaaacctggcggcagcgcaaaagatg

SEQ ID NO: 124563 - DNA, 103 bp, Artificial Sequence
  Synthetic Polynucleotide
taatacgactcactatagggtgaagaaataaggcttgcgaggttaacaacaacagaggagagttgttatgctcgcaagcaacctggcggcagcgcaaaagatg

SEQ ID NO: 124564 - DNA, 103 bp, Artificial Sequence
  Synthetic Polynucleotide
taatacgactcactatagggtggtgttggttgaagaaataaggcttgcgaaacagaggagatcgcaaatgttatttcttaacctggcggcagcgcaaaagatg

SEQ ID NO: 124565 - DNA, 103 bp, Artificial Sequence
  Synthetic Polynucleotide
taatacgactcactataggggccatcaacgttctcacttcatcatcttggaacagaggagaccaagaatgtgaagtgagaacctggcggcagcgcaaaagatg

SEQ ID NO: 124566 - DNA, 103 bp, Artificial Sequence
  Synthetic Polynucleotide
taatacgactcactataggggaggttgttttggtgttggttgaagaaataaacagaggagatatttcatgaaccaacacaacctggcggcagcgcaaaagatg

SEQ ID NO: 124567 - DNA, 103 bp, Artificial Sequence
  Synthetic Polynucleotide
taatacgactcactatagggggggtcacctgaggttgttttggtgttggtaacagaggagaaccaacatgaaaacaaccaacctggcggcagcgcaaaagatg

SEQ ID NO: 124568 - DNA, 103 bp, Artificial Sequence
  Synthetic Polynucleotide
taatacgactcactatagggttgaggcatgggggtcacctgaggttgtttaacagaggagaaaacaaatgcaggtgaccaacctggcggcagcgcaaaagatg

SEQ ID NO: 124569 - DNA, 103 bp, Artificial Sequence
  Synthetic Polynucleotide
taatacgactcactatagggaactgtactgttgaggcatgggggtcacctaacagaggagaaggtgaatgccatgcctcaacctggcggcagcgcaaaagatg

SEQ ID NO: 124570 - DNA, 103 bp, Artificial Sequence
  Synthetic Polynucleotide
taatacgactcactatagggagaatttgaaaactgtactgttgaggcatgaacagaggagacatgccatgacagtacagaacctggcggcagcgcaaaagatg

SEQ ID NO: 124571 - DNA, 103 bp, Artificial Sequence
  Synthetic Polynucleotide
taatacgactcactatagggctgaggtggtagaatttgaaaactgtactgaacagaggagacagtacatgtttcaaattaacctggcggcagcgcaaaagatg

SEQ ID NO: 124572 - DNA, 103 bp, Artificial Sequence
  Synthetic Polynucleotide
taatacgactcactataggggtagccagcactgaggtggtagaatttgaaaacagaggagattcaaaatgtaccacctcaacctggcggcagcgcaaaagatg

SEQ ID NO: 124573 - DNA, 103 bp, Artificial Sequence
  Synthetic Polynucleotide
taatacgactcactatagggagctgcaagggtagccagcactgaggtggtaacagaggagaaccaccatggtgctggctaacctggcggcagcgcaaaagatg

SEQ ID NO: 124574 - DNA, 103 bp, Artificial Sequence
  Synthetic Polynucleotide
taatacgactcactatagggcctcagcaagagctgcaagggtagccagcaaacagaggagatgctggatgcccttgcagaacctggcggcagcgcaaaagatg

SEQ ID NO: 124575 - DNA, 103 bp, Artificial Sequence
  Synthetic Polynucleotide
taatacgactcactataggggggactgatgcctcagcaagagctgcaaggaacagaggagaccttgcatgtcttgctgaaacctggcggcagcgcaaaagatg

SEQ ID NO: 124576 - DNA, 103 bp, Artificial Sequence
  Synthetic Polynucleotide
taatacgactcactatagggggcgccatttgccatcaacgttctcacttcaacagaggagagaagtgatgacgttgatgaacctggcggcagcgcaaaagatg

SEQ ID NO: 124577 - DNA, 103 bp, Artificial Sequence
  Synthetic Polynucleotide
taatacgactcactataggggttggagagggggactgatgcctcagcaagaacagaggagacttgctatggcatcagtcaacctggcggcagcgcaaaagatg

SEQ ID NO: 124578 - DNA, 103 bp, Artificial Sequence
  Synthetic Polynucleotide
taatacgactcactatagggctctgtgtgagttggagagggggactgatgaacagaggagacatcagatgccctctccaaacctggcggcagcgcaaaagatg

SEQ ID NO: 124579 - DNA, 103 bp, Artificial Sequence
  Synthetic Polynucleotide
taatacgactcactatagggttggctgtggctctgtgtgagttggagaggaacagaggagacctctcatgctcacacagaacctggcggcagcgcaaaagatg

SEQ ID NO: 124580 - DNA, 103 bp, Artificial Sequence
  Synthetic Polynucleotide
taatacgactcactatagggttcctctgtattggctgtggctctgtgtgaaacagaggagatcacacatggccacagccaacctggcggcagcgcaaaagatg

SEQ ID NO: 124581 - DNA, 103 bp, Artificial Sequence
  Synthetic Polynucleotide
taatacgactcactatagggcttctataatttcctctgtattggctgtggaacagaggagaccacagatgatacagaggaacctggcggcagcgcaaaagatg

SEQ ID NO: 124582 - DNA, 103 bp, Artificial Sequence
  Synthetic Polynucleotide
taatacgactcactatagggacggaatttccttctataatttcctctgtaaacagaggagatacagaatgaattatagaaacctggcggcagcgcaaaagatg

SEQ ID NO: 124583 - DNA, 103 bp, Artificial Sequence
  Synthetic Polynucleotide
taatacgactcactatagggtgatgagtcaacggaatttccttctataataacagaggagaattataatgggaaattccaacctggcggcagcgcaaaagatg

SEQ ID NO: 124584 - DNA, 103 bp, Artificial Sequence
  Synthetic Polynucleotide
taatacgactcactatagggcttgctggattgatgagtcaacggaatttcaacagaggagagaaattatgttgactcataacctggcggcagcgcaaaagatg

SEQ ID NO: 124585 - DNA, 103 bp, Artificial Sequence
  Synthetic Polynucleotide
taatacgactcactatagggctccccattacttgctggattgatgagtcaaacagaggagatgactcatgaatccagcaaacctggcggcagcgcaaaagatg

SEQ ID NO: 124586 - DNA, 103 bp, Artificial Sequence
  Synthetic Polynucleotide
taatacgactcactatagggctggcctccactccccattacttgctggataacagaggagaatccagatggtaatggggaacctggcggcagcgcaaaagatg

SEQ ID NO: 124587 - DNA, 103 bp, Artificial Sequence
  Synthetic Polynucleotide
taatacgactcactatagggtggtgaatggggcgccatttgccatcaacgaacagaggagacgttgaatgcaaatggcgaacctggcggcagcgcaaaagatg

SEQ ID NO: 124588 - DNA, 103 bp, Artificial Sequence
  Synthetic Polynucleotide
taatacgactcactatagggtgatgaccctctggcctccactccccattaaacagaggagataatggatggtggaggccaacctggcggcagcgcaaaagatg

SEQ ID NO: 124589 - DNA, 103 bp, Artificial Sequence
  Synthetic Polynucleotide
taatacgactcactataggggtcactatggtgatgaccctctggcctccaaacagaggagatggaggatggagggtcataacctggcggcagcgcaaaagatg

SEQ ID NO: 124590 - DNA, 103 bp, Artificial Sequence
  Synthetic Polynucleotide
taatacgactcactataggggactccatcagtcactatggtgatgaccctaacagaggagaagggtcatgaccatagtgaacctggcggcagcgcaaaagatg

SEQ ID NO: 124591 - DNA, 103 bp, Artificial Sequence
  Synthetic Polynucleotide
taatacgactcactatagggtacccagagggactccatcagtcactatggaacagaggagaccatagatgctgatggagaacctggcggcagcgcaaaagatg

SEQ ID NO: 124592 - DNA, 103 bp, Artificial Sequence
  Synthetic Polynucleotide
taatacgactcactataggggtttggatattacccagagggactccatcaaacagaggagatgatggatgccctctgggaacctggcggcagcgcaaaagatg

SEQ ID NO: 124593 - DNA, 103 bp, Artificial Sequence
  Synthetic Polynucleotide
taatacgactcactatagggagggattgaagtttggatattacccagaggaacagaggagacctctgatgaatatccaaaacctggcggcagcgcaaaagatg

SEQ ID NO: 124594 - DNA, 103 bp, Artificial Sequence
  Synthetic Polynucleotide
taatacgactcactatagggtgcctccagtagggattgaagtttggatataacagaggagaatatccatgcttcaatccaacctggcggcagcgcaaaagatg

SEQ ID NO: 124595 - DNA, 103 bp, Artificial Sequence
  Synthetic Polynucleotide
taatacgactcactatagggggctggccaatgcctccagtagggattgaaaacagaggagattcaatatgtactggaggaacctggcggcagcgcaaaagatg

SEQ ID NO: 124596 - DNA, 103 bp, Artificial Sequence
  Synthetic Polynucleotide
taatacgactcactatagggtacaataaatggctggccaatgcctccagtaacagaggagaactggaatgattggccagaacctggcggcagcgcaaaagatg

SEQ ID NO: 124597 - DNA, 103 bp, Artificial Sequence
  Synthetic Polynucleotide
taatacgactcactatagggcttgcacagttacaataaatggctggccaaaacagaggagattggccatgcatttattgaacctggcggcagcgcaaaagatg

SEQ ID NO: 124598 - DNA, 103 bp, Artificial Sequence
  Synthetic Polynucleotide
taatacgactcactatagggagccagtctgtggtgaatggggcgccatttaacagaggagaaaatggatgcccattcacaacctggcggcagcgcaaaagatg

SEQ ID NO: 124599 - DNA, 103 bp, Artificial Sequence
  Synthetic Polynucleotide
taatacgactcactatagggtgctgtccatcttgcacagttacaataaataacagaggagaatttatatgaactgtgcaaacctggcggcagcgcaaaagatg

SEQ ID NO: 124600 - DNA, 103 bp, Artificial Sequence
  Synthetic Polynucleotide
taatacgactcactatagggagttagaacttgctgtccatcttgcacagtaacagaggagaactgtgatggatggacagaacctggcggcagcgcaaaagatg

SEQ ID NO: 124601 - DNA, 103 bp, Artificial Sequence
  Synthetic Polynucleotide
taatacgactcactatagggcagcaggtacagttagaacttgctgtccataacagaggagaatggacatgaagttctaaaacctggcggcagcgcaaaagatg

SEQ ID NO: 124602 - DNA, 103 bp, Artificial Sequence
  Synthetic Polynucleotide
taatacgactcactataggggcaaccttaccagcaggtacagttagaactaacagaggagaagttctatgtgtacctgcaacctggcggcagcgcaaaagatg

SEQ ID NO: 124603 - DNA, 103 bp, Artificial Sequence
  Synthetic Polynucleotide
taatacgactcactatagggagtctcctctgcaaccttaccagcaggtacaacagaggagagtacctatgggtaaggttaacctggcggcagcgcaaaagatg

SEQ ID NO: 124604 - DNA, 103 bp, Artificial Sequence
  Synthetic Polynucleotide
taatacgactcactatagggctttaattacagtctcctctgcaaccttacaacagaggagagtaaggatgcagaggagaaacctggcggcagcgcaaaagatg

SEQ ID NO: 124605 - DNA, 103 bp, Artificial Sequence
  Synthetic Polynucleotide
taatacgactcactatagggtcttcttcctctttaattacagtctcctctaacagaggagaagaggaatgtgtaattaaaacctggcggcagcgcaaaagatg

SEQ ID NO: 124606 - DNA, 103 bp, Artificial Sequence
  Synthetic Polynucleotide
taatacgactcactatagggcaacttctcttcttcttcctctttaattacaacagaggagagtaattatggaggaagaaaacctggcggcagcgcaaaagatg

SEQ ID NO: 124607 - DNA, 103 bp, Artificial Sequence
  Synthetic Polynucleotide
taatacgactcactatagggttgttagtggcaacttctcttcttcttcctaacagaggagaaggaagatgaagagaagtaacctggcggcagcgcaaaagatg

SEQ ID NO: 124608 - DNA, 103 bp, Artificial Sequence
  Synthetic Polynucleotide
taatacgactcactatagggcttggtttctttgttagtggcaacttctctaacagaggagaagagaaatggccactaacaacctggcggcagcgcaaaagatg

SEQ ID NO: 124609 - DNA, 103 bp, Artificial Sequence
  Synthetic Polynucleotide
taatacgactcactatagggctctccagccgagaattcctccaaagtcataacagaggagaatgactatggaggaattcaacctggcggcagcgcaaaagatg

SEQ ID NO: 124610 - DNA, 103 bp, Artificial Sequence
  Synthetic Polynucleotide
taatacgactcactatagggcaccccgacagtgatcgtgcgctgactcagaacagaggagactgagtatgcgcacgatcaacctggcggcagcgcaaaagatg

SEQ ID NO: 124611 - DNA, 103 bp, Artificial Sequence
  Synthetic Polynucleotide
taatacgactcactatagggccgcttcgtacaccccgacagtgatcgtgcaacagaggagagcacgaatgctgtcggggaacctggcggcagcgcaaaagatg

SEQ ID NO: 124612 - DNA, 103 bp, Artificial Sequence
  Synthetic Polynucleotide
taatacgactcactatagggagcagcttggccgcttcgtacaccccgacaaacagaggagatgtcggatggtacgaagcaacctggcggcagcgcaaaagatg

SEQ ID NO: 124613 - DNA, 103 bp, Artificial Sequence
  Synthetic Polynucleotide
taatacgactcactataggggtcgacgttgagcagcttggccgcttcgtaaacagaggagatacgaaatggccaagctgaacctggcggcagcgcaaaagatg

SEQ ID NO: 124614 - DNA, 103 bp, Artificial Sequence
  Synthetic Polynucleotide
taatacgactcactatagggcgttatcggggtcgacgttgagcagcttggaacagaggagaccaagcatgtcaacgtcgaacctggcggcagcgcaaaagatg

SEQ ID NO: 124615 - DNA, 103 bp, Artificial Sequence
  Synthetic Polynucleotide
taatacgactcactatagggcacaacaccacgttatcggggtcgacgttgaacagaggagacaacgtatgccccgataaaacctggcggcagcgcaaaagatg

SEQ ID NO: 124616 - DNA, 103 bp, Artificial Sequence
  Synthetic Polynucleotide
taatacgactcactatagggcgccagcaggcacaacaccacgttatcgggaacagaggagacccgatatggtggtgttgaacctggcggcagcgcaaaagatg

SEQ ID NO: 124617 - DNA, 103 bp, Artificial Sequence
  Synthetic Polynucleotide
taatacgactcactatagggcctcgtccgccgccagcaggcacaacaccaaacagaggagatggtgtatggcctgctggaacctggcggcagcgcaaaagatg

SEQ ID NO: 124618 - DNA, 103 bp, Artificial Sequence
  Synthetic Polynucleotide
taatacgactcactatagggctgtcgtcgtcctcgtccgccgccagcaggaacagaggagacctgctatgggcggacgaaacctggcggcagcgcaaaagatg

SEQ ID NO: 124619 - DNA, 103 bp, Artificial Sequence
  Synthetic Polynucleotide
taatacgactcactatagggagccacatctctgtcgtcgtcctcgtccgcaacagaggagagcggacatggacgacgacaacctggcggcagcgcaaaagatg

SEQ ID NO: 124620 - DNA, 103 bp, Artificial Sequence
  Synthetic Polynucleotide
taatacgactcactatagggcggtcttctgctctccagccgagaattcctaacagaggagaaggaatatgcggctggagaacctggcggcagcgcaaaagatg

SEQ ID NO: 124621 - DNA, 103 bp, Artificial Sequence
  Synthetic Polynucleotide
taatacgactcactatagggggatctgcagagccacatctctgtcgtcgtaacagaggagaacgacgatggagatgtggaacctggcggcagcgcaaaagatg

SEQ ID NO: 124622 - DNA, 103 bp, Artificial Sequence
  Synthetic Polynucleotide
taatacgactcactatagggagggtgaagtggatctgcagagccacatctaacagaggagaagatgtatgtctgcagataacctggcggcagcgcaaaagatg

SEQ ID NO: 124623 - DNA, 103 bp, Artificial Sequence
  Synthetic Polynucleotide
taatacgactcactatagggcgcctggatcagggtgaagtggatctgcagaacagaggagactgcagatgcacttcaccaacctggcggcagcgcaaaagatg

SEQ ID NO: 124624 - DNA, 103 bp, Artificial Sequence
  Synthetic Polynucleotide
taatacgactcactatagggcgcagcaaaacgcctggatcagggtgaagtaacagaggagaacttcaatgtgatccaggaacctggcggcagcgcaaaagatg

SEQ ID NO: 124625 - DNA, 103 bp, Artificial Sequence
  Synthetic Polynucleotide
taatacgactcactatagggatgtcgttctcgcagcaaaacgcctggatcaacagaggagagatccaatggttttgctgaacctggcggcagcgcaaaagatg

SEQ ID NO: 124626 - DNA, 103 bp, Artificial Sequence
  Synthetic Polynucleotide
taatacgactcactatagggcaggatgttgatgtcgttctcgcagcaaaaaacagaggagattttgcatggagaacgacaacctggcggcagcgcaaaagatg

SEQ ID NO: 124627 - DNA, 103 bp, Artificial Sequence
  Synthetic Polynucleotide
taatacgactcactatagggtgctgacgcgcaggatgttgatgtcgttctaacagaggagaagaacgatgtcaacatccaacctggcggcagcgcaaaagatg

SEQ ID NO: 124628 - DNA, 103 bp, Artificial Sequence
  Synthetic Polynucleotide
taatacgactcactatagggcggcccgggttgctgacgcgcaggatgttgaacagaggagacaacatatggcgcgtcagaacctggcggcagcgcaaaagatg

SEQ ID NO: 124629 - DNA, 103 bp, Artificial Sequence
  Synthetic Polynucleotide
taatacgactcactatagggctccgccagccggcccgggttgctgacgcgaacagaggagacgcgtcatgaacccgggcaacctggcggcagcgcaaaagatg

SEQ ID NO: 124630 - DNA, 103 bp, Artificial Sequence
  Synthetic Polynucleotide
taatacgactcactatagggagagcaggagctccgccagccggcccgggtaacagaggagaacccggatgggctggcggaacctggcggcagcgcaaaagatg

SEQ ID NO: 124631 - DNA, 103 bp, Artificial Sequence
  Synthetic Polynucleotide
taatacgactcactatagggtccatcctttcggtcttctgctctccagccaacagaggagaggctggatggcagaagacaacctggcggcagcgcaaaagatg

SEQ ID NO: 124632 - DNA, 103 bp, Artificial Sequence
  Synthetic Polynucleotide
taatacgactcactatagggtcggtctccaagagcaggagctccgccagcaacagaggagagctggcatggctcctgctaacctggcggcagcgcaaaagatg

SEQ ID NO: 124633 - DNA, 103 bp, Artificial Sequence
  Synthetic Polynucleotide
taatacgactcactatagggggggccagcgtcggtctccaagagcaggagaacagaggagactcctgatgttggagaccaacctggcggcagcgcaaaagatg

SEQ ID NO: 124634 - DNA, 103 bp, Artificial Sequence
  Synthetic Polynucleotide
taatacgactcactatagggcgctcgccgcggggccagcgtcggtctccaaacagaggagatggagaatgacgctggccaacctggcggcagcgcaaaagatg

SEQ ID NO: 124635 - DNA, 103 bp, Artificial Sequence
  Synthetic Polynucleotide
taatacgactcactatagggtcggcgccctcgctcgccgcggggccagcgaacagaggagacgctggatgcgcggcgagaacctggcggcagcgcaaaagatg

SEQ ID NO: 124636 - DNA, 103 bp, Artificial Sequence
  Synthetic Polynucleotide
taatacgactcactatagggcgggggctgctcggcgccctcgctcgccgcaacagaggagagcggcgatggagggcgccaacctggcggcagcgcaaaagatg

SEQ ID NO: 124637 - DNA, 103 bp, Artificial Sequence
  Synthetic Polynucleotide
taatacgactcactatagggagtgcaggtccgggggctgctcggcgccctaacagaggagaagggcgatgagcagccccaacctggcggcagcgcaaaagatg

SEQ ID NO: 124638 - DNA, 103 bp, Artificial Sequence
  Synthetic Polynucleotide
taatacgactcactatagggaccagcacgcagtgcaggtccgggggctgcaacagaggagagcagccatgggacctgcaaacctggcggcagcgcaaaagatg

SEQ ID NO: 124639 - DNA, 103 bp, Artificial Sequence
  Synthetic Polynucleotide
taatacgactcactatagggtggattcgtcaccagcacgcagtgcaggtcaacagaggagagacctgatgtgcgtgctgaacctggcggcagcgcaaaagatg

SEQ ID NO: 124640 - DNA, 103 bp, Artificial Sequence
  Synthetic Polynucleotide
taatacgactcactataggggagatgaatgtggattcgtcaccagcacgcaacagaggagagcgtgcatgtgacgaatcaacctggcggcagcgcaaaagatg

SEQ ID NO: 124641 - DNA, 103 bp, Artificial Sequence
  Synthetic Polynucleotide
taatacgactcactatagggtccttccattgagatgaatgtggattcgtcaacagaggagagacgaaatgacattcatcaacctggcggcagcgcaaaagatg

SEQ ID NO: 124642 - DNA, 103 bp, Artificial Sequence
  Synthetic Polynucleotide
taatacgactcactatagggccccaccttatccatcctttcggtcttctgaacagaggagacagaagatggaaaggatgaacctggcggcagcgcaaaagatg

SEQ ID NO: 124643 - DNA, 103 bp, Artificial Sequence
  Synthetic Polynucleotide
taatacgactcactatagggtaaggcaggatccttccattgagatgaatgaacagaggagacattcaatgcaatggaagaacctggcggcagcgcaaaagatg

SEQ ID NO: 124644 - DNA, 103 bp, Artificial Sequence
  Synthetic Polynucleotide
taatacgactcactatagggtaagttgacttaaggcaggatccttccattaacagaggagaaatggaatgatcctgcctaacctggcggcagcgcaaaagatg

SEQ ID NO: 124645 - DNA, 103 bp, Artificial Sequence
  Synthetic Polynucleotide
taatacgactcactatagggcaaaaacaaataagttgacttaaggcaggaaacagaggagatcctgcatgaagtcaactaacctggcggcagcgcaaaagatg

SEQ ID NO: 124646 - DNA, 103 bp, Artificial Sequence
  Synthetic Polynucleotide
taatacgactcactatagggactttcccggcaaaaacaaataagttgactaacagaggagaagtcaaatgatttgttttaacctggcggcagcgcaaaagatg

SEQ ID NO: 124647 - DNA, 103 bp, Artificial Sequence
  Synthetic Polynucleotide
taatacgactcactatagggccatgtagcgactttcccggcaaaaacaaaaacagaggagatttgttatggccgggaaaaacctggcggcagcgcaaaagatg

SEQ ID NO: 124648 - DNA, 103 bp, Artificial Sequence
  Synthetic Polynucleotide
taatacgactcactatagggacccattgatccatgtagcgactttcccggaacagaggagaccgggaatgtcgctacataacctggcggcagcgcaaaagatg

SEQ ID NO: 124649 - DNA, 103 bp, Artificial Sequence
  Synthetic Polynucleotide
taatacgactcactatagggaatcactggaacccattgatccatgtagcgaacagaggagacgctacatggatcaatggaacctggcggcagcgcaaaagatg

SEQ ID NO: 124650 - DNA, 103 bp, Artificial Sequence
  Synthetic Polynucleotide
taatacgactcactatagggcagggagattaatcactggaacccattgataacagaggagaatcaatatgttccagtgaaacctggcggcagcgcaaaagatg

SEQ ID NO: 124651 - DNA, 103 bp, Artificial Sequence
  Synthetic Polynucleotide
taatacgactcactatagggccagggcatcccccaccttatccatcctttaacagaggagaaaaggaatgataaggtggaacctggcggcagcgcaaaagatg

SEQ ID NO: 124652 - DNA, 103 bp, Artificial Sequence
  Synthetic Polynucleotide
taatacgactcactatagggagcacttcctccagggcatcccccaccttaaacagaggagataaggtatgggatgccctaacctggcggcagcgcaaaagatg

SEQ ID NO: 124653 - DNA, 103 bp, Artificial Sequence
  Synthetic Polynucleotide
taatacgactcactatagggggctttgctgagcacttcctccagggcatcaacagaggagagatgccatggaggaagtgaacctggcggcagcgcaaaagatg

SEQ ID NO: 124654 - DNA, 103 bp, Artificial Sequence
  Synthetic Polynucleotide
taatacgactcactataggggctgactcagggctttgctgagcacttcctaacagaggagaaggaagatgtcagcaaagaacctggcggcagcgcaaaagatg

SEQ ID NO: 124655 - DNA, 103 bp, Artificial Sequence
  Synthetic Polynucleotide
taatacgactcactataggggtgatcgtgcgctgactcagggctttgctgaacagaggagacagcaaatgcctgagtcaaacctggcggcagcgcaaaagatg

SEQ ID NO: 124656 - DNA, 103 bp, Artificial Sequence
  Synthetic Polynucleotide
taatacgactcactatagggccccagggaccccaggccagggaactccataacagaggagaatggagatgcctggcctgaacctggcggcagcgcaaaagatg

SEQ ID NO: 124657 - DNA, 103 bp, Artificial Sequence
  Synthetic Polynucleotide
taatacgactcactataggggccctcaggcccagaggggaagaaaaccccaacagaggagaggggttatgttcccctctaacctggcggcagcgcaaaagatg

SEQ ID NO: 124658 - DNA, 103 bp, Artificial Sequence
  Synthetic Polynucleotide
taatacgactcactataggggcccccagccaccaccataaagccaccagcaacagaggagagctggtatgtttatggtgaacctggcggcagcgcaaaagatg

SEQ ID NO: 124659 - DNA, 103 bp, Artificial Sequence
  Synthetic Polynucleotide
taatacgactcactatagggcgctaccgctgcccccagccaccaccataaaacagaggagattatggatgtggctggggaacctggcggcagcgcaaaagatg

SEQ ID NO: 124660 - DNA, 103 bp, Artificial Sequence
  Synthetic Polynucleotide
taatacgactcactatagggccacaattcccgctaccgctgcccccagccaacagaggagaggctggatgcagcggtagaacctggcggcagcgcaaaagatg

SEQ ID NO: 124661 - DNA, 103 bp, Artificial Sequence
  Synthetic Polynucleotide
taatacgactcactatagggagccacctccccacaattcccgctaccgctaacagaggagaagcggtatggggaattgtaacctggcggcagcgcaaaagatg

SEQ ID NO: 124662 - DNA, 103 bp, Artificial Sequence
  Synthetic Polynucleotide
taatacgactcactatagggtcaggcctgaagccacctccccacaattccaacagaggagaggaattatggggaggtggaacctggcggcagcgcaaaagatg

SEQ ID NO: 124663 - DNA, 103 bp, Artificial Sequence
  Synthetic Polynucleotide
taatacgactcactataggggggcccagtgtcaggcctgaagccacctccaacagaggagaggaggtatgttcaggcctaacctggcggcagcgcaaaagatg

SEQ ID NO: 124664 - DNA, 103 bp, Artificial Sequence
  Synthetic Polynucleotide
taatacgactcactatagggagtacctggggggcccagtgtcaggcctgaaacagaggagatcaggcatgacactgggcaacctggcggcagcgcaaaagatg

SEQ ID NO: 124665 - DNA, 103 bp, Artificial Sequence
  Synthetic Polynucleotide
taatacgactcactatagggagagatgggcagtacctggggggcccagtgaacagaggagacactggatgccccaggtaaacctggcggcagcgcaaaagatg

SEQ ID NO: 124666 - DNA, 103 bp, Artificial Sequence
  Synthetic Polynucleotide
taatacgactcactatagggaggccttggtagagatgggcagtacctgggaacagaggagacccaggatgtgcccatctaacctggcggcagcgcaaaagatg

SEQ ID NO: 124667 - DNA, 103 bp, Artificial Sequence
  Synthetic Polynucleotide
taatacgactcactatagggcacagggcccaggccttggtagagatgggcaacagaggagagcccatatgtaccaaggcaacctggcggcagcgcaaaagatg

SEQ ID NO: 124668 - DNA, 103 bp, Artificial Sequence
  Synthetic Polynucleotide
taatacgactcactatagggctgcatccaagccctcaggcccagaggggaaacagaggagatcccctatgggcctgaggaacctggcggcagcgcaaaagatg

SEQ ID NO: 124669 - DNA, 103 bp, Artificial Sequence
  Synthetic Polynucleotide
taatacgactcactatagggctgacagcaccacagggcccaggccttggtaacagaggagaaccaagatgtgggccctgaacctggcggcagcgcaaaagatg

SEQ ID NO: 124670 - DNA, 103 bp, Artificial Sequence
  Synthetic Polynucleotide
taatacgactcactatagggctaacaggccctgacagcaccacagggcccaacagaggagagggcccatgggtgctgtcaacctggcggcagcgcaaaagatg

SEQ ID NO: 124671 - DNA, 103 bp, Artificial Sequence
  Synthetic Polynucleotide
taatacgactcactatagggcatgaggtggctaacaggccctgacagcacaacagaggagagtgctgatggggcctgttaacctggcggcagcgcaaaagatg

SEQ ID NO: 124672 - DNA, 103 bp, Artificial Sequence
  Synthetic Polynucleotide
taatacgactcactatagggcagggaaaggcatgaggtggctaacaggccaacagaggagaggcctgatggccacctcaaacctggcggcagcgcaaaagatg

SEQ ID NO: 124673 - DNA, 103 bp, Artificial Sequence
  Synthetic Polynucleotide
taatacgactcactatagggagtaggggtccagggaaaggcatgaggtggaacagaggagaccacctatggcctttcccaacctggcggcagcgcaaaagatg

SEQ ID NO: 124674 - DNA, 103 bp, Artificial Sequence
  Synthetic Polynucleotide
taatacgactcactataggggggtgagcccagtaggggtccagggaaaggaacagaggagacctttcatgggacccctaaacctggcggcagcgcaaaagatg

SEQ ID NO: 124675 - DNA, 103 bp, Artificial Sequence
  Synthetic Polynucleotide
taatacgactcactatagggaggagcccgtgggtgagcccagtaggggtcaacagaggagagaccccatgtgggctcacaacctggcggcagcgcaaaagatg

SEQ ID NO: 124676 - DNA, 103 bp, Artificial Sequence
  Synthetic Polynucleotide
taatacgactcactatagggcctgtggggaaggagcccgtgggtgagcccaacagaggagagggctcatgcacgggctcaacctggcggcagcgcaaaagatg

SEQ ID NO: 124677 - DNA, 103 bp, Artificial Sequence
  Synthetic Polynucleotide
taatacgactcactataggggggcatggggcctgtggggaaggagcccgtaacagaggagaacgggcatgttccccacaaacctggcggcagcgcaaaagatg

SEQ ID NO: 124678 - DNA, 103 bp, Artificial Sequence
  Synthetic Polynucleotide
taatacgactcactatagggtggtggtggggggcatggggcctgtggggaaacagaggagatccccaatggccccatgcaacctggcggcagcgcaaaagatg

SEQ ID NO: 124679 - DNA, 103 bp, Artificial Sequence
  Synthetic Polynucleotide
taatacgactcactataggggaggaagctgctgcatccaagccctcaggcaacagaggagagcctgaatgcttggatgcaacctggcggcagcgcaaaagatg

SEQ ID NO: 124680 - DNA, 103 bp, Artificial Sequence
  Synthetic Polynucleotide
taatacgactcactatagggacagtagtgctggtggtggggggcatggggaacagaggagaccccatatgccccaccacaacctggcggcagcgcaaaagatg

SEQ ID NO: 124681 - DNA, 103 bp, Artificial Sequence
  Synthetic Polynucleotide
taatacgactcactatagggcggagccaccacagtagtgctggtggtgggaacagaggagacccaccatgagcactactaacctggcggcagcgcaaaagatg

SEQ ID NO: 124682 - DNA, 103 bp, Artificial Sequence
  Synthetic Polynucleotide
taatacgactcactatagggatgagctgagcggagccaccacagtagtgcaacagaggagagcactaatgtggtggctcaacctggcggcagcgcaaaagatg

SEQ ID NO: 124683 - DNA, 103 bp, Artificial Sequence
  Synthetic Polynucleotide
taatacgactcactatagggcggggcagtggaggaagctgctgcatccaaaacagaggagattggatatggcagcttccaacctggcggcagcgcaaaagatg

SEQ ID NO: 124684 - DNA, 103 bp, Artificial Sequence
  Synthetic Polynucleotide
taatacgactcactatagggtggctgtgctcggggcagtggaggaagctgaacagaggagacagcttatgccactgcccaacctggcggcagcgcaaaagatg

SEQ ID NO: 124685 - DNA, 103 bp, Artificial Sequence
  Synthetic Polynucleotide
taatacgactcactataggggctgcagcggtggctgtgctcggggcagtgaacagaggagacactgcatggagcacagcaacctggcggcagcgcaaaagatg

SEQ ID NO: 124686 - DNA, 103 bp, Artificial Sequence
  Synthetic Polynucleotide
taatacgactcactatagggcagtgccgcagctgcagcggtggctgtgctaacagaggagaagcacaatgaccgctgcaaacctggcggcagcgcaaaagatg

SEQ ID NO: 124687 - DNA, 103 bp, Artificial Sequence
  Synthetic Polynucleotide
taatacgactcactatagggtgtagtaggccagtgccgcagctgcagcggaacagaggagaccgctgatgctgcggcacaacctggcggcagcgcaaaagatg

SEQ ID NO: 124688 - DNA, 103 bp, Artificial Sequence
  Synthetic Polynucleotide
taatacgactcactatagggtcagcgtccctgtagtaggccagtgccgcaaacagaggagatgcggcatgggcctactaaacctggcggcagcgcaaaagatg

SEQ ID NO: 124689 - DNA, 103 bp, Artificial Sequence
  Synthetic Polynucleotide
taatacgactcactatagggtctgtaggcctcagcgtccctgtagtaggcaacagaggagagcctacatgagggacgctaacctggcggcagcgcaaaagatg

SEQ ID NO: 124690 - DNA, 103 bp, Artificial Sequence
  Synthetic Polynucleotide
taatacgactcactataggggctctgaggtccccagggaccccaggccagaacagaggagactggccatgggtccctggaacctggcggcagcgcaaaagatg

SEQ ID NO: 124691 - DNA, 103 bp, Artificial Sequence
  Synthetic Polynucleotide
taatacgactcactatagggctggggagtgtctgtaggcctcagcgtcccaacagaggagagggacgatgaggcctacaaacctggcggcagcgcaaaagatg

SEQ ID NO: 124692 - DNA, 103 bp, Artificial Sequence
  Synthetic Polynucleotide
taatacgactcactatagggacctgaaagactggggagtgtctgtaggccaacagaggagaggcctaatgacactccccaacctggcggcagcgcaaaagatg

SEQ ID NO: 124693 - DNA, 103 bp, Artificial Sequence
  Synthetic Polynucleotide
taatacgactcactatagggcaatgggtacacctgaaagactggggagtgaacagaggagacactccatggtctttcagaacctggcggcagcgcaaaagatg

SEQ ID NO: 124694 - DNA, 103 bp, Artificial Sequence
  Synthetic Polynucleotide
taatacgactcactatagggtacagttgagcaatgggtacacctgaaagaaacagaggagatctttcatgtgtacccataacctggcggcagcgcaaaagatg

SEQ ID NO: 124695 - DNA, 103 bp, Artificial Sequence
  Synthetic Polynucleotide
taatacgactcactatagggatcccctccatacagttgagcaatgggtacaacagaggagagtacccatggctcaactgaacctggcggcagcgcaaaagatg

SEQ ID NO: 124696 - DNA, 103 bp, Artificial Sequence
  Synthetic Polynucleotide
taatacgactcactataggggccccctgggatcccctccatacagttgagaacagaggagactcaacatgatggaggggaacctggcggcagcgcaaaagatg

SEQ ID NO: 124697 - DNA, 103 bp, Artificial Sequence
  Synthetic Polynucleotide
taatacgactcactatagggcatatggtgagccccctgggatcccctccaaacagaggagatggaggatgtcccaggggaacctggcggcagcgcaaaagatg

SEQ ID NO: 124698 - DNA, 103 bp, Artificial Sequence
  Synthetic Polynucleotide
taatacgactcactataggggcccagccggcatatggtgagccccctgggaacagaggagacccaggatgctcaccataaacctggcggcagcgcaaaagatg

SEQ ID NO: 124699 - DNA, 103 bp, Artificial Sequence
  Synthetic Polynucleotide
taatacgactcactatagggcttgccgtaggcccagccggcatatggtgaaacagaggagatcaccaatggccggctggaacctggcggcagcgcaaaagatg

SEQ ID NO: 124700 - DNA, 103 bp, Artificial Sequence
  Synthetic Polynucleotide
taatacgactcactatagggagagccccgtcttgccgtaggcccagccggaacagaggagaccggctatgcctacggcaaacctggcggcagcgcaaaagatg

SEQ ID NO: 124701 - DNA, 103 bp, Artificial Sequence
  Synthetic Polynucleotide
taatacgactcactatagggtgggggaggggctctgaggtccccagggacaacagaggagagtccctatggacctcagaaacctggcggcagcgcaaaagatg

SEQ ID NO: 124702 - DNA, 103 bp, Artificial Sequence
  Synthetic Polynucleotide
taatacgactcactataggggaggcagggtagagccccgtcttgccgtagaacagaggagactacggatggacggggctaacctggcggcagcgcaaaagatg

SEQ ID NO: 124703 - DNA, 103 bp, Artificial Sequence
  Synthetic Polynucleotide
taatacgactcactatagggacacacagttgaggcagggtagagccccgtaacagaggagaacggggatgtaccctgccaacctggcggcagcgcaaaagatg

SEQ ID NO: 124704 - DNA, 103 bp, Artificial Sequence
  Synthetic Polynucleotide
taatacgactcactatagggcgcgggtgggacacacagttgaggcagggtaacagaggagaaccctgatgcaactgtgtaacctggcggcagcgcaaaagatg

SEQ ID NO: 124705 - DNA, 103 bp, Artificial Sequence
  Synthetic Polynucleotide
taatacgactcactatagggggagagtcctcgcgggtgggacacacagttaacagaggagaaactgtatgtcccacccgaacctggcggcagcgcaaaagatg

SEQ ID NO: 124706 - DNA, 103 bp, Artificial Sequence
  Synthetic Polynucleotide
taatacgactcactatagggggcctggggaggagagtcctcgcgggtgggaacagaggagacccaccatggaggactctaacctggcggcagcgcaaaagatg

SEQ ID NO: 124707 - DNA, 103 bp, Artificial Sequence
  Synthetic Polynucleotide
taatacgactcactataggggatcttccacggcctggggaggagagtcctaacagaggagaaggactatgctccccaggaacctggcggcagcgcaaaagatg

SEQ ID NO: 124708 - DNA, 103 bp, Artificial Sequence
  Synthetic Polynucleotide
taatacgactcactatagggtttccatccagatcttccacggcctggggaaacagaggagatccccaatgcgtggaagaaacctggcggcagcgcaaaagatg

SEQ ID NO: 124709 - DNA, 103 bp, Artificial Sequence
  Synthetic Polynucleotide
taatacgactcactatagggggtgctgccttttccatccagatcttccacaacagaggagagtggaaatgctggatggaaacctggcggcagcgcaaaagatg

SEQ ID NO: 124710 - DNA, 103 bp, Artificial Sequence
  Synthetic Polynucleotide
taatacgactcactatagggccaggaagctggtgctgccttttccatccaaacagaggagatggatgatgaaggcagcaaacctggcggcagcgcaaaagatg

SEQ ID NO: 124711 - DNA, 103 bp, Artificial Sequence
  Synthetic Polynucleotide
taatacgactcactatagggttcaaagtctccaggaagctggtgctgcctaacagaggagaaggcagatgcagcttcctaacctggcggcagcgcaaaagatg

SEQ ID NO: 124712 - DNA, 103 bp, Artificial Sequence
  Synthetic Polynucleotide
taatacgactcactatagggatccacaaactgggggaggggctctgaggtaacagaggagaacctcaatgcccctccccaacctggcggcagcgcaaaagatg

SEQ ID NO: 124713 - DNA, 103 bp, Artificial Sequence
  Synthetic Polynucleotide
taatacgactcactatagggccgctctgtcttcaaagtctccaggaagctaacagaggagaagcttcatggagactttgaacctggcggcagcgcaaaagatg

SEQ ID NO: 124714 - DNA, 103 bp, Artificial Sequence
  Synthetic Polynucleotide
taatacgactcactatagggctgggctcagccgctctgtcttcaaagtctaacagaggagaagacttatgagacagagcaacctggcggcagcgcaaaagatg

SEQ ID NO: 124715 - DNA, 103 bp, Artificial Sequence
  Synthetic Polynucleotide
taatacgactcactataggggtcaggaggtctgggctcagccgctctgtcaacagaggagagacagaatggctgagcccaacctggcggcagcgcaaaagatg

SEQ ID NO: 124716 - DNA, 103 bp, Artificial Sequence
  Synthetic Polynucleotide
taatacgactcactatagggaggtcccagggtcaggaggtctgggctcagaacagaggagactgagcatggacctcctgaacctggcggcagcgcaaaagatg

SEQ ID NO: 124717 - DNA, 103 bp, Artificial Sequence
  Synthetic Polynucleotide
taatacgactcactatagggaaggcagtgcaggtcccagggtcaggaggtaacagaggagaacctccatgccctgggacaacctggcggcagcgcaaaagatg

SEQ ID NO: 124718 - DNA, 103 bp, Artificial Sequence
  Synthetic Polynucleotide
taatacgactcactataggggggagtgatgaaggcagtgcaggtcccaggaacagaggagacctgggatgtgcactgccaacctggcggcagcgcaaaagatg

SEQ ID NO: 124719 - DNA, 103 bp, Artificial Sequence
  Synthetic Polynucleotide
taatacgactcactatagggattggggacagggagtgatgaaggcagtgcaacagaggagagcactgatgtcatcactcaacctggcggcagcgcaaaagatg

SEQ ID NO: 124720 - DNA, 103 bp, Artificial Sequence
  Synthetic Polynucleotide
taatacgactcactatagggcataagcactattggggacagggagtgatgaacagaggagacatcacatgctgtccccaaacctggcggcagcgcaaaagatg

SEQ ID NO: 124721 - DNA, 103 bp, Artificial Sequence
  Synthetic Polynucleotide
taatacgactcactatagggtcagggcccccataagcactattggggacaaacagaggagatgtcccatgtagtgcttaaacctggcggcagcgcaaaagatg

SEQ ID NO: 124722 - DNA, 103 bp, Artificial Sequence
  Synthetic Polynucleotide
taatacgactcactatagggactggaaaagtcagggcccccataagcactaacagaggagaagtgctatggggggccctaacctggcggcagcgcaaaagatg

SEQ ID NO: 124723 - DNA, 103 bp, Artificial Sequence
  Synthetic Polynucleotide
taatacgactcactatagggccagagcaggatccacaaactgggggagggaacagaggagaccctccatgagtttgtggaacctggcggcagcgcaaaagatg

SEQ ID NO: 124724 - DNA, 103 bp, Artificial Sequence
  Synthetic Polynucleotide
taatacgactcactatagggaaaagaaggtactggaaaagtcagggccccaacagaggagaggggccatgacttttccaaacctggcggcagcgcaaaagatg

SEQ ID NO: 124725 - DNA, 103 bp, Artificial Sequence
  Synthetic Polynucleotide
taatacgactcactatagggccggtgggagaaaagaaggtactggaaaagaacagaggagacttttcatgtaccttcttaacctggcggcagcgcaaaagatg

SEQ ID NO: 124726 - DNA, 103 bp, Artificial Sequence
  Synthetic Polynucleotide
taatacgactcactataggggagggggctcccggtgggagaaaagaaggtaacagaggagaaccttcatgtctcccaccaacctggcggcagcgcaaaagatg

SEQ ID NO: 124727 - DNA, 103 bp, Artificial Sequence
  Synthetic Polynucleotide
taatacgactcactatagggctgctgaattgagggggctcccggtgggagaacagaggagactcccaatgggagcccccaacctggcggcagcgcaaaagatg

SEQ ID NO: 124728 - DNA, 103 bp, Artificial Sequence
  Synthetic Polynucleotide
taatacgactcactataggggaggaataggctgctgaattgagggggctcaacagaggagagagcccatgcaattcagcaacctggcggcagcgcaaaagatg

SEQ ID NO: 124729 - DNA, 103 bp, Artificial Sequence
  Synthetic Polynucleotide
taatacgactcactatagggaagcttgggagaggaataggctgctgaattaacagaggagaaattcaatggcctattccaacctggcggcagcgcaaaagatg

SEQ ID NO: 124730 - DNA, 103 bp, Artificial Sequence
  Synthetic Polynucleotide
taatacgactcactataggggagttccacgaagcttgggagaggaataggaacagaggagacctattatgctcccaagcaacctggcggcagcgcaaaagatg

SEQ ID NO: 124731 - DNA, 103 bp, Artificial Sequence
  Synthetic Polynucleotide
taatacgactcactatagggggcagggggagagttccacgaagcttgggaaacagaggagatcccaaatgtcgtggaacaacctggcggcagcgcaaaagatg

SEQ ID NO: 124732 - DNA, 103 bp, Artificial Sequence
  Synthetic Polynucleotide
taatacgactcactatagggctcacagggaggcagggggagagttccacgaacagaggagacgtggaatgctccccctgaacctggcggcagcgcaaaagatg

SEQ ID NO: 124733 - DNA, 103 bp, Artificial Sequence
  Synthetic Polynucleotide
taatacgactcactatagggactccctggcctcacagggaggcagggggaaacagaggagatcccccatgctccctgtgaacctggcggcagcgcaaaagatg

SEQ ID NO: 124734 - DNA, 103 bp, Artificial Sequence
  Synthetic Polynucleotide
taatacgactcactataggggtggaggacaccagagcaggatccacaaacaacagaggagagtttgtatgtcctgctctaacctggcggcagcgcaaaagatg

SEQ ID NO: 124735 - DNA, 103 bp, Artificial Sequence
  Synthetic Polynucleotide
taatacgactcactatagggcagttcacacactccctggcctcacagggaaacagaggagatccctgatgggccagggaaacctggcggcagcgcaaaagatg

SEQ ID NO: 124736 - DNA, 103 bp, Artificial Sequence
  Synthetic Polynucleotide
taatacgactcactatagggtgttgctccgcagttcacacactccctggcaacagaggagagccaggatgtgtgtgaacaacctggcggcagcgcaaaagatg

SEQ ID NO: 124737 - DNA, 103 bp, Artificial Sequence
  Synthetic Polynucleotide
taatacgactcactataggggtggagtggctgttgctccgcagttcacacaacagaggagagtgtgaatggcggagcaaaacctggcggcagcgcaaaagatg

SEQ ID NO: 124738 - DNA, 103 bp, Artificial Sequence
  Synthetic Polynucleotide
taatacgactcactatagggctccgccacagtggagtggctgttgctccgaacagaggagacggagcatgagccactccaacctggcggcagcgcaaaagatg

SEQ ID NO: 124739 - DNA, 103 bp, Artificial Sequence
  Synthetic Polynucleotide
taatacgactcactatagggtgtcctgtccctccgccacagtggagtggcaacagaggagagccactatgctgtggcggaacctggcggcagcgcaaaagatg

SEQ ID NO: 124740 - DNA, 103 bp, Artificial Sequence
  Synthetic Polynucleotide
taatacgactcactatagggggtagtggcctgtcctgtccctccgccacaaacagaggagatgtggcatggggacaggaaacctggcggcagcgcaaaagatg

SEQ ID NO: 124741 - DNA, 103 bp, Artificial Sequence
  Synthetic Polynucleotide
taatacgactcactataggggcgttgcataggtagtggcctgtcctgtccaacagaggagaggacagatgaggccactaaacctggcggcagcgcaaaagatg

SEQ ID NO: 124742 - DNA, 103 bp, Artificial Sequence
  Synthetic Polynucleotide
taatacgactcactataggggaggccgcaggcgttgcataggtagtggccaacagaggagaggccacatgctatgcaacaacctggcggcagcgcaaaagatg

SEQ ID NO: 124743 - DNA, 103 bp, Artificial Sequence
  Synthetic Polynucleotide
taatacgactcactatagggtcttgtgatagaggccgcaggcgttgcataaacagaggagatatgcaatgcctgcggccaacctggcggcagcgcaaaagatg

SEQ ID NO: 124744 - DNA, 103 bp, Artificial Sequence
  Synthetic Polynucleotide
taatacgactcactatagggtgcccattcatcttgtgatagaggccgcagaacagaggagactgcggatgctatcacaaaacctggcggcagcgcaaaagatg

SEQ ID NO: 124745 - DNA, 103 bp, Artificial Sequence
  Synthetic Polynucleotide
taatacgactcactatagggtgattctggtgtggaggacaccagagcaggaacagaggagacctgctatggtgtcctccaacctggcggcagcgcaaaagatg

SEQ ID NO: 124746 - DNA, 103 bp, Artificial Sequence
  Synthetic Polynucleotide
taatacgactcactataggggggcctgttctgcccattcatcttgtgataaacagaggagatatcacatgatgaatgggaacctggcggcagcgcaaaagatg

SEQ ID NO: 124747 - DNA, 103 bp, Artificial Sequence
  Synthetic Polynucleotide
taatacgactcactataggggccggatgaggggcctgttctgcccattcaaacagaggagatgaatgatgagaacaggcaacctggcggcagcgcaaaagatg

SEQ ID NO: 124748 - DNA, 103 bp, Artificial Sequence
  Synthetic Polynucleotide
taatacgactcactatagggcgcttcttgggccggatgaggggcctgttcaacagaggagagaacagatgcctcatccgaacctggcggcagcgcaaaagatg

SEQ ID NO: 124749 - DNA, 103 bp, Artificial Sequence
  Synthetic Polynucleotide
taatacgactcactataggggacaatcaggcgcttcttgggccggatgagaacagaggagactcatcatgcccaagaagaacctggcggcagcgcaaaagatg

SEQ ID NO: 124750 - DNA, 103 bp, Artificial Sequence
  Synthetic Polynucleotide
taatacgactcactatagggcccgtttactgacaatcaggcgcttcttggaacagaggagaccaagaatggcctgattgaacctggcggcagcgcaaaagatg

SEQ ID NO: 124751 - DNA, 103 bp, Artificial Sequence
  Synthetic Polynucleotide
taatacgactcactatagggtgagtacctgcccgtttactgacaatcaggaacagaggagacctgatatgcagtaaacgaacctggcggcagcgcaaaagatg

SEQ ID NO: 124752 - DNA, 103 bp, Artificial Sequence
  Synthetic Polynucleotide
taatacgactcactataggggttggtgcactgagtacctgcccgtttactaacagaggagaagtaaaatggcaggtactaacctggcggcagcgcaaaagatg

SEQ ID NO: 124753 - DNA, 103 bp, Artificial Sequence
  Synthetic Polynucleotide
taatacgactcactatagggtcgtctggcagttggtgcactgagtacctgaacagaggagacaggtaatgagtgcaccaaacctggcggcagcgcaaaagatg

SEQ ID NO: 124754 - DNA, 103 bp, Artificial Sequence
  Synthetic Polynucleotide
taatacgactcactataggggtcgtggtggtcgtctggcagttggtgcacaacagaggagagtgcacatgctgccagacaacctggcggcagcgcaaaagatg

SEQ ID NO: 124755 - DNA, 103 bp, Artificial Sequence
  Synthetic Polynucleotide
taatacgactcactatagggccgccacagtgtcgtggtggtcgtctggcaaacagaggagatgccagatgaccaccacgaacctggcggcagcgcaaaagatg

SEQ ID NO: 124756 - DNA, 103 bp, Artificial Sequence
  Synthetic Polynucleotide
taatacgactcactatagggagaaaacccctgattctggtgtggaggacaaacagaggagatgtcctatgcaccagaataacctggcggcagcgcaaaagatg

SEQ ID NO: 124757 - DNA, 103 bp, Artificial Sequence
  Synthetic Polynucleotide
taatacgactcactatagggtggcatttctccgccacagtgtcgtggtggaacagaggagaccaccaatgcactgtggcaacctggcggcagcgcaaaagatg

SEQ ID NO: 124758 - DNA, 103 bp, Artificial Sequence
  Synthetic Polynucleotide
taatacgactcactatagggggatccccactggcatttctccgccacagtaacagaggagaactgtgatggagaaatgcaacctggcggcagcgcaaaagatg

SEQ ID NO: 124759 - DNA, 103 bp, Artificial Sequence
  Synthetic Polynucleotide
taatacgactcactatagggattgcacacgggatccccactggcatttctaacagaggagaagaaatatgagtggggataacctggcggcagcgcaaaagatg

SEQ ID NO: 124760 - DNA, 103 bp, Artificial Sequence
  Synthetic Polynucleotide
taatacgactcactatagggggccgcaggcattgcacacgggatccccacaacagaggagagtggggatgccgtgtgcaaacctggcggcagcgcaaaagatg

SEQ ID NO: 124761 - DNA, 103 bp, Artificial Sequence
  Synthetic Polynucleotide
taatacgactcactatagggttgtagtagaggccgcaggcattgcacacgaacagaggagacgtgtgatgtgcctgcggaacctggcggcagcgcaaaagatg

SEQ ID NO: 124762 - DNA, 103 bp, Artificial Sequence
  Synthetic Polynucleotide
taatacgactcactatagggctggtgtagcttgtagtagaggccgcaggcaacagaggagagcctgcatgctctactacaacctggcggcagcgcaaaagatg

SEQ ID NO: 124763 - DNA, 103 bp, Artificial Sequence
  Synthetic Polynucleotide
taatacgactcactataggggccggttcacctggtgtagcttgtagtagaaacagaggagatctactatgagctacaccaacctggcggcagcgcaaaagatg

SEQ ID NO: 124764 - DNA, 103 bp, Artificial Sequence
  Synthetic Polynucleotide
taatacgactcactatagggatggtcagtggccggttcacctggtgtagcaacagaggagagctacaatgggtgaaccgaacctggcggcagcgcaaaagatg

SEQ ID NO: 124765 - DNA, 103 bp, Artificial Sequence
  Synthetic Polynucleotide
taatacgactcactatagggatccttccgcatggtcagtggccggttcacaacagaggagagtgaacatgccactgaccaacctggcggcagcgcaaaagatg

SEQ ID NO: 124766 - DNA, 103 bp, Artificial Sequence
  Synthetic Polynucleotide
taatacgactcactatagggtctgaataccatccttccgcatggtcagtgaacagaggagacactgaatgtgcggaaggaacctggcggcagcgcaaaagatg

SEQ ID NO: 124767 - DNA, 103 bp, Artificial Sequence
  Synthetic Polynucleotide
taatacgactcactatagggccagaggggaagaaaacccctgattctggtaacagaggagaaccagaatgaggggttttaacctggcggcagcgcaaaagatg

SEQ ID NO: 124768 - DNA, 103 bp, Artificial Sequence
  Synthetic Polynucleotide
taatacgactcactatagggcggtttcgagtctgaataccatccttccgcaacagaggagagcggaaatgtggtattcaaacctggcggcagcgcaaaagatg

SEQ ID NO: 124769 - DNA, 103 bp, Artificial Sequence
  Synthetic Polynucleotide
taatacgactcactatagggagatgccttgcggtttcgagtctgaataccaacagaggagaggtattatgactcgaaacaacctggcggcagcgcaaaagatg

SEQ ID NO: 124770 - DNA, 103 bp, Artificial Sequence
  Synthetic Polynucleotide
taatacgactcactatagggtcccttttccagatgccttgcggtttcgagaacagaggagactcgaaatggcaaggcataacctggcggcagcgcaaaagatg

SEQ ID NO: 124771 - DNA, 103 bp, Artificial Sequence
  Synthetic Polynucleotide
taatacgactcactatagggcgtttctttttcccttttccagatgccttgaacagaggagacaaggcatgtggaaaaggaacctggcggcagcgcaaaagatg

SEQ ID NO: 124772 - DNA, 103 bp, Artificial Sequence
  Synthetic Polynucleotide
taatacgactcactatagggactggagccccgtttctttttcccttttccaacagaggagaggaaaaatgaaaaagaaaaacctggcggcagcgcaaaagatg

SEQ ID NO: 124773 - DNA, 103 bp, Artificial Sequence
  Synthetic Polynucleotide
taatacgactcactatagggtgcctcccagactggagccccgtttcttttaacagaggagaaaaagaatgggggctccaaacctggcggcagcgcaaaagatg

SEQ ID NO: 124774 - DNA, 103 bp, Artificial Sequence
  Synthetic Polynucleotide
taatacgactcactataggggctgctcctgtgcctcccagactggagcccaacagaggagagggctcatgtctgggaggaacctggcggcagcgcaaaagatg

SEQ ID NO: 124775 - DNA, 103 bp, Artificial Sequence
  Synthetic Polynucleotide
taatacgactcactatagggtggtccttcggctgctcctgtgcctcccagaacagaggagactgggaatgacaggagcaaacctggcggcagcgcaaaagatg

SEQ ID NO: 124776 - DNA, 103 bp, Artificial Sequence
  Synthetic Polynucleotide
taatacgactcactatagggagccaccagctggtccttcggctgctcctgaacagaggagacaggagatgccgaaggacaacctggcggcagcgcaaaagatg

SEQ ID NO: 124777 - DNA, 103 bp, Artificial Sequence
  Synthetic Polynucleotide
taatacgactcactatagggaccaccataaagccaccagctggtccttcgaacagaggagacgaaggatgagctggtggaacctggcggcagcgcaaaagatg

SEQ ID NO: 124778 - DNA, 103 bp, Artificial Sequence
  Synthetic Polynucleotide
taatacgactcactatagggccagcgcggctgctcgggcgccacctccataacagaggagaatggagatggcgcccgagaacctggcggcagcgcaaaagatg

SEQ ID NO: 124779 - DNA, 103 bp, Artificial Sequence
  Synthetic Polynucleotide
taatacgactcactatagggcagcagctgcgcgggttccatgtagttgtgaacagaggagacacaacatgatggaacccaacctggcggcagcgcaaaagatg

SEQ ID NO: 124780 - DNA, 103 bp, Artificial Sequence
  Synthetic Polynucleotide
taatacgactcactatagggcgacagtcttcgcttgggcttgatgagtggaacagaggagaccactcatgaagcccaagaacctggcggcagcgcaaaagatg

SEQ ID NO: 124781 - DNA, 103 bp, Artificial Sequence
  Synthetic Polynucleotide
taatacgactcactatagggttctggcggccgacagtcttcgcttgggctaacagaggagaagcccaatggaagactgtaacctggcggcagcgcaaaagatg

SEQ ID NO: 124782 - DNA, 103 bp, Artificial Sequence
  Synthetic Polynucleotide
taatacgactcactataggggtgccggctcttctggcggccgacagtcttaacagaggagaaagactatgggccgccagaacctggcggcagcgcaaaagatg

SEQ ID NO: 124783 - DNA, 103 bp, Artificial Sequence
  Synthetic Polynucleotide
taatacgactcactatagggtgcacaacaggtgccggctcttctggcggcaacagaggagagccgccatgagagccggcaacctggcggcagcgcaaaagatg

SEQ ID NO: 124784 - DNA, 103 bp, Artificial Sequence
  Synthetic Polynucleotide
taatacgactcactatagggtctgacaatttgcacaacaggtgccggctcaacagaggagagagccgatgcctgttgtgaacctggcggcagcgcaaaagatg

SEQ ID NO: 124785 - DNA, 103 bp, Artificial Sequence
  Synthetic Polynucleotide
taatacgactcactataggggtggttgtcgtctgacaatttgcacaacagaacagaggagactgttgatgaaattgtcaaacctggcggcagcgcaaaagatg

SEQ ID NO: 124786 - DNA, 103 bp, Artificial Sequence
  Synthetic Polynucleotide
taatacgactcactatagggccataaggtggtggttgtcgtctgacaattaacagaggagaaattgtatgacgacaaccaacctggcggcagcgcaaaagatg

SEQ ID NO: 124787 - DNA, 103 bp, Artificial Sequence
  Synthetic Polynucleotide
taatacgactcactatagggcgtttcggcgccataaggtggtggttgtcgaacagaggagacgacaaatgccaccttataacctggcggcagcgcaaaagatg

SEQ ID NO: 124788 - DNA, 103 bp, Artificial Sequence
  Synthetic Polynucleotide
taatacgactcactatagggtccccgttggcgtttcggcgccataaggtgaacagaggagacaccttatggcgccgaaaaacctggcggcagcgcaaaagatg

SEQ ID NO: 124789 - DNA, 103 bp, Artificial Sequence
  Synthetic Polynucleotide
taatacgactcactataggggcagacagggtccccgttggcgtttcggcgaacagaggagacgccgaatggccaacgggaacctggcggcagcgcaaaagatg

SEQ ID NO: 124790 - DNA, 103 bp, Artificial Sequence
  Synthetic Polynucleotide
taatacgactcactatagggcgtctggaggcagcagctgcgcgggttccaaacagaggagatggaacatgcgcagctgcaacctggcggcagcgcaaaagatg

SEQ ID NO: 124791 - DNA, 103 bp, Artificial Sequence
  Synthetic Polynucleotide
taatacgactcactatagggcacaggcgttgcagacagggtccccgttggaacagaggagaccaacgatgaccctgtctaacctggcggcagcgcaaaagatg

SEQ ID NO: 124792 - DNA, 103 bp, Artificial Sequence
  Synthetic Polynucleotide
taatacgactcactatagggtagtagaggccacaggcgttgcagacagggaacagaggagaccctgtatgcaacgcctgaacctggcggcagcgcaaaagatg

SEQ ID NO: 124793 - DNA, 103 bp, Artificial Sequence
  Synthetic Polynucleotide
taatacgactcactataggggtgcagcttgtagtagaggccacaggcgttaacagaggagaaacgccatgggcctctacaacctggcggcagcgcaaaagatg

SEQ ID NO: 124794 - DNA, 103 bp, Artificial Sequence
  Synthetic Polynucleotide
taatacgactcactatagggtgttaacattgtgcagcttgtagtagaggcaacagaggagagcctctatgacaagctgcaacctggcggcagcgcaaaagatg

SEQ ID NO: 124795 - DNA, 103 bp, Artificial Sequence
  Synthetic Polynucleotide
taatacgactcactataggggtcagtggcctgttaacattgtgcagcttgaacagaggagacaagctatgcaatgttaaaacctggcggcagcgcaaaagatg

SEQ ID NO: 124796 - DNA, 103 bp, Artificial Sequence
  Synthetic Polynucleotide
taatacgactcactatagggcttcttcatggtcagtggcctgttaacattaacagaggagaaatgttatgaggccactgaacctggcggcagcgcaaaagatg

SEQ ID NO: 124797 - DNA, 103 bp, Artificial Sequence
  Synthetic Polynucleotide
taatacgactcactatagggggatcccttccttcttcatggtcagtggccaacagaggagaggccacatgccatgaagaaacctggcggcagcgcaaaagatg

SEQ ID NO: 124798 - DNA, 103 bp, Artificial Sequence
  Synthetic Polynucleotide
taatacgactcactatagggttccgagtctggatcccttccttcttcatgaacagaggagacatgaaatgggaagggataacctggcggcagcgcaaaagatg

SEQ ID NO: 124799 - DNA, 103 bp, Artificial Sequence
  Synthetic Polynucleotide
taatacgactcactatagggcatcttccggttccgagtctggatcccttcaacagaggagagaagggatgcagactcggaacctggcggcagcgcaaaagatg

SEQ ID NO: 124800 - DNA, 103 bp, Artificial Sequence
  Synthetic Polynucleotide
taatacgactcactatagggacttgttggacatcttccggttccgagtctaacagaggagaagactcatgaccggaagaaacctggcggcagcgcaaaagatg

SEQ ID NO: 124801 - DNA, 103 bp, Artificial Sequence
  Synthetic Polynucleotide
taatacgactcactatagggacgtccacctcgtctggaggcagcagctgcaacagaggagagcagctatggcctccagaaacctggcggcagcgcaaaagatg

SEQ ID NO: 124802 - DNA, 103 bp, Artificial Sequence
  Synthetic Polynucleotide
taatacgactcactatagggctcttcttggacttgttggacatcttccggaacagaggagaccggaaatggtccaacaaaacctggcggcagcgcaaaagatg

SEQ ID NO: 124803 - DNA, 103 bp, Artificial Sequence
  Synthetic Polynucleotide
taatacgactcactatagggccctttcttgctcttcttggacttgttggaaacagaggagatccaacatgtccaagaagaacctggcggcagcgcaaaagatg

SEQ ID NO: 124804 - DNA, 103 bp, Artificial Sequence
  Synthetic Polynucleotide
taatacgactcactatagggagcactccgcccctttcttgctcttcttggaacagaggagaccaagaatggcaagaaagaacctggcggcagcgcaaaagatg

SEQ ID NO: 124805 - DNA, 103 bp, Artificial Sequence
  Synthetic Polynucleotide
taatacgactcactatagggagctcctcgaagcactccgcccctttcttgaacagaggagacaagaaatgggcggagtgaacctggcggcagcgcaaaagatg

SEQ ID NO: 124806 - DNA, 103 bp, Artificial Sequence
  Synthetic Polynucleotide
taatacgactcactataggggcactttgacagctcctcgaagcactccgcaacagaggagagcggagatgttcgaggagaacctggcggcagcgcaaaagatg

SEQ ID NO: 124807 - DNA, 103 bp, Artificial Sequence
  Synthetic Polynucleotide
taatacgactcactatagggtctcctgcatgcactttgacagctcctcgaaacagaggagatcgaggatgtgtcaaagtaacctggcggcagcgcaaaagatg

SEQ ID NO: 124808 - DNA, 103 bp, Artificial Sequence
  Synthetic Polynucleotide
taatacgactcactatagggggggatgacttctcctgcatgcactttgacaacagaggagagtcaaaatgcatgcaggaaacctggcggcagcgcaaaagatg

SEQ ID NO: 124809 - DNA, 103 bp, Artificial Sequence
  Synthetic Polynucleotide
taatacgactcactatagggtgcactgaagggggatgacttctcctgcataacagaggagaatgcagatgaagtcatccaacctggcggcagcgcaaaagatg

SEQ ID NO: 124810 - DNA, 103 bp, Artificial Sequence
  Synthetic Polynucleotide
taatacgactcactatagggccagggcagctgcactgaagggggatgactaacagaggagaagtcatatgccttcagtgaacctggcggcagcgcaaaagatg

SEQ ID NO: 124811 - DNA, 103 bp, Artificial Sequence
  Synthetic Polynucleotide
taatacgactcactatagggatgtgtccagccagggcagctgcactgaagaacagaggagacttcagatgagctgccctaacctggcggcagcgcaaaagatg

SEQ ID NO: 124812 - DNA, 103 bp, Artificial Sequence
  Synthetic Polynucleotide
taatacgactcactatagggattgaagaagacgtccacctcgtctggaggaacagaggagacctccaatggaggtggacaacctggcggcagcgcaaaagatg

SEQ ID NO: 124813 - DNA, 103 bp, Artificial Sequence
  Synthetic Polynucleotide
taatacgactcactatagggcacaggtgccatgtgtccagccagggcagcaacagaggagagctgccatggctggacacaacctggcggcagcgcaaaagatg

SEQ ID NO: 124814 - DNA, 103 bp, Artificial Sequence
  Synthetic Polynucleotide
taatacgactcactatagggggaggtggcccacaggtgccatgtgtccagaacagaggagactggacatgtggcacctgaacctggcggcagcgcaaaagatg

SEQ ID NO: 124815 - DNA, 103 bp, Artificial Sequence
  Synthetic Polynucleotide
taatacgactcactatagggctgaagggcgggaggtggcccacaggtgccaacagaggagaggcaccatggggccacctaacctggcggcagcgcaaaagatg

SEQ ID NO: 124816 - DNA, 103 bp, Artificial Sequence
  Synthetic Polynucleotide
taatacgactcactatagggtccggagtggctgaagggcgggaggtggccaacagaggagaggccacatgccgcccttcaacctggcggcagcgcaaaagatg

SEQ ID NO: 124817 - DNA, 103 bp, Artificial Sequence
  Synthetic Polynucleotide
taatacgactcactataggggcaggatgtgtccggagtggctgaagggcgaacagaggagacgccctatggccactccgaacctggcggcagcgcaaaagatg

SEQ ID NO: 124818 - DNA, 103 bp, Artificial Sequence
  Synthetic Polynucleotide
taatacgactcactataggggtcggagtgggcaggatgtgtccggagtggaacagaggagaccactcatgacacatcctaacctggcggcagcgcaaaagatg

SEQ ID NO: 124819 - DNA, 103 bp, Artificial Sequence
  Synthetic Polynucleotide
taatacgactcactataggggtggatgggcgtcggagtgggcaggatgtgaacagaggagacacatcatgcccactccgaacctggcggcagcgcaaaagatg

SEQ ID NO: 124820 - DNA, 103 bp, Artificial Sequence
  Synthetic Polynucleotide
taatacgactcactatagggtggaggaggggtggatgggcgtcggagtggaacagaggagaccactcatgcgcccatccaacctggcggcagcgcaaaagatg

SEQ ID NO: 124821 - DNA, 103 bp, Artificial Sequence
  Synthetic Polynucleotide
taatacgactcactatagggaaggagaggctggaggaggggtggatgggcaacagaggagagcccatatgcccctcctcaacctggcggcagcgcaaaagatg

SEQ ID NO: 124822 - DNA, 103 bp, Artificial Sequence
  Synthetic Polynucleotide
taatacgactcactatagggggggtggccgaaggagaggctggaggagggaacagaggagaccctccatgagcctctccaacctggcggcagcgcaaaagatg

SEQ ID NO: 124823 - DNA, 103 bp, Artificial Sequence
  Synthetic Polynucleotide
taatacgactcactatagggagtcgaggtgattgaagaagacgtccacctaacagaggagaaggtggatgtcttcttcaaacctggcggcagcgcaaaagatg

SEQ ID NO: 124824 - DNA, 103 bp, Artificial Sequence
  Synthetic Polynucleotide
taatacgactcactatagggtggacgggtgggggtggccgaaggagaggcaacagaggagagcctctatgtcggccaccaacctggcggcagcgcaaaagatg

SEQ ID NO: 124825 - DNA, 103 bp, Artificial Sequence
  Synthetic Polynucleotide
taatacgactcactataggggtcaccatgctggacgggtgggggtggccgaacagaggagacggccaatgccacccgtcaacctggcggcagcgcaaaagatg

SEQ ID NO: 124826 - DNA, 103 bp, Artificial Sequence
  Synthetic Polynucleotide
taatacgactcactataggggcccatggcggtcaccatgctggacgggtgaacagaggagacacccgatgagcatggtgaacctggcggcagcgcaaaagatg

SEQ ID NO: 124827 - DNA, 103 bp, Artificial Sequence
  Synthetic Polynucleotide
taatacgactcactatagggttgccctgcgagtcgaggtgattgaagaagaacagaggagacttcttatgtcacctcgaaacctggcggcagcgcaaaagatg

SEQ ID NO: 124828 - DNA, 103 bp, Artificial Sequence
  Synthetic Polynucleotide
taatacgactcactatagggatagtaggggttgccctgcgagtcgaggtgaacagaggagacacctcatgtcgcagggcaacctggcggcagcgcaaaagatg

SEQ ID NO: 124829 - DNA, 103 bp, Artificial Sequence
  Synthetic Polynucleotide
taatacgactcactatagggcggggttggcatagtaggggttgccctgcgaacagaggagacgcaggatgacccctactaacctggcggcagcgcaaaagatg

SEQ ID NO: 124830 - DNA, 103 bp, Artificial Sequence
  Synthetic Polynucleotide
taatacgactcactatagggcgcgcgtgagcggggttggcatagtaggggaacagaggagacccctaatgtgccaacccaacctggcggcagcgcaaaagatg

SEQ ID NO: 124831 - DNA, 103 bp, Artificial Sequence
  Synthetic Polynucleotide
taatacgactcactataggggacgcgcgcccgcgcgtgagcggggttggcaacagaggagagccaacatggctcacgcgaacctggcggcagcgcaaaagatg

SEQ ID NO: 124832 - DNA, 103 bp, Artificial Sequence
  Synthetic Polynucleotide
taatacgactcactatagggggtgcgccatccagcgcggctgctcgggcgaacagaggagacgcccgatgagccgcgctaacctggcggcagcgcaaaagatg

SEQ ID NO: 124833 - DNA, 103 bp, Artificial Sequence
  Synthetic Polynucleotide
taatacgactcactatagggggctgtaggagacgcgcgcccgcgcgtgagaacagaggagactcacgatggggcgcgcgaacctggcggcagcgcaaaagatg

SEQ ID NO: 124834 - DNA, 103 bp, Artificial Sequence
  Synthetic Polynucleotide
taatacgactcactataggggcgtgcgcggggctgtaggagacgcgcgccaacagaggagaggcgcgatgctcctacagaacctggcggcagcgcaaaagatg

SEQ ID NO: 124835 - DNA, 103 bp, Artificial Sequence
  Synthetic Polynucleotide
taatacgactcactatagggggtcaggcgggcgtgcgcggggctgtaggaaacagaggagatcctacatgcccgcgcacaacctggcggcagcgcaaaagatg

SEQ ID NO: 124836 - DNA, 103 bp, Artificial Sequence
  Synthetic Polynucleotide
taatacgactcactatagggtctggcctccggtcaggcgggcgtgcgcggaacagaggagaccgcgcatgcccgcctgaaacctggcggcagcgcaaaagatg

SEQ ID NO: 124837 - DNA, 103 bp, Artificial Sequence
  Synthetic Polynucleotide
taatacgactcactataggggggcggcacatctggcctccggtcaggcggaacagaggagaccgcctatgcggaggccaaacctggcggcagcgcaaaagatg

SEQ ID NO: 124838 - DNA, 103 bp, Artificial Sequence
  Synthetic Polynucleotide
taatacgactcactatagggcaacaagtgtgggcggcacatctggcctccaacagaggagaggaggcatgatgtgccgcaacctggcggcagcgcaaaagatg

SEQ ID NO: 124839 - DNA, 103 bp, Artificial Sequence
  Synthetic Polynucleotide
taatacgactcactatagggccgggctgtgcaacaagtgtgggcggcacaaacagaggagatgtgccatgcacacttgtaacctggcggcagcgcaaaagatg

SEQ ID NO: 124840 - DNA, 103 bp, Artificial Sequence
  Synthetic Polynucleotide
taatacgactcactatagggcagggcaaacccgggctgtgcaacaagtgtaacagaggagaacacttatggcacagcccaacctggcggcagcgcaaaagatg

SEQ ID NO: 124841 - DNA, 103 bp, Artificial Sequence
  Synthetic Polynucleotide
taatacgactcactatagggcccgtccagccagggcaaacccgggctgtgaacagaggagacacagcatgggtttgcccaacctggcggcagcgcaaaagatg

SEQ ID NO: 124842 - DNA, 103 bp, Artificial Sequence
  Synthetic Polynucleotide
taatacgactcactatagggctgctttgcccccgtccagccagggcaaacaacagaggagagtttgcatgggctggacgaacctggcggcagcgcaaaagatg

SEQ ID NO: 124843 - DNA, 103 bp, Artificial Sequence
  Synthetic Polynucleotide
taatacgactcactatagggagcacggccgggtgcgccatccagcgcggcaacagaggagagccgcgatggatggcgcaaacctggcggcagcgcaaaagatg

SEQ ID NO: 124844 - DNA, 103 bp, Artificial Sequence
  Synthetic Polynucleotide
taatacgactcactataggggcagagagggctgctttgcccccgtccagcaacagaggagagctggaatggggcaaagcaacctggcggcagcgcaaaagatg

SEQ ID NO: 124845 - DNA, 103 bp, Artificial Sequence
  Synthetic Polynucleotide
taatacgactcactatagggggccgcagcggcagagagggctgctttgccaacagaggagaggcaaaatggccctctctaacctggcggcagcgcaaaagatg

SEQ ID NO: 124846 - DNA, 103 bp, Artificial Sequence
  Synthetic Polynucleotide
taatacgactcactatagggtgtggtggtgggccgcagcggcagagagggaacagaggagaccctctatgccgctgcggaacctggcggcagcgcaaaagatg

SEQ ID NO: 124847 - DNA, 103 bp, Artificial Sequence
  Synthetic Polynucleotide
taatacgactcactataggggtccaggggttgtggtggtgggccgcagcgaacagaggagacgctgcatgccaccaccaaacctggcggcagcgcaaaagatg

SEQ ID NO: 124848 - DNA, 103 bp, Artificial Sequence
  Synthetic Polynucleotide
taatacgactcactatagggggggctcacggtccaggggttgtggtggtgaacagaggagacaccacatgaacccctggaacctggcggcagcgcaaaagatg

SEQ ID NO: 124849 - DNA, 103 bp, Artificial Sequence
  Synthetic Polynucleotide
taatacgactcactatagggtcttggagaaggggctcacggtccaggggtaacagaggagaacccctatgccgtgagccaacctggcggcagcgcaaaagatg

SEQ ID NO: 124850 - DNA, 103 bp, Artificial Sequence
  Synthetic Polynucleotide
taatacgactcactatagggtgcagtggcgtcttggagaaggggctcacgaacagaggagacgtgagatgcttctccaaaacctggcggcagcgcaaaagatg

SEQ ID NO: 124851 - DNA, 103 bp, Artificial Sequence
  Synthetic Polynucleotide
taatacgactcactatagggagctgaggggtgcagtggcgtcttggagaaaacagaggagattctccatgacgccactgaacctggcggcagcgcaaaagatg

SEQ ID NO: 124852 - DNA, 103 bp, Artificial Sequence
  Synthetic Polynucleotide
taatacgactcactatagggggcctccagcagctgaggggtgcagtggcgaacagaggagacgccacatgacccctcagaacctggcggcagcgcaaaagatg

SEQ ID NO: 124853 - DNA, 103 bp, Artificial Sequence
  Synthetic Polynucleotide
taatacgactcactataggggggcctccagggcctccagcagctgaggggaacagaggagacccctcatgtgctggaggaacctggcggcagcgcaaaagatg

SEQ ID NO: 124854 - DNA, 103 bp, Artificial Sequence
  Synthetic Polynucleotide
taatacgactcactatagggctgcgcattcagcacggccgggtgcgccataacagaggagaatggcgatgccggccgtgaacctggcggcagcgcaaaagatg

SEQ ID NO: 124855 - DNA, 103 bp, Artificial Sequence
  Synthetic Polynucleotide
taatacgactcactatagggcacagagagtgggcctccagggcctccagcaacagaggagagctggaatgcctggaggcaacctggcggcagcgcaaaagatg

SEQ ID NO: 124856 - DNA, 103 bp, Artificial Sequence
  Synthetic Polynucleotide
taatacgactcactatagggcccctgggtacacagagagtgggcctccagaacagaggagactggagatgcactctctgaacctggcggcagcgcaaaagatg

SEQ ID NO: 124857 - DNA, 103 bp, Artificial Sequence
  Synthetic Polynucleotide
taatacgactcactatagggccacccccagcccctgggtacacagagagtaacagaggagaactctcatggtacccaggaacctggcggcagcgcaaaagatg

SEQ ID NO: 124858 - DNA, 103 bp, Artificial Sequence
  Synthetic Polynucleotide
taatacgactcactatagggtcccccgctcccacccccagcccctgggtaaacagaggagatacccaatggctgggggtaacctggcggcagcgcaaaagatg

SEQ ID NO: 124859 - DNA, 103 bp, Artificial Sequence
  Synthetic Polynucleotide
taatacgactcactatagggtcccgctgcctcccccgctcccacccccagaacagaggagactggggatgggagcggggaacctggcggcagcgcaaaagatg

SEQ ID NO: 124860 - DNA, 103 bp, Artificial Sequence
  Synthetic Polynucleotide
taatacgactcactataggggccactgagctcccgctgcctcccccgctcaacagaggagagagcggatgaggcagcggaacctggcggcagcgcaaaagatg

SEQ ID NO: 124861 - DNA, 103 bp, Artificial Sequence
  Synthetic Polynucleotide
taatacgactcactatagggggtgagggaggccactgagctcccgctgccaacagaggagaggcagcatgagctcagtgaacctggcggcagcgcaaaagatg

SEQ ID NO: 124862 - DNA, 103 bp, Artificial Sequence
  Synthetic Polynucleotide
taatacgactcactatagggctgctgtaggggtgagggaggccactgagcaacagaggagagctcagatgcctccctcaaacctggcggcagcgcaaaagatg

SEQ ID NO: 124863 - DNA, 103 bp, Artificial Sequence
  Synthetic Polynucleotide
taatacgactcactatagggccagagtgggctgctgtaggggtgagggagaacagaggagactccctatgccctacagcaacctggcggcagcgcaaaagatg

SEQ ID NO: 124864 - DNA, 103 bp, Artificial Sequence
  Synthetic Polynucleotide
taatacgactcactatagggaaggtgggagccagagtgggctgctgtaggaacagaggagacctacaatggcccactctaacctggcggcagcgcaaaagatg

SEQ ID NO: 124865 - DNA, 103 bp, Artificial Sequence
  Synthetic Polynucleotide
taatacgactcactatagggagtcggggtgctgcgcattcagcacggccgaacagaggagacggccgatgtgaatgcgcaacctggcggcagcgcaaaagatg

SEQ ID NO: 124866 - DNA, 103 bp, Artificial Sequence
  Synthetic Polynucleotide
taatacgactcactatagggggaagccgaaaaggtgggagccagagtgggaacagaggagacccactatggctcccaccaacctggcggcagcgcaaaagatg

SEQ ID NO: 124867 - DNA, 103 bp, Artificial Sequence
  Synthetic Polynucleotide
taatacgactcactatagggggcgtgggtgggaagccgaaaaggtgggagaacagaggagactcccaatgtttcggcttaacctggcggcagcgcaaaagatg

SEQ ID NO: 124868 - DNA, 103 bp, Artificial Sequence
  Synthetic Polynucleotide
taatacgactcactatagggttctttgggtggcgtgggtgggaagccgaaaacagaggagattcggcatgccacccacgaacctggcggcagcgcaaaagatg

SEQ ID NO: 124869 - DNA, 103 bp, Artificial Sequence
  Synthetic Polynucleotide
taatacgactcactatagggcaggagacacttctttgggtggcgtgggtgaacagaggagacacccaatgcacccaaagaacctggcggcagcgcaaaagatg

SEQ ID NO: 124870 - DNA, 103 bp, Artificial Sequence
  Synthetic Polynucleotide
taatacgactcactataggggtgctagggtcaggagacacttctttgggtaacagaggagaacccaaatgagtgtctccaacctggcggcagcgcaaaagatg

SEQ ID NO: 124871 - DNA, 103 bp, Artificial Sequence
  Synthetic Polynucleotide
taatacgactcactatagggagcccccgtggtgctagggtcaggagacacaacagaggagagtgtctatggaccctagcaacctggcggcagcgcaaaagatg

SEQ ID NO: 124872 - DNA, 103 bp, Artificial Sequence
  Synthetic Polynucleotide
taatacgactcactatagggctggagacgcagcccccgtggtgctagggtaacagaggagaaccctaatgccacgggggaacctggcggcagcgcaaaagatg

SEQ ID NO: 124873 - DNA, 103 bp, Artificial Sequence
  Synthetic Polynucleotide
taatacgactcactataggggaagatgaggctggagacgcagcccccgtgaacagaggagacacgggatgtgcgtctccaacctggcggcagcgcaaaagatg

SEQ ID NO: 124874 - DNA, 103 bp, Artificial Sequence
  Synthetic Polynucleotide
taatacgactcactatagggaccccccgcggaagatgaggctggagacgcaacagaggagagcgtctatggcctcatctaacctggcggcagcgcaaaagatg

SEQ ID NO: 124875 - DNA, 103 bp, Artificial Sequence
  Synthetic Polynucleotide
taatacgactcactataggggggctgcactaccccccgcggaagatgaggaacagaggagacctcatatgccgcgggggaacctggcggcagcgcaaaagatg

SEQ ID NO: 124876 - DNA, 103 bp, Artificial Sequence
  Synthetic Polynucleotide
taatacgactcactataggggggtggtgtgagtcggggtgctgcgcattcaacagaggagagaatgcatggcaccccgaaacctggcggcagcgcaaaagatg

SEQ ID NO: 124877 - DNA, 103 bp, Artificial Sequence
  Synthetic Polynucleotide
taatacgactcactatagggtcctctcctcgggctgcactaccccccgcgaacagaggagacgcgggatgtagtgcagcaacctggcggcagcgcaaaagatg

SEQ ID NO: 124878 - DNA, 103 bp, Artificial Sequence
  Synthetic Polynucleotide
taatacgactcactataggggccgtccttgtcctctcctcgggctgcactaacagaggagaagtgcaatgcgaggagagaacctggcggcagcgcaaaagatg

SEQ ID NO: 124879 - DNA, 103 bp, Artificial Sequence
  Synthetic Polynucleotide
taatacgactcactatagggggtacttgacgccgtccttgtcctctcctcaacagaggagagaggagatgacaaggacgaacctggcggcagcgcaaaagatg

SEQ ID NO: 124880 - DNA, 103 bp, Artificial Sequence
  Synthetic Polynucleotide
taatacgactcactatagggagtgacacctggtacttgacgccgtccttgaacagaggagacaaggaatgcgtcaagtaaacctggcggcagcgcaaaagatg

SEQ ID NO: 124881 - DNA, 103 bp, Artificial Sequence
  Synthetic Polynucleotide
taatacgactcactataggggctctccgtcagtgacacctggtacttgacaacagaggagagtcaagatgcaggtgtcaaacctggcggcagcgcaaaagatg

SEQ ID NO: 124882 - DNA, 103 bp, Artificial Sequence
  Synthetic Polynucleotide
taatacgactcactatagggccatcttcatgctctccgtcagtgacacctaacagaggagaaggtgtatgtgacggagaaacctggcggcagcgcaaaagatg

SEQ ID NO: 124883 - DNA, 103 bp, Artificial Sequence
  Synthetic Polynucleotide
taatacgactcactatagggctgccactttccatcttcatgctctccgtcaacagaggagagacggaatgcatgaagataacctggcggcagcgcaaaagatg

SEQ ID NO: 124884 - DNA, 103 bp, Artificial Sequence
  Synthetic Polynucleotide
taatacgactcactataggggcgcaggggactgccactttccatcttcataacagaggagaatgaagatggaaagtggcaacctggcggcagcgcaaaagatg

SEQ ID NO: 124885 - DNA, 103 bp, Artificial Sequence
  Synthetic Polynucleotide
taatacgactcactatagggctaggcctgggcgcaggggactgccactttaacagaggagaaaagtgatggtcccctgcaacctggcggcagcgcaaaagatg

SEQ ID NO: 124886 - DNA, 103 bp, Artificial Sequence
  Synthetic Polynucleotide
taatacgactcactatagggcccatagtagctaggcctgggcgcaggggaaacagaggagatcccctatgcccaggcctaacctggcggcagcgcaaaagatg

SEQ ID NO: 124887 - DNA, 103 bp, Artificial Sequence
  Synthetic Polynucleotide
taatacgactcactatagggcgccaggcccgggtggtgtgagtcggggtgaacagaggagacaccccatgtcacaccacaacctggcggcagcgcaaaagatg

SEQ ID NO: 124888 - DNA, 103 bp, Artificial Sequence
  Synthetic Polynucleotide
taatacgactcactatagggaggctgggtgcccatagtagctaggcctggaacagaggagaccaggcatggctactatgaacctggcggcagcgcaaaagatg

SEQ ID NO: 124889 - DNA, 103 bp, Artificial Sequence
  Synthetic Polynucleotide
taatacgactcactatagggggtgtgtagcaggctgggtgcccatagtagaacagaggagactactaatggcacccagcaacctggcggcagcgcaaaagatg

SEQ ID NO: 124890 - DNA, 103 bp, Artificial Sequence
  Synthetic Polynucleotide
taatacgactcactataggggggatggggtggtgtgtagcaggctgggtgaacagaggagacacccaatgtgctacacaaacctggcggcagcgcaaaagatg

SEQ ID NO: 124891 - DNA, 103 bp, Artificial Sequence
  Synthetic Polynucleotide
taatacgactcactatagggggggtaggtggggatggggtggtgtgtagcaacagaggagagctacaatgcaccccatcaacctggcggcagcgcaaaagatg

SEQ ID NO: 124892 - DNA, 103 bp, Artificial Sequence
  Synthetic Polynucleotide
taatacgactcactataggggcacataggaggggtaggtggggatggggtaacagaggagaaccccaatgccacctaccaacctggcggcagcgcaaaagatg

SEQ ID NO: 124893 - DNA, 103 bp, Artificial Sequence
  Synthetic Polynucleotide
taatacgactcactataggggcagccgccggcacataggaggggtaggtgaacagaggagacacctaatgctcctatgtaacctggcggcagcgcaaaagatg

SEQ ID NO: 124894 - DNA, 103 bp, Artificial Sequence
  Synthetic Polynucleotide
taatacgactcactataggggtagtcgtgggcagccgccggcacataggaaacagaggagatcctatatgccggcggctaacctggcggcagcgcaaaagatg

SEQ ID NO: 124895 - DNA, 103 bp, Artificial Sequence
  Synthetic Polynucleotide
taatacgactcactataggggtccgctgctgtagtcgtgggcagccgccgaacagaggagacggcggatgcccacgactaacctggcggcagcgcaaaagatg

SEQ ID NO: 124896 - DNA, 103 bp, Artificial Sequence
  Synthetic Polynucleotide
taatacgactcactataggggggtggaagagtccgctgctgtagtcgtggaacagaggagaccacgaatgcagcagcggaacctggcggcagcgcaaaagatg

SEQ ID NO: 124897 - DNA, 103 bp, Artificial Sequence
  Synthetic Polynucleotide
taatacgactcactataggggaagcctccggggtggaagagtccgctgctaacagaggagaagcagcatgctcttccacaacctggcggcagcgcaaaagatg

SEQ ID NO: 124898 - DNA, 103 bp, Artificial Sequence
  Synthetic Polynucleotide
taatacgactcactatagggtgtagttgtgcgccaggcccgggtggtgtgaacagaggagacacaccatgcgggcctggaacctggcggcagcgcaaaagatg

SEQ ID NO: 124899 - DNA, 103 bp, Artificial Sequence
  Synthetic Polynucleotide
taatacgactcactataggggtccccccaggaagcctccggggtggaagaaacagaggagatcttccatgccggaggctaacctggcggcagcgcaaaagatg

SEQ ID NO: 124900 - DNA, 103 bp, Artificial Sequence
  Synthetic Polynucleotide
taatacgactcactatagggctggaggccggtccccccaggaagcctccgaacagaggagacggaggatgcctggggggaacctggcggcagcgcaaaagatg

SEQ ID NO: 124901 - DNA, 103 bp, Artificial Sequence
  Synthetic Polynucleotide
taatacgactcactatagggaggggtgaagctggaggccggtccccccagaacagaggagactggggatgccggcctccaacctggcggcagcgcaaaagatg

SEQ ID NO: 124902 - DNA, 103 bp, Artificial Sequence
  Synthetic Polynucleotide
taatacgactcactatagggtgcgctgcttaggggtgaagctggaggccgaacagaggagacggcctatggcttcacccaacctggcggcagcgcaaaagatg

SEQ ID NO: 124903 - DNA, 103 bp, Artificial Sequence
  Synthetic Polynucleotide
taatacgactcactatagggcgagccttgctgcgctgcttaggggtgaagaacagaggagacttcacatgtaagcagcgaacctggcggcagcgcaaaagatg

SEQ ID NO: 124904 - DNA, 103 bp, Artificial Sequence
  Synthetic Polynucleotide
taatacgactcactatagggtgaacaggaacgagccttgctgcgctgcttaacagaggagaaagcagatgagcaaggctaacctggcggcagcgcaaaagatg

SEQ ID NO: 124905 - DNA, 103 bp, Artificial Sequence
  Synthetic Polynucleotide
taatacgactcactatagggcccggccttctgaacaggaacgagccttgcaacagaggagagcaaggatggttcctgttaacctggcggcagcgcaaaagatg

SEQ ID NO: 124906 - DNA, 103 bp, Artificial Sequence
  Synthetic Polynucleotide
taatacgactcactatagggttgacacactcccggccttctgaacaggaaaacagaggagattcctgatgagaaggccgaacctggcggcagcgcaaaagatg

SEQ ID NO: 124907 - DNA, 103 bp, Artificial Sequence
  Synthetic Polynucleotide
taatacgactcactatagggggccccacagttgacacactcccggccttcaacagaggagagaaggcatggagtgtgtcaacctggcggcagcgcaaaagatg

SEQ ID NO: 124908 - DNA, 103 bp, Artificial Sequence
  Synthetic Polynucleotide
taatacgactcactataggggggtggctgtggccccacagttgacacactaacagaggagaagtgtgatgactgtggggaacctggcggcagcgcaaaagatg

SEQ ID NO: 124909 - DNA, 103 bp, Artificial Sequence
  Synthetic Polynucleotide
taatacgactcactataggggcgggttccatgtagttgtgcgccaggcccaacagaggagagggcctatggcacaactaaacctggcggcagcgcaaaagatg

SEQ ID NO: 124910 - DNA, 103 bp, Artificial Sequence
  Synthetic Polynucleotide
taatacgactcactatagggcgccagagaggggtggctgtggccccacagaacagaggagactgtggatgcacagccacaacctggcggcagcgcaaaagatg

SEQ ID NO: 124911 - DNA, 103 bp, Artificial Sequence
  Synthetic Polynucleotide
taatacgactcactataggggccgtcccgccgccagagaggggtggctgtaacagaggagaacagccatgcctctctggaacctggcggcagcgcaaaagatg

SEQ ID NO: 124912 - DNA, 103 bp, Artificial Sequence
  Synthetic Polynucleotide
taatacgactcactatagggagtggccggtgccgtcccgccgccagagagaacagaggagactctctatgggcgggacgaacctggcggcagcgcaaaagatg

SEQ ID NO: 124913 - DNA, 103 bp, Artificial Sequence
  Synthetic Polynucleotide
taatacgactcactatagggttgcacaggtagtggccggtgccgtcccgcaacagaggagagcgggaatgcaccggccaaacctggcggcagcgcaaaagatg

SEQ ID NO: 124914 - DNA, 103 bp, Artificial Sequence
  Synthetic Polynucleotide
taatacgactcactataggggccacaggcattgcacaggtagtggccggtaacagaggagaaccggcatgtacctgtgcaacctggcggcagcgcaaaagatg

SEQ ID NO: 124915 - DNA, 103 bp, Artificial Sequence
  Synthetic Polynucleotide
taatacgactcactatagggtgtggtagaggccacaggcattgcacaggtaacagaggagaacctgtatgatgcctgtgaacctggcggcagcgcaaaagatg

SEQ ID NO: 124916 - DNA, 103 bp, Artificial Sequence
  Synthetic Polynucleotide
taatacgactcactatagggccattcatcttgtggtagaggccacaggcaaacagaggagatgcctgatgcctctaccaaacctggcggcagcgcaaaagatg

SEQ ID NO: 124917 - DNA, 103 bp, Artificial Sequence
  Synthetic Polynucleotide
taatacgactcactatagggtcggttctgcccattcatcttgtggtagagaacagaggagactctacatgaagatgaataacctggcggcagcgcaaaagatg

SEQ ID NO: 124918 - DNA, 103 bp, Artificial Sequence
  Synthetic Polynucleotide
taatacgactcactatagggtgatgagtggtcggttctgcccattcatctaacagaggagaagatgaatgggcagaaccaacctggcggcagcgcaaaagatg

SEQ ID NO: 124919 - DNA, 103 bp, Artificial Sequence
  Synthetic Polynucleotide
taatacgactcactatagggcgcttgggcttgatgagtggtcggttctgcaacagaggagagcagaaatgaccactcataacctggcggcagcgcaaaagatg

SEQ ID NO: 124920 - DNA, 103 bp, Artificial Sequence
  Synthetic Polynucleotide
taatacgactcactatagggccagcgcggctggtccgccgtcacctccataacagaggagaatggagatgacggcggacaacctggcggcagcgcaaaagatg

SEQ ID NO: 124921 - DNA, 103 bp, Artificial Sequence
  Synthetic Polynucleotide
taatacgactcactatagggctgcgccgcgtccatgtaggagtggctgagaacagaggagactcagcatgtcctacatgaacctggcggcagcgcaaaagatg

SEQ ID NO: 124922 - DNA, 103 bp, Artificial Sequence
  Synthetic Polynucleotide
taatacgactcactatagggggcattgcagacagggtccccattggcattaacagaggagaaatgccatgggggaccctaacctggcggcagcgcaaaagatg

SEQ ID NO: 124923 - DNA, 103 bp, Artificial Sequence
  Synthetic Polynucleotide
taatacgactcactatagggagagcccacaggcattgcagacagggtcccaacagaggagagggaccatgtctgcaatgaacctggcggcagcgcaaaagatg

SEQ ID NO: 124924 - DNA, 103 bp, Artificial Sequence
  Synthetic Polynucleotide
taatacgactcactatagggagcttgtagtagagcccacaggcattgcagaacagaggagactgcaaatgctgtgggctaacctggcggcagcgcaaaagatg

SEQ ID NO: 124925 - DNA, 103 bp, Artificial Sequence
  Synthetic Polynucleotide
taatacgactcactatagggaatattgtgaagcttgtagtagagcccacaaacagaggagatgtgggatgtactacaagaacctggcggcagcgcaaaagatg

SEQ ID NO: 124926 - DNA, 103 bp, Artificial Sequence
  Synthetic Polynucleotide
taatacgactcactatagggggggtctgttaatattgtgaagcttgtagtaacagaggagaactacaatgttcacaataaacctggcggcagcgcaaaagatg

SEQ ID NO: 124927 - DNA, 103 bp, Artificial Sequence
  Synthetic Polynucleotide
taatacgactcactatagggttcatagtcaggggtctgttaatattgtgaaacagaggagatcacaaatgtaacagaccaacctggcggcagcgcaaaagatg

SEQ ID NO: 124928 - DNA, 103 bp, Artificial Sequence
  Synthetic Polynucleotide
taatacgactcactataggggccttccttcttcatagtcaggggtctgttaacagaggagaaacagaatgctgactatgaacctggcggcagcgcaaaagatg

SEQ ID NO: 124929 - DNA, 103 bp, Artificial Sequence
  Synthetic Polynucleotide
taatacgactcactatagggtggtctggatgccttccttcttcatagtcaaacagaggagatgactaatgagaaggaagaacctggcggcagcgcaaaagatg

SEQ ID NO: 124930 - DNA, 103 bp, Artificial Sequence
  Synthetic Polynucleotide
taatacgactcactatagggtttcggtttctggtctggatgccttccttcaacagaggagagaaggaatgcatccagacaacctggcggcagcgcaaaagatg

SEQ ID NO: 124931 - DNA, 103 bp, Artificial Sequence
  Synthetic Polynucleotide
taatacgactcactataggggctagacatttttcggtttctggtctggataacagaggagaatccagatgagaaaccgaaacctggcggcagcgcaaaagatg

SEQ ID NO: 124932 - DNA, 103 bp, Artificial Sequence
  Synthetic Polynucleotide
taatacgactcactataggggcagcgggtactgcgccgcgtccatgtaggaacagaggagacctacaatgacgcggcgcaacctggcggcagcgcaaaagatg

SEQ ID NO: 124933 - DNA, 103 bp, Artificial Sequence
  Synthetic Polynucleotide
taatacgactcactatagggttttggatttgctagacatttttcggtttcaacagaggagagaaaccatgaaatgtctaaacctggcggcagcgcaaaagatg

SEQ ID NO: 124934 - DNA, 103 bp, Artificial Sequence
  Synthetic Polynucleotide
taatacgactcactatagggtttttgcactttttggatttgctagacattaacagaggagaaatgtcatgcaaatccaaaacctggcggcagcgcaaaagatg

SEQ ID NO: 124935 - DNA, 103 bp, Artificial Sequence
  Synthetic Polynucleotide
taatacgactcactataggggtcatgcacttttttgcactttttggatttaacagaggagaaaatccatgaagtgcaaaaacctggcggcagcgcaaaagatg

SEQ ID NO: 124936 - DNA, 103 bp, Artificial Sequence
  Synthetic Polynucleotide
taatacgactcactatagggcctccagtgagtcatgcacttttttgcactaacagaggagaagtgcaatgaagtgcatgaacctggcggcagcgcaaaagatg

SEQ ID NO: 124937 - DNA, 103 bp, Artificial Sequence
  Synthetic Polynucleotide
taatacgactcactatagggttggggaagtcctccagtgagtcatgcactaacagaggagaagtgcaatgctcactggaaacctggcggcagcgcaaaagatg

SEQ ID NO: 124938 - DNA, 103 bp, Artificial Sequence
  Synthetic Polynucleotide
taatacgactcactatagggcgagctgttcttggggaagtcctccagtgaaacagaggagatcactgatggacttccccaacctggcggcagcgcaaaagatg

SEQ ID NO: 124939 - DNA, 103 bp, Artificial Sequence
  Synthetic Polynucleotide
taatacgactcactatagggccgggttaaacgagctgttcttggggaagtaacagaggagaacttccatgagaacagctaacctggcggcagcgcaaaagatg

SEQ ID NO: 124940 - DNA, 103 bp, Artificial Sequence
  Synthetic Polynucleotide
taatacgactcactataggggagagggcggccgggttaaacgagctgttcaacagaggagagaacagatggtttaacccaacctggcggcagcgcaaaagatg

SEQ ID NO: 124941 - DNA, 103 bp, Artificial Sequence
  Synthetic Polynucleotide
taatacgactcactatagggcatgtgtctggagagggcggccgggttaaaaacagaggagatttaacatggccgccctcaacctggcggcagcgcaaaagatg

SEQ ID NO: 124942 - DNA, 103 bp, Artificial Sequence
  Synthetic Polynucleotide
taatacgactcactatagggtcagggaggacatgtgtctggagagggcggaacagaggagaccgcccatgccagacacaaacctggcggcagcgcaaaagatg

SEQ ID NO: 124943 - DNA, 103 bp, Artificial Sequence
  Synthetic Polynucleotide
taatacgactcactatagggacctcctccggcagcgggtactgcgccgcgaacagaggagacgcggcatggtacccgctaacctggcggcagcgcaaaagatg

SEQ ID NO: 124944 - DNA, 103 bp, Artificial Sequence
  Synthetic Polynucleotide
taatacgactcactataggggagatgtggctcagggaggacatgtgtctgaacagaggagacagacaatggtcctccctaacctggcggcagcgcaaaagatg

SEQ ID NO: 124945 - DNA, 103 bp, Artificial Sequence
  Synthetic Polynucleotide
taatacgactcactataggggctgaagggcgagatgtggctcagggaggaaacagaggagatcctccatgagccacatcaacctggcggcagcgcaaaagatg

SEQ ID NO: 124946 - DNA, 103 bp, Artificial Sequence
  Synthetic Polynucleotide
taatacgactcactatagggggctggagtggctgaagggcgagatgtggcaacagaggagagccacaatgcgcccttcaaacctggcggcagcgcaaaagatg

SEQ ID NO: 124947 - DNA, 103 bp, Artificial Sequence
  Synthetic Polynucleotide
taatacgactcactataggggtcagcatgtggctggagtggctgaagggcaacagaggagagcccttatgccactccagaacctggcggcagcgcaaaagatg

SEQ ID NO: 124948 - DNA, 103 bp, Artificial Sequence
  Synthetic Polynucleotide
taatacgactcactatagggcgtgggcgtggtcagcatgtggctggagtgaacagaggagacactccatgcacatgctgaacctggcggcagcgcaaaagatg

SEQ ID NO: 124949 - DNA, 103 bp, Artificial Sequence
  Synthetic Polynucleotide
taatacgactcactatagggggtgcatcggcgtgggcgtggtcagcatgtaacagaggagaacatgcatgccacgcccaaacctggcggcagcgcaaaagatg

SEQ ID NO: 124950 - DNA, 103 bp, Artificial Sequence
  Synthetic Polynucleotide
taatacgactcactatagggctggatggcgggtgcatcggcgtgggcgtgaacagaggagacacgccatggccgatgcaaacctggcggcagcgcaaaagatg

SEQ ID NO: 124951 - DNA, 103 bp, Artificial Sequence
  Synthetic Polynucleotide
taatacgactcactatagggaaaggacaggctggatggcgggtgcatcggaacagaggagaccgatgatgccgccatccaacctggcggcagcgcaaaagatg

SEQ ID NO: 124952 - DNA, 103 bp, Artificial Sequence
  Synthetic Polynucleotide
taatacgactcactatagggggtgtggtccaaaggacaggctggatggcgaacagaggagacgccatatggcctgtcctaacctggcggcagcgcaaaagatg

SEQ ID NO: 124953 - DNA, 103 bp, Artificial Sequence
  Synthetic Polynucleotide
taatacgactcactatagggctggaggggtggtgtggtccaaaggacaggaacagaggagacctgtcatgtggaccacaaacctggcggcagcgcaaaagatg

SEQ ID NO: 124954 - DNA, 103 bp, Artificial Sequence
  Synthetic Polynucleotide
taatacgactcactatagggaagcacatccacctcctccggcagcgggtaaacagaggagatacccgatgccggaggagaacctggcggcagcgcaaaagatg

SEQ ID NO: 124955 - DNA, 103 bp, Artificial Sequence
  Synthetic Polynucleotide
taatacgactcactatagggggtgaccatgctggaggggtggtgtggtccaacagaggagaggaccaatgcacccctccaacctggcggcagcgcaaaagatg

SEQ ID NO: 124956 - DNA, 103 bp, Artificial Sequence
  Synthetic Polynucleotide
taatacgactcactatagggaacccatggcggtgaccatgctggaggggtaacagaggagaacccctatggcatggtcaaacctggcggcagcgcaaaagatg

SEQ ID NO: 124957 - DNA, 103 bp, Artificial Sequence
  Synthetic Polynucleotide
taatacgactcactatagggcgatgttaaaaagcacatccacctcctccgaacagaggagacggaggatgtggatgtgcaacctggcggcagcgcaaaagatg

SEQ ID NO: 124958 - DNA, 103 bp, Artificial Sequence
  Synthetic Polynucleotide
taatacgactcactatagggccttgaccgtcgatgttaaaaagcacatccaacagaggagaggatgtatgttttaacataacctggcggcagcgcaaaagatg

SEQ ID NO: 124959 - DNA, 103 bp, Artificial Sequence
  Synthetic Polynucleotide
taatacgactcactataggggacgtggttgccttgaccgtcgatgttaaaaacagaggagatttaacatggacggtcaaaacctggcggcagcgcaaaagatg

SEQ ID NO: 124960 - DNA, 103 bp, Artificial Sequence
  Synthetic Polynucleotide
taatacgactcactatagggagtagggcgggacgtggttgccttgaccgtaacagaggagaacggtcatggcaaccacgaacctggcggcagcgcaaaagatg

SEQ ID NO: 124961 - DNA, 103 bp, Artificial Sequence
  Synthetic Polynucleotide
taatacgactcactataggggagtttccgtagtagggcgggacgtggttgaacagaggagacaaccaatgcccgccctaaacctggcggcagcgcaaaagatg

SEQ ID NO: 124962 - DNA, 103 bp, Artificial Sequence
  Synthetic Polynucleotide
taatacgactcactatagggggccctgaccgagtttccgtagtagggcggaacagaggagaccgcccatgtacggaaacaacctggcggcagcgcaaaagatg

SEQ ID NO: 124963 - DNA, 103 bp, Artificial Sequence
  Synthetic Polynucleotide
taatacgactcactatagggggtggctcacccagcgcggctggtccgccgaacagaggagacggcggatgagccgcgctaacctggcggcagcgcaaaagatg

SEQ ID NO: 124964 - DNA, 103 bp, Artificial Sequence
  Synthetic Polynucleotide
taatacgactcactatagggtctgcaccgtggccctgaccgagtttccgtaacagaggagaacggaaatgcggtcagggaacctggcggcagcgcaaaagatg

SEQ ID NO: 124965 - DNA, 103 bp, Artificial Sequence
  Synthetic Polynucleotide
taatacgactcactatagggggagggtacctctgcaccgtggccctgaccaacagaggagaggtcagatgcacggtgcaaacctggcggcagcgcaaaagatg

SEQ ID NO: 124966 - DNA, 103 bp, Artificial Sequence
  Synthetic Polynucleotide
taatacgactcactataggggtggtgggtcggagggtacctctgcaccgtaacagaggagaacggtgatgaggtaccctaacctggcggcagcgcaaaagatg

SEQ ID NO: 124967 - DNA, 103 bp, Artificial Sequence
  Synthetic Polynucleotide
taatacgactcactatagggcctggctcccgtggtgggtcggagggtaccaacagaggagaggtaccatgcgacccaccaacctggcggcagcgcaaaagatg

SEQ ID NO: 124968 - DNA, 103 bp, Artificial Sequence
  Synthetic Polynucleotide
taatacgactcactataggggggcggcacacctggctcccgtggtgggtcaacagaggagagacccaatgcgggagccaaacctggcggcagcgcaaaagatg

SEQ ID NO: 124969 - DNA, 103 bp, Artificial Sequence
  Synthetic Polynucleotide
taatacgactcactatagggaagcagaggcgggcggcacacctggctcccaacagaggagagggagcatggtgtgccgcaacctggcggcagcgcaaaagatg

SEQ ID NO: 124970 - DNA, 103 bp, Artificial Sequence
  Synthetic Polynucleotide
taatacgactcactataggggggatccatgaagcagaggcgggcggcacaaacagaggagatgtgccatgcgcctctgcaacctggcggcagcgcaaaagatg

SEQ ID NO: 124971 - DNA, 103 bp, Artificial Sequence
  Synthetic Polynucleotide
taatacgactcactatagggagccagggtagggatccatgaagcagaggcaacagaggagagcctctatgtcatggatcaacctggcggcagcgcaaaagatg

SEQ ID NO: 124972 - DNA, 103 bp, Artificial Sequence
  Synthetic Polynucleotide
taatacgactcactataggggccgccgtccagccagggtagggatccatgaacagaggagacatggaatgctaccctggaacctggcggcagcgcaaaagatg

SEQ ID NO: 124973 - DNA, 103 bp, Artificial Sequence
  Synthetic Polynucleotide
taatacgactcactatagggccagggctttgccgccgtccagccagggtaaacagaggagataccctatgtggacggcgaacctggcggcagcgcaaaagatg

SEQ ID NO: 124974 - DNA, 103 bp, Artificial Sequence
  Synthetic Polynucleotide
taatacgactcactataggggcggggtggtggtggctcacccagcgcggcaacagaggagagccgcgatgggtgagccaaacctggcggcagcgcaaaagatg

SEQ ID NO: 124975 - DNA, 103 bp, Artificial Sequence
  Synthetic Polynucleotide
taatacgactcactatagggtggtggctgcccagggctttgccgccgtccaacagaggagaggacggatgcaaagccctaacctggcggcagcgcaaaagatg

SEQ ID NO: 124976 - DNA, 103 bp, Artificial Sequence
  Synthetic Polynucleotide
taatacgactcactatagggggaggcggtgtggtggctgcccagggctttaacagaggagaaaagccatgggcagccacaacctggcggcagcgcaaaagatg

SEQ ID NO: 124977 - DNA, 103 bp, Artificial Sequence
  Synthetic Polynucleotide
taatacgactcactataggggattccagggggaggcggtgtggtggctgcaacagaggagagcagccatgacaccgcctaacctggcggcagcgcaaaagatg

SEQ ID NO: 124978 - DNA, 103 bp, Artificial Sequence
  Synthetic Polynucleotide
taatacgactcactatagggaaggggctgagattccagggggaggcggtgaacagaggagacaccgcatgcccctggaaaacctggcggcagcgcaaaagatg

SEQ ID NO: 124979 - DNA, 103 bp, Artificial Sequence
  Synthetic Polynucleotide
taatacgactcactatagggcgtcttggagaaggggctgagattccagggaacagaggagaccctggatgctcagccccaacctggcggcagcgcaaaagatg

SEQ ID NO: 124980 - DNA, 103 bp, Artificial Sequence
  Synthetic Polynucleotide
taatacgactcactatagggggtggatggacgtcttggagaaggggctgaaacagaggagatcagccatgtctccaagaaacctggcggcagcgcaaaagatg

SEQ ID NO: 124981 - DNA, 103 bp, Artificial Sequence
  Synthetic Polynucleotide
taatacgactcactatagggggggagccgtggtggatggacgtcttggagaacagaggagactccaaatggtccatccaaacctggcggcagcgcaaaagatg

SEQ ID NO: 124982 - DNA, 103 bp, Artificial Sequence
  Synthetic Polynucleotide
taatacgactcactataggggaggggccccggggagccgtggtggatggaaacagaggagatccatcatgcacggctccaacctggcggcagcgcaaaagatg

SEQ ID NO: 124983 - DNA, 103 bp, Artificial Sequence
  Synthetic Polynucleotide
taatacgactcactatagggggtagacggagaggggccccggggagccgtaacagaggagaacggctatgcggggccccaacctggcggcagcgcaaaagatg

SEQ ID NO: 124984 - DNA, 103 bp, Artificial Sequence
  Synthetic Polynucleotide
taatacgactcactataggggaggccggggggtagacggagaggggccccaacagaggagaggggccatgctccgtctaaacctggcggcagcgcaaaagatg

SEQ ID NO: 124985 - DNA, 103 bp, Artificial Sequence
  Synthetic Polynucleotide
taatacgactcactataggggttgagcacggcggggtggtggtggctcacaacagaggagagtgagcatgcaccaccccaacctggcggcagcgcaaaagatg

SEQ ID NO: 124986 - DNA, 103 bp, Artificial Sequence
  Synthetic Polynucleotide
taatacgactcactatagggggaggaggacgaggccggggggtagacggaaacagaggagatccgtcatgcccccggccaacctggcggcagcgcaaaagatg

SEQ ID NO: 124987 - DNA, 103 bp, Artificial Sequence
  Synthetic Polynucleotide
taatacgactcactatagggcccccgacaaggaggaggacgaggccggggaacagaggagaccccggatgcgtcctcctaacctggcggcagcgcaaaagatg

SEQ ID NO: 124988 - DNA, 103 bp, Artificial Sequence
  Synthetic Polynucleotide
taatacgactcactatagggctggcgtggccccccgacaaggaggaggacaacagaggagagtcctcatgcttgtcgggaacctggcggcagcgcaaaagatg

SEQ ID NO: 124989 - DNA, 103 bp, Artificial Sequence
  Synthetic Polynucleotide
taatacgactcactataggggaggtgcgggctggcgtggccccccgacaaaacagaggagattgtcgatgggccacgccaacctggcggcagcgcaaaagatg

SEQ ID NO: 124990 - DNA, 103 bp, Artificial Sequence
  Synthetic Polynucleotide
taatacgactcactatagggggaaggtgaagaggtgcgggctggcgtggcaacagaggagagccacgatggcccgcaccaacctggcggcagcgcaaaagatg

SEQ ID NO: 124991 - DNA, 103 bp, Artificial Sequence
  Synthetic Polynucleotide
taatacgactcactatagggggggtgggcgggaaggtgaagaggtgcgggaacagaggagacccgcaatgcttcaccttaacctggcggcagcgcaaaagatg

SEQ ID NO: 124992 - DNA, 103 bp, Artificial Sequence
  Synthetic Polynucleotide
taatacgactcactataggggtccttcggcggggtgggcgggaaggtgaaaacagaggagattcaccatgccgcccaccaacctggcggcagcgcaaaagatg

SEQ ID NO: 124993 - DNA, 103 bp, Artificial Sequence
  Synthetic Polynucleotide
taatacgactcactatagggccggggagacgtccttcggcggggtgggcgaacagaggagacgcccaatgcgccgaaggaacctggcggcagcgcaaaagatg

SEQ ID NO: 124994 - DNA, 103 bp, Artificial Sequence
  Synthetic Polynucleotide
taatacgactcactatagggagcgatgggtccggggagacgtccttcggcaacagaggagagccgaaatgcgtctccccaacctggcggcagcgcaaaagatg

SEQ ID NO: 124995 - DNA, 103 bp, Artificial Sequence
  Synthetic Polynucleotide
taatacgactcactatagggtggggtggacagcgatgggtccggggagacaacagaggagagtctccatggacccatcgaacctggcggcagcgcaaaagatg

SEQ ID NO: 124996 - DNA, 103 bp, Artificial Sequence
  Synthetic Polynucleotide
taatacgactcactatagggggtgctgcccgttgagcacggcggggtggtaacagaggagaaccaccatgccgtgctcaaacctggcggcagcgcaaaagatg

SEQ ID NO: 124997 - DNA, 103 bp, Artificial Sequence
  Synthetic Polynucleotide
taatacgactcactatagggcggccgagcctggggtggacagcgatgggtaacagaggagaacccatatgtgtccacccaacctggcggcagcgcaaaagatg

SEQ ID NO: 124998 - DNA, 103 bp, Artificial Sequence
  Synthetic Polynucleotide
taatacgactcactatagggcgggccgagccggccgagcctggggtggacaacagaggagagtccacatgaggctcggcaacctggcggcagcgcaaaagatg

SEQ ID NO: 124999 - DNA, 103 bp, Artificial Sequence
  Synthetic Polynucleotide
taatacgactcactatagggctcgtcctgccgggccgagccggccgagccaacagaggagaggctcgatgggctcggccaacctggcggcagcgcaaaagatg

SEQ ID NO: 125000 - DNA, 103 bp, Artificial Sequence
  Synthetic Polynucleotide
taatacgactcactatagggggcactctttctcgtcctgccgggccgagcaacagaggagagctcggatgggcaggacgaacctggcggcagcgcaaaagatg

SEQ ID NO: 125001 - DNA, 103 bp, Artificial Sequence
  Synthetic Polynucleotide
taatacgactcactatagggtggtacttgaggcactctttctcgtcctgcaacagaggagagcaggaatggaaagagtgaacctggcggcagcgcaaaagatg

SEQ ID NO: 125002 - DNA, 103 bp, Artificial Sequence
  Synthetic Polynucleotide
taatacgactcactatagggcaggggcacctggtacttgaggcactctttaacagaggagaaaagagatgctcaagtacaacctggcggcagcgcaaaagatg

SEQ ID NO: 125003 - DNA, 103 bp, Artificial Sequence
  Synthetic Polynucleotide
taatacgactcactatagggtgctgtcgggcaggggcacctggtacttgaaacagaggagatcaagtatgaggtgccccaacctggcggcagcgcaaaagatg

SEQ ID NO: 125004 - DNA, 103 bp, Artificial Sequence
  Synthetic Polynucleotide
taatacgactcactatagggtccagcttcatgctgtcgggcaggggcaccaacagaggagaggtgccatggcccgacagaacctggcggcagcgcaaaagatg

SEQ ID NO: 125005 - DNA, 103 bp, Artificial Sequence
  Synthetic Polynucleotide
taatacgactcactataggggtgggacgactccagcttcatgctgtcgggaacagaggagacccgacatgatgaagctgaacctggcggcagcgcaaaagatg

SEQ ID NO: 125006 - DNA, 103 bp, Artificial Sequence
  Synthetic Polynucleotide
taatacgactcactatagggtgccacgggagtgggacgactccagcttcaaacagaggagatgaagcatgagtcgtcccaacctggcggcagcgcaaaagatg

SEQ ID NO: 125007 - DNA, 103 bp, Artificial Sequence
  Synthetic Polynucleotide
taatacgactcactatagggtgcgtgtccgggtgctgcccgttgagcacgaacagaggagacgtgctatgcgggcagcaaacctggcggcagcgcaaaagatg

SEQ ID NO: 125008 - DNA, 103 bp, Artificial Sequence
  Synthetic Polynucleotide
taatacgactcactataggggcggtcatgctgccacgggagtgggacgacaacagaggagagtcgtcatgctcccgtggaacctggcggcagcgcaaaagatg

SEQ ID NO: 125009 - DNA, 103 bp, Artificial Sequence
  Synthetic Polynucleotide
taatacgactcactatagggtccacccagggcggtcatgctgccacgggaaacagaggagatcccgtatgagcatgaccaacctggcggcagcgcaaaagatg

SEQ ID NO: 125010 - DNA, 103 bp, Artificial Sequence
  Synthetic Polynucleotide
taatacgactcactatagggacgaggaggctccacccagggcggtcatgcaacagaggagagcatgaatgccctgggtgaacctggcggcagcgcaaaagatg

SEQ ID NO: 125011 - DNA, 103 bp, Artificial Sequence
  Synthetic Polynucleotide
taatacgactcactatagggtggtgggtcgacgaggaggctccacccaggaacagaggagacctgggatgagcctcctcaacctggcggcagcgcaaaagatg

SEQ ID NO: 125012 - DNA, 103 bp, Artificial Sequence
  Synthetic Polynucleotide
taatacgactcactatagggggtgatggggtggtgggtcgacgaggaggcaacagaggagagcctccatgtcgacccacaacctggcggcagcgcaaaagatg

SEQ ID NO: 125013 - DNA, 103 bp, Artificial Sequence
  Synthetic Polynucleotide
taatacgactcactataggggcgggtaggtggtgatggggtggtgggtcgaacagaggagacgacccatgaccccatcaaacctggcggcagcgcaaaagatg

SEQ ID NO: 125014 - DNA, 103 bp, Artificial Sequence
  Synthetic Polynucleotide
taatacgactcactatagggggcacgtagggcgggtaggtggtgatggggaacagaggagaccccatatgcacctacccaacctggcggcagcgcaaaagatg

SEQ ID NO: 125015 - DNA, 103 bp, Artificial Sequence
  Synthetic Polynucleotide
taatacgactcactataggggctgtactcgggcacgtagggcgggtaggtaacagaggagaacctacatgccctacgtgaacctggcggcagcgcaaaagatg

SEQ ID NO: 125016 - DNA, 103 bp, Artificial Sequence
  Synthetic Polynucleotide
taatacgactcactatagggagagtccggagctgtactcgggcacgtaggaacagaggagacctacgatgccgagtacaaacctggcggcagcgcaaaagatg

SEQ ID NO: 125017 - DNA, 103 bp, Artificial Sequence
  Synthetic Polynucleotide
taatacgactcactatagggctgggggggaagagtccggagctgtactcgaacagaggagacgagtaatgctccggactaacctggcggcagcgcaaaagatg

SEQ ID NO: 125018 - DNA, 103 bp, Artificial Sequence
  Synthetic Polynucleotide
taatacgactcactataggggcccgggtggtgcgtgtccgggtgctgcccaacagaggagagggcagatgccggacacgaacctggcggcagcgcaaaagatg

SEQ ID NO: 125019 - DNA, 103 bp, Artificial Sequence
  Synthetic Polynucleotide
taatacgactcactatagggcagcaggctgctgggggggaagagtccggaaacagaggagatccggaatgttcccccccaacctggcggcagcgcaaaagatg

SEQ ID NO: 125020 - DNA, 103 bp, Artificial Sequence
  Synthetic Polynucleotide
taatacgactcactataggggggagccgcccagcaggctgctgggggggaaacagaggagatcccccatggcagcctgcaacctggcggcagcgcaaaagatg

SEQ ID NO: 125021 - DNA, 103 bp, Artificial Sequence
  Synthetic Polynucleotide
taatacgactcactatagggaagccggtgggggagccgcccagcaggctgaacagaggagacagcctatggggcggctcaacctggcggcagcgcaaaagatg

SEQ ID NO: 125022 - DNA, 103 bp, Artificial Sequence
  Synthetic Polynucleotide
taatacgactcactatagggcttgcatccgaagccggtgggggagccgccaacagaggagaggcggcatgcccaccggcaacctggcggcagcgcaaaagatg

SEQ ID NO: 125023 - DNA, 103 bp, Artificial Sequence
  Synthetic Polynucleotide
taatacgactcactatagggtgggcctggacttgcatccgaagccggtggaacagaggagaccaccgatgtcggatgcaaacctggcggcagcgcaaaagatg

SEQ ID NO: 125024 - DNA, 103 bp, Artificial Sequence
  Synthetic Polynucleotide
taatacgactcactataggggaccgggccttgggcctggacttgcatccgaacagaggagacggatgatggtccaggccaacctggcggcagcgcaaaagatg

SEQ ID NO: 125025 - DNA, 103 bp, Artificial Sequence
  Synthetic Polynucleotide
taatacgactcactataggggcctgtgctggaccgggccttgggcctggaaacagaggagatccaggatgaaggcccggaacctggcggcagcgcaaaagatg

SEQ ID NO: 125026 - DNA, 103 bp, Artificial Sequence
  Synthetic Polynucleotide
taatacgactcactatagggcacactccctgcctgtgctggaccgggcctaacagaggagaaggcccatgccagcacagaacctggcggcagcgcaaaagatg

SEQ ID NO: 125027 - DNA, 103 bp, Artificial Sequence
  Synthetic Polynucleotide
taatacgactcactatagggccacagttcacacactccctgcctgtgctgaacagaggagacagcacatgcagggagtgaacctggcggcagcgcaaaagatg

SEQ ID NO: 125028 - DNA, 103 bp, Artificial Sequence
  Synthetic Polynucleotide
taatacgactcactatagggcgaggttgccccacagttcacacactccctaacagaggagaagggagatggtgaactgtaacctggcggcagcgcaaaagatg

SEQ ID NO: 125029 - DNA, 103 bp, Artificial Sequence
  Synthetic Polynucleotide
taatacgactcactatagggagtggctgaggcccgggtggtgcgtgtccgaacagaggagacggacaatgaccacccggaacctggcggcagcgcaaaagatg

SEQ ID NO: 125030 - DNA, 103 bp, Artificial Sequence
  Synthetic Polynucleotide
taatacgactcactatagggacagtggggtcgaggttgccccacagttcaaacagaggagatgaactatggggcaacctaacctggcggcagcgcaaaagatg

SEQ ID NO: 125031 - DNA, 103 bp, Artificial Sequence
  Synthetic Polynucleotide
taatacgactcactatagggtctcgccgccacagtggggtcgaggttgccaacagaggagaggcaacatggaccccactaacctggcggcagcgcaaaagatg

SEQ ID NO: 125032 - DNA, 103 bp, Artificial Sequence
  Synthetic Polynucleotide
taatacgactcactatagggtcccgtgccatctcgccgccacagtggggtaacagaggagaaccccaatgtggcggcgaaacctggcggcagcgcaaaagatg

SEQ ID NO: 125033 - DNA, 103 bp, Artificial Sequence
  Synthetic Polynucleotide
taatacgactcactatagggacaggtagtgtcccgtgccatctcgccgccaacagaggagaggcggcatgatggcacggaacctggcggcagcgcaaaagatg

SEQ ID NO: 125034 - DNA, 103 bp, Artificial Sequence
  Synthetic Polynucleotide
taatacgactcactatagggcaggcgttgcacaggtagtgtcccgtgccaaacagaggagatggcacatgacactacctaacctggcggcagcgcaaaagatg

SEQ ID NO: 125035 - DNA, 103 bp, Artificial Sequence
  Synthetic Polynucleotide
taatacgactcactatagggatagagcccgcaggcgttgcacaggtagtgaacagaggagacactacatgtgcaacgccaacctggcggcagcgcaaaagatg

SEQ ID NO: 125036 - DNA, 103 bp, Artificial Sequence
  Synthetic Polynucleotide
taatacgactcactatagggtcattttgtgatagagcccgcaggcgttgcaacagaggagagcaacgatggcgggctctaacctggcggcagcgcaaaagatg

SEQ ID NO: 125037 - DNA, 103 bp, Artificial Sequence
  Synthetic Polynucleotide
taatacgactcactatagggttctgtccgttcattttgtgatagagcccgaacagaggagacgggctatgtcacaaaataacctggcggcagcgcaaaagatg

SEQ ID NO: 125038 - DNA, 103 bp, Artificial Sequence
  Synthetic Polynucleotide
taatacgactcactataggggaggggccggttctgtccgttcattttgtgaacagaggagacacaaaatgaacggacagaacctggcggcagcgcaaaagatg

SEQ ID NO: 125039 - DNA, 103 bp, Artificial Sequence
  Synthetic Polynucleotide
taatacgactcactatagggtgggcttaatgaggggccggttctgtccgtaacagaggagaacggacatgaccggccccaacctggcggcagcgcaaaagatg

SEQ ID NO: 125040 - DNA, 103 bp, Artificial Sequence
  Synthetic Polynucleotide
taatacgactcactatagggtccatgtaggagtggctgaggcccgggtggaacagaggagaccacccatgcctcagccaaacctggcggcagcgcaaaagatg

SEQ ID NO: 125041 - DNA, 103 bp, Artificial Sequence
  Synthetic Polynucleotide
taatacgactcactatagggagccttcgcttgggcttaatgaggggccggaacagaggagaccggccatgcattaagccaacctggcggcagcgcaaaagatg

SEQ ID NO: 125042 - DNA, 103 bp, Artificial Sequence
  Synthetic Polynucleotide
taatacgactcactatagggggctgcagacagccttcgcttgggcttaataacagaggagaattaagatgaagcgaaggaacctggcggcagcgcaaaagatg

SEQ ID NO: 125043 - DNA, 103 bp, Artificial Sequence
  Synthetic Polynucleotide
taatacgactcactatagggctgctctcctggctgcagacagccttcgctaacagaggagaagcgaaatgtgtctgcagaacctggcggcagcgcaaaagatg

SEQ ID NO: 125044 - DNA, 103 bp, Artificial Sequence
  Synthetic Polynucleotide
taatacgactcactatagggcaggacgtccctgctctcctggctgcagacaacagaggagagtctgcatgcaggagagcaacctggcggcagcgcaaaagatg

SEQ ID NO: 125045 - DNA, 103 bp, Artificial Sequence
  Synthetic Polynucleotide
taatacgactcactatagggacagttcgcacaggacgtccctgctctcctaacagaggagaaggagaatggggacgtccaacctggcggcagcgcaaaagatg

SEQ ID NO: 125046 - DNA, 103 bp, Artificial Sequence
  Synthetic Polynucleotide
taatacgactcactatagggtggtggtctgacagttcgcacaggacgtccaacagaggagaggacgtatggtgcgaactaacctggcggcagcgcaaaagatg

SEQ ID NO: 125047 - DNA, 103 bp, Artificial Sequence
  Synthetic Polynucleotide
taatacgactcactatagggagtgtggttgtggtggtctgacagttcgcaaacagaggagatgcgaaatgtcagaccacaacctggcggcagcgcaaaagatg

SEQ ID NO: 125048 - DNA, 103 bp, Artificial Sequence
  Synthetic Polynucleotide
taatacgactcactatagggcctcctccagagtgtggttgtggtggtctgaacagaggagacagaccatgacaaccacaaacctggcggcagcgcaaaagatg

SEQ ID NO: 125049 - DNA, 103 bp, Artificial Sequence
  Synthetic Polynucleotide
taatacgactcactatagggcattggcattcctcctccagagtgtggttgaacagaggagacaaccaatgtctggaggaaacctggcggcagcgcaaaagatg

SEQ ID NO: 125050 - DNA, 103 bp, Artificial Sequence
  Synthetic Polynucleotide
taatacgactcactatagggacagggtccccattggcattcctcctccagaacagaggagactggagatggaatgccaaaacctggcggcagcgcaaaagatg

SEQ ID NO: 125051 - DNA, 103 bp, Artificial Sequence
  Synthetic Polynucleotide
taatacgactcactataggggttggcggccatggccaagctctgatacataacagaggagaatgtatatgagcttggccaacctggcggcagcgcaaaagatg

SEQ ID NO: 125052 - DNA, 103 bp, Artificial Sequence
  Synthetic Polynucleotide
taatacgactcactataggggggcacgtagactggcgaggacgcggcgccaacagaggagaggcgccatgtcctcgccaaacctggcggcagcgcaaaagatg

SEQ ID NO: 125053 - DNA, 103 bp, Artificial Sequence
  Synthetic Polynucleotide
taatacgactcactatagggaaggctctcactgcctgaaggagctgctggaacagaggagaccagcaatgccttcaggcaacctggcggcagcgcaaaagatg

SEQ ID NO: 125054 - DNA, 103 bp, Artificial Sequence
  Synthetic Polynucleotide
taatacgactcactatagggtggcgggaggaaggctctcactgcctgaagaacagaggagacttcagatggtgagagccaacctggcggcagcgcaaaagatg

SEQ ID NO: 125055 - DNA, 103 bp, Artificial Sequence
  Synthetic Polynucleotide
taatacgactcactataggggaagcaccgctggcgggaggaaggctctcaaacagaggagatgagagatgtcctcccgcaacctggcggcagcgcaaaagatg

SEQ ID NO: 125056 - DNA, 103 bp, Artificial Sequence
  Synthetic Polynucleotide
taatacgactcactatagggggagttgctggaagcaccgctggcgggaggaacagaggagacctcccatgagcggtgctaacctggcggcagcgcaaaagatg

SEQ ID NO: 125057 - DNA, 103 bp, Artificial Sequence
  Synthetic Polynucleotide
taatacgactcactatagggtggcgttgctggagttgctggaagcaccgcaacagaggagagcggtgatgccagcaactaacctggcggcagcgcaaaagatg

SEQ ID NO: 125058 - DNA, 103 bp, Artificial Sequence
  Synthetic Polynucleotide
taatacgactcactatagggctgctggtggtggcgttgctggagttgctgaacagaggagacagcaaatgcagcaacgcaacctggcggcagcgcaaaagatg

SEQ ID NO: 125059 - DNA, 103 bp, Artificial Sequence
  Synthetic Polynucleotide
taatacgactcactatagggctcctcgctgctgctggtggtggcgttgctaacagaggagaagcaacatgaccaccagcaacctggcggcagcgcaaaagatg

SEQ ID NO: 125060 - DNA, 103 bp, Artificial Sequence
  Synthetic Polynucleotide
taatacgactcactatagggtgggacgcatctcctcgctgctgctggtggaacagaggagaccaccaatggcagcgaggaacctggcggcagcgcaaaagatg

SEQ ID NO: 125061 - DNA, 103 bp, Artificial Sequence
  Synthetic Polynucleotide
taatacgactcactatagggtccgtcttgatgggacgcatctcctcgctgaacagaggagacagcgaatggatgcgtccaacctggcggcagcgcaaaagatg

SEQ ID NO: 125062 - DNA, 103 bp, Artificial Sequence
  Synthetic Polynucleotide
taatacgactcactatagggcaggccaggctccgtcttgatgggacgcataacagaggagaatgcgtatgatcaagacgaacctggcggcagcgcaaaagatg

SEQ ID NO: 125063 - DNA, 103 bp, Artificial Sequence
  Synthetic Polynucleotide
taatacgactcactatagggcccgcggtgtgggcacgtagactggcgaggaacagaggagacctcgcatgtctacgtgcaacctggcggcagcgcaaaagatg

SEQ ID NO: 125064 - DNA, 103 bp, Artificial Sequence
  Synthetic Polynucleotide
taatacgactcactatagggagtgagatgacaggccaggctccgtcttgaaacagaggagatcaagaatgagcctggccaacctggcggcagcgcaaaagatg

SEQ ID NO: 125065 - DNA, 103 bp, Artificial Sequence
  Synthetic Polynucleotide
taatacgactcactatagggctgtgcccgtagtgagatgacaggccaggcaacagaggagagcctggatggtcatctcaaacctggcggcagcgcaaaagatg

SEQ ID NO: 125066 - DNA, 103 bp, Artificial Sequence
  Synthetic Polynucleotide
taatacgactcactatagggcacggagctgctgtgcccgtagtgagatgaaacagaggagatcatctatgtacgggcacaacctggcggcagcgcaaaagatg

SEQ ID NO: 125067 - DNA, 103 bp, Artificial Sequence
  Synthetic Polynucleotide
taatacgactcactatagggacgtctgggacacggagctgctgtgcccgtaacagaggagaacgggcatggcagctccgaacctggcggcagcgcaaaagatg

SEQ ID NO: 125068 - DNA, 103 bp, Artificial Sequence
  Synthetic Polynucleotide
taatacgactcactatagggctgactgagaacgtctgggacacggagctgaacagaggagacagctcatggtcccagacaacctggcggcagcgcaaaagatg

SEQ ID NO: 125069 - DNA, 103 bp, Artificial Sequence
  Synthetic Polynucleotide
taatacgactcactatagggagacatcgcactgactgagaacgtctgggaaacagaggagatcccagatgttctcagtcaacctggcggcagcgcaaaagatg

SEQ ID NO: 125070 - DNA, 103 bp, Artificial Sequence
  Synthetic Polynucleotide
taatacgactcactataggggcccatggccagacatcgcactgactgagaaacagaggagatctcagatggtgcgatgtaacctggcggcagcgcaaaagatg

SEQ ID NO: 125071 - DNA, 103 bp, Artificial Sequence
  Synthetic Polynucleotide
taatacgactcactatagggtggatggagggcccatggccagacatcgcaaacagaggagatgcgatatgtggccatggaacctggcggcagcgcaaaagatg

SEQ ID NO: 125072 - DNA, 103 bp, Artificial Sequence
  Synthetic Polynucleotide
taatacgactcactataggggaggacagggtggatggagggcccatggccaacagaggagaggccatatgccctccatcaacctggcggcagcgcaaaagatg

SEQ ID NO: 125073 - DNA, 103 bp, Artificial Sequence
  Synthetic Polynucleotide
taatacgactcactatagggtcagggccgagaggacagggtggatggaggaacagaggagacctccaatgaccctgtccaacctggcggcagcgcaaaagatg

SEQ ID NO: 125074 - DNA, 103 bp, Artificial Sequence
  Synthetic Polynucleotide
taatacgactcactataggggaggagggcacccgcggtgtgggcacgtagaacagaggagactacgtatgcacaccgcgaacctggcggcagcgcaaaagatg

SEQ ID NO: 125075 - DNA, 103 bp, Artificial Sequence
  Synthetic Polynucleotide
taatacgactcactatagggggggagagcttcagggccgagaggacagggaacagaggagaccctgtatgctcggccctaacctggcggcagcgcaaaagatg

SEQ ID NO: 125076 - DNA, 103 bp, Artificial Sequence
  Synthetic Polynucleotide
taatacgactcactatagggatagccttgtggggagagcttcagggccgaaacagaggagatcggccatgaagctctccaacctggcggcagcgcaaaagatg

SEQ ID NO: 125077 - DNA, 103 bp, Artificial Sequence
  Synthetic Polynucleotide
taatacgactcactatagggcgggagacgcatagccttgtggggagagctaacagaggagaagctctatgcacaaggctaacctggcggcagcgcaaaagatg

SEQ ID NO: 125078 - DNA, 103 bp, Artificial Sequence
  Synthetic Polynucleotide
taatacgactcactataggggactggctgacgggagacgcatagccttgtaacagaggagaacaaggatgtgcgtctccaacctggcggcagcgcaaaagatg

SEQ ID NO: 125079 - DNA, 103 bp, Artificial Sequence
  Synthetic Polynucleotide
taatacgactcactatagggggtctgtggagactggctgacgggagacgcaacagaggagagcgtctatggtcagccagaacctggcggcagcgcaaaagatg

SEQ ID NO: 125080 - DNA, 103 bp, Artificial Sequence
  Synthetic Polynucleotide
taatacgactcactataggggcttggagctggtctgtggagactggctgaaacagaggagatcagccatgctccacagaaacctggcggcagcgcaaaagatg

SEQ ID NO: 125081 - DNA, 103 bp, Artificial Sequence
  Synthetic Polynucleotide
taatacgactcactatagggcaagagtcctgcttggagctggtctgtggaaacagaggagatccacaatgcagctccaaaacctggcggcagcgcaaaagatg

SEQ ID NO: 125082 - DNA, 103 bp, Artificial Sequence
  Synthetic Polynucleotide
taatacgactcactatagggcaggctgttccaagagtcctgcttggagctaacagaggagaagctccatgcaggactctaacctggcggcagcgcaaaagatg

SEQ ID NO: 125083 - DNA, 103 bp, Artificial Sequence
  Synthetic Polynucleotide
taatacgactcactatagggcggccaagaccaggctgttccaagagtcctaacagaggagaaggactatgggaacagccaacctggcggcagcgcaaaagatg

SEQ ID NO: 125084 - DNA, 103 bp, Artificial Sequence
  Synthetic Polynucleotide
taatacgactcactatagggccgtgactgtcggccaagaccaggctgttcaacagaggagagaacagatgggtcttggcaacctggcggcagcgcaaaagatg

SEQ ID NO: 125085 - DNA, 103 bp, Artificial Sequence
  Synthetic Polynucleotide
taatacgactcactataggggcccagcacggaggagggcacccgcggtgtaacagaggagaacaccgatggtgccctccaacctggcggcagcgcaaaagatg

SEQ ID NO: 125086 - DNA, 103 bp, Artificial Sequence
  Synthetic Polynucleotide
taatacgactcactataggggattatgtccccgtgactgtcggccaagacaacagaggagagtcttgatggacagtcacaacctggcggcagcgcaaaagatg

SEQ ID NO: 125087 - DNA, 103 bp, Artificial Sequence
  Synthetic Polynucleotide
taatacgactcactatagggggtaggacaggcccagcacggaggagggcaaacagaggagatgccctatgccgtgctggaacctggcggcagcgcaaaagatg

SEQ ID NO: 125088 - DNA, 103 bp, Artificial Sequence
  Synthetic Polynucleotide
taatacgactcactatagggccgccctggaggtaggacaggcccagcacgaacagaggagacgtgctatgcctgtcctaaacctggcggcagcgcaaaagatg

SEQ ID NO: 125089 - DNA, 103 bp, Artificial Sequence
  Synthetic Polynucleotide
taatacgactcactataggggcccgcgcctccgccctggaggtaggacagaacagaggagactgtccatgctccagggcaacctggcggcagcgcaaaagatg

SEQ ID NO: 125090 - DNA, 103 bp, Artificial Sequence
  Synthetic Polynucleotide
taatacgactcactatagggcggacgcagagcccgcgcctccgccctggaaacagaggagatccaggatggaggcgcggaacctggcggcagcgcaaaagatg

SEQ ID NO: 125091 - DNA, 103 bp, Artificial Sequence
  Synthetic Polynucleotide
taatacgactcactataggggaggcgcctccggacgcagagcccgcgcctaacagaggagaaggcgcatgctctgcgtcaacctggcggcagcgcaaaagatg

SEQ ID NO: 125092 - DNA, 103 bp, Artificial Sequence
  Synthetic Polynucleotide
taatacgactcactataggggctgccgcccgaggcgcctccggacgcagaaacagaggagatctgcgatgggaggcgccaacctggcggcagcgcaaaagatg

SEQ ID NO: 125093 - DNA, 103 bp, Artificial Sequence
  Synthetic Polynucleotide
taatacgactcactataggggcggcccgtggttggcggccatggccaagcaacagaggagagcttggatgtggccgccaaacctggcggcagcgcaaaagatg

SEQ ID NO: 125094 - DNA, 103 bp, Artificial Sequence
  Synthetic Polynucleotide
taatacgactcactatagggccccaccggagctgccgcccgaggcgcctcaacagaggagagaggcgatgcgggcggcaaacctggcggcagcgcaaaagatg

SEQ ID NO: 125095 - DNA, 103 bp, Artificial Sequence
  Synthetic Polynucleotide
taatacgactcactatagggccagacgcggccccaccggagctgccgcccaacagaggagagggcggatgctccggtggaacctggcggcagcgcaaaagatg

SEQ ID NO: 125096 - DNA, 103 bp, Artificial Sequence
  Synthetic Polynucleotide
taatacgactcactataggggggccccgcaccagacgcggccccaccggaaacagaggagatccggtatggccgcgtctaacctggcggcagcgcaaaagatg

SEQ ID NO: 125097 - DNA, 103 bp, Artificial Sequence
  Synthetic Polynucleotide
taatacgactcactataggggctgggtcccgggccccgcaccagacgcggaacagaggagaccgcgtatggtgcggggcaacctggcggcagcgcaaaagatg

SEQ ID NO: 125098 - DNA, 103 bp, Artificial Sequence
  Synthetic Polynucleotide
taatacgactcactataggggggctgccctgctgggtcccgggccccgcaaacagaggagatgcgggatgcgggacccaaacctggcggcagcgcaaaagatg

SEQ ID NO: 125099 - DNA, 103 bp, Artificial Sequence
  Synthetic Polynucleotide
taatacgactcactataggggctccatcccgggctgccctgctgggtcccaacagaggagagggaccatgcagggcagcaacctggcggcagcgcaaaagatg

SEQ ID NO: 125100 - DNA, 103 bp, Artificial Sequence
  Synthetic Polynucleotide
taatacgactcactatagggctcccgcctggctccatcccgggctgccctaacagaggagaagggcaatgcgggatggaaacctggcggcagcgcaaaagatg

SEQ ID NO: 125101 - DNA, 103 bp, Artificial Sequence
  Synthetic Polynucleotide
taatacgactcactataggggctccgtcggctcccgcctggctccatcccaacagaggagagggatgatgccaggcgggaacctggcggcagcgcaaaagatg

SEQ ID NO: 125102 - DNA, 103 bp, Artificial Sequence
  Synthetic Polynucleotide
taatacgactcactatagggggtgtaagcggctccgtcggctcccgcctgaacagaggagacaggcgatggccgacggaaacctggcggcagcgcaaaagatg

SEQ ID NO: 125103 - DNA, 103 bp, Artificial Sequence
  Synthetic Polynucleotide
taatacgactcactatagggccggcggcggggtgtaagcggctccgtcggaacagaggagaccgacgatgccgcttacaaacctggcggcagcgcaaaagatg

SEQ ID NO: 125104 - DNA, 103 bp, Artificial Sequence
  Synthetic Polynucleotide
taatacgactcactataggggcaccggggggcggcccgtggttggcggccaacagaggagaggccgcatgccacgggccaacctggcggcagcgcaaaagatg

SEQ ID NO: 125105 - DNA, 103 bp, Artificial Sequence
  Synthetic Polynucleotide
taatacgactcactatagggcgcggcgacaccggcggcggggtgtaagcgaacagaggagacgcttaatgcccgccgccaacctggcggcagcgcaaaagatg

SEQ ID NO: 125106 - DNA, 103 bp, Artificial Sequence
  Synthetic Polynucleotide
taatacgactcactataggggaaggagaagcgcggcgacaccggcggcggaacagaggagaccgccgatggtgtcgccgaacctggcggcagcgcaaaagatg

SEQ ID NO: 125107 - DNA, 103 bp, Artificial Sequence
  Synthetic Polynucleotide
taatacgactcactatagggtggtccccgggaaggagaagcgcggcgacaaacagaggagatgtcgcatggcttctcctaacctggcggcagcgcaaaagatg

SEQ ID NO: 125108 - DNA, 103 bp, Artificial Sequence
  Synthetic Polynucleotide
taatacgactcactatagggagggacccggtggtccccgggaaggagaagaacagaggagacttctcatgcccggggacaacctggcggcagcgcaaaagatg

SEQ ID NO: 125109 - DNA, 103 bp, Artificial Sequence
  Synthetic Polynucleotide
taatacgactcactatagggggcggccgccagggacccggtggtccccggaacagaggagaccggggatgaccgggtccaacctggcggcagcgcaaaagatg

SEQ ID NO: 125110 - DNA, 103 bp, Artificial Sequence
  Synthetic Polynucleotide
taatacgactcactatagggcagcggcggcggcggccgccagggacccggaacagaggagaccgggtatgtggcggccgaacctggcggcagcgcaaaagatg

SEQ ID NO: 125111 - DNA, 103 bp, Artificial Sequence
  Synthetic Polynucleotide
taatacgactcactatagggcgggccgcggcagcggcggcggcggccgccaacagaggagaggcggcatgcgccgccgcaacctggcggcagcgcaaaagatg

SEQ ID NO: 125112 - DNA, 103 bp, Artificial Sequence
  Synthetic Polynucleotide
taatacgactcactatagggcgcagcttcccgggccgcggcagcggcggcaacagaggagagccgccatggccgcggccaacctggcggcagcgcaaaagatg

SEQ ID NO: 125113 - DNA, 103 bp, Artificial Sequence
  Synthetic Polynucleotide
taatacgactcactatagggtgctgtaggccgcagcttcccgggccgcggaacagaggagaccgcggatggggaagctgaacctggcggcagcgcaaaagatg

SEQ ID NO: 125114 - DNA, 103 bp, Artificial Sequence
  Synthetic Polynucleotide
taatacgactcactatagggccgccgccactgctgtaggccgcagcttccaacagaggagaggaagcatgggcctacagaacctggcggcagcgcaaaagatg

SEQ ID NO: 125115 - DNA, 103 bp, Artificial Sequence
  Synthetic Polynucleotide
taatacgactcactatagggcgcctcgtaggcaccggggggcggcccgtgaacagaggagacacgggatgccccccggtaacctggcggcagcgcaaaagatg

SEQ ID NO: 125116 - DNA, 103 bp, Artificial Sequence
  Synthetic Polynucleotide
taatacgactcactatagggacccgccgctccgccgccactgctgtaggcaacagaggagagcctacatgagtggcggcaacctggcggcagcgcaaaagatg

SEQ ID NO: 125117 - DNA, 103 bp, Artificial Sequence
  Synthetic Polynucleotide
taatacgactcactatagggccaggcccgcacccgccgctccgccgccacaacagaggagagtggcgatggagcggcggaacctggcggcagcgcaaaagatg

SEQ ID NO: 125118 - DNA, 103 bp, Artificial Sequence
  Synthetic Polynucleotide
taatacgactcactatagggtcgcggcccgccaggcccgcacccgccgctaacagaggagaagcggcatgtgcgggcctaacctggcggcagcgcaaaagatg

SEQ ID NO: 125119 - DNA, 103 bp, Artificial Sequence
  Synthetic Polynucleotide
taatacgactcactatagggcccgtactgctcgcggcccgccaggcccgcaacagaggagagcgggcatggcgggccgcaacctggcggcagcgcaaaagatg

SEQ ID NO: 125120 - DNA, 103 bp, Artificial Sequence
  Synthetic Polynucleotide
taatacgactcactatagggagccggcgcgcccgtactgctcgcggcccgaacagaggagacgggccatgagcagtacgaacctggcggcagcgcaaaagatg

SEQ ID NO: 125121 - DNA, 103 bp, Artificial Sequence
  Synthetic Polynucleotide
taatacgactcactataggggagcccgcgaagccggcgcgcccgtactgcaacagaggagagcagtaatggcgcgccggaacctggcggcagcgcaaaagatg

SEQ ID NO: 125122 - DNA, 103 bp, Artificial Sequence
  Synthetic Polynucleotide
taatacgactcactataggggctggagtaggagcccgcgaagccggcgcgaacagaggagacgcgccatgttcgcgggcaacctggcggcagcgcaaaagatg

SEQ ID NO: 125123 - DNA, 103 bp, Artificial Sequence
  Synthetic Polynucleotide
taatacgactcactatagggccgggtaggggctggagtaggagcccgcgaaacagaggagatcgcggatgcctactccaaacctggcggcagcgcaaaagatg

SEQ ID NO: 125124 - DNA, 103 bp, Artificial Sequence
  Synthetic Polynucleotide
taatacgactcactataggggccatgtaagccgggtaggggctggagtagaacagaggagactactcatgcccctacccaacctggcggcagcgcaaaagatg

SEQ ID NO: 125125 - DNA, 103 bp, Artificial Sequence
  Synthetic Polynucleotide
taatacgactcactataggggcccacgtcggccatgtaagccgggtagggaacagaggagaccctacatggcttacatgaacctggcggcagcgcaaaagatg

SEQ ID NO: 125126 - DNA, 103 bp, Artificial Sequence
  Synthetic Polynucleotide
taatacgactcactatagggcggggccgcccgcctcgtaggcaccgggggaacagaggagacccccgatgcctacgaggaacctggcggcagcgcaaaagatg

SEQ ID NO: 125127 - DNA, 103 bp, Artificial Sequence
  Synthetic Polynucleotide
taatacgactcactatagggcccaggacgcgcccacgtcggccatgtaagaacagaggagacttacaatgccgacgtggaacctggcggcagcgcaaaagatg

SEQ ID NO: 125128 - DNA, 103 bp, Artificial Sequence
  Synthetic Polynucleotide
taatacgactcactataggggcggctgcggcccaggacgcgcccacgtcgaacagaggagacgacgtatgcgcgtcctgaacctggcggcagcgcaaaagatg

SEQ ID NO: 125129 - DNA, 103 bp, Artificial Sequence
  Synthetic Polynucleotide
taatacgactcactatagggggaggcggcggcggctgcggcccaggacgcaacagaggagagcgtccatggccgcagccaacctggcggcagcgcaaaagatg

SEQ ID NO: 125130 - DNA, 103 bp, Artificial Sequence
  Synthetic Polynucleotide
taatacgactcactatagggaggggccggcggaggcggcggcggctgcggaacagaggagaccgcagatgccgccgcctaacctggcggcagcgcaaaagatg

SEQ ID NO: 125131 - DNA, 103 bp, Artificial Sequence
  Synthetic Polynucleotide
taatacgactcactataggggggctgtcgaaggggccggcggaggcggcgaacagaggagacgccgcatgcgccggcccaacctggcggcagcgcaaaagatg

SEQ ID NO: 125132 - DNA, 103 bp, Artificial Sequence
  Synthetic Polynucleotide
taatacgactcactataggggtgcaggaccgggctgtcgaaggggccggcaacagaggagagccggcatgttcgacagcaacctggcggcagcgcaaaagatg

SEQ ID NO: 125133 - DNA, 103 bp, Artificial Sequence
  Synthetic Polynucleotide
taatacgactcactatagggcgggcaggctgtgcaggaccgggctgtcgaaacagaggagatcgacaatgcggtcctgcaacctggcggcagcgcaaaagatg

SEQ ID NO: 125134 - DNA, 103 bp, Artificial Sequence
  Synthetic Polynucleotide
taatacgactcactatagggttggcccggccgggcaggctgtgcaggaccaacagaggagaggtcctatgcagcctgccaacctggcggcagcgcaaaagatg

SEQ ID NO: 125135 - DNA, 103 bp, Artificial Sequence
  Synthetic Polynucleotide
taatacgactcactatagggggcggccgggttggcccggccgggcaggctaacagaggagaagcctgatgggccgggccaacctggcggcagcgcaaaagatg

SEQ ID NO: 125136 - DNA, 103 bp, Artificial Sequence
  Synthetic Polynucleotide
taatacgactcactatagggtggggtgtcgggcggccgggttggcccggcaacagaggagagccgggatgacccggccgaacctggcggcagcgcaaaagatg

SEQ ID NO: 125137 - DNA, 103 bp, Artificial Sequence
  Synthetic Polynucleotide
taatacgactcactatagggatgaaggcgccggggccgcccgcctcgtagaacagaggagactacgaatggggcggcccaacctggcggcagcgcaaaagatg

SEQ ID NO: 125138 - DNA, 103 bp, Artificial Sequence
  Synthetic Polynucleotide
taatacgactcactatagggatatcgagattggggtgtcgggcggccgggaacagaggagacccggcatgccgacacccaacctggcggcagcgcaaaagatg

SEQ ID NO: 125139 - DNA, 103 bp, Artificial Sequence
  Synthetic Polynucleotide
taatacgactcactataggggtcgtcaaacatatcgagattggggtgtcgaacagaggagacgacacatgaatctcgataacctggcggcagcgcaaaagatg

SEQ ID NO: 125140 - DNA, 103 bp, Artificial Sequence
  Synthetic Polynucleotide
taatacgactcactatagggcttctgagaagtcgtcaaacatatcgagataacagaggagaatctcgatgtgtttgacgaacctggcggcagcgcaaaagatg

SEQ ID NO: 125141 - DNA, 103 bp, Artificial Sequence
  Synthetic Polynucleotide
taatacgactcactatagggcactctctgccttctgagaagtcgtcaaacaacagaggagagtttgaatgcttctcagaaacctggcggcagcgcaaaagatg

SEQ ID NO: 125142 - DNA, 103 bp, Artificial Sequence
  Synthetic Polynucleotide
taatacgactcactatagggacagttgacacactctctgccttctgagaaaacagaggagattctcaatgggcagagagaacctggcggcagcgcaaaagatg

SEQ ID NO: 125143 - DNA, 103 bp, Artificial Sequence
  Synthetic Polynucleotide
taatacgactcactatagggacatagccccacagttgacacactctctgcaacagaggagagcagagatggtgtcaactaacctggcggcagcgcaaaagatg

SEQ ID NO: 125144 - DNA, 103 bp, Artificial Sequence
  Synthetic Polynucleotide
taatacgactcactatagggagcggggtggacatagccccacagttgacaaacagaggagatgtcaaatgtggggctataacctggcggcagcgcaaaagatg

SEQ ID NO: 125145 - DNA, 103 bp, Artificial Sequence
  Synthetic Polynucleotide
taatacgactcactatagggtcgcctccagagcggggtggacatagccccaacagaggagaggggctatgtccaccccgaacctggcggcagcgcaaaagatg

SEQ ID NO: 125146 - DNA, 103 bp, Artificial Sequence
  Synthetic Polynucleotide
taatacgactcactatagggccgtcccatctcgcctccagagcggggtggaacagaggagaccacccatgtctggaggcaacctggcggcagcgcaaaagatg

SEQ ID NO: 125147 - DNA, 103 bp, Artificial Sequence
  Synthetic Polynucleotide
taatacgactcactatagggagatagtgacccgtcccatctcgcctccagaacagaggagactggagatgagatgggacaacctggcggcagcgcaaaagatg

SEQ ID NO: 125148 - DNA, 103 bp, Artificial Sequence
  Synthetic Polynucleotide
taatacgactcactatagggcgcgccgtgcatgaaggcgccggggccgccaacagaggagaggcggcatgggcgccttcaacctggcggcagcgcaaaagatg

SEQ ID NO: 125149 - DNA, 103 bp, Artificial Sequence
  Synthetic Polynucleotide
taatacgactcactatagggggcgttgcacagatagtgacccgtcccatcaacagaggagagatgggatgggtcactataacctggcggcagcgcaaaagatg

SEQ ID NO: 125150 - DNA, 103 bp, Artificial Sequence
  Synthetic Polynucleotide
taatacgactcactatagggagaggccgcaggcgttgcacagatagtgacaacagaggagagtcactatgtgtgcaacgaacctggcggcagcgcaaaagatg

SEQ ID NO: 125151 - DNA, 103 bp, Artificial Sequence
  Synthetic Polynucleotide
taatacgactcactatagggatcttgtggtagaggccgcaggcgttgcacaacagaggagagtgcaaatgctgcggcctaacctggcggcagcgcaaaagatg

SEQ ID NO: 125152 - DNA, 103 bp, Artificial Sequence
  Synthetic Polynucleotide
taatacgactcactataggggatgccgttcatcttgtggtagaggccgcaaacagaggagatgcggcatgtaccacaagaacctggcggcagcgcaaaagatg

SEQ ID NO: 125153 - DNA, 103 bp, Artificial Sequence
  Synthetic Polynucleotide
taatacgactcactataggggcggccggttgatgccgttcatcttgtggtaacagaggagaaccacaatgtgaacggcaaacctggcggcagcgcaaaagatg

SEQ ID NO: 125154 - DNA, 103 bp, Artificial Sequence
  Synthetic Polynucleotide
taatacgactcactatagggggcttgatgagcggccggttgatgccgttcaacagaggagagaacggatgcaaccggccaacctggcggcagcgcaaaagatg

SEQ ID NO: 125155 - DNA, 103 bp, Artificial Sequence
  Synthetic Polynucleotide
taatacgactcactatagggccggcgctgaggcttgatgagcggccggttaacagaggagaaaccggatgctcatcaagaacctggcggcagcgcaaaagatg

SEQ ID NO: 125156 - DNA, 103 bp, Artificial Sequence
  Synthetic Polynucleotide
taatacgactcactatagggaggcggacagccggcgctgaggcttgatgaaacagaggagatcatcaatgctcagcgccaacctggcggcagcgcaaaagatg

SEQ ID NO: 125157 - DNA, 103 bp, Artificial Sequence
  Synthetic Polynucleotide
taatacgactcactatagggactcggcgggaggcggacagccggcgctgaaacagaggagatcagcgatggctgtccgcaacctggcggcagcgcaaaagatg

SEQ ID NO: 125158 - DNA, 103 bp, Artificial Sequence
  Synthetic Polynucleotide
taatacgactcactatagggggagaggcccactcggcgggaggcggacagaacagaggagactgtccatgtcccgccgaaacctggcggcagcgcaaaagatg

SEQ ID NO: 125159 - DNA, 103 bp, Artificial Sequence
  Synthetic Polynucleotide
taatacgactcactatagggacgcggcgcccgcgccgtgcatgaaggcgcaacagaggagagcgcctatgtgcacggcgaacctggcggcagcgcaaaagatg

SEQ ID NO: 125160 - DNA, 103 bp, Artificial Sequence
  Synthetic Polynucleotide
taatacgactcactatagggagttggcacaggagaggcccactcggcgggaacagaggagacccgccatgtgggcctctaacctggcggcagcgcaaaagatg

SEQ ID NO: 125161 - DNA, 103 bp, Artificial Sequence
  Synthetic Polynucleotide
taatacgactcactataggggtggtctggcagttggcacaggagaggcccaacagaggagagggcctatgctgtgccaaaacctggcggcagcgcaaaagatg

SEQ ID NO: 125162 - DNA, 103 bp, Artificial Sequence
  Synthetic Polynucleotide
taatacgactcactatagggcgtggtggtggtggtctggcagttggcacaaacagaggagatgtgccatgtgccagaccaacctggcggcagcgcaaaagatg

SEQ ID NO: 125163 - DNA, 103 bp, Artificial Sequence
  Synthetic Polynucleotide
taatacgactcactatagggggcgccacagcgtggtggtggtggtctggcaacagaggagagccagaatgccaccaccaaacctggcggcagcgcaaaagatg

SEQ ID NO: 125164 - DNA, 103 bp, Artificial Sequence
  Synthetic Polynucleotide
taatacgactcactatagggtccgcattgcggcgccacagcgtggtggtgaacagaggagacaccacatggctgtggcgaacctggcggcagcgcaaaagatg

SEQ ID NO: 125165 - DNA, 103 bp, Artificial Sequence
  Synthetic Polynucleotide
taatacgactcactatagggaggctcgccctccgcattgcggcgccacagaacagaggagactgtggatgcgcaatgcgaacctggcggcagcgcaaaagatg

SEQ ID NO: 125166 - DNA, 103 bp, Artificial Sequence
  Synthetic Polynucleotide
taatacgactcactatagggcattgcacacaggctcgccctccgcattgcaacagaggagagcaatgatgagggcgagcaacctggcggcagcgcaaaagatg

SEQ ID NO: 125167 - DNA, 103 bp, Artificial Sequence
  Synthetic Polynucleotide
taatacgactcactatagggaggccgcaggcattgcacacaggctcgcccaacagaggagagggcgaatgtgtgtgcaaaacctggcggcagcgcaaaagatg

SEQ ID NO: 125168 - DNA, 103 bp, Artificial Sequence
  Synthetic Polynucleotide
taatacgactcactatagggcttcatgtagaggccgcaggcattgcacacaacagaggagagtgtgcatggcctgcggcaacctggcggcagcgcaaaagatg

SEQ ID NO: 125169 - DNA, 103 bp, Artificial Sequence
  Synthetic Polynucleotide
taatacgactcactatagggccccgtggagcttcatgtagaggccgcaggaacagaggagacctgcgatgtctacatgaaacctggcggcagcgcaaaagatg

SEQ ID NO: 125170 - DNA, 103 bp, Artificial Sequence
  Synthetic Polynucleotide
taatacgactcactatagggactggcgaggacgcggcgcccgcgccgtgcaacagaggagagcacggatggggcgccgcaacctggcggcagcgcaaaagatg

SEQ ID NO: 125171 - DNA, 103 bp, Artificial Sequence
  Synthetic Polynucleotide
taatacgactcactatagggggcctggggaccccgtggagcttcatgtagaacagaggagactacatatggctccacggaacctggcggcagcgcaaaagatg

SEQ ID NO: 125172 - DNA, 103 bp, Artificial Sequence
  Synthetic Polynucleotide
taatacgactcactatagggcattgcaagaggcctggggaccccgtggagaacagaggagactccacatggtccccaggaacctggcggcagcgcaaaagatg

SEQ ID NO: 125173 - DNA, 103 bp, Artificial Sequence
  Synthetic Polynucleotide
taatacgactcactatagggcctctttccgcattgcaagaggcctggggaaacagaggagatccccaatgctcttgcaaaacctggcggcagcgcaaaagatg

SEQ ID NO: 125174 - DNA, 103 bp, Artificial Sequence
  Synthetic Polynucleotide
taatacgactcactataggggtttggatcccctctttccgcattgcaagaaacagaggagatcttgcatggcggaaagaaacctggcggcagcgcaaaagatg

SEQ ID NO: 125175 - DNA, 103 bp, Artificial Sequence
  Synthetic Polynucleotide
taatacgactcactatagggccgttttctggtttggatcccctctttccgaacagaggagacggaaaatggggatccaaaacctggcggcagcgcaaaagatg

SEQ ID NO: 125176 - DNA, 103 bp, Artificial Sequence
  Synthetic Polynucleotide
taatacgactcactatagggtcttgggcttccgttttctggtttggatccaacagaggagaggatccatgccagaaaacaacctggcggcagcgcaaaagatg

SEQ ID NO: 125177 - DNA, 103 bp, Artificial Sequence
  Synthetic Polynucleotide
taatacgactcactatagggttattcaggttcttgggcttccgttttctgaacagaggagacagaaaatggaagcccaaaacctggcggcagcgcaaaagatg

SEQ ID NO: 125178 - DNA, 103 bp, Artificial Sequence
  Synthetic Polynucleotide
taatacgactcactatagggtgtcttagatttattcaggttcttgggcttaacagaggagaaagcccatgaacctgaataacctggcggcagcgcaaaagatg

SEQ ID NO: 125179 - DNA, 103 bp, Artificial Sequence
  Synthetic Polynucleotide
taatacgactcactataggggagctgctggtgtcttagatttattcaggtaacagaggagaacctgaatgaatctaagaaacctggcggcagcgcaaaagatg

SEQ ID NO: 125180 - DNA, 103 bp, Artificial Sequence
  Synthetic Polynucleotide
taatacgactcactatagggctgcctgaaggagctgctggtgtcttagataacagaggagaatctaaatgaccagcagcaacctggcggcagcgcaaaagatg

SEQ ID NO: 125181 - DNA, 103 bp, Artificial Sequence
  Synthetic Polynucleotide
taatacgactcactataggggctcgcggccagcgccaggctctggtacataacagaggagaatgtacatgagcctggcgaacctggcggcagcgcaaaagatg

SEQ ID NO: 125182 - DNA, 103 bp, Artificial Sequence
  Synthetic Polynucleotide
taatacgactcactatagggggggacgcgcgccggcggcacaaacatcggaacagaggagaccgatgatggtgccgccgaacctggcggcagcgcaaaagatg

SEQ ID NO: 125183 - DNA, 103 bp, Artificial Sequence
  Synthetic Polynucleotide
taatacgactcactatagggcccagggcacactggggacgccaggctgggaacagaggagacccagcatggcgtccccaaacctggcggcagcgcaaaagatg

SEQ ID NO: 125184 - DNA, 103 bp, Artificial Sequence
  Synthetic Polynucleotide
taatacgactcactatagggccatgctgggcccagggcacactggggacgaacagaggagacgtcccatgtgtgccctgaacctggcggcagcgcaaaagatg

SEQ ID NO: 125185 - DNA, 103 bp, Artificial Sequence
  Synthetic Polynucleotide
taatacgactcactataggggcctggggggccatgctgggcccagggcacaacagaggagagtgcccatggcccagcataacctggcggcagcgcaaaagatg

SEQ ID NO: 125186 - DNA, 103 bp, Artificial Sequence
  Synthetic Polynucleotide
taatacgactcactatagggctggccagaggcctggggggccatgctgggaacagaggagacccagcatggccccccagaacctggcggcagcgcaaaagatg

SEQ ID NO: 125187 - DNA, 103 bp, Artificial Sequence
  Synthetic Polynucleotide
taatacgactcactatagggagtcatcctcctggccagaggcctggggggaacagaggagaccccccatgcctctggccaacctggcggcagcgcaaaagatg

SEQ ID NO: 125188 - DNA, 103 bp, Artificial Sequence
  Synthetic Polynucleotide
taatacgactcactatagggggggcaagagagtcatcctcctggccagagaacagaggagactctggatgggaggatgaaacctggcggcagcgcaaaagatg

SEQ ID NO: 125189 - DNA, 103 bp, Artificial Sequence
  Synthetic Polynucleotide
taatacgactcactatagggcaagtggccgggggcaagagagtcatcctcaacagaggagagaggatatgtctcttgccaacctggcggcagcgcaaaagatg

SEQ ID NO: 125190 - DNA, 103 bp, Artificial Sequence
  Synthetic Polynucleotide
taatacgactcactatagggacttgaactccaagtggccgggggcaagagaacagaggagactcttgatgccggccactaacctggcggcagcgcaaaagatg

SEQ ID NO: 125191 - DNA, 103 bp, Artificial Sequence
  Synthetic Polynucleotide
taatacgactcactatagggtcaggctcgaacttgaactccaagtggccgaacagaggagacggccaatgggagttcaaaacctggcggcagcgcaaaagatg

SEQ ID NO: 125192 - DNA, 103 bp, Artificial Sequence
  Synthetic Polynucleotide
taatacgactcactatagggggcaaagtcctcaggctcgaacttgaactcaacagaggagagagttcatgttcgagcctaacctggcggcagcgcaaaagatg

SEQ ID NO: 125193 - DNA, 103 bp, Artificial Sequence
  Synthetic Polynucleotide
taatacgactcactatagggacagcatcgaggggacgcgcgccggcggcaaacagaggagatgccgcatgcgcgcgtccaacctggcggcagcgcaaaagatg

SEQ ID NO: 125194 - DNA, 103 bp, Artificial Sequence
  Synthetic Polynucleotide
taatacgactcactatagggtggaggggaaggcaaagtcctcaggctcgaaacagaggagatcgagcatgaggactttgaacctggcggcagcgcaaaagatg

SEQ ID NO: 125195 - DNA, 103 bp, Artificial Sequence
  Synthetic Polynucleotide
taatacgactcactatagggcttggggccgtggaggggaaggcaaagtccaacagaggagaggacttatgcttcccctcaacctggcggcagcgcaaaagatg

SEQ ID NO: 125196 - DNA, 103 bp, Artificial Sequence
  Synthetic Polynucleotide
taatacgactcactatagggagcctgggggcttggggccgtggaggggaaaacagaggagattccccatgacggccccaaacctggcggcagcgcaaaagatg

SEQ ID NO: 125197 - DNA, 103 bp, Artificial Sequence
  Synthetic Polynucleotide
taatacgactcactatagggccctgaggccagcctgggggcttggggccgaacagaggagacggcccatggcccccaggaacctggcggcagcgcaaaagatg

SEQ ID NO: 125198 - DNA, 103 bp, Artificial Sequence
  Synthetic Polynucleotide
taatacgactcactatagggcgcagagcccccctgaggccagcctgggggaacagaggagacccccaatgtggcctcagaacctggcggcagcgcaaaagatg

SEQ ID NO: 125199 - DNA, 103 bp, Artificial Sequence
  Synthetic Polynucleotide
taatacgactcactatagggggcctcttggcgcagagcccccctgaggccaacagaggagaggcctcatgggggctctgaacctggcggcagcgcaaaagatg

SEQ ID NO: 125200 - DNA, 103 bp, Artificial Sequence
  Synthetic Polynucleotide
taatacgactcactataggggcgcacaccaggcctcttggcgcagagcccaacagaggagagggctcatggccaagaggaacctggcggcagcgcaaaagatg

SEQ ID NO: 125201 - DNA, 103 bp, Artificial Sequence
  Synthetic Polynucleotide
taatacgactcactataggggccaaggccagcgcacaccaggcctcttggaacagaggagaccaagaatgctggtgtgcaacctggcggcagcgcaaaagatg

SEQ ID NO: 125202 - DNA, 103 bp, Artificial Sequence
  Synthetic Polynucleotide
taatacgactcactataggggacaggtaggacagcatcgaggggacgcgcaacagaggagagcgcgtatgctcgatgctaacctggcggcagcgcaaaagatg

SEQ ID NO: 125203 - DNA, 103 bp, Artificial Sequence
  Synthetic Polynucleotide
taatacgactcactatagggctcacacccggacaggtaggacagcatcgaaacagaggagatcgatgatgtcctacctgaacctggcggcagcgcaaaagatg

SEQ ID NO: 125204 - DNA, 103 bp, Artificial Sequence
  Synthetic Polynucleotide
taatacgactcactataggggcgggctcggctcacacccggacaggtaggaacagaggagacctaccatgccgggtgtgaacctggcggcagcgcaaaagatg

SEQ ID NO: 125205 - DNA, 103 bp, Artificial Sequence
  Synthetic Polynucleotide
taatacgactcactatagggtcggggggctgcgggctcggctcacacccgaacagaggagacgggtgatggccgagcccaacctggcggcagcgcaaaagatg

SEQ ID NO: 125206 - DNA, 103 bp, Artificial Sequence
  Synthetic Polynucleotide
taatacgactcactatagggcgcagcgagctcggggggctgcgggctcggaacagaggagaccgagcatgcagccccccaacctggcggcagcgcaaaagatg

SEQ ID NO: 125207 - DNA, 103 bp, Artificial Sequence
  Synthetic Polynucleotide
taatacgactcactatagggagccggggcgcgcagcgagctcggggggctaacagaggagaagccccatgagctcgctgaacctggcggcagcgcaaaagatg

SEQ ID NO: 125208 - DNA, 103 bp, Artificial Sequence
  Synthetic Polynucleotide
taatacgactcactataggggtctgcgcccagccggggcgcgcagcgagcaacagaggagagctcgcatggcgccccggaacctggcggcagcgcaaaagatg

SEQ ID NO: 125209 - DNA, 103 bp, Artificial Sequence
  Synthetic Polynucleotide
taatacgactcactatagggcgcggtggctgtctgcgcccagccggggcgaacagaggagacgccccatgtgggcgcagaacctggcggcagcgcaaaagatg

SEQ ID NO: 125210 - DNA, 103 bp, Artificial Sequence
  Synthetic Polynucleotide
taatacgactcactatagggcctggcgggggctcgcggccagcgccaggcaacagaggagagcctggatgtggccgcgaaacctggcggcagcgcaaaagatg

SEQ ID NO: 125211 - DNA, 103 bp, Artificial Sequence
  Synthetic Polynucleotide
taatacgactcactatagggccgacgaatccgcggtggctgtctgcgcccaacagaggagagggcgcatgcagccaccgaacctggcggcagcgcaaaagatg

SEQ ID NO: 125212 - DNA, 103 bp, Artificial Sequence
  Synthetic Polynucleotide
taatacgactcactataggggggccgaaggccgacgaatccgcggtggctaacagaggagaagccacatgggattcgtcaacctggcggcagcgcaaaagatg

SEQ ID NO: 125213 - DNA, 103 bp, Artificial Sequence
  Synthetic Polynucleotide
taatacgactcactatagggcggactgcccgggccgaaggccgacgaatcaacagaggagagattcgatggccttcggcaacctggcggcagcgcaaaagatg

SEQ ID NO: 125214 - DNA, 103 bp, Artificial Sequence
  Synthetic Polynucleotide
taatacgactcactatagggctggggggtgcggactgcccgggccgaaggaacagaggagaccttcgatgcgggcagtcaacctggcggcagcgcaaaagatg

SEQ ID NO: 125215 - DNA, 103 bp, Artificial Sequence
  Synthetic Polynucleotide
taatacgactcactataggggggtgcgcggctggggggtgcggactgcccaacagaggagagggcagatggcaccccccaacctggcggcagcgcaaaagatg

SEQ ID NO: 125216 - DNA, 103 bp, Artificial Sequence
  Synthetic Polynucleotide
taatacgactcactatagggggccccgggcgggtgcgcggctggggggtgaacagaggagacaccccatggccgcgcacaacctggcggcagcgcaaaagatg

SEQ ID NO: 125217 - DNA, 103 bp, Artificial Sequence
  Synthetic Polynucleotide
taatacgactcactatagggggaaggcggtggccccgggcgggtgcgcggaacagaggagaccgcgcatgcgcccggggaacctggcggcagcgcaaaagatg

SEQ ID NO: 125218 - DNA, 103 bp, Artificial Sequence
  Synthetic Polynucleotide
taatacgactcactatagggtgcgcgaaagggaaggcggtggccccgggcaacagaggagagcccggatgcaccgccttaacctggcggcagcgcaaaagatg

SEQ ID NO: 125219 - DNA, 103 bp, Artificial Sequence
  Synthetic Polynucleotide
taatacgactcactatagggcgaggggctgtgcgcgaaagggaaggcggtaacagaggagaaccgccatgcctttcgcgaacctggcggcagcgcaaaagatg

SEQ ID NO: 125220 - DNA, 103 bp, Artificial Sequence
  Synthetic Polynucleotide
taatacgactcactatagggtgccgggccccgaggggctgtgcgcgaaagaacagaggagactttcgatgacagcccctaacctggcggcagcgcaaaagatg

SEQ ID NO: 125221 - DNA, 103 bp, Artificial Sequence
  Synthetic Polynucleotide
taatacgactcactataggggcgtaggcggcctggcgggggctcgcggccaacagaggagaggccgcatgcccccgccaaacctggcggcagcgcaaaagatg

SEQ ID NO: 125222 - DNA, 103 bp, Artificial Sequence
  Synthetic Polynucleotide
taatacgactcactatagggctgccgccgctgccgggccccgaggggctgaacagaggagacagcccatgggggcccggaacctggcggcagcgcaaaagatg

SEQ ID NO: 125223 - DNA, 103 bp, Artificial Sequence
  Synthetic Polynucleotide
taatacgactcactataggggccccccgcgctgccgccgctgccgggcccaacagaggagagggcccatgagcggcggcaacctggcggcagcgcaaaagatg

SEQ ID NO: 125224 - DNA, 103 bp, Artificial Sequence
  Synthetic Polynucleotide
taatacgactcactatagggtgccgtctcggccccccgcgctgccgccgcaacagaggagagcggcgatggcgcgggggaacctggcggcagcgcaaaagatg

SEQ ID NO: 125225 - DNA, 103 bp, Artificial Sequence
  Synthetic Polynucleotide
taatacgactcactatagggtggtaggcactgccgtctcggccccccgcgaacagaggagacgcgggatgccgagacggaacctggcggcagcgcaaaagatg

SEQ ID NO: 125226 - DNA, 103 bp, Artificial Sequence
  Synthetic Polynucleotide
taatacgactcactatagggcagcgcgccctggtaggcactgccgtctcgaacagaggagacgagacatgagtgcctacaacctggcggcagcgcaaaagatg

SEQ ID NO: 125227 - DNA, 103 bp, Artificial Sequence
  Synthetic Polynucleotide
taatacgactcactatagggctcgaggcaacagcgcgccctggtaggcacaacagaggagagtgcctatgagggcgcgcaacctggcggcagcgcaaaagatg

SEQ ID NO: 125228 - DNA, 103 bp, Artificial Sequence
  Synthetic Polynucleotide
taatacgactcactataggggcgaactgttctcgaggcaacagcgcgcccaacagaggagagggcgcatggttgcctcgaacctggcggcagcgcaaaagatg

SEQ ID NO: 125229 - DNA, 103 bp, Artificial Sequence
  Synthetic Polynucleotide
taatacgactcactatagggaagcggggccgcgaactgttctcgaggcaaaacagaggagattgcctatggaacagttcaacctggcggcagcgcaaaagatg

SEQ ID NO: 125230 - DNA, 103 bp, Artificial Sequence
  Synthetic Polynucleotide
taatacgactcactatagggccggccgcccaagcggggccgcgaactgttaacagaggagaaacagtatgcggccccgcaacctggcggcagcgcaaaagatg

SEQ ID NO: 125231 - DNA, 103 bp, Artificial Sequence
  Synthetic Polynucleotide
taatacgactcactataggggaggtccccaccggccgcccaagcggggccaacagaggagaggccccatgtgggcggccaacctggcggcagcgcaaaagatg

SEQ ID NO: 125232 - DNA, 103 bp, Artificial Sequence
  Synthetic Polynucleotide
taatacgactcactataggggcccgagtcggcgtaggcggcctggcggggaacagaggagaccccgcatggccgcctacaacctggcggcagcgcaaaagatg

SEQ ID NO: 125233 - DNA, 103 bp, Artificial Sequence
  Synthetic Polynucleotide
taatacgactcactatagggggcggagtacgaggtccccaccggccgcccaacagaggagagggcggatggtggggaccaacctggcggcagcgcaaaagatg

SEQ ID NO: 125234 - DNA, 103 bp, Artificial Sequence
  Synthetic Polynucleotide
taatacgactcactatagggccgggtaggtggcggagtacgaggtccccaaacagaggagatggggaatgcgtactccgaacctggcggcagcgcaaaagatg

SEQ ID NO: 125235 - DNA, 103 bp, Artificial Sequence
  Synthetic Polynucleotide
taatacgactcactatagggctcacgtaggccgggtaggtggcggagtacaacagaggagagtactcatgcacctacccaacctggcggcagcgcaaaagatg

SEQ ID NO: 125236 - DNA, 103 bp, Artificial Sequence
  Synthetic Polynucleotide
taatacgactcactatagggcacgtcggggctcacgtaggccgggtaggtaacagaggagaacctacatggcctacgtgaacctggcggcagcgcaaaagatg

SEQ ID NO: 125237 - DNA, 103 bp, Artificial Sequence
  Synthetic Polynucleotide
taatacgactcactatagggaggactgggccacgtcggggctcacgtaggaacagaggagacctacgatggccccgacgaacctggcggcagcgcaaaagatg

SEQ ID NO: 125238 - DNA, 103 bp, Artificial Sequence
  Synthetic Polynucleotide
taatacgactcactatagggccggcagtccaggactgggccacgtcggggaacagaggagaccccgaatgggcccagtcaacctggcggcagcgcaaaagatg

SEQ ID NO: 125239 - DNA, 103 bp, Artificial Sequence
  Synthetic Polynucleotide
taatacgactcactatagggatcgaagggcccggcagtccaggactgggcaacagaggagagcccagatgtggactgccaacctggcggcagcgcaaaagatg

SEQ ID NO: 125240 - DNA, 103 bp, Artificial Sequence
  Synthetic Polynucleotide
taatacgactcactatagggggacgctgccatcgaagggcccggcagtccaacagaggagaggactgatgggcccttcgaacctggcggcagcgcaaaagatg

SEQ ID NO: 125241 - DNA, 103 bp, Artificial Sequence
  Synthetic Polynucleotide
taatacgactcactatagggaggccgtgcaggacgctgccatcgaagggcaacagaggagagcccttatgtggcagcgtaacctggcggcagcgcaaaagatg

SEQ ID NO: 125242 - DNA, 103 bp, Artificial Sequence
  Synthetic Polynucleotide
taatacgactcactataggggcggcctgggaggccgtgcaggacgctgccaacagaggagaggcagcatgctgcacggcaacctggcggcagcgcaaaagatg

SEQ ID NO: 125243 - DNA, 103 bp, Artificial Sequence
  Synthetic Polynucleotide
taatacgactcactataggggcaggaaggagcccgagtcggcgtaggcggaacagaggagaccgcctatgccgactcggaacctggcggcagcgcaaaagatg

SEQ ID NO: 125244 - DNA, 103 bp, Artificial Sequence
  Synthetic Polynucleotide
taatacgactcactatagggaggtgggcctgcggcctgggaggccgtgcaaacagaggagatgcacgatgtcccaggccaacctggcggcagcgcaaaagatg

SEQ ID NO: 125245 - DNA, 103 bp, Artificial Sequence
  Synthetic Polynucleotide
taatacgactcactatagggtcggacacgaaggtgggcctgcggcctgggaacagaggagacccaggatgcaggcccacaacctggcggcagcgcaaaagatg

SEQ ID NO: 125246 - DNA, 103 bp, Artificial Sequence
  Synthetic Polynucleotide
taatacgactcactatagggctccaagaagtcggacacgaaggtgggcctaacagaggagaaggcccatgttcgtgtccaacctggcggcagcgcaaaagatg

SEQ ID NO: 125247 - DNA, 103 bp, Artificial Sequence
  Synthetic Polynucleotide
taatacgactcactatagggccgggaactcctccaagaagtcggacacgaaacagaggagatcgtgtatgacttcttggaacctggcggcagcgcaaaagatg

SEQ ID NO: 125248 - DNA, 103 bp, Artificial Sequence
  Synthetic Polynucleotide
taatacgactcactatagggcgaccctcacccgggaactcctccaagaagaacagaggagacttcttatgggagttcccaacctggcggcagcgcaaaagatg

SEQ ID NO: 125249 - DNA, 103 bp, Artificial Sequence
  Synthetic Polynucleotide
taatacgactcactataggggacacactcacgaccctcacccgggaactcaacagaggagagagttcatgggtgagggtaacctggcggcagcgcaaaagatg

SEQ ID NO: 125250 - DNA, 103 bp, Artificial Sequence
  Synthetic Polynucleotide
taatacgactcactatagggccccgcagttgacacactcacgaccctcacaacagaggagagtgaggatggtgagtgtgaacctggcggcagcgcaaaagatg

SEQ ID NO: 125251 - DNA, 103 bp, Artificial Sequence
  Synthetic Polynucleotide
taatacgactcactataggggtggacagggccccgcagttgacacactcaaacagaggagatgagtgatgcaactgcggaacctggcggcagcgcaaaagatg

SEQ ID NO: 125252 - DNA, 103 bp, Artificial Sequence
  Synthetic Polynucleotide
taatacgactcactatagggccacagcggtgtggacagggccccgcagttaacagaggagaaactgcatggccctgtccaacctggcggcagcgcaaaagatg

SEQ ID NO: 125253 - DNA, 103 bp, Artificial Sequence
  Synthetic Polynucleotide
taatacgactcactatagggcgtctcggcgccacagcggtgtggacagggaacagaggagaccctgtatgcaccgctgtaacctggcggcagcgcaaaagatg

SEQ ID NO: 125254 - DNA, 103 bp, Artificial Sequence
  Synthetic Polynucleotide
taatacgactcactatagggcccggagcgtgcaggaaggagcccgagtcgaacagaggagacgactcatgctccttcctaacctggcggcagcgcaaaagatg

SEQ ID NO: 125255 - DNA, 103 bp, Artificial Sequence
  Synthetic Polynucleotide
taatacgactcactatagggtggccggtgccgtctcggcgccacagcggtaacagaggagaaccgctatggcgccgagaaacctggcggcagcgcaaaagatg

SEQ ID NO: 125256 - DNA, 103 bp, Artificial Sequence
  Synthetic Polynucleotide
taatacgactcactataggggcacaggtagtggccggtgccgtctcggcgaacagaggagacgccgaatgggcaccggcaacctggcggcagcgcaaaagatg

SEQ ID NO: 125257 - DNA, 103 bp, Artificial Sequence
  Synthetic Polynucleotide
taatacgactcactatagggcgcaggcattgcacaggtagtggccggtgcaacagaggagagcaccgatgactacctgtaacctggcggcagcgcaaaagatg

SEQ ID NO: 125258 - DNA, 103 bp, Artificial Sequence
  Synthetic Polynucleotide
taatacgactcactatagggtggtagaggccgcaggcattgcacaggtagaacagaggagactacctatgcaatgcctgaacctggcggcagcgcaaaagatg

SEQ ID NO: 125259 - DNA, 103 bp, Artificial Sequence
  Synthetic Polynucleotide
taatacgactcactatagggattcatcttgtggtagaggccgcaggcattaacagaggagaaatgccatgggcctctacaacctggcggcagcgcaaaagatg

SEQ ID NO: 125260 - DNA, 103 bp, Artificial Sequence
  Synthetic Polynucleotide
taatacgactcactatagggggttgacgccattcatcttgtggtagaggcaacagaggagagcctctatgacaagatgaaacctggcggcagcgcaaaagatg

SEQ ID NO: 125261 - DNA, 103 bp, Artificial Sequence
  Synthetic Polynucleotide
taatacgactcactatagggacgagcggccggttgacgccattcatcttgaacagaggagacaagatatgtggcgtcaaaacctggcggcagcgcaaaagatg

SEQ ID NO: 125262 - DNA, 103 bp, Artificial Sequence
  Synthetic Polynucleotide
taatacgactcactatagggctgaggccgaacgagcggccggttgacgccaacagaggagaggcgtcatgcggccgctcaacctggcggcagcgcaaaagatg

SEQ ID NO: 125263 - DNA, 103 bp, Artificial Sequence
  Synthetic Polynucleotide
taatacgactcactatagggacaggcgcttctgaggccgaacgagcggccaacagaggagaggccgcatgttcggcctcaacctggcggcagcgcaaaagatg

SEQ ID NO: 125264 - DNA, 103 bp, Artificial Sequence
  Synthetic Polynucleotide
taatacgactcactatagggcgggacgaggacaggcgcttctgaggccgaaacagaggagatcggccatggaagcgcctaacctggcggcagcgcaaaagatg

SEQ ID NO: 125265 - DNA, 103 bp, Artificial Sequence
  Synthetic Polynucleotide
taatacgactcactatagggagagccggcgcccggagcgtgcaggaaggaaacagaggagatccttcatgcacgctccgaacctggcggcagcgcaaaagatg

SEQ ID NO: 125266 - DNA, 103 bp, Artificial Sequence
  Synthetic Polynucleotide
taatacgactcactataggggccggcgcggcgggacgaggacaggcgcttaacagaggagaaagcgcatgtcctcgtccaacctggcggcagcgcaaaagatg

SEQ ID NO: 125267 - DNA, 103 bp, Artificial Sequence
  Synthetic Polynucleotide
taatacgactcactatagggtgcagcagaggccggcgcggcgggacgaggaacagaggagacctcgtatggccgcgccgaacctggcggcagcgcaaaagatg

SEQ ID NO: 125268 - DNA, 103 bp, Artificial Sequence
  Synthetic Polynucleotide
taatacgactcactatagggtggcagttggtgcagcagaggccggcgcggaacagaggagaccgcgcatgcctctgctgaacctggcggcagcgcaaaagatg

SEQ ID NO: 125269 - DNA, 103 bp, Artificial Sequence
  Synthetic Polynucleotide
taatacgactcactataggggttggtcgtgtggcagttggtgcagcagagaacagaggagactctgcatgaccaactgcaacctggcggcagcgcaaaagatg

SEQ ID NO: 125270 - DNA, 103 bp, Artificial Sequence
  Synthetic Polynucleotide
taatacgactcactatagggacagcgtggtgttggtcgtgtggcagttggaacagaggagaccaactatgacacgaccaaacctggcggcagcgcaaaagatg

SEQ ID NO: 125271 - DNA, 103 bp, Artificial Sequence
  Synthetic Polynucleotide
taatacgactcactatagggttccgccgccacagcgtggtgttggtcgtgaacagaggagacacgacatgcaccacgctaacctggcggcagcgcaaaagatg

SEQ ID NO: 125272 - DNA, 103 bp, Artificial Sequence
  Synthetic Polynucleotide
taatacgactcactatagggcccctccgagttccgccgccacagcgtggtaacagaggagaaccacgatgtggcggcggaacctggcggcagcgcaaaagatg

SEQ ID NO: 125273 - DNA, 103 bp, Artificial Sequence
  Synthetic Polynucleotide
taatacgactcactatagggacacgggctccccctccgagttccgccgccaacagaggagaggcggcatgactcggaggaacctggcggcagcgcaaaagatg

SEQ ID NO: 125274 - DNA, 103 bp, Artificial Sequence
  Synthetic Polynucleotide
taatacgactcactatagggcaggcattgcacacgggctccccctccgagaacagaggagactcggaatgggagcccgtaacctggcggcagcgcaaaagatg

SEQ ID NO: 125275 - DNA, 103 bp, Artificial Sequence
  Synthetic Polynucleotide
taatacgactcactataggggtagaggccgcaggcattgcacacgggctcaacagaggagagagcccatgtgcaatgccaacctggcggcagcgcaaaagatg

SEQ ID NO: 125276 - DNA, 103 bp, Artificial Sequence
  Synthetic Polynucleotide
taatacgactcactatagggcaaacatcggagagccggcgcccggagcgtaacagaggagaacgctcatggcgccggctaacctggcggcagcgcaaaagatg

SEQ ID NO: 125277 - DNA, 103 bp, Artificial Sequence
  Synthetic Polynucleotide
taatacgactcactataggggcagcttcatgtagaggccgcaggcattgcaacagaggagagcaatgatggcggcctctaacctggcggcagcgcaaaagatg

SEQ ID NO: 125278 - DNA, 103 bp, Artificial Sequence
  Synthetic Polynucleotide
taatacgactcactatagggggcaccccgtgcagcttcatgtagaggccgaacagaggagacggcctatgcatgaagctaacctggcggcagcgcaaaagatg

SEQ ID NO: 125279 - DNA, 103 bp, Artificial Sequence
  Synthetic Polynucleotide
taatacgactcactatagggcagaggccgcggcaccccgtgcagcttcataacagaggagaatgaagatgcacggggtgaacctggcggcagcgcaaaagatg

SEQ ID NO: 125280 - DNA, 103 bp, Artificial Sequence
  Synthetic Polynucleotide
taatacgactcactatagggtcttcatagccagaggccgcggcaccccgtaacagaggagaacggggatgcgcggcctcaacctggcggcagcgcaaaagatg

SEQ ID NO: 125281 - DNA, 103 bp, Artificial Sequence
  Synthetic Polynucleotide
taatacgactcactatagggatgctttccttcttcatagccagaggccgcaacagaggagagcggccatgggctatgaaaacctggcggcagcgcaaaagatg

SEQ ID NO: 125282 - DNA, 103 bp, Artificial Sequence
  Synthetic Polynucleotide
taatacgactcactatagggccgtgtctggatgctttccttcttcatagcaacagaggagagctatgatgaaggaaagcaacctggcggcagcgcaaaagatg

SEQ ID NO: 125283 - DNA, 103 bp, Artificial Sequence
  Synthetic Polynucleotide
taatacgactcactataggggcttccgcttccgtgtctggatgctttcctaacagaggagaaggaaaatgtccagacacaacctggcggcagcgcaaaagatg

SEQ ID NO: 125284 - DNA, 103 bp, Artificial Sequence
  Synthetic Polynucleotide
taatacgactcactatagggatggtctttggcttccgcttccgtgtctggaacagaggagaccagacatggaagcggaaaacctggcggcagcgcaaaagatg

SEQ ID NO: 125285 - DNA, 103 bp, Artificial Sequence
  Synthetic Polynucleotide
taatacgactcactatagggggccttggcgatggtctttggcttccgcttaacagaggagaaagcggatgccaaagaccaacctggcggcagcgcaaaagatg

SEQ ID NO: 125286 - DNA, 103 bp, Artificial Sequence
  Synthetic Polynucleotide
taatacgactcactatagggaggagcccctggccttggcgatggtctttgaacagaggagacaaagaatgtcgccaaggaacctggcggcagcgcaaaagatg

SEQ ID NO: 125287 - DNA, 103 bp, Artificial Sequence
  Synthetic Polynucleotide
taatacgactcactataggggccggcggcacaaacatcggagagccggcgaacagaggagacgccggatgtccgatgttaacctggcggcagcgcaaaagatg

SEQ ID NO: 125288 - DNA, 103 bp, Artificial Sequence
  Synthetic Polynucleotide
taatacgactcactataggggtggatcctgaggagcccctggccttggcgaacagaggagacgccaaatgcaggggctcaacctggcggcagcgcaaaagatg

SEQ ID NO: 125289 - DNA, 103 bp, Artificial Sequence
  Synthetic Polynucleotide
taatacgactcactatagggggcattccttgtggatcctgaggagcccctaacagaggagaaggggcatgtcaggatccaacctggcggcagcgcaaaagatg

SEQ ID NO: 125290 - DNA, 103 bp, Artificial Sequence
  Synthetic Polynucleotide
taatacgactcactataggggggaggccgaggcattccttgtggatcctgaacagaggagacaggatatgcaaggaatgaacctggcggcagcgcaaaagatg

SEQ ID NO: 125291 - DNA, 103 bp, Artificial Sequence
  Synthetic Polynucleotide
taatacgactcactatagggacagcagatggggaggccgaggcattccttaacagaggagaaaggaaatgctcggcctcaacctggcggcagcgcaaaagatg

SEQ ID NO: 125292 - DNA, 103 bp, Artificial Sequence
  Synthetic Polynucleotide
taatacgactcactatagggagtgctggcgacagcagatggggaggccgaaacagaggagatcggccatgccatctgctaacctggcggcagcgcaaaagatg

SEQ ID NO: 125293 - DNA, 103 bp, Artificial Sequence
  Synthetic Polynucleotide
taatacgactcactatagggctgagctgtcagtgctggcgacagcagatgaacagaggagacatctgatgtcgccagcaaacctggcggcagcgcaaaagatg

SEQ ID NO: 125294 - DNA, 103 bp, Artificial Sequence
  Synthetic Polynucleotide
taatacgactcactataggggaagtggctgctgagctgtcagtgctggcgaacagaggagacgccagatgtgacagctcaacctggcggcagcgcaaaagatg

SEQ ID NO: 125295 - DNA, 103 bp, Artificial Sequence
  Synthetic Polynucleotide
taatacgactcactatagggcttggctttcgaagtggctgctgagctgtcaacagaggagagacagcatggcagccactaacctggcggcagcgcaaaagatg

SEQ ID NO: 125296 - DNA, 103 bp, Artificial Sequence
  Synthetic Polynucleotide
taatacgactcactatagggccaggctgggcttggctttcgaagtggctgaacagaggagacagccaatgcgaaagccaaacctggcggcagcgcaaaagatg

SEQ ID NO: 125297 - DNA, 103 bp, Artificial Sequence
  Synthetic Polynucleotide
taatacgactcactatagggactggggacgccaggctgggcttggctttcaacagaggagagaaagcatggcccagcctaacctggcggcagcgcaaaagatg

SEQ ID NO: 125298 - DNA, 103 bp, Artificial Sequence
  Synthetic Polynucleotide
taatacgactcactatagggcaagcaccagccgccgtcagtcaaggccataacagaggagaatggccatgactgacggcaacctggcggcagcgcaaaagatg

SEQ ID NO: 125299 - DNA, 103 bp, Artificial Sequence
  Synthetic Polynucleotide
taatacgactcactatagggagagatgggggaaggcggcgtggagggctcaacagaggagagagcccatgacgccgcctaacctggcggcagcgcaaaagatg

SEQ ID NO: 125300 - DNA, 103 bp, Artificial Sequence
  Synthetic Polynucleotide
taatacgactcactataggggtagggcgagtaggggctcggatggtggtgaacagaggagacaccacatgccgagccccaacctggcggcagcgcaaaagatg

SEQ ID NO: 125301 - DNA, 103 bp, Artificial Sequence
  Synthetic Polynucleotide
taatacgactcactataggggcgcccccacgtagggcgagtaggggctcgaacagaggagacgagccatgactcgccctaacctggcggcagcgcaaaagatg

SEQ ID NO: 125302 - DNA, 103 bp, Artificial Sequence
  Synthetic Polynucleotide
taatacgactcactatagggggcgtcagtggcgcccccacgtagggcgagaacagaggagactcgccatgcgtgggggcaacctggcggcagcgcaaaagatg

SEQ ID NO: 125303 - DNA, 103 bp, Artificial Sequence
  Synthetic Polynucleotide
taatacgactcactataggggggccaggcaggcgtcagtggcgcccccacaacagaggagagtggggatgccactgacgaacctggcggcagcgcaaaagatg

SEQ ID NO: 125304 - DNA, 103 bp, Artificial Sequence
  Synthetic Polynucleotide
taatacgactcactatagggagggtccggcgggccaggcaggcgtcagtgaacagaggagacactgaatgctgcctggcaacctggcggcagcgcaaaagatg

SEQ ID NO: 125305 - DNA, 103 bp, Artificial Sequence
  Synthetic Polynucleotide
taatacgactcactatagggggggtctcgaagggtccggcgggccaggcaaacagaggagatgcctgatgcgccggaccaacctggcggcagcgcaaaagatg

SEQ ID NO: 125306 - DNA, 103 bp, Artificial Sequence
  Synthetic Polynucleotide
taatacgactcactataggggtgcagcaccggggtctcgaagggtccggcaacagaggagagccggaatgttcgagaccaacctggcggcagcgcaaaagatg

SEQ ID NO: 125307 - DNA, 103 bp, Artificial Sequence
  Synthetic Polynucleotide
taatacgactcactatagggtctgcaggctgtgcagcaccggggtctcgaaacagaggagatcgagaatgcggtgctgcaacctggcggcagcgcaaaagatg

SEQ ID NO: 125308 - DNA, 103 bp, Artificial Sequence
  Synthetic Polynucleotide
taatacgactcactatagggccggcgcggctctgcaggctgtgcagcaccaacagaggagaggtgctatgcagcctgcaaacctggcggcagcgcaaaagatg

SEQ ID NO: 125309 - DNA, 103 bp, Artificial Sequence
  Synthetic Polynucleotide
taatacgactcactataggggagcggggctccggcgcggctctgcaggctaacagaggagaagcctgatgagccgcgccaacctggcggcagcgcaaaagatg

SEQ ID NO: 125310 - DNA, 103 bp, Artificial Sequence
  Synthetic Polynucleotide
taatacgactcactatagggaggacgaggaagagatgggggaaggcggcgaacagaggagacgccgcatgcccccatctaacctggcggcagcgcaaaagatg

SEQ ID NO: 125311 - DNA, 103 bp, Artificial Sequence
  Synthetic Polynucleotide
taatacgactcactatagggggggcaccgggagcggggctccggcgcggcaacagaggagagccgcgatggagccccgcaacctggcggcagcgcaaaagatg

SEQ ID NO: 125312 - DNA, 103 bp, Artificial Sequence
  Synthetic Polynucleotide
taatacgactcactatagggctgggaccccggggcaccgggagcggggctaacagaggagaagccccatgcccggtgccaacctggcggcagcgcaaaagatg

SEQ ID NO: 125313 - DNA, 103 bp, Artificial Sequence
  Synthetic Polynucleotide
taatacgactcactatagggcaggtctgcactgggaccccggggcaccggaacagaggagaccggtgatgcggggtcccaacctggcggcagcgcaaaagatg

SEQ ID NO: 125314 - DNA, 103 bp, Artificial Sequence
  Synthetic Polynucleotide
taatacgactcactatagggggtcctccagcaggtctgcactgggaccccaacagaggagaggggtcatggtgcagaccaacctggcggcagcgcaaaagatg

SEQ ID NO: 125315 - DNA, 103 bp, Artificial Sequence
  Synthetic Polynucleotide
taatacgactcactatagggctctcggacaggtcctccagcaggtctgcaaacagaggagatgcagaatggctggaggaaacctggcggcagcgcaaaagatg

SEQ ID NO: 125316 - DNA, 103 bp, Artificial Sequence
  Synthetic Polynucleotide
taatacgactcactataggggcactcgcggctctcggacaggtcctccagaacagaggagactggagatgctgtccgagaacctggcggcagcgcaaaagatg

SEQ ID NO: 125317 - DNA, 103 bp, Artificial Sequence
  Synthetic Polynucleotide
taatacgactcactatagggcgcagttcacgcactcgcggctctcggacaaacagaggagatgtccgatggccgcgagtaacctggcggcagcgcaaaagatg

SEQ ID NO: 125318 - DNA, 103 bp, Artificial Sequence
  Synthetic Polynucleotide
taatacgactcactatagggtggatggagccgcagttcacgcactcgcggaacagaggagaccgcgaatgcgtgaactgaacctggcggcagcgcaaaagatg

SEQ ID NO: 125319 - DNA, 103 bp, Artificial Sequence
  Synthetic Polynucleotide
taatacgactcactatagggcagcggcgtctggatggagccgcagttcacaacagaggagagtgaacatgggctccatcaacctggcggcagcgcaaaagatg

SEQ ID NO: 125320 - DNA, 103 bp, Artificial Sequence
  Synthetic Polynucleotide
taatacgactcactatagggcccgccgccacagcggcgtctggatggagcaacagaggagagctccaatgagacgccgcaacctggcggcagcgcaaaagatg

SEQ ID NO: 125321 - DNA, 103 bp, Artificial Sequence
  Synthetic Polynucleotide
taatacgactcactataggggagcaggaggaggacgaggaagagatggggaacagaggagaccccatatgttcctcgtcaacctggcggcagcgcaaaagatg

SEQ ID NO: 125322 - DNA, 103 bp, Artificial Sequence
  Synthetic Polynucleotide
taatacgactcactatagggccggtgccgtcccgccgccacagcggcgtcaacagaggagagacgccatggtggcggcgaacctggcggcagcgcaaaagatg

SEQ ID NO: 125323 - DNA, 103 bp, Artificial Sequence
  Synthetic Polynucleotide
taatacgactcactatagggcaggtagtggccggtgccgtcccgccgccaaacagaggagatggcggatggacggcaccaacctggcggcagcgcaaaagatg

SEQ ID NO: 125324 - DNA, 103 bp, Artificial Sequence
  Synthetic Polynucleotide
taatacgactcactatagggaggcgttgcacaggtagtggccggtgccgtaacagaggagaacggcaatggccactaccaacctggcggcagcgcaaaagatg

SEQ ID NO: 125325 - DNA, 103 bp, Artificial Sequence
  Synthetic Polynucleotide
taatacgactcactatagggtagagcccgcaggcgttgcacaggtagtggaacagaggagaccactaatggtgcaacgcaacctggcggcagcgcaaaagatg

SEQ ID NO: 125326 - DNA, 103 bp, Artificial Sequence
  Synthetic Polynucleotide
taatacgactcactatagggcatcttgctgtagagcccgcaggcgttgcaaacagaggagatgcaacatgtgcgggctcaacctggcggcagcgcaaaagatg

SEQ ID NO: 125327 - DNA, 103 bp, Artificial Sequence
  Synthetic Polynucleotide
taatacgactcactatagggtgaggccgttcatcttgctgtagagcccgcaacagaggagagcgggcatgacagcaagaaacctggcggcagcgcaaaagatg

SEQ ID NO: 125328 - DNA, 103 bp, Artificial Sequence
  Synthetic Polynucleotide
taatacgactcactatagggaggggccggctgaggccgttcatcttgctgaacagaggagacagcaaatggaacggcctaacctggcggcagcgcaaaagatg

SEQ ID NO: 125329 - DNA, 103 bp, Artificial Sequence
  Synthetic Polynucleotide
taatacgactcactatagggcggcttgatgaggggccggctgaggccgttaacagaggagaaacggcatgagccggcccaacctggcggcagcgcaaaagatg

SEQ ID NO: 125330 - DNA, 103 bp, Artificial Sequence
  Synthetic Polynucleotide
taatacgactcactatagggcgcgcttctgcggcttgatgaggggccggcaacagaggagagccggcatgtcatcaagcaacctggcggcagcgcaaaagatg

SEQ ID NO: 125331 - DNA, 103 bp, Artificial Sequence
  Synthetic Polynucleotide
taatacgactcactataggggatgaaggcacgcgcttctgcggcttgatgaacagaggagacatcaaatggcagaagcgaacctggcggcagcgcaaaagatg

SEQ ID NO: 125332 - DNA, 103 bp, Artificial Sequence
  Synthetic Polynucleotide
taatacgactcactatagggtccgccccgggagcaggaggaggacgaggaaacagaggagatcctcgatgtcctcctgcaacctggcggcagcgcaaaagatg

SEQ ID NO: 125333 - DNA, 103 bp, Artificial Sequence
  Synthetic Polynucleotide
taatacgactcactatagggaagccgccgtgatgaaggcacgcgcttctgaacagaggagacagaagatggtgccttcaaacctggcggcagcgcaaaagatg

SEQ ID NO: 125334 - DNA, 103 bp, Artificial Sequence
  Synthetic Polynucleotide
taatacgactcactatagggaggacaatccaagccgccgtgatgaaggcaaacagaggagatgccttatgcacggcggcaacctggcggcagcgcaaaagatg

SEQ ID NO: 125335 - DNA, 103 bp, Artificial Sequence
  Synthetic Polynucleotide
taatacgactcactatagggcagttggcacaggacaatccaagccgccgtaacagaggagaacggcgatgtggattgtcaacctggcggcagcgcaaaagatg

SEQ ID NO: 125336 - DNA, 103 bp, Artificial Sequence
  Synthetic Polynucleotide
taatacgactcactatagggtgtggtgtgacagttggcacaggacaatccaacagaggagaggattgatgtgtgccaacaacctggcggcagcgcaaaagatg

SEQ ID NO: 125337 - DNA, 103 bp, Artificial Sequence
  Synthetic Polynucleotide
taatacgactcactatagggaggtggtagttgtggtgtgacagttggcacaacagaggagagtgccaatggtcacaccaaacctggcggcagcgcaaaagatg

SEQ ID NO: 125338 - DNA, 103 bp, Artificial Sequence
  Synthetic Polynucleotide
taatacgactcactatagggctgcgccataaggtggtagttgtggtgtgaaacagaggagatcacacatgaactaccacaacctggcggcagcgcaaaagatg

SEQ ID NO: 125339 - DNA, 103 bp, Artificial Sequence
  Synthetic Polynucleotide
taatacgactcactatagggctcggcgtttctgcgccataaggtggtagtaacagaggagaactaccatgttatggcgcaacctggcggcagcgcaaaagatg

SEQ ID NO: 125340 - DNA, 103 bp, Artificial Sequence
  Synthetic Polynucleotide
taatacgactcactatagggcgggttcaccctcggcgtttctgcgccataaacagaggagatatggcatggaaacgccgaacctggcggcagcgcaaaagatg

SEQ ID NO: 125341 - DNA, 103 bp, Artificial Sequence
  Synthetic Polynucleotide
taatacgactcactataggggcattgcacacgggttcaccctcggcgtttaacagaggagaaaacgcatggggtgaaccaacctggcggcagcgcaaaagatg

SEQ ID NO: 125342 - DNA, 103 bp, Artificial Sequence
  Synthetic Polynucleotide
taatacgactcactataggggagtccacaagcattgcacacgggttcaccaacagaggagaggtgaaatggtgtgcaataacctggcggcagcgcaaaagatg

SEQ ID NO: 125343 - DNA, 103 bp, Artificial Sequence
  Synthetic Polynucleotide
taatacgactcactatagggggccccgctctccgccccgggagcaggaggaacagaggagacctcctatgcccggggcgaacctggcggcagcgcaaaagatg

SEQ ID NO: 125344 - DNA, 103 bp, Artificial Sequence
  Synthetic Polynucleotide
taatacgactcactataggggtttcatgtagagtccacaagcattgcacaaacagaggagatgtgcaatgcttgtggacaacctggcggcagcgcaaaagatg

SEQ ID NO: 125345 - DNA, 103 bp, Artificial Sequence
  Synthetic Polynucleotide
taatacgactcactatagggaccccatggagtttcatgtagagtccacaaaacagaggagattgtggatgctacatgaaaacctggcggcagcgcaaaagatg

SEQ ID NO: 125346 - DNA, 103 bp, Artificial Sequence
  Synthetic Polynucleotide
taatacgactcactatagggtggtctgggcaccccatggagtttcatgtaaacagaggagatacatgatgctccatgggaacctggcggcagcgcaaaagatg

SEQ ID NO: 125347 - DNA, 103 bp, Artificial Sequence
  Synthetic Polynucleotide
taatacgactcactatagggtcatagcaagtggtctgggcaccccatggaaacagaggagatccatgatgtgcccagacaacctggcggcagcgcaaaagatg

SEQ ID NO: 125348 - DNA, 103 bp, Artificial Sequence
  Synthetic Polynucleotide
taatacgactcactatagggccctcttttttcatagcaagtggtctgggcaacagaggagagcccagatgacttgctataacctggcggcagcgcaaaagatg

SEQ ID NO: 125349 - DNA, 103 bp, Artificial Sequence
  Synthetic Polynucleotide
taatacgactcactatagggggtttgaattccctcttttttcatagcaagaacagaggagacttgctatgaaaaaagagaacctggcggcagcgcaaaagatg

SEQ ID NO: 125350 - DNA, 103 bp, Artificial Sequence
  Synthetic Polynucleotide
taatacgactcactatagggttcgtttcctggtttgaattccctctttttaacagaggagaaaaaagatggaattcaaaaacctggcggcagcgcaaaagatg

SEQ ID NO: 125351 - DNA, 103 bp, Artificial Sequence
  Synthetic Polynucleotide
taatacgactcactatagggttcttaggttttcgtttcctggtttgaattaacagaggagaaattcaatgcaggaaacgaacctggcggcagcgcaaaagatg

SEQ ID NO: 125352 - DNA, 103 bp, Artificial Sequence
  Synthetic Polynucleotide
taatacgactcactatagggtttatttatgttcttaggttttcgtttcctaacagaggagaaggaaaatgaaacctaagaacctggcggcagcgcaaaagatg

SEQ ID NO: 125353 - DNA, 103 bp, Artificial Sequence
  Synthetic Polynucleotide
taatacgactcactatagggaagtctttgatttatttatgttcttaggttaacagaggagaaacctaatgacataaataaacctggcggcagcgcaaaagatg

SEQ ID NO: 125354 - DNA, 103 bp, Artificial Sequence
  Synthetic Polynucleotide
taatacgactcactataggggcgccgccggggccccgctctccgccccggaacagaggagaccggggatgagagcggggaacctggcggcagcgcaaaagatg

SEQ ID NO: 125355 - DNA, 103 bp, Artificial Sequence
  Synthetic Polynucleotide
taatacgactcactatagggttaccagagcaagtctttgatttatttatgaacagaggagacataaaatgatcaaagacaacctggcggcagcgcaaaagatg

SEQ ID NO: 125356 - DNA, 103 bp, Artificial Sequence
  Synthetic Polynucleotide
taatacgactcactatagggattattgctattaccagagcaagtctttgaaacagaggagatcaaagatgtgctctggtaacctggcggcagcgcaaaagatg

SEQ ID NO: 125357 - DNA, 103 bp, Artificial Sequence
  Synthetic Polynucleotide
taatacgactcactatagggtgggaatggaattattgctattaccagagcaacagaggagagctctgatgatagcaataaacctggcggcagcgcaaaagatg

SEQ ID NO: 125358 - DNA, 103 bp, Artificial Sequence
  Synthetic Polynucleotide
taatacgactcactataggggttggagtcatgggaatggaattattgctaaacagaggagatagcaaatgttccattccaacctggcggcagcgcaaaagatg

SEQ ID NO: 125359 - DNA, 103 bp, Artificial Sequence
  Synthetic Polynucleotide
taatacgactcactatagggagaggtggaagttggagtcatgggaatggaaacagaggagatccattatgatgactccaaacctggcggcagcgcaaaagatg

SEQ ID NO: 125360 - DNA, 103 bp, Artificial Sequence
  Synthetic Polynucleotide
taatacgactcactatagggctgagttagaagaggtggaagttggagtcaaacagaggagatgactcatgcttccacctaacctggcggcagcgcaaaagatg

SEQ ID NO: 125361 - DNA, 103 bp, Artificial Sequence
  Synthetic Polynucleotide
taatacgactcactatagggctgcaatcatctgagttagaagaggtggaaaacagaggagattccacatgttctaactcaacctggcggcagcgcaaaagatg

SEQ ID NO: 125362 - DNA, 103 bp, Artificial Sequence
  Synthetic Polynucleotide
taatacgactcactatagggagtatttttgctgcaatcatctgagttagaaacagaggagatctaacatggatgattgcaacctggcggcagcgcaaaagatg

SEQ ID NO: 125363 - DNA, 103 bp, Artificial Sequence
  Synthetic Polynucleotide
taatacgactcactatagggttgtgggggaagtatttttgctgcaatcataacagaggagaatgattatggcaaaaataaacctggcggcagcgcaaaagatg

SEQ ID NO: 125364 - DNA, 103 bp, Artificial Sequence
  Synthetic Polynucleotide
taatacgactcactataggggtaggttgtgttgtgggggaagtatttttgaacagaggagacaaaaaatgttcccccacaacctggcggcagcgcaaaagatg

SEQ ID NO: 125365 - DNA, 103 bp, Artificial Sequence
  Synthetic Polynucleotide
taatacgactcactataggggcagttgctggcgccgccggggccccgctcaacagaggagagagcggatgcccggcggcaacctggcggcagcgcaaaagatg

SEQ ID NO: 125366 - DNA, 103 bp, Artificial Sequence
  Synthetic Polynucleotide
taatacgactcactatagggccctgaggctgtaggttgtgttgtgggggaaacagaggagatcccccatgacacaacctaacctggcggcagcgcaaaagatg

SEQ ID NO: 125367 - DNA, 103 bp, Artificial Sequence
  Synthetic Polynucleotide
taatacgactcactataggggggcacccgcccctgaggctgtaggttgtgaacagaggagacacaacatgcagcctcagaacctggcggcagcgcaaaagatg

SEQ ID NO: 125368 - DNA, 103 bp, Artificial Sequence
  Synthetic Polynucleotide
taatacgactcactataggggtcatcaccggggcacccgcccctgaggctaacagaggagaagcctcatgggcgggtgcaacctggcggcagcgcaaaagatg

SEQ ID NO: 125369 - DNA, 103 bp, Artificial Sequence
  Synthetic Polynucleotide
taatacgactcactatagggtcccgcaccagtcatcaccggggcacccgcaacagaggagagcgggtatgccggtgatgaacctggcggcagcgcaaaagatg

SEQ ID NO: 125370 - DNA, 103 bp, Artificial Sequence
  Synthetic Polynucleotide
taatacgactcactatagggtggtgctctctcccgcaccagtcatcaccgaacagaggagacggtgaatgctggtgcggaacctggcggcagcgcaaaagatg

SEQ ID NO: 125371 - DNA, 103 bp, Artificial Sequence
  Synthetic Polynucleotide
taatacgactcactatagggttctcgggattggtgctctctcccgcaccaaacagaggagatggtgcatgagagagcacaacctggcggcagcgcaaaagatg

SEQ ID NO: 125372 - DNA, 103 bp, Artificial Sequence
  Synthetic Polynucleotide
taatacgactcactataggggagctcgctgttctcgggattggtgctctcaacagaggagagagagcatgaatcccgagaacctggcggcagcgcaaaagatg

SEQ ID NO: 125373 - DNA, 103 bp, Artificial Sequence
  Synthetic Polynucleotide
taatacgactcactatagggccgaatacttgagctcgctgttctcgggataacagaggagaatcccgatgacagcgagcaacctggcggcagcgcaaaagatg

SEQ ID NO: 125374 - DNA, 103 bp, Artificial Sequence
  Synthetic Polynucleotide
taatacgactcactatagggccatcttgacccgaatacttgagctcgctgaacagaggagacagcgaatgcaagtattcaacctggcggcagcgcaaaagatg

SEQ ID NO: 125375 - DNA, 103 bp, Artificial Sequence
  Synthetic Polynucleotide
taatacgactcactatagggtatgtagagcccatcttgacccgaatacttaacagaggagaaagtatatgggtcaagataacctggcggcagcgcaaaagatg

SEQ ID NO: 125376 - DNA, 103 bp, Artificial Sequence
  Synthetic Polynucleotide
taatacgactcactataggggaggcgtcccgcagttgctggcgccgccggaacagaggagaccggcgatgccagcaactaacctggcggcagcgcaaaagatg

SEQ ID NO: 125377 - DNA, 103 bp, Artificial Sequence
  Synthetic Polynucleotide
taatacgactcactataggggactgacgcctatgtagagcccatcttgacaacagaggagagtcaagatgggctctacaaacctggcggcagcgcaaaagatg

SEQ ID NO: 125378 - DNA, 103 bp, Artificial Sequence
  Synthetic Polynucleotide
taatacgactcactatagggggcgaggcgagactgacgcctatgtagagcaacagaggagagctctaatgaggcgtcagaacctggcggcagcgcaaaagatg

SEQ ID NO: 125379 - DNA, 103 bp, Artificial Sequence
  Synthetic Polynucleotide
taatacgactcactataggggacttcggccggcgaggcgagactgacgccaacagaggagaggcgtcatgctcgcctcgaacctggcggcagcgcaaaagatg

SEQ ID NO: 125380 - DNA, 103 bp, Artificial Sequence
  Synthetic Polynucleotide
taatacgactcactatagggcggaggacgtgacttcggccggcgaggcgaaacagaggagatcgcctatgcggccgaagaacctggcggcagcgcaaaagatg

SEQ ID NO: 125381 - DNA, 103 bp, Artificial Sequence
  Synthetic Polynucleotide
taatacgactcactatagggtccggtcgcacggaggacgtgacttcggccaacagaggagaggccgaatgcacgtcctcaacctggcggcagcgcaaaagatg

SEQ ID NO: 125382 - DNA, 103 bp, Artificial Sequence
  Synthetic Polynucleotide
taatacgactcactataggggcaccaggaatccggtcgcacggaggacgtaacagaggagaacgtccatggtgcgaccgaacctggcggcagcgcaaaagatg

SEQ ID NO: 125383 - DNA, 103 bp, Artificial Sequence
  Synthetic Polynucleotide
taatacgactcactataggggggccagggcgcaccaggaatccggtcgcaaacagaggagatgcgacatgattcctggtaacctggcggcagcgcaaaagatg

SEQ ID NO: 125384 - DNA, 103 bp, Artificial Sequence
  Synthetic Polynucleotide
taatacgactcactataggggtgtcgagctgaggcgtcccgcagttgctgaacagaggagacagcaaatgcgggacgccaacctggcggcagcgcaaaagatg

SEQ ID NO: 125385 - DNA, 103 bp, Artificial Sequence
  Synthetic Polynucleotide
taatacgactcactatagggcgccgcctccgtgtcgagctgaggcgtcccaacagaggagagggacgatgcagctcgacaacctggcggcagcgcaaaagatg

SEQ ID NO: 125386 - DNA, 103 bp, Artificial Sequence
  Synthetic Polynucleotide
taatacgactcactatagggagcgcttcggcaagcaccagccgccgtcagaacagaggagactgacgatggctggtgctaacctggcggcagcgcaaaagatg

SEQ ID NO: 125387 - DNA, 103 bp, Artificial Sequence
  Synthetic Polynucleotide
taatacgactcactatagggggggtccggccgccgcctccgtgtcgagctaacagaggagaagctcgatgcggaggcggaacctggcggcagcgcaaaagatg

SEQ ID NO: 125388 - DNA, 103 bp, Artificial Sequence
  Synthetic Polynucleotide
taatacgactcactataggggagcgggccgggggtccggccgccgcctccaacagaggagaggaggcatgggccggaccaacctggcggcagcgcaaaagatg

SEQ ID NO: 125389 - DNA, 103 bp, Artificial Sequence
  Synthetic Polynucleotide
taatacgactcactataggggagcagcagcgagcgggccgggggtccggcaacagaggagagccggaatgccggcccgcaacctggcggcagcgcaaaagatg

SEQ ID NO: 125390 - DNA, 103 bp, Artificial Sequence
  Synthetic Polynucleotide
taatacgactcactatagggcgtaggaactgagcagcagcgagcgggccgaacagaggagacggcccatgcgctgctgcaacctggcggcagcgcaaaagatg

SEQ ID NO: 125391 - DNA, 103 bp, Artificial Sequence
  Synthetic Polynucleotide
taatacgactcactatagggggatgcgaagcgtaggaactgagcagcagcaacagaggagagctgctatgcagttcctaaacctggcggcagcgcaaaagatg

SEQ ID NO: 125392 - DNA, 103 bp, Artificial Sequence
  Synthetic Polynucleotide
taatacgactcactatagggagccccgaagggatgcgaagcgtaggaactaacagaggagaagttccatggcttcgcataacctggcggcagcgcaaaagatg

SEQ ID NO: 125393 - DNA, 103 bp, Artificial Sequence
  Synthetic Polynucleotide
taatacgactcactataggggtccgtggggagccccgaagggatgcgaagaacagaggagacttcgcatgccttcggggaacctggcggcagcgcaaaagatg

SEQ ID NO: 125394 - DNA, 103 bp, Artificial Sequence
  Synthetic Polynucleotide
taatacgactcactatagggggcgccgaaggtccgtggggagccccgaagaacagaggagacttcggatgtccccacggaacctggcggcagcgcaaaagatg

SEQ ID NO: 125395 - DNA, 103 bp, Artificial Sequence
  Synthetic Polynucleotide
taatacgactcactatagggcgcgaccccaggcgccgaaggtccgtggggaacagaggagaccccacatgccttcggcgaacctggcggcagcgcaaaagatg

SEQ ID NO: 125396 - DNA, 103 bp, Artificial Sequence
  Synthetic Polynucleotide
taatacgactcactatagggccccggggcccgcgaccccaggcgccgaagaacagaggagacttcggatgctggggtcgaacctggcggcagcgcaaaagatg

SEQ ID NO: 125397 - DNA, 103 bp, Artificial Sequence
  Synthetic Polynucleotide
taatacgactcactataggggcggccccgaagcgcttcggcaagcaccagaacagaggagactggtgatggccgaagcgaacctggcggcagcgcaaaagatg

SEQ ID NO: 125398 - DNA, 103 bp, Artificial Sequence
  Synthetic Polynucleotide
taatacgactcactataggggacaggttgcccccggggcccgcgaccccaaacagaggagatggggtatggggccccggaacctggcggcagcgcaaaagatg

SEQ ID NO: 125399 - DNA, 103 bp, Artificial Sequence
  Synthetic Polynucleotide
taatacgactcactatagggctcccagctcgacaggttgcccccggggccaacagaggagaggccccatgggcaacctgaacctggcggcagcgcaaaagatg

SEQ ID NO: 125400 - DNA, 103 bp, Artificial Sequence
  Synthetic Polynucleotide
taatacgactcactataggggcagcaagtcctcccagctcgacaggttgcaacagaggagagcaaccatgcgagctgggaacctggcggcagcgcaaaagatg

SEQ ID NO: 125401 - DNA, 103 bp, Artificial Sequence
  Synthetic Polynucleotide
taatacgactcactatagggtcagtgaacagcagcaagtcctcccagctcaacagaggagagagctgatgggacttgctaacctggcggcagcgcaaaagatg

SEQ ID NO: 125402 - DNA, 103 bp, Artificial Sequence
  Synthetic Polynucleotide
taatacgactcactatagggttggtcgaggtcagtgaacagcagcaagtcaacagaggagagacttgatgctgttcactaacctggcggcagcgcaaaagatg

SEQ ID NO: 125403 - DNA, 103 bp, Artificial Sequence
  Synthetic Polynucleotide
taatacgactcactatagggcggtcgcggcttggtcgaggtcagtgaacaaacagaggagatgttcaatgacctcgaccaacctggcggcagcgcaaaagatg

SEQ ID NO: 125404 - DNA, 103 bp, Artificial Sequence
  Synthetic Polynucleotide
taatacgactcactatagggagcttgctggcggtcgcggcttggtcgaggaacagaggagacctcgaatgagccgcgacaacctggcggcagcgcaaaagatg

SEQ ID NO: 125405 - DNA, 103 bp, Artificial Sequence
  Synthetic Polynucleotide
taatacgactcactatagggggaccacagcagcttgctggcggtcgcggcaacagaggagagccgcgatggccagcaagaacctggcggcagcgcaaaagatg

SEQ ID NO: 125406 - DNA, 103 bp, Artificial Sequence
  Synthetic Polynucleotide
taatacgactcactatagggcgccgcggctggaccacagcagcttgctggaacagaggagaccagcaatgtgctgtggtaacctggcggcagcgcaaaagatg

SEQ ID NO: 125407 - DNA, 103 bp, Artificial Sequence
  Synthetic Polynucleotide
taatacgactcactatagggctcagcttggcgccgcggctggaccacagcaacagaggagagctgtgatgcagccgcggaacctggcggcagcgcaaaagatg

SEQ ID NO: 125408 - DNA, 103 bp, Artificial Sequence
  Synthetic Polynucleotide
taatacgactcactataggggtccgcacccgcggccccgaagcgcttcggaacagaggagaccgaagatgttcggggccaacctggcggcagcgcaaaagatg

SEQ ID NO: 125409 - DNA, 103 bp, Artificial Sequence
  Synthetic Polynucleotide
taatacgactcactatagggtgcgaaggggctcagcttggcgccgcggctaacagaggagaagccgcatggccaagctgaacctggcggcagcgcaaaagatg

SEQ ID NO: 125410 - DNA, 103 bp, Artificial Sequence
  Synthetic Polynucleotide
taatacgactcactataggggctgctcgggtgcgaaggggctcagcttggaacagaggagaccaagcatggccccttcgaacctggcggcagcgcaaaagatg

SEQ ID NO: 125411 - DNA, 103 bp, Artificial Sequence
  Synthetic Polynucleotide
taatacgactcactatagggatctcctccggctgctcgggtgcgaaggggaacagaggagaccccttatgacccgagcaaacctggcggcagcgcaaaagatg

SEQ ID NO: 125412 - DNA, 103 bp, Artificial Sequence
  Synthetic Polynucleotide
taatacgactcactatagggggtctggtacatctcctccggctgctcgggaacagaggagacccgagatgccggaggagaacctggcggcagcgcaaaagatg

SEQ ID NO: 125413 - DNA, 103 bp, Artificial Sequence
  Synthetic Polynucleotide
taatacgactcactataggggagcggcgagggtctggtacatctcctccgaacagaggagacggaggatgtgtaccagaaacctggcggcagcgcaaaagatg

SEQ ID NO: 125414 - DNA, 103 bp, Artificial Sequence
  Synthetic Polynucleotide
taatacgactcactatagggtggctggagagagcggcgagggtctggtacaacagaggagagtaccaatgcctcgccgcaacctggcggcagcgcaaaagatg

SEQ ID NO: 125415 - DNA, 103 bp, Artificial Sequence
  Synthetic Polynucleotide
taatacgactcactatagggggccggaccctggctggagagagcggcgagaacagaggagactcgccatgctctccagcaacctggcggcagcgcaaaagatg

SEQ ID NO: 125416 - DNA, 103 bp, Artificial Sequence
  Synthetic Polynucleotide
taatacgactcactatagggcgtcgtaggcggccggaccctggctggagaaacagaggagatctccaatgagggtccggaacctggcggcagcgcaaaagatg

SEQ ID NO: 125417 - DNA, 103 bp, Artificial Sequence
  Synthetic Polynucleotide
taatacgactcactatagggccgggcgcgccgtcgtaggcggccggacccaacagaggagagggtccatgcgcctacgaaacctggcggcagcgcaaaagatg

SEQ ID NO: 125418 - DNA, 103 bp, Artificial Sequence
  Synthetic Polynucleotide
taatacgactcactatagggcacgaagccgccgggcgcgccgtcgtaggcaacagaggagagcctacatgggcgcgcccaacctggcggcagcgcaaaagatg

SEQ ID NO: 125419 - DNA, 103 bp, Artificial Sequence
  Synthetic Polynucleotide
taatacgactcactatagggagtcgctggcgtccgcacccgcggccccgaaacagaggagatcggggatgcgggtgcggaacctggcggcagcgcaaaagatg

SEQ ID NO: 125420 - DNA, 103 bp, Artificial Sequence
  Synthetic Polynucleotide
taatacgactcactatagggccgcagagtgcacgaagccgccgggcgcgcaacagaggagagcgcgcatggcggcttcgaacctggcggcagcgcaaaagatg

SEQ ID NO: 125421 - DNA, 103 bp, Artificial Sequence
  Synthetic Polynucleotide
taatacgactcactataggggccgccgcggccgcagagtgcacgaagccgaacagaggagacggcttatggcactctgcaacctggcggcagcgcaaaagatg

SEQ ID NO: 125422 - DNA, 103 bp, Artificial Sequence
  Synthetic Polynucleotide
taatacgactcactatagggcgcggctgctgccgccgcggccgcagagtgaacagaggagacactctatggccgcggcgaacctggcggcagcgcaaaagatg

SEQ ID NO: 125423 - DNA, 103 bp, Artificial Sequence
  Synthetic Polynucleotide
taatacgactcactatagggtggccgccgccgcggctgctgccgccgcggaacagaggagaccgcggatgcagcagccgaacctggcggcagcgcaaaagatg

SEQ ID NO: 125424 - DNA, 103 bp, Artificial Sequence
  Synthetic Polynucleotide
taatacgactcactatagggaccggggagctggccgccgccgcggctgctaacagaggagaagcagcatgggcggcggcaacctggcggcagcgcaaaagatg

SEQ ID NO: 125425 - DNA, 103 bp, Artificial Sequence
  Synthetic Polynucleotide
taatacgactcactataggggggcacgtagaccggggagctggccgccgcaacagaggagagcggcgatgagctccccgaacctggcggcagcgcaaaagatg

SEQ ID NO: 125426 - DNA, 103 bp, Artificial Sequence
  Synthetic Polynucleotide
taatacgactcactatagggcgcgggtggtgggcacgtagaccggggagcaacagaggagagctcccatgtctacgtgcaacctggcggcagcgcaaaagatg

SEQ ID NO: 125427 - DNA, 103 bp, Artificial Sequence
  Synthetic Polynucleotide
taatacgactcactatagggatggaacccacgcgggtggtgggcacgtagaacagaggagactacgtatgcaccacccgaacctggcggcagcgcaaaagatg

SEQ ID NO: 125428 - DNA, 103 bp, Artificial Sequence
  Synthetic Polynucleotide
taatacgactcactataggggccgggcagcatggaacccacgcgggtggtaacagaggagaaccaccatggtgggttccaacctggcggcagcgcaaaagatg

SEQ ID NO: 125429 - DNA, 103 bp, Artificial Sequence
  Synthetic Polynucleotide
taatacgactcactatagggggtacggtaggccgggcagcatggaacccaaacagaggagatgggttatgtgctgcccgaacctggcggcagcgcaaaagatg

SEQ ID NO: 125430 - DNA, 103 bp, Artificial Sequence
  Synthetic Polynucleotide
taatacgactcactatagggaaggctctggagtcgctggcgtccgcacccaacagaggagagggtgcatgcgccagcgaaacctggcggcagcgcaaaagatg

SEQ ID NO: 125431 - DNA, 103 bp, Artificial Sequence
  Synthetic Polynucleotide
taatacgactcactatagggccctgcaggtggtacggtaggccgggcagcaacagaggagagctgccatgcctaccgtaaacctggcggcagcgcaaaagatg

SEQ ID NO: 125432 - DNA, 103 bp, Artificial Sequence
  Synthetic Polynucleotide
taatacgactcactatagggactgcccgacccctgcaggtggtacggtagaacagaggagactaccgatgcacctgcagaacctggcggcagcgcaaaagatg

SEQ ID NO: 125433 - DNA, 103 bp, Artificial Sequence
  Synthetic Polynucleotide
taatacgactcactatagggtggctggcccactgcccgacccctgcaggtaacagaggagaacctgcatgggtcgggcaaacctggcggcagcgcaaaagatg

SEQ ID NO: 125434 - DNA, 103 bp, Artificial Sequence
  Synthetic Polynucleotide
taatacgactcactatagggcccgcgtggttggctggcccactgcccgacaacagaggagagtcgggatgtgggccagcaacctggcggcagcgcaaaagatg

SEQ ID NO: 125435 - DNA, 103 bp, Artificial Sequence
  Synthetic Polynucleotide
taatacgactcactataggggcccgcgccgcccgcgtggttggctggcccaacagaggagagggccaatgaaccacgcgaacctggcggcagcgcaaaagatg

SEQ ID NO: 125436 - DNA, 103 bp, Artificial Sequence
  Synthetic Polynucleotide
taatacgactcactatagggcggggtgcgcgcccgcgccgcccgcgtggtaacagaggagaaccacgatggcggcgcggaacctggcggcagcgcaaaagatg

SEQ ID NO: 125437 - DNA, 103 bp, Artificial Sequence
  Synthetic Polynucleotide
taatacgactcactatagggtgaggccagccggggtgcgcgcccgcgccgaacagaggagacggcgcatgcgcgcacccaacctggcggcagcgcaaaagatg

SEQ ID NO: 125438 - DNA, 103 bp, Artificial Sequence
  Synthetic Polynucleotide
taatacgactcactatagggggccgaggcctgaggccagccggggtgcgcaacagaggagagcgcacatgggctggcctaacctggcggcagcgcaaaagatg

SEQ ID NO: 125439 - DNA, 103 bp, Artificial Sequence
  Synthetic Polynucleotide
taatacgactcactataggggagggctgtcggccgaggcctgaggccagcaacagaggagagctggcatgaggcctcggaacctggcggcagcgcaaaagatg

SEQ ID NO: 125440 - DNA, 103 bp, Artificial Sequence
  Synthetic Polynucleotide
taatacgactcactatagggctgccgtatggagggctgtcggccgaggccaacagaggagaggcctcatgcgacagcccaacctggcggcagcgcaaaagatg

SEQ ID NO: 125441 - DNA, 103 bp, Artificial Sequence
  Synthetic Polynucleotide
taatacgactcactatagggccgcgctggaaaggctctggagtcgctggcaacagaggagagccagcatgtccagagccaacctggcggcagcgcaaaagatg

SEQ ID NO: 125442 - DNA, 103 bp, Artificial Sequence
  Synthetic Polynucleotide
taatacgactcactataggggccgcctccgctgccgtatggagggctgtcaacagaggagagacagcatgccatacggcaacctggcggcagcgcaaaagatg

SEQ ID NO: 125443 - DNA, 103 bp, Artificial Sequence
  Synthetic Polynucleotide
taatacgactcactatagggcgccagccgcgccgcctccgctgccgtatgaacagaggagacatacgatggcggaggcgaacctggcggcagcgcaaaagatg

SEQ ID NO: 125444 - DNA, 103 bp, Artificial Sequence
  Synthetic Polynucleotide
taatacgactcactataggggcggccccgccgccagccgcgccgcctccgaacagaggagacggaggatgcgcggctggaacctggcggcagcgcaaaagatg

SEQ ID NO: 125445 - DNA, 103 bp, Artificial Sequence
  Synthetic Polynucleotide
taatacgactcactataggggccaggccccgcggccccgccgccagccgcaacagaggagagcggctatgggcggggccaacctggcggcagcgcaaaagatg

SEQ ID NO: 125446 - DNA, 103 bp, Artificial Sequence
  Synthetic Polynucleotide
taatacgactcactatagggagccagcgccgccaggccccgcggccccgcaacagaggagagcggggatgcggggcctgaacctggcggcagcgcaaaagatg

SEQ ID NO: 125447 - DNA, 103 bp, Artificial Sequence
  Synthetic Polynucleotide
taatacgactcactataggggccgcggctgagccagcgccgccaggccccaacagaggagaggggccatgcggcgctggaacctggcggcagcgcaaaagatg

SEQ ID NO: 125448 - DNA, 103 bp, Artificial Sequence
  Synthetic Polynucleotide
taatacgactcactatagggcgagacgtgcgccgcggctgagccagcgccaacagaggagaggcgctatgtcagccgcgaacctggcggcagcgcaaaagatg

SEQ ID NO: 125449 - DNA, 103 bp, Artificial Sequence
  Synthetic Polynucleotide
taatacgactcactatagggggaagcgcgccgagacgtgcgccgcggctgaacagaggagacagccgatgcgcacgtctaacctggcggcagcgcaaaagatg

SEQ ID NO: 125450 - DNA, 103 bp, Artificial Sequence
  Synthetic Polynucleotide
taatacgactcactatagggggagagtaggggaagcgcgccgagacgtgcaacagaggagagcacgtatgggcgcgcttaacctggcggcagcgcaaaagatg

SEQ ID NO: 125451 - DNA, 103 bp, Artificial Sequence
  Synthetic Polynucleotide
taatacgactcactataggggggcgggctgggagagtaggggaagcgcgcaacagaggagagcgcgcatgccctactctaacctggcggcagcgcaaaagatg

SEQ ID NO: 125452 - DNA, 103 bp, Artificial Sequence
  Synthetic Polynucleotide
taatacgactcactatagggtggagggctcccgcgctggaaaggctctggaacagaggagaccagagatgttccagcgcaacctggcggcagcgcaaaagatg

SEQ ID NO: 125453 - DNA, 103 bp, Artificial Sequence
  Synthetic Polynucleotide
taatacgactcactatagggcgttggccatgggcgggctgggagagtaggaacagaggagacctactatgccagcccgcaacctggcggcagcgcaaaagatg

SEQ ID NO: 125454 - DNA, 103 bp, Artificial Sequence
  Synthetic Polynucleotide
taatacgactcactatagggcgcgcggcgccgttggccatgggcgggctgaacagaggagacagcccatgcatggccaaaacctggcggcagcgcaaaagatg

SEQ ID NO: 125455 - DNA, 103 bp, Artificial Sequence
  Synthetic Polynucleotide
taatacgactcactatagggtcccggctcccgcgcggcgccgttggccataacagaggagaatggccatgggcgccgcgaacctggcggcagcgcaaaagatg

SEQ ID NO: 125456 - DNA, 103 bp, Artificial Sequence
  Synthetic Polynucleotide
taatacgactcactatagggccgcgtagcctcccggctcccgcgcggcgcaacagaggagagcgccgatggggagccggaacctggcggcagcgcaaaagatg

SEQ ID NO: 125457 - DNA, 103 bp, Artificial Sequence
  Synthetic Polynucleotide
taatacgactcactatagggctgcccgccgccgcgtagcctcccggctccaacagaggagaggagccatgaggctacgcaacctggcggcagcgcaaaagatg

SEQ ID NO: 125458 - DNA, 103 bp, Artificial Sequence
  Synthetic Polynucleotide
taatacgactcactatagggcgcgcccccactgcccgccgccgcgtagccaacagaggagaggctacatggcggcgggcaacctggcggcagcgcaaaagatg

SEQ ID NO: 125459 - DNA, 103 bp, Artificial Sequence
  Synthetic Polynucleotide
taatacgactcactatagggtcacgcctcccgcgcccccactgcccgccgaacagaggagacggcggatggtgggggcgaacctggcggcagcgcaaaagatg

SEQ ID NO: 125460 - DNA, 103 bp, Artificial Sequence
  Synthetic Polynucleotide
taatacgactcactatagggccgccgccgctcacgcctcccgcgcccccaaacagaggagatgggggatggggaggcgtaacctggcggcagcgcaaaagatg

SEQ ID NO: 125461 - DNA, 103 bp, Artificial Sequence
  Synthetic Polynucleotide
taatacgactcactatagggcaggctactgccgccgccgctcacgcctccaacagaggagaggaggcatgagcggcggcaacctggcggcagcgcaaaagatg

SEQ ID NO: 125462 - DNA, 103 bp, Artificial Sequence
  Synthetic Polynucleotide
taatacgactcactatagggccatggccgccaggctactgccgccgccgcaacagaggagagcggcgatggcagtagccaacctggcggcagcgcaaaagatg

SEQ ID NO: 125463 - DNA, 103 bp, Artificial Sequence
  Synthetic Polynucleotide
taatacgactcactataggggaaggcggcgtggagggctcccgcgctggaaacagaggagatccagcatgggagccctcaacctggcggcagcgcaaaagatg

SEQ ID NO: 125464 - DNA, 103 bp, Artificial Sequence
  Synthetic Polynucleotide
taatacgactcactatagggtcgcggccgcccatggccgccaggctactgaacagaggagacagtagatgggcggccataacctggcggcagcgcaaaagatg

SEQ ID NO: 125465 - DNA, 103 bp, Artificial Sequence
  Synthetic Polynucleotide
taatacgactcactataggggtactggggctcgcggccgcccatggccgcaacagaggagagcggccatgggcggccgcaacctggcggcagcgcaaaagatg

SEQ ID NO: 125466 - DNA, 103 bp, Artificial Sequence
  Synthetic Polynucleotide
taatacgactcactatagggacagcgagctgtactggggctcgcggccgcaacagaggagagcggccatgagccccagtaacctggcggcagcgcaaaagatg

SEQ ID NO: 125467 - DNA, 103 bp, Artificial Sequence
  Synthetic Polynucleotide
taatacgactcactatagggcgcgcggccgacagcgagctgtactggggcaacagaggagagccccaatgcagctcgctaacctggcggcagcgcaaaagatg

SEQ ID NO: 125468 - DNA, 103 bp, Artificial Sequence
  Synthetic Polynucleotide
taatacgactcactataggggttcagcggccgcgcggccgacagcgagctaacagaggagaagctcgatgtcggccgcgaacctggcggcagcgcaaaagatg

SEQ ID NO: 125469 - DNA, 103 bp, Artificial Sequence
  Synthetic Polynucleotide
taatacgactcactatagggggtacgtcccgttcagcggccgcgcggccgaacagaggagacggccgatgggccgctgaaacctggcggcagcgcaaaagatg

SEQ ID NO: 125470 - DNA, 103 bp, Artificial Sequence
  Synthetic Polynucleotide
taatacgactcactatagggtggtggtggtggtacgtcccgttcagcggcaacagaggagagccgctatgcgggacgtaaacctggcggcagcgcaaaagatg

SEQ ID NO: 125471 - DNA, 103 bp, Artificial Sequence
  Synthetic Polynucleotide
taatacgactcactataggggtggtggtggtggtggtggtggtacgtcccaacagaggagagggacgatgcaccaccacaacctggcggcagcgcaaaagatg

SEQ ID NO: 125472 - DNA, 103 bp, Artificial Sequence
  Synthetic Polynucleotide
taatacgactcactataggggatggtggtggtggtggtggtggtggtggtaacagaggagaaccaccatgaccaccaccaacctggcggcagcgcaaaagatg

SEQ ID NO: 125473 - DNA, 103 bp, Artificial Sequence
  Synthetic Polynucleotide
taatacgactcactatagggtaggggctcggatggtggtggtggtggtggaacagaggagaccaccaatgccaccaccaaacctggcggcagcgcaaaagatg

SEQ ID NO: 125474 - DNA, 103 bp, Artificial Sequence
  Synthetic Polynucleotide
taatacgactcactataggggcgaagagcatcttctgtcattctatccataacagaggagaatggatatgatgacagaaaacctggcggcagcgcaaaagatg

SEQ ID NO: 125475 - DNA, 103 bp, Artificial Sequence
  Synthetic Polynucleotide
taatacgactcactatagggcatggcctcatgcccctccattttgagtcgaacagaggagacgactcatgatggaggggaacctggcggcagcgcaaaagatg

SEQ ID NO: 125476 - DNA, 103 bp, Artificial Sequence
  Synthetic Polynucleotide
taatacgactcactataggggctggggctaggaagtggcgaggacactctaacagaggagaagagtgatgtcgccacttaacctggcggcagcgcaaaagatg

SEQ ID NO: 125477 - DNA, 103 bp, Artificial Sequence
  Synthetic Polynucleotide
taatacgactcactatagggcagtcatggcgctggggctaggaagtggcgaacagaggagacgccacatgctagccccaaacctggcggcagcgcaaaagatg

SEQ ID NO: 125478 - DNA, 103 bp, Artificial Sequence
  Synthetic Polynucleotide
taatacgactcactatagggttggcagcatcagtcatggcgctggggctaaacagaggagatagcccatgcgccatgacaacctggcggcagcgcaaaagatg

SEQ ID NO: 125479 - DNA, 103 bp, Artificial Sequence
  Synthetic Polynucleotide
taatacgactcactatagggagcctgtgagttggcagcatcagtcatggcaacagaggagagccatgatggatgctgccaacctggcggcagcgcaaaagatg

SEQ ID NO: 125480 - DNA, 103 bp, Artificial Sequence
  Synthetic Polynucleotide
taatacgactcactatagggatttggctgcagcctgtgagttggcagcataacagaggagaatgctgatgactcacaggaacctggcggcagcgcaaaagatg

SEQ ID NO: 125481 - DNA, 103 bp, Artificial Sequence
  Synthetic Polynucleotide
taatacgactcactatagggcgaagagccaatttggctgcagcctgtgagaacagaggagactcacaatgtgcagccaaaacctggcggcagcgcaaaagatg

SEQ ID NO: 125482 - DNA, 103 bp, Artificial Sequence
  Synthetic Polynucleotide
taatacgactcactatagggcagctgtttgcgaagagccaatttggctgcaacagaggagagcagccatgttggctcttaacctggcggcagcgcaaaagatg

SEQ ID NO: 125483 - DNA, 103 bp, Artificial Sequence
  Synthetic Polynucleotide
taatacgactcactataggggtgtcttttccagctgtttgcgaagagccaaacagaggagatggctcatggcaaacagcaacctggcggcagcgcaaaagatg

SEQ ID NO: 125484 - DNA, 103 bp, Artificial Sequence
  Synthetic Polynucleotide
taatacgactcactatagggatctccaggagtgtcttttccagctgtttgaacagaggagacaaacaatgggaaaagacaacctggcggcagcgcaaaagatg

SEQ ID NO: 125485 - DNA, 103 bp, Artificial Sequence
  Synthetic Polynucleotide
taatacgactcactatagggagggggtgggatctccaggagtgtcttttcaacagaggagagaaaagatgctcctggagaacctggcggcagcgcaaaagatg

SEQ ID NO: 125486 - DNA, 103 bp, Artificial Sequence
  Synthetic Polynucleotide
taatacgactcactatagggtcagacgttccatggcctcatgcccctccaaacagaggagatggaggatgatgaggccaaacctggcggcagcgcaaaagatg

SEQ ID NO: 125487 - DNA, 103 bp, Artificial Sequence
  Synthetic Polynucleotide
taatacgactcactatagggcaggaggtttagggggtgggatctccaggaaacagaggagatcctggatgtcccaccccaacctggcggcagcgcaaaagatg

SEQ ID NO: 125488 - DNA, 103 bp, Artificial Sequence
  Synthetic Polynucleotide
taatacgactcactatagggagtaagggagcaggaggtttagggggtgggaacagaggagacccaccatgtaaacctccaacctggcggcagcgcaaaagatg

SEQ ID NO: 125489 - DNA, 103 bp, Artificial Sequence
  Synthetic Polynucleotide
taatacgactcactatagggcaagaaatgaagtaagggagcaggaggtttaacagaggagaaaacctatggctcccttaaacctggcggcagcgcaaaagatg

SEQ ID NO: 125490 - DNA, 103 bp, Artificial Sequence
  Synthetic Polynucleotide
taatacgactcactatagggctgcactaggcaagaaatgaagtaagggagaacagaggagactccctatgttcatttctaacctggcggcagcgcaaaagatg

SEQ ID NO: 125491 - DNA, 103 bp, Artificial Sequence
  Synthetic Polynucleotide
taatacgactcactatagggtcgctattggctgcactaggcaagaaatgaaacagaggagatcatttatggcctagtgcaacctggcggcagcgcaaaagatg

SEQ ID NO: 125492 - DNA, 103 bp, Artificial Sequence
  Synthetic Polynucleotide
taatacgactcactataggggtagatgaactcgctattggctgcactaggaacagaggagacctagtatggccaatagcaacctggcggcagcgcaaaagatg

SEQ ID NO: 125493 - DNA, 103 bp, Artificial Sequence
  Synthetic Polynucleotide
taatacgactcactatagggagcctaccatgtagatgaactcgctattggaacagaggagaccaataatgagttcatctaacctggcggcagcgcaaaagatg

SEQ ID NO: 125494 - DNA, 103 bp, Artificial Sequence
  Synthetic Polynucleotide
taatacgactcactatagggacttcttccaagcctaccatgtagatgaacaacagaggagagttcatatgcatggtaggaacctggcggcagcgcaaaagatg

SEQ ID NO: 125495 - DNA, 103 bp, Artificial Sequence
  Synthetic Polynucleotide
taatacgactcactatagggactctgtacgacttcttccaagcctaccataacagaggagaatggtaatgttggaagaaaacctggcggcagcgcaaaagatg

SEQ ID NO: 125496 - DNA, 103 bp, Artificial Sequence
  Synthetic Polynucleotide
taatacgactcactatagggtgtcaatgacactctgtacgacttcttccaaacagaggagatggaagatgtcgtacagaaacctggcggcagcgcaaaagatg

SEQ ID NO: 125497 - DNA, 103 bp, Artificial Sequence
  Synthetic Polynucleotide
taatacgactcactataggggccaacattttcagacgttccatggcctcaaacagaggagatgaggcatgggaacgtctaacctggcggcagcgcaaaagatg

SEQ ID NO: 125498 - DNA, 103 bp, Artificial Sequence
  Synthetic Polynucleotide
taatacgactcactatagggttgccttggctgtcaatgacactctgtacgaacagaggagacgtacaatgtgtcattgaaacctggcggcagcgcaaaagatg

SEQ ID NO: 125499 - DNA, 103 bp, Artificial Sequence
  Synthetic Polynucleotide
taatacgactcactatagggggcacagcttttgccttggctgtcaatgacaacagaggagagtcattatgagccaaggcaacctggcggcagcgcaaaagatg

SEQ ID NO: 125500 - DNA, 103 bp, Artificial Sequence
  Synthetic Polynucleotide
taatacgactcactataggggcagaagtgaggcacagcttttgccttggcaacagaggagagccaagatgaaagctgtgaacctggcggcagcgcaaaagatg

SEQ ID NO: 125501 - DNA, 103 bp, Artificial Sequence
  Synthetic Polynucleotide
taatacgactcactatagggggttcaacccgcagaagtgaggcacagcttaacagaggagaaagctgatgctcacttctaacctggcggcagcgcaaaagatg

SEQ ID NO: 125502 - DNA, 103 bp, Artificial Sequence
  Synthetic Polynucleotide
taatacgactcactatagggacatacaaagggttcaacccgcagaagtgaaacagaggagatcacttatgcgggttgaaaacctggcggcagcgcaaaagatg

SEQ ID NO: 125503 - DNA, 103 bp, Artificial Sequence
  Synthetic Polynucleotide
taatacgactcactatagggggcactgggcacatacaaagggttcaacccaacagaggagagggttgatgcctttgtataacctggcggcagcgcaaaagatg

SEQ ID NO: 125504 - DNA, 103 bp, Artificial Sequence
  Synthetic Polynucleotide
taatacgactcactatagggaaatctgtgcggcactgggcacatacaaagaacagaggagactttgtatgtgcccagtgaacctggcggcagcgcaaaagatg

SEQ ID NO: 125505 - DNA, 103 bp, Artificial Sequence
  Synthetic Polynucleotide
taatacgactcactataggggtgaggggtgaaatctgtgcggcactgggcaacagaggagagcccagatgcgcacagataacctggcggcagcgcaaaagatg

SEQ ID NO: 125506 - DNA, 103 bp, Artificial Sequence
  Synthetic Polynucleotide
taatacgactcactatagggcttgcttccagtgaggggtgaaatctgtgcaacagaggagagcacagatgtcacccctcaacctggcggcagcgcaaaagatg

SEQ ID NO: 125507 - DNA, 103 bp, Artificial Sequence
  Synthetic Polynucleotide
taatacgactcactatagggccattcttttcttgcttccagtgaggggtgaacagaggagacaccccatgctggaagcaaacctggcggcagcgcaaaagatg

SEQ ID NO: 125508 - DNA, 103 bp, Artificial Sequence
  Synthetic Polynucleotide
taatacgactcactatagggtttgagcaatgccaacattttcagacgttcaacagaggagagaacgtatgaaaatgttgaacctggcggcagcgcaaaagatg

SEQ ID NO: 125509 - DNA, 103 bp, Artificial Sequence
  Synthetic Polynucleotide
taatacgactcactatagggtagaatcttaccattcttttcttgcttccaaacagaggagatggaagatggaaaagaataacctggcggcagcgcaaaagatg

SEQ ID NO: 125510 - DNA, 103 bp, Artificial Sequence
  Synthetic Polynucleotide
taatacgactcactatagggactgctcacatagaatcttaccattcttttaacagaggagaaaaagaatggtaagattcaacctggcggcagcgcaaaagatg

SEQ ID NO: 125511 - DNA, 103 bp, Artificial Sequence
  Synthetic Polynucleotide
taatacgactcactataggggaggtcatacactgctcacatagaatcttaaacagaggagataagatatgatgtgagcaaacctggcggcagcgcaaaagatg

SEQ ID NO: 125512 - DNA, 103 bp, Artificial Sequence
  Synthetic Polynucleotide
taatacgactcactatagggtttctggttggaggtcatacactgctcacaaacagaggagatgtgagatgtgtatgaccaacctggcggcagcgcaaaagatg

SEQ ID NO: 125513 - DNA, 103 bp, Artificial Sequence
  Synthetic Polynucleotide
taatacgactcactatagggttagagcctttttctggttggaggtcatacaacagaggagagtatgaatgccaaccagaaacctggcggcagcgcaaaagatg

SEQ ID NO: 125514 - DNA, 103 bp, Artificial Sequence
  Synthetic Polynucleotide
taatacgactcactatagggtgttcagcttttagagcctttttctggttgaacagaggagacaaccaatgaaaggctctaacctggcggcagcgcaaaagatg

SEQ ID NO: 125515 - DNA, 103 bp, Artificial Sequence
  Synthetic Polynucleotide
taatacgactcactatagggccggttggtgtgttcagcttttagagccttaacagaggagaaaggctatgaaagctgaaaacctggcggcagcgcaaaagatg

SEQ ID NO: 125516 - DNA, 103 bp, Artificial Sequence
  Synthetic Polynucleotide
taatacgactcactatagggcatttttcagccggttggtgtgttcagcttaacagaggagaaagctgatgacaccaaccaacctggcggcagcgcaaaagatg

SEQ ID NO: 125517 - DNA, 103 bp, Artificial Sequence
  Synthetic Polynucleotide
taatacgactcactatagggttcacaaatgcatttttcagccggttggtgaacagaggagacaccaaatggctgaaaaaaacctggcggcagcgcaaaagatg

SEQ ID NO: 125518 - DNA, 103 bp, Artificial Sequence
  Synthetic Polynucleotide
taatacgactcactatagggctgtagggctttcacaaatgcatttttcagaacagaggagactgaaaatggcatttgtgaacctggcggcagcgcaaaagatg

SEQ ID NO: 125519 - DNA, 103 bp, Artificial Sequence
  Synthetic Polynucleotide
taatacgactcactatagggaatccttccttttgagcaatgccaacatttaacagaggagaaaatgtatgcattgctcaaacctggcggcagcgcaaaagatg

SEQ ID NO: 125520 - DNA, 103 bp, Artificial Sequence
  Synthetic Polynucleotide
taatacgactcactatagggcctgttcctgctgtagggctttcacaaatgaacagaggagacatttgatgaagccctacaacctggcggcagcgcaaaagatg

SEQ ID NO: 125521 - DNA, 103 bp, Artificial Sequence
  Synthetic Polynucleotide
taatacgactcactatagggtgttcaatttcctgttcctgctgtagggctaacagaggagaagccctatggcaggaacaaacctggcggcagcgcaaaagatg

SEQ ID NO: 125522 - DNA, 103 bp, Artificial Sequence
  Synthetic Polynucleotide
taatacgactcactatagggctgtaatcgctgttcaatttcctgttcctgaacagaggagacaggaaatggaaattgaaaacctggcggcagcgcaaaagatg

SEQ ID NO: 125523 - DNA, 103 bp, Artificial Sequence
  Synthetic Polynucleotide
taatacgactcactatagggctgcctgctgctgtaatcgctgttcaatttaacagaggagaaaattgatgagcgattacaacctggcggcagcgcaaaagatg

SEQ ID NO: 125524 - DNA, 103 bp, Artificial Sequence
  Synthetic Polynucleotide
taatacgactcactatagggggggagagggctgcctgctgctgtaatcgcaacagaggagagcgattatggcagcaggcaacctggcggcagcgcaaaagatg

SEQ ID NO: 125525 - DNA, 103 bp, Artificial Sequence
  Synthetic Polynucleotide
taatacgactcactatagggagccgtagtgggggagagggctgcctgctgaacagaggagacagcagatggccctctccaacctggcggcagcgcaaaagatg

SEQ ID NO: 125526 - DNA, 103 bp, Artificial Sequence
  Synthetic Polynucleotide
taatacgactcactatagggacacagctggagccgtagtgggggagagggaacagaggagaccctctatgccactacggaacctggcggcagcgcaaaagatg

SEQ ID NO: 125527 - DNA, 103 bp, Artificial Sequence
  Synthetic Polynucleotide
taatacgactcactatagggctgacactggacacagctggagccgtagtgaacagaggagacactacatgtccagctgtaacctggcggcagcgcaaaagatg

SEQ ID NO: 125528 - DNA, 103 bp, Artificial Sequence
  Synthetic Polynucleotide
taatacgactcactatagggctcttgtttactgacactggacacagctggaacagaggagaccagctatgtccagtgtcaacctggcggcagcgcaaaagatg

SEQ ID NO: 125529 - DNA, 103 bp, Artificial Sequence
  Synthetic Polynucleotide
taatacgactcactatagggtcatgatggtctcttgtttactgacactggaacagaggagaccagtgatggtaaacaagaacctggcggcagcgcaaaagatg

SEQ ID NO: 125530 - DNA, 103 bp, Artificial Sequence
  Synthetic Polynucleotide
taatacgactcactatagggagatttgccaaatccttccttttgagcaataacagaggagaattgctatgaaggaaggaaacctggcggcagcgcaaaagatg

SEQ ID NO: 125531 - DNA, 103 bp, Artificial Sequence
  Synthetic Polynucleotide
taatacgactcactataggggtatgatgtctcatgatggtctcttgtttaaacagaggagataaacaatggaccatcataacctggcggcagcgcaaaagatg

SEQ ID NO: 125532 - DNA, 103 bp, Artificial Sequence
  Synthetic Polynucleotide
taatacgactcactatagggctgccgaagcgtatgatgtctcatgatggtaacagaggagaaccatcatgagacatcataacctggcggcagcgcaaaagatg

SEQ ID NO: 125533 - DNA, 103 bp, Artificial Sequence
  Synthetic Polynucleotide
taatacgactcactataggggctgtggagcctgccgaagcgtatgatgtcaacagaggagagacatcatgcgcttcggcaacctggcggcagcgcaaaagatg

SEQ ID NO: 125534 - DNA, 103 bp, Artificial Sequence
  Synthetic Polynucleotide
taatacgactcactatagggctgctctggggctgtggagcctgccgaagcaacagaggagagcttcgatgggctccacaaacctggcggcagcgcaaaagatg

SEQ ID NO: 125535 - DNA, 103 bp, Artificial Sequence
  Synthetic Polynucleotide
taatacgactcactatagggacgctggaggctgctctggggctgtggagcaacagaggagagctccaatgccccagagcaacctggcggcagcgcaaaagatg

SEQ ID NO: 125536 - DNA, 103 bp, Artificial Sequence
  Synthetic Polynucleotide
taatacgactcactatagggtgggtatgccacgctggaggctgctctgggaacagaggagacccagaatggcctccagcaacctggcggcagcgcaaaagatg

SEQ ID NO: 125537 - DNA, 103 bp, Artificial Sequence
  Synthetic Polynucleotide
taatacgactcactatagggcgggcagatgtgggtatgccacgctggaggaacagaggagacctccaatgtggcataccaacctggcggcagcgcaaaagatg

SEQ ID NO: 125538 - DNA, 103 bp, Artificial Sequence
  Synthetic Polynucleotide
taatacgactcactatagggaagcatggagcgggcagatgtgggtatgccaacagaggagaggcataatgacatctgccaacctggcggcagcgcaaaagatg

SEQ ID NO: 125539 - DNA, 103 bp, Artificial Sequence
  Synthetic Polynucleotide
taatacgactcactatagggcaaagtttgaaagcatggagcgggcagatgaacagaggagacatctgatggctccatgcaacctggcggcagcgcaaaagatg

SEQ ID NO: 125540 - DNA, 103 bp, Artificial Sequence
  Synthetic Polynucleotide
taatacgactcactatagggggtgcctgtgcaaagtttgaaagcatggagaacagaggagactccatatgttcaaacttaacctggcggcagcgcaaaagatg

SEQ ID NO: 125541 - DNA, 103 bp, Artificial Sequence
  Synthetic Polynucleotide
taatacgactcactatagggtggcacctcaagatttgccaaatccttcctaacagaggagaaggaagatgttggcaaataacctggcggcagcgcaaaagatg

SEQ ID NO: 125542 - DNA, 103 bp, Artificial Sequence
  Synthetic Polynucleotide
taatacgactcactatagggagacaactggggtgcctgtgcaaagtttgaaacagaggagatcaaacatggcacaggcaaacctggcggcagcgcaaaagatg

SEQ ID NO: 125543 - DNA, 103 bp, Artificial Sequence
  Synthetic Polynucleotide
taatacgactcactatagggcacctggcacagacaactggggtgcctgtgaacagaggagacacaggatgcccagttgtaacctggcggcagcgcaaaagatg

SEQ ID NO: 125544 - DNA, 103 bp, Artificial Sequence
  Synthetic Polynucleotide
taatacgactcactatagggccaaggaggccacctggcacagacaactggaacagaggagaccagttatgtgtgccaggaacctggcggcagcgcaaaagatg

SEQ ID NO: 125545 - DNA, 103 bp, Artificial Sequence
  Synthetic Polynucleotide
taatacgactcactatagggacctggcataccaaggaggccacctggcacaacagaggagagtgccaatgggcctccttaacctggcggcagcgcaaaagatg

SEQ ID NO: 125546 - DNA, 103 bp, Artificial Sequence
  Synthetic Polynucleotide
taatacgactcactatagggcaatgttgacacctggcataccaaggaggcaacagaggagagcctccatggtatgccagaacctggcggcagcgcaaaagatg

SEQ ID NO: 125547 - DNA, 103 bp, Artificial Sequence
  Synthetic Polynucleotide
taatacgactcactatagggttcaagtatgcaatgttgacacctggcataaacagaggagatatgccatgtgtcaacataacctggcggcagcgcaaaagatg

SEQ ID NO: 125548 - DNA, 103 bp, Artificial Sequence
  Synthetic Polynucleotide
taatacgactcactataggggatgccagtattcaagtatgcaatgttgacaacagaggagagtcaacatggcatacttgaacctggcggcagcgcaaaagatg

SEQ ID NO: 125549 - DNA, 103 bp, Artificial Sequence
  Synthetic Polynucleotide
taatacgactcactatagggtgtgtcctccgatgccagtattcaagtatgaacagaggagacatactatgatactggcaaacctggcggcagcgcaaaagatg

SEQ ID NO: 125550 - DNA, 103 bp, Artificial Sequence
  Synthetic Polynucleotide
taatacgactcactatagggctggggcctttgtgtcctccgatgccagtaaacagaggagatactggatgcggaggacaaacctggcggcagcgcaaaagatg

SEQ ID NO: 125551 - DNA, 103 bp, Artificial Sequence
  Synthetic Polynucleotide
taatacgactcactataggggtctgccaaactggggcctttgtgtcctccaacagaggagaggaggaatgaaaggccccaacctggcggcagcgcaaaagatg

SEQ ID NO: 125552 - DNA, 103 bp, Artificial Sequence
  Synthetic Polynucleotide
taatacgactcactataggggtaactcatgtggcacctcaagatttgccaaacagaggagatggcaaatgttgaggtgcaacctggcggcagcgcaaaagatg

SEQ ID NO: 125553 - DNA, 103 bp, Artificial Sequence
  Synthetic Polynucleotide
taatacgactcactatagggcacgctgtcggtctgccaaactggggccttaacagaggagaaaggccatggtttggcagaacctggcggcagcgcaaaagatg

SEQ ID NO: 125554 - DNA, 103 bp, Artificial Sequence
  Synthetic Polynucleotide
taatacgactcactatagggaaaaggtattcacgctgtcggtctgccaaaaacagaggagatttggcatgccgacagcgaacctggcggcagcgcaaaagatg

SEQ ID NO: 125555 - DNA, 103 bp, Artificial Sequence
  Synthetic Polynucleotide
taatacgactcactataggggatcatgtctaaaaggtattcacgctgtcgaacagaggagacgacagatggaataccttaacctggcggcagcgcaaaagatg

SEQ ID NO: 125556 - DNA, 103 bp, Artificial Sequence
  Synthetic Polynucleotide
taatacgactcactatagggaccggggagggatcatgtctaaaaggtattaacagaggagaaataccatgtagacatgaaacctggcggcagcgcaaaagatg

SEQ ID NO: 125557 - DNA, 103 bp, Artificial Sequence
  Synthetic Polynucleotide
taatacgactcactatagggtgcgatatagaccggggagggatcatgtctaacagaggagaagacatatgccctccccgaacctggcggcagcgcaaaagatg

SEQ ID NO: 125558 - DNA, 103 bp, Artificial Sequence
  Synthetic Polynucleotide
taatacgactcactatagggactgatggactgcgatatagaccggggaggaacagaggagacctcccatgtctatatcgaacctggcggcagcgcaaaagatg

SEQ ID NO: 125559 - DNA, 103 bp, Artificial Sequence
  Synthetic Polynucleotide
taatacgactcactatagggatttctgtccactgatggactgcgatatagaacagaggagactatatatgagtccatcaaacctggcggcagcgcaaaagatg

SEQ ID NO: 125560 - DNA, 103 bp, Artificial Sequence
  Synthetic Polynucleotide
taatacgactcactatagggtgtttggtgggtaactcatgtggcacctcaaacagaggagatgaggtatgacatgagttaacctggcggcagcgcaaaagatg

SEQ ID NO: 125561 - DNA, 103 bp, Artificial Sequence
  Synthetic Polynucleotide
taatacgactcactatagggactgccatcctgtttggtgggtaactcatgaacagaggagacatgagatgcccaccaaaaacctggcggcagcgcaaaagatg

SEQ ID NO: 125562 - DNA, 103 bp, Artificial Sequence
  Synthetic Polynucleotide
taatacgactcactatagggacagattcaagcgaagagcatcttctgtcaaacagaggagatgacagatgatgctcttcaacctggcggcagcgcaaaagatg

SEQ ID NO: 125563 - DNA, 103 bp, Artificial Sequence
  Synthetic Polynucleotide
taatacgactcactatagggccttgacaccactgccatcctgtttggtggaacagaggagaccaccaatgaggatggcaaacctggcggcagcgcaaaagatg

SEQ ID NO: 125564 - DNA, 103 bp, Artificial Sequence
  Synthetic Polynucleotide
taatacgactcactatagggtcttcatagcccttgacaccactgccatccaacagaggagaggatggatgtggtgtcaaaacctggcggcagcgcaaaagatg

SEQ ID NO: 125565 - DNA, 103 bp, Artificial Sequence
  Synthetic Polynucleotide
taatacgactcactataggggttaagtttttcttcatagcccttgacaccaacagaggagaggtgtcatgggctatgaaaacctggcggcagcgcaaaagatg

SEQ ID NO: 125566 - DNA, 103 bp, Artificial Sequence
  Synthetic Polynucleotide
taatacgactcactatagggtgagattcccgttaagtttttcttcatagcaacagaggagagctatgatgaaaaacttaaacctggcggcagcgcaaaagatg

SEQ ID NO: 125567 - DNA, 103 bp, Artificial Sequence
  Synthetic Polynucleotide
taatacgactcactatagggccatgaggcctgagattcccgttaagttttaacagaggagaaaaactatgcgggaatctaacctggcggcagcgcaaaagatg

SEQ ID NO: 125568 - DNA, 103 bp, Artificial Sequence
  Synthetic Polynucleotide
taatacgactcactatagggcctgttgtctccatgaggcctgagattcccaacagaggagagggaatatgaggcctcataacctggcggcagcgcaaaagatg

SEQ ID NO: 125569 - DNA, 103 bp, Artificial Sequence
  Synthetic Polynucleotide
taatacgactcactatagggttccagcagtcctgttgtctccatgaggccaacagaggagaggcctcatggagacaacaaacctggcggcagcgcaaaagatg

SEQ ID NO: 125570 - DNA, 103 bp, Artificial Sequence
  Synthetic Polynucleotide
taatacgactcactatagggttgcctggccttccagcagtcctgttgtctaacagaggagaagacaaatggactgctggaacctggcggcagcgcaaaagatg

SEQ ID NO: 125571 - DNA, 103 bp, Artificial Sequence
  Synthetic Polynucleotide
taatacgactcactataggggatgttttctttgcctggccttccagcagtaacagaggagaactgctatgaggccaggcaacctggcggcagcgcaaaagatg

SEQ ID NO: 125572 - DNA, 103 bp, Artificial Sequence
  Synthetic Polynucleotide
taatacgactcactataggggctcatcattgatgttttctttgcctggccaacagaggagaggccagatgaagaaaacaaacctggcggcagcgcaaaagatg

SEQ ID NO: 125573 - DNA, 103 bp, Artificial Sequence
  Synthetic Polynucleotide
taatacgactcactatagggctccgcttcaacagattcaagcgaagagcaaacagaggagatgctctatgcttgaatctaacctggcggcagcgcaaaagatg

SEQ ID NO: 125574 - DNA, 103 bp, Artificial Sequence
  Synthetic Polynucleotide
taatacgactcactatagggatatccacaggctcatcattgatgttttctaacagaggagaagaaaaatgcaatgatgaaacctggcggcagcgcaaaagatg

SEQ ID NO: 125575 - DNA, 103 bp, Artificial Sequence
  Synthetic Polynucleotide
taatacgactcactatagggtctagcactcatatccacaggctcatcattaacagaggagaaatgatatgcctgtggataacctggcggcagcgcaaaagatg

SEQ ID NO: 125576 - DNA, 103 bp, Artificial Sequence
  Synthetic Polynucleotide
taatacgactcactataggggctcactccgtctagcactcatatccacagaacagaggagactgtggatgtgagtgctaaacctggcggcagcgcaaaagatg

SEQ ID NO: 125577 - DNA, 103 bp, Artificial Sequence
  Synthetic Polynucleotide
taatacgactcactatagggcctcgctctggctcactccgtctagcactcaacagaggagagagtgcatgacggagtgaaacctggcggcagcgcaaaagatg

SEQ ID NO: 125578 - DNA, 103 bp, Artificial Sequence
  Synthetic Polynucleotide
taatacgactcactatagggagttagccttcctcgctctggctcactccgaacagaggagacggagtatgccagagcgaaacctggcggcagcgcaaaagatg

SEQ ID NO: 125579 - DNA, 103 bp, Artificial Sequence
  Synthetic Polynucleotide
taatacgactcactatagggctggtgagggagttagccttcctcgctctgaacagaggagacagagcatggaaggctaaaacctggcggcagcgcaaaagatg

SEQ ID NO: 125580 - DNA, 103 bp, Artificial Sequence
  Synthetic Polynucleotide
taatacgactcactatagggacaatgatgtctggtgagggagttagccttaacagaggagaaaggctatgtccctcaccaacctggcggcagcgcaaaagatg

SEQ ID NO: 125581 - DNA, 103 bp, Artificial Sequence
  Synthetic Polynucleotide
taatacgactcactataggggtcagacaaaacaatgatgtctggtgagggaacagaggagaccctcaatggacatcattaacctggcggcagcgcaaaagatg

SEQ ID NO: 125582 - DNA, 103 bp, Artificial Sequence
  Synthetic Polynucleotide
taatacgactcactatagggaagcctcattgtcagacaaaacaatgatgtaacagaggagaacatcaatgttttgtctgaacctggcggcagcgcaaaagatg

SEQ ID NO: 125583 - DNA, 103 bp, Artificial Sequence
  Synthetic Polynucleotide
taatacgactcactatagggcggggactggaagcctcattgtcagacaaaaacagaggagatttgtcatgcaatgaggcaacctggcggcagcgcaaaagatg

SEQ ID NO: 125584 - DNA, 103 bp, Artificial Sequence
  Synthetic Polynucleotide
taatacgactcactatagggtgggtccaagctccgcttcaacagattcaaaacagaggagattgaatatgttgaagcggaacctggcggcagcgcaaaagatg

SEQ ID NO: 125585 - DNA, 103 bp, Artificial Sequence
  Synthetic Polynucleotide
taatacgactcactatagggggaactggaacggggactggaagcctcattaacagaggagaaatgagatgtccagtcccaacctggcggcagcgcaaaagatg

SEQ ID NO: 125586 - DNA, 103 bp, Artificial Sequence
  Synthetic Polynucleotide
taatacgactcactatagggcttccattctggaactggaacggggactggaacagaggagaccagtcatggttccagttaacctggcggcagcgcaaaagatg

SEQ ID NO: 125587 - DNA, 103 bp, Artificial Sequence
  Synthetic Polynucleotide
taatacgactcactatagggttgagtctttcttccattctggaactggaaaacagaggagattccagatgcagaatggaaacctggcggcagcgcaaaagatg

SEQ ID NO: 125588 - DNA, 103 bp, Artificial Sequence
  Synthetic Polynucleotide
taatacgactcactataggggttggctgctttgagtctttcttccattctaacagaggagaagaatgatggaaagactcaacctggcggcagcgcaaaagatg

SEQ ID NO: 125589 - DNA, 103 bp, Artificial Sequence
  Synthetic Polynucleotide
taatacgactcactatagggacatctctaagttggctgctttgagtctttaacagaggagaaaagacatgaagcagccaaacctggcggcagcgcaaaagatg

SEQ ID NO: 125590 - DNA, 103 bp, Artificial Sequence
  Synthetic Polynucleotide
taatacgactcactatagggttccccttaaacatctctaagttggctgctaacagaggagaagcagcatgcttagagataacctggcggcagcgcaaaagatg

SEQ ID NO: 125591 - DNA, 103 bp, Artificial Sequence
  Synthetic Polynucleotide
taatacgactcactatagggctcaatgcctttccccttaaacatctctaaaacagaggagattagagatgtttaaggggaacctggcggcagcgcaaaagatg

SEQ ID NO: 125592 - DNA, 103 bp, Artificial Sequence
  Synthetic Polynucleotide
taatacgactcactataggggctgccgctcctcaatgcctttccccttaaaacagaggagattaaggatgaaggcattgaacctggcggcagcgcaaaagatg

SEQ ID NO: 125593 - DNA, 103 bp, Artificial Sequence
  Synthetic Polynucleotide
taatacgactcactatagggttgataagctgctgccgctcctcaatgcctaacagaggagaaggcatatgggagcggcaaacctggcggcagcgcaaaagatg

SEQ ID NO: 125594 - DNA, 103 bp, Artificial Sequence
  Synthetic Polynucleotide
taatacgactcactatagggcctcagctgcttgataagctgctgccgctcaacagaggagagagcggatgcagcttatcaacctggcggcagcgcaaaagatg

SEQ ID NO: 125595 - DNA, 103 bp, Artificial Sequence
  Synthetic Polynucleotide
taatacgactcactataggggctcatctgctgggtccaagctccgcttcaaacagaggagatgaagcatggcttggaccaacctggcggcagcgcaaaagatg

SEQ ID NO: 125596 - DNA, 103 bp, Artificial Sequence
  Synthetic Polynucleotide
taatacgactcactataggggtagctcatccctcagctgcttgataagctaacagaggagaagcttaatgagcagctgaaacctggcggcagcgcaaaagatg

SEQ ID NO: 125597 - DNA, 103 bp, Artificial Sequence
  Synthetic Polynucleotide
taatacgactcactatagggtcttccaatcgtagctcatccctcagctgcaacagaggagagcagctatgggatgagctaacctggcggcagcgcaaaagatg

SEQ ID NO: 125598 - DNA, 103 bp, Artificial Sequence
  Synthetic Polynucleotide
taatacgactcactatagggcagtcgggcttcttccaatcgtagctcatcaacagaggagagatgagatgcgattggaaaacctggcggcagcgcaaaagatg

SEQ ID NO: 125599 - DNA, 103 bp, Artificial Sequence
  Synthetic Polynucleotide
taatacgactcactatagggttaacaggaccagtcgggcttcttccaatcaacagaggagagattggatgaagcccgacaacctggcggcagcgcaaaagatg

SEQ ID NO: 125600 - DNA, 103 bp, Artificial Sequence
  Synthetic Polynucleotide
taatacgactcactatagggctcagtttctttaacaggaccagtcgggctaacagaggagaagcccgatgggtcctgttaacctggcggcagcgcaaaagatg

SEQ ID NO: 125601 - DNA, 103 bp, Artificial Sequence
  Synthetic Polynucleotide
taatacgactcactatagggctgactctgtctcagtttctttaacaggacaacagaggagagtcctgatgaagaaactgaacctggcggcagcgcaaaagatg

SEQ ID NO: 125602 - DNA, 103 bp, Artificial Sequence
  Synthetic Polynucleotide
taatacgactcactatagggctttctgtagctgactctgtctcagtttctaacagaggagaagaaacatggacagagtcaacctggcggcagcgcaaaagatg

SEQ ID NO: 125603 - DNA, 103 bp, Artificial Sequence
  Synthetic Polynucleotide
taatacgactcactatagggaccacattctctttctgtagctgactctgtaacagaggagaacagagatggctacagaaaacctggcggcagcgcaaaagatg

SEQ ID NO: 125604 - DNA, 103 bp, Artificial Sequence
  Synthetic Polynucleotide
taatacgactcactatagggagtcttctggaccacattctctttctgtagaacagaggagactacagatggagaatgtgaacctggcggcagcgcaaaagatg

SEQ ID NO: 125605 - DNA, 103 bp, Artificial Sequence
  Synthetic Polynucleotide
taatacgactcactataggggtacaactggagtcttctggaccacattctaacagaggagaagaatgatgtccagaagaaacctggcggcagcgcaaaagatg

SEQ ID NO: 125606 - DNA, 103 bp, Artificial Sequence
  Synthetic Polynucleotide
taatacgactcactatagggacatcatctcgctcatctgctgggtccaagaacagaggagacttggaatgagcagatgaaacctggcggcagcgcaaaagatg

SEQ ID NO: 125607 - DNA, 103 bp, Artificial Sequence
  Synthetic Polynucleotide
taatacgactcactataggggctgcattctgtacaactggagtcttctggaacagaggagaccagaaatgtccagttgtaacctggcggcagcgcaaaagatg

SEQ ID NO: 125608 - DNA, 103 bp, Artificial Sequence
  Synthetic Polynucleotide
taatacgactcactatagggaacaatagatgctgcattctgtacaactggaacagaggagaccagttatgcagaatgcaaacctggcggcagcgcaaaagatg

SEQ ID NO: 125609 - DNA, 103 bp, Artificial Sequence
  Synthetic Polynucleotide
taatacgactcactataggggagatggctgaacaatagatgctgcattctaacagaggagaagaatgatgcatctattgaacctggcggcagcgcaaaagatg

SEQ ID NO: 125610 - DNA, 103 bp, Artificial Sequence
  Synthetic Polynucleotide
taatacgactcactatagggacatgggcaggagatggctgaacaatagataacagaggagaatctatatgtcagccatcaacctggcggcagcgcaaaagatg

SEQ ID NO: 125611 - DNA, 103 bp, Artificial Sequence
  Synthetic Polynucleotide
taatacgactcactatagggctgctgtcccacatgggcaggagatggctgaacagaggagacagccaatgcctgcccataacctggcggcagcgcaaaagatg

SEQ ID NO: 125612 - DNA, 103 bp, Artificial Sequence
  Synthetic Polynucleotide
taatacgactcactatagggtagataggccctgctgtcccacatgggcagaacagaggagactgcccatgtgggacagcaacctggcggcagcgcaaaagatg

SEQ ID NO: 125613 - DNA, 103 bp, Artificial Sequence
  Synthetic Polynucleotide
taatacgactcactataggggagggaagcttagataggccctgctgtcccaacagaggagagggacaatggggcctatcaacctggcggcagcgcaaaagatg

SEQ ID NO: 125614 - DNA, 103 bp, Artificial Sequence
  Synthetic Polynucleotide
taatacgactcactatagggcccaggccgagagggaagcttagataggccaacagaggagaggcctaatgaagcttcccaacctggcggcagcgcaaaagatg

SEQ ID NO: 125615 - DNA, 103 bp, Artificial Sequence
  Synthetic Polynucleotide
taatacgactcactatagggccccttgggccccaggccgagagggaagctaacagaggagaagcttcatgctcggcctgaacctggcggcagcgcaaaagatg

SEQ ID NO: 125616 - DNA, 103 bp, Artificial Sequence
  Synthetic Polynucleotide
taatacgactcactatagggtgaggttcaaccccttgggccccaggccgaaacagaggagatcggccatgggcccaaggaacctggcggcagcgcaaaagatg

SEQ ID NO: 125617 - DNA, 103 bp, Artificial Sequence
  Synthetic Polynucleotide
taatacgactcactatagggctttgccaggacatcatctcgctcatctgcaacagaggagagcagatatgcgagatgataacctggcggcagcgcaaaagatg

SEQ ID NO: 125618 - DNA, 103 bp, Artificial Sequence
  Synthetic Polynucleotide
taatacgactcactatagggtctcaaattttgaggttcaaccccttgggcaacagaggagagcccaaatggttgaacctaacctggcggcagcgcaaaagatg

SEQ ID NO: 125619 - DNA, 103 bp, Artificial Sequence
  Synthetic Polynucleotide
taatacgactcactatagggcctgtaatgttctcaaattttgaggttcaaaacagaggagattgaacatgaaaatttgaaacctggcggcagcgcaaaagatg

SEQ ID NO: 125620 - DNA, 103 bp, Artificial Sequence
  Synthetic Polynucleotide
taatacgactcactatagggacactgtgaccctgtaatgttctcaaatttaacagaggagaaaatttatgaacattacaaacctggcggcagcgcaaaagatg

SEQ ID NO: 125621 - DNA, 103 bp, Artificial Sequence
  Synthetic Polynucleotide
taatacgactcactatagggtgaacggatgacactgtgaccctgtaatgtaacagaggagaacattaatgggtcacagtaacctggcggcagcgcaaaagatg

SEQ ID NO: 125622 - DNA, 103 bp, Artificial Sequence
  Synthetic Polynucleotide
taatacgactcactatagggtattggtagctgaacggatgacactgtgacaacagaggagagtcacaatgtcatccgttaacctggcggcagcgcaaaagatg

SEQ ID NO: 125623 - DNA, 103 bp, Artificial Sequence
  Synthetic Polynucleotide
taatacgactcactatagggggaagggtggtattggtagctgaacggatgaacagaggagacatccgatgagctaccaaaacctggcggcagcgcaaaagatg

SEQ ID NO: 125624 - DNA, 103 bp, Artificial Sequence
  Synthetic Polynucleotide
taatacgactcactatagggcaacatgtgtggaagggtggtattggtagcaacagaggagagctaccatgaccacccttaacctggcggcagcgcaaaagatg

SEQ ID NO: 125625 - DNA, 103 bp, Artificial Sequence
  Synthetic Polynucleotide
taatacgactcactataggggttgagacatcaacatgtgtggaagggtggaacagaggagaccacccatgcacacatgtaacctggcggcagcgcaaaagatg

SEQ ID NO: 125626 - DNA, 103 bp, Artificial Sequence
  Synthetic Polynucleotide
taatacgactcactataggggcaataacacgttgagacatcaacatgtgtaacagaggagaacacatatggatgtctcaaacctggcggcagcgcaaaagatg

SEQ ID NO: 125627 - DNA, 103 bp, Artificial Sequence
  Synthetic Polynucleotide
taatacgactcactatagggtgggtttggtgcaataacacgttgagacataacagaggagaatgtctatgcgtgttattaacctggcggcagcgcaaaagatg

SEQ ID NO: 125628 - DNA, 103 bp, Artificial Sequence
  Synthetic Polynucleotide
taatacgactcactatagggttttgagtcgctttgccaggacatcatctcaacagaggagagagatgatgtcctggcaaaacctggcggcagcgcaaaagatg

SEQ ID NO: 125629 - DNA, 103 bp, Artificial Sequence
  Synthetic Polynucleotide
taatacgactcactataggggtagctgggctgggtttggtgcaataacacaacagaggagagtgttaatgcaccaaaccaacctggcggcagcgcaaaagatg

SEQ ID NO: 125630 - DNA, 103 bp, Artificial Sequence
  Synthetic Polynucleotide
taatacgactcactatagggcgctgaccctgtagctgggctgggtttggtaacagaggagaaccaaaatgagcccagctaacctggcggcagcgcaaaagatg

SEQ ID NO: 125631 - DNA, 103 bp, Artificial Sequence
  Synthetic Polynucleotide
taatacgactcactatagggaggcgggccccgctgaccctgtagctgggcaacagaggagagcccagatgcagggtcagaacctggcggcagcgcaaaagatg

SEQ ID NO: 125632 - DNA, 103 bp, Artificial Sequence
  Synthetic Polynucleotide
taatacgactcactatagggggccaggcttaggcgggccccgctgaccctaacagaggagaagggtcatgggggcccgcaacctggcggcagcgcaaaagatg

SEQ ID NO: 125633 - DNA, 103 bp, Artificial Sequence
  Synthetic Polynucleotide
taatacgactcactataggggtgcgtacaaggccaggcttaggcgggcccaacagaggagagggcccatgtaagcctggaacctggcggcagcgcaaaagatg

SEQ ID NO: 125634 - DNA, 103 bp, Artificial Sequence
  Synthetic Polynucleotide
taatacgactcactataggggggtgttgtggtgcgtacaaggccaggcttaacagaggagaaagcctatgcttgtacgcaacctggcggcagcgcaaaagatg

SEQ ID NO: 125635 - DNA, 103 bp, Artificial Sequence
  Synthetic Polynucleotide
taatacgactcactataggggattcatgttgggtgttgtggtgcgtacaaaacagaggagattgtacatgccacaacacaacctggcggcagcgcaaaagatg

SEQ ID NO: 125636 - DNA, 103 bp, Artificial Sequence
  Synthetic Polynucleotide
taatacgactcactatagggttgatggcgggattcatgttgggtgttgtgaacagaggagacacaacatgcaacatgaaaacctggcggcagcgcaaaagatg

SEQ ID NO: 125637 - DNA, 103 bp, Artificial Sequence
  Synthetic Polynucleotide
taatacgactcactatagggcggttgataattgatggcgggattcatgttaacagaggagaaacatgatgcccgccatcaacctggcggcagcgcaaaagatg

SEQ ID NO: 125638 - DNA, 103 bp, Artificial Sequence
  Synthetic Polynucleotide
taatacgactcactatagggaacttgactgcggttgataattgatggcggaacagaggagaccgccaatgattatcaacaacctggcggcagcgcaaaagatg

SEQ ID NO: 125639 - DNA, 103 bp, Artificial Sequence
  Synthetic Polynucleotide
taatacgactcactatagggtgcccctccattttgagtcgctttgccaggaacagaggagacctggcatggcgactcaaaacctggcggcagcgcaaaagatg

SEQ ID NO: 125640 - DNA, 103 bp, Artificial Sequence
  Synthetic Polynucleotide
taatacgactcactatagggggaacagaagaacttgactgcggttgataaaacagaggagattatcaatggcagtcaagaacctggcggcagcgcaaaagatg

SEQ ID NO: 125641 - DNA, 103 bp, Artificial Sequence
  Synthetic Polynucleotide
taatacgactcactatagggacgctgacatggaacagaagaacttgactgaacagaggagacagtcaatgtcttctgttaacctggcggcagcgcaaaagatg

SEQ ID NO: 125642 - DNA, 103 bp, Artificial Sequence
  Synthetic Polynucleotide
taatacgactcactatagggaggatgttgtacgctgacatggaacagaagaacagaggagacttctgatgcatgtcagcaacctggcggcagcgcaaaagatg

SEQ ID NO: 125643 - DNA, 103 bp, Artificial Sequence
  Synthetic Polynucleotide
taatacgactcactatagggtagatggcagaggatgttgtacgctgacataacagaggagaatgtcaatgtacaacatcaacctggcggcagcgcaaaagatg

SEQ ID NO: 125644 - DNA, 103 bp, Artificial Sequence
  Synthetic Polynucleotide
taatacgactcactatagggaaggttcatatagatggcagaggatgttgtaacagaggagaacaacaatgtctgccatcaacctggcggcagcgcaaaagatg

SEQ ID NO: 125645 - DNA, 103 bp, Artificial Sequence
  Synthetic Polynucleotide
taatacgactcactatagggtatgagaagcaaggttcatatagatggcagaacagaggagactgccaatgatatgaaccaacctggcggcagcgcaaaagatg

SEQ ID NO: 125646 - DNA, 103 bp, Artificial Sequence
  Synthetic Polynucleotide
taatacgactcactatagggcctggctggatatgagaagcaaggttcataaacagaggagatatgaaatgtgcttctcaaacctggcggcagcgcaaaagatg

SEQ ID NO: 125647 - DNA, 103 bp, Artificial Sequence
  Synthetic Polynucleotide
taatacgactcactataggggttcaccgtccctggctggatatgagaagcaacagaggagagcttctatgatccagccaaacctggcggcagcgcaaaagatg

SEQ ID NO: 125648 - DNA, 103 bp, Artificial Sequence
  Synthetic Polynucleotide
taatacgactcactatagggaggacactctgttcaccgtccctggctggaaacagaggagatccagcatgggacggtgaaacctggcggcagcgcaaaagatg

SEQ ID NO: 125649 - DNA, 103 bp, Artificial Sequence
  Synthetic Polynucleotide
taatacgactcactatagggggaagtggcgaggacactctgttcaccgtcaacagaggagagacggtatgcagagtgtcaacctggcggcagcgcaaaagatg

SEQ ID NO: 125650 - DNA, 103 bp, Artificial Sequence
  Synthetic Polynucleotide
taatacgactcactatagggcatcagcgacggcgggaacgctgcgctcataacagaggagaatgagcatggcgttcccgaacctggcggcagcgcaaaagatg

SEQ ID NO: 125651 - DNA, 103 bp, Artificial Sequence
  Synthetic Polynucleotide
taatacgactcactataggggacgaaatggccggggctgggctgcggcggaacagaggagaccgccgatgcccagccccaacctggcggcagcgcaaaagatg

SEQ ID NO: 125652 - DNA, 103 bp, Artificial Sequence
  Synthetic Polynucleotide
taatacgactcactatagggatgctgacttctgatagcgaacctgctgacaacagaggagagtcagcatgttcgctatcaacctggcggcagcgcaaaagatg

SEQ ID NO: 125653 - DNA, 103 bp, Artificial Sequence
  Synthetic Polynucleotide
taatacgactcactatagggctagctgctgatgctgacttctgatagcgaaacagaggagatcgctaatggaagtcagcaacctggcggcagcgcaaaagatg

SEQ ID NO: 125654 - DNA, 103 bp, Artificial Sequence
  Synthetic Polynucleotide
taatacgactcactatagggcgggcctgttctagctgctgatgctgacttaacagaggagaaagtcaatgtcagcagctaacctggcggcagcgcaaaagatg

SEQ ID NO: 125655 - DNA, 103 bp, Artificial Sequence
  Synthetic Polynucleotide
taatacgactcactatagggagccggtgtagacgaaatggccggggctggaacagaggagaccagccatggccatttcgaacctggcggcagcgcaaaagatg

SEQ ID NO: 125656 - DNA, 103 bp, Artificial Sequence
  Synthetic Polynucleotide
taatacgactcactatagggaacatggggtagccggtgtagacgaaatggaacagaggagaccatttatgctacaccggaacctggcggcagcgcaaaagatg

SEQ ID NO: 125657 - DNA, 103 bp, Artificial Sequence
  Synthetic Polynucleotide
taatacgactcactataggggtagggcatgaacatggggtagccggtgtaaacagaggagatacaccatgtaccccatgaacctggcggcagcgcaaaagatg

SEQ ID NO: 125658 - DNA, 103 bp, Artificial Sequence
  Synthetic Polynucleotide
taatacgactcactatagggctaccggccggtagggcatgaacatggggtaacagaggagaaccccaatgtcatgccctaacctggcggcagcgcaaaagatg

SEQ ID NO: 125659 - DNA, 103 bp, Artificial Sequence
  Synthetic Polynucleotide
taatacgactcactatagggggcggcagcactaccggccggtagggcatgaacagaggagacatgccatgccggccggtaacctggcggcagcgcaaaagatg

SEQ ID NO: 125660 - DNA, 103 bp, Artificial Sequence
  Synthetic Polynucleotide
taatacgactcactatagggcggcggcggcggcggcagcactaccggccgaacagaggagacggccgatggtgctgccgaacctggcggcagcgcaaaagatg

SEQ ID NO: 125661 - DNA, 103 bp, Artificial Sequence
  Synthetic Polynucleotide
taatacgactcactatagggcgggcggcggcggcggcggcggcggcagcaaacagaggagatgctgcatgcgccgccgcaacctggcggcagcgcaaaagatg

SEQ ID NO: 125662 - DNA, 103 bp, Artificial Sequence
  Synthetic Polynucleotide
taatacgactcactatagggtggggcagcgcgggcggcggcggcggcggcaacagaggagagccgccatggccgccgccaacctggcggcagcgcaaaagatg

SEQ ID NO: 125663 - DNA, 103 bp, Artificial Sequence
  Synthetic Polynucleotide
taatacgactcactatagggcagcgcggcctggggcagcgcgggcggcggaacagaggagaccgccgatggcgctgcccaacctggcggcagcgcaaaagatg

SEQ ID NO: 125664 - DNA, 103 bp, Artificial Sequence
  Synthetic Polynucleotide
taatacgactcactataggggctgcatcatcatcagcgacggcgggaacgaacagaggagacgttccatgcgtcgctgaaacctggcggcagcgcaaaagatg

SEQ ID NO: 125665 - DNA, 103 bp, Artificial Sequence
  Synthetic Polynucleotide
taatacgactcactataggggcgctggctgcagcgcggcctggggcagcgaacagaggagacgctgcatgaggccgcgcaacctggcggcagcgcaaaagatg

SEQ ID NO: 125666 - DNA, 103 bp, Artificial Sequence
  Synthetic Polynucleotide
taatacgactcactataggggcgggcggcagcgctggctgcagcgcggccaacagaggagaggccgcatggcagccagcaacctggcggcagcgcaaaagatg

SEQ ID NO: 125667 - DNA, 103 bp, Artificial Sequence
  Synthetic Polynucleotide
taatacgactcactataggggtgagggtgtgcgggcggcagcgctggctgaacagaggagacagccaatgctgccgcccaacctggcggcagcgcaaaagatg

SEQ ID NO: 125668 - DNA, 103 bp, Artificial Sequence
  Synthetic Polynucleotide
taatacgactcactatagggggatctggtggtgagggtgtgcgggcggcaaacagaggagatgccgcatgcacaccctcaacctggcggcagcgcaaaagatg

SEQ ID NO: 125669 - DNA, 103 bp, Artificial Sequence
  Synthetic Polynucleotide
taatacgactcactatagggggcaggctggggatctggtggtgagggtgtaacagaggagaacacccatgccaccagataacctggcggcagcgcaaaagatg

SEQ ID NO: 125670 - DNA, 103 bp, Artificial Sequence
  Synthetic Polynucleotide
taatacgactcactataggggaagcctgtgggcaggctggggatctggtgaacagaggagacaccagatgcccagcctgaacctggcggcagcgcaaaagatg

SEQ ID NO: 125671 - DNA, 103 bp, Artificial Sequence
  Synthetic Polynucleotide
taatacgactcactatagggggctggagcagaagcctgtgggcaggctggaacagaggagaccagccatgccacaggctaacctggcggcagcgcaaaagatg

SEQ ID NO: 125672 - DNA, 103 bp, Artificial Sequence
  Synthetic Polynucleotide
taatacgactcactatagggccctgcgccaggctggagcagaagcctgtgaacagaggagacacaggatgctgctccagaacctggcggcagcgcaaaagatg

SEQ ID NO: 125673 - DNA, 103 bp, Artificial Sequence
  Synthetic Polynucleotide
taatacgactcactataggggagcgccatgccctgcgccaggctggagcaaacagaggagatgctccatgctggcgcagaacctggcggcagcgcaaaagatg

SEQ ID NO: 125674 - DNA, 103 bp, Artificial Sequence
  Synthetic Polynucleotide
taatacgactcactataggggcgtagaggtgagcgccatgccctgcgccaaacagaggagatggcgcatggcatggcgcaacctggcggcagcgcaaaagatg

SEQ ID NO: 125675 - DNA, 103 bp, Artificial Sequence
  Synthetic Polynucleotide
taatacgactcactatagggcccagcgggcgctgcatcatcatcagcgacaacagaggagagtcgctatggatgatgcaaacctggcggcagcgcaaaagatg

SEQ ID NO: 125676 - DNA, 103 bp, Artificial Sequence
  Synthetic Polynucleotide
taatacgactcactataggggtggccatgagcgtagaggtgagcgccatgaacagaggagacatggcatgcacctctacaacctggcggcagcgcaaaagatg

SEQ ID NO: 125677 - DNA, 103 bp, Artificial Sequence
  Synthetic Polynucleotide
taatacgactcactataggggccggggagcgtggccatgagcgtagaggtaacagaggagaacctctatgctcatggccaacctggcggcagcgcaaaagatg

SEQ ID NO: 125678 - DNA, 103 bp, Artificial Sequence
  Synthetic Polynucleotide
taatacgactcactatagggcggagaagccgccggggagcgtggccatgaaacagaggagatcatggatgcgctccccgaacctggcggcagcgcaaaagatg

SEQ ID NO: 125679 - DNA, 103 bp, Artificial Sequence
  Synthetic Polynucleotide
taatacgactcactatagggtggggcgacgcggagaagccgccggggagcaacagaggagagctcccatgcggcttctcaacctggcggcagcgcaaaagatg

SEQ ID NO: 125680 - DNA, 103 bp, Artificial Sequence
  Synthetic Polynucleotide
taatacgactcactatagggctcctggtgctggggcgacgcggagaagccaacagaggagaggcttcatggcgtcgcccaacctggcggcagcgcaaaagatg

SEQ ID NO: 125681 - DNA, 103 bp, Artificial Sequence
  Synthetic Polynucleotide
taatacgactcactatagggccgctgccgcctcctggtgctggggcgacgaacagaggagacgtcgcatgagcaccaggaacctggcggcagcgcaaaagatg

SEQ ID NO: 125682 - DNA, 103 bp, Artificial Sequence
  Synthetic Polynucleotide
taatacgactcactatagggaacttgcgggccgctgccgcctcctggtgcaacagaggagagcaccaatgggcggcagcaacctggcggcagcgcaaaagatg

SEQ ID NO: 125683 - DNA, 103 bp, Artificial Sequence
  Synthetic Polynucleotide
taatacgactcactatagggctgcggcgcgaacttgcgggccgctgccgcaacagaggagagcggcaatggcccgcaagaacctggcggcagcgcaaaagatg

SEQ ID NO: 125684 - DNA, 103 bp, Artificial Sequence
  Synthetic Polynucleotide
taatacgactcactatagggcgggcagcggctgcggcgcgaacttgcgggaacagaggagacccgcaatgtcgcgccgcaacctggcggcagcgcaaaagatg

SEQ ID NO: 125685 - DNA, 103 bp, Artificial Sequence
  Synthetic Polynucleotide
taatacgactcactatagggttaccgccgccgggcagcggctgcggcgcgaacagaggagacgcgccatggccgctgccaacctggcggcagcgcaaaagatg

SEQ ID NO: 125686 - DNA, 103 bp, Artificial Sequence
  Synthetic Polynucleotide
taatacgactcactatagggggtgctactccccagcgggcgctgcatcataacagaggagaatgatgatgcgcccgctgaacctggcggcagcgcaaaagatg

SEQ ID NO: 125687 - DNA, 103 bp, Artificial Sequence
  Synthetic Polynucleotide
taatacgactcactatagggcttgtcgaagttaccgccgccgggcagcggaacagaggagaccgctgatgggcggcggtaacctggcggcagcgcaaaagatg

SEQ ID NO: 125688 - DNA, 103 bp, Artificial Sequence
  Synthetic Polynucleotide
taatacgactcactataggggcgcctccgccttgtcgaagttaccgccgcaacagaggagagcggcgatgacttcgacaaacctggcggcagcgcaaaagatg

SEQ ID NO: 125689 - DNA, 103 bp, Artificial Sequence
  Synthetic Polynucleotide
taatacgactcactatagggtcagcctgcagcgcctccgccttgtcgaagaacagaggagacttcgaatgggcggaggcaacctggcggcagcgcaaaagatg

SEQ ID NO: 125690 - DNA, 103 bp, Artificial Sequence
  Synthetic Polynucleotide
taatacgactcactataggggtcctccgcgtcagcctgcagcgcctccgcaacagaggagagcggagatgctgcaggctaacctggcggcagcgcaaaagatg

SEQ ID NO: 125691 - DNA, 103 bp, Artificial Sequence
  Synthetic Polynucleotide
taatacgactcactatagggagcctttgccgtcctccgcgtcagcctgcaaacagaggagatgcaggatgacgcggaggaacctggcggcagcgcaaaagatg

SEQ ID NO: 125692 - DNA, 103 bp, Artificial Sequence
  Synthetic Polynucleotide
taatacgactcactatagggttggccaggaagcctttgccgtcctccgcgaacagaggagacgcggaatgcggcaaaggaacctggcggcagcgcaaaagatg

SEQ ID NO: 125693 - DNA, 103 bp, Artificial Sequence
  Synthetic Polynucleotide
taatacgactcactatagggcgagccctctttggccaggaagcctttgccaacagaggagaggcaaaatgttcctggccaacctggcggcagcgcaaaagatg

SEQ ID NO: 125694 - DNA, 103 bp, Artificial Sequence
  Synthetic Polynucleotide
taatacgactcactatagggaggcgagcagcgagccctctttggccaggaaacagaggagatcctggatgaagagggctaacctggcggcagcgcaaaagatg

SEQ ID NO: 125695 - DNA, 103 bp, Artificial Sequence
  Synthetic Polynucleotide
taatacgactcactataggggccgcggagaaggcgagcagcgagccctctaacagaggagaagagggatggctgctcgcaacctggcggcagcgcaaaagatg

SEQ ID NO: 125696 - DNA, 103 bp, Artificial Sequence
  Synthetic Polynucleotide
taatacgactcactatagggcaccgtctcggccgcggagaaggcgagcagaacagaggagactgctcatgttctccgcgaacctggcggcagcgcaaaagatg

SEQ ID NO: 125697 - DNA, 103 bp, Artificial Sequence
  Synthetic Polynucleotide
taatacgactcactatagggtgctgaaggcggtgctactccccagcgggcaacagaggagagcccgcatgggagtagcaaacctggcggcagcgcaaaagatg

SEQ ID NO: 125698 - DNA, 103 bp, Artificial Sequence
  Synthetic Polynucleotide
taatacgactcactataggggcgaagcctgcaccgtctcggccgcggagaaacagaggagatctccgatgccgagacggaacctggcggcagcgcaaaagatg

SEQ ID NO: 125699 - DNA, 103 bp, Artificial Sequence
  Synthetic Polynucleotide
taatacgactcactataggggccccgacgagcgaagcctgcaccgtctcgaacagaggagacgagacatggcaggcttcaacctggcggcagcgcaaaagatg

SEQ ID NO: 125700 - DNA, 103 bp, Artificial Sequence
  Synthetic Polynucleotide
taatacgactcactatagggccctcggacagccccgacgagcgaagcctgaacagaggagacaggctatgctcgtcgggaacctggcggcagcgcaaaagatg

SEQ ID NO: 125701 - DNA, 103 bp, Artificial Sequence
  Synthetic Polynucleotide
taatacgactcactatagggctttcccttgccctcggacagccccgacgaaacagaggagatcgtcgatgctgtccgagaacctggcggcagcgcaaaagatg

SEQ ID NO: 125702 - DNA, 103 bp, Artificial Sequence
  Synthetic Polynucleotide
taatacgactcactatagggtttgactcgtctttcccttgccctcggacaaacagaggagatgtccgatggcaagggaaaacctggcggcagcgcaaaagatg

SEQ ID NO: 125703 - DNA, 103 bp, Artificial Sequence
  Synthetic Polynucleotide
taatacgactcactataggggtcttccacctttgactcgtctttcccttgaacagaggagacaagggatggacgagtcaaacctggcggcagcgcaaaagatg

SEQ ID NO: 125704 - DNA, 103 bp, Artificial Sequence
  Synthetic Polynucleotide
taatacgactcactatagggccttcgggtcgtcttccacctttgactcgtaacagaggagaacgagtatgaggtggaagaacctggcggcagcgcaaaagatg

SEQ ID NO: 125705 - DNA, 103 bp, Artificial Sequence
  Synthetic Polynucleotide
taatacgactcactatagggtcctccttgcccttcgggtcgtcttccaccaacagaggagaggtggaatgcgacccgaaaacctggcggcagcgcaaaagatg

SEQ ID NO: 125706 - DNA, 103 bp, Artificial Sequence
  Synthetic Polynucleotide
taatacgactcactatagggcgagaagctctcctccttgcccttcgggtcaacagaggagagacccgatgggcaaggagaacctggcggcagcgcaaaagatg

SEQ ID NO: 125707 - DNA, 103 bp, Artificial Sequence
  Synthetic Polynucleotide
taatacgactcactatagggcgctctccagcgagaagctctcctccttgcaacagaggagagcaaggatgagagcttctaacctggcggcagcgcaaaagatg

SEQ ID NO: 125708 - DNA, 103 bp, Artificial Sequence
  Synthetic Polynucleotide
taatacgactcactatagggagcgagtctatgctgaaggcggtgctactcaacagaggagagagtagatgcgccttcagaacctggcggcagcgcaaaagatg

SEQ ID NO: 125709 - DNA, 103 bp, Artificial Sequence
  Synthetic Polynucleotide
taatacgactcactatagggtagtccacatcgctctccagcgagaagctcaacagaggagagagcttatggctggagagaacctggcggcagcgcaaaagatg

SEQ ID NO: 125710 - DNA, 103 bp, Artificial Sequence
  Synthetic Polynucleotide
taatacgactcactatagggatccgagctgtagtccacatcgctctccagaacagaggagactggagatggatgtggacaacctggcggcagcgcaaaagatg

SEQ ID NO: 125711 - DNA, 103 bp, Artificial Sequence
  Synthetic Polynucleotide
taatacgactcactatagggtcagattgtcatccgagctgtagtccacataacagaggagaatgtggatgacagctcggaacctggcggcagcgcaaaagatg

SEQ ID NO: 125712 - DNA, 103 bp, Artificial Sequence
  Synthetic Polynucleotide
taatacgactcactataggggcctggccagtcagattgtcatccgagctgaacagaggagacagctcatgtgacaatctaacctggcggcagcgcaaaagatg

SEQ ID NO: 125713 - DNA, 103 bp, Artificial Sequence
  Synthetic Polynucleotide
taatacgactcactatagggcttgtgagctgcctggccagtcagattgtcaacagaggagagacaatatgactggccagaacctggcggcagcgcaaaagatg

SEQ ID NO: 125714 - DNA, 103 bp, Artificial Sequence
  Synthetic Polynucleotide
taatacgactcactatagggggtcttcctccttgtgagctgcctggccagaacagaggagactggccatgcagctcacaaacctggcggcagcgcaaaagatg

SEQ ID NO: 125715 - DNA, 103 bp, Artificial Sequence
  Synthetic Polynucleotide
taatacgactcactataggggcgtggcccgggtcttcctccttgtgagctaacagaggagaagctcaatgggaggaagaaacctggcggcagcgcaaaagatg

SEQ ID NO: 125716 - DNA, 103 bp, Artificial Sequence
  Synthetic Polynucleotide
taatacgactcactatagggctcctccagcgcgtggcccgggtcttcctcaacagaggagagaggaaatgccgggccacaacctggcggcagcgcaaaagatg

SEQ ID NO: 125717 - DNA, 103 bp, Artificial Sequence
  Synthetic Polynucleotide
taatacgactcactatagggtcggcggggtctcctccagcgcgtggcccgaacagaggagacgggccatgcgctggaggaacctggcggcagcgcaaaagatg

SEQ ID NO: 125718 - DNA, 103 bp, Artificial Sequence
  Synthetic Polynucleotide
taatacgactcactataggggcgccgctgctcggcggggtctcctccagcaacagaggagagctggaatggaccccgccaacctggcggcagcgcaaaagatg

SEQ ID NO: 125719 - DNA, 103 bp, Artificial Sequence
  Synthetic Polynucleotide
taatacgactcactataggggctgccgatcagcgagtctatgctgaaggcaacagaggagagccttcatgatagactcgaacctggcggcagcgcaaaagatg

SEQ ID NO: 125720 - DNA, 103 bp, Artificial Sequence
  Synthetic Polynucleotide
taatacgactcactataggggctgcccgcggcgccgctgctcggcggggtaacagaggagaaccccgatgagcagcggcaacctggcggcagcgcaaaagatg

SEQ ID NO: 125721 - DNA, 103 bp, Artificial Sequence
  Synthetic Polynucleotide
taatacgactcactatagggtagacgtggtgctgcccgcggcgccgctgcaacagaggagagcagcgatgccgcgggcaaacctggcggcagcgcaaaagatg

SEQ ID NO: 125722 - DNA, 103 bp, Artificial Sequence
  Synthetic Polynucleotide
taatacgactcactatagggttcttgcccgtagacgtggtgctgcccgcgaacagaggagacgcgggatgcaccacgtcaacctggcggcagcgcaaaagatg

SEQ ID NO: 125723 - DNA, 103 bp, Artificial Sequence
  Synthetic Polynucleotide
taatacgactcactatagggccgccgccggttcttgcccgtagacgtggtaacagaggagaaccacgatgacgggcaagaacctggcggcagcgcaaaagatg

SEQ ID NO: 125724 - DNA, 103 bp, Artificial Sequence
  Synthetic Polynucleotide
taatacgactcactatagggaggcagtccgccgccgccggttcttgcccgaacagaggagacgggcaatgaccggcggcaacctggcggcagcgcaaaagatg

SEQ ID NO: 125725 - DNA, 103 bp, Artificial Sequence
  Synthetic Polynucleotide
taatacgactcactatagggtcgctggtgaaggcagtccgccgccgccggaacagaggagaccggcgatggcggactgcaacctggcggcagcgcaaaagatg

SEQ ID NO: 125726 - DNA, 103 bp, Artificial Sequence
  Synthetic Polynucleotide
taatacgactcactatagggcagcagctgctcgctggtgaaggcagtccgaacagaggagacggactatgttcaccagcaacctggcggcagcgcaaaagatg

SEQ ID NO: 125727 - DNA, 103 bp, Artificial Sequence
  Synthetic Polynucleotide
taatacgactcactatagggtctctagctccagcagctgctcgctggtgaaacagaggagatcaccaatgagcagctgcaacctggcggcagcgcaaaagatg

SEQ ID NO: 125728 - DNA, 103 bp, Artificial Sequence
  Synthetic Polynucleotide
taatacgactcactatagggtggaactccttctctagctccagcagctgcaacagaggagagcagctatgggagctagaaacctggcggcagcgcaaaagatg

SEQ ID NO: 125729 - DNA, 103 bp, Artificial Sequence
  Synthetic Polynucleotide
taatacgactcactatagggctttttgcagtggaactccttctctagctcaacagaggagagagctaatgaaggagttcaacctggcggcagcgcaaaagatg

SEQ ID NO: 125730 - DNA, 103 bp, Artificial Sequence
  Synthetic Polynucleotide
taatacgactcactataggggctgcggcgggctgccgatcagcgagtctaaacagaggagatagactatgtgatcggcaaacctggcggcagcgcaaaagatg

SEQ ID NO: 125731 - DNA, 103 bp, Artificial Sequence
  Synthetic Polynucleotide
taatacgactcactatagggaggagaggtactttttgcagtggaactcctaacagaggagaaggagtatgactgcaaaaaacctggcggcagcgcaaaagatg

SEQ ID NO: 125732 - DNA, 103 bp, Artificial Sequence
  Synthetic Polynucleotide
taatacgactcactatagggcgctcggtcaaggagaggtactttttgcagaacagaggagactgcaaatggtacctctcaacctggcggcagcgcaaaagatg

SEQ ID NO: 125733 - DNA, 103 bp, Artificial Sequence
  Synthetic Polynucleotide
taatacgactcactataggggatctgcgagcgctcggtcaaggagaggtaaacagaggagatacctcatgttgaccgagaacctggcggcagcgcaaaagatg

SEQ ID NO: 125734 - DNA, 103 bp, Artificial Sequence
  Synthetic Polynucleotide
taatacgactcactataggggggcgtgggcgatctgcgagcgctcggtcaaacagaggagatgaccgatggctcgcagaaacctggcggcagcgcaaaagatg

SEQ ID NO: 125735 - DNA, 103 bp, Artificial Sequence
  Synthetic Polynucleotide
taatacgactcactatagggctgagtttgagggcgtgggcgatctgcgagaacagaggagactcgcaatgcgcccacgcaacctggcggcagcgcaaaagatg

SEQ ID NO: 125736 - DNA, 103 bp, Artificial Sequence
  Synthetic Polynucleotide
taatacgactcactatagggctgcacctcgctgagtttgagggcgtgggcaacagaggagagcccacatgctcaaactcaacctggcggcagcgcaaaagatg

SEQ ID NO: 125737 - DNA, 103 bp, Artificial Sequence
  Synthetic Polynucleotide
taatacgactcactatagggagattttcacctgcacctcgctgagtttgaaacagaggagatcaaacatggcgaggtgcaacctggcggcagcgcaaaagatg

SEQ ID NO: 125738 - DNA, 103 bp, Artificial Sequence
  Synthetic Polynucleotide
taatacgactcactatagggttctggaaccagattttcacctgcacctcgaacagaggagacgaggtatgggtgaaaataacctggcggcagcgcaaaagatg

SEQ ID NO: 125739 - DNA, 103 bp, Artificial Sequence
  Synthetic Polynucleotide
taatacgactcactatagggggcccgtcggttctggaaccagattttcacaacagaggagagtgaaaatgtggttccagaacctggcggcagcgcaaaagatg

SEQ ID NO: 125740 - DNA, 103 bp, Artificial Sequence
  Synthetic Polynucleotide
taatacgactcactataggggtttccacttggcccgtcggttctggaaccaacagaggagaggttccatgaccgacgggaacctggcggcagcgcaaaagatg

SEQ ID NO: 125741 - DNA, 103 bp, Artificial Sequence
  Synthetic Polynucleotide
taatacgactcactatagggccggggctgggctgcggcgggctgccgatcaacagaggagagatcggatgcccgccgcaaacctggcggcagcgcaaaagatg

SEQ ID NO: 125742 - DNA, 103 bp, Artificial Sequence
  Synthetic Polynucleotide
taatacgactcactataggggccttcacccgtttccacttggcccgtcggaacagaggagaccgacgatgcaagtggaaaacctggcggcagcgcaaaagatg

SEQ ID NO: 125743 - DNA, 103 bp, Artificial Sequence
  Synthetic Polynucleotide
taatacgactcactatagggggcattgcctgccttcacccgtttccacttaacagaggagaaagtggatgcgggtgaagaacctggcggcagcgcaaaagatg

SEQ ID NO: 125744 - DNA, 103 bp, Artificial Sequence
  Synthetic Polynucleotide
taatacgactcactatagggtcttggaattggcattgcctgccttcacccaacagaggagagggtgaatgcaggcaatgaacctggcggcagcgcaaaagatg

SEQ ID NO: 125745 - DNA, 103 bp, Artificial Sequence
  Synthetic Polynucleotide
taatacgactcactatagggggctcccctgtcttggaattggcattgcctaacagaggagaaggcaaatgcaattccaaaacctggcggcagcgcaaaagatg

SEQ ID NO: 125746 - DNA, 103 bp, Artificial Sequence
  Synthetic Polynucleotide
taatacgactcactataggggttccgggagggctcccctgtcttggaattaacagaggagaaattccatgacaggggagaacctggcggcagcgcaaaagatg

SEQ ID NO: 125747 - DNA, 103 bp, Artificial Sequence
  Synthetic Polynucleotide
taatacgactcactatagggcgatcttagggttccgggagggctcccctgaacagaggagacaggggatgcctcccggaaacctggcggcagcgcaaaagatg

SEQ ID NO: 125748 - DNA, 103 bp, Artificial Sequence
  Synthetic Polynucleotide
taatacgactcactatagggatggggacgacgatcttagggttccgggagaacagaggagactcccgatgccctaagataacctggcggcagcgcaaaagatg

SEQ ID NO: 125749 - DNA, 103 bp, Artificial Sequence
  Synthetic Polynucleotide
taatacgactcactataggggtggacagggatggggacgacgatcttaggaacagaggagacctaagatggtcgtccccaacctggcggcagcgcaaaagatg

SEQ ID NO: 125750 - DNA, 103 bp, Artificial Sequence
  Synthetic Polynucleotide
taatacgactcactatagggacctgctgacgtggacagggatggggacgaaacagaggagatcgtccatgtccctgtccaacctggcggcagcgcaaaagatg

SEQ ID NO: 125751 - DNA, 103 bp, Artificial Sequence
  Synthetic Polynucleotide
taatacgactcactatagggctgatagcgaacctgctgacgtggacagggaacagaggagaccctgtatgcgtcagcagaacctggcggcagcgcaaaagatg

SEQ ID NO: 125752 - DNA, 103 bp, Artificial Sequence
  Synthetic Polynucleotide
taatacgactcactatagggccgaaaagtccttttcggcctgtgagccataacagaggagaatggctatgaggccgaaaaacctggcggcagcgcaaaagatg

SEQ ID NO: 125753 - DNA, 103 bp, Artificial Sequence
  Synthetic Polynucleotide
taatacgactcactatagggagaacccgggaccggaagttccctcggcgcaacagaggagagcgccgatggaacttccgaacctggcggcagcgcaaaagatg

SEQ ID NO: 125754 - DNA, 103 bp, Artificial Sequence
  Synthetic Polynucleotide
taatacgactcactatagggcttttcattaaggcagtcaattaaattttcaacagaggagagaaaatatgattgactgcaacctggcggcagcgcaaaagatg

SEQ ID NO: 125755 - DNA, 103 bp, Artificial Sequence
  Synthetic Polynucleotide
taatacgactcactatagggtgttgataatcttttcattaaggcagtcaaaacagaggagattgactatgttaatgaaaaacctggcggcagcgcaaaagatg

SEQ ID NO: 125756 - DNA, 103 bp, Artificial Sequence
  Synthetic Polynucleotide
taatacgactcactatagggatttcttggatgttgataatcttttcattaaacagaggagataatgaatggattatcaaaacctggcggcagcgcaaaagatg

SEQ ID NO: 125757 - DNA, 103 bp, Artificial Sequence
  Synthetic Polynucleotide
taatacgactcactatagggggatgattctatttcttggatgttgataataacagaggagaattatcatgatccaagaaaacctggcggcagcgcaaaagatg

SEQ ID NO: 125758 - DNA, 103 bp, Artificial Sequence
  Synthetic Polynucleotide
taatacgactcactataggggtgcatgcatggatgattctatttcttggaaacagaggagatccaagatgtagaatcataacctggcggcagcgcaaaagatg

SEQ ID NO: 125759 - DNA, 103 bp, Artificial Sequence
  Synthetic Polynucleotide
taatacgactcactatagggtttaaaaggagtgcatgcatggatgattctaacagaggagaagaatcatgcatgcatgcaacctggcggcagcgcaaaagatg

SEQ ID NO: 125760 - DNA, 103 bp, Artificial Sequence
  Synthetic Polynucleotide
taatacgactcactatagggcatagcttgttttaaaaggagtgcatgcataacagaggagaatgcatatgctccttttaaacctggcggcagcgcaaaagatg

SEQ ID NO: 125761 - DNA, 103 bp, Artificial Sequence
  Synthetic Polynucleotide
taatacgactcactatagggtcataaaggtcatagcttgttttaaaaggaaacagaggagatcctttatgaacaagctaaacctggcggcagcgcaaaagatg

SEQ ID NO: 125762 - DNA, 103 bp, Artificial Sequence
  Synthetic Polynucleotide
taatacgactcactatagggtgcctgcgtttcataaaggtcatagcttgtaacagaggagaacaagcatggacctttataacctggcggcagcgcaaaagatg

SEQ ID NO: 125763 - DNA, 103 bp, Artificial Sequence
  Synthetic Polynucleotide
taatacgactcactatagggtaattcatcttgcctgcgtttcataaaggtaacagaggagaacctttatgaaacgcaggaacctggcggcagcgcaaaagatg

SEQ ID NO: 125764 - DNA, 103 bp, Artificial Sequence
  Synthetic Polynucleotide
taatacgactcactatagggcttcctccgcagaacccgggaccggaagttaacagaggagaaacttcatgtcccgggttaacctggcggcagcgcaaaagatg

SEQ ID NO: 125765 - DNA, 103 bp, Artificial Sequence
  Synthetic Polynucleotide
taatacgactcactatagggattcatgttttaattcatcttgcctgcgttaacagaggagaaacgcaatgaagatgaataacctggcggcagcgcaaaagatg

SEQ ID NO: 125766 - DNA, 103 bp, Artificial Sequence
  Synthetic Polynucleotide
taatacgactcactatagggaaatacgttgattcatgttttaattcatctaacagaggagaagatgaatgaaaacatgaaacctggcggcagcgcaaaagatg

SEQ ID NO: 125767 - DNA, 103 bp, Artificial Sequence
  Synthetic Polynucleotide
taatacgactcactatagggtaactgttgtaaatacgttgattcatgtttaacagaggagaaaacatatgtcaacgtataacctggcggcagcgcaaaagatg

SEQ ID NO: 125768 - DNA, 103 bp, Artificial Sequence
  Synthetic Polynucleotide
taatacgactcactatagggctttgcgtgataactgttgtaaatacgttgaacagaggagacaacgtatgtacaacagtaacctggcggcagcgcaaaagatg

SEQ ID NO: 125769 - DNA, 103 bp, Artificial Sequence
  Synthetic Polynucleotide
taatacgactcactataggggatgtctcatctttgcgtgataactgttgtaacagaggagaacaacaatgatcacgcaaaacctggcggcagcgcaaaagatg

SEQ ID NO: 125770 - DNA, 103 bp, Artificial Sequence
  Synthetic Polynucleotide
taatacgactcactatagggtccacttgtggatgtctcatctttgcgtgaaacagaggagatcacgcatggatgagacaaacctggcggcagcgcaaaagatg

SEQ ID NO: 125771 - DNA, 103 bp, Artificial Sequence
  Synthetic Polynucleotide
taatacgactcactatagggctgagaagtttccacttgtggatgtctcataacagaggagaatgagaatgccacaagtgaacctggcggcagcgcaaaagatg

SEQ ID NO: 125772 - DNA, 103 bp, Artificial Sequence
  Synthetic Polynucleotide
taatacgactcactatagggttttcatctactgagaagtttccacttgtgaacagaggagacacaagatgaaacttctcaacctggcggcagcgcaaaagatg

SEQ ID NO: 125773 - DNA, 103 bp, Artificial Sequence
  Synthetic Polynucleotide
taatacgactcactatagggccactgagttttttcatctactgagaagttaacagaggagaaacttcatggtagatgaaaacctggcggcagcgcaaaagatg

SEQ ID NO: 125774 - DNA, 103 bp, Artificial Sequence
  Synthetic Polynucleotide
taatacgactcactatagggcttctaaaatccactgagttttttcatctaaacagaggagatagatgatgaaactcagtaacctggcggcagcgcaaaagatg

SEQ ID NO: 125775 - DNA, 103 bp, Artificial Sequence
  Synthetic Polynucleotide
taatacgactcactataggggagggcggctcttcctccgcagaacccgggaacagaggagacccgggatgtgcggaggaaacctggcggcagcgcaaaagatg

SEQ ID NO: 125776 - DNA, 103 bp, Artificial Sequence
  Synthetic Polynucleotide
taatacgactcactataggggattcaatctcttctaaaatccactgagttaacagaggagaaactcaatggattttagaaacctggcggcagcgcaaaagatg

SEQ ID NO: 125777 - DNA, 103 bp, Artificial Sequence
  Synthetic Polynucleotide
taatacgactcactatagggtgtccttcgagattcaatctcttctaaaataacagaggagaattttaatggagattgaaaacctggcggcagcgcaaaagatg

SEQ ID NO: 125778 - DNA, 103 bp, Artificial Sequence
  Synthetic Polynucleotide
taatacgactcactataggggtcttctttttgtccttcgagattcaatctaacagaggagaagattgatgctcgaaggaaacctggcggcagcgcaaaagatg

SEQ ID NO: 125779 - DNA, 103 bp, Artificial Sequence
  Synthetic Polynucleotide
taatacgactcactatagggacccttgcttgtcttctttttgtccttcgaaacagaggagatcgaagatgaaaaagaagaacctggcggcagcgcaaaagatg

SEQ ID NO: 125780 - DNA, 103 bp, Artificial Sequence
  Synthetic Polynucleotide
taatacgactcactatagggcccagaaagcacccttgcttgtcttcttttaacagaggagaaaaagaatgcaagcaaggaacctggcggcagcgcaaaagatg

SEQ ID NO: 125781 - DNA, 103 bp, Artificial Sequence
  Synthetic Polynucleotide
taatacgactcactatagggggttacaattcccagaaagcacccttgcttaacagaggagaaagcaaatgtgctttctgaacctggcggcagcgcaaaagatg

SEQ ID NO: 125782 - DNA, 103 bp, Artificial Sequence
  Synthetic Polynucleotide
taatacgactcactatagggccttcctgatggttacaattcccagaaagcaacagaggagagctttcatggaattgtaaaacctggcggcagcgcaaaagatg

SEQ ID NO: 125783 - DNA, 103 bp, Artificial Sequence
  Synthetic Polynucleotide
taatacgactcactatagggactagatgttccttcctgatggttacaattaacagaggagaaattgtatgcatcaggaaaacctggcggcagcgcaaaagatg

SEQ ID NO: 125784 - DNA, 103 bp, Artificial Sequence
  Synthetic Polynucleotide
taatacgactcactataggggttcatcatcactagatgttccttcctgataacagaggagaatcaggatggaacatctaaacctggcggcagcgcaaaagatg

SEQ ID NO: 125785 - DNA, 103 bp, Artificial Sequence
  Synthetic Polynucleotide
taatacgactcactataggggctgaaggcagttcatcatcactagatgttaacagaggagaaacatcatgtgatgatgaaacctggcggcagcgcaaaagatg

SEQ ID NO: 125786 - DNA, 103 bp, Artificial Sequence
  Synthetic Polynucleotide
taatacgactcactataggggcctcctccagagggcggctcttcctccgcaacagaggagagcggagatggagccgcccaacctggcggcagcgcaaaagatg

SEQ ID NO: 125787 - DNA, 103 bp, Artificial Sequence
  Synthetic Polynucleotide
taatacgactcactatagggaatcatctctgctgaaggcagttcatcatcaacagaggagagatgatatgctgccttcaaacctggcggcagcgcaaaagatg

SEQ ID NO: 125788 - DNA, 103 bp, Artificial Sequence
  Synthetic Polynucleotide
taatacgactcactatagggtttggaagtcaatcatctctgctgaaggcaaacagaggagatgccttatgcagagatgaaacctggcggcagcgcaaaagatg

SEQ ID NO: 125789 - DNA, 103 bp, Artificial Sequence
  Synthetic Polynucleotide
taatacgactcactatagggccttggcttttttggaagtcaatcatctctaacagaggagaagagatatgtgacttccaaacctggcggcagcgcaaaagatg

SEQ ID NO: 125790 - DNA, 103 bp, Artificial Sequence
  Synthetic Polynucleotide
taatacgactcactatagggtaaaatgtcaccttggcttttttggaagtcaacagaggagagacttcatgaaaagccaaaacctggcggcagcgcaaaagatg

SEQ ID NO: 125791 - DNA, 103 bp, Artificial Sequence
  Synthetic Polynucleotide
taatacgactcactatagggtctgtttctgtaaaatgtcaccttggctttaacagaggagaaaagccatggtgacatttaacctggcggcagcgcaaaagatg

SEQ ID NO: 125792 - DNA, 103 bp, Artificial Sequence
  Synthetic Polynucleotide
taatacgactcactatagggaaaactttcttctgtttctgtaaaatgtcaaacagaggagatgacatatgacagaaacaaacctggcggcagcgcaaaagatg

SEQ ID NO: 125793 - DNA, 103 bp, Artificial Sequence
  Synthetic Polynucleotide
taatacgactcactatagggcacttcttcaaaaactttcttctgtttctgaacagaggagacagaaaatgaagaaagttaacctggcggcagcgcaaaagatg

SEQ ID NO: 125794 - DNA, 103 bp, Artificial Sequence
  Synthetic Polynucleotide
taatacgactcactatagggaatcatcttgcacttcttcaaaaactttctaacagaggagaagaaagatgttgaagaagaacctggcggcagcgcaaaagatg

SEQ ID NO: 125795 - DNA, 103 bp, Artificial Sequence
  Synthetic Polynucleotide
taatacgactcactatagggatgttacaaaaatcatcttgcacttcttcaaacagaggagatgaagaatggcaagatgaaacctggcggcagcgcaaaagatg

SEQ ID NO: 125796 - DNA, 103 bp, Artificial Sequence
  Synthetic Polynucleotide
taatacgactcactatagggaatattctggatgttacaaaaatcatcttgaacagaggagacaagatatgttttgtaacaacctggcggcagcgcaaaagatg

SEQ ID NO: 125797 - DNA, 103 bp, Artificial Sequence
  Synthetic Polynucleotide
taatacgactcactatagggcctgcgcgcggcctcctccagagggcggctaacagaggagaagccgcatgctggaggagaacctggcggcagcgcaaaagatg

SEQ ID NO: 125798 - DNA, 103 bp, Artificial Sequence
  Synthetic Polynucleotide
taatacgactcactatagggatttcaacaaaatattctggatgttacaaaaacagaggagatttgtaatgtccagaataaacctggcggcagcgcaaaagatg

SEQ ID NO: 125799 - DNA, 103 bp, Artificial Sequence
  Synthetic Polynucleotide
taatacgactcactatagggcattgctgaaatttcaacaaaatattctggaacagaggagaccagaaatgtttgttgaaaacctggcggcagcgcaaaagatg

SEQ ID NO: 125800 - DNA, 103 bp, Artificial Sequence
  Synthetic Polynucleotide
taatacgactcactatagggcttttctcgccattgctgaaatttcaacaaaacagaggagattgttgatgtttcagcaaaacctggcggcagcgcaaaagatg

SEQ ID NO: 125801 - DNA, 103 bp, Artificial Sequence
  Synthetic Polynucleotide
taatacgactcactatagggagtcaggaaacttttctcgccattgctgaaaacagaggagattcagcatgggcgagaaaaacctggcggcagcgcaaaagatg

SEQ ID NO: 125802 - DNA, 103 bp, Artificial Sequence
  Synthetic Polynucleotide
taatacgactcactatagggtcataataggagtcaggaaacttttctcgcaacagaggagagcgagaatggtttcctgaaacctggcggcagcgcaaaagatg

SEQ ID NO: 125803 - DNA, 103 bp, Artificial Sequence
  Synthetic Polynucleotide
taatacgactcactatagggaatgaaagcttcataataggagtcaggaaaaacagaggagatttcctatgtcctattataacctggcggcagcgcaaaagatg

SEQ ID NO: 125804 - DNA, 103 bp, Artificial Sequence
  Synthetic Polynucleotide
taatacgactcactatagggtgcataaactaatgaaagcttcataataggaacagaggagacctattatgaagctttcaaacctggcggcagcgcaaaagatg

SEQ ID NO: 125805 - DNA, 103 bp, Artificial Sequence
  Synthetic Polynucleotide
taatacgactcactatagggagctttggtatgcataaactaatgaaagctaacagaggagaagctttatgtagtttatgaacctggcggcagcgcaaaagatg

SEQ ID NO: 125806 - DNA, 103 bp, Artificial Sequence
  Synthetic Polynucleotide
taatacgactcactataggggggatttaaaagctttggtatgcataaactaacagaggagaagtttaatgataccaaagaacctggcggcagcgcaaaagatg

SEQ ID NO: 125807 - DNA, 103 bp, Artificial Sequence
  Synthetic Polynucleotide
taatacgactcactatagggctcgtattaggggatttaaaagctttggtaaacagaggagataccaaatgttttaaatcaacctggcggcagcgcaaaagatg

SEQ ID NO: 125808 - DNA, 103 bp, Artificial Sequence
  Synthetic Polynucleotide
taatacgactcactatagggagtcccgccacctgcgcgcggcctcctccaaacagaggagatggaggatgccgcgcgcaaacctggcggcagcgcaaaagatg

SEQ ID NO: 125809 - DNA, 103 bp, Artificial Sequence
  Synthetic Polynucleotide
taatacgactcactatagggatcaactgaactcgtattaggggatttaaaaacagaggagatttaaaatgcctaatacgaacctggcggcagcgcaaaagatg

SEQ ID NO: 125810 - DNA, 103 bp, Artificial Sequence
  Synthetic Polynucleotide
taatacgactcactatagggattccaatcaatcaactgaactcgtattagaacagaggagactaataatggttcagttgaacctggcggcagcgcaaaagatg

SEQ ID NO: 125811 - DNA, 103 bp, Artificial Sequence
  Synthetic Polynucleotide
taatacgactcactatagggacttaagaggattccaatcaatcaactgaaaacagaggagattcagtatgttgattggaaacctggcggcagcgcaaaagatg

SEQ ID NO: 125812 - DNA, 103 bp, Artificial Sequence
  Synthetic Polynucleotide
taatacgactcactataggggtggattccaacttaagaggattccaatcaaacagaggagatgattgatgtcctcttaaaacctggcggcagcgcaaaagatg

SEQ ID NO: 125813 - DNA, 103 bp, Artificial Sequence
  Synthetic Polynucleotide
taatacgactcactatagggttttaaacctgtggattccaacttaagaggaacagaggagacctcttatgttggaatccaacctggcggcagcgcaaaagatg

SEQ ID NO: 125814 - DNA, 103 bp, Artificial Sequence
  Synthetic Polynucleotide
taatacgactcactatagggatggcatctcttttaaacctgtggattccaaacagaggagatggaatatgcaggtttaaaacctggcggcagcgcaaaagatg

SEQ ID NO: 125815 - DNA, 103 bp, Artificial Sequence
  Synthetic Polynucleotide
taatacgactcactataggggatttgaaccatggcatctcttttaaacctaacagaggagaaggtttatgagagatgccaacctggcggcagcgcaaaagatg

SEQ ID NO: 125816 - DNA, 103 bp, Artificial Sequence
  Synthetic Polynucleotide
taatacgactcactatagggttcttctacagatttgaaccatggcatctcaacagaggagagagatgatgtggttcaaaaacctggcggcagcgcaaaagatg

SEQ ID NO: 125817 - DNA, 103 bp, Artificial Sequence
  Synthetic Polynucleotide
taatacgactcactatagggtatccataaattcttctacagatttgaaccaacagaggagaggttcaatgctgtagaagaacctggcggcagcgcaaaagatg

SEQ ID NO: 125818 - DNA, 103 bp, Artificial Sequence
  Synthetic Polynucleotide
taatacgactcactatagggtccacactgctatccataaattcttctacaaacagaggagatgtagaatgatttatggaaacctggcggcagcgcaaaagatg

SEQ ID NO: 125819 - DNA, 103 bp, Artificial Sequence
  Synthetic Polynucleotide
taatacgactcactatagggccggtggggcagtcccgccacctgcgcgcgaacagaggagacgcgcgatggtggcgggaaacctggcggcagcgcaaaagatg

SEQ ID NO: 125820 - DNA, 103 bp, Artificial Sequence
  Synthetic Polynucleotide
taatacgactcactatagggctttgaatcttccacactgctatccataaaaacagaggagatttatgatgagcagtgtgaacctggcggcagcgcaaaagatg

SEQ ID NO: 125821 - DNA, 103 bp, Artificial Sequence
  Synthetic Polynucleotide
taatacgactcactatagggtactttccttctttgaatcttccacactgcaacagaggagagcagtgatgaagattcaaaacctggcggcagcgcaaaagatg

SEQ ID NO: 125822 - DNA, 103 bp, Artificial Sequence
  Synthetic Polynucleotide
taatacgactcactatagggttatctgaactactttccttctttgaatctaacagaggagaagattcatggaaggaaagaacctggcggcagcgcaaaagatg

SEQ ID NO: 125823 - DNA, 103 bp, Artificial Sequence
  Synthetic Polynucleotide
taatacgactcactatagggcaagacttttttatctgaactactttccttaacagaggagaaaggaaatgagttcagataacctggcggcagcgcaaaagatg

SEQ ID NO: 125824 - DNA, 103 bp, Artificial Sequence
  Synthetic Polynucleotide
taatacgactcactatagggtgattgcagacaagacttttttatctgaacaacagaggagagttcagatgaaaaagtctaacctggcggcagcgcaaaagatg

SEQ ID NO: 125825 - DNA, 103 bp, Artificial Sequence
  Synthetic Polynucleotide
taatacgactcactataggggttttgttgatgattgcagacaagacttttaacagaggagaaaaagtatggtctgcaataacctggcggcagcgcaaaagatg

SEQ ID NO: 125826 - DNA, 103 bp, Artificial Sequence
  Synthetic Polynucleotide
taatacgactcactataggggggaataattgttttgttgatgattgcagaaacagaggagatctgcaatgatcaacaaaaacctggcggcagcgcaaaagatg

SEQ ID NO: 125827 - DNA, 103 bp, Artificial Sequence
  Synthetic Polynucleotide
taatacgactcactatagggctgtaagtcggggaataattgttttgttgaaacagaggagatcaacaatgcaattattcaacctggcggcagcgcaaaagatg

SEQ ID NO: 125828 - DNA, 103 bp, Artificial Sequence
  Synthetic Polynucleotide
taatacgactcactatagggtctacaaagtctgtaagtcggggaataattaacagaggagaaattatatgccgacttacaacctggcggcagcgcaaaagatg

SEQ ID NO: 125829 - DNA, 103 bp, Artificial Sequence
  Synthetic Polynucleotide
taatacgactcactatagggccaaaggaattctacaaagtctgtaagtcgaacagaggagacgacttatggactttgtaaacctggcggcagcgcaaaagatg

SEQ ID NO: 125830 - DNA, 103 bp, Artificial Sequence
  Synthetic Polynucleotide
taatacgactcactatagggggccccgaacccggtggggcagtcccgccaaacagaggagatggcggatgtgccccaccaacctggcggcagcgcaaaagatg

SEQ ID NO: 125831 - DNA, 103 bp, Artificial Sequence
  Synthetic Polynucleotide
taatacgactcactatagggacaaaggatcccaaaggaattctacaaagtaacagaggagaactttgatgaattcctttaacctggcggcagcgcaaaagatg

SEQ ID NO: 125832 - DNA, 103 bp, Artificial Sequence
  Synthetic Polynucleotide
taatacgactcactatagggtgtgaggttgacaaaggatcccaaaggaataacagaggagaattcctatgggatcctttaacctggcggcagcgcaaaagatg

SEQ ID NO: 125833 - DNA, 103 bp, Artificial Sequence
  Synthetic Polynucleotide
taatacgactcactatagggacttgttgtctgtgaggttgacaaaggatcaacagaggagagatcctatgtcaacctcaaacctggcggcagcgcaaaagatg

SEQ ID NO: 125834 - DNA, 103 bp, Artificial Sequence
  Synthetic Polynucleotide
taatacgactcactataggggtgttattaaacttgttgtctgtgaggttgaacagaggagacaacctatgagacaacaaaacctggcggcagcgcaaaagatg

SEQ ID NO: 125835 - DNA, 103 bp, Artificial Sequence
  Synthetic Polynucleotide
taatacgactcactatagggactctgcaatgtgttattaaacttgttgtcaacagaggagagacaacatgtttaataacaacctggcggcagcgcaaaagatg

SEQ ID NO: 125836 - DNA, 103 bp, Artificial Sequence
  Synthetic Polynucleotide
taatacgactcactatagggttcaagaatcactctgcaatgtgttattaaaacagaggagattaataatgcattgcagaaacctggcggcagcgcaaaagatg

SEQ ID NO: 125837 - DNA, 103 bp, Artificial Sequence
  Synthetic Polynucleotide
taatacgactcactatagggtggaatgttcttcaagaatcactctgcaataacagaggagaattgcaatgtgattcttgaacctggcggcagcgcaaaagatg

SEQ ID NO: 125838 - DNA, 103 bp, Artificial Sequence
  Synthetic Polynucleotide
taatacgactcactatagggttttcacaagtggaatgttcttcaagaatcaacagaggagagattctatgagaacattcaacctggcggcagcgcaaaagatg

SEQ ID NO: 125839 - DNA, 103 bp, Artificial Sequence
  Synthetic Polynucleotide
taatacgactcactatagggactaacttcattttcacaagtggaatgttcaacagaggagagaacatatgacttgtgaaaacctggcggcagcgcaaaagatg

SEQ ID NO: 125840 - DNA, 103 bp, Artificial Sequence
  Synthetic Polynucleotide
taatacgactcactataggggtctgcttttactaacttcattttcacaagaacagaggagacttgtgatgatgaagttaaacctggcggcagcgcaaaagatg

SEQ ID NO: 125841 - DNA, 103 bp, Artificial Sequence
  Synthetic Polynucleotide
taatacgactcactatagggcggccacgagggccccgaacccggtggggcaacagaggagagccccaatgggttcggggaacctggcggcagcgcaaaagatg

SEQ ID NO: 125842 - DNA, 103 bp, Artificial Sequence
  Synthetic Polynucleotide
taatacgactcactatagggagtaaatcctgtctgcttttactaacttcaaacagaggagatgaagtatgtaaaagcagaacctggcggcagcgcaaaagatg

SEQ ID NO: 125843 - DNA, 103 bp, Artificial Sequence
  Synthetic Polynucleotide
taatacgactcactatagggaatggatttaagtaaatcctgtctgcttttaacagaggagaaaaagcatgcaggatttaaacctggcggcagcgcaaaagatg

SEQ ID NO: 125844 - DNA, 103 bp, Artificial Sequence
  Synthetic Polynucleotide
taatacgactcactatagggttcttgaaacaatggatttaagtaaatcctaacagaggagaaggattatgttaaatccaaacctggcggcagcgcaaaagatg

SEQ ID NO: 125845 - DNA, 103 bp, Artificial Sequence
  Synthetic Polynucleotide
taatacgactcactataggggcctttttcattcttgaaacaatggatttaaacagaggagataaatcatgtgtttcaagaacctggcggcagcgcaaaagatg

SEQ ID NO: 125846 - DNA, 103 bp, Artificial Sequence
  Synthetic Polynucleotide
taatacgactcactatagggatcttctactgcctttttcattcttgaaacaacagaggagagtttcaatgatgaaaaagaacctggcggcagcgcaaaagatg

SEQ ID NO: 125847 - DNA, 103 bp, Artificial Sequence
  Synthetic Polynucleotide
taatacgactcactatagggtaaaaacatcatcttctactgcctttttcaaacagaggagatgaaaaatgcagtagaagaacctggcggcagcgcaaaagatg

SEQ ID NO: 125848 - DNA, 103 bp, Artificial Sequence
  Synthetic Polynucleotide
taatacgactcactatagggtacagaggaataaaaacatcatcttctactaacagaggagaagtagaatgtgatgttttaacctggcggcagcgcaaaagatg

SEQ ID NO: 125849 - DNA, 103 bp, Artificial Sequence
  Synthetic Polynucleotide
taatacgactcactatagggactctttggatacagaggaataaaaacatcaacagaggagagatgttatgattcctctgaacctggcggcagcgcaaaagatg

SEQ ID NO: 125850 - DNA, 103 bp, Artificial Sequence
  Synthetic Polynucleotide
taatacgactcactatagggtttctacagcactctttggatacagaggaaaacagaggagattcctcatgatccaaagaaacctggcggcagcgcaaaagatg

SEQ ID NO: 125851 - DNA, 103 bp, Artificial Sequence
  Synthetic Polynucleotide
taatacgactcactataggggatgttttgttttctacagcactctttggaaacagaggagatccaaaatgtgctgtagaaacctggcggcagcgcaaaagatg

SEQ ID NO: 125852 - DNA, 103 bp, Artificial Sequence
  Synthetic Polynucleotide
taatacgactcactataggggacccggccccggccacgagggccccgaacaacagaggagagttcggatgcctcgtggcaacctggcggcagcgcaaaagatg

SEQ ID NO: 125853 - DNA, 103 bp, Artificial Sequence
  Synthetic Polynucleotide
taatacgactcactatagggtgaatgaggtgatgttttgttttctacagcaacagaggagagctgtaatgaacaaaacaaacctggcggcagcgcaaaagatg

SEQ ID NO: 125854 - DNA, 103 bp, Artificial Sequence
  Synthetic Polynucleotide
taatacgactcactatagggcttggaactttgaatgaggtgatgttttgtaacagaggagaacaaaaatgcacctcattaacctggcggcagcgcaaaagatg

SEQ ID NO: 125855 - DNA, 103 bp, Artificial Sequence
  Synthetic Polynucleotide
taatacgactcactatagggaactgtctttcttggaactttgaatgaggtaacagaggagaacctcaatgaaagttccaaacctggcggcagcgcaaaagatg

SEQ ID NO: 125856 - DNA, 103 bp, Artificial Sequence
  Synthetic Polynucleotide
taatacgactcactataggggcctgaccagaactgtctttcttggaacttaacagaggagaaagttcatggaaagacagaacctggcggcagcgcaaaagatg

SEQ ID NO: 125857 - DNA, 103 bp, Artificial Sequence
  Synthetic Polynucleotide
taatacgactcactatagggagagctttaggcctgaccagaactgtctttaacagaggagaaaagacatgtctggtcagaacctggcggcagcgcaaaagatg

SEQ ID NO: 125858 - DNA, 103 bp, Artificial Sequence
  Synthetic Polynucleotide
taatacgactcactatagggatattgcggaagagctttaggcctgaccagaacagaggagactggtcatgcctaaagctaacctggcggcagcgcaaaagatg

SEQ ID NO: 125859 - DNA, 103 bp, Artificial Sequence
  Synthetic Polynucleotide
taatacgactcactatagggccaaagaagaatattgcggaagagctttagaacagaggagactaaagatgttccgcaataacctggcggcagcgcaaaagatg

SEQ ID NO: 125860 - DNA, 103 bp, Artificial Sequence
  Synthetic Polynucleotide
taatacgactcactatagggggagtccattccaaagaagaatattgcggaaacagaggagatccgcaatgttcttctttaacctggcggcagcgcaaaagatg

SEQ ID NO: 125861 - DNA, 103 bp, Artificial Sequence
  Synthetic Polynucleotide
taatacgactcactatagggtcatctgtaaggagtccattccaaagaagaaacagaggagatcttctatggaatggactaacctggcggcagcgcaaaagatg

SEQ ID NO: 125862 - DNA, 103 bp, Artificial Sequence
  Synthetic Polynucleotide
taatacgactcactatagggttgcaaggtgtcatctgtaaggagtccattaacagaggagaaatggaatgcttacagataacctggcggcagcgcaaaagatg

SEQ ID NO: 125863 - DNA, 103 bp, Artificial Sequence
  Synthetic Polynucleotide
taatacgactcactatagggccgcgcgctgccgaaaagtccttttcggccaacagaggagaggccgaatgggacttttcaacctggcggcagcgcaaaagatg

SEQ ID NO: 125864 - DNA, 103 bp, Artificial Sequence
  Synthetic Polynucleotide
taatacgactcactatagggagctcgcccagacccggccccggccacgagaacagaggagactcgtgatgggggccgggaacctggcggcagcgcaaaagatg

SEQ ID NO: 125865 - DNA, 103 bp, Artificial Sequence
  Synthetic Polynucleotide
taatacgactcactataggggtcctagttcttgcaaggtgtcatctgtaaaacagaggagattacagatgacaccttgcaacctggcggcagcgcaaaagatg

SEQ ID NO: 125866 - DNA, 103 bp, Artificial Sequence
  Synthetic Polynucleotide
taatacgactcactatagggagcttccctagtcctagttcttgcaaggtgaacagaggagacaccttatgagaactaggaacctggcggcagcgcaaaagatg

SEQ ID NO: 125867 - DNA, 103 bp, Artificial Sequence
  Synthetic Polynucleotide
taatacgactcactatagggacgatttagcagcttccctagtcctagttcaacagaggagagaactaatgctagggaagaacctggcggcagcgcaaaagatg

SEQ ID NO: 125868 - DNA, 103 bp, Artificial Sequence
  Synthetic Polynucleotide
taatacgactcactatagggtaataaggtaacgatttagcagcttccctaaacagaggagatagggaatgtgctaaatcaacctggcggcagcgcaaaagatg

SEQ ID NO: 125869 - DNA, 103 bp, Artificial Sequence
  Synthetic Polynucleotide
taatacgactcactatagggagaagtgctataataaggtaacgatttagcaacagaggagagctaaaatgttaccttataacctggcggcagcgcaaaagatg

SEQ ID NO: 125870 - DNA, 103 bp, Artificial Sequence
  Synthetic Polynucleotide
taatacgactcactatagggtgtggcattgagaagtgctataataaggtaaacagaggagataccttatgatagcacttaacctggcggcagcgcaaaagatg

SEQ ID NO: 125871 - DNA, 103 bp, Artificial Sequence
  Synthetic Polynucleotide
taatacgactcactatagggctggcccaggtgtggcattgagaagtgctaaacagaggagatagcacatgtcaatgccaaacctggcggcagcgcaaaagatg

SEQ ID NO: 125872 - DNA, 103 bp, Artificial Sequence
  Synthetic Polynucleotide
taatacgactcactatagggttaaccacatctggcccaggtgtggcattgaacagaggagacaatgcatgacctgggccaacctggcggcagcgcaaaagatg

SEQ ID NO: 125873 - DNA, 103 bp, Artificial Sequence
  Synthetic Polynucleotide
taatacgactcactataggggttgcactttttaaccacatctggcccaggaacagaggagacctgggatggatgtggttaacctggcggcagcgcaaaagatg

SEQ ID NO: 125874 - DNA, 103 bp, Artificial Sequence
  Synthetic Polynucleotide
taatacgactcactatagggctgctacctggttgcactttttaaccacataacagaggagaatgtggatgaaaagtgcaaacctggcggcagcgcaaaagatg

SEQ ID NO: 125875 - DNA, 103 bp, Artificial Sequence
  Synthetic Polynucleotide
taatacgactcactataggggcacgccgggagctcgcccagacccggcccaacagaggagagggccgatgctgggcgagaacctggcggcagcgcaaaagatg

SEQ ID NO: 125876 - DNA, 103 bp, Artificial Sequence
  Synthetic Polynucleotide
taatacgactcactatagggggtagacatgctgctacctggttgcactttaacagaggagaaaagtgatgccaggtagcaacctggcggcagcgcaaaagatg

SEQ ID NO: 125877 - DNA, 103 bp, Artificial Sequence
  Synthetic Polynucleotide
taatacgactcactatagggccatttttctggtagacatgctgctacctgaacagaggagacaggtaatggcatgtctaaacctggcggcagcgcaaaagatg

SEQ ID NO: 125878 - DNA, 103 bp, Artificial Sequence
  Synthetic Polynucleotide
taatacgactcactatagggaattttcaaaccatttttctggtagacatgaacagaggagacatgtcatgcagaaaaataacctggcggcagcgcaaaagatg

SEQ ID NO: 125879 - DNA, 103 bp, Artificial Sequence
  Synthetic Polynucleotide
taatacgactcactatagggctcatggcagaattttcaaaccatttttctaacagaggagaagaaaaatggtttgaaaaaacctggcggcagcgcaaaagatg

SEQ ID NO: 125880 - DNA, 103 bp, Artificial Sequence
  Synthetic Polynucleotide
taatacgactcactatagggaatagatgtcctcatggcagaattttcaaaaacagaggagatttgaaatgtctgccatgaacctggcggcagcgcaaaagatg

SEQ ID NO: 125881 - DNA, 103 bp, Artificial Sequence
  Synthetic Polynucleotide
taatacgactcactatagggctagctgtggaatagatgtcctcatggcagaacagaggagactgccaatgggacatctaaacctggcggcagcgcaaaagatg

SEQ ID NO: 125882 - DNA, 103 bp, Artificial Sequence
  Synthetic Polynucleotide
taatacgactcactatagggatgaagttttctagctgtggaatagatgtcaacagaggagagacatcatgtccacagctaacctggcggcagcgcaaaagatg

SEQ ID NO: 125883 - DNA, 103 bp, Artificial Sequence
  Synthetic Polynucleotide
taatacgactcactatagggtaaaaactgaatgaagttttctagctgtggaacagaggagaccacagatggaaaacttcaacctggcggcagcgcaaaagatg

SEQ ID NO: 125884 - DNA, 103 bp, Artificial Sequence
  Synthetic Polynucleotide
taatacgactcactatagggcagactgcaataaaaactgaatgaagttttaacagaggagaaaaactatgttcagttttaacctggcggcagcgcaaaagatg

SEQ ID NO: 125885 - DNA, 103 bp, Artificial Sequence
  Synthetic Polynucleotide
taatacgactcactatagggaatttatgtgcagactgcaataaaaactgaaacagaggagatcagttatgattgcagtcaacctggcggcagcgcaaaagatg

SEQ ID NO: 125886 - DNA, 103 bp, Artificial Sequence
  Synthetic Polynucleotide
taatacgactcactatagggcgctttggtggcacgccgggagctcgcccaaacagaggagatgggcgatgtcccggcgtaacctggcggcagcgcaaaagatg

SEQ ID NO: 125887 - DNA, 103 bp, Artificial Sequence
  Synthetic Polynucleotide
taatacgactcactatagggacttctagataatttatgtgcagactgcaaaacagaggagattgcagatggcacataaaaacctggcggcagcgcaaaagatg

SEQ ID NO: 125888 - DNA, 103 bp, Artificial Sequence
  Synthetic Polynucleotide
taatacgactcactatagggccctgaattcacttctagataatttatgtgaacagaggagacacataatgtatctagaaaacctggcggcagcgcaaaagatg

SEQ ID NO: 125889 - DNA, 103 bp, Artificial Sequence
  Synthetic Polynucleotide
taatacgactcactatagggtcgacttcatccctgaattcacttctagataacagaggagaatctagatgtgaattcagaacctggcggcagcgcaaaagatg

SEQ ID NO: 125890 - DNA, 103 bp, Artificial Sequence
  Synthetic Polynucleotide
taatacgactcactatagggaattatttcttcgacttcatccctgaattcaacagaggagagaattcatggatgaagtcaacctggcggcagcgcaaaagatg

SEQ ID NO: 125891 - DNA, 103 bp, Artificial Sequence
  Synthetic Polynucleotide
taatacgactcactatagggccaaaataagaattatttcttcgacttcataacagaggagaatgaagatgaagaaataaaacctggcggcagcgcaaaagatg

SEQ ID NO: 125892 - DNA, 103 bp, Artificial Sequence
  Synthetic Polynucleotide
taatacgactcactatagggtttattttcaccaaaataagaattatttctaacagaggagaagaaatatgtcttattttaacctggcggcagcgcaaaagatg

SEQ ID NO: 125893 - DNA, 103 bp, Artificial Sequence
  Synthetic Polynucleotide
taatacgactcactatagggattcaaagcttttattttcaccaaaataagaacagaggagacttattatggtgaaaataaacctggcggcagcgcaaaagatg

SEQ ID NO: 125894 - DNA, 103 bp, Artificial Sequence
  Synthetic Polynucleotide
taatacgactcactatagggattctgcttgattcaaagcttttattttcaaacagaggagatgaaaaatgaagctttgaaacctggcggcagcgcaaaagatg

SEQ ID NO: 125895 - DNA, 103 bp, Artificial Sequence
  Synthetic Polynucleotide
taatacgactcactatagggcctatgaaggattctgcttgattcaaagctaacagaggagaagctttatgtcaagcagaaacctggcggcagcgcaaaagatg

SEQ ID NO: 125896 - DNA, 103 bp, Artificial Sequence
  Synthetic Polynucleotide
taatacgactcactataggggtgatgctctcctatgaaggattctgcttgaacagaggagacaagcaatgtccttcataaacctggcggcagcgcaaaagatg

SEQ ID NO: 125897 - DNA, 103 bp, Artificial Sequence
  Synthetic Polynucleotide
taatacgactcactatagggcgcggggagccgctttggtggcacgccgggaacagaggagacccggcatgccaccaaagaacctggcggcagcgcaaaagatg

SEQ ID NO: 125898 - DNA, 103 bp, Artificial Sequence
  Synthetic Polynucleotide
taatacgactcactataggggatggtctaggtgatgctctcctatgaaggaacagaggagaccttcaatggagagcatcaacctggcggcagcgcaaaagatg

SEQ ID NO: 125899 - DNA, 103 bp, Artificial Sequence
  Synthetic Polynucleotide
taatacgactcactatagggagtgatttaagatggtctaggtgatgctctaacagaggagaagagcaatgcctagaccaaacctggcggcagcgcaaaagatg

SEQ ID NO: 125900 - DNA, 103 bp, Artificial Sequence
  Synthetic Polynucleotide
taatacgactcactatagggttctttaattagtgatttaagatggtctagaacagaggagactagacatgcttaaatcaaacctggcggcagcgcaaaagatg

SEQ ID NO: 125901 - DNA, 103 bp, Artificial Sequence
  Synthetic Polynucleotide
taatacgactcactatagggccttcgtccgcgcggggagccgctttggtgaacagaggagacaccaaatgggctccccgaacctggcggcagcgcaaaagatg

SEQ ID NO: 125902 - DNA, 103 bp, Artificial Sequence
  Synthetic Polynucleotide
taatacgactcactatagggggattctgagccttcgtccgcgcggggagcaacagaggagagctcccatggcggacgaaaacctggcggcagcgcaaaagatg

SEQ ID NO: 125903 - DNA, 103 bp, Artificial Sequence
  Synthetic Polynucleotide
taatacgactcactatagggcaagggttctggattctgagccttcgtccgaacagaggagacggacgatggctcagaataacctggcggcagcgcaaaagatg

SEQ ID NO: 125904 - DNA, 103 bp, Artificial Sequence
  Synthetic Polynucleotide
taatacgactcactataggggtggacacatcaagggttctggattctgagaacagaggagactcagaatgcagaaccctaacctggcggcagcgcaaaagatg

SEQ ID NO: 125905 - DNA, 103 bp, Artificial Sequence
  Synthetic Polynucleotide
taatacgactcactatagggctcttcatctgtggacacatcaagggttctaacagaggagaagaaccatggatgtgtccaacctggcggcagcgcaaaagatg

SEQ ID NO: 125906 - DNA, 103 bp, Artificial Sequence
  Synthetic Polynucleotide
taatacgactcactataggggtattttatcctcttcatctgtggacacataacagaggagaatgtgtatgcagatgaagaacctggcggcagcgcaaaagatg

SEQ ID NO: 125907 - DNA, 103 bp, Artificial Sequence
  Synthetic Polynucleotide
taatacgactcactatagggctggaatcagccgcgcgctgccgaaaagtcaacagaggagagactttatggcagcgcgcaacctggcggcagcgcaaaagatg

SEQ ID NO: 125908 - DNA, 103 bp, Artificial Sequence
  Synthetic Polynucleotide
taatacgactcactataggggaggagtgatgtattttatcctcttcatctaacagaggagaagatgaatgggataaaataacctggcggcagcgcaaaagatg

SEQ ID NO: 125909 - DNA, 103 bp, Artificial Sequence
  Synthetic Polynucleotide
taatacgactcactatagggcttactttctgaggagtgatgtattttatcaacagaggagagataaaatgcatcactccaacctggcggcagcgcaaaagatg

SEQ ID NO: 125910 - DNA, 103 bp, Artificial Sequence
  Synthetic Polynucleotide
taatacgactcactatagggcctgatcatccttactttctgaggagtgataacagaggagaatcactatgcagaaagtaaacctggcggcagcgcaaaagatg

SEQ ID NO: 125911 - DNA, 103 bp, Artificial Sequence
  Synthetic Polynucleotide
taatacgactcactataggggaagacaaaccctgatcatccttactttctaacagaggagaagaaagatgggatgatcaaacctggcggcagcgcaaaagatg

SEQ ID NO: 125912 - DNA, 103 bp, Artificial Sequence
  Synthetic Polynucleotide
taatacgactcactatagggagaactgtcagaagacaaaccctgatcatcaacagaggagagatgatatgggtttgtctaacctggcggcagcgcaaaagatg

SEQ ID NO: 125913 - DNA, 103 bp, Artificial Sequence
  Synthetic Polynucleotide
taatacgactcactatagggcaagagagctagaactgtcagaagacaaacaacagaggagagtttgtatgctgacagttaacctggcggcagcgcaaaagatg

SEQ ID NO: 125914 - DNA, 103 bp, Artificial Sequence
  Synthetic Polynucleotide
taatacgactcactatagggtctttttctccaagagagctagaactgtcaaacagaggagatgacagatgtagctctctaacctggcggcagcgcaaaagatg

SEQ ID NO: 125915 - DNA, 103 bp, Artificial Sequence
  Synthetic Polynucleotide
taatacgactcactatagggtgatgaaagttctttttctccaagagagctaacagaggagaagctctatgggagaaaaaaacctggcggcagcgcaaaagatg

SEQ ID NO: 125916 - DNA, 103 bp, Artificial Sequence
  Synthetic Polynucleotide
taatacgactcactatagggtcttaactgttgatgaaagttctttttctcaacagaggagagagaaaatgaactttcataacctggcggcagcgcaaaagatg

SEQ ID NO: 125917 - DNA, 103 bp, Artificial Sequence
  Synthetic Polynucleotide
taatacgactcactataggggcatctgggatcttaactgttgatgaaagtaacagaggagaactttcatgaacagttaaaacctggcggcagcgcaaaagatg

SEQ ID NO: 125918 - DNA, 103 bp, Artificial Sequence
  Synthetic Polynucleotide
taatacgactcactatagggatcgctgtcgctggaatcagccgcgcgctgaacagaggagacagcgcatggctgattccaacctggcggcagcgcaaaagatg

SEQ ID NO: 125919 - DNA, 103 bp, Artificial Sequence
  Synthetic Polynucleotide
taatacgactcactatagggaataaaagctgcatctgggatcttaactgtaacagaggagaacagttatgatcccagataacctggcggcagcgcaaaagatg

SEQ ID NO: 125920 - DNA, 103 bp, Artificial Sequence
  Synthetic Polynucleotide
taatacgactcactataggggggctgcctgaataaaagctgcatctgggaaacagaggagatcccagatgcagcttttaaacctggcggcagcgcaaaagatg

SEQ ID NO: 125921 - DNA, 103 bp, Artificial Sequence
  Synthetic Polynucleotide
taatacgactcactatagggcgttttctgcgggctgcctgaataaaagctaacagaggagaagctttatgtcaggcagcaacctggcggcagcgcaaaagatg

SEQ ID NO: 125922 - DNA, 103 bp, Artificial Sequence
  Synthetic Polynucleotide
taatacgactcactatagggggccaattcacgttttctgcgggctgcctgaacagaggagacaggcaatgcgcagaaaaaacctggcggcagcgcaaaagatg

SEQ ID NO: 125923 - DNA, 103 bp, Artificial Sequence
  Synthetic Polynucleotide
taatacgactcactatagggcttgggccctggccaattcacgttttctgcaacagaggagagcagaaatggtgaattggaacctggcggcagcgcaaaagatg

SEQ ID NO: 125924 - DNA, 103 bp, Artificial Sequence
  Synthetic Polynucleotide
taatacgactcactatagggatatagtcatcttgggccctggccaattcaaacagaggagatgaattatgcagggcccaaacctggcggcagcgcaaaagatg

SEQ ID NO: 125925 - DNA, 103 bp, Artificial Sequence
  Synthetic Polynucleotide
taatacgactcactatagggatccaaagaaatatagtcatcttgggccctaacagaggagaagggccatggatgactataacctggcggcagcgcaaaagatg

SEQ ID NO: 125926 - DNA, 103 bp, Artificial Sequence
  Synthetic Polynucleotide
taatacgactcactatagggtatgttgtacatccaaagaaatatagtcataacagaggagaatgactatgtttctttggaacctggcggcagcgcaaaagatg

SEQ ID NO: 125927 - DNA, 103 bp, Artificial Sequence
  Synthetic Polynucleotide
taatacgactcactatagggatggaggaggtatgttgtacatccaaagaaaacagaggagattctttatgtgtacaacaaacctggcggcagcgcaaaagatg

SEQ ID NO: 125928 - DNA, 103 bp, Artificial Sequence
  Synthetic Polynucleotide
taatacgactcactatagggcataccagagatggaggaggtatgttgtacaacagaggagagtacaaatgacctcctccaacctggcggcagcgcaaaagatg

SEQ ID NO: 125929 - DNA, 103 bp, Artificial Sequence
  Synthetic Polynucleotide
taatacgactcactatagggcctcggcgccatcgctgtcgctggaatcagaacagaggagactgattatggcgacagcgaacctggcggcagcgcaaaagatg

SEQ ID NO: 125930 - DNA, 103 bp, Artificial Sequence
  Synthetic Polynucleotide
taatacgactcactatagggtctctctcttcataccagagatggaggaggaacagaggagacctcctatgtctctggtaaacctggcggcagcgcaaaagatg

SEQ ID NO: 125931 - DNA, 103 bp, Artificial Sequence
  Synthetic Polynucleotide
taatacgactcactatagggtcatcttcgctctctctcttcataccagagaacagaggagactctggatggaagagagaaacctggcggcagcgcaaaagatg

SEQ ID NO: 125932 - DNA, 103 bp, Artificial Sequence
  Synthetic Polynucleotide
taatacgactcactatagggactctcagggtcatcttcgctctctctcttaacagaggagaaagagaatgagcgaagataacctggcggcagcgcaaaagatg

SEQ ID NO: 125933 - DNA, 103 bp, Artificial Sequence
  Synthetic Polynucleotide
taatacgactcactatagggcatcaggctcactctcagggtcatcttcgcaacagaggagagcgaagatgaccctgagaaacctggcggcagcgcaaaagatg

SEQ ID NO: 125934 - DNA, 103 bp, Artificial Sequence
  Synthetic Polynucleotide
taatacgactcactatagggttttcatggtcatcaggctcactctcagggaacagaggagaccctgaatgtgagcctgaaacctggcggcagcgcaaaagatg

SEQ ID NO: 125935 - DNA, 103 bp, Artificial Sequence
  Synthetic Polynucleotide
taatacgactcactatagggtggtattctcttttcatggtcatcaggctcaacagaggagagagcctatggaccatgaaaacctggcggcagcgcaaaagatg

SEQ ID NO: 125936 - DNA, 103 bp, Artificial Sequence
  Synthetic Polynucleotide
taatacgactcactatagggttagagtaaatggtattctcttttcatggtaacagaggagaaccatgatgagagaatacaacctggcggcagcgcaaaagatg

SEQ ID NO: 125937 - DNA, 103 bp, Artificial Sequence
  Synthetic Polynucleotide
taatacgactcactataggggtttgaggtcttagagtaaatggtattctcaacagaggagagagaatatgatttactctaacctggcggcagcgcaaaagatg

SEQ ID NO: 125938 - DNA, 103 bp, Artificial Sequence
  Synthetic Polynucleotide
taatacgactcactatagggttgtctaagtgtttgaggtcttagagtaaaaacagaggagatttactatgagacctcaaaacctggcggcagcgcaaaagatg

SEQ ID NO: 125939 - DNA, 103 bp, Artificial Sequence
  Synthetic Polynucleotide
taatacgactcactatagggcagccatcctttgtctaagtgtttgaggtcaacagaggagagacctcatgcacttagacaacctggcggcagcgcaaaagatg

SEQ ID NO: 125940 - DNA, 103 bp, Artificial Sequence
  Synthetic Polynucleotide
taatacgactcactataggggcaggcgactcctcggcgccatcgctgtcgaacagaggagacgacagatgtggcgccgaaacctggcggcagcgcaaaagatg

SEQ ID NO: 125941 - DNA, 103 bp, Artificial Sequence
  Synthetic Polynucleotide
taatacgactcactatagggattgattcctcagccatcctttgtctaagtaacagaggagaacttagatgaaggatggcaacctggcggcagcgcaaaagatg

SEQ ID NO: 125942 - DNA, 103 bp, Artificial Sequence
  Synthetic Polynucleotide
taatacgactcactatagggatttctgcttattgattcctcagccatcctaacagaggagaaggatgatggaggaatcaaacctggcggcagcgcaaaagatg

SEQ ID NO: 125943 - DNA, 103 bp, Artificial Sequence
  Synthetic Polynucleotide
taatacgactcactatagggttgtttcttcatttctgcttattgattcctaacagaggagaaggaatatgtaagcagaaaacctggcggcagcgcaaaagatg

SEQ ID NO: 125944 - DNA, 103 bp, Artificial Sequence
  Synthetic Polynucleotide
taatacgactcactatagggctttcttcacttgtttcttcatttctgcttaacagaggagaaagcagatgtgaagaaacaacctggcggcagcgcaaaagatg

SEQ ID NO: 125945 - DNA, 103 bp, Artificial Sequence
  Synthetic Polynucleotide
taatacgactcactatagggatcttcctgactttcttcacttgtttcttcaacagaggagagaagaaatgagtgaagaaaacctggcggcagcgcaaaagatg

SEQ ID NO: 125946 - DNA, 103 bp, Artificial Sequence
  Synthetic Polynucleotide
taatacgactcactatagggcttgcttttcatcttcctgactttcttcacaacagaggagagtgaagatggtcaggaagaacctggcggcagcgcaaaagatg

SEQ ID NO: 125947 - DNA, 103 bp, Artificial Sequence
  Synthetic Polynucleotide
taatacgactcactatagggtcccaagtatcttgcttttcatcttcctgaaacagaggagatcaggaatgtgaaaagcaaacctggcggcagcgcaaaagatg

SEQ ID NO: 125948 - DNA, 103 bp, Artificial Sequence
  Synthetic Polynucleotide
taatacgactcactatagggttgctgttgttcccaagtatcttgcttttcaacagaggagagaaaagatggatacttggaacctggcggcagcgcaaaagatg

SEQ ID NO: 125949 - DNA, 103 bp, Artificial Sequence
  Synthetic Polynucleotide
taatacgactcactatagggctttcctcatttgctgttgttcccaagtataacagaggagaatacttatgaacaacagcaacctggcggcagcgcaaaagatg

SEQ ID NO: 125950 - DNA, 103 bp, Artificial Sequence
  Synthetic Polynucleotide
taatacgactcactatagggattttaactgctttcctcatttgctgttgtaacagaggagaacaacaatgaatgaggaaaacctggcggcagcgcaaaagatg

SEQ ID NO: 125951 - DNA, 103 bp, Artificial Sequence
  Synthetic Polynucleotide
taatacgactcactatagggcccaggctcagcaggcgactcctcggcgccaacagaggagaggcgccatggagtcgcctaacctggcggcagcgcaaaagatg

SEQ ID NO: 125952 - DNA, 103 bp, Artificial Sequence
  Synthetic Polynucleotide
taatacgactcactatagggttcctctatgattttaactgctttcctcataacagaggagaatgaggatggcagttaaaaacctggcggcagcgcaaaagatg

SEQ ID NO: 125953 - DNA, 103 bp, Artificial Sequence
  Synthetic Polynucleotide
taatacgactcactatagggctatgtctctttcctctatgattttaactgaacagaggagacagttaatgtcatagaggaacctggcggcagcgcaaaagatg

SEQ ID NO: 125954 - DNA, 103 bp, Artificial Sequence
  Synthetic Polynucleotide
taatacgactcactatagggcaggaaagatctatgtctctttcctctatgaacagaggagacatagaatgaagagacataacctggcggcagcgcaaaagatg

SEQ ID NO: 125955 - DNA, 103 bp, Artificial Sequence
  Synthetic Polynucleotide
taatacgactcactatagggtccattgccacaggaaagatctatgtctctaacagaggagaagagacatggatctttccaacctggcggcagcgcaaaagatg

SEQ ID NO: 125956 - DNA, 103 bp, Artificial Sequence
  Synthetic Polynucleotide
taatacgactcactatagggcttttgaagatccattgccacaggaaagataacagaggagaatctttatggtggcaatgaacctggcggcagcgcaaaagatg

SEQ ID NO: 125957 - DNA, 103 bp, Artificial Sequence
  Synthetic Polynucleotide
taatacgactcactatagggaatttcttcacttttgaagatccattgccaaacagaggagatggcaaatgatcttcaaaaacctggcggcagcgcaaaagatg

SEQ ID NO: 125958 - DNA, 103 bp, Artificial Sequence
  Synthetic Polynucleotide
taatacgactcactatagggggaagtatcaaatttcttcacttttgaagaaacagaggagatcttcaatggtgaagaaaaacctggcggcagcgcaaaagatg

SEQ ID NO: 125959 - DNA, 103 bp, Artificial Sequence
  Synthetic Polynucleotide
taatacgactcactataggggaaatgaaatggaagtatcaaatttcttcaaacagaggagatgaagaatgttgatacttaacctggcggcagcgcaaaagatg

SEQ ID NO: 125960 - DNA, 103 bp, Artificial Sequence
  Synthetic Polynucleotide
taatacgactcactatagggtttactggcggaaatgaaatggaagtatcaaacagaggagatgatacatgcatttcattaacctggcggcagcgcaaaagatg

SEQ ID NO: 125961 - DNA, 103 bp, Artificial Sequence
  Synthetic Polynucleotide
taatacgactcactatagggaatttctaaatttactggcggaaatgaaataacagaggagaatttcaatgccgccagtaaacctggcggcagcgcaaaagatg

SEQ ID NO: 125962 - DNA, 103 bp, Artificial Sequence
  Synthetic Polynucleotide
taatacgactcactatagggccctcggcgccccaggctcagcaggcgactaacagaggagaagtcgcatgctgagcctgaacctggcggcagcgcaaaagatg

SEQ ID NO: 125963 - DNA, 103 bp, Artificial Sequence
  Synthetic Polynucleotide
taatacgactcactataggggcttctttataatttctaaatttactggcgaacagaggagacgccagatgatttagaaaaacctggcggcagcgcaaaagatg

SEQ ID NO: 125964 - DNA, 103 bp, Artificial Sequence
  Synthetic Polynucleotide
taatacgactcactataggggtatttaattgcttctttataatttctaaaaacagaggagatttagaatgtataaagaaaacctggcggcagcgcaaaagatg

SEQ ID NO: 125965 - DNA, 103 bp, Artificial Sequence
  Synthetic Polynucleotide
taatacgactcactatagggtgttaatctagtatttaattgcttctttataacagaggagaataaagatgcaattaaataacctggcggcagcgcaaaagatg

SEQ ID NO: 125966 - DNA, 103 bp, Artificial Sequence
  Synthetic Polynucleotide
taatacgactcactatagggcctgtagtaatgttaatctagtatttaattaacagaggagaaattaaatgctagattaaaacctggcggcagcgcaaaagatg

SEQ ID NO: 125967 - DNA, 103 bp, Artificial Sequence
  Synthetic Polynucleotide
taatacgactcactatagggcggtgagtttcctgtagtaatgttaatctaaacagaggagatagattatgattactacaaacctggcggcagcgcaaaagatg

SEQ ID NO: 125968 - DNA, 103 bp, Artificial Sequence
  Synthetic Polynucleotide
taatacgactcactatagggcaggtgtgagcggtgagtttcctgtagtaaaacagaggagattactaatggaaactcacaacctggcggcagcgcaaaagatg

SEQ ID NO: 125969 - DNA, 103 bp, Artificial Sequence
  Synthetic Polynucleotide
taatacgactcactatagggcatactccctcaggtgtgagcggtgagtttaacagaggagaaaactcatggctcacaccaacctggcggcagcgcaaaagatg

SEQ ID NO: 125970 - DNA, 103 bp, Artificial Sequence
  Synthetic Polynucleotide
taatacgactcactatagggacgtatttttcatactccctcaggtgtgagaacagaggagactcacaatggagggagtaaacctggcggcagcgcaaaagatg

SEQ ID NO: 125971 - DNA, 103 bp, Artificial Sequence
  Synthetic Polynucleotide
taatacgactcactataggggacatcttgtacgtatttttcatactccctaacagaggagaagggagatggaaaaatacaacctggcggcagcgcaaaagatg

SEQ ID NO: 125972 - DNA, 103 bp, Artificial Sequence
  Synthetic Polynucleotide
taatacgactcactatagggttgagcttttgacatcttgtacgtatttttaacagaggagaaaaaatatgtacaagatgaacctggcggcagcgcaaaagatg

SEQ ID NO: 125973 - DNA, 103 bp, Artificial Sequence
  Synthetic Polynucleotide
taatacgactcactatagggaccggaagttccctcggcgccccaggctcaaacagaggagatgagccatgggcgccgagaacctggcggcagcgcaaaagatg

SEQ ID NO: 125974 - DNA, 103 bp, Artificial Sequence
  Synthetic Polynucleotide
taatacgactcactatagggatggtactctttgagcttttgacatcttgtaacagaggagaacaagaatgcaaaagctcaacctggcggcagcgcaaaagatg

SEQ ID NO: 125975 - DNA, 103 bp, Artificial Sequence
  Synthetic Polynucleotide
taatacgactcactatagggtaggttctggatggtactctttgagcttttaacagaggagaaaaagcatgaagagtaccaacctggcggcagcgcaaaagatg

SEQ ID NO: 125976 - DNA, 103 bp, Artificial Sequence
  Synthetic Polynucleotide
taatacgactcactatagggatgaactctctaggttctggatggtactctaacagaggagaagagtaatgtccagaaccaacctggcggcagcgcaaaagatg

SEQ ID NO: 125977 - DNA, 103 bp, Artificial Sequence
  Synthetic Polynucleotide
taatacgactcactataggggcttgatttgatgaactctctaggttctggaacagaggagaccagaaatgagagagttcaacctggcggcagcgcaaaagatg

SEQ ID NO: 125978 - DNA, 103 bp, Artificial Sequence
  Synthetic Polynucleotide
taatacgactcactatagggacaatttagagcttgatttgatgaactctcaacagaggagagagagtatgtcaaatcaaaacctggcggcagcgcaaaagatg

SEQ ID NO: 125979 - DNA, 103 bp, Artificial Sequence
  Synthetic Polynucleotide
taatacgactcactatagggtatagaatttacaatttagagcttgatttgaacagaggagacaaatcatgctctaaattaacctggcggcagcgcaaaagatg

SEQ ID NO: 125980 - DNA, 103 bp, Artificial Sequence
  Synthetic Polynucleotide
taatacgactcactatagggttcatgcttttatagaatttacaatttagaaacagaggagatctaaaatgtaaattctaaacctggcggcagcgcaaaagatg

SEQ ID NO: 125981 - DNA, 103 bp, Artificial Sequence
  Synthetic Polynucleotide
taatacgactcactatagggcacataaattttcatgcttttatagaatttaacagaggagaaaattcatgaaaagcatgaacctggcggcagcgcaaaagatg

SEQ ID NO: 125982 - DNA, 103 bp, Artificial Sequence
  Synthetic Polynucleotide
taatacgactcactatagggttaaattttccacataaattttcatgctttaacagaggagaaaagcaatgaaatttatgaacctggcggcagcgcaaaagatg

SEQ ID NO: 125983 - DNA, 103 bp, Artificial Sequence
  Synthetic Polynucleotide
taatacgactcactatagggaggcagtcaattaaattttccacataaattaacagaggagaaatttaatgggaaaatttaacctggcggcagcgcaaaagatg

SEQ ID NO: 125984 - DNA, 103 bp, Artificial Sequence
  Synthetic Polynucleotide
taatacgactcactataggggtcttcagaatcaaagtcgtcaggttccataacagaggagaatggaaatggacgactttaacctggcggcagcgcaaaagatg

SEQ ID NO: 125985 - DNA, 103 bp, Artificial Sequence
  Synthetic Polynucleotide
taatacgactcactatagggataggaatctggccactcctggaaccagtcaacagaggagagactggatgcaggagtggaacctggcggcagcgcaaaagatg

SEQ ID NO: 125986 - DNA, 103 bp, Artificial Sequence
  Synthetic Polynucleotide
taatacgactcactatagggctgctggtaaaagggttctgaagagttttgaacagaggagacaaaacatgtcagaacccaacctggcggcagcgcaaaagatg

SEQ ID NO: 125987 - DNA, 103 bp, Artificial Sequence
  Synthetic Polynucleotide
taatacgactcactatagggccaatggaagctgctggtaaaagggttctgaacagaggagacagaacatgtttaccagcaacctggcggcagcgcaaaagatg

SEQ ID NO: 125988 - DNA, 103 bp, Artificial Sequence
  Synthetic Polynucleotide
taatacgactcactataggggcaggtggctccaatggaagctgctggtaaaacagaggagattaccaatggcttccattaacctggcggcagcgcaaaagatg

SEQ ID NO: 125989 - DNA, 103 bp, Artificial Sequence
  Synthetic Polynucleotide
taatacgactcactatagggagttttggctgcaggtggctccaatggaagaacagaggagacttccaatggagccacctaacctggcggcagcgcaaaagatg

SEQ ID NO: 125990 - DNA, 103 bp, Artificial Sequence
  Synthetic Polynucleotide
taatacgactcactatagggggggacagccagttttggctgcaggtggctaacagaggagaagccacatgcagccaaaaaacctggcggcagcgcaaaagatg

SEQ ID NO: 125991 - DNA, 103 bp, Artificial Sequence
  Synthetic Polynucleotide
taatacgactcactatagggggccataatgggggacagccagttttggctaacagaggagaagccaaatgtggctgtccaacctggcggcagcgcaaaagatg

SEQ ID NO: 125992 - DNA, 103 bp, Artificial Sequence
  Synthetic Polynucleotide
taatacgactcactatagggcgctggatttggccataatgggggacagccaacagaggagaggctgtatgccattatggaacctggcggcagcgcaaaagatg

SEQ ID NO: 125993 - DNA, 103 bp, Artificial Sequence
  Synthetic Polynucleotide
taatacgactcactatagggaaagattacccgctggatttggccataatgaacagaggagacattatatgcaaatccagaacctggcggcagcgcaaaagatg

SEQ ID NO: 125994 - DNA, 103 bp, Artificial Sequence
  Synthetic Polynucleotide
taatacgactcactatagggttctcttcataaagattacccgctggatttaacagaggagaaaatccatggggtaatctaacctggcggcagcgcaaaagatg

SEQ ID NO: 125995 - DNA, 103 bp, Artificial Sequence
  Synthetic Polynucleotide
taatacgactcactatagggcacatgtactttctcttcataaagattaccaacagaggagaggtaatatgtatgaagagaacctggcggcagcgcaaaagatg

SEQ ID NO: 125996 - DNA, 103 bp, Artificial Sequence
  Synthetic Polynucleotide
taatacgactcactatagggtgtgtttggcataggaatctggccactcctaacagaggagaaggagtatgcagattcctaacctggcggcagcgcaaaagatg

SEQ ID NO: 125997 - DNA, 103 bp, Artificial Sequence
  Synthetic Polynucleotide
taatacgactcactatagggtgttaaaatccacatgtactttctcttcataacagaggagaatgaagatgaagtacatgaacctggcggcagcgcaaaagatg

SEQ ID NO: 125998 - DNA, 103 bp, Artificial Sequence
  Synthetic Polynucleotide
taatacgactcactatagggtggacgtagctgttaaaatccacatgtactaacagaggagaagtacaatgggattttaaaacctggcggcagcgcaaaagatg

SEQ ID NO: 125999 - DNA, 103 bp, Artificial Sequence
  Synthetic Polynucleotide
taatacgactcactatagggtgcaggagactggacgtagctgttaaaatcaacagaggagagattttatgagctacgtcaacctggcggcagcgcaaaagatg

SEQ ID NO: 126000 - DNA, 103 bp, Artificial Sequence
  Synthetic Polynucleotide
taatacgactcactataggggtgaatggtatgcaggagactggacgtagcaacagaggagagctacgatgagtctcctgaacctggcggcagcgcaaaagatg

SEQ ID NO: 126001 - DNA, 103 bp, Artificial Sequence
  Synthetic Polynucleotide
taatacgactcactatagggtcttcttgaggtgaatggtatgcaggagacaacagaggagagtctccatgataccattcaacctggcggcagcgcaaaagatg

SEQ ID NO: 126002 - DNA, 103 bp, Artificial Sequence
  Synthetic Polynucleotide
taatacgactcactataggggagaaaggggtcttcttgaggtgaatggtaaacagaggagataccatatgcctcaagaaaacctggcggcagcgcaaaagatg

SEQ ID NO: 126003 - DNA, 103 bp, Artificial Sequence
  Synthetic Polynucleotide
taatacgactcactatagggcgtaggtgaagagaaaggggtcttcttgagaacagaggagactcaagatgacccctttcaacctggcggcagcgcaaaagatg

SEQ ID NO: 126004 - DNA, 103 bp, Artificial Sequence
  Synthetic Polynucleotide
taatacgactcactatagggggatgagaggcgtaggtgaagagaaaggggaacagaggagaccccttatgcttcacctaaacctggcggcagcgcaaaagatg

SEQ ID NO: 126005 - DNA, 103 bp, Artificial Sequence
  Synthetic Polynucleotide
taatacgactcactatagggttgctgatgaggatgagaggcgtaggtgaaaacagaggagattcaccatggcctctcataacctggcggcagcgcaaaagatg

SEQ ID NO: 126006 - DNA, 103 bp, Artificial Sequence
  Synthetic Polynucleotide
taatacgactcactataggggcagtgaatattgctgatgaggatgagaggaacagaggagacctctcatgctcatcagcaacctggcggcagcgcaaaagatg

SEQ ID NO: 126007 - DNA, 103 bp, Artificial Sequence
  Synthetic Polynucleotide
taatacgactcactataggggagctgtagatgtgtttggcataggaatctaacagaggagaagattcatgtgccaaacaaacctggcggcagcgcaaaagatg

SEQ ID NO: 126008 - DNA, 103 bp, Artificial Sequence
  Synthetic Polynucleotide
taatacgactcactatagggctcttgcttggcagtgaatattgctgatgaaacagaggagatcatcaatgatattcactaacctggcggcagcgcaaaagatg

SEQ ID NO: 126009 - DNA, 103 bp, Artificial Sequence
  Synthetic Polynucleotide
taatacgactcactatagggccatttgctgctcttgcttggcagtgaataaacagaggagatattcaatgccaagcaagaacctggcggcagcgcaaaagatg

SEQ ID NO: 126010 - DNA, 103 bp, Artificial Sequence
  Synthetic Polynucleotide
taatacgactcactatagggcctcaaaatcccatttgctgctcttgcttgaacagaggagacaagcaatggcagcaaataacctggcggcagcgcaaaagatg

SEQ ID NO: 126011 - DNA, 103 bp, Artificial Sequence
  Synthetic Polynucleotide
taatacgactcactataggggtcatttcttcctcaaaatcccatttgctgaacagaggagacagcaaatgggattttgaaacctggcggcagcgcaaaagatg

SEQ ID NO: 126012 - DNA, 103 bp, Artificial Sequence
  Synthetic Polynucleotide
taatacgactcactatagggacccaagtatgtcatttcttcctcaaaatcaacagaggagagattttatggaagaaatgaacctggcggcagcgcaaaagatg

SEQ ID NO: 126013 - DNA, 103 bp, Artificial Sequence
  Synthetic Polynucleotide
taatacgactcactatagggagtgatccaaacccaagtatgtcatttcttaacagaggagaaagaaaatgcatacttggaacctggcggcagcgcaaaagatg

SEQ ID NO: 126014 - DNA, 103 bp, Artificial Sequence
  Synthetic Polynucleotide
taatacgactcactatagggtcattgttgcagtgatccaaacccaagtataacagaggagaatacttatgtttggatcaaacctggcggcagcgcaaaagatg

SEQ ID NO: 126015 - DNA, 103 bp, Artificial Sequence
  Synthetic Polynucleotide
taatacgactcactatagggcagaagcatatcattgttgcagtgatccaaaacagaggagattggatatgtgcaacaataacctggcggcagcgcaaaagatg

SEQ ID NO: 126016 - DNA, 103 bp, Artificial Sequence
  Synthetic Polynucleotide
taatacgactcactataggggacacaggttcagaagcatatcattgttgcaacagaggagagcaacaatgatatgcttcaacctggcggcagcgcaaaagatg

SEQ ID NO: 126017 - DNA, 103 bp, Artificial Sequence
  Synthetic Polynucleotide
taatacgactcactatagggcatctcaaaggacacaggttcagaagcataaacagaggagatatgctatggaacctgtgaacctggcggcagcgcaaaagatg

SEQ ID NO: 126018 - DNA, 103 bp, Artificial Sequence
  Synthetic Polynucleotide
taatacgactcactatagggcttgtcctccgagctgtagatgtgtttggcaacagaggagagccaaaatgatctacagcaacctggcggcagcgcaaaagatg

SEQ ID NO: 126019 - DNA, 103 bp, Artificial Sequence
  Synthetic Polynucleotide
taatacgactcactataggggctgcgcattcttgtcctccgagctgtagaaacagaggagatctacaatgcggaggacaaacctggcggcagcgcaaaagatg

SEQ ID NO: 126020 - DNA, 103 bp, Artificial Sequence
  Synthetic Polynucleotide
taatacgactcactatagggctcaggtgccgctgcgcattcttgtcctccaacagaggagaggaggaatggaatgcgcaaacctggcggcagcgcaaaagatg

SEQ ID NO: 126021 - DNA, 103 bp, Artificial Sequence
  Synthetic Polynucleotide
taatacgactcactatagggggcccagctgctcaggtgccgctgcgcattaacagaggagaaatgcgatgcggcacctgaacctggcggcagcgcaaaagatg

SEQ ID NO: 126022 - DNA, 103 bp, Artificial Sequence
  Synthetic Polynucleotide
taatacgactcactatagggtattgcgcatggcccagctgctcaggtgccaacagaggagaggcaccatggcagctgggaacctggcggcagcgcaaaagatg

SEQ ID NO: 126023 - DNA, 103 bp, Artificial Sequence
  Synthetic Polynucleotide
taatacgactcactatagggtggttgttggtattgcgcatggcccagctgaacagaggagacagctgatgcatgcgcaaaacctggcggcagcgcaaaagatg

SEQ ID NO: 126024 - DNA, 103 bp, Artificial Sequence
  Synthetic Polynucleotide
taatacgactcactataggggcgggagttgtggttgttggtattgcgcataacagaggagaatgcgcatgaccaacaacaacctggcggcagcgcaaaagatg

SEQ ID NO: 126025 - DNA, 103 bp, Artificial Sequence
  Synthetic Polynucleotide
taatacgactcactatagggatatctctttgtcttcagaatcaaagtcgtaacagaggagaacgactatgattctgaagaacctggcggcagcgcaaaagatg

SEQ ID NO: 126026 - DNA, 103 bp, Artificial Sequence
  Synthetic Polynucleotide
taatacgactcactatagggtcttgaggatgcgggagttgtggttgttggaacagaggagaccaacaatgacaactcccaacctggcggcagcgcaaaagatg

SEQ ID NO: 126027 - DNA, 103 bp, Artificial Sequence
  Synthetic Polynucleotide
taatacgactcactatagggaggcaggacttcttgaggatgcgggagttgaacagaggagacaactcatgcatcctcaaaacctggcggcagcgcaaaagatg

SEQ ID NO: 126028 - DNA, 103 bp, Artificial Sequence
  Synthetic Polynucleotide
taatacgactcactatagggcaccacacccaggcaggacttcttgaggataacagaggagaatcctcatgaagtcctgcaacctggcggcagcgcaaaagatg

SEQ ID NO: 126029 - DNA, 103 bp, Artificial Sequence
  Synthetic Polynucleotide
taatacgactcactatagggggccgcacaccaccacacccaggcaggactaacagaggagaagtcctatgtgggtgtggaacctggcggcagcgcaaaagatg

SEQ ID NO: 126030 - DNA, 103 bp, Artificial Sequence
  Synthetic Polynucleotide
taatacgactcactatagggagacagtcgcggccgcacaccaccacacccaacagaggagagggtgtatgggtgtgcggaacctggcggcagcgcaaaagatg

SEQ ID NO: 126031 - DNA, 103 bp, Artificial Sequence
  Synthetic Polynucleotide
taatacgactcactatagggctcctctgcgagacagtcgcggccgcacacaacagaggagagtgtgcatgcgcgactgtaacctggcggcagcgcaaaagatg

SEQ ID NO: 126032 - DNA, 103 bp, Artificial Sequence
  Synthetic Polynucleotide
taatacgactcactatagggtcttgcgcccctcctctgcgagacagtcgcaacagaggagagcgactatgtcgcagaggaacctggcggcagcgcaaaagatg

SEQ ID NO: 126033 - DNA, 103 bp, Artificial Sequence
  Synthetic Polynucleotide
taatacgactcactatagggctcaggtagatcttgcgcccctcctctgcgaacagaggagacgcagaatgggggcgcaaaacctggcggcagcgcaaaagatg

SEQ ID NO: 126034 - DNA, 103 bp, Artificial Sequence
  Synthetic Polynucleotide
taatacgactcactataggggatggcaggtctcaggtagatcttgcgcccaacagaggagagggcgcatgatctacctgaacctggcggcagcgcaaaagatg

SEQ ID NO: 126035 - DNA, 103 bp, Artificial Sequence
  Synthetic Polynucleotide
taatacgactcactatagggccttgtcacagatggcaggtctcaggtagaaacagaggagatctaccatggacctgccaaacctggcggcagcgcaaaagatg

SEQ ID NO: 126036 - DNA, 103 bp, Artificial Sequence
  Synthetic Polynucleotide
taatacgactcactatagggtcccagcttaatatctctttgtcttcagaaaacagaggagattctgaatgcaaagagataacctggcggcagcgcaaaagatg

SEQ ID NO: 126037 - DNA, 103 bp, Artificial Sequence
  Synthetic Polynucleotide
taatacgactcactatagggttctgccgggccttgtcacagatggcaggtaacagaggagaacctgcatgctgtgacaaaacctggcggcagcgcaaaagatg

SEQ ID NO: 126038 - DNA, 103 bp, Artificial Sequence
  Synthetic Polynucleotide
taatacgactcactatagggccgctgctgcttctgccgggccttgtcacaaacagaggagatgtgacatggcccggcagaacctggcggcagcgcaaaagatg

SEQ ID NO: 126039 - DNA, 103 bp, Artificial Sequence
  Synthetic Polynucleotide
taatacgactcactataggggacagcgtttccgctgctgcttctgccgggaacagaggagacccggcatgagcagcagcaacctggcggcagcgcaaaagatg

SEQ ID NO: 126040 - DNA, 103 bp, Artificial Sequence
  Synthetic Polynucleotide
taatacgactcactatagggtcacagttgggacagcgtttccgctgctgcaacagaggagagcagcaatggaaacgctgaacctggcggcagcgcaaaagatg

SEQ ID NO: 126041 - DNA, 103 bp, Artificial Sequence
  Synthetic Polynucleotide
taatacgactcactatagggcagaggcccgtcacagttgggacagcgtttaacagaggagaaaacgcatgcccaactgtaacctggcggcagcgcaaaagatg

SEQ ID NO: 126042 - DNA, 103 bp, Artificial Sequence
  Synthetic Polynucleotide
taatacgactcactatagggggatgagcttcagaggcccgtcacagttggaacagaggagaccaactatgacgggcctcaacctggcggcagcgcaaaagatg

SEQ ID NO: 126043 - DNA, 103 bp, Artificial Sequence
  Synthetic Polynucleotide
taatacgactcactatagggcctcggcaagggatgagcttcagaggcccgaacagaggagacgggccatggaagctcataacctggcggcagcgcaaaagatg

SEQ ID NO: 126044 - DNA, 103 bp, Artificial Sequence
  Synthetic Polynucleotide
taatacgactcactataggggcccccatgacctcggcaagggatgagcttaacagaggagaaagctcatgccttgccgaaacctggcggcagcgcaaaagatg

SEQ ID NO: 126045 - DNA, 103 bp, Artificial Sequence
  Synthetic Polynucleotide
taatacgactcactatagggtgaccgggaagcccccatgacctcggcaagaacagaggagacttgccatggtcatggggaacctggcggcagcgcaaaagatg

SEQ ID NO: 126046 - DNA, 103 bp, Artificial Sequence
  Synthetic Polynucleotide
taatacgactcactatagggcagaagttggtgaccgggaagcccccatgaaacagaggagatcatggatgcttcccggtaacctggcggcagcgcaaaagatg

SEQ ID NO: 126047 - DNA, 103 bp, Artificial Sequence
  Synthetic Polynucleotide
taatacgactcactatagggatcattaatatcccagcttaatatctctttaacagaggagaaaagagatgttaagctggaacctggcggcagcgcaaaagatg

SEQ ID NO: 126048 - DNA, 103 bp, Artificial Sequence
  Synthetic Polynucleotide
taatacgactcactataggggtcgtgcctccagaagttggtgaccgggaaaacagaggagattcccgatgaccaacttcaacctggcggcagcgcaaaagatg

SEQ ID NO: 126049 - DNA, 103 bp, Artificial Sequence
  Synthetic Polynucleotide
taatacgactcactatagggtaaagcgtccgtcgtgcctccagaagttggaacagaggagaccaactatgggaggcacgaacctggcggcagcgcaaaagatg

SEQ ID NO: 126050 - DNA, 103 bp, Artificial Sequence
  Synthetic Polynucleotide
taatacgactcactatagggtggaaaaatataaagcgtccgtcgtgcctcaacagaggagagaggcaatgcggacgcttaacctggcggcagcgcaaaagatg

SEQ ID NO: 126051 - DNA, 103 bp, Artificial Sequence
  Synthetic Polynucleotide
taatacgactcactatagggtccctttgactggaaaaatataaagcgtccaacagaggagaggacgcatgatatttttcaacctggcggcagcgcaaaagatg

SEQ ID NO: 126052 - DNA, 103 bp, Artificial Sequence
  Synthetic Polynucleotide
taatacgactcactataggggatcatgctctccctttgactggaaaaataaacagaggagatattttatgagtcaaaggaacctggcggcagcgcaaaagatg

SEQ ID NO: 126053 - DNA, 103 bp, Artificial Sequence
  Synthetic Polynucleotide
taatacgactcactatagggggttttggatgatcatgctctccctttgacaacagaggagagtcaaaatgagagcatgaaacctggcggcagcgcaaaagatg

SEQ ID NO: 126054 - DNA, 103 bp, Artificial Sequence
  Synthetic Polynucleotide
taatacgactcactatagggcttggtttctggttttggatgatcatgctcaacagaggagagagcatatgcatccaaaaaacctggcggcagcgcaaaagatg

SEQ ID NO: 126055 - DNA, 103 bp, Artificial Sequence
  Synthetic Polynucleotide
taatacgactcactatagggcagcttctaacttggtttctggttttggataacagaggagaatccaaatgcagaaaccaaacctggcggcagcgcaaaagatg

SEQ ID NO: 126056 - DNA, 103 bp, Artificial Sequence
  Synthetic Polynucleotide
taatacgactcactatagggcttcttgcctcagcttctaacttggtttctaacagaggagaagaaacatggttagaagcaacctggcggcagcgcaaaagatg

SEQ ID NO: 126057 - DNA, 103 bp, Artificial Sequence
  Synthetic Polynucleotide
taatacgactcactatagggcttcatggctcttcttgcctcagcttctaaaacagaggagattagaaatggaggcaagaaacctggcggcagcgcaaaagatg

SEQ ID NO: 126058 - DNA, 103 bp, Artificial Sequence
  Synthetic Polynucleotide
taatacgactcactataggggcagtttcacatcattaatatcccagcttaaacagaggagataagctatgatattaatgaacctggcggcagcgcaaaagatg

SEQ ID NO: 126059 - DNA, 103 bp, Artificial Sequence
  Synthetic Polynucleotide
taatacgactcactatagggtgttcactttcttcatggctcttcttgcctaacagaggagaaggcaaatggagccatgaaacctggcggcagcgcaaaagatg

SEQ ID NO: 126060 - DNA, 103 bp, Artificial Sequence
  Synthetic Polynucleotide
taatacgactcactataggggaaggtgctgtgttcactttcttcatggctaacagaggagaagccatatggaaagtgaaaacctggcggcagcgcaaaagatg

SEQ ID NO: 126061 - DNA, 103 bp, Artificial Sequence
  Synthetic Polynucleotide
taatacgactcactatagggtgagacggaggaaggtgctgtgttcactttaacagaggagaaaagtgatgacagcacctaacctggcggcagcgcaaaagatg

SEQ ID NO: 126062 - DNA, 103 bp, Artificial Sequence
  Synthetic Polynucleotide
taatacgactcactatagggtcaggctcaatgagacggaggaaggtgctgaacagaggagacagcacatgcctccgtctaacctggcggcagcgcaaaagatg

SEQ ID NO: 126063 - DNA, 103 bp, Artificial Sequence
  Synthetic Polynucleotide
taatacgactcactataggggtgctccccttcaggctcaatgagacggagaacagaggagactccgtatgattgagcctaacctggcggcagcgcaaaagatg

SEQ ID NO: 126064 - DNA, 103 bp, Artificial Sequence
  Synthetic Polynucleotide
taatacgactcactatagggcctggtctctgtgctccccttcaggctcaaaacagaggagattgagcatgaaggggagcaacctggcggcagcgcaaaagatg

SEQ ID NO: 126065 - DNA, 103 bp, Artificial Sequence
  Synthetic Polynucleotide
taatacgactcactatagggctggaagagacctggtctctgtgctcccctaacagaggagaaggggaatgcagagaccaaacctggcggcagcgcaaaagatg

SEQ ID NO: 126066 - DNA, 103 bp, Artificial Sequence
  Synthetic Polynucleotide
taatacgactcactatagggtgtgtttcacctggaagagacctggtctctaacagaggagaagagacatggtctcttccaacctggcggcagcgcaaaagatg

SEQ ID NO: 126067 - DNA, 103 bp, Artificial Sequence
  Synthetic Polynucleotide
taatacgactcactatagggcccctgactttgtgtttcacctggaagagaaacagaggagatctcttatgggtgaaacaaacctggcggcagcgcaaaagatg

SEQ ID NO: 126068 - DNA, 103 bp, Artificial Sequence
  Synthetic Polynucleotide
taatacgactcactatagggaaggtaaactcccctgactttgtgtttcacaacagaggagagtgaaaatgaaagtcaggaacctggcggcagcgcaaaagatg

SEQ ID NO: 126069 - DNA, 103 bp, Artificial Sequence
  Synthetic Polynucleotide
taatacgactcactatagggacgttctgtggcagtttcacatcattaataaacagaggagatattaaatgtgtgaaactaacctggcggcagcgcaaaagatg

SEQ ID NO: 126070 - DNA, 103 bp, Artificial Sequence
  Synthetic Polynucleotide
taatacgactcactataggggaccaagttaaaggtaaactcccctgacttaacagaggagaaagtcaatggagtttaccaacctggcggcagcgcaaaagatg

SEQ ID NO: 126071 - DNA, 103 bp, Artificial Sequence
  Synthetic Polynucleotide
taatacgactcactatagggttcctggaaagaccaagttaaaggtaaactaacagaggagaagtttaatgttaacttggaacctggcggcagcgcaaaagatg

SEQ ID NO: 126072 - DNA, 103 bp, Artificial Sequence
  Synthetic Polynucleotide
taatacgactcactatagggattggacgccttcctggaaagaccaagttaaacagaggagataacttatgctttccaggaacctggcggcagcgcaaaagatg

SEQ ID NO: 126073 - DNA, 103 bp, Artificial Sequence
  Synthetic Polynucleotide
taatacgactcactatagggctaccaggcaattggacgccttcctggaaaaacagaggagatttccaatgaggcgtccaaacctggcggcagcgcaaaagatg

SEQ ID NO: 126074 - DNA, 103 bp, Artificial Sequence
  Synthetic Polynucleotide
taatacgactcactatagggtccactgtaactaccaggcaattggacgccaacagaggagaggcgtcatgttgcctggtaacctggcggcagcgcaaaagatg

SEQ ID NO: 126075 - DNA, 103 bp, Artificial Sequence
  Synthetic Polynucleotide
taatacgactcactatagggctattaaatgtccactgtaactaccaggcaaacagaggagatgcctgatggttacagtgaacctggcggcagcgcaaaagatg

SEQ ID NO: 126076 - DNA, 103 bp, Artificial Sequence
  Synthetic Polynucleotide
taatacgactcactatagggggagtgttagctattaaatgtccactgtaaaacagaggagattacagatgacatttaataacctggcggcagcgcaaaagatg

SEQ ID NO: 126077 - DNA, 103 bp, Artificial Sequence
  Synthetic Polynucleotide
taatacgactcactataggggttctgctgaggagtgttagctattaaatgaacagaggagacatttaatggctaacactaacctggcggcagcgcaaaagatg

SEQ ID NO: 126078 - DNA, 103 bp, Artificial Sequence
  Synthetic Polynucleotide
taatacgactcactatagggcatttagtgagttctgctgaggagtgttagaacagaggagactaacaatgctcagcagaaacctggcggcagcgcaaaagatg

SEQ ID NO: 126079 - DNA, 103 bp, Artificial Sequence
  Synthetic Polynucleotide
taatacgactcactataggggaaaagcaatcatttagtgagttctgctgaaacagaggagatcagcaatgctcactaaaaacctggcggcagcgcaaaagatg

SEQ ID NO: 126080 - DNA, 103 bp, Artificial Sequence
  Synthetic Polynucleotide
taatacgactcactatagggggtttttttcacgttctgtggcagtttcacaacagaggagagtgaaaatgccacagaacaacctggcggcagcgcaaaagatg

SEQ ID NO: 126081 - DNA, 103 bp, Artificial Sequence
  Synthetic Polynucleotide
taatacgactcactatagggcttggagaaggaaaagcaatcatttagtgaaacagaggagatcactaatggattgctttaacctggcggcagcgcaaaagatg

SEQ ID NO: 126082 - DNA, 103 bp, Artificial Sequence
  Synthetic Polynucleotide
taatacgactcactataggggaccataactcttggagaaggaaaagcaataacagaggagaattgctatgccttctccaaacctggcggcagcgcaaaagatg

SEQ ID NO: 126083 - DNA, 103 bp, Artificial Sequence
  Synthetic Polynucleotide
taatacgactcactatagggattcctcccagaccataactcttggagaagaacagaggagacttctcatggagttatggaacctggcggcagcgcaaaagatg

SEQ ID NO: 126084 - DNA, 103 bp, Artificial Sequence
  Synthetic Polynucleotide
taatacgactcactatagggcagatctgtgattcctcccagaccataactaacagaggagaagttatatgctgggaggaaacctggcggcagcgcaaaagatg

SEQ ID NO: 126085 - DNA, 103 bp, Artificial Sequence
  Synthetic Polynucleotide
taatacgactcactatagggtctggtcagtcagatctgtgattcctcccaaacagaggagatgggagatgtcacagatcaacctggcggcagcgcaaaagatg

SEQ ID NO: 126086 - DNA, 103 bp, Artificial Sequence
  Synthetic Polynucleotide
taatacgactcactatagggacagtggaagtctggtcagtcagatctgtgaacagaggagacacagaatggactgaccaaacctggcggcagcgcaaaagatg

SEQ ID NO: 126087 - DNA, 103 bp, Artificial Sequence
  Synthetic Polynucleotide
taatacgactcactatagggcatggggtccacagtggaagtctggtcagtaacagaggagaactgacatgacttccactaacctggcggcagcgcaaaagatg

SEQ ID NO: 126088 - DNA, 103 bp, Artificial Sequence
  Synthetic Polynucleotide
taatacgactcactatagggcatagagcttcatggggtccacagtggaagaacagaggagacttccaatgtggaccccaaacctggcggcagcgcaaaagatg

SEQ ID NO: 126089 - DNA, 103 bp, Artificial Sequence
  Synthetic Polynucleotide
taatacgactcactatagggttgcgcttttcatagagcttcatggggtccaacagaggagaggacccatggaagctctaaacctggcggcagcgcaaaagatg

SEQ ID NO: 126090 - DNA, 103 bp, Artificial Sequence
  Synthetic Polynucleotide
taatacgactcactatagggactggacaatttgcgcttttcatagagcttaacagaggagaaagctcatggaaaagcgcaacctggcggcagcgcaaaagatg

SEQ ID NO: 126091 - DNA, 103 bp, Artificial Sequence
  Synthetic Polynucleotide
taatacgactcactatagggggaaccagtcggtttttttcacgttctgtgaacagaggagacacagaatgtgaaaaaaaaacctggcggcagcgcaaaagatg

SEQ ID NO: 126092 - DNA, 103 bp, Artificial Sequence
  Synthetic Polynucleotide
taatacgactcactatagggaggttctgctactggacaatttgcgcttttaacagaggagaaaaagcatgaattgtccaaacctggcggcagcgcaaaagatg

SEQ ID NO: 126093 - DNA, 103 bp, Artificial Sequence
  Synthetic Polynucleotide
taatacgactcactatagggccactactgtaggttctgctactggacaataacagaggagaattgtcatgtagcagaacaacctggcggcagcgcaaaagatg

SEQ ID NO: 126094 - DNA, 103 bp, Artificial Sequence
  Synthetic Polynucleotide
taatacgactcactatagggaagcaggtctccactactgtaggttctgctaacagaggagaagcagaatgtacagtagtaacctggcggcagcgcaaaagatg

SEQ ID NO: 126095 - DNA, 103 bp, Artificial Sequence
  Synthetic Polynucleotide
taatacgactcactatagggcagaaggaggaagcaggtctccactactgtaacagaggagaacagtaatggagacctgcaacctggcggcagcgcaaaagatg

SEQ ID NO: 126096 - DNA, 103 bp, Artificial Sequence
  Synthetic Polynucleotide
taatacgactcactatagggactccggaggcagaaggaggaagcaggtctaacagaggagaagacctatgtcctccttcaacctggcggcagcgcaaaagatg

SEQ ID NO: 126097 - DNA, 103 bp, Artificial Sequence
  Synthetic Polynucleotide
taatacgactcactatagggatcagagtagactccggaggcagaaggaggaacagaggagacctcctatggcctccggaaacctggcggcagcgcaaaagatg

SEQ ID NO: 126098 - DNA, 103 bp, Artificial Sequence
  Synthetic Polynucleotide
taatacgactcactataggggatcgccatgatcagagtagactccggaggaacagaggagacctccgatgtctactctgaacctggcggcagcgcaaaagatg

SEQ ID NO: 126099 - DNA, 103 bp, Artificial Sequence
  Synthetic Polynucleotide
taatacgactcactatagggcacgcttgtagatcgccatgatcagagtagaacagaggagactactcatgtcatggcgaaacctggcggcagcgcaaaagatg

SEQ ID NO: 126100 - DNA, 103 bp, Artificial Sequence
  Synthetic Polynucleotide
taatacgactcactatagggatttttactccacgcttgtagatcgccatgaacagaggagacatggcatgctacaagcgaacctggcggcagcgcaaaagatg

SEQ ID NO: 126101 - DNA, 103 bp, Artificial Sequence
  Synthetic Polynucleotide
taatacgactcactatagggccaaagcagcatttttactccacgcttgtaaacagaggagatacaagatgggagtaaaaaacctggcggcagcgcaaaagatg

SEQ ID NO: 126102 - DNA, 103 bp, Artificial Sequence
  Synthetic Polynucleotide
taatacgactcactatagggggccactcctggaaccagtcggtttttttcaacagaggagagaaaaaatgcgactggttaacctggcggcagcgcaaaagatg

SEQ ID NO: 126103 - DNA, 103 bp, Artificial Sequence
  Synthetic Polynucleotide
taatacgactcactatagggtgatttctccccaaagcagcatttttactcaacagaggagagagtaaatgtgctgctttaacctggcggcagcgcaaaagatg

SEQ ID NO: 126104 - DNA, 103 bp, Artificial Sequence
  Synthetic Polynucleotide
taatacgactcactataggggtcagcaagatgatttctccccaaagcagcaacagaggagagctgctatggggagaaataacctggcggcagcgcaaaagatg

SEQ ID NO: 126105 - DNA, 103 bp, Artificial Sequence
  Synthetic Polynucleotide
taatacgactcactatagggaataacagttgtcagcaagatgatttctccaacagaggagaggagaaatgatcttgctgaacctggcggcagcgcaaaagatg

SEQ ID NO: 126106 - DNA, 103 bp, Artificial Sequence
  Synthetic Polynucleotide
taatacgactcactatagggggataattggaataacagttgtcagcaagaaacagaggagatcttgcatgcaactgttaaacctggcggcagcgcaaaagatg

SEQ ID NO: 126107 - DNA, 103 bp, Artificial Sequence
  Synthetic Polynucleotide
taatacgactcactatagggcagaggaaaaggataattggaataacagttaacagaggagaaactgtatgtccaattataacctggcggcagcgcaaaagatg

SEQ ID NO: 126108 - DNA, 103 bp, Artificial Sequence
  Synthetic Polynucleotide
taatacgactcactataggggccagctggtcagaggaaaaggataattggaacagaggagaccaattatgcttttcctcaacctggcggcagcgcaaaagatg

SEQ ID NO: 126109 - DNA, 103 bp, Artificial Sequence
  Synthetic Polynucleotide
taatacgactcactatagggaagctgcaaggccagctggtcagaggaaaaaacagaggagattttccatggaccagctgaacctggcggcagcgcaaaagatg

SEQ ID NO: 126110 - DNA, 103 bp, Artificial Sequence
  Synthetic Polynucleotide
taatacgactcactatagggggaaggagagaagctgcaaggccagctggtaacagaggagaaccagcatgccttgcagcaacctggcggcagcgcaaaagatg

SEQ ID NO: 126111 - DNA, 103 bp, Artificial Sequence
  Synthetic Polynucleotide
taatacgactcactatagggaagagttttgggaaggagagaagctgcaagaacagaggagacttgcaatgtctctccttaacctggcggcagcgcaaaagatg

SEQ ID NO: 126112 - DNA, 103 bp, Artificial Sequence
  Synthetic Polynucleotide
taatacgactcactatagggaagggttctgaagagttttgggaaggagagaacagaggagactctccatgccaaaactcaacctggcggcagcgcaaaagatg

SEQ ID NO: 126113 - DNA, 103 bp, Artificial Sequence
  Synthetic Polynucleotide
taatacgactcactatagggcttgcttttgacgagaaatgagcgcggcataacagaggagaatgccgatgtcatttctcaacctggcggcagcgcaaaagatg

SEQ ID NO: 126114 - DNA, 103 bp, Artificial Sequence
  Synthetic Polynucleotide
taatacgactcactataggggctgtctgctcggctaggcgccggtacattaacagaggagaaatgtaatggcgcctagcaacctggcggcagcgcaaaagatg

SEQ ID NO: 126115 - DNA, 103 bp, Artificial Sequence
  Synthetic Polynucleotide
taatacgactcactataggggtagggccgagtgtctgagtggataagcagaacagaggagactgcttatgcactcagacaacctggcggcagcgcaaaagatg

SEQ ID NO: 126116 - DNA, 103 bp, Artificial Sequence
  Synthetic Polynucleotide
taatacgactcactatagggactgacaggggtagggccgagtgtctgagtaacagaggagaactcagatgctcggccctaacctggcggcagcgcaaaagatg

SEQ ID NO: 126117 - DNA, 103 bp, Artificial Sequence
  Synthetic Polynucleotide
taatacgactcactatagggttgccacagtactgacaggggtagggccgaaacagaggagatcggccatgcccctgtcaaacctggcggcagcgcaaaagatg

SEQ ID NO: 126118 - DNA, 103 bp, Artificial Sequence
  Synthetic Polynucleotide
taatacgactcactataggggtggaacctcttgccacagtactgacagggaacagaggagaccctgtatgtactgtggcaacctggcggcagcgcaaaagatg

SEQ ID NO: 126119 - DNA, 103 bp, Artificial Sequence
  Synthetic Polynucleotide
taatacgactcactatagggctgacttctggtggaacctcttgccacagtaacagaggagaactgtgatgagaggttccaacctggcggcagcgcaaaagatg

SEQ ID NO: 126120 - DNA, 103 bp, Artificial Sequence
  Synthetic Polynucleotide
taatacgactcactatagggttcttcatgtctgacttctggtggaacctcaacagaggagagaggttatgccagaagtcaacctggcggcagcgcaaaagatg

SEQ ID NO: 126121 - DNA, 103 bp, Artificial Sequence
  Synthetic Polynucleotide
taatacgactcactataggggaaagtgtgtttcttcatgtctgacttctgaacagaggagacagaagatggacatgaagaacctggcggcagcgcaaaagatg

SEQ ID NO: 126122 - DNA, 103 bp, Artificial Sequence
  Synthetic Polynucleotide
taatacgactcactatagggcagtgtggatgaaagtgtgtttcttcatgtaacagaggagaacatgaatgaacacacttaacctggcggcagcgcaaaagatg

SEQ ID NO: 126123 - DNA, 103 bp, Artificial Sequence
  Synthetic Polynucleotide
taatacgactcactatagggggcttctcaccagtgtggatgaaagtgtgtaacagaggagaacacacatgcatccacacaacctggcggcagcgcaaaagatg

SEQ ID NO: 126124 - DNA, 103 bp, Artificial Sequence
  Synthetic Polynucleotide
taatacgactcactataggggcacttgtgaggcttctcaccagtgtggataacagaggagaatccacatgggtgagaagaacctggcggcagcgcaaaagatg

SEQ ID NO: 126125 - DNA, 103 bp, Artificial Sequence
  Synthetic Polynucleotide
taatacgactcactatagggcatttgaagtgctgtctgctcggctaggcgaacagaggagacgcctaatggagcagacaaacctggcggcagcgcaaaagatg

SEQ ID NO: 126126 - DNA, 103 bp, Artificial Sequence
  Synthetic Polynucleotide
taatacgactcactatagggcgcacacctggcacttgtgaggcttctcacaacagaggagagtgagaatgctcacaagtaacctggcggcagcgcaaaagatg

SEQ ID NO: 126127 - DNA, 103 bp, Artificial Sequence
  Synthetic Polynucleotide
taatacgactcactatagggaatgccttgccgcacacctggcacttgtgaaacagaggagatcacaaatgccaggtgtgaacctggcggcagcgcaaaagatg

SEQ ID NO: 126128 - DNA, 103 bp, Artificial Sequence
  Synthetic Polynucleotide
taatacgactcactataggggctctggctgaatgccttgccgcacacctgaacagaggagacaggtgatgggcaaggcaaacctggcggcagcgcaaaagatg

SEQ ID NO: 126129 - DNA, 103 bp, Artificial Sequence
  Synthetic Polynucleotide
taatacgactcactatagggtgaggttggagctctggctgaatgccttgcaacagaggagagcaaggatgtcagccagaaacctggcggcagcgcaaaagatg

SEQ ID NO: 126130 - DNA, 103 bp, Artificial Sequence
  Synthetic Polynucleotide
taatacgactcactatagggctgtgggtgatgaggttggagctctggctgaacagaggagacagccaatgctccaacctaacctggcggcagcgcaaaagatg

SEQ ID NO: 126131 - DNA, 103 bp, Artificial Sequence
  Synthetic Polynucleotide
taatacgactcactataggggtgtttgcggctgtgggtgatgaggttggaaacagaggagatccaacatgatcacccacaacctggcggcagcgcaaaagatg

SEQ ID NO: 126132 - DNA, 103 bp, Artificial Sequence
  Synthetic Polynucleotide
taatacgactcactatagggtgaagcctgtgtgtttgcggctgtgggtgaaacagaggagatcacccatggccgcaaacaacctggcggcagcgcaaaagatg

SEQ ID NO: 126133 - DNA, 103 bp, Artificial Sequence
  Synthetic Polynucleotide
taatacgactcactatagggccgaagggcttgaagcctgtgtgtttgcggaacagaggagaccgcaaatgcacaggcttaacctggcggcagcgcaaaagatg

SEQ ID NO: 126134 - DNA, 103 bp, Artificial Sequence
  Synthetic Polynucleotide
taatacgactcactataggggaggtcgcagccgaagggcttgaagcctgtaacagaggagaacaggcatgaagcccttcaacctggcggcagcgcaaaagatg

SEQ ID NO: 126135 - DNA, 103 bp, Artificial Sequence
  Synthetic Polynucleotide
taatacgactcactatagggccttcccacagaggtcgcagccgaagggctaacagaggagaagccctatggctgcgaccaacctggcggcagcgcaaaagatg

SEQ ID NO: 126136 - DNA, 103 bp, Artificial Sequence
  Synthetic Polynucleotide
taatacgactcactataggggccccgcctgcatttgaagtgctgtctgctaacagaggagaagcagaatgcacttcaaaaacctggcggcagcgcaaaagatg

SEQ ID NO: 126137 - DNA, 103 bp, Artificial Sequence
  Synthetic Polynucleotide
taatacgactcactatagggctctggaaacccttcccacagaggtcgcagaacagaggagactgcgaatgctgtgggaaaacctggcggcagcgcaaaagatg

SEQ ID NO: 126138 - DNA, 103 bp, Artificial Sequence
  Synthetic Polynucleotide
taatacgactcactataggggtccaccttcctctggaaacccttcccacaaacagaggagatgtgggatgggtttccagaacctggcggcagcgcaaaagatg

SEQ ID NO: 126139 - DNA, 103 bp, Artificial Sequence
  Synthetic Polynucleotide
taatacgactcactataggggccttcggaggtccaccttcctctggaaacaacagaggagagtttccatgggaaggtggaacctggcggcagcgcaaaagatg

SEQ ID NO: 126140 - DNA, 103 bp, Artificial Sequence
  Synthetic Polynucleotide
taatacgactcactataggggtctcccggtgccttcggaggtccaccttcaacagaggagagaaggtatgcctccgaagaacctggcggcagcgcaaaagatg

SEQ ID NO: 126141 - DNA, 103 bp, Artificial Sequence
  Synthetic Polynucleotide
taatacgactcactatagggcccatgctgcgtctcccggtgccttcggagaacagaggagactccgaatgcaccgggagaacctggcggcagcgcaaaagatg

SEQ ID NO: 126142 - DNA, 103 bp, Artificial Sequence
  Synthetic Polynucleotide
taatacgactcactatagggctccgccttcgccccgcctgcatttgaagtaacagaggagaacttcaatggcaggcgggaacctggcggcagcgcaaaagatg

SEQ ID NO: 126143 - DNA, 103 bp, Artificial Sequence
  Synthetic Polynucleotide
taatacgactcactatagggggtcccggggctccgccttcgccccgcctgaacagaggagacaggcgatgcgaaggcggaacctggcggcagcgcaaaagatg

SEQ ID NO: 126144 - DNA, 103 bp, Artificial Sequence
  Synthetic Polynucleotide
taatacgactcactatagggggggacaaacggtcccggggctccgccttcaacagaggagagaaggcatggccccgggaaacctggcggcagcgcaaaagatg

SEQ ID NO: 126145 - DNA, 103 bp, Artificial Sequence
  Synthetic Polynucleotide
taatacgactcactatagggctgcgattcgggggacaaacggtcccggggaacagaggagaccccggatgcgtttgtccaacctggcggcagcgcaaaagatg

SEQ ID NO: 126146 - DNA, 103 bp, Artificial Sequence
  Synthetic Polynucleotide
taatacgactcactatagggcttcggtcagctgcgattcgggggacaaacaacagaggagagtttgtatgccgaatcgcaacctggcggcagcgcaaaagatg

SEQ ID NO: 126147 - DNA, 103 bp, Artificial Sequence
  Synthetic Polynucleotide
taatacgactcactatagggctgtctggggcttcggtcagctgcgattcgaacagaggagacgaatcatggctgaccgaaacctggcggcagcgcaaaagatg

SEQ ID NO: 126148 - DNA, 103 bp, Artificial Sequence
  Synthetic Polynucleotide
taatacgactcactatagggtgcggaggctctgtctggggcttcggtcagaacagaggagactgaccatggccccagacaacctggcggcagcgcaaaagatg

SEQ ID NO: 126149 - DNA, 103 bp, Artificial Sequence
  Synthetic Polynucleotide
taatacgactcactatagggtgtgagccttcttgcttttgacgagaaatgaacagaggagacatttcatgtcaaaagcaaacctggcggcagcgcaaaagatg

SEQ ID NO: 126150 - DNA, 103 bp, Artificial Sequence
  Synthetic Polynucleotide
taatacgactcactatagggtgtctggggatgcggaggctctgtctggggaacagaggagaccccagatggagcctccgaacctggcggcagcgcaaaagatg

SEQ ID NO: 126151 - DNA, 103 bp, Artificial Sequence
  Synthetic Polynucleotide
taatacgactcactatagggccttcgcagctgtctggggatgcggaggctaacagaggagaagcctcatgatccccagaaacctggcggcagcgcaaaagatg

SEQ ID NO: 126152 - DNA, 103 bp, Artificial Sequence
  Synthetic Polynucleotide
taatacgactcactataggggcagacgctgccttcgcagctgtctggggaaacagaggagatccccaatgagctgcgaaaacctggcggcagcgcaaaagatg

SEQ ID NO: 126153 - DNA, 103 bp, Artificial Sequence
  Synthetic Polynucleotide
taatacgactcactatagggagctccgttcgcagacgctgccttcgcagcaacagaggagagctgcgatggcagcgtctaacctggcggcagcgcaaaagatg

SEQ ID NO: 126154 - DNA, 103 bp, Artificial Sequence
  Synthetic Polynucleotide
taatacgactcactatagggtcaaactccgagctccgttcgcagacgctgaacagaggagacagcgtatgcgaacggagaacctggcggcagcgcaaaagatg

SEQ ID NO: 126155 - DNA, 103 bp, Artificial Sequence
  Synthetic Polynucleotide
taatacgactcactatagggccagaagtcctcaaactccgagctccgttcaacagaggagagaacggatgtcggagtttaacctggcggcagcgcaaaagatg

SEQ ID NO: 126156 - DNA, 103 bp, Artificial Sequence
  Synthetic Polynucleotide
taatacgactcactatagggacgggggcctccagaagtcctcaaactccgaacagaggagacggagtatgaggacttctaacctggcggcagcgcaaaagatg

SEQ ID NO: 126157 - DNA, 103 bp, Artificial Sequence
  Synthetic Polynucleotide
taatacgactcactataggggcggagggtgacgggggcctccagaagtccaacagaggagaggacttatggaggcccccaacctggcggcagcgcaaaagatg

SEQ ID NO: 126158 - DNA, 103 bp, Artificial Sequence
  Synthetic Polynucleotide
taatacgactcactatagggggctggagacgcggagggtgacgggggcctaacagaggagaaggcccatgtcaccctccaacctggcggcagcgcaaaagatg

SEQ ID NO: 126159 - DNA, 103 bp, Artificial Sequence
  Synthetic Polynucleotide
taatacgactcactatagggacttctccgaggctggagacgcggagggtgaacagaggagacaccctatgcgtctccagaacctggcggcagcgcaaaagatg

SEQ ID NO: 126160 - DNA, 103 bp, Artificial Sequence
  Synthetic Polynucleotide
taatacgactcactatagggtggtggtagctgtgagccttcttgcttttgaacagaggagacaaaagatggaaggctcaaacctggcggcagcgcaaaagatg

SEQ ID NO: 126161 - DNA, 103 bp, Artificial Sequence
  Synthetic Polynucleotide
taatacgactcactataggggggcacattgacttctccgaggctggagacaacagaggagagtctccatgctcggagaaaacctggcggcagcgcaaaagatg

SEQ ID NO: 126162 - DNA, 103 bp, Artificial Sequence
  Synthetic Polynucleotide
taatacgactcactataggggtccagcgatgggcacattgacttctccgaaacagaggagatcggagatgtcaatgtgcaacctggcggcagcgcaaaagatg

SEQ ID NO: 126163 - DNA, 103 bp, Artificial Sequence
  Synthetic Polynucleotide
taatacgactcactataggggctgggcttcgtccagcgatgggcacattgaacagaggagacaatgtatgcatcgctggaacctggcggcagcgcaaaagatg

SEQ ID NO: 126164 - DNA, 103 bp, Artificial Sequence
  Synthetic Polynucleotide
taatacgactcactatagggagggggaagggctgggcttcgtccagcgataacagaggagaatcgctatgcgaagcccaaacctggcggcagcgcaaaagatg

SEQ ID NO: 126165 - DNA, 103 bp, Artificial Sequence
  Synthetic Polynucleotide
taatacgactcactatagggtttgaaaggcagggggaagggctgggcttcaacagaggagagaagccatgcccttccccaacctggcggcagcgcaaaagatg

SEQ ID NO: 126166 - DNA, 103 bp, Artificial Sequence
  Synthetic Polynucleotide
taatacgactcactatagggatgagtacggtttgaaaggcagggggaaggaacagaggagaccttccatgtgcctttcaaacctggcggcagcgcaaaagatg

SEQ ID NO: 126167 - DNA, 103 bp, Artificial Sequence
  Synthetic Polynucleotide
taatacgactcactatagggaggccgctccatgagtacggtttgaaaggcaacagaggagagcctttatgaccgtactcaacctggcggcagcgcaaaagatg

SEQ ID NO: 126168 - DNA, 103 bp, Artificial Sequence
  Synthetic Polynucleotide
taatacgactcactatagggagaacccgccaggccgctccatgagtacggaacagaggagaccgtacatgtggagcggcaacctggcggcagcgcaaaagatg

SEQ ID NO: 126169 - DNA, 103 bp, Artificial Sequence
  Synthetic Polynucleotide
taatacgactcactataggggccgcaggtcagaacccgccaggccgctccaacagaggagaggagcgatgtggcgggttaacctggcggcagcgcaaaagatg

SEQ ID NO: 126170 - DNA, 103 bp, Artificial Sequence
  Synthetic Polynucleotide
taatacgactcactatagggtgcaccaggtgccgcaggtcagaacccgccaacagaggagaggcgggatgtgacctgcgaacctggcggcagcgcaaaagatg

SEQ ID NO: 126171 - DNA, 103 bp, Artificial Sequence
  Synthetic Polynucleotide
taatacgactcactatagggggagcgcggctggtggtagctgtgagccttaacagaggagaaaggctatgagctaccacaacctggcggcagcgcaaaagatg

SEQ ID NO: 126172 - DNA, 103 bp, Artificial Sequence
  Synthetic Polynucleotide
taatacgactcactatagggtcggtagctctgcaccaggtgccgcaggtcaacagaggagagacctgatgcacctggtgaacctggcggcagcgcaaaagatg

SEQ ID NO: 126173 - DNA, 103 bp, Artificial Sequence
  Synthetic Polynucleotide
taatacgactcactatagggccccacacggtcggtagctctgcaccaggtaacagaggagaacctggatgagagctaccaacctggcggcagcgcaaaagatg

SEQ ID NO: 126174 - DNA, 103 bp, Artificial Sequence
  Synthetic Polynucleotide
taatacgactcactatagggcgctccagggccccacacggtcggtagctcaacagaggagagagctaatgaccgtgtggaacctggcggcagcgcaaaagatg

SEQ ID NO: 126175 - DNA, 103 bp, Artificial Sequence
  Synthetic Polynucleotide
taatacgactcactataggggccagcgccacgctccagggccccacacggaacagaggagaccgtgtatggccctggagaacctggcggcagcgcaaaagatg

SEQ ID NO: 126176 - DNA, 103 bp, Artificial Sequence
  Synthetic Polynucleotide
taatacgactcactatagggagaggcccaggccagcgccacgctccagggaacagaggagaccctggatggtggcgctgaacctggcggcagcgcaaaagatg

SEQ ID NO: 126177 - DNA, 103 bp, Artificial Sequence
  Synthetic Polynucleotide
taatacgactcactatagggggttcgcagaagaggcccaggccagcgccaaacagaggagatggcgcatgcctgggcctaacctggcggcagcgcaaaagatg

SEQ ID NO: 126178 - DNA, 103 bp, Artificial Sequence
  Synthetic Polynucleotide
taatacgactcactatagggctccggggcgggttcgcagaagaggcccagaacagaggagactgggcatgttctgcgaaaacctggcggcagcgcaaaagatg

SEQ ID NO: 126179 - DNA, 103 bp, Artificial Sequence
  Synthetic Polynucleotide
taatacgactcactatagggggtggccaggctccggggcgggttcgcagaaacagaggagatctgcgatgccgccccggaacctggcggcagcgcaaaagatg

SEQ ID NO: 126180 - DNA, 103 bp, Artificial Sequence
  Synthetic Polynucleotide
taatacgactcactatagggagcgcggccgggtggccaggctccggggcgaacagaggagacgccccatggcctggccaaacctggcggcagcgcaaaagatg

SEQ ID NO: 126181 - DNA, 103 bp, Artificial Sequence
  Synthetic Polynucleotide
taatacgactcactatagggcgggccgtacagcgcggccgggtggccaggaacagaggagacctggcatgccggccgcgaacctggcggcagcgcaaaagatg

SEQ ID NO: 126182 - DNA, 103 bp, Artificial Sequence
  Synthetic Polynucleotide
taatacgactcactatagggctggtcctggggagcgcggctggtggtagcaacagaggagagctaccatgagccgcgctaacctggcggcagcgcaaaagatg

SEQ ID NO: 126183 - DNA, 103 bp, Artificial Sequence
  Synthetic Polynucleotide
taatacgactcactatagggcagcccgcttcgggccgtacagcgcggccgaacagaggagacggccgatgtgtacggccaacctggcggcagcgcaaaagatg

SEQ ID NO: 126184 - DNA, 103 bp, Artificial Sequence
  Synthetic Polynucleotide
taatacgactcactataggggcgccgccggcagcccgcttcgggccgtacaacagaggagagtacggatggaagcgggcaacctggcggcagcgcaaaagatg

SEQ ID NO: 126185 - DNA, 103 bp, Artificial Sequence
  Synthetic Polynucleotide
taatacgactcactatagggcccggcccccgcgccgccggcagcccgcttaacagaggagaaagcggatggccggcggcaacctggcggcagcgcaaaagatg

SEQ ID NO: 126186 - DNA, 103 bp, Artificial Sequence
  Synthetic Polynucleotide
taatacgactcactatagggtccctggcgccccggcccccgcgccgccggaacagaggagaccggcgatgcgggggccgaacctggcggcagcgcaaaagatg

SEQ ID NO: 126187 - DNA, 103 bp, Artificial Sequence
  Synthetic Polynucleotide
taatacgactcactataggggcgctgcagctccctggcgccccggcccccaacagaggagagggggcatgggcgccaggaacctggcggcagcgcaaaagatg

SEQ ID NO: 126188 - DNA, 103 bp, Artificial Sequence
  Synthetic Polynucleotide
taatacgactcactatagggaccggcccctgcgctgcagctccctggcgcaacagaggagagcgccaatgagctgcagcaacctggcggcagcgcaaaagatg

SEQ ID NO: 126189 - DNA, 103 bp, Artificial Sequence
  Synthetic Polynucleotide
taatacgactcactatagggcagcggtggcaccggcccctgcgctgcagcaacagaggagagctgcaatgcaggggccgaacctggcggcagcgcaaaagatg

SEQ ID NO: 126190 - DNA, 103 bp, Artificial Sequence
  Synthetic Polynucleotide
taatacgactcactatagggaggccagggccagcggtggcaccggcccctaacagaggagaaggggcatgtgccaccgcaacctggcggcagcgcaaaagatg

SEQ ID NO: 126191 - DNA, 103 bp, Artificial Sequence
  Synthetic Polynucleotide
taatacgactcactataggggtagagccctaggccagggccagcggtggcaacagaggagagccaccatgggccctggcaacctggcggcagcgcaaaagatg

SEQ ID NO: 126192 - DNA, 103 bp, Artificial Sequence
  Synthetic Polynucleotide
taatacgactcactatagggcgaagtcgccgtagagccctaggccagggcaacagaggagagccctgatgtagggctctaacctggcggcagcgcaaaagatg

SEQ ID NO: 126193 - DNA, 103 bp, Artificial Sequence
  Synthetic Polynucleotide
taatacgactcactatagggagggaatagtctggtcctggggagcgcggcaacagaggagagccgcgatgcccaggaccaacctggcggcagcgcaaaagatg

SEQ ID NO: 126194 - DNA, 103 bp, Artificial Sequence
  Synthetic Polynucleotide
taatacgactcactataggggccgcagacccgaagtcgccgtagagccctaacagaggagaagggctatgcggcgacttaacctggcggcagcgcaaaagatg

SEQ ID NO: 126195 - DNA, 103 bp, Artificial Sequence
  Synthetic Polynucleotide
taatacgactcactatagggcagcccggctgccgcagacccgaagtcgccaacagaggagaggcgacatggggtctgcgaacctggcggcagcgcaaaagatg

SEQ ID NO: 126196 - DNA, 103 bp, Artificial Sequence
  Synthetic Polynucleotide
taatacgactcactataggggcctctcatacagcccggctgccgcagaccaacagaggagaggtctgatgcagccgggcaacctggcggcagcgcaaaagatg

SEQ ID NO: 126197 - DNA, 103 bp, Artificial Sequence
  Synthetic Polynucleotide
taatacgactcactataggggctgccgtgggcctctcatacagcccggctaacagaggagaagccggatggtatgagagaacctggcggcagcgcaaaagatg

SEQ ID NO: 126198 - DNA, 103 bp, Artificial Sequence
  Synthetic Polynucleotide
taatacgactcactatagggcaagcccgccgctgccgtgggcctctcataaacagaggagatatgagatgcccacggcaaacctggcggcagcgcaaaagatg

SEQ ID NO: 126199 - DNA, 103 bp, Artificial Sequence
  Synthetic Polynucleotide
taatacgactcactatagggcggggtacagcaagcccgccgctgccgtggaacagaggagaccacggatgcggcgggctaacctggcggcagcgcaaaagatg

SEQ ID NO: 126200 - DNA, 103 bp, Artificial Sequence
  Synthetic Polynucleotide
taatacgactcactatagggtggccacgctcggggtacagcaagcccgccaacagaggagaggcgggatggctgtacccaacctggcggcagcgcaaaagatg

SEQ ID NO: 126201 - DNA, 103 bp, Artificial Sequence
  Synthetic Polynucleotide
taatacgactcactataggggtgcagcccgtggccacgctcggggtacagaacagaggagactgtacatggagcgtggcaacctggcggcagcgcaaaagatg

SEQ ID NO: 126202 - DNA, 103 bp, Artificial Sequence
  Synthetic Polynucleotide
taatacgactcactatagggccttgtctgcgtgcagcccgtggccacgctaacagaggagaagcgtgatgacgggctgcaacctggcggcagcgcaaaagatg

SEQ ID NO: 126203 - DNA, 103 bp, Artificial Sequence
  Synthetic Polynucleotide
taatacgactcactatagggacgccagcgcccttgtctgcgtgcagcccgaacagaggagacgggctatgcgcagacaaaacctggcggcagcgcaaaagatg

SEQ ID NO: 126204 - DNA, 103 bp, Artificial Sequence
  Synthetic Polynucleotide
taatacgactcactatagggctctaaacggagggaatagtctggtcctggaacagaggagaccaggaatggactattccaacctggcggcagcgcaaaagatg

SEQ ID NO: 126205 - DNA, 103 bp, Artificial Sequence
  Synthetic Polynucleotide
taatacgactcactatagggctccaccttgacgccagcgcccttgtctgcaacagaggagagcagacatgggcgctggcaacctggcggcagcgcaaaagatg

SEQ ID NO: 126206 - DNA, 103 bp, Artificial Sequence
  Synthetic Polynucleotide
taatacgactcactataggggcagctccgactccaccttgacgccagcgcaacagaggagagcgctgatgtcaaggtggaacctggcggcagcgcaaaagatg

SEQ ID NO: 126207 - DNA, 103 bp, Artificial Sequence
  Synthetic Polynucleotide
taatacgactcactatagggcgggtgcacagcagctccgactccaccttgaacagaggagacaaggtatggtcggagctaacctggcggcagcgcaaaagatg

SEQ ID NO: 126208 - DNA, 103 bp, Artificial Sequence
  Synthetic Polynucleotide
taatacgactcactatagggcagcagcaggcgggtgcacagcagctccgaaacagaggagatcggagatgctgtgcaccaacctggcggcagcgcaaaagatg

SEQ ID NO: 126209 - DNA, 103 bp, Artificial Sequence
  Synthetic Polynucleotide
taatacgactcactatagggagccgccgcccagcagcaggcgggtgcacaaacagaggagatgtgcaatggcctgctgcaacctggcggcagcgcaaaagatg

SEQ ID NO: 126210 - DNA, 103 bp, Artificial Sequence
  Synthetic Polynucleotide
taatacgactcactatagggcacttgtaggagccgccgcccagcagcaggaacagaggagacctgctatggggcggcggaacctggcggcagcgcaaaagatg

SEQ ID NO: 126211 - DNA, 103 bp, Artificial Sequence
  Synthetic Polynucleotide
taatacgactcactataggggcacttgatgcacttgtaggagccgccgccaacagaggagaggcggcatgtcctacaagaacctggcggcagcgcaaaagatg

SEQ ID NO: 126212 - DNA, 103 bp, Artificial Sequence
  Synthetic Polynucleotide
taatacgactcactatagggacaccttgctgcacttgatgcacttgtaggaacagaggagacctacaatggcatcaagtaacctggcggcagcgcaaaagatg

SEQ ID NO: 126213 - DNA, 103 bp, Artificial Sequence
  Synthetic Polynucleotide
taatacgactcactatagggggcgtggagaacaccttgctgcacttgatgaacagaggagacatcaaatgcagcaaggtaacctggcggcagcgcaaaagatg

SEQ ID NO: 126214 - DNA, 103 bp, Artificial Sequence
  Synthetic Polynucleotide
taatacgactcactataggggagcccgtgcggcgtggagaacaccttgctaacagaggagaagcaagatgttctccacgaacctggcggcagcgcaaaagatg

SEQ ID NO: 126215 - DNA, 103 bp, Artificial Sequence
  Synthetic Polynucleotide
taatacgactcactatagggccggtacattctctaaacggagggaatagtaacagaggagaactattatgtccgtttagaacctggcggcagcgcaaaagatg

SEQ ID NO: 126216 - DNA, 103 bp, Artificial Sequence
  Synthetic Polynucleotide
taatacgactcactatagggcgtgcacctcgagcccgtgcggcgtggagaaacagaggagatctccaatgcgcacgggcaacctggcggcagcgcaaaagatg

SEQ ID NO: 126217 - DNA, 103 bp, Artificial Sequence
  Synthetic Polynucleotide
taatacgactcactataggggacctgcgcacgtgcacctcgagcccgtgcaacagaggagagcacggatgcgaggtgcaaacctggcggcagcgcaaaagatg

SEQ ID NO: 126218 - DNA, 103 bp, Artificial Sequence
  Synthetic Polynucleotide
taatacgactcactatagggaccgctgtgggacctgcgcacgtgcacctcaacagaggagagaggtgatggtgcgcaggaacctggcggcagcgcaaaagatg

SEQ ID NO: 126219 - DNA, 103 bp, Artificial Sequence
  Synthetic Polynucleotide
taatacgactcactatagggagggtctggtaccgctgtgggacctgcgcaaacagaggagatgcgcaatgcccacagcgaacctggcggcagcgcaaaagatg

SEQ ID NO: 126220 - DNA, 103 bp, Artificial Sequence
  Synthetic Polynucleotide
taatacgactcactatagggtcgcaggcaaagggtctggtaccgctgtggaacagaggagaccacagatgtaccagaccaacctggcggcagcgcaaaagatg

SEQ ID NO: 126221 - DNA, 103 bp, Artificial Sequence
  Synthetic Polynucleotide
taatacgactcactataggggccgcacatctcgcaggcaaagggtctggtaacagaggagaaccagaatgtttgcctgcaacctggcggcagcgcaaaagatg

SEQ ID NO: 126222 - DNA, 103 bp, Artificial Sequence
  Synthetic Polynucleotide
taatacgactcactatagggcgaaggtcttgccgcacatctcgcaggcaaaacagaggagattgcctatgagatgtgcgaacctggcggcagcgcaaaagatg

SEQ ID NO: 126223 - DNA, 103 bp, Artificial Sequence
  Synthetic Polynucleotide
taatacgactcactatagggaccgcgtgcccgaaggtcttgccgcacatcaacagaggagagatgtgatgcaagaccttaacctggcggcagcgcaaaagatg

SEQ ID NO: 126224 - DNA, 103 bp, Artificial Sequence
  Synthetic Polynucleotide
taatacgactcactatagggctccaggctcaccgcgtgcccgaaggtcttaacagaggagaaagaccatggggcacgcgaacctggcggcagcgcaaaagatg

SEQ ID NO: 126225 - DNA, 103 bp, Artificial Sequence
  Synthetic Polynucleotide
taatacgactcactatagggctttgtgctgctccaggctcaccgcgtgccaacagaggagaggcacgatgtgagcctggaacctggcggcagcgcaaaagatg

SEQ ID NO: 126226 - DNA, 103 bp, Artificial Sequence
  Synthetic Polynucleotide
taatacgactcactatagggcggctaggcgccggtacattctctaaacggaacagaggagaccgtttatggaatgtaccaacctggcggcagcgcaaaagatg

SEQ ID NO: 126227 - DNA, 103 bp, Artificial Sequence
  Synthetic Polynucleotide
taatacgactcactataggggagtgcacggctttgtgctgctccaggctcaacagaggagagagcctatggcagcacaaaacctggcggcagcgcaaaagatg

SEQ ID NO: 126228 - DNA, 103 bp, Artificial Sequence
  Synthetic Polynucleotide
taatacgactcactatagggccgttcctgcgagtgcacggctttgtgctgaacagaggagacagcacatggccgtgcacaacctggcggcagcgcaaaagatg

SEQ ID NO: 126229 - DNA, 103 bp, Artificial Sequence
  Synthetic Polynucleotide
taatacgactcactatagggagtcaaagctccgttcctgcgagtgcacggaacagaggagaccgtgcatgcgcaggaacaacctggcggcagcgcaaaagatg

SEQ ID NO: 126230 - DNA, 103 bp, Artificial Sequence
  Synthetic Polynucleotide
taatacgactcactatagggcagatcttacagtcaaagctccgttcctgcaacagaggagagcaggaatggagctttgaaacctggcggcagcgcaaaagatg

SEQ ID NO: 126231 - DNA, 103 bp, Artificial Sequence
  Synthetic Polynucleotide
taatacgactcactataggggctcttcccacagatcttacagtcaaagctaacagaggagaagctttatgtgtaagatcaacctggcggcagcgcaaaagatg

SEQ ID NO: 126232 - DNA, 103 bp, Artificial Sequence
  Synthetic Polynucleotide
taatacgactcactatagggacctcttgaagctcttcccacagatcttacaacagaggagagtaagaatggtgggaagaaacctggcggcagcgcaaaagatg

SEQ ID NO: 126233 - DNA, 103 bp, Artificial Sequence
  Synthetic Polynucleotide
taatacgactcactatagggagtgtggatgacctcttgaagctcttcccaaacagaggagatgggaaatgcttcaagagaacctggcggcagcgcaaaagatg

SEQ ID NO: 126234 - DNA, 103 bp, Artificial Sequence
  Synthetic Polynucleotide
taatacgactcactataggggtgtgtggacagtgtggatgacctcttgaaaacagaggagattcaagatgtcatccacaaacctggcggcagcgcaaaagatg

SEQ ID NO: 126235 - DNA, 103 bp, Artificial Sequence
  Synthetic Polynucleotide
taatacgactcactatagggggataagcaggtgtgtggacagtgtggatgaacagaggagacatccaatgtgtccacacaacctggcggcagcgcaaaagatg

SEQ ID NO: 126236 - DNA, 103 bp, Artificial Sequence
  Synthetic Polynucleotide
taatacgactcactataggggtgtctgagtggataagcaggtgtgtggacaacagaggagagtccacatgcctgcttataacctggcggcagcgcaaaagatg

SEQ ID NO: 126237 - DNA, 103 bp, Artificial Sequence
  Synthetic Polynucleotide
taatacgactcactataggggattggtggtggggtcatcgagttgaacataacagaggagaatgttcatgtcgatgaccaacctggcggcagcgcaaaagatg

SEQ ID NO: 126238 - DNA, 103 bp, Artificial Sequence
  Synthetic Polynucleotide
taatacgactcactataggggaagggcgggccagacagtccttctgtcccaacagaggagagggacaatgggactgtctaacctggcggcagcgcaaaagatg

SEQ ID NO: 126239 - DNA, 103 bp, Artificial Sequence
  Synthetic Polynucleotide
taatacgactcactatagggtttactgcagccctcgtgctcacacatgtaaacagaggagatacatgatggagcacgagaacctggcggcagcgcaaaagatg

SEQ ID NO: 126240 - DNA, 103 bp, Artificial Sequence
  Synthetic Polynucleotide
taatacgactcactatagggtgctgaaggctttactgcagccctcgtgctaacagaggagaagcacgatggctgcagtaaacctggcggcagcgcaaaagatg

SEQ ID NO: 126241 - DNA, 103 bp, Artificial Sequence
  Synthetic Polynucleotide
taatacgactcactatagggtcactggcattgctgaaggctttactgcagaacagaggagactgcagatgagccttcagaacctggcggcagcgcaaaagatg

SEQ ID NO: 126242 - DNA, 103 bp, Artificial Sequence
  Synthetic Polynucleotide
taatacgactcactatagggcttggctcggtcactggcattgctgaaggcaacagaggagagccttcatgaatgccagtaacctggcggcagcgcaaaagatg

SEQ ID NO: 126243 - DNA, 103 bp, Artificial Sequence
  Synthetic Polynucleotide
taatacgactcactataggggattctggtgcttggctcggtcactggcataacagaggagaatgccaatgaccgagccaaacctggcggcagcgcaaaagatg

SEQ ID NO: 126244 - DNA, 103 bp, Artificial Sequence
  Synthetic Polynucleotide
taatacgactcactataggggaatgggtccgattctggtgcttggctcggaacagaggagaccgagcatggcaccagaaaacctggcggcagcgcaaaagatg

SEQ ID NO: 126245 - DNA, 103 bp, Artificial Sequence
  Synthetic Polynucleotide
taatacgactcactatagggcttctcattggaatgggtccgattctggtgaacagaggagacaccagatgcggacccataacctggcggcagcgcaaaagatg

SEQ ID NO: 126246 - DNA, 103 bp, Artificial Sequence
  Synthetic Polynucleotide
taatacgactcactatagggatacatacggcttctcattggaatgggtccaacagaggagaggacccatgccaatgagaaacctggcggcagcgcaaaagatg

SEQ ID NO: 126247 - DNA, 103 bp, Artificial Sequence
  Synthetic Polynucleotide
taatacgactcactataggggggagcttacatacatacggcttctcattgaacagaggagacaatgaatggccgtatgtaacctggcggcagcgcaaaagatg

SEQ ID NO: 126248 - DNA, 103 bp, Artificial Sequence
  Synthetic Polynucleotide
taatacgactcactatagggggtgcagccagggagcttacatacatacggaacagaggagaccgtatatgtgtaagctcaacctggcggcagcgcaaaagatg

SEQ ID NO: 126249 - DNA, 103 bp, Artificial Sequence
  Synthetic Polynucleotide
taatacgactcactatagggcttggtggcagaagggcgggccagacagtcaacagaggagagactgtatggcccgccctaacctggcggcagcgcaaaagatg

SEQ ID NO: 126250 - DNA, 103 bp, Artificial Sequence
  Synthetic Polynucleotide
taatacgactcactatagggtatagcgtttggtgcagccagggagcttacaacagaggagagtaagcatgctggctgcaaacctggcggcagcgcaaaagatg

SEQ ID NO: 126251 - DNA, 103 bp, Artificial Sequence
  Synthetic Polynucleotide
taatacgactcactatagggctaggatctgtatagcgtttggtgcagccaaacagaggagatggctgatgcaaacgctaaacctggcggcagcgcaaaagatg

SEQ ID NO: 126252 - DNA, 103 bp, Artificial Sequence
  Synthetic Polynucleotide
taatacgactcactatagggtcgcagcgagctaggatctgtatagcgtttaacagaggagaaaacgcatgacagatcctaacctggcggcagcgcaaaagatg

SEQ ID NO: 126253 - DNA, 103 bp, Artificial Sequence
  Synthetic Polynucleotide
taatacgactcactatagggtgacatgttttcgcagcgagctaggatctgaacagaggagacagatcatggctcgctgcaacctggcggcagcgcaaaagatg

SEQ ID NO: 126254 - DNA, 103 bp, Artificial Sequence
  Synthetic Polynucleotide
taatacgactcactatagggtgcactgtcttgacatgttttcgcagcgagaacagaggagactcgctatgaaaacatgtaacctggcggcagcgcaaaagatg

SEQ ID NO: 126255 - DNA, 103 bp, Artificial Sequence
  Synthetic Polynucleotide
taatacgactcactataggggtcaggaccatgcactgtcttgacatgtttaacagaggagaaaacatatgaagacagtgaacctggcggcagcgcaaaagatg

SEQ ID NO: 126256 - DNA, 103 bp, Artificial Sequence
  Synthetic Polynucleotide
taatacgactcactatagggtcacatgggcgtcaggaccatgcactgtctaacagaggagaagacagatgatggtcctgaacctggcggcagcgcaaaagatg

SEQ ID NO: 126257 - DNA, 103 bp, Artificial Sequence
  Synthetic Polynucleotide
taatacgactcactatagggtgccgtttggtcacatgggcgtcaggaccaaacagaggagatggtccatgcgcccatgtaacctggcggcagcgcaaaagatg

SEQ ID NO: 126258 - DNA, 103 bp, Artificial Sequence
  Synthetic Polynucleotide
taatacgactcactatagggatccccacggtgccgtttggtcacatgggcaacagaggagagcccatatgaccaaacggaacctggcggcagcgcaaaagatg

SEQ ID NO: 126259 - DNA, 103 bp, Artificial Sequence
  Synthetic Polynucleotide
taatacgactcactataggggcagggggccatccccacggtgccgtttggaacagaggagaccaaacatgaccgtggggaacctggcggcagcgcaaaagatg

SEQ ID NO: 126260 - DNA, 103 bp, Artificial Sequence
  Synthetic Polynucleotide
taatacgactcactatagggatgaggttagcttggtggcagaagggcgggaacagaggagacccgccatgctgccaccaaacctggcggcagcgcaaaagatg

SEQ ID NO: 126261 - DNA, 103 bp, Artificial Sequence
  Synthetic Polynucleotide
taatacgactcactatagggggtgcccgaggcagggggccatccccacggaacagaggagaccgtggatgtggccccctaacctggcggcagcgcaaaagatg

SEQ ID NO: 126262 - DNA, 103 bp, Artificial Sequence
  Synthetic Polynucleotide
taatacgactcactatagggagaaatggatggtgcccgaggcagggggccaacagaggagaggccccatgcctcgggcaaacctggcggcagcgcaaaagatg

SEQ ID NO: 126263 - DNA, 103 bp, Artificial Sequence
  Synthetic Polynucleotide
taatacgactcactataggggctccactgtagaaatggatggtgcccgagaacagaggagactcgggatgcatccatttaacctggcggcagcgcaaaagatg

SEQ ID NO: 126264 - DNA, 103 bp, Artificial Sequence
  Synthetic Polynucleotide
taatacgactcactatagggtccctcttgggctccactgtagaaatggataacagaggagaatccatatgtacagtggaaacctggcggcagcgcaaaagatg

SEQ ID NO: 126265 - DNA, 103 bp, Artificial Sequence
  Synthetic Polynucleotide
taatacgactcactatagggtccttcccgctccctcttgggctccactgtaacagaggagaacagtgatgcccaagaggaacctggcggcagcgcaaaagatg

SEQ ID NO: 126266 - DNA, 103 bp, Artificial Sequence
  Synthetic Polynucleotide
taatacgactcactatagggtgatgggacctccttcccgctccctcttggaacagaggagaccaagaatgagcgggaagaacctggcggcagcgcaaaagatg

SEQ ID NO: 126267 - DNA, 103 bp, Artificial Sequence
  Synthetic Polynucleotide
taatacgactcactatagggctttcctccctgatgggacctccttcccgcaacagaggagagcgggaatgaggtcccataacctggcggcagcgcaaaagatg

SEQ ID NO: 126268 - DNA, 103 bp, Artificial Sequence
  Synthetic Polynucleotide
taatacgactcactatagggagtcagtctgctttcctccctgatgggaccaacagaggagaggtcccatgagggaggaaaacctggcggcagcgcaaaagatg

SEQ ID NO: 126269 - DNA, 103 bp, Artificial Sequence
  Synthetic Polynucleotide
taatacgactcactatagggcctctggcacagtcagtctgctttcctcccaacagaggagagggaggatggcagactgaaacctggcggcagcgcaaaagatg

SEQ ID NO: 126270 - DNA, 103 bp, Artificial Sequence
  Synthetic Polynucleotide
taatacgactcactatagggttcatggcaccctctggcacagtcagtctgaacagaggagacagactatgtgtgccagaaacctggcggcagcgcaaaagatg

SEQ ID NO: 126271 - DNA, 103 bp, Artificial Sequence
  Synthetic Polynucleotide
taatacgactcactatagggggggccggacatgaggttagcttggtggcaaacagaggagatgccacatggctaacctcaacctggcggcagcgcaaaagatg

SEQ ID NO: 126272 - DNA, 103 bp, Artificial Sequence
  Synthetic Polynucleotide
taatacgactcactatagggtggctgtggcttcatggcaccctctggcacaacagaggagagtgccaatgggtgccatgaacctggcggcagcgcaaaagatg

SEQ ID NO: 126273 - DNA, 103 bp, Artificial Sequence
  Synthetic Polynucleotide
taatacgactcactatagggccccagggcttggctgtggcttcatggcacaacagaggagagtgccaatgagccacagcaacctggcggcagcgcaaaagatg

SEQ ID NO: 126274 - DNA, 103 bp, Artificial Sequence
  Synthetic Polynucleotide
taatacgactcactataggggatgactgggccccagggcttggctgtggcaacagaggagagccacaatgaagccctggaacctggcggcagcgcaaaagatg

SEQ ID NO: 126275 - DNA, 103 bp, Artificial Sequence
  Synthetic Polynucleotide
taatacgactcactatagggactgctgcaggatgactgggccccagggctaacagaggagaagccctatggcccagtcaaacctggcggcagcgcaaaagatg

SEQ ID NO: 126276 - DNA, 103 bp, Artificial Sequence
  Synthetic Polynucleotide
taatacgactcactataggggggagtggtcactgctgcaggatgactgggaacagaggagacccagtatgcctgcagcaaacctggcggcagcgcaaaagatg

SEQ ID NO: 126277 - DNA, 103 bp, Artificial Sequence
  Synthetic Polynucleotide
taatacgactcactatagggctccctgccggggagtggtcactgctgcagaacagaggagactgcagatgtgaccactcaacctggcggcagcgcaaaagatg

SEQ ID NO: 126278 - DNA, 103 bp, Artificial Sequence
  Synthetic Polynucleotide
taatacgactcactatagggattggctgcactccctgccggggagtggtcaacagaggagagaccacatgccggcagggaacctggcggcagcgcaaaagatg

SEQ ID NO: 126279 - DNA, 103 bp, Artificial Sequence
  Synthetic Polynucleotide
taatacgactcactatagggcactgtctgtattggctgcactccctgccgaacagaggagacggcagatggtgcagccaaacctggcggcagcgcaaaagatg

SEQ ID NO: 126280 - DNA, 103 bp, Artificial Sequence
  Synthetic Polynucleotide
taatacgactcactatagggatttccacaccactgtctgtattggctgcaaacagaggagatgcagcatgtacagacagaacctggcggcagcgcaaaagatg

SEQ ID NO: 126281 - DNA, 103 bp, Artificial Sequence
  Synthetic Polynucleotide
taatacgactcactatagggattgccagtcatttccacaccactgtctgtaacagaggagaacagacatgggtgtggaaaacctggcggcagcgcaaaagatg

SEQ ID NO: 126282 - DNA, 103 bp, Artificial Sequence
  Synthetic Polynucleotide
taatacgactcactatagggcataactgtgggggccggacatgaggttagaacagaggagactaaccatgtgtccggccaacctggcggcagcgcaaaagatg

SEQ ID NO: 126283 - DNA, 103 bp, Artificial Sequence
  Synthetic Polynucleotide
taatacgactcactatagggtgccccctgcattgccagtcatttccacacaacagaggagagtgtggatgtgactggcaaacctggcggcagcgcaaaagatg

SEQ ID NO: 126284 - DNA, 103 bp, Artificial Sequence
  Synthetic Polynucleotide
taatacgactcactatagggtcttcagtgctgccccctgcattgccagtcaacagaggagagactggatgtgcagggggaacctggcggcagcgcaaaagatg

SEQ ID NO: 126285 - DNA, 103 bp, Artificial Sequence
  Synthetic Polynucleotide
taatacgactcactataggggctggagaggtcttcagtgctgccccctgcaacagaggagagcagggatgagcactgaaaacctggcggcagcgcaaaagatg

SEQ ID NO: 126286 - DNA, 103 bp, Artificial Sequence
  Synthetic Polynucleotide
taatacgactcactatagggcctcgtccaagctggagaggtcttcagtgcaacagaggagagcactgatgacctctccaaacctggcggcagcgcaaaagatg

SEQ ID NO: 126287 - DNA, 103 bp, Artificial Sequence
  Synthetic Polynucleotide
taatacgactcactatagggatgcaaggtccctcgtccaagctggagaggaacagaggagacctctcatgcttggacgaaacctggcggcagcgcaaaagatg

SEQ ID NO: 126288 - DNA, 103 bp, Artificial Sequence
  Synthetic Polynucleotide
taatacgactcactatagggagtgccagcaatgcaaggtccctcgtccaaaacagaggagattggacatgggaccttgcaacctggcggcagcgcaaaagatg

SEQ ID NO: 126289 - DNA, 103 bp, Artificial Sequence
  Synthetic Polynucleotide
taatacgactcactatagggtggacagaccagtgccagcaatgcaaggtcaacagaggagagaccttatgttgctggcaaacctggcggcagcgcaaaagatg

SEQ ID NO: 126290 - DNA, 103 bp, Artificial Sequence
  Synthetic Polynucleotide
taatacgactcactatagggcggcgaagagtggacagaccagtgccagcaaacagaggagatgctggatgtggtctgtcaacctggcggcagcgcaaaagatg

SEQ ID NO: 126291 - DNA, 103 bp, Artificial Sequence
  Synthetic Polynucleotide
taatacgactcactataggggttctcaaggcggcgaagagtggacagaccaacagaggagaggtctgatgactcttcgcaacctggcggcagcgcaaaagatg

SEQ ID NO: 126292 - DNA, 103 bp, Artificial Sequence
  Synthetic Polynucleotide
taatacgactcactatagggccagcctgaggttctcaaggcggcgaagagaacagaggagactcttcatggccttgagaaacctggcggcagcgcaaaagatg

SEQ ID NO: 126293 - DNA, 103 bp, Artificial Sequence
  Synthetic Polynucleotide
taatacgactcactatagggctggctggcccataactgtgggggccggacaacagaggagagtccggatgccacagttaaacctggcggcagcgcaaaagatg

SEQ ID NO: 126294 - DNA, 103 bp, Artificial Sequence
  Synthetic Polynucleotide
taatacgactcactatagggtgtagctggtccagcctgaggttctcaaggaacagaggagaccttgaatgcctcaggctaacctggcggcagcgcaaaagatg

SEQ ID NO: 126295 - DNA, 103 bp, Artificial Sequence
  Synthetic Polynucleotide
taatacgactcactatagggccggagttgatgtagctggtccagcctgagaacagaggagactcaggatggaccagctaaacctggcggcagcgcaaaagatg

SEQ ID NO: 126296 - DNA, 103 bp, Artificial Sequence
  Synthetic Polynucleotide
taatacgactcactatagggtccctattggccggagttgatgtagctggtaacagaggagaaccagcatgatcaactccaacctggcggcagcgcaaaagatg

SEQ ID NO: 126297 - DNA, 103 bp, Artificial Sequence
  Synthetic Polynucleotide
taatacgactcactatagggagaccccgggtccctattggccggagttgaaacagaggagatcaactatggccaataggaacctggcggcagcgcaaaagatg

SEQ ID NO: 126298 - DNA, 103 bp, Artificial Sequence
  Synthetic Polynucleotide
taatacgactcactataggggggcagtttgagaccccgggtccctattggaacagaggagaccaataatgacccggggtaacctggcggcagcgcaaaagatg

SEQ ID NO: 126299 - DNA, 103 bp, Artificial Sequence
  Synthetic Polynucleotide
taatacgactcactataggggggacaagctgggcagtttgagaccccgggaacagaggagacccgggatgtcaaactgcaacctggcggcagcgcaaaagatg

SEQ ID NO: 126300 - DNA, 103 bp, Artificial Sequence
  Synthetic Polynucleotide
taatacgactcactataggggtaccggtgtgggacaagctgggcagtttgaacagaggagacaaactatgcagcttgtcaacctggcggcagcgcaaaagatg

SEQ ID NO: 126301 - DNA, 103 bp, Artificial Sequence
  Synthetic Polynucleotide
taatacgactcactatagggggacacagtggtaccggtgtgggacaagctaacagaggagaagcttgatgcacaccggtaacctggcggcagcgcaaaagatg

SEQ ID NO: 126302 - DNA, 103 bp, Artificial Sequence
  Synthetic Polynucleotide
taatacgactcactatagggccacgcggcgggacacagtggtaccggtgtaacagaggagaacaccgatgccactgtgtaacctggcggcagcgcaaaagatg

SEQ ID NO: 126303 - DNA, 103 bp, Artificial Sequence
  Synthetic Polynucleotide
taatacgactcactatagggactggggggcccacgcggcgggacacagtgaacagaggagacactgtatgccgccgcgtaacctggcggcagcgcaaaagatg

SEQ ID NO: 126304 - DNA, 103 bp, Artificial Sequence
  Synthetic Polynucleotide
taatacgactcactataggggttggtctctctggctggcccataactgtgaacagaggagacacagtatggggccagccaacctggcggcagcgcaaaagatg

SEQ ID NO: 126305 - DNA, 103 bp, Artificial Sequence
  Synthetic Polynucleotide
taatacgactcactatagggttcaagagagactggggggcccacgcggcgaacagaggagacgccgcatgggccccccaaacctggcggcagcgcaaaagatg

SEQ ID NO: 126306 - DNA, 103 bp, Artificial Sequence
  Synthetic Polynucleotide
taatacgactcactatagggtgctgcggcgttcaagagagactggggggcaacagaggagagcccccatgtctctcttgaacctggcggcagcgcaaaagatg

SEQ ID NO: 126307 - DNA, 103 bp, Artificial Sequence
  Synthetic Polynucleotide
taatacgactcactatagggctggagctgctgctgcggcgttcaagagagaacagaggagactctctatgacgccgcagaacctggcggcagcgcaaaagatg

SEQ ID NO: 126308 - DNA, 103 bp, Artificial Sequence
  Synthetic Polynucleotide
taatacgactcactataggggctgatgctgctggagctgctgctgcggcgaacagaggagacgccgcatgagcagctccaacctggcggcagcgcaaaagatg

SEQ ID NO: 126309 - DNA, 103 bp, Artificial Sequence
  Synthetic Polynucleotide
taatacgactcactatagggtataggcagagctgatgctgctggagctgcaacagaggagagcagctatggcagcatcaaacctggcggcagcgcaaaagatg

SEQ ID NO: 126310 - DNA, 103 bp, Artificial Sequence
  Synthetic Polynucleotide
taatacgactcactatagggcggctgacagtataggcagagctgatgctgaacagaggagacagcatatgctctgcctaaacctggcggcagcgcaaaagatg

SEQ ID NO: 126311 - DNA, 103 bp, Artificial Sequence
  Synthetic Polynucleotide
taatacgactcactatagggggaggagcggcggctgacagtataggcagaaacagaggagatctgccatgactgtcagcaacctggcggcagcgcaaaagatg

SEQ ID NO: 126312 - DNA, 103 bp, Artificial Sequence
  Synthetic Polynucleotide
taatacgactcactataggggagaggccagggaggagcggcggctgacagaacagaggagactgtcaatggccgctcctaacctggcggcagcgcaaaagatg

SEQ ID NO: 126313 - DNA, 103 bp, Artificial Sequence
  Synthetic Polynucleotide
taatacgactcactatagggggggggaaaggagaggccagggaggagcggaacagaggagaccgctcatgcctggcctcaacctggcggcagcgcaaaagatg

SEQ ID NO: 126314 - DNA, 103 bp, Artificial Sequence
  Synthetic Polynucleotide
taatacgactcactatagggtggggagccaggggggaaaggagaggccagaacagaggagactggccatgcctttccccaacctggcggcagcgcaaaagatg

SEQ ID NO: 126315 - DNA, 103 bp, Artificial Sequence
  Synthetic Polynucleotide
taatacgactcactatagggcggtgcagctgttggtctctctggctggccaacagaggagaggccagatggagagaccaaacctggcggcagcgcaaaagatg

SEQ ID NO: 126316 - DNA, 103 bp, Artificial Sequence
  Synthetic Polynucleotide
taatacgactcactatagggcattctctggtggggagccaggggggaaagaacagaggagactttccatgctggctcccaacctggcggcagcgcaaaagatg

SEQ ID NO: 126317 - DNA, 103 bp, Artificial Sequence
  Synthetic Polynucleotide
taatacgactcactataggggaggatgctccattctctggtggggagccaaacagaggagatggctcatgaccagagaaaacctggcggcagcgcaaaagatg

SEQ ID NO: 126318 - DNA, 103 bp, Artificial Sequence
  Synthetic Polynucleotide
taatacgactcactataggggccaggcagggaggatgctccattctctggaacagaggagaccagagatgggagcatccaacctggcggcagcgcaaaagatg

SEQ ID NO: 126319 - DNA, 103 bp, Artificial Sequence
  Synthetic Polynucleotide
taatacgactcactatagggcaggcataaggccaggcagggaggatgctcaacagaggagagagcatatgccctgcctgaacctggcggcagcgcaaaagatg

SEQ ID NO: 126320 - DNA, 103 bp, Artificial Sequence
  Synthetic Polynucleotide
taatacgactcactatagggtagtgctgggcaggcataaggccaggcaggaacagaggagacctgccatgccttatgccaacctggcggcagcgcaaaagatg

SEQ ID NO: 126321 - DNA, 103 bp, Artificial Sequence
  Synthetic Polynucleotide
taatacgactcactatagggccgaagcaggtagtgctgggcaggcataagaacagaggagacttatgatggcccagcacaacctggcggcagcgcaaaagatg

SEQ ID NO: 126322 - DNA, 103 bp, Artificial Sequence
  Synthetic Polynucleotide
taatacgactcactatagggcatatcttgcccgaagcaggtagtgctgggaacagaggagacccagcatgacctgcttcaacctggcggcagcgcaaaagatg

SEQ ID NO: 126323 - DNA, 103 bp, Artificial Sequence
  Synthetic Polynucleotide
taatacgactcactatagggctggctgaagcatatcttgcccgaagcaggaacagaggagacctgctatgggcaagataaacctggcggcagcgcaaaagatg

SEQ ID NO: 126324 - DNA, 103 bp, Artificial Sequence
  Synthetic Polynucleotide
taatacgactcactatagggaccaccccctctggctgaagcatatcttgcaacagaggagagcaagaatggcttcagccaacctggcggcagcgcaaaagatg

SEQ ID NO: 126325 - DNA, 103 bp, Artificial Sequence
  Synthetic Polynucleotide
taatacgactcactatagggtgggcgaagtaccaccccctctggctgaagaacagaggagacttcagatggagggggtgaacctggcggcagcgcaaaagatg

SEQ ID NO: 126326 - DNA, 103 bp, Artificial Sequence
  Synthetic Polynucleotide
taatacgactcactatagggagtgggccctcggtgcagctgttggtctctaacagaggagaagagacatgcagctgcacaacctggcggcagcgcaaaagatg

SEQ ID NO: 126327 - DNA, 103 bp, Artificial Sequence
  Synthetic Polynucleotide
taatacgactcactataggggatgctgcagtgggcgaagtaccaccccctaacagaggagaagggggatgtacttcgccaacctggcggcagcgcaaaagatg

SEQ ID NO: 126328 - DNA, 103 bp, Artificial Sequence
  Synthetic Polynucleotide
taatacgactcactatagggatccaggctggatgctgcagtgggcgaagtaacagaggagaacttcgatgactgcagcaaacctggcggcagcgcaaaagatg

SEQ ID NO: 126329 - DNA, 103 bp, Artificial Sequence
  Synthetic Polynucleotide
taatacgactcactatagggcacctatccgatccaggctggatgctgcagaacagaggagactgcagatgccagcctggaacctggcggcagcgcaaaagatg

SEQ ID NO: 126330 - DNA, 103 bp, Artificial Sequence
  Synthetic Polynucleotide
taatacgactcactatagggatgggaagaccacctatccgatccaggctgaacagaggagacagcctatgtcggataggaacctggcggcagcgcaaaagatg

SEQ ID NO: 126331 - DNA, 103 bp, Artificial Sequence
  Synthetic Polynucleotide
taatacgactcactatagggccaaggaggcatgggaagaccacctatccgaacagaggagacggataatgggtcttcccaacctggcggcagcgcaaaagatg

SEQ ID NO: 126332 - DNA, 103 bp, Artificial Sequence
  Synthetic Polynucleotide
taatacgactcactatagggctcggcttctccaaggaggcatgggaagacaacagaggagagtcttcatgtgcctccttaacctggcggcagcgcaaaagatg

SEQ ID NO: 126333 - DNA, 103 bp, Artificial Sequence
  Synthetic Polynucleotide
taatacgactcactatagggggatactcggctcggcttctccaaggaggcaacagaggagagcctccatggagaagccgaacctggcggcagcgcaaaagatg

SEQ ID NO: 126334 - DNA, 103 bp, Artificial Sequence
  Synthetic Polynucleotide
taatacgactcactataggggttgtatcctggatactcggctcggcttctaacagaggagaagaagcatggccgagtataacctggcggcagcgcaaaagatg

SEQ ID NO: 126335 - DNA, 103 bp, Artificial Sequence
  Synthetic Polynucleotide
taatacgactcactatagggctgcattggggttgtatcctggatactcggaacagaggagaccgagtatgcaggatacaaacctggcggcagcgcaaaagatg

SEQ ID NO: 126336 - DNA, 103 bp, Artificial Sequence
  Synthetic Polynucleotide
taatacgactcactatagggcgggtgacccctgcattggggttgtatcctaacagaggagaaggataatgccccaatgcaacctggcggcagcgcaaaagatg

SEQ ID NO: 126337 - DNA, 103 bp, Artificial Sequence
  Synthetic Polynucleotide
taatacgactcactatagggagaagaaaagagtgggccctcggtgcagctaacagaggagaagctgcatggagggcccaaacctggcggcagcgcaaaagatg

SEQ ID NO: 126338 - DNA, 103 bp, Artificial Sequence
  Synthetic Polynucleotide
taatacgactcactatagggactggccctccgggtgacccctgcattgggaacagaggagacccaatatgggggtcaccaacctggcggcagcgcaaaagatg

SEQ ID NO: 126339 - DNA, 103 bp, Artificial Sequence
  Synthetic Polynucleotide
taatacgactcactataggggggctgggtcactggccctccgggtgacccaacagaggagagggtcaatgggagggccaaacctggcggcagcgcaaaagatg

SEQ ID NO: 126340 - DNA, 103 bp, Artificial Sequence
  Synthetic Polynucleotide
taatacgactcactatagggtcagcagcctgggctgggtcactggccctcaacagaggagagagggcatgtgacccagcaacctggcggcagcgcaaaagatg

SEQ ID NO: 126341 - DNA, 103 bp, Artificial Sequence
  Synthetic Polynucleotide
taatacgactcactatagggagcaggacggtcagcagcctgggctgggtcaacagaggagagacccaatgcaggctgctaacctggcggcagcgcaaaagatg

SEQ ID NO: 126342 - DNA, 103 bp, Artificial Sequence
  Synthetic Polynucleotide
taatacgactcactatagggctctagctggagcaggacggtcagcagcctaacagaggagaaggctgatgaccgtcctgaacctggcggcagcgcaaaagatg

SEQ ID NO: 126343 - DNA, 103 bp, Artificial Sequence
  Synthetic Polynucleotide
taatacgactcactatagggaacctctggactctagctggagcaggacggaacagaggagaccgtccatgtccagctagaacctggcggcagcgcaaaagatg

SEQ ID NO: 126344 - DNA, 103 bp, Artificial Sequence
  Synthetic Polynucleotide
taatacgactcactatagggcaggctcttgaacctctggactctagctggaacagaggagaccagctatggtccagaggaacctggcggcagcgcaaaagatg

SEQ ID NO: 126345 - DNA, 103 bp, Artificial Sequence
  Synthetic Polynucleotide
taatacgactcactatagggggacacagcccaggctcttgaacctctggaaacagaggagatccagaatgtcaagagccaacctggcggcagcgcaaaagatg

SEQ ID NO: 126346 - DNA, 103 bp, Artificial Sequence
  Synthetic Polynucleotide
taatacgactcactatagggggtggggtatggacacagcccaggctcttgaacagaggagacaagagatggggctgtgtaacctggcggcagcgcaaaagatg

SEQ ID NO: 126347 - DNA, 103 bp, Artificial Sequence
  Synthetic Polynucleotide
taatacgactcactatagggtgccacagtgggtggggtatggacacagccaacagaggagaggctgtatgcataccccaaacctggcggcagcgcaaaagatg

SEQ ID NO: 126348 - DNA, 103 bp, Artificial Sequence
  Synthetic Polynucleotide
taatacgactcactatagggcatagctactgattggtggtggggtcatcgaacagaggagacgatgaatgcaccaccaaaacctggcggcagcgcaaaagatg

SEQ ID NO: 126349 - DNA, 103 bp, Artificial Sequence
  Synthetic Polynucleotide
taatacgactcactatagggcactccggggagaagaaaagagtgggccctaacagaggagaagggccatgtcttttcttaacctggcggcagcgcaaaagatg

SEQ ID NO: 126350 - DNA, 103 bp, Artificial Sequence
  Synthetic Polynucleotide
taatacgactcactataggggtcctccccctgccacagtgggtggggtataacagaggagaatacccatgccactgtggaacctggcggcagcgcaaaagatg

SEQ ID NO: 126351 - DNA, 103 bp, Artificial Sequence
  Synthetic Polynucleotide
taatacgactcactatagggtcaaagttctgtcctccccctgccacagtgaacagaggagacactgtatgagggggaggaacctggcggcagcgcaaaagatg

SEQ ID NO: 126352 - DNA, 103 bp, Artificial Sequence
  Synthetic Polynucleotide
taatacgactcactataggggaggtaaggatcaaagttctgtcctcccccaacagaggagagggggaatgcagaactttaacctggcggcagcgcaaaagatg

SEQ ID NO: 126353 - DNA, 103 bp, Artificial Sequence
  Synthetic Polynucleotide
taatacgactcactatagggcagaggttgggaggtaaggatcaaagttctaacagaggagaagaactatgatccttaccaacctggcggcagcgcaaaagatg

SEQ ID NO: 126354 - DNA, 103 bp, Artificial Sequence
  Synthetic Polynucleotide
taatacgactcactatagggggtgagtagacagaggttgggaggtaaggaaacagaggagatccttaatgcccaacctcaacctggcggcagcgcaaaagatg

SEQ ID NO: 126355 - DNA, 103 bp, Artificial Sequence
  Synthetic Polynucleotide
taatacgactcactatagggggggggctgtggtgagtagacagaggttggaacagaggagaccaaccatggtctactcaaacctggcggcagcgcaaaagatg

SEQ ID NO: 126356 - DNA, 103 bp, Artificial Sequence
  Synthetic Polynucleotide
taatacgactcactatagggcagtgatgctggggggctgtggtgagtagaaacagaggagatctactatgcacagccccaacctggcggcagcgcaaaagatg

SEQ ID NO: 126357 - DNA, 103 bp, Artificial Sequence
  Synthetic Polynucleotide
taatacgactcactataggggcagcattctcagtgatgctggggggctgtaacagaggagaacagccatgcagcatcacaacctggcggcagcgcaaaagatg

SEQ ID NO: 126358 - DNA, 103 bp, Artificial Sequence
  Synthetic Polynucleotide
taatacgactcactatagggagcatccatggcagcattctcagtgatgctaacagaggagaagcatcatggagaatgctaacctggcggcagcgcaaaagatg

SEQ ID NO: 126359 - DNA, 103 bp, Artificial Sequence
  Synthetic Polynucleotide
taatacgactcactataggggtagccctctagcatccatggcagcattctaacagaggagaagaatgatgccatggatgaacctggcggcagcgcaaaagatg

SEQ ID NO: 126360 - DNA, 103 bp, Artificial Sequence
  Synthetic Polynucleotide
taatacgactcactatagggaacttgactgcactccggggagaagaaaagaacagaggagacttttcatgtccccggagaacctggcggcagcgcaaaagatg

SEQ ID NO: 126361 - DNA, 103 bp, Artificial Sequence
  Synthetic Polynucleotide
taatacgactcactatagggggctcttcctgtagccctctagcatccatgaacagaggagacatggaatgtagagggctaacctggcggcagcgcaaaagatg

SEQ ID NO: 126362 - DNA, 103 bp, Artificial Sequence
  Synthetic Polynucleotide
taatacgactcactatagggcccaacttctggctcttcctgtagccctctaacagaggagaagagggatgcaggaagagaacctggcggcagcgcaaaagatg

SEQ ID NO: 126363 - DNA, 103 bp, Artificial Sequence
  Synthetic Polynucleotide
taatacgactcactatagggccatggaggtcccaacttctggctcttcctaacagaggagaaggaagatgcagaagttgaacctggcggcagcgcaaaagatg

SEQ ID NO: 126364 - DNA, 103 bp, Artificial Sequence
  Synthetic Polynucleotide
taatacgactcactatagggccactgcccaccatggaggtcccaacttctaacagaggagaagaagtatggacctccataacctggcggcagcgcaaaagatg

SEQ ID NO: 126365 - DNA, 103 bp, Artificial Sequence
  Synthetic Polynucleotide
taatacgactcactatagggggggttcagaccactgcccaccatggaggtaacagaggagaacctccatggtgggcagtaacctggcggcagcgcaaaagatg

SEQ ID NO: 126366 - DNA, 103 bp, Artificial Sequence
  Synthetic Polynucleotide
taatacgactcactatagggagtccatataggggttcagaccactgcccaaacagaggagatgggcaatggtctgaaccaacctggcggcagcgcaaaagatg

SEQ ID NO: 126367 - DNA, 103 bp, Artificial Sequence
  Synthetic Polynucleotide
taatacgactcactataggggtaggtgggaagtccatataggggttcagaaacagaggagatctgaaatgctatatggaaacctggcggcagcgcaaaagatg

SEQ ID NO: 126368 - DNA, 103 bp, Artificial Sequence
  Synthetic Polynucleotide
taatacgactcactatagggcagagtatcagtaggtgggaagtccatataaacagaggagatatatgatgttcccacctaacctggcggcagcgcaaaagatg

SEQ ID NO: 126369 - DNA, 103 bp, Artificial Sequence
  Synthetic Polynucleotide
taatacgactcactatagggccccatatcccagagtatcagtaggtgggaaacagaggagatcccacatgctgatactcaacctggcggcagcgcaaaagatg

SEQ ID NO: 126370 - DNA, 103 bp, Artificial Sequence
  Synthetic Polynucleotide
taatacgactcactatagggccttcaggtcccccatatcccagagtatcaaacagaggagatgatacatggggatatggaacctggcggcagcgcaaaagatg

SEQ ID NO: 126371 - DNA, 103 bp, Artificial Sequence
  Synthetic Polynucleotide
taatacgactcactatagggcttcttggtcaacttgactgcactccggggaacagaggagaccccggatggcagtcaagaacctggcggcagcgcaaaagatg

SEQ ID NO: 126372 - DNA, 103 bp, Artificial Sequence
  Synthetic Polynucleotide
taatacgactcactatagggagctgctgccccttcaggtcccccatatccaacagaggagaggatatatgggacctgaaaacctggcggcagcgcaaaagatg

SEQ ID NO: 126373 - DNA, 103 bp, Artificial Sequence
  Synthetic Polynucleotide
taatacgactcactatagggcataaggctcagctgctgccccttcaggtcaacagaggagagacctgatggggcagcagaacctggcggcagcgcaaaagatg

SEQ ID NO: 126374 - DNA, 103 bp, Artificial Sequence
  Synthetic Polynucleotide
taatacgactcactatagggcccctcgctccataaggctcagctgctgccaacagaggagaggcagcatgtgagccttaaacctggcggcagcgcaaaagatg

SEQ ID NO: 126375 - DNA, 103 bp, Artificial Sequence
  Synthetic Polynucleotide
taatacgactcactatagggagagcctggacccctcgctccataaggctcaacagaggagagagcctatgggagcgaggaacctggcggcagcgcaaaagatg

SEQ ID NO: 126376 - DNA, 103 bp, Artificial Sequence
  Synthetic Polynucleotide
taatacgactcactatagggcaagaggcagagagcctggacccctcgctcaacagaggagagagcgaatggtccaggctaacctggcggcagcgcaaaagatg

SEQ ID NO: 126377 - DNA, 103 bp, Artificial Sequence
  Synthetic Polynucleotide
taatacgactcactatagggggaccaggcccaagaggcagagagcctggaaacagaggagatccaggatgtctgcctctaacctggcggcagcgcaaaagatg

SEQ ID NO: 126378 - DNA, 103 bp, Artificial Sequence
  Synthetic Polynucleotide
taatacgactcactataggggttggtgggtggaccaggcccaagaggcagaacagaggagactgcctatggggcctggtaacctggcggcagcgcaaaagatg

SEQ ID NO: 126379 - DNA, 103 bp, Artificial Sequence
  Synthetic Polynucleotide
taatacgactcactatagggtggggccatagttggtgggtggaccaggccaacagaggagaggcctgatgcacccaccaaacctggcggcagcgcaaaagatg

SEQ ID NO: 126380 - DNA, 103 bp, Artificial Sequence
  Synthetic Polynucleotide
taatacgactcactatagggggacaggggttggggccatagttggtgggtaacagaggagaacccacatgctatggcccaacctggcggcagcgcaaaagatg

SEQ ID NO: 126381 - DNA, 103 bp, Artificial Sequence
  Synthetic Polynucleotide
taatacgactcactatagggggcctgctggggacaggggttggggccataaacagaggagatatggcatgaacccctgtaacctggcggcagcgcaaaagatg

SEQ ID NO: 126382 - DNA, 103 bp, Artificial Sequence
  Synthetic Polynucleotide
taatacgactcactatagggacagtgcccgcttcttggtcaacttgactgaacagaggagacagtcaatgtgaccaagaaacctggcggcagcgcaaaagatg

SEQ ID NO: 126383 - DNA, 103 bp, Artificial Sequence
  Synthetic Polynucleotide
taatacgactcactatagggcaggatatgaggcctgctggggacaggggtaacagaggagaacccctatgcccagcaggaacctggcggcagcgcaaaagatg

SEQ ID NO: 126384 - DNA, 103 bp, Artificial Sequence
  Synthetic Polynucleotide
taatacgactcactatagggtgggtggggtcaggatatgaggcctgctggaacagaggagaccagcaatgctcatatccaacctggcggcagcgcaaaagatg

SEQ ID NO: 126385 - DNA, 103 bp, Artificial Sequence
  Synthetic Polynucleotide
taatacgactcactatagggccatgtttcttgggtggggtcaggatatgaaacagaggagatcatatatggaccccaccaacctggcggcagcgcaaaagatg

SEQ ID NO: 126386 - DNA, 103 bp, Artificial Sequence
  Synthetic Polynucleotide
taatacgactcactatagggggaactcaccccatgtttcttgggtggggtaacagaggagaaccccaatgaagaaacataacctggcggcagcgcaaaagatg

SEQ ID NO: 126387 - DNA, 103 bp, Artificial Sequence
  Synthetic Polynucleotide
taatacgactcactataggggagtgggaagggaactcaccccatgtttctaacagaggagaagaaacatggggtgagttaacctggcggcagcgcaaaagatg

SEQ ID NO: 126388 - DNA, 103 bp, Artificial Sequence
  Synthetic Polynucleotide
taatacgactcactataggggtacagcccagagtgggaagggaactcaccaacagaggagaggtgagatgccttcccacaacctggcggcagcgcaaaagatg

SEQ ID NO: 126389 - DNA, 103 bp, Artificial Sequence
  Synthetic Polynucleotide
taatacgactcactatagggtggggcctgggtacagcccagagtgggaagaacagaggagacttcccatgctgggctgtaacctggcggcagcgcaaaagatg

SEQ ID NO: 126390 - DNA, 103 bp, Artificial Sequence
  Synthetic Polynucleotide
taatacgactcactatagggcctagagccttggggcctgggtacagcccaaacagaggagatgggctatgcccaggcccaacctggcggcagcgcaaaagatg

SEQ ID NO: 126391 - DNA, 103 bp, Artificial Sequence
  Synthetic Polynucleotide
taatacgactcactataggggtaggttccacctagagccttggggcctggaacagaggagaccaggcatgaaggctctaaacctggcggcagcgcaaaagatg

SEQ ID NO: 126392 - DNA, 103 bp, Artificial Sequence
  Synthetic Polynucleotide
taatacgactcactataggggacactggctgtaggttccacctagagcctaacagaggagaaggctcatggtggaacctaacctggcggcagcgcaaaagatg

SEQ ID NO: 126393 - DNA, 103 bp, Artificial Sequence
  Synthetic Polynucleotide
taatacgactcactatagggggtgagatggacagtgcccgcttcttggtcaacagaggagagaccaaatggcgggcactaacctggcggcagcgcaaaagatg

SEQ ID NO: 126394 - DNA, 103 bp, Artificial Sequence
  Synthetic Polynucleotide
taatacgactcactatagggtcaagtcgaggacactggctgtaggttccaaacagaggagatggaacatgcagccagtgaacctggcggcagcgcaaaagatg

SEQ ID NO: 126395 - DNA, 103 bp, Artificial Sequence
  Synthetic Polynucleotide
taatacgactcactatagggtccataatgttcaagtcgaggacactggctaacagaggagaagccagatgcctcgacttaacctggcggcagcgcaaaagatg

SEQ ID NO: 126396 - DNA, 103 bp, Artificial Sequence
  Synthetic Polynucleotide
taatacgactcactatagggcttgcacttgtccataatgttcaagtcgagaacagaggagactcgacatgaacattatgaacctggcggcagcgcaaaagatg

SEQ ID NO: 126397 - DNA, 103 bp, Artificial Sequence
  Synthetic Polynucleotide
taatacgactcactatagggtctggcttgacttgcacttgtccataatgtaacagaggagaacattaatgacaagtgcaaacctggcggcagcgcaaaagatg

SEQ ID NO: 126398 - DNA, 103 bp, Artificial Sequence
  Synthetic Polynucleotide
taatacgactcactataggggcacccctgttctggcttgacttgcacttgaacagaggagacaagtgatggtcaagccaaacctggcggcagcgcaaaagatg

SEQ ID NO: 126399 - DNA, 103 bp, Artificial Sequence
  Synthetic Polynucleotide
taatacgactcactatagggaccccactgggcacccctgttctggcttgaaacagaggagatcaagcatgaacaggggtaacctggcggcagcgcaaaagatg

SEQ ID NO: 126400 - DNA, 103 bp, Artificial Sequence
  Synthetic Polynucleotide
taatacgactcactataggggtggagtcagaccccactgggcacccctgtaacagaggagaacagggatgcccagtgggaacctggcggcagcgcaaaagatg

SEQ ID NO: 126401 - DNA, 103 bp, Artificial Sequence
  Synthetic Polynucleotide
taatacgactcactatagggtgccagtcctgtggagtcagaccccactggaacagaggagaccagtgatgtctgactccaacctggcggcagcgcaaaagatg

SEQ ID NO: 126402 - DNA, 103 bp, Artificial Sequence
  Synthetic Polynucleotide
taatacgactcactatagggtgaggcagggtgccagtcctgtggagtcagaacagaggagactgactatgcaggactggaacctggcggcagcgcaaaagatg

SEQ ID NO: 126403 - DNA, 103 bp, Artificial Sequence
  Synthetic Polynucleotide
taatacgactcactataggggggtgggcattgaggcagggtgccagtcctaacagaggagaaggactatgaccctgcctaacctggcggcagcgcaaaagatg

SEQ ID NO: 126404 - DNA, 103 bp, Artificial Sequence
  Synthetic Polynucleotide
taatacgactcactatagggatccgacagaggtgagatggacagtgcccgaacagaggagacgggcaatgtccatctcaaacctggcggcagcgcaaaagatg

SEQ ID NO: 126405 - DNA, 103 bp, Artificial Sequence
  Synthetic Polynucleotide
taatacgactcactatagggcccctcactggggtgggcattgaggcagggaacagaggagaccctgcatgaatgcccacaacctggcggcagcgcaaaagatg

SEQ ID NO: 126406 - DNA, 103 bp, Artificial Sequence
  Synthetic Polynucleotide
taatacgactcactataggggatgtgggggcccctcactggggtgggcataacagaggagaatgcccatgccagtgaggaacctggcggcagcgcaaaagatg

SEQ ID NO: 126407 - DNA, 103 bp, Artificial Sequence
  Synthetic Polynucleotide
taatacgactcactatagggagaggctgtggatgtgggggcccctcactgaacagaggagacagtgaatggcccccacaaacctggcggcagcgcaaaagatg

SEQ ID NO: 126408 - DNA, 103 bp, Artificial Sequence
  Synthetic Polynucleotide
taatacgactcactatagggatgggaaaagagaggctgtggatgtgggggaacagaggagacccccaatgccacagcctaacctggcggcagcgcaaaagatg

SEQ ID NO: 126409 - DNA, 103 bp, Artificial Sequence
  Synthetic Polynucleotide
taatacgactcactataggggctgggggtaatgggaaaagagaggctgtgaacagaggagacacagcatgtcttttcccaacctggcggcagcgcaaaagatg

SEQ ID NO: 126410 - DNA, 103 bp, Artificial Sequence
  Synthetic Polynucleotide
taatacgactcactatagggggaggagagggctgggggtaatgggaaaagaacagaggagacttttcatgttacccccaaacctggcggcagcgcaaaagatg

SEQ ID NO: 126411 - DNA, 103 bp, Artificial Sequence
  Synthetic Polynucleotide
taatacgactcactataggggagatattggggaggagagggctgggggtaaacagaggagataccccatgccctctcctaacctggcggcagcgcaaaagatg

SEQ ID NO: 126412 - DNA, 103 bp, Artificial Sequence
  Synthetic Polynucleotide
taatacgactcactatagggggcctgactggagatattggggaggagaggaacagaggagacctctcatgcccaatatcaacctggcggcagcgcaaaagatg

SEQ ID NO: 126413 - DNA, 103 bp, Artificial Sequence
  Synthetic Polynucleotide
taatacgactcactatagggtgggtataggggcctgactggagatattggaacagaggagaccaataatgccagtcaggaacctggcggcagcgcaaaagatg

SEQ ID NO: 126414 - DNA, 103 bp, Artificial Sequence
  Synthetic Polynucleotide
taatacgactcactatagggagggggtggctgggtataggggcctgactgaacagaggagacagtcaatgccctataccaacctggcggcagcgcaaaagatg

SEQ ID NO: 126415 - DNA, 103 bp, Artificial Sequence
  Synthetic Polynucleotide
taatacgactcactatagggccaggctggcatccgacagaggtgagatggaacagaggagaccatctatgctctgtcggaacctggcggcagcgcaaaagatg

SEQ ID NO: 126416 - DNA, 103 bp, Artificial Sequence
  Synthetic Polynucleotide
taatacgactcactataggggaagataatcagggggtggctgggtataggaacagaggagacctataatgagccaccccaacctggcggcagcgcaaaagatg

SEQ ID NO: 126417 - DNA, 103 bp, Artificial Sequence
  Synthetic Polynucleotide
taatacgactcactatagggggttctgaaggaagataatcagggggtggcaacagaggagagccaccatgtgattatctaacctggcggcagcgcaaaagatg

SEQ ID NO: 126418 - DNA, 103 bp, Artificial Sequence
  Synthetic Polynucleotide
taatacgactcactataggggcaaggcctgggttctgaaggaagataatcaacagaggagagattatatgccttcagaaaacctggcggcagcgcaaaagatg

SEQ ID NO: 126419 - DNA, 103 bp, Artificial Sequence
  Synthetic Polynucleotide
taatacgactcactatagggcaaagtccaggcaaggcctgggttctgaagaacagaggagacttcagatgccaggccttaacctggcggcagcgcaaaagatg

SEQ ID NO: 126420 - DNA, 103 bp, Artificial Sequence
  Synthetic Polynucleotide
taatacgactcactataggggtgggggaatcaaagtccaggcaaggcctgaacagaggagacaggccatgcctggacttaacctggcggcagcgcaaaagatg

SEQ ID NO: 126421 - DNA, 103 bp, Artificial Sequence
  Synthetic Polynucleotide
taatacgactcactatagggtgtggaatgggtgggggaatcaaagtccagaacagaggagactggacatggattcccccaacctggcggcagcgcaaaagatg

SEQ ID NO: 126422 - DNA, 103 bp, Artificial Sequence
  Synthetic Polynucleotide
taatacgactcactatagggtgagctgccctgtggaatgggtgggggaataacagaggagaattcccatgcccattccaaacctggcggcagcgcaaaagatg

SEQ ID NO: 126423 - DNA, 103 bp, Artificial Sequence
  Synthetic Polynucleotide
taatacgactcactatagggagctgagccttgagctgccctgtggaatggaacagaggagaccattcatgagggcagctaacctggcggcagcgcaaaagatg

SEQ ID NO: 126424 - DNA, 103 bp, Artificial Sequence
  Synthetic Polynucleotide
taatacgactcactatagggattacacacaagctgagccttgagctgcccaacagaggagagggcagatgaaggctcagaacctggcggcagcgcaaaagatg

SEQ ID NO: 126425 - DNA, 103 bp, Artificial Sequence
  Synthetic Polynucleotide
taatacgactcactatagggattgaacataattacacacaagctgagcctaacagaggagaaggctcatgttgtgtgtaaacctggcggcagcgcaaaagatg

SEQ ID NO: 126426 - DNA, 103 bp, Artificial Sequence
  Synthetic Polynucleotide
taatacgactcactataggggtctgcaggtccaggctggcatccgacagaaacagaggagatctgtcatgtgccagcctaacctggcggcagcgcaaaagatg

SEQ ID NO: 126427 - DNA, 103 bp, Artificial Sequence
  Synthetic Polynucleotide
taatacgactcactatagggtcctgttgagattgaacataattacacacaaacagaggagatgtgtgatgttatgttcaaacctggcggcagcgcaaaagatg

SEQ ID NO: 126428 - DNA, 103 bp, Artificial Sequence
  Synthetic Polynucleotide
taatacgactcactatagggccacagtagctcctgttgagattgaacataaacagaggagatatgttatgtctcaacagaacctggcggcagcgcaaaagatg

SEQ ID NO: 126429 - DNA, 103 bp, Artificial Sequence
  Synthetic Polynucleotide
taatacgactcactatagggccccaccctcccacagtagctcctgttgagaacagaggagactcaacatgagctactgtaacctggcggcagcgcaaaagatg

SEQ ID NO: 126430 - DNA, 103 bp, Artificial Sequence
  Synthetic Polynucleotide
taatacgactcactatagggtcttccctgcccccaccctcccacagtagcaacagaggagagctactatgggagggtggaacctggcggcagcgcaaaagatg

SEQ ID NO: 126431 - DNA, 103 bp, Artificial Sequence
  Synthetic Polynucleotide
taatacgactcactatagggggcgggggcatcttccctgcccccaccctcaacagaggagagagggtatgggcagggaaaacctggcggcagcgcaaaagatg

SEQ ID NO: 126432 - DNA, 103 bp, Artificial Sequence
  Synthetic Polynucleotide
taatacgactcactatagggaaggttcctgggcgggggcatcttccctgcaacagaggagagcagggatgatgcccccgaacctggcggcagcgcaaaagatg

SEQ ID NO: 126433 - DNA, 103 bp, Artificial Sequence
  Synthetic Polynucleotide
taatacgactcactatagggctctggtaggaaggttcctgggcgggggcaaacagaggagatgccccatgccaggaaccaacctggcggcagcgcaaaagatg

SEQ ID NO: 126434 - DNA, 103 bp, Artificial Sequence
  Synthetic Polynucleotide
taatacgactcactatagggaaacttgggactctggtaggaaggttcctgaacagaggagacaggaaatgtcctaccagaacctggcggcagcgcaaaagatg

SEQ ID NO: 126435 - DNA, 103 bp, Artificial Sequence
  Synthetic Polynucleotide
taatacgactcactatagggaaccccccagaaacttgggactctggtaggaacagaggagacctaccatggtcccaagtaacctggcggcagcgcaaaagatg

SEQ ID NO: 126436 - DNA, 103 bp, Artificial Sequence
  Synthetic Polynucleotide
taatacgactcactatagggctaacctgggaaccccccagaaacttgggaaacagaggagatcccaaatgtctggggggaacctggcggcagcgcaaaagatg

SEQ ID NO: 126437 - DNA, 103 bp, Artificial Sequence
  Synthetic Polynucleotide
taatacgactcactataggggcggataaccgtctgcaggtccaggctggcaacagaggagagccagcatggacctgcagaacctggcggcagcgcaaaagatg

SEQ ID NO: 126438 - DNA, 103 bp, Artificial Sequence
  Synthetic Polynucleotide
taatacgactcactatagggacggcttgggctaacctgggaaccccccagaacagaggagactggggatgtcccaggttaacctggcggcagcgcaaaagatg

SEQ ID NO: 126439 - DNA, 103 bp, Artificial Sequence
  Synthetic Polynucleotide
taatacgactcactataggggagctttagcacggcttgggctaacctgggaacagaggagacccaggatggcccaagccaacctggcggcagcgcaaaagatg

SEQ ID NO: 126440 - DNA, 103 bp, Artificial Sequence
  Synthetic Polynucleotide
taatacgactcactataggggtgttcactggagctttagcacggcttgggaacagaggagacccaagatgtgctaaagcaacctggcggcagcgcaaaagatg

SEQ ID NO: 126441 - DNA, 103 bp, Artificial Sequence
  Synthetic Polynucleotide
taatacgactcactatagggaggtccatatgtgttcactggagctttagcaacagaggagagctaaaatgccagtgaacaacctggcggcagcgcaaaagatg

SEQ ID NO: 126442 - DNA, 103 bp, Artificial Sequence
  Synthetic Polynucleotide
taatacgactcactataggggtccaaagccaggtccatatgtgttcactgaacagaggagacagtgaatgcatatggacaacctggcggcagcgcaaaagatg

SEQ ID NO: 126443 - DNA, 103 bp, Artificial Sequence
  Synthetic Polynucleotide
taatacgactcactatagggggcaagttgggtccaaagccaggtccatataacagaggagaatatggatgtggctttggaacctggcggcagcgcaaaagatg

SEQ ID NO: 126444 - DNA, 103 bp, Artificial Sequence
  Synthetic Polynucleotide
taatacgactcactatagggcttgtgattgggcaagttgggtccaaagccaacagaggagaggctttatgcccaacttgaacctggcggcagcgcaaaagatg

SEQ ID NO: 126445 - DNA, 103 bp, Artificial Sequence
  Synthetic Polynucleotide
taatacgactcactatagggaggaacctgacttgtgattgggcaagttggaacagaggagaccaactatgccaatcacaaacctggcggcagcgcaaaagatg

SEQ ID NO: 126446 - DNA, 103 bp, Artificial Sequence
  Synthetic Polynucleotide
taatacgactcactatagggggggtgggataggaacctgacttgtgattgaacagaggagacaatcaatggtcaggttcaacctggcggcagcgcaaaagatg

SEQ ID NO: 126447 - DNA, 103 bp, Artificial Sequence
  Synthetic Polynucleotide
taatacgactcactataggggcatggtgaaggggtgggataggaacctgaaacagaggagatcaggtatgtatcccaccaacctggcggcagcgcaaaagatg

SEQ ID NO: 126448 - DNA, 103 bp, Artificial Sequence
  Synthetic Polynucleotide
taatacgactcactatagggtgggtgaggtgcggataaccgtctgcaggtaacagaggagaacctgcatgcggttatccaacctggcggcagcgcaaaagatg

SEQ ID NO: 126449 - DNA, 103 bp, Artificial Sequence
  Synthetic Polynucleotide
taatacgactcactatagggaattttcatggcatggtgaaggggtgggataacagaggagaatcccaatgcttcaccataacctggcggcagcgcaaaagatg

SEQ ID NO: 126450 - DNA, 103 bp, Artificial Sequence
  Synthetic Polynucleotide
taatacgactcactatagggcccactacaaaattttcatggcatggtgaaaacagaggagattcaccatgccatgaaaaaacctggcggcagcgcaaaagatg

SEQ ID NO: 126451 - DNA, 103 bp, Artificial Sequence
  Synthetic Polynucleotide
taatacgactcactatagggcctatttgcccccactacaaaattttcatgaacagaggagacatgaaatgtttgtagtgaacctggcggcagcgcaaaagatg

SEQ ID NO: 126452 - DNA, 103 bp, Artificial Sequence
  Synthetic Polynucleotide
taatacgactcactatagggtatgtgaagccctatttgcccccactacaaaacagaggagattgtagatggggcaaataaacctggcggcagcgcaaaagatg

SEQ ID NO: 126453 - DNA, 103 bp, Artificial Sequence
  Synthetic Polynucleotide
taatacgactcactataggggctgctgccctatgtgaagccctatttgccaacagaggagaggcaaaatgggcttcacaaacctggcggcagcgcaaaagatg

SEQ ID NO: 126454 - DNA, 103 bp, Artificial Sequence
  Synthetic Polynucleotide
taatacgactcactatagggtcgaggtggtgctgctgccctatgtgaagcaacagaggagagcttcaatgagggcagcaaacctggcggcagcgcaaaagatg

SEQ ID NO: 126455 - DNA, 103 bp, Artificial Sequence
  Synthetic Polynucleotide
taatacgactcactatagggggggcagaagtcgaggtggtgctgctgcccaacagaggagagggcagatgcaccacctcaacctggcggcagcgcaaaagatg

SEQ ID NO: 126456 - DNA, 103 bp, Artificial Sequence
  Synthetic Polynucleotide
taatacgactcactataggggtgggcaatgggggcagaagtcgaggtggtaacagaggagaaccaccatgacttctgccaacctggcggcagcgcaaaagatg

SEQ ID NO: 126457 - DNA, 103 bp, Artificial Sequence
  Synthetic Polynucleotide
taatacgactcactatagggcccatagcaagtgggcaatgggggcagaagaacagaggagacttctgatgccattgcccaacctggcggcagcgcaaaagatg

SEQ ID NO: 126458 - DNA, 103 bp, Artificial Sequence
  Synthetic Polynucleotide
taatacgactcactatagggctttgagaggcccatagcaagtgggcaatgaacagaggagacattgcatgcttgctatgaacctggcggcagcgcaaaagatg

SEQ ID NO: 126459 - DNA, 103 bp, Artificial Sequence
  Synthetic Polynucleotide
taatacgactcactatagggcagggctcgccatagctactgattggtggtaacagaggagaaccaccatgcagtagctaaacctggcggcagcgcaaaagatg

SEQ ID NO: 126460 - DNA, 103 bp, Artificial Sequence
  Synthetic Polynucleotide
taatacgactcactatagggacgagggagctgggtgaggtgcggataaccaacagaggagaggttatatgcacctcaccaacctggcggcagcgcaaaagatg

SEQ ID NO: 126461 - DNA, 103 bp, Artificial Sequence
  Synthetic Polynucleotide
taatacgactcactataggggtgcctcccactttgagaggcccatagcaaaacagaggagattgctaatggcctctcaaaacctggcggcagcgcaaaagatg

SEQ ID NO: 126462 - DNA, 103 bp, Artificial Sequence
  Synthetic Polynucleotide
taatacgactcactataggggctggggtttgtgcctcccactttgagaggaacagaggagacctctcatggtgggaggcaacctggcggcagcgcaaaagatg

SEQ ID NO: 126463 - DNA, 103 bp, Artificial Sequence
  Synthetic Polynucleotide
taatacgactcactataggggatgaccacagctggggtttgtgcctcccaaacagaggagatgggagatgcaaaccccaaacctggcggcagcgcaaaagatg

SEQ ID NO: 126464 - DNA, 103 bp, Artificial Sequence
  Synthetic Polynucleotide
taatacgactcactatagggcccacctcaggatgaccacagctggggtttaacagaggagaaaacccatgctgtggtcaaacctggcggcagcgcaaaagatg

SEQ ID NO: 126465 - DNA, 103 bp, Artificial Sequence
  Synthetic Polynucleotide
taatacgactcactatagggtcctagcctgcccacctcaggatgaccacaaacagaggagatgtggtatgcctgaggtgaacctggcggcagcgcaaaagatg

SEQ ID NO: 126466 - DNA, 103 bp, Artificial Sequence
  Synthetic Polynucleotide
taatacgactcactatagggcaggaccccctcctagcctgcccacctcagaacagaggagactgaggatggcaggctagaacctggcggcagcgcaaaagatg

SEQ ID NO: 126467 - DNA, 103 bp, Artificial Sequence
  Synthetic Polynucleotide
taatacgactcactataggggggtacaaggcaggaccccctcctagcctgaacagaggagacaggctatgagggggtccaacctggcggcagcgcaaaagatg

SEQ ID NO: 126468 - DNA, 103 bp, Artificial Sequence
  Synthetic Polynucleotide
taatacgactcactatagggttcgggaggagggtacaaggcaggacccccaacagaggagagggggtatggccttgtacaacctggcggcagcgcaaaagatg

SEQ ID NO: 126469 - DNA, 103 bp, Artificial Sequence
  Synthetic Polynucleotide
taatacgactcactatagggatacctgtccttcgggaggagggtacaaggaacagaggagaccttgtatgctcctcccgaacctggcggcagcgcaaaagatg

SEQ ID NO: 126470 - DNA, 103 bp, Artificial Sequence
  Synthetic Polynucleotide
taatacgactcactatagggagggggttacatacctgtccttcgggaggaaacagaggagatcctccatgaggacaggtaacctggcggcagcgcaaaagatg

SEQ ID NO: 126471 - DNA, 103 bp, Artificial Sequence
  Synthetic Polynucleotide
taatacgactcactataggggatgaaagctacgagggagctgggtgaggtaacagaggagaacctcaatgagctccctcaacctggcggcagcgcaaaagatg

SEQ ID NO: 126472 - DNA, 103 bp, Artificial Sequence
  Synthetic Polynucleotide
taatacgactcactatagggaagagagtccagggggttacatacctgtccaacagaggagaggacagatgtgtaaccccaacctggcggcagcgcaaaagatg

SEQ ID NO: 126473 - DNA, 103 bp, Artificial Sequence
  Synthetic Polynucleotide
taatacgactcactatagggtgtcaagatcaagagagtccagggggttacaacagaggagagtaaccatgtggactctcaacctggcggcagcgcaaaagatg

SEQ ID NO: 126474 - DNA, 103 bp, Artificial Sequence
  Synthetic Polynucleotide
taatacgactcactatagggagctgagtgttgtcaagatcaagagagtccaacagaggagaggactcatgtgatcttgaaacctggcggcagcgcaaaagatg

SEQ ID NO: 126475 - DNA, 103 bp, Artificial Sequence
  Synthetic Polynucleotide
taatacgactcactatagggcacaaagtccagctgagtgttgtcaagatcaacagaggagagatcttatgaacactcagaacctggcggcagcgcaaaagatg

SEQ ID NO: 126476 - DNA, 103 bp, Artificial Sequence
  Synthetic Polynucleotide
taatacgactcactatagggccagaatagccacaaagtccagctgagtgtaacagaggagaacactcatgtggactttgaacctggcggcagcgcaaaagatg

SEQ ID NO: 126477 - DNA, 103 bp, Artificial Sequence
  Synthetic Polynucleotide
taatacgactcactatagggtggggctcatccagaatagccacaaagtccaacagaggagaggacttatgggctattctaacctggcggcagcgcaaaagatg

SEQ ID NO: 126478 - DNA, 103 bp, Artificial Sequence
  Synthetic Polynucleotide
taatacgactcactatagggactcagcccctggggctcatccagaatagcaacagaggagagctattatggatgagcccaacctggcggcagcgcaaaagatg

SEQ ID NO: 126479 - DNA, 103 bp, Artificial Sequence
  Synthetic Polynucleotide
taatacgactcactatagggaaggaggaggactcagcccctggggctcataacagaggagaatgagcatgaggggctgaaacctggcggcagcgcaaaagatg

SEQ ID NO: 126480 - DNA, 103 bp, Artificial Sequence
  Synthetic Polynucleotide
taatacgactcactatagggtgatcatgggaaggaggaggactcagccccaacagaggagaggggctatgtcctcctccaacctggcggcagcgcaaaagatg

SEQ ID NO: 126481 - DNA, 103 bp, Artificial Sequence
  Synthetic Polynucleotide
taatacgactcactataggggctgccccgctgatcatgggaaggaggaggaacagaggagacctcctatgtcccatgataacctggcggcagcgcaaaagatg

SEQ ID NO: 126482 - DNA, 103 bp, Artificial Sequence
  Synthetic Polynucleotide
taatacgactcactatagggatcgcgagttgatgaaagctacgagggagcaacagaggagagctcccatgtagctttcaaacctggcggcagcgcaaaagatg

SEQ ID NO: 126483 - DNA, 103 bp, Artificial Sequence
  Synthetic Polynucleotide
taatacgactcactatagggtatgtccagagctgccccgctgatcatgggaacagaggagacccatgatgagcggggcaaacctggcggcagcgcaaaagatg

SEQ ID NO: 126484 - DNA, 103 bp, Artificial Sequence
  Synthetic Polynucleotide
taatacgactcactatagggggaggtggggtatgtccagagctgccccgcaacagaggagagcggggatgctctggacaaacctggcggcagcgcaaaagatg

SEQ ID NO: 126485 - DNA, 103 bp, Artificial Sequence
  Synthetic Polynucleotide
taatacgactcactataggggggcccagagggaggtggggtatgtccagaaacagaggagatctggaatgaccccacctaacctggcggcagcgcaaaagatg

SEQ ID NO: 126486 - DNA, 103 bp, Artificial Sequence
  Synthetic Polynucleotide
taatacgactcactatagggccatgttggggggcccagagggaggtggggaacagaggagaccccacatgcctctgggcaacctggcggcagcgcaaaagatg

SEQ ID NO: 126487 - DNA, 103 bp, Artificial Sequence
  Synthetic Polynucleotide
taatacgactcactatagggttgcccacagccatgttggggggcccagagaacagaggagactctggatgccccaacataacctggcggcagcgcaaaagatg

SEQ ID NO: 126488 - DNA, 103 bp, Artificial Sequence
  Synthetic Polynucleotide
taatacgactcactataggggacactcatgttgcccacagccatgttgggaacagaggagacccaacatggctgtgggcaacctggcggcagcgcaaaagatg

SEQ ID NO: 126489 - DNA, 103 bp, Artificial Sequence
  Synthetic Polynucleotide
taatacgactcactatagggatctcagtaagacactcatgttgcccacagaacagaggagactgtggatgacatgagtgaacctggcggcagcgcaaaagatg

SEQ ID NO: 126490 - DNA, 103 bp, Artificial Sequence
  Synthetic Polynucleotide
taatacgactcactatagggccaggtagggatctcagtaagacactcatgaacagaggagacatgagatgcttactgagaacctggcggcagcgcaaaagatg

SEQ ID NO: 126491 - DNA, 103 bp, Artificial Sequence
  Synthetic Polynucleotide
taatacgactcactatagggttctgtttccccaggtagggatctcagtaaaacagaggagattactgatgtccctacctaacctggcggcagcgcaaaagatg

SEQ ID NO: 126492 - DNA, 103 bp, Artificial Sequence
  Synthetic Polynucleotide
taatacgactcactatagggagttgaggaattctgtttccccaggtagggaacagaggagaccctacatggggaaacagaacctggcggcagcgcaaaagatg

SEQ ID NO: 126493 - DNA, 103 bp, Artificial Sequence
  Synthetic Polynucleotide
taatacgactcactatagggggagatgtgcatcgcgagttgatgaaagctaacagaggagaagctttatgcaactcgcgaacctggcggcagcgcaaaagatg

SEQ ID NO: 126494 - DNA, 103 bp, Artificial Sequence
  Synthetic Polynucleotide
taatacgactcactatagggtaggcactagagttgaggaattctgtttccaacagaggagaggaaacatgattcctcaaaacctggcggcagcgcaaaagatg

SEQ ID NO: 126495 - DNA, 103 bp, Artificial Sequence
  Synthetic Polynucleotide
taatacgactcactatagggggagcctcctggagatgtgcatcgcgagttaacagaggagaaactcgatgtgcacatctaacctggcggcagcgcaaaagatg

SEQ ID NO: 126496 - DNA, 103 bp, Artificial Sequence
  Synthetic Polynucleotide
taatacgactcactataggggatgaccgtaggagcctcctggagatgtgcaacagaggagagcacatatgcaggaggctaacctggcggcagcgcaaaagatg

SEQ ID NO: 126497 - DNA, 103 bp, Artificial Sequence
  Synthetic Polynucleotide
taatacgactcactatagggccaatggagagatgaccgtaggagcctcctaacagaggagaaggaggatgctacggtcaaacctggcggcagcgcaaaagatg

SEQ ID NO: 126498 - DNA, 103 bp, Artificial Sequence
  Synthetic Polynucleotide
taatacgactcactataggggctcatggtgccaatggagagatgaccgtaaacagaggagatacggtatgctctccattaacctggcggcagcgcaaaagatg

SEQ ID NO: 126499 - DNA, 103 bp, Artificial Sequence
  Synthetic Polynucleotide
taatacgactcactatagggccagagatgggctcatggtgccaatggagaaacagaggagatctccaatggcaccatgaaacctggcggcagcgcaaaagatg

SEQ ID NO: 126500 - DNA, 103 bp, Artificial Sequence
  Synthetic Polynucleotide
taatacgactcactataggggctgggaatcccagagatgggctcatggtgaacagaggagacaccatatgcccatctctaacctggcggcagcgcaaaagatg

SEQ ID NO: 126501 - DNA, 103 bp, Artificial Sequence
  Synthetic Polynucleotide
taatacgactcactatagggccggagacagcagggctcgccatagctactaacagaggagaagtagcatgggcgagcccaacctggcggcagcgcaaaagatg

SEQ ID NO: 126502 - DNA, 103 bp, Artificial Sequence
  Synthetic Polynucleotide
taatacgactcactatagggattcatctgggctgggaatcccagagatggaacagaggagaccatctatgggattcccaaacctggcggcagcgcaaaagatg

SEQ ID NO: 126503 - DNA, 103 bp, Artificial Sequence
  Synthetic Polynucleotide
taatacgactcactatagggctttttggtgattcatctgggctgggaatcaacagaggagagattccatgcccagatgaaacctggcggcagcgcaaaagatg

SEQ ID NO: 126504 - DNA, 103 bp, Artificial Sequence
  Synthetic Polynucleotide
taatacgactcactatagggggcgagggccctttttggtgattcatctggaacagaggagaccagatatgtcaccaaaaaacctggcggcagcgcaaaagatg

SEQ ID NO: 126505 - DNA, 103 bp, Artificial Sequence
  Synthetic Polynucleotide
taatacgactcactatagggcccaaaggaaggcgagggccctttttggtgaacagaggagacaccaaatggggccctcgaacctggcggcagcgcaaaagatg

SEQ ID NO: 126506 - DNA, 103 bp, Artificial Sequence
  Synthetic Polynucleotide
taatacgactcactatagggaaggctggaccccaaaggaaggcgagggccaacagaggagaggccctatgcttcctttgaacctggcggcagcgcaaaagatg

SEQ ID NO: 126507 - DNA, 103 bp, Artificial Sequence
  Synthetic Polynucleotide
taatacgactcactatagggtggggaccacaaggctggaccccaaaggaaaacagaggagattccttatgggtccagccaacctggcggcagcgcaaaagatg

SEQ ID NO: 126508 - DNA, 103 bp, Artificial Sequence
  Synthetic Polynucleotide
taatacgactcactatagggggcagagtcatggggaccacaaggctggacaacagaggagagtccagatgtgtggtcccaacctggcggcagcgcaaaagatg

SEQ ID NO: 126509 - DNA, 103 bp, Artificial Sequence
  Synthetic Polynucleotide
taatacgactcactatagggtcccaccccgggcagagtcatggggaccacaacagaggagagtggtcatgatgactctgaacctggcggcagcgcaaaagatg

SEQ ID NO: 126510 - DNA, 103 bp, Artificial Sequence
  Synthetic Polynucleotide
taatacgactcactatagggtgtgggatcatcccaccccgggcagagtcaaacagaggagatgactcatgccggggtggaacctggcggcagcgcaaaagatg

SEQ ID NO: 126511 - DNA, 103 bp, Artificial Sequence
  Synthetic Polynucleotide
taatacgactcactatagggggactgaggatgtgggatcatcccaccccgaacagaggagacggggtatgatgatcccaaacctggcggcagcgcaaaagatg

SEQ ID NO: 126512 - DNA, 103 bp, Artificial Sequence
  Synthetic Polynucleotide
taatacgactcactatagggtggggaggggccggagacagcagggctcgcaacagaggagagcgagcatggctgtctccaacctggcggcagcgcaaaagatg

SEQ ID NO: 126513 - DNA, 103 bp, Artificial Sequence
  Synthetic Polynucleotide
taatacgactcactatagggagggtccccgggactgaggatgtgggatcaaacagaggagatgatccatgatcctcagtaacctggcggcagcgcaaaagatg

SEQ ID NO: 126514 - DNA, 103 bp, Artificial Sequence
  Synthetic Polynucleotide
taatacgactcactatagggcaagttgggaagggtccccgggactgaggaaacagaggagatcctcaatgccggggaccaacctggcggcagcgcaaaagatg

SEQ ID NO: 126515 - DNA, 103 bp, Artificial Sequence
  Synthetic Polynucleotide
taatacgactcactatagggcttcagctggcaagttgggaagggtccccgaacagaggagacggggaatgttcccaactaacctggcggcagcgcaaaagatg

SEQ ID NO: 126516 - DNA, 103 bp, Artificial Sequence
  Synthetic Polynucleotide
taatacgactcactatagggccagctcagacttcagctggcaagttgggaaacagaggagatcccaaatggccagctgaaacctggcggcagcgcaaaagatg

SEQ ID NO: 126517 - DNA, 103 bp, Artificial Sequence
  Synthetic Polynucleotide
taatacgactcactatagggaccagcatgtccagctcagacttcagctggaacagaggagaccagctatggtctgagctaacctggcggcagcgcaaaagatg

SEQ ID NO: 126518 - DNA, 103 bp, Artificial Sequence
  Synthetic Polynucleotide
taatacgactcactataggggcacttgccaaccagcatgtccagctcagaaacagaggagatctgagatggacatgctgaacctggcggcagcgcaaaagatg

SEQ ID NO: 126519 - DNA, 103 bp, Artificial Sequence
  Synthetic Polynucleotide
taatacgactcactataggggttcctcccggcacttgccaaccagcatgtaacagaggagaacatgcatgttggcaagtaacctggcggcagcgcaaaagatg

SEQ ID NO: 126520 - DNA, 103 bp, Artificial Sequence
  Synthetic Polynucleotide
taatacgactcactatagggccttccaagggttcctcccggcacttgccaaacagaggagatggcaaatgccgggaggaaacctggcggcagcgcaaaagatg

SEQ ID NO: 126521 - DNA, 103 bp, Artificial Sequence
  Synthetic Polynucleotide
taatacgactcactatagggggacatatcaccttccaagggttcctcccgaacagaggagacgggagatgcccttggaaaacctggcggcagcgcaaaagatg

SEQ ID NO: 126522 - DNA, 103 bp, Artificial Sequence
  Synthetic Polynucleotide
taatacgactcactatagggagttggggctggacatatcaccttccaaggaacagaggagaccttggatggtgatatgtaacctggcggcagcgcaaaagatg

SEQ ID NO: 126523 - DNA, 103 bp, Artificial Sequence
  Synthetic Polynucleotide
taatacgactcactataggggccccctgactggggaggggccggagacagaacagaggagactgtctatggcccctcccaacctggcggcagcgcaaaagatg

SEQ ID NO: 126524 - DNA, 103 bp, Artificial Sequence
  Synthetic Polynucleotide
taatacgactcactatagggatgcctgtggagttggggctggacatatcaaacagaggagatgatatatgcagccccaaaacctggcggcagcgcaaaagatg

SEQ ID NO: 126525 - DNA, 103 bp, Artificial Sequence
  Synthetic Polynucleotide
taatacgactcactataggggggatcctgtatgcctgtggagttggggctaacagaggagaagccccatgtccacaggcaacctggcggcagcgcaaaagatg

SEQ ID NO: 126526 - DNA, 103 bp, Artificial Sequence
  Synthetic Polynucleotide
taatacgactcactatagggtccccaacaggggatcctgtatgcctgtggaacagaggagaccacagatgtacaggatcaacctggcggcagcgcaaaagatg

SEQ ID NO: 126527 - DNA, 103 bp, Artificial Sequence
  Synthetic Polynucleotide
taatacgactcactatagggccatccagcatccccaacaggggatcctgtaacagaggagaacaggaatgcctgttgggaacctggcggcagcgcaaaagatg

SEQ ID NO: 126528 - DNA, 103 bp, Artificial Sequence
  Synthetic Polynucleotide
taatacgactcactataggggtcctcccgcccatccagcatccccaacagaacagaggagactgttgatgatgctggataacctggcggcagcgcaaaagatg

SEQ ID NO: 126529 - DNA, 103 bp, Artificial Sequence
  Synthetic Polynucleotide
taatacgactcactatagggctctctcgaggtcctcccgcccatccagcaaacagaggagatgctggatgggcgggaggaacctggcggcagcgcaaaagatg

SEQ ID NO: 126530 - DNA, 103 bp, Artificial Sequence
  Synthetic Polynucleotide
taatacgactcactatagggcgcttctcctctctctcgaggtcctcccgcaacagaggagagcgggaatgcctcgagagaacctggcggcagcgcaaaagatg

SEQ ID NO: 126531 - DNA, 103 bp, Artificial Sequence
  Synthetic Polynucleotide
taatacgactcactatagggttcaggctcacgcttctcctctctctcgagaacagaggagactcgagatggaggagaagaacctggcggcagcgcaaaagatg

SEQ ID NO: 126532 - DNA, 103 bp, Artificial Sequence
  Synthetic Polynucleotide
taatacgactcactatagggcatacacagattcaggctcacgcttctcctaacagaggagaaggagaatggtgagcctgaacctggcggcagcgcaaaagatg

SEQ ID NO: 126533 - DNA, 103 bp, Artificial Sequence
  Synthetic Polynucleotide
taatacgactcactatagggcagtcagtttcatacacagattcaggctcaaacagaggagatgagccatgatctgtgtaaacctggcggcagcgcaaaagatg

SEQ ID NO: 126534 - DNA, 103 bp, Artificial Sequence
  Synthetic Polynucleotide
taatacgactcactatagggcacactgggggccccctgactggggaggggaacagaggagacccctcatgagtcaggggaacctggcggcagcgcaaaagatg

SEQ ID NO: 126535 - DNA, 103 bp, Artificial Sequence
  Synthetic Polynucleotide
taatacgactcactatagggatcccaacggcagtcagtttcatacacagaaacagaggagatctgtgatggaaactgacaacctggcggcagcgcaaaagatg

SEQ ID NO: 126536 - DNA, 103 bp, Artificial Sequence
  Synthetic Polynucleotide
taatacgactcactatagggggctgcagccatcccaacggcagtcagtttaacagaggagaaaactgatggccgttgggaacctggcggcagcgcaaaagatg

SEQ ID NO: 126537 - DNA, 103 bp, Artificial Sequence
  Synthetic Polynucleotide
taatacgactcactatagggtcaaattcctggctgcagccatcccaacggaacagaggagaccgttgatgtggctgcagaacctggcggcagcgcaaaagatg

SEQ ID NO: 126538 - DNA, 103 bp, Artificial Sequence
  Synthetic Polynucleotide
taatacgactcactatagggctcttgggagtcaaattcctggctgcagccaacagaggagaggctgcatgcaggaatttaacctggcggcagcgcaaaagatg

SEQ ID NO: 126539 - DNA, 103 bp, Artificial Sequence
  Synthetic Polynucleotide
taatacgactcactataggggcaccagctgctcttgggagtcaaattcctaacagaggagaaggaatatgactcccaagaacctggcggcagcgcaaaagatg

SEQ ID NO: 126540 - DNA, 103 bp, Artificial Sequence
  Synthetic Polynucleotide
taatacgactcactatagggttgatgtggtgcaccagctgctcttgggagaacagaggagactcccaatggcagctggtaacctggcggcagcgcaaaagatg

SEQ ID NO: 126541 - DNA, 103 bp, Artificial Sequence
  Synthetic Polynucleotide
taatacgactcactataggggtgctcgctgttgatgtggtgcaccagctgaacagaggagacagctgatgcaccacatcaacctggcggcagcgcaaaagatg

SEQ ID NO: 126542 - DNA, 103 bp, Artificial Sequence
  Synthetic Polynucleotide
taatacgactcactatagggccccgtggatgtgctcgctgttgatgtggtaacagaggagaaccacaatgacagcgagcaacctggcggcagcgcaaaagatg

SEQ ID NO: 126543 - DNA, 103 bp, Artificial Sequence
  Synthetic Polynucleotide
taatacgactcactatagggtccttccgctccccgtggatgtgctcgctgaacagaggagacagcgaatgcatccacggaacctggcggcagcgcaaaagatg

SEQ ID NO: 126544 - DNA, 103 bp, Artificial Sequence
  Synthetic Polynucleotide
taatacgactcactataggggcacacgaactccttccgctccccgtggataacagaggagaatccacatggagcggaagaacctggcggcagcgcaaaagatg

SEQ ID NO: 126545 - DNA, 103 bp, Artificial Sequence
  Synthetic Polynucleotide
taatacgactcactatagggcttctgtccccacactgggggccccctgacaacagaggagagtcaggatgcccccagtgaacctggcggcagcgcaaaagatg

SEQ ID NO: 126546 - DNA, 103 bp, Artificial Sequence
  Synthetic Polynucleotide
taatacgactcactatagggccccccagtggcacacgaactccttccgctaacagaggagaagcggaatgagttcgtgtaacctggcggcagcgcaaaagatg

SEQ ID NO: 126547 - DNA, 103 bp, Artificial Sequence
  Synthetic Polynucleotide
taatacgactcactatagggctggagcagcccccccagtggcacacgaacaacagaggagagttcgtatgccactggggaacctggcggcagcgcaaaagatg

SEQ ID NO: 126548 - DNA, 103 bp, Artificial Sequence
  Synthetic Polynucleotide
taatacgactcactatagggcctcagctccctggagcagcccccccagtgaacagaggagacactggatgggctgctccaacctggcggcagcgcaaaagatg

SEQ ID NO: 126549 - DNA, 103 bp, Artificial Sequence
  Synthetic Polynucleotide
taatacgactcactatagggctttgaagggcctcagctccctggagcagcaacagaggagagctgctatggggagctgaaacctggcggcagcgcaaaagatg

SEQ ID NO: 126550 - DNA, 103 bp, Artificial Sequence
  Synthetic Polynucleotide
taatacgactcactatagggatgtactgggctttgaagggcctcagctccaacagaggagaggagctatggcccttcaaaacctggcggcagcgcaaaagatg

SEQ ID NO: 126551 - DNA, 103 bp, Artificial Sequence
  Synthetic Polynucleotide
taatacgactcactatagggaaccaccagcatgtactgggctttgaagggaacagaggagacccttcatggcccagtacaacctggcggcagcgcaaaagatg

SEQ ID NO: 126552 - DNA, 103 bp, Artificial Sequence
  Synthetic Polynucleotide
taatacgactcactatagggtgcgcatgtgaaccaccagcatgtactgggaacagaggagacccagtatgtgctggtggaacctggcggcagcgcaaaagatg

SEQ ID NO: 126553 - DNA, 103 bp, Artificial Sequence
  Synthetic Polynucleotide
taatacgactcactatagggccagtgtgtctgcgcatgtgaaccaccagcaacagaggagagctggtatgtcacatgcgaacctggcggcagcgcaaaagatg

SEQ ID NO: 126554 - DNA, 103 bp, Artificial Sequence
  Synthetic Polynucleotide
taatacgactcactatagggtggcttctcgccagtgtgtctgcgcatgtgaacagaggagacacatgatgagacacactaacctggcggcagcgcaaaagatg

SEQ ID NO: 126555 - DNA, 103 bp, Artificial Sequence
  Synthetic Polynucleotide
taatacgactcactatagggtgcacttgtgtggcttctcgccagtgtgtcaacagaggagagacacaatggcgagaagcaacctggcggcagcgcaaaagatg

SEQ ID NO: 126556 - DNA, 103 bp, Artificial Sequence
  Synthetic Polynucleotide
taatacgactcactatagggccagacagtccttctgtccccacactggggaacagaggagaccccagatgggggacagaaacctggcggcagcgcaaaagatg

SEQ ID NO: 126557 - DNA, 103 bp, Artificial Sequence
  Synthetic Polynucleotide
taatacgactcactatagggccttcaaacgtgcacttgtgtggcttctcgaacagaggagacgagaaatgacacaagtgaacctggcggcagcgcaaaagatg

SEQ ID NO: 126558 - DNA, 103 bp, Artificial Sequence
  Synthetic Polynucleotide
taatacgactcactatagggcttccggcacccttcaaacgtgcacttgtgaacagaggagacacaagatgacgtttgaaaacctggcggcagcgcaaaagatg

SEQ ID NO: 126559 - DNA, 103 bp, Artificial Sequence
  Synthetic Polynucleotide
taatacgactcactataggggtgagtatgacttccggcacccttcaaacgaacagaggagacgtttgatgggtgccggaaacctggcggcagcgcaaaagatg

SEQ ID NO: 126560 - DNA, 103 bp, Artificial Sequence
  Synthetic Polynucleotide
taatacgactcactatagggttttcgaggcgtgagtatgacttccggcacaacagaggagagtgccgatggtcatactcaacctggcggcagcgcaaaagatg

SEQ ID NO: 126561 - DNA, 103 bp, Artificial Sequence
  Synthetic Polynucleotide
taatacgactcactatagggcgtcttcaggttttcgaggcgtgagtatgaaacagaggagatcatacatgcgcctcgaaaacctggcggcagcgcaaaagatg

SEQ ID NO: 126562 - DNA, 103 bp, Artificial Sequence
  Synthetic Polynucleotide
taatacgactcactatagggaccgcaggtgcgtcttcaggttttcgaggcaacagaggagagcctcgatgacctgaagaaacctggcggcagcgcaaaagatg

SEQ ID NO: 126563 - DNA, 103 bp, Artificial Sequence
  Synthetic Polynucleotide
taatacgactcactatagggcccgtgtgtgaccgcaggtgcgtcttcaggaacagaggagacctgaaatggcacctgcgaacctggcggcagcgcaaaagatg

SEQ ID NO: 126564 - DNA, 103 bp, Artificial Sequence
  Synthetic Polynucleotide
taatacgactcactatagggtggcttctcacccgtgtgtgaccgcaggtgaacagaggagacacctgatgtcacacacgaacctggcggcagcgcaaaagatg

SEQ ID NO: 126565 - DNA, 103 bp, Artificial Sequence
  Synthetic Polynucleotide
taatacgactcactatagggcacacatgtatggcttctcacccgtgtgtgaacagaggagacacacaatggtgagaagcaacctggcggcagcgcaaaagatg

SEQ ID NO: 126566 - DNA, 103 bp, Artificial Sequence
  Synthetic Polynucleotide
taatacgactcactatagggccctcgtgctcacacatgtatggcttctcaaacagaggagatgagaaatgatacatgtgaacctggcggcagcgcaaaagatg

SEQ ID NO: 126567 - DNA, 103 bp, Artificial Sequence
  Synthetic Polynucleotide
taatacgactcactatagggggaggcagtggctgaggcagacgtctccataacagaggagaatggagatgtctgcctcaaacctggcggcagcgcaaaagatg

SEQ ID NO: 126568 - DNA, 103 bp, Artificial Sequence
  Synthetic Polynucleotide
taatacgactcactatagggcgctgcagccaccaccaaaggagaggccttaacagaggagaaaggccatgcctttggtgaacctggcggcagcgcaaaagatg

SEQ ID NO: 126569 - DNA, 103 bp, Artificial Sequence
  Synthetic Polynucleotide
taatacgactcactatagggctgggtgggcgtggcattgatggaggtgagaacagaggagactcaccatgatcaatgccaacctggcggcagcgcaaaagatg

SEQ ID NO: 126570 - DNA, 103 bp, Artificial Sequence
  Synthetic Polynucleotide
taatacgactcactatagggtgctgctgagctgggtgggcgtggcattgaaacagaggagatcaatgatgcgcccacccaacctggcggcagcgcaaaagatg

SEQ ID NO: 126571 - DNA, 103 bp, Artificial Sequence
  Synthetic Polynucleotide
taatacgactcactatagggcagttgctgctgctgctgagctgggtgggcaacagaggagagcccacatggctcagcagaacctggcggcagcgcaaaagatg

SEQ ID NO: 126572 - DNA, 103 bp, Artificial Sequence
  Synthetic Polynucleotide
taatacgactcactataggggtcactcagacagttgctgctgctgctgagaacagaggagactcagcatgagcagcaacaacctggcggcagcgcaaaagatg

SEQ ID NO: 126573 - DNA, 103 bp, Artificial Sequence
  Synthetic Polynucleotide
taatacgactcactatagggtctggttggtgtcactcagacagttgctgcaacagaggagagcagcaatggtctgagtgaacctggcggcagcgcaaaagatg

SEQ ID NO: 126574 - DNA, 103 bp, Artificial Sequence
  Synthetic Polynucleotide
taatacgactcactatagggctctgcttgttctggttggtgtcactcagaaacagaggagatctgagatgcaccaaccaaacctggcggcagcgcaaaagatg

SEQ ID NO: 126575 - DNA, 103 bp, Artificial Sequence
  Synthetic Polynucleotide
taatacgactcactatagggcgactcactgctctgcttgttctggttggtaacagaggagaaccaacatgaacaagcagaacctggcggcagcgcaaaagatg

SEQ ID NO: 126576 - DNA, 103 bp, Artificial Sequence
  Synthetic Polynucleotide
taatacgactcactatagggtgctgacggccgactcactgctctgcttgtaacagaggagaacaagcatggcagtgagtaacctggcggcagcgcaaaagatg

SEQ ID NO: 126577 - DNA, 103 bp, Artificial Sequence
  Synthetic Polynucleotide
taatacgactcactatagggttgacggtgctgctgacggccgactcactgaacagaggagacagtgaatgggccgtcagaacctggcggcagcgcaaaagatg

SEQ ID NO: 126578 - DNA, 103 bp, Artificial Sequence
  Synthetic Polynucleotide
taatacgactcactatagggggcgacagggttgacggtgctgctgacggcaacagaggagagccgtcatgagcaccgtcaacctggcggcagcgcaaaagatg

SEQ ID NO: 126579 - DNA, 103 bp, Artificial Sequence
  Synthetic Polynucleotide
taatacgactcactatagggctgctgctgccgctgcagccaccaccaaagaacagaggagactttggatgtggctgcagaacctggcggcagcgcaaaagatg

SEQ ID NO: 126580 - DNA, 103 bp, Artificial Sequence
  Synthetic Polynucleotide
taatacgactcactataggggcttgtgaatggcgacagggttgacggtgcaacagaggagagcaccgatgaccctgtcgaacctggcggcagcgcaaaagatg

SEQ ID NO: 126581 - DNA, 103 bp, Artificial Sequence
  Synthetic Polynucleotide
taatacgactcactatagggaccttgctgcgcttgtgaatggcgacagggaacagaggagaccctgtatgcattcacaaaacctggcggcagcgcaaaagatg

SEQ ID NO: 126582 - DNA, 103 bp, Artificial Sequence
  Synthetic Polynucleotide
taatacgactcactatagggctcggtcttgaccttgctgcgcttgtgaataacagaggagaattcacatgcgcagcaagaacctggcggcagcgcaaaagatg

SEQ ID NO: 126583 - DNA, 103 bp, Artificial Sequence
  Synthetic Polynucleotide
taatacgactcactatagggggccctcaggctcggtcttgaccttgctgcaacagaggagagcagcaatgtcaagaccgaacctggcggcagcgcaaaagatg

SEQ ID NO: 126584 - DNA, 103 bp, Artificial Sequence
  Synthetic Polynucleotide
taatacgactcactataggggccggccgcaggccctcaggctcggtcttgaacagaggagacaagacatggcctgagggaacctggcggcagcgcaaaagatg

SEQ ID NO: 126585 - DNA, 103 bp, Artificial Sequence
  Synthetic Polynucleotide
taatacgactcactatagggcagaggggaggccggccgcaggccctcaggaacagaggagacctgagatgctgcggccgaacctggcggcagcgcaaaagatg

SEQ ID NO: 126586 - DNA, 103 bp, Artificial Sequence
  Synthetic Polynucleotide
taatacgactcactataggggcgtcagcgccagaggggaggccggccgcaaacagaggagatgcggcatgcctcccctcaacctggcggcagcgcaaaagatg

SEQ ID NO: 126587 - DNA, 103 bp, Artificial Sequence
  Synthetic Polynucleotide
taatacgactcactatagggacctggccctgcgtcagcgccagaggggagaacagaggagactccccatgggcgctgacaacctggcggcagcgcaaaagatg

SEQ ID NO: 126588 - DNA, 103 bp, Artificial Sequence
  Synthetic Polynucleotide
taatacgactcactataggggtgtccagacacctggccctgcgtcagcgcaacagaggagagcgctgatgcagggccagaacctggcggcagcgcaaaagatg

SEQ ID NO: 126589 - DNA, 103 bp, Artificial Sequence
  Synthetic Polynucleotide
taatacgactcactatagggcacatgagccgtgtccagacacctggccctaacagaggagaagggccatgtgtctggacaacctggcggcagcgcaaaagatg

SEQ ID NO: 126590 - DNA, 103 bp, Artificial Sequence
  Synthetic Polynucleotide
taatacgactcactataggggcagctaccgctgctgctgccgctgcagccaacagaggagaggctgcatgggcagcagcaacctggcggcagcgcaaaagatg

SEQ ID NO: 126591 - DNA, 103 bp, Artificial Sequence
  Synthetic Polynucleotide
taatacgactcactatagggagggcacacccacatgagccgtgtccagacaacagaggagagtctggatgcggctcatgaacctggcggcagcgcaaaagatg

SEQ ID NO: 126592 - DNA, 103 bp, Artificial Sequence
  Synthetic Polynucleotide
taatacgactcactatagggggagaggggaagggcacacccacatgagccaacagaggagaggctcaatggggtgtgccaacctggcggcagcgcaaaagatg

SEQ ID NO: 126593 - DNA, 103 bp, Artificial Sequence
  Synthetic Polynucleotide
taatacgactcactataggggctgctcctgggagaggggaagggcacaccaacagaggagaggtgtgatgttcccctctaacctggcggcagcgcaaaagatg

SEQ ID NO: 126594 - DNA, 103 bp, Artificial Sequence
  Synthetic Polynucleotide
taatacgactcactatagggaggtcagccagctgctcctgggagaggggaaacagaggagatcccctatgccaggagcaaacctggcggcagcgcaaaagatg

SEQ ID NO: 126595 - DNA, 103 bp, Artificial Sequence
  Synthetic Polynucleotide
taatacgactcactatagggatcttccttgaggtcagccagctgctcctgaacagaggagacaggagatgctggctgacaacctggcggcagcgcaaaagatg

SEQ ID NO: 126596 - DNA, 103 bp, Artificial Sequence
  Synthetic Polynucleotide
taatacgactcactatagggccctgtccagatcttccttgaggtcagccaaacagaggagatggctgatgtcaaggaagaacctggcggcagcgcaaaagatg

SEQ ID NO: 126597 - DNA, 103 bp, Artificial Sequence
  Synthetic Polynucleotide
taatacgactcactatagggttacagtcatccctgtccagatcttccttgaacagaggagacaaggaatgtctggacagaacctggcggcagcgcaaaagatg

SEQ ID NO: 126598 - DNA, 103 bp, Artificial Sequence
  Synthetic Polynucleotide
taatacgactcactatagggagcctcctgcttacagtcatccctgtccagaacagaggagactggacatggatgactgtaacctggcggcagcgcaaaagatg

SEQ ID NO: 126599 - DNA, 103 bp, Artificial Sequence
  Synthetic Polynucleotide
taatacgactcactatagggtgaccacctcagcctcctgcttacagtcataacagaggagaatgactatgagcaggaggaacctggcggcagcgcaaaagatg

SEQ ID NO: 126600 - DNA, 103 bp, Artificial Sequence
  Synthetic Polynucleotide
taatacgactcactataggggtctcatagatgaccacctcagcctcctgcaacagaggagagcaggaatgtgaggtggtaacctggcggcagcgcaaaagatg

SEQ ID NO: 126601 - DNA, 103 bp, Artificial Sequence
  Synthetic Polynucleotide
taatacgactcactatagggcactccttgggcagctaccgctgctgctgcaacagaggagagcagcaatggcggtagctaacctggcggcagcgcaaaagatg

SEQ ID NO: 126602 - DNA, 103 bp, Artificial Sequence
  Synthetic Polynucleotide
taatacgactcactataggggtggcagttggtctcatagatgaccacctcaacagaggagagaggtgatgatctatgagaacctggcggcagcgcaaaagatg

SEQ ID NO: 126603 - DNA, 103 bp, Artificial Sequence
  Synthetic Polynucleotide
taatacgactcactatagggagtcttcccagtggcagttggtctcatagaaacagaggagatctatgatgccaactgccaacctggcggcagcgcaaaagatg

SEQ ID NO: 126604 - DNA, 103 bp, Artificial Sequence
  Synthetic Polynucleotide
taatacgactcactatagggtccttggtgcagtcttcccagtggcagttgaacagaggagacaactgatgctgggaagaaacctggcggcagcgcaaaagatg

SEQ ID NO: 126605 - DNA, 103 bp, Artificial Sequence
  Synthetic Polynucleotide
taatacgactcactatagggggtgtcgtactccttggtgcagtcttcccaaacagaggagatgggaaatgtgcaccaagaacctggcggcagcgcaaaagatg

SEQ ID NO: 126606 - DNA, 103 bp, Artificial Sequence
  Synthetic Polynucleotide
taatacgactcactataggggctgctcctgggtgtcgtactccttggtgcaacagaggagagcaccaatgagtacgacaaacctggcggcagcgcaaaagatg

SEQ ID NO: 126607 - DNA, 103 bp, Artificial Sequence
  Synthetic Polynucleotide
taatacgactcactatagggtgatgcaccagctgctcctgggtgtcgtacaacagaggagagtacgaatgccaggagcaaacctggcggcagcgcaaaagatg

SEQ ID NO: 126608 - DNA, 103 bp, Artificial Sequence
  Synthetic Polynucleotide
taatacgactcactataggggttgttgatgtgatgcaccagctgctcctgaacagaggagacaggagatgctggtgcataacctggcggcagcgcaaaagatg

SEQ ID NO: 126609 - DNA, 103 bp, Artificial Sequence
  Synthetic Polynucleotide
taatacgactcactatagggggatgtgctcgttgttgatgtgatgcaccaaacagaggagatggtgcatgacatcaacaaacctggcggcagcgcaaaagatg

SEQ ID NO: 126610 - DNA, 103 bp, Artificial Sequence
  Synthetic Polynucleotide
taatacgactcactatagggttctccccgtggatgtgctcgttgttgatgaacagaggagacatcaaatgcgagcacataacctggcggcagcgcaaaagatg

SEQ ID NO: 126611 - DNA, 103 bp, Artificial Sequence
  Synthetic Polynucleotide
taatacgactcactatagggaaactccttcttctccccgtggatgtgctcaacagaggagagagcacatgcacggggagaacctggcggcagcgcaaaagatg

SEQ ID NO: 126612 - DNA, 103 bp, Artificial Sequence
  Synthetic Polynucleotide
taatacgactcactataggggatgctgcggcactccttgggcagctaccgaacagaggagacggtagatgcccaaggagaacctggcggcagcgcaaaagatg

SEQ ID NO: 126613 - DNA, 103 bp, Artificial Sequence
  Synthetic Polynucleotide
taatacgactcactatagggagcggcacacaaactccttcttctccccgtaacagaggagaacggggatgagaaggagtaacctggcggcagcgcaaaagatg

SEQ ID NO: 126614 - DNA, 103 bp, Artificial Sequence
  Synthetic Polynucleotide
taatacgactcactatagggcaggcctgccagcggcacacaaactccttcaacagaggagagaaggaatgtgtgtgccgaacctggcggcagcgcaaaagatg

SEQ ID NO: 126615 - DNA, 103 bp, Artificial Sequence
  Synthetic Polynucleotide
taatacgactcactatagggctcccgcgtgcaggcctgccagcggcacacaacagaggagagtgtgcatgtggcaggccaacctggcggcagcgcaaaagatg

SEQ ID NO: 126616 - DNA, 103 bp, Artificial Sequence
  Synthetic Polynucleotide
taatacgactcactatagggagggcttctgctcccgcgtgcaggcctgccaacagaggagaggcaggatggcacgcgggaacctggcggcagcgcaaaagatg

SEQ ID NO: 126617 - DNA, 103 bp, Artificial Sequence
  Synthetic Polynucleotide
taatacgactcactatagggtgcgccttgaagggcttctgctcccgcgtgaacagaggagacacgcgatggcagaagccaacctggcggcagcgcaaaagatg

SEQ ID NO: 126618 - DNA, 103 bp, Artificial Sequence
  Synthetic Polynucleotide
taatacgactcactatagggcagcatgtactgcgccttgaagggcttctgaacagaggagacagaagatgttcaaggcgaacctggcggcagcgcaaaagatg

SEQ ID NO: 126619 - DNA, 103 bp, Artificial Sequence
  Synthetic Polynucleotide
taatacgactcactatagggtgtgcaccaccagcatgtactgcgccttgaaacagaggagatcaaggatgagtacatgcaacctggcggcagcgcaaaagatg

SEQ ID NO: 126620 - DNA, 103 bp, Artificial Sequence
  Synthetic Polynucleotide
taatacgactcactatagggtgtcgccgcatgtgcaccaccagcatgtacaacagaggagagtacatatgggtggtgcaaacctggcggcagcgcaaaagatg

SEQ ID NO: 126621 - DNA, 103 bp, Artificial Sequence
  Synthetic Polynucleotide
taatacgactcactatagggctcgcccgtgtgtcgccgcatgtgcaccacaacagaggagagtggtgatgatgcggcgaaacctggcggcagcgcaaaagatg

SEQ ID NO: 126622 - DNA, 103 bp, Artificial Sequence
  Synthetic Polynucleotide
taatacgactcactatagggtgtggggcttctcgcccgtgtgtcgccgcaaacagaggagatgcggcatgacacgggcgaacctggcggcagcgcaaaagatg

SEQ ID NO: 126623 - DNA, 103 bp, Artificial Sequence
  Synthetic Polynucleotide
taatacgactcactatagggggtggcaagagatgctgcggcactccttggaacagaggagaccaaggatggccgcagcaaacctggcggcagcgcaaaagatg

SEQ ID NO: 126624 - DNA, 103 bp, Artificial Sequence
  Synthetic Polynucleotide
taatacgactcactatagggaacgtgcacttgtggggcttctcgcccgtgaacagaggagacacgggatggaagccccaaacctggcggcagcgcaaaagatg

SEQ ID NO: 126625 - DNA, 103 bp, Artificial Sequence
  Synthetic Polynucleotide
taatacgactcactataggggcagccctcgaacgtgcacttgtggggcttaacagaggagaaagcccatgaagtgcacgaacctggcggcagcgcaaaagatg

SEQ ID NO: 126626 - DNA, 103 bp, Artificial Sequence
  Synthetic Polynucleotide
taatacgactcactatagggaggccttcgagcagccctcgaacgtgcactaacagaggagaagtgcaatgtcgagggctaacctggcggcagcgcaaaagatg

SEQ ID NO: 126627 - DNA, 103 bp, Artificial Sequence
  Synthetic Polynucleotide
taatacgactcactatagggaggcgggagtaggccttcgagcagccctcgaacagaggagacgagggatgctcgaaggcaacctggcggcagcgcaaaagatg

SEQ ID NO: 126628 - DNA, 103 bp, Artificial Sequence
  Synthetic Polynucleotide
taatacgactcactatagggcaggttctccaggcgggagtaggccttcgaaacagaggagatcgaagatgtactcccgcaacctggcggcagcgcaaaagatg

SEQ ID NO: 126629 - DNA, 103 bp, Artificial Sequence
  Synthetic Polynucleotide
taatacgactcactatagggggtgtgtcttcaggttctccaggcgggagtaacagaggagaactcccatgtggagaaccaacctggcggcagcgcaaaagatg

SEQ ID NO: 126630 - DNA, 103 bp, Artificial Sequence
  Synthetic Polynucleotide
taatacgactcactatagggtgggaccgcaggtgtgtcttcaggttctccaacagaggagaggagaaatggaagacacaaacctggcggcagcgcaaaagatg

SEQ ID NO: 126631 - DNA, 103 bp, Artificial Sequence
  Synthetic Polynucleotide
taatacgactcactatagggctccccggtgtgggaccgcaggtgtgtcttaacagaggagaaagacaatgctgcggtccaacctggcggcagcgcaaaagatg

SEQ ID NO: 126632 - DNA, 103 bp, Artificial Sequence
  Synthetic Polynucleotide
taatacgactcactatagggcatatggcttctccccggtgtgggaccgcaaacagaggagatgcggtatgacaccggggaacctggcggcagcgcaaaagatg

SEQ ID NO: 126633 - DNA, 103 bp, Artificial Sequence
  Synthetic Polynucleotide
taatacgactcactatagggtgctcacacacatatggcttctccccggtgaacagaggagacaccggatggaagccataaacctggcggcagcgcaaaagatg

SEQ ID NO: 126634 - DNA, 103 bp, Artificial Sequence
  Synthetic Polynucleotide
taatacgactcactatagggcgcatggaatggtggcaagagatgctgcggaacagaggagaccgcagatgctcttgccaaacctggcggcagcgcaaaagatg

SEQ ID NO: 126635 - DNA, 103 bp, Artificial Sequence
  Synthetic Polynucleotide
taatacgactcactataggggcagccctcgtgctcacacacatatggcttaacagaggagaaagccaatggtgtgtgagaacctggcggcagcgcaaaagatg

SEQ ID NO: 126636 - DNA, 103 bp, Artificial Sequence
  Synthetic Polynucleotide
taatacgactcactatagggaggctttgttgcagccctcgtgctcacacaaacagaggagatgtgtgatgacgagggctaacctggcggcagcgcaaaagatg

SEQ ID NO: 126637 - DNA, 103 bp, Artificial Sequence
  Synthetic Polynucleotide
taatacgactcactataggggcgttggagaaggctttgttgcagccctcgaacagaggagacgagggatgcaacaaagcaacctggcggcagcgcaaaagatg

SEQ ID NO: 126638 - DNA, 103 bp, Artificial Sequence
  Synthetic Polynucleotide
taatacgactcactataggggcggtccgaggcgttggagaaggctttgttaacagaggagaaacaaaatgttctccaacaacctggcggcagcgcaaaagatg

SEQ ID NO: 126639 - DNA, 103 bp, Artificial Sequence
  Synthetic Polynucleotide
taatacgactcactatagggggtgcttggcgcggtccgaggcgttggagaaacagaggagatctccaatgcctcggaccaacctggcggcagcgcaaaagatg

SEQ ID NO: 126640 - DNA, 103 bp, Artificial Sequence
  Synthetic Polynucleotide
taatacgactcactataggggtgcgattctggtgcttggcgcggtccgagaacagaggagactcggaatgcgccaagcaaacctggcggcagcgcaaaagatg

SEQ ID NO: 126641 - DNA, 103 bp, Artificial Sequence
  Synthetic Polynucleotide
taatacgactcactataggggttggagtgggtgcgattctggtgcttggcaacagaggagagccaagatgcagaatcgcaacctggcggcagcgcaaaagatg

SEQ ID NO: 126642 - DNA, 103 bp, Artificial Sequence
  Synthetic Polynucleotide
taatacgactcactatagggagggtttctcgttggagtgggtgcgattctaacagaggagaagaatcatgcccactccaaacctggcggcagcgcaaaagatg

SEQ ID NO: 126643 - DNA, 103 bp, Artificial Sequence
  Synthetic Polynucleotide
taatacgactcactatagggttgcagatgtagggtttctcgttggagtggaacagaggagaccactcatgcgagaaaccaacctggcggcagcgcaaaagatg

SEQ ID NO: 126644 - DNA, 103 bp, Artificial Sequence
  Synthetic Polynucleotide
taatacgactcactataggggcctgggatcttgcagatgtagggtttctcaacagaggagagagaaaatgtacatctgcaacctggcggcagcgcaaaagatg

SEQ ID NO: 126645 - DNA, 103 bp, Artificial Sequence
  Synthetic Polynucleotide
taatacgactcactatagggtcggtaggggcgcatggaatggtggcaagaaacagaggagatcttgcatgcattccatgaacctggcggcagcgcaaaagatg

SEQ ID NO: 126646 - DNA, 103 bp, Artificial Sequence
  Synthetic Polynucleotide
taatacgactcactatagggtcttggtgcagcctgggatcttgcagatgtaacagaggagaacatctatgagatcccagaacctggcggcagcgcaaaagatg

SEQ ID NO: 126647 - DNA, 103 bp, Artificial Sequence
  Synthetic Polynucleotide
taatacgactcactatagggtctgtgtatctcttggtgcagcctgggatcaacagaggagagatcccatgctgcaccaaaacctggcggcagcgcaaaagatg

SEQ ID NO: 126648 - DNA, 103 bp, Artificial Sequence
  Synthetic Polynucleotide
taatacgactcactatagggagagctggggtctgtgtatctcttggtgcaaacagaggagatgcaccatgagatacacaaacctggcggcagcgcaaaagatg

SEQ ID NO: 126649 - DNA, 103 bp, Artificial Sequence
  Synthetic Polynucleotide
taatacgactcactataggggcttccggagagagctggggtctgtgtatcaacagaggagagatacaatgaccccagctaacctggcggcagcgcaaaagatg

SEQ ID NO: 126650 - DNA, 103 bp, Artificial Sequence
  Synthetic Polynucleotide
taatacgactcactataggggttttcacatgcttccggagagagctggggaacagaggagaccccagatgtctccggaaaacctggcggcagcgcaaaagatg

SEQ ID NO: 126651 - DNA, 103 bp, Artificial Sequence
  Synthetic Polynucleotide
taatacgactcactataggggccgtggaccgttttcacatgcttccggagaacagaggagactccggatgcatgtgaaaaacctggcggcagcgcaaaagatg

SEQ ID NO: 126652 - DNA, 103 bp, Artificial Sequence
  Synthetic Polynucleotide
taatacgactcactataggggggcatctgggccgtggaccgttttcacataacagaggagaatgtgaatgcggtccacgaacctggcggcagcgcaaaagatg

SEQ ID NO: 126653 - DNA, 103 bp, Artificial Sequence
  Synthetic Polynucleotide
taatacgactcactatagggttggtgacgtgggcatctgggccgtggaccaacagaggagaggtccaatgcccagatgcaacctggcggcagcgcaaaagatg

SEQ ID NO: 126654 - DNA, 103 bp, Artificial Sequence
  Synthetic Polynucleotide
taatacgactcactataggggcgctgcttcttggtgacgtgggcatctggaacagaggagaccagatatgcacgtcaccaacctggcggcagcgcaaaagatg

SEQ ID NO: 126655 - DNA, 103 bp, Artificial Sequence
  Synthetic Polynucleotide
taatacgactcactataggggcacgtcattgcgctgcttcttggtgacgtaacagaggagaacgtcaatgagaagcagcaacctggcggcagcgcaaaagatg

SEQ ID NO: 126656 - DNA, 103 bp, Artificial Sequence
  Synthetic Polynucleotide
taatacgactcactatagggcgcatgtcaatcggtaggggcgcatggaataacagaggagaattccaatggcccctaccaacctggcggcagcgcaaaagatg

SEQ ID NO: 126657 - DNA, 103 bp, Artificial Sequence
  Synthetic Polynucleotide
taatacgactcactataggggtgcggaggtgcacgtcattgcgctgcttcaacagaggagagaagcaatgcaatgacgtaacctggcggcagcgcaaaagatg

SEQ ID NO: 126658 - DNA, 103 bp, Artificial Sequence
  Synthetic Polynucleotide
taatacgactcactataggggagcagcggtgtgcggaggtgcacgtcattaacagaggagaaatgacatgcacctccgcaacctggcggcagcgcaaaagatg

SEQ ID NO: 126659 - DNA, 103 bp, Artificial Sequence
  Synthetic Polynucleotide
taatacgactcactatagggcattctctttgagcagcggtgtgcggaggtaacagaggagaacctccatgcaccgctgcaacctggcggcagcgcaaaagatg

SEQ ID NO: 126660 - DNA, 103 bp, Artificial Sequence
  Synthetic Polynucleotide
taatacgactcactatagggtcactgtccccattctctttgagcagcggtaacagaggagaaccgctatgcaaagagaaaacctggcggcagcgcaaaagatg

SEQ ID NO: 126661 - DNA, 103 bp, Artificial Sequence
  Synthetic Polynucleotide
taatacgactcactatagggcgtgccggcctcactgtccccattctctttaacagaggagaaaagagatgggggacagtaacctggcggcagcgcaaaagatg

SEQ ID NO: 126662 - DNA, 103 bp, Artificial Sequence
  Synthetic Polynucleotide
taatacgactcactatagggcgccaggctccgtgccggcctcactgtcccaacagaggagagggacaatgaggccggcaaacctggcggcagcgcaaaagatg

SEQ ID NO: 126663 - DNA, 103 bp, Artificial Sequence
  Synthetic Polynucleotide
taatacgactcactatagggctctctgggccgccaggctccgtgccggccaacagaggagaggccggatgggagcctggaacctggcggcagcgcaaaagatg

SEQ ID NO: 126664 - DNA, 103 bp, Artificial Sequence
  Synthetic Polynucleotide
taatacgactcactatagggggcctcggtgctctctgggccgccaggctcaacagaggagagagcctatgggcccagagaacctggcggcagcgcaaaagatg

SEQ ID NO: 126665 - DNA, 103 bp, Artificial Sequence
  Synthetic Polynucleotide
taatacgactcactatagggtggtgctgctggcctcggtgctctctgggcaacagaggagagcccagatggcaccgaggaacctggcggcagcgcaaaagatg

SEQ ID NO: 126666 - DNA, 103 bp, Artificial Sequence
  Synthetic Polynucleotide
taatacgactcactatagggacggcctggctggtgctgctggcctcggtgaacagaggagacaccgaatgcagcagcacaacctggcggcagcgcaaaagatg

SEQ ID NO: 126667 - DNA, 103 bp, Artificial Sequence
  Synthetic Polynucleotide
taatacgactcactatagggttcctggtgtcgcatgtcaatcggtaggggaacagaggagacccctaatgattgacatgaacctggcggcagcgcaaaagatg

SEQ ID NO: 126668 - DNA, 103 bp, Artificial Sequence
  Synthetic Polynucleotide
taatacgactcactataggggcagtcctccacggcctggctggtgctgctaacagaggagaagcagcatgagccaggccaacctggcggcagcgcaaaagatg

SEQ ID NO: 126669 - DNA, 103 bp, Artificial Sequence
  Synthetic Polynucleotide
taatacgactcactatagggtgacgtgcaggcagtcctccacggcctggcaacagaggagagccaggatgtggaggactaacctggcggcagcgcaaaagatg

SEQ ID NO: 126670 - DNA, 103 bp, Artificial Sequence
  Synthetic Polynucleotide
taatacgactcactatagggttgatggctctgacgtgcaggcagtcctccaacagaggagaggaggaatgcctgcacgtaacctggcggcagcgcaaaagatg

SEQ ID NO: 126671 - DNA, 103 bp, Artificial Sequence
  Synthetic Polynucleotide
taatacgactcactataggggctctcggtcttgatggctctgacgtgcagaacagaggagactgcacatgagagccatcaacctggcggcagcgcaaaagatg

SEQ ID NO: 126672 - DNA, 103 bp, Artificial Sequence
  Synthetic Polynucleotide
taatacgactcactatagggacagcccggagctctcggtcttgatggctcaacagaggagagagccaatgagaccgagaaacctggcggcagcgcaaaagatg

SEQ ID NO: 126673 - DNA, 103 bp, Artificial Sequence
  Synthetic Polynucleotide
taatacgactcactatagggctggactgacacagcccggagctctcggtcaacagaggagagaccgaatgctccgggctaacctggcggcagcgcaaaagatg

SEQ ID NO: 126674 - DNA, 103 bp, Artificial Sequence
  Synthetic Polynucleotide
taatacgactcactatagggggccccggggctggactgacacagcccggaaacagaggagatccgggatgtgtcagtccaacctggcggcagcgcaaaagatg

SEQ ID NO: 126675 - DNA, 103 bp, Artificial Sequence
  Synthetic Polynucleotide
taatacgactcactatagggaggacgactgggccccggggctggactgacaacagaggagagtcagtatggccccggggaacctggcggcagcgcaaaagatg

SEQ ID NO: 126676 - DNA, 103 bp, Artificial Sequence
  Synthetic Polynucleotide
taatacgactcactatagggtcgctgctgcaggacgactgggccccggggaacagaggagaccccggatgccagtcgtcaacctggcggcagcgcaaaagatg

SEQ ID NO: 126677 - DNA, 103 bp, Artificial Sequence
  Synthetic Polynucleotide
taatacgactcactatagggaggagagggctcgctgctgcaggacgactgaacagaggagacagtcgatgtgcagcagcaacctggcggcagcgcaaaagatg

SEQ ID NO: 126678 - DNA, 103 bp, Artificial Sequence
  Synthetic Polynucleotide
taatacgactcactatagggcttgcttctcggaggcagtggctgaggcagaacagaggagactgcctatgccactgcctaacctggcggcagcgcaaaagatg

SEQ ID NO: 126679 - DNA, 103 bp, Artificial Sequence
  Synthetic Polynucleotide
taatacgactcactatagggggtaccttccttcctggtgtcgcatgtcaaaacagaggagattgacaatggacaccaggaacctggcggcagcgcaaaagatg

SEQ ID NO: 126680 - DNA, 103 bp, Artificial Sequence
  Synthetic Polynucleotide
taatacgactcactatagggcactgcccagaggagagggctcgctgctgcaacagaggagagcagcaatgagccctctcaacctggcggcagcgcaaaagatg

SEQ ID NO: 126681 - DNA, 103 bp, Artificial Sequence
  Synthetic Polynucleotide
taatacgactcactatagggttgttgggggcactgcccagaggagagggcaacagaggagagccctcatgtctgggcagaacctggcggcagcgcaaaagatg

SEQ ID NO: 126682 - DNA, 103 bp, Artificial Sequence
  Synthetic Polynucleotide
taatacgactcactataggggccactgtcattgttgggggcactgcccagaacagaggagactgggcatggcccccaacaacctggcggcagcgcaaaagatg

SEQ ID NO: 126683 - DNA, 103 bp, Artificial Sequence
  Synthetic Polynucleotide
taatacgactcactataggggcatctccacgccactgtcattgttgggggaacagaggagacccccaatgatgacagtgaacctggcggcagcgcaaaagatg

SEQ ID NO: 126684 - DNA, 103 bp, Artificial Sequence
  Synthetic Polynucleotide
taatacgactcactatagggcccgtccccggcatctccacgccactgtcaaacagaggagatgacagatgcgtggagataacctggcggcagcgcaaaagatg

SEQ ID NO: 126685 - DNA, 103 bp, Artificial Sequence
  Synthetic Polynucleotide
taatacgactcactataggggctcccgggccccgtccccggcatctccacaacagaggagagtggagatgccggggacgaacctggcggcagcgcaaaagatg

SEQ ID NO: 126686 - DNA, 103 bp, Artificial Sequence
  Synthetic Polynucleotide
taatacgactcactatagggggtctcccaggctcccgggccccgtccccgaacagaggagacggggaatgggcccgggaaacctggcggcagcgcaaaagatg

SEQ ID NO: 126687 - DNA, 103 bp, Artificial Sequence
  Synthetic Polynucleotide
taatacgactcactatagggagtgccgtcaggtctcccaggctcccgggcaacagaggagagcccggatgcctgggagaaacctggcggcagcgcaaaagatg

SEQ ID NO: 126688 - DNA, 103 bp, Artificial Sequence
  Synthetic Polynucleotide
taatacgactcactatagggtgtgtcatccagtgccgtcaggtctcccagaacagaggagactgggaatgctgacggcaaacctggcggcagcgcaaaagatg

SEQ ID NO: 126689 - DNA, 103 bp, Artificial Sequence
  Synthetic Polynucleotide
taatacgactcactatagggcccctgggggtgtgtcatccagtgccgtcaaacagaggagatgacggatgtggatgacaaacctggcggcagcgcaaaagatg

SEQ ID NO: 126690 - DNA, 103 bp, Artificial Sequence
  Synthetic Polynucleotide
taatacgactcactatagggggctcgtaatggtaccttccttcctggtgtaacagaggagaacaccaatgaggaaggtaaacctggcggcagcgcaaaagatg

SEQ ID NO: 126691 - DNA, 103 bp, Artificial Sequence
  Synthetic Polynucleotide
taatacgactcactataggggaggtgtcggcccctgggggtgtgtcatccaacagaggagaggatgaatgacccccaggaacctggcggcagcgcaaaagatg

SEQ ID NO: 126692 - DNA, 103 bp, Artificial Sequence
  Synthetic Polynucleotide
taatacgactcactatagggagccagggctgaggtgtcggcccctgggggaacagaggagacccccaatggccgacaccaacctggcggcagcgcaaaagatg

SEQ ID NO: 126693 - DNA, 103 bp, Artificial Sequence
  Synthetic Polynucleotide
taatacgactcactatagggcggagggggcagccagggctgaggtgtcggaacagaggagaccgacaatgcagccctggaacctggcggcagcgcaaaagatg

SEQ ID NO: 126694 - DNA, 103 bp, Artificial Sequence
  Synthetic Polynucleotide
taatacgactcactatagggaggccaccagcggagggggcagccagggctaacagaggagaagccctatgtgccccctcaacctggcggcagcgcaaaagatg

SEQ ID NO: 126695 - DNA, 103 bp, Artificial Sequence
  Synthetic Polynucleotide
taatacgactcactataggggcgcagctggaggccaccagcggagggggcaacagaggagagcccccatggctggtggcaacctggcggcagcgcaaaagatg

SEQ ID NO: 126696 - DNA, 103 bp, Artificial Sequence
  Synthetic Polynucleotide
taatacgactcactatagggtcatgtgtttgcgcagctggaggccaccagaacagaggagactggtgatgtccagctgcaacctggcggcagcgcaaaagatg

SEQ ID NO: 126697 - DNA, 103 bp, Artificial Sequence
  Synthetic Polynucleotide
taatacgactcactatagggtgcatggtggtcatgtgtttgcgcagctggaacagaggagaccagctatgcaaacacataacctggcggcagcgcaaaagatg

SEQ ID NO: 126698 - DNA, 103 bp, Artificial Sequence
  Synthetic Polynucleotide
taatacgactcactatagggctcgaaccggtgcatggtggtcatgtgtttaacagaggagaaaacacatgaccaccatgaacctggcggcagcgcaaaagatg

SEQ ID NO: 126699 - DNA, 103 bp, Artificial Sequence
  Synthetic Polynucleotide
taatacgactcactatagggtcttgagctgctcgaaccggtgcatggtggaacagaggagaccaccaatgaccggttcgaacctggcggcagcgcaaaagatg

SEQ ID NO: 126700 - DNA, 103 bp, Artificial Sequence
  Synthetic Polynucleotide
taatacgactcactatagggagcttctccttcttgagctgctcgaaccggaacagaggagaccggttatggcagctcaaaacctggcggcagcgcaaaagatg

SEQ ID NO: 126701 - DNA, 103 bp, Artificial Sequence
  Synthetic Polynucleotide
taatacgactcactataggggacagaatgaggctcgtaatggtaccttccaacagaggagaggaaggatgcattacgagaacctggcggcagcgcaaaagatg

SEQ ID NO: 126702 - DNA, 103 bp, Artificial Sequence
  Synthetic Polynucleotide
taatacgactcactataggggagtgacttgagcttctccttcttgagctgaacagaggagacagctcatgaaggagaagaacctggcggcagcgcaaaagatg

SEQ ID NO: 126703 - DNA, 103 bp, Artificial Sequence
  Synthetic Polynucleotide
taatacgactcactatagggaggaatccttgagtgacttgagcttctcctaacagaggagaaggagaatgtcaagtcacaacctggcggcagcgcaaaagatg

SEQ ID NO: 126704 - DNA, 103 bp, Artificial Sequence
  Synthetic Polynucleotide
taatacgactcactataggggcccatgagcaggaatccttgagtgacttgaacagaggagacaagtcatgcaaggattcaacctggcggcagcgcaaaagatg

SEQ ID NO: 126705 - DNA, 103 bp, Artificial Sequence
  Synthetic Polynucleotide
taatacgactcactatagggagtcggcccggcccatgagcaggaatccttaacagaggagaaaggatatgtgctcatggaacctggcggcagcgcaaaagatg

SEQ ID NO: 126706 - DNA, 103 bp, Artificial Sequence
  Synthetic Polynucleotide
taatacgactcactataggggcgtgtgtggagtcggcccggcccatgagcaacagaggagagctcatatgccgggccgaaacctggcggcagcgcaaaagatg

SEQ ID NO: 126707 - DNA, 103 bp, Artificial Sequence
  Synthetic Polynucleotide
taatacgactcactatagggttggtgttccgcgtgtgtggagtcggcccgaacagaggagacgggccatgtccacacacaacctggcggcagcgcaaaagatg

SEQ ID NO: 126708 - DNA, 103 bp, Artificial Sequence
  Synthetic Polynucleotide
taatacgactcactataggggggaggcagcttggtgttccgcgtgtgtggaacagaggagaccacacatgcggaacaccaacctggcggcagcgcaaaagatg

SEQ ID NO: 126709 - DNA, 103 bp, Artificial Sequence
  Synthetic Polynucleotide
taatacgactcactatagggttcccgggaggggaggcagcttggtgttccaacagaggagaggaacaatgagctgcctcaacctggcggcagcgcaaaagatg

SEQ ID NO: 126710 - DNA, 103 bp, Artificial Sequence
  Synthetic Polynucleotide
taatacgactcactatagggatggagccacttcccgggaggggaggcagcaacagaggagagctgccatgcctcccgggaacctggcggcagcgcaaaagatg

SEQ ID NO: 126711 - DNA, 103 bp, Artificial Sequence
  Synthetic Polynucleotide
taatacgactcactataggggttttccaggatggagccacttcccgggagaacagaggagactcccgatgagtggctccaacctggcggcagcgcaaaagatg

SEQ ID NO: 126712 - DNA, 103 bp, Artificial Sequence
  Synthetic Polynucleotide
taatacgactcactataggggcacaccgtggacagaatgaggctcgtaataacagaggagaattacgatgctcattctgaacctggcggcagcgcaaaagatg

SEQ ID NO: 126713 - DNA, 103 bp, Artificial Sequence
  Synthetic Polynucleotide
taatacgactcactatagggtgccactgaagttttccaggatggagccacaacagaggagagtggctatgtcctggaaaaacctggcggcagcgcaaaagatg

SEQ ID NO: 126714 - DNA, 103 bp, Artificial Sequence
  Synthetic Polynucleotide
taatacgactcactatagggccgcccccactgccactgaagttttccaggaacagaggagacctggaatgcttcagtggaacctggcggcagcgcaaaagatg

SEQ ID NO: 126715 - DNA, 103 bp, Artificial Sequence
  Synthetic Polynucleotide
taatacgactcactatagggcgcgggcccgccgcccccactgccactgaaaacagaggagattcagtatgagtgggggcaacctggcggcagcgcaaaagatg

SEQ ID NO: 126716 - DNA, 103 bp, Artificial Sequence
  Synthetic Polynucleotide
taatacgactcactataggggcagcagccccgcgggcccgccgcccccacaacagaggagagtggggatggcgggcccgaacctggcggcagcgcaaaagatg

SEQ ID NO: 126717 - DNA, 103 bp, Artificial Sequence
  Synthetic Polynucleotide
taatacgactcactatagggcgcgggttcggcagcagccccgcgggcccgaacagaggagacgggccatgggggctgctaacctggcggcagcgcaaaagatg

SEQ ID NO: 126718 - DNA, 103 bp, Artificial Sequence
  Synthetic Polynucleotide
taatacgactcactatagggctccgacagccgcgggttcggcagcagcccaacagaggagagggctgatgccgaacccgaacctggcggcagcgcaaaagatg

SEQ ID NO: 126719 - DNA, 103 bp, Artificial Sequence
  Synthetic Polynucleotide
taatacgactcactatagggtcgcggacagctccgacagccgcgggttcgaacagaggagacgaaccatgggctgtcggaacctggcggcagcgcaaaagatg

SEQ ID NO: 126720 - DNA, 103 bp, Artificial Sequence
  Synthetic Polynucleotide
taatacgactcactataggggtcacctcgctcgcggacagctccgacagcaacagaggagagctgtcatggctgtccgcaacctggcggcagcgcaaaagatg

SEQ ID NO: 126721 - DNA, 103 bp, Artificial Sequence
  Synthetic Polynucleotide
taatacgactcactataggggctcagcatggtcacctcgctcgcggacagaacagaggagactgtccatgagcgaggtgaacctggcggcagcgcaaaagatg

SEQ ID NO: 126722 - DNA, 103 bp, Artificial Sequence
  Synthetic Polynucleotide
taatacgactcactatagggcctgcagctggctcagcatggtcacctcgcaacagaggagagcgaggatgccatgctgaaacctggcggcagcgcaaaagatg

SEQ ID NO: 126723 - DNA, 103 bp, Artificial Sequence
  Synthetic Polynucleotide
taatacgactcactataggggggggcccgtgcacaccgtggacagaatgaaacagaggagatcattcatgccacggtgtaacctggcggcagcgcaaaagatg

SEQ ID NO: 126724 - DNA, 103 bp, Artificial Sequence
  Synthetic Polynucleotide
taatacgactcactatagggtcgcggcgctcctgcagctggctcagcatgaacagaggagacatgctatgccagctgcaaacctggcggcagcgcaaaagatg

SEQ ID NO: 126725 - DNA, 103 bp, Artificial Sequence
  Synthetic Polynucleotide
taatacgactcactatagggggtggagctgtcgcggcgctcctgcagctgaacagaggagacagctgatggagcgccgcaacctggcggcagcgcaaaagatg

SEQ ID NO: 126726 - DNA, 103 bp, Artificial Sequence
  Synthetic Polynucleotide
taatacgactcactatagggtgaccgtgctggtggagctgtcgcggcgctaacagaggagaagcgccatgacagctccaaacctggcggcagcgcaaaagatg

SEQ ID NO: 126727 - DNA, 103 bp, Artificial Sequence
  Synthetic Polynucleotide
taatacgactcactatagggtaggccgagctgaccgtgctggtggagctgaacagaggagacagctcatgcagcacggtaacctggcggcagcgcaaaagatg

SEQ ID NO: 126728 - DNA, 103 bp, Artificial Sequence
  Synthetic Polynucleotide
taatacgactcactataggggctcacggtgtaggccgagctgaccgtgctaacagaggagaagcacgatgagctcggccaacctggcggcagcgcaaaagatg

SEQ ID NO: 126729 - DNA, 103 bp, Artificial Sequence
  Synthetic Polynucleotide
taatacgactcactatagggaggagcggcggctcacggtgtaggccgagcaacagaggagagctcggatgacaccgtgaaacctggcggcagcgcaaaagatg

SEQ ID NO: 126730 - DNA, 103 bp, Artificial Sequence
  Synthetic Polynucleotide
taatacgactcactataggggagatgccggaggagcggcggctcacggtgaacagaggagacaccgtatgccgccgctcaacctggcggcagcgcaaaagatg

SEQ ID NO: 126731 - DNA, 103 bp, Artificial Sequence
  Synthetic Polynucleotide
taatacgactcactataggggaagtagggggagatgccggaggagcggcgaacagaggagacgccgcatgtccggcatcaacctggcggcagcgcaaaagatg

SEQ ID NO: 126732 - DNA, 103 bp, Artificial Sequence
  Synthetic Polynucleotide
taatacgactcactatagggggcggctggagaagtagggggagatgccggaacagaggagaccggcaatgccccctactaacctggcggcagcgcaaaagatg

SEQ ID NO: 126733 - DNA, 103 bp, Artificial Sequence
  Synthetic Polynucleotide
taatacgactcactatagggtcgctggagcggcggctggagaagtaggggaacagaggagacccctaatgctccagccgaacctggcggcagcgcaaaagatg

SEQ ID NO: 126734 - DNA, 103 bp, Artificial Sequence
  Synthetic Polynucleotide
taatacgactcactataggggctgagggcagggggcccgtgcacaccgtgaacagaggagacacggtatgcacgggcccaacctggcggcagcgcaaaagatg

SEQ ID NO: 126735 - DNA, 103 bp, Artificial Sequence
  Synthetic Polynucleotide
taatacgactcactataggggggcgaggcctcgctggagcggcggctggaaacagaggagatccagcatgcgctccagcaacctggcggcagcgcaaaagatg

SEQ ID NO: 126736 - DNA, 103 bp, Artificial Sequence
  Synthetic Polynucleotide
taatacgactcactatagggcggcgcccaggggcgaggcctcgctggagcaacagaggagagctccaatgaggcctcgcaacctggcggcagcgcaaaagatg

SEQ ID NO: 126737 - DNA, 103 bp, Artificial Sequence
  Synthetic Polynucleotide
taatacgactcactatagggtgcgggcggccggcgcccaggggcgaggccaacagaggagaggcctcatgcctgggcgcaacctggcggcagcgcaaaagatg

SEQ ID NO: 126738 - DNA, 103 bp, Artificial Sequence
  Synthetic Polynucleotide
taatacgactcactataggggctcgcgttgtgcgggcggccggcgcccagaacagaggagactgggcatgggccgcccgaacctggcggcagcgcaaaagatg

SEQ ID NO: 126739 - DNA, 103 bp, Artificial Sequence
  Synthetic Polynucleotide
taatacgactcactatagggagtcagcggagctcgcgttgtgcgggcggcaacagaggagagccgccatgacaacgcgaaacctggcggcagcgcaaaagatg

SEQ ID NO: 126740 - DNA, 103 bp, Artificial Sequence
  Synthetic Polynucleotide
taatacgactcactataggggggtcgtaggagtcagcggagctcgcgttgaacagaggagacaacgcatgctccgctgaaacctggcggcagcgcaaaagatg

SEQ ID NO: 126741 - DNA, 103 bp, Artificial Sequence
  Synthetic Polynucleotide
taatacgactcactatagggcgtggagatggggtcgtaggagtcagcggaaacagaggagatccgctatgtcctacgacaacctggcggcagcgcaaaagatg

SEQ ID NO: 126742 - DNA, 103 bp, Artificial Sequence
  Synthetic Polynucleotide
taatacgactcactataggggcgacgcgtccgtggagatggggtcgtaggaacagaggagacctacgatgccatctccaaacctggcggcagcgcaaaagatg

SEQ ID NO: 126743 - DNA, 103 bp, Artificial Sequence
  Synthetic Polynucleotide
taatacgactcactatagggctcgagcgccgcgacgcgtccgtggagatgaacagaggagacatctcatgggacgcgtcaacctggcggcagcgcaaaagatg

SEQ ID NO: 126744 - DNA, 103 bp, Artificial Sequence
  Synthetic Polynucleotide
taatacgactcactataggggctggcctcgctcgagcgccgcgacgcgtcaacagaggagagacgcgatgcggcgctcgaacctggcggcagcgcaaaagatg

SEQ ID NO: 126745 - DNA, 103 bp, Artificial Sequence
  Synthetic Polynucleotide
taatacgactcactatagggcagggctgccgctgagggcagggggcccgtaacagaggagaacgggcatgctgccctcaaacctggcggcagcgcaaaagatg

SEQ ID NO: 126746 - DNA, 103 bp, Artificial Sequence
  Synthetic Polynucleotide
taatacgactcactatagggcgctgcactggctggcctcgctcgagcgccaacagaggagaggcgctatggcgaggccaaacctggcggcagcgcaaaagatg

SEQ ID NO: 126747 - DNA, 103 bp, Artificial Sequence
  Synthetic Polynucleotide
taatacgactcactatagggccggagccgccgctgcactggctggcctcgaacagaggagacgaggcatgccagtgcagaacctggcggcagcgcaaaagatg

SEQ ID NO: 126748 - DNA, 103 bp, Artificial Sequence
  Synthetic Polynucleotide
taatacgactcactataggggttgagcagcccggagccgccgctgcactgaacagaggagacagtgcatgggcggctccaacctggcggcagcgcaaaagatg

SEQ ID NO: 126749 - DNA, 103 bp, Artificial Sequence
  Synthetic Polynucleotide
taatacgactcactatagggccggcgtgaggttgagcagcccggagccgcaacagaggagagcggctatgggctgctcaaacctggcggcagcgcaaaagatg

SEQ ID NO: 126750 - DNA, 103 bp, Artificial Sequence
  Synthetic Polynucleotide
taatacgactcactatagggtactgctgcgccggcgtgaggttgagcagcaacagaggagagctgctatgcctcacgccaacctggcggcagcgcaaaagatg

SEQ ID NO: 126751 - DNA, 103 bp, Artificial Sequence
  Synthetic Polynucleotide
taatacgactcactatagggccgcaggctgtactgctgcgccggcgtgagaacagaggagactcacgatggcgcagcagaacctggcggcagcgcaaaagatg

SEQ ID NO: 126752 - DNA, 103 bp, Artificial Sequence
  Synthetic Polynucleotide
taatacgactcactatagggcgtacttggcccgcaggctgtactgctgcgaacagaggagacgcagcatgacagcctgcaacctggcggcagcgcaaaagatg

SEQ ID NO: 126753 - DNA, 103 bp, Artificial Sequence
  Synthetic Polynucleotide
taatacgactcactataggggtggctgccgcgtacttggcccgcaggctgaacagaggagacagcctatgggccaagtaaacctggcggcagcgcaaaagatg

SEQ ID NO: 126754 - DNA, 103 bp, Artificial Sequence
  Synthetic Polynucleotide
taatacgactcactatagggggggccgccagtggctgccgcgtacttggcaacagaggagagccaagatggcggcagccaacctggcggcagcgcaaaagatg

SEQ ID NO: 126755 - DNA, 103 bp, Artificial Sequence
  Synthetic Polynucleotide
taatacgactcactataggggagtgggcggggggccgccagtggctgccgaacagaggagacggcagatgctggcggccaacctggcggcagcgcaaaagatg

SEQ ID NO: 126756 - DNA, 103 bp, Artificial Sequence
  Synthetic Polynucleotide
taatacgactcactatagggtcagagatgacagggctgccgctgagggcaaacagaggagatgccctatgcggcagcccaacctggcggcagcgcaaaagatg

SEQ ID NO: 126757 - DNA, 103 bp, Artificial Sequence
  Synthetic Polynucleotide
taatacgactcactatagggcccggcagcggagtgggcggggggccgccaaacagaggagatggcggatgcccgcccacaacctggcggcagcgcaaaagatg

SEQ ID NO: 126758 - DNA, 103 bp, Artificial Sequence
  Synthetic Polynucleotide
taatacgactcactataggggcgctccaggcccggcagcggagtgggcggaacagaggagaccgcccatgccgctgccgaacctggcggcagcgcaaaagatg

SEQ ID NO: 126759 - DNA, 103 bp, Artificial Sequence
  Synthetic Polynucleotide
taatacgactcactataggggcaggctcatgcgctccaggcccggcagcgaacagaggagacgctgcatggcctggagcaacctggcggcagcgcaaaagatg

SEQ ID NO: 126760 - DNA, 103 bp, Artificial Sequence
  Synthetic Polynucleotide
taatacgactcactatagggagcctggtccgcaggctcatgcgctccaggaacagaggagacctggaatgcatgagcctaacctggcggcagcgcaaaagatg

SEQ ID NO: 126761 - DNA, 103 bp, Artificial Sequence
  Synthetic Polynucleotide
taatacgactcactatagggcagcagcgccagcctggtccgcaggctcataacagaggagaatgagcatgcggaccaggaacctggcggcagcgcaaaagatg

SEQ ID NO: 126762 - DNA, 103 bp, Artificial Sequence
  Synthetic Polynucleotide
taatacgactcactatagggcgggcgcgtccagcagcgccagcctggtccaacagaggagaggaccaatgtggcgctgcaacctggcggcagcgcaaaagatg

SEQ ID NO: 126763 - DNA, 103 bp, Artificial Sequence
  Synthetic Polynucleotide
taatacgactcactatagggagcgtgcgctcgggcgcgtccagcagcgccaacagaggagaggcgctatgggacgcgccaacctggcggcagcgcaaaagatg

SEQ ID NO: 126764 - DNA, 103 bp, Artificial Sequence
  Synthetic Polynucleotide
taatacgactcactataggggccggcgggcagcgtgcgctcgggcgcgtcaacagaggagagacgcgatggagcgcacgaacctggcggcagcgcaaaagatg

SEQ ID NO: 126765 - DNA, 103 bp, Artificial Sequence
  Synthetic Polynucleotide
taatacgactcactatagggggcgtgggcagccggcgggcagcgtgcgctaacagaggagaagcgcaatgtgcccgccgaacctggcggcagcgcaaaagatg

SEQ ID NO: 126766 - DNA, 103 bp, Artificial Sequence
  Synthetic Polynucleotide
taatacgactcactatagggggccccagtgggcgtgggcagccggcgggcaacagaggagagcccgcatgctgcccacgaacctggcggcagcgcaaaagatg

SEQ ID NO: 126767 - DNA, 103 bp, Artificial Sequence
  Synthetic Polynucleotide
taatacgactcactatagggcaaggagatgtcagagatgacagggctgccaacagaggagaggcagcatggtcatctctaacctggcggcagcgcaaaagatg

SEQ ID NO: 126768 - DNA, 103 bp, Artificial Sequence
  Synthetic Polynucleotide
taatacgactcactataggggccacgccgcggccccagtgggcgtgggcaaacagaggagatgcccaatgccactggggaacctggcggcagcgcaaaagatg

SEQ ID NO: 126769 - DNA, 103 bp, Artificial Sequence
  Synthetic Polynucleotide
taatacgactcactataggggcccgtcgctgccacgccgcggccccagtgaacagaggagacactggatgcgcggcgtgaacctggcggcagcgcaaaagatg

SEQ ID NO: 126770 - DNA, 103 bp, Artificial Sequence
  Synthetic Polynucleotide
taatacgactcactatagggccataggtcggcccgtcgctgccacgccgcaacagaggagagcggcgatgcagcgacggaacctggcggcagcgcaaaagatg

SEQ ID NO: 126771 - DNA, 103 bp, Artificial Sequence
  Synthetic Polynucleotide
taatacgactcactataggggtggccgtggccataggtcggcccgtcgctaacagaggagaagcgacatgccgacctataacctggcggcagcgcaaaagatg

SEQ ID NO: 126772 - DNA, 103 bp, Artificial Sequence
  Synthetic Polynucleotide
taatacgactcactatagggcagcccccgcgtggccgtggccataggtcgaacagaggagacgacctatggccacggccaacctggcggcagcgcaaaagatg

SEQ ID NO: 126773 - DNA, 103 bp, Artificial Sequence
  Synthetic Polynucleotide
taatacgactcactatagggaaggcgggcgcagcccccgcgtggccgtggaacagaggagaccacggatgcgcgggggcaacctggcggcagcgcaaaagatg

SEQ ID NO: 126774 - DNA, 103 bp, Artificial Sequence
  Synthetic Polynucleotide
taatacgactcactatagggctcgtgggggaaggcgggcgcagcccccgcaacagaggagagcggggatggcgcccgccaacctggcggcagcgcaaaagatg

SEQ ID NO: 126775 - DNA, 103 bp, Artificial Sequence
  Synthetic Polynucleotide
taatacgactcactatagggcgcctggagcctcgtgggggaaggcgggcgaacagaggagacgcccgatgtcccccacgaacctggcggcagcgcaaaagatg

SEQ ID NO: 126776 - DNA, 103 bp, Artificial Sequence
  Synthetic Polynucleotide
taatacgactcactatagggctggctccgccgcctggagcctcgtgggggaacagaggagacccccaatgggctccaggaacctggcggcagcgcaaaagatg

SEQ ID NO: 126777 - DNA, 103 bp, Artificial Sequence
  Synthetic Polynucleotide
taatacgactcactataggggctggcccgcctggctccgccgcctggagcaacagaggagagctccaatgggcggagccaacctggcggcagcgcaaaagatg

SEQ ID NO: 126778 - DNA, 103 bp, Artificial Sequence
  Synthetic Polynucleotide
taatacgactcactatagggaaagccggatcaaggagatgtcagagatgaaacagaggagatcatctatgacatctcctaacctggcggcagcgcaaaagatg

SEQ ID NO: 126779 - DNA, 103 bp, Artificial Sequence
  Synthetic Polynucleotide
taatacgactcactataggggcacagggtcgctggcccgcctggctccgcaacagaggagagcggagatgggcgggccaaacctggcggcagcgcaaaagatg

SEQ ID NO: 126780 - DNA, 103 bp, Artificial Sequence
  Synthetic Polynucleotide
taatacgactcactatagggtcgggccgccgcacagggtcgctggcccgcaacagaggagagcgggcatgcgaccctgtaacctggcggcagcgcaaaagatg

SEQ ID NO: 126781 - DNA, 103 bp, Artificial Sequence
  Synthetic Polynucleotide
taatacgactcactatagggggacagggcatcgggccgccgcacagggtcaacagaggagagaccctatgcggcggcccaacctggcggcagcgcaaaagatg

SEQ ID NO: 126782 - DNA, 103 bp, Artificial Sequence
  Synthetic Polynucleotide
taatacgactcactatagggcccgcggcagggacagggcatcgggccgccaacagaggagaggcggcatgatgccctgtaacctggcggcagcgcaaaagatg

SEQ ID NO: 126783 - DNA, 103 bp, Artificial Sequence
  Synthetic Polynucleotide
taatacgactcactatagggaagcgctgcacccgcggcagggacagggcaaacagaggagatgccctatgcctgccgcgaacctggcggcagcgcaaaagatg

SEQ ID NO: 126784 - DNA, 103 bp, Artificial Sequence
  Synthetic Polynucleotide
taatacgactcactatagggggtgctgtggaagcgctgcacccgcggcagaacagaggagactgccgatggtgcagcgcaacctggcggcagcgcaaaagatg

SEQ ID NO: 126785 - DNA, 103 bp, Artificial Sequence
  Synthetic Polynucleotide
taatacgactcactatagggtcacgttgtgggtgctgtggaagcgctgcaaacagaggagatgcagcatgtccacagcaaacctggcggcagcgcaaaagatg

SEQ ID NO: 126786 - DNA, 103 bp, Artificial Sequence
  Synthetic Polynucleotide
taatacgactcactataggggggccggggttcacgttgtgggtgctgtggaacagaggagaccacagatgccacaacgtaacctggcggcagcgcaaaagatg

SEQ ID NO: 126787 - DNA, 103 bp, Artificial Sequence
  Synthetic Polynucleotide
taatacgactcactataggggggcggcagcgggccggggttcacgttgtgaacagaggagacacaacatgaaccccggcaacctggcggcagcgcaaaagatg

SEQ ID NO: 126788 - DNA, 103 bp, Artificial Sequence
  Synthetic Polynucleotide
taatacgactcactatagggtgtcggcacagggcggcagcgggccggggtaacagaggagaaccccgatgcgctgccgcaacctggcggcagcgcaaaagatg

SEQ ID NO: 126789 - DNA, 103 bp, Artificial Sequence
  Synthetic Polynucleotide
taatacgactcactatagggcttttggcttcttgcttctcggaggcagtgaacagaggagacactgcatgcgagaagcaaacctggcggcagcgcaaaagatg

SEQ ID NO: 126790 - DNA, 103 bp, Artificial Sequence
  Synthetic Polynucleotide
taatacgactcactataggggggtgcggggaaagccggatcaaggagatgaacagaggagacatctcatggatccggctaacctggcggcagcgcaaaagatg

SEQ ID NO: 126791 - DNA, 103 bp, Artificial Sequence
  Synthetic Polynucleotide
taatacgactcactatagggaggcctcgcctgtcggcacagggcggcagcaacagaggagagctgccatgctgtgccgaaacctggcggcagcgcaaaagatg

SEQ ID NO: 126792 - DNA, 103 bp, Artificial Sequence
  Synthetic Polynucleotide
taatacgactcactatagggctgcaggcggaggcctcgcctgtcggcacaaacagaggagatgtgccatgaggcgaggcaacctggcggcagcgcaaaagatg

SEQ ID NO: 126793 - DNA, 103 bp, Artificial Sequence
  Synthetic Polynucleotide
taatacgactcactatagggtcgggtggctctgcaggcggaggcctcgccaacagaggagaggcgagatgtccgcctgcaacctggcggcagcgcaaaagatg

SEQ ID NO: 126794 - DNA, 103 bp, Artificial Sequence
  Synthetic Polynucleotide
taatacgactcactatagggccgtcggtgctcgggtggctctgcaggcggaacagaggagaccgcctatggagccacccaacctggcggcagcgcaaaagatg

SEQ ID NO: 126795 - DNA, 103 bp, Artificial Sequence
  Synthetic Polynucleotide
taatacgactcactatagggggccaggccgccgtcggtgctcgggtggctaacagaggagaagccacatgagcaccgacaacctggcggcagcgcaaaagatg

SEQ ID NO: 126796 - DNA, 103 bp, Artificial Sequence
  Synthetic Polynucleotide
taatacgactcactatagggaggcgccgcgggccaggccgccgtcggtgcaacagaggagagcaccgatggcggcctggaacctggcggcagcgcaaaagatg

SEQ ID NO: 126797 - DNA, 103 bp, Artificial Sequence
  Synthetic Polynucleotide
taatacgactcactatagggcggggcgagtaggcgccgcgggccaggccgaacagaggagacggcctatgccgcggcgcaacctggcggcagcgcaaaagatg

SEQ ID NO: 126798 - DNA, 103 bp, Artificial Sequence
  Synthetic Polynucleotide
taatacgactcactataggggctaggcggccggggcgagtaggcgccgcgaacagaggagacgcggcatgtactcgcccaacctggcggcagcgcaaaagatg

SEQ ID NO: 126799 - DNA, 103 bp, Artificial Sequence
  Synthetic Polynucleotide
taatacgactcactatagggtctcgctgatgctaggcggccggggcgagtaacagaggagaactcgcatgggccgcctaaacctggcggcagcgcaaaagatg

SEQ ID NO: 126800 - DNA, 103 bp, Artificial Sequence
  Synthetic Polynucleotide
taatacgactcactatagggatcgccacgttctcgctgatgctaggcggcaacagaggagagccgccatgcatcagcgaaacctggcggcagcgcaaaagatg

SEQ ID NO: 126801 - DNA, 103 bp, Artificial Sequence
  Synthetic Polynucleotide
taatacgactcactatagggagggccagccgggtgcggggaaagccggataacagaggagaatccggatgtccccgcacaacctggcggcagcgcaaaagatg

SEQ ID NO: 126802 - DNA, 103 bp, Artificial Sequence
  Synthetic Polynucleotide
taatacgactcactatagggcacggcctccatcgccacgttctcgctgataacagaggagaatcagcatgaacgtggcgaacctggcggcagcgcaaaagatg

SEQ ID NO: 126803 - DNA, 103 bp, Artificial Sequence
  Synthetic Polynucleotide
taatacgactcactatagggctcctgccgccacggcctccatcgccacgtaacagaggagaacgtggatgtggaggccgaacctggcggcagcgcaaaagatg

SEQ ID NO: 126804 - DNA, 103 bp, Artificial Sequence
  Synthetic Polynucleotide
taatacgactcactataggggcgccgtccactcctgccgccacggcctccaacagaggagaggaggcatgggcggcaggaacctggcggcagcgcaaaagatg

SEQ ID NO: 126805 - DNA, 103 bp, Artificial Sequence
  Synthetic Polynucleotide
taatacgactcactatagggctcgggccccgcgccgtccactcctgccgcaacagaggagagcggcaatggtggacggcaacctggcggcagcgcaaaagatg

SEQ ID NO: 126806 - DNA, 103 bp, Artificial Sequence
  Synthetic Polynucleotide
taatacgactcactatagggccaggtcggcctcgggccccgcgccgtccaaacagaggagatggacgatgcggggcccgaacctggcggcagcgcaaaagatg

SEQ ID NO: 126807 - DNA, 103 bp, Artificial Sequence
  Synthetic Polynucleotide
taatacgactcactatagggtccggcagccccaggtcggcctcgggccccaacagaggagaggggccatgggccgacctaacctggcggcagcgcaaaagatg

SEQ ID NO: 126808 - DNA, 103 bp, Artificial Sequence
  Synthetic Polynucleotide
taatacgactcactatagggcaggtcgtcctccggcagccccaggtcggcaacagaggagagccgacatggggctgccgaacctggcggcagcgcaaaagatg

SEQ ID NO: 126809 - DNA, 103 bp, Artificial Sequence
  Synthetic Polynucleotide
taatacgactcactatagggctggaagcaccaggtcgtcctccggcagccaacagaggagaggctgcatgaggacgaccaacctggcggcagcgcaaaagatg

SEQ ID NO: 126810 - DNA, 103 bp, Artificial Sequence
  Synthetic Polynucleotide
taatacgactcactatagggaccacgtcgtctggaagcaccaggtcgtccaacagaggagaggacgaatgggtgcttccaacctggcggcagcgcaaaagatg

SEQ ID NO: 126811 - DNA, 103 bp, Artificial Sequence
  Synthetic Polynucleotide
taatacgactcactataggggatgtactgcaccacgtcgtctggaagcacaacagaggagagtgcttatggacgacgtgaacctggcggcagcgcaaaagatg

SEQ ID NO: 126812 - DNA, 103 bp, Artificial Sequence
  Synthetic Polynucleotide
taatacgactcactataggggggactccccagggccagccgggtgcggggaacagaggagaccccgcatgcggctggccaacctggcggcagcgcaaaagatg

SEQ ID NO: 126813 - DNA, 103 bp, Artificial Sequence
  Synthetic Polynucleotide
taatacgactcactatagggcgtgcgccttgatgtactgcaccacgtcgtaacagaggagaacgacgatgtgcagtacaaacctggcggcagcgcaaaagatg

SEQ ID NO: 126814 - DNA, 103 bp, Artificial Sequence
  Synthetic Polynucleotide
taatacgactcactataggggcgccactggcgtgcgccttgatgtactgcaacagaggagagcagtaatgcaaggcgcaaacctggcggcagcgcaaaagatg

SEQ ID NO: 126815 - DNA, 103 bp, Artificial Sequence
  Synthetic Polynucleotide
taatacgactcactatagggctcgtccagagcgccactggcgtgcgccttaacagaggagaaaggcgatggccagtggcaacctggcggcagcgcaaaagatg

SEQ ID NO: 126816 - DNA, 103 bp, Artificial Sequence
  Synthetic Polynucleotide
taatacgactcactataggggcccggtgccctcgtccagagcgccactggaacagaggagaccagtgatgctctggacgaacctggcggcagcgcaaaagatg

SEQ ID NO: 126817 - DNA, 103 bp, Artificial Sequence
  Synthetic Polynucleotide
taatacgactcactatagggggatacacctgcccggtgccctcgtccagaaacagaggagatctggaatggggcaccggaacctggcggcagcgcaaaagatg

SEQ ID NO: 126818 - DNA, 103 bp, Artificial Sequence
  Synthetic Polynucleotide
taatacgactcactataggggctttccgtgggatacacctgcccggtgccaacagaggagaggcaccatgcaggtgtataacctggcggcagcgcaaaagatg

SEQ ID NO: 126819 - DNA, 103 bp, Artificial Sequence
  Synthetic Polynucleotide
taatacgactcactatagggagaagccagtgctttccgtgggatacacctaacagaggagaaggtgtatgccacggaaaaacctggcggcagcgcaaaagatg

SEQ ID NO: 126820 - DNA, 103 bp, Artificial Sequence
  Synthetic Polynucleotide
taatacgactcactataggggggttgtcagagaagccagtgctttccgtgaacagaggagacacggaatgcactggcttaacctggcggcagcgcaaaagatg

SEQ ID NO: 126821 - DNA, 103 bp, Artificial Sequence
  Synthetic Polynucleotide
taatacgactcactataggggggtagtctggggttgtcagagaagccagtaacagaggagaactggcatgtctgacaacaacctggcggcagcgcaaaagatg

SEQ ID NO: 126822 - DNA, 103 bp, Artificial Sequence
  Synthetic Polynucleotide
taatacgactcactataggggccccgggctgggtagtctggggttgtcagaacagaggagactgacaatgccagactacaacctggcggcagcgcaaaagatg

SEQ ID NO: 126823 - DNA, 103 bp, Artificial Sequence
  Synthetic Polynucleotide
taatacgactcactataggggcgttgaagggggactccccagggccagccaacagaggagaggctggatgtggggagtcaacctggcggcagcgcaaaagatg

SEQ ID NO: 126824 - DNA, 103 bp, Artificial Sequence
  Synthetic Polynucleotide
taatacgactcactatagggtggccgtgcagccccgggctgggtagtctgaacagaggagacagactatgcagcccgggaacctggcggcagcgcaaaagatg

SEQ ID NO: 126825 - DNA, 103 bp, Artificial Sequence
  Synthetic Polynucleotide
taatacgactcactatagggcatcctgcgctggccgtgcagccccgggctaacagaggagaagcccgatgctgcacggcaacctggcggcagcgcaaaagatg

SEQ ID NO: 126826 - DNA, 103 bp, Artificial Sequence
  Synthetic Polynucleotide
taatacgactcactatagggccgcagccaccatcctgcgctggccgtgcaaacagaggagatgcacgatgagcgcaggaaacctggcggcagcgcaaaagatg

SEQ ID NO: 126827 - DNA, 103 bp, Artificial Sequence
  Synthetic Polynucleotide
taatacgactcactatagggacgttggagtccgcagccaccatcctgcgcaacagaggagagcgcagatgggtggctgcaacctggcggcagcgcaaaagatg

SEQ ID NO: 126828 - DNA, 103 bp, Artificial Sequence
  Synthetic Polynucleotide
taatacgactcactatagggggaggggcccacgttggagtccgcagccacaacagaggagagtggctatggactccaacaacctggcggcagcgcaaaagatg

SEQ ID NO: 126829 - DNA, 103 bp, Artificial Sequence
  Synthetic Polynucleotide
taatacgactcactataggggcataggggcggaggggcccacgttggagtaacagaggagaactccaatgtgggcccctaacctggcggcagcgcaaaagatg

SEQ ID NO: 126830 - DNA, 103 bp, Artificial Sequence
  Synthetic Polynucleotide
taatacgactcactatagggcatcctcccagcataggggcggaggggcccaacagaggagagggcccatgcgcccctataacctggcggcagcgcaaaagatg

SEQ ID NO: 126831 - DNA, 103 bp, Artificial Sequence
  Synthetic Polynucleotide
taatacgactcactataggggcctaactggcatcctcccagcataggggcaacagaggagagcccctatgctgggaggaaacctggcggcagcgcaaaagatg

SEQ ID NO: 126832 - DNA, 103 bp, Artificial Sequence
  Synthetic Polynucleotide
taatacgactcactataggggcgccccaaagcctaactggcatcctcccaaacagaggagatgggagatggccagttagaacctggcggcagcgcaaaagatg

SEQ ID NO: 126833 - DNA, 103 bp, Artificial Sequence
  Synthetic Polynucleotide
taatacgactcactatagggaggctggagggcgccccaaagcctaactggaacagaggagaccagttatgctttggggcaacctggcggcagcgcaaaagatg

SEQ ID NO: 126834 - DNA, 103 bp, Artificial Sequence
  Synthetic Polynucleotide
taatacgactcactatagggcgggtggggggcgttgaagggggactccccaacagaggagaggggagatgcccttcaacaacctggcggcagcgcaaaagatg

SEQ ID NO: 126835 - DNA, 103 bp, Artificial Sequence
  Synthetic Polynucleotide
taatacgactcactatagggatttttgttcaggctggagggcgccccaaaaacagaggagatttgggatgccctccagcaacctggcggcagcgcaaaagatg

SEQ ID NO: 126836 - DNA, 103 bp, Artificial Sequence
  Synthetic Polynucleotide
taatacgactcactatagggcaggcatgttatttttgttcaggctggaggaacagaggagacctccaatgtgaacaaaaaacctggcggcagcgcaaaagatg

SEQ ID NO: 126837 - DNA, 103 bp, Artificial Sequence
  Synthetic Polynucleotide
taatacgactcactatagggttccactgcacaggcatgttatttttgttcaacagaggagagaacaaatgtaacatgccaacctggcggcagcgcaaaagatg

SEQ ID NO: 126838 - DNA, 103 bp, Artificial Sequence
  Synthetic Polynucleotide
taatacgactcactataggggctcacctcattccactgcacaggcatgttaacagaggagaaacatgatggtgcagtggaacctggcggcagcgcaaaagatg

SEQ ID NO: 126839 - DNA, 103 bp, Artificial Sequence
  Synthetic Polynucleotide
taatacgactcactatagggcggtgccggagctcacctcattccactgcaaacagaggagatgcagtatgatgaggtgaaacctggcggcagcgcaaaagatg

SEQ ID NO: 126840 - DNA, 103 bp, Artificial Sequence
  Synthetic Polynucleotide
taatacgactcactatagggagggcgtctacggtgccggagctcacctcaaacagaggagatgaggtatgctccggcacaacctggcggcagcgcaaaagatg

SEQ ID NO: 126841 - DNA, 103 bp, Artificial Sequence
  Synthetic Polynucleotide
taatacgactcactatagggctggctggccagggcgtctacggtgccggaaacagaggagatccggcatggtagacgccaacctggcggcagcgcaaaagatg

SEQ ID NO: 126842 - DNA, 103 bp, Artificial Sequence
  Synthetic Polynucleotide
taatacgactcactataggggaggcttcacctggctggccagggcgtctaaacagaggagatagacgatgtggccagccaacctggcggcagcgcaaaagatg

SEQ ID NO: 126843 - DNA, 103 bp, Artificial Sequence
  Synthetic Polynucleotide
taatacgactcactatagggggaaagggtggaggcttcacctggctggccaacagaggagaggccagatgggtgaagccaacctggcggcagcgcaaaagatg

SEQ ID NO: 126844 - DNA, 103 bp, Artificial Sequence
  Synthetic Polynucleotide
taatacgactcactataggggttgccctgaggaaagggtggaggcttcacaacagaggagagtgaagatgccaccctttaacctggcggcagcgcaaaagatg

SEQ ID NO: 126845 - DNA, 103 bp, Artificial Sequence
  Synthetic Polynucleotide
taatacgactcactatagggggttcacgtacgggtggggggcgttgaaggaacagaggagaccttcaatgccccccaccaacctggcggcagcgcaaaagatg

SEQ ID NO: 126846 - DNA, 103 bp, Artificial Sequence
  Synthetic Polynucleotide
taatacgactcactatagggccaccgccaggttgccctgaggaaagggtgaacagaggagacaccctatgctcagggcaaacctggcggcagcgcaaaagatg

SEQ ID NO: 126847 - DNA, 103 bp, Artificial Sequence
  Synthetic Polynucleotide
taatacgactcactatagggttctgctgcaccaccgccaggttgccctgaaacagaggagatcagggatgcctggcggtaacctggcggcagcgcaaaagatg

SEQ ID NO: 126848 - DNA, 103 bp, Artificial Sequence
  Synthetic Polynucleotide
taatacgactcactatagggaaaggcaggcttctgctgcaccaccgccagaacagaggagactggcgatggtgcagcagaacctggcggcagcgcaaaagatg

SEQ ID NO: 126849 - DNA, 103 bp, Artificial Sequence
  Synthetic Polynucleotide
taatacgactcactatagggggtactggccaaaggcaggcttctgctgcaaacagaggagatgcagcatgagcctgcctaacctggcggcagcgcaaaagatg

SEQ ID NO: 126850 - DNA, 103 bp, Artificial Sequence
  Synthetic Polynucleotide
taatacgactcactatagggctgtagcccgggtactggccaaaggcaggcaacagaggagagcctgcatgtggccagtaaacctggcggcagcgcaaaagatg

SEQ ID NO: 126851 - DNA, 103 bp, Artificial Sequence
  Synthetic Polynucleotide
taatacgactcactataggggccttgcggactgtagcccgggtactggccaacagaggagaggccagatgccgggctacaacctggcggcagcgcaaaagatg

SEQ ID NO: 126852 - DNA, 103 bp, Artificial Sequence
  Synthetic Polynucleotide
taatacgactcactatagggtagcctgtaggccttgcggactgtagcccgaacagaggagacgggctatggtccgcaagaacctggcggcagcgcaaaagatg

SEQ ID NO: 126853 - DNA, 103 bp, Artificial Sequence
  Synthetic Polynucleotide
taatacgactcactatagggcccccagggctagcctgtaggccttgcggaaacagaggagatccgcaatgcctacaggcaacctggcggcagcgcaaaagatg

SEQ ID NO: 126854 - DNA, 103 bp, Artificial Sequence
  Synthetic Polynucleotide
taatacgactcactataggggctgtccaggcccccagggctagcctgtagaacagaggagactacagatgagccctgggaacctggcggcagcgcaaaagatg

SEQ ID NO: 126855 - DNA, 103 bp, Artificial Sequence
  Synthetic Polynucleotide
taatacgactcactataggggtggctgcgtgctgtccaggcccccagggcaacagaggagagccctgatggcctggacaaacctggcggcagcgcaaaagatg

SEQ ID NO: 126856 - DNA, 103 bp, Artificial Sequence
  Synthetic Polynucleotide
taatacgactcactatagggtccatgtgggggttcacgtacgggtgggggaacagaggagacccccaatggtacgtgaaaacctggcggcagcgcaaaagatg

SEQ ID NO: 126857 - DNA, 103 bp, Artificial Sequence
  Synthetic Polynucleotide
taatacgactcactatagggggctgcaggtgtggctgcgtgctgtccaggaacagaggagacctggaatgcacgcagccaacctggcggcagcgcaaaagatg

SEQ ID NO: 126858 - DNA, 103 bp, Artificial Sequence
  Synthetic Polynucleotide
taatacgactcactatagggtccgctgcggggctgcaggtgtggctgcgtaacagaggagaacgcagatgcacctgcagaacctggcggcagcgcaaaagatg

SEQ ID NO: 126859 - DNA, 103 bp, Artificial Sequence
  Synthetic Polynucleotide
taatacgactcactataggggggagggggctccgctgcggggctgcaggtaacagaggagaacctgcatgcccgcagcgaacctggcggcagcgcaaaagatg

SEQ ID NO: 126860 - DNA, 103 bp, Artificial Sequence
  Synthetic Polynucleotide
taatacgactcactataggggggatgccctgggagggggctccgctgcggaacagaggagaccgcagatgagccccctcaacctggcggcagcgcaaaagatg

SEQ ID NO: 126861 - DNA, 103 bp, Artificial Sequence
  Synthetic Polynucleotide
taatacgactcactataggggtttaccctggggatgccctgggagggggcaacagaggagagcccccatgcagggcatcaacctggcggcagcgcaaaagatg

SEQ ID NO: 126862 - DNA, 103 bp, Artificial Sequence
  Synthetic Polynucleotide
taatacgactcactataggggctgcatgtagtttaccctggggatgccctaacagaggagaagggcaatgccagggtaaaacctggcggcagcgcaaaagatg

SEQ ID NO: 126863 - DNA, 103 bp, Artificial Sequence
  Synthetic Polynucleotide
taatacgactcactatagggtgtcgcagctgctgcatgtagtttaccctgaacagaggagacagggtatgctacatgcaaacctggcggcagcgcaaaagatg

SEQ ID NO: 126864 - DNA, 103 bp, Artificial Sequence
  Synthetic Polynucleotide
taatacgactcactatagggtgccactggctgtcgcagctgctgcatgtaaacagaggagatacatgatgcagctgcgaaacctggcggcagcgcaaaagatg

SEQ ID NO: 126865 - DNA, 103 bp, Artificial Sequence
  Synthetic Polynucleotide
taatacgactcactatagggactggctgcctgccactggctgtcgcagctaacagaggagaagctgcatgagccagtggaacctggcggcagcgcaaaagatg

SEQ ID NO: 126866 - DNA, 103 bp, Artificial Sequence
  Synthetic Polynucleotide
taatacgactcactatagggatgccaggacactggctgcctgccactggcaacagaggagagccagtatgaggcagccaaacctggcggcagcgcaaaagatg

SEQ ID NO: 126867 - DNA, 103 bp, Artificial Sequence
  Synthetic Polynucleotide
taatacgactcactataggggaggtagtgctccatgtgggggttcacgtaaacagaggagatacgtgatgccccacatgaacctggcggcagcgcaaaagatg

SEQ ID NO: 126868 - DNA, 103 bp, Artificial Sequence
  Synthetic Polynucleotide
taatacgactcactatagggagtggtagtcatgccaggacactggctgccaacagaggagaggcagcatgtgtcctggcaacctggcggcagcgcaaaagatg

SEQ ID NO: 126869 - DNA, 103 bp, Artificial Sequence
  Synthetic Polynucleotide
taatacgactcactataggggggggctcatagtggtagtcatgccaggacaacagaggagagtcctgatgtgactaccaaacctggcggcagcgcaaaagatg

SEQ ID NO: 126870 - DNA, 103 bp, Artificial Sequence
  Synthetic Polynucleotide
taatacgactcactatagggtagcaggcatgggggctcatagtggtagtcaacagaggagagactacatgtatgagcccaacctggcggcagcgcaaaagatg

SEQ ID NO: 126871 - DNA, 103 bp, Artificial Sequence
  Synthetic Polynucleotide
taatacgactcactataggggacttggccatagcaggcatgggggctcataacagaggagaatgagcatgcatgcctgcaacctggcggcagcgcaaaagatg

SEQ ID NO: 126872 - DNA, 103 bp, Artificial Sequence
  Synthetic Polynucleotide
taatacgactcactataggggctgggggtggacttggccatagcaggcataacagaggagaatgcctatgatggccaagaacctggcggcagcgcaaaagatg

SEQ ID NO: 126873 - DNA, 103 bp, Artificial Sequence
  Synthetic Polynucleotide
taatacgactcactatagggctggggctcagctgggggtggacttggccaaacagaggagatggccaatgccacccccaaacctggcggcagcgcaaaagatg

SEQ ID NO: 126874 - DNA, 103 bp, Artificial Sequence
  Synthetic Polynucleotide
taatacgactcactatagggactgatggtgctggggctcagctgggggtgaacagaggagacaccccatgctgagccccaacctggcggcagcgcaaaagatg

SEQ ID NO: 126875 - DNA, 103 bp, Artificial Sequence
  Synthetic Polynucleotide
taatacgactcactatagggtgagggccccactgatggtgctggggctcaaacagaggagatgagccatggcaccatcaaacctggcggcagcgcaaaagatg

SEQ ID NO: 126876 - DNA, 103 bp, Artificial Sequence
  Synthetic Polynucleotide
taatacgactcactataggggggaactggttgagggccccactgatggtgaacagaggagacaccatatgtggggccctaacctggcggcagcgcaaaagatg

SEQ ID NO: 126877 - DNA, 103 bp, Artificial Sequence
  Synthetic Polynucleotide
taatacgactcactataggggcaggattgggggaactggttgagggccccaacagaggagaggggccatgaaccagttcaacctggcggcagcgcaaaagatg

SEQ ID NO: 126878 - DNA, 103 bp, Artificial Sequence
  Synthetic Polynucleotide
taatacgactcactataggggcacagaacggaggtagtgctccatgtgggaacagaggagacccacaatgagcactaccaacctggcggcagcgcaaaagatg

SEQ ID NO: 126879 - DNA, 103 bp, Artificial Sequence
  Synthetic Polynucleotide
taatacgactcactataggggcatgttgctgcaggattgggggaactggtaacagaggagaaccagtatgcccaatcctaacctggcggcagcgcaaaagatg

SEQ ID NO: 126880 - DNA, 103 bp, Artificial Sequence
  Synthetic Polynucleotide
taatacgactcactatagggggcttggctggcatgttgctgcaggattggaacagaggagaccaatcatgcagcaacataacctggcggcagcgcaaaagatg

SEQ ID NO: 126881 - DNA, 103 bp, Artificial Sequence
  Synthetic Polynucleotide
taatacgactcactatagggcagatgccctggcttggctggcatgttgctaacagaggagaagcaacatgccagccaagaacctggcggcagcgcaaaagatg

SEQ ID NO: 126882 - DNA, 103 bp, Artificial Sequence
  Synthetic Polynucleotide
taatacgactcactataggggagggtgccccagatgccctggcttggctgaacagaggagacagccaatgcagggcatcaacctggcggcagcgcaaaagatg

SEQ ID NO: 126883 - DNA, 103 bp, Artificial Sequence
  Synthetic Polynucleotide
taatacgactcactatagggtctgtctgctgagggtgccccagatgccctaacagaggagaagggcaatgggggcacccaacctggcggcagcgcaaaagatg

SEQ ID NO: 126884 - DNA, 103 bp, Artificial Sequence
  Synthetic Polynucleotide
taatacgactcactatagggaggtgccacttctgtctgctgagggtgcccaacagaggagagggcacatgcagcagacaaacctggcggcagcgcaaaagatg

SEQ ID NO: 126885 - DNA, 103 bp, Artificial Sequence
  Synthetic Polynucleotide
taatacgactcactatagggtggtggggtcaggtgccacttctgtctgctaacagaggagaagcagaatgaagtggcacaacctggcggcagcgcaaaagatg

SEQ ID NO: 126886 - DNA, 103 bp, Artificial Sequence
  Synthetic Polynucleotide
taatacgactcactatagggttgcccatcgtggtggggtcaggtgccactaacagaggagaagtggcatgtgaccccacaacctggcggcagcgcaaaagatg

SEQ ID NO: 126887 - DNA, 103 bp, Artificial Sequence
  Synthetic Polynucleotide
taatacgactcactatagggcctgtggcgattgcccatcgtggtggggtcaacagaggagagaccccatgacgatgggcaacctggcggcagcgcaaaagatg

SEQ ID NO: 126888 - DNA, 103 bp, Artificial Sequence
  Synthetic Polynucleotide
taatacgactcactatagggccccaagttccctgtggcgattgcccatcgaacagaggagacgatggatgatcgccacaaacctggcggcagcgcaaaagatg

SEQ ID NO: 126889 - DNA, 103 bp, Artificial Sequence
  Synthetic Polynucleotide
taatacgactcactataggggggctgctgtgcacagaacggaggtagtgcaacagaggagagcactaatgccgttctgtaacctggcggcagcgcaaaagatg

SEQ ID NO: 126890 - DNA, 103 bp, Artificial Sequence
  Synthetic Polynucleotide
taatacgactcactataggggaatcggggaccccaagttccctgtggcgaaacagaggagatcgccaatgggaacttggaacctggcggcagcgcaaaagatg

SEQ ID NO: 126891 - DNA, 103 bp, Artificial Sequence
  Synthetic Polynucleotide
taatacgactcactatagggagccagggctgaatcggggaccccaagttcaacagaggagagaacttatggtccccgataacctggcggcagcgcaaaagatg

SEQ ID NO: 126892 - DNA, 103 bp, Artificial Sequence
  Synthetic Polynucleotide
taatacgactcactataggggtggcactccagccagggctgaatcggggaaacagaggagatccccgatgcagccctggaacctggcggcagcgcaaaagatg

SEQ ID NO: 126893 - DNA, 103 bp, Artificial Sequence
  Synthetic Polynucleotide
taatacgactcactataggggggtgaggtggtggcactccagccagggctaacagaggagaagccctatgtggagtgccaacctggcggcagcgcaaaagatg

SEQ ID NO: 126894 - DNA, 103 bp, Artificial Sequence
  Synthetic Polynucleotide
taatacgactcactataggggctctggactgggtgaggtggtggcactccaacagaggagaggagtgatgccacctcacaacctggcggcagcgcaaaagatg

SEQ ID NO: 126895 - DNA, 103 bp, Artificial Sequence
  Synthetic Polynucleotide
taatacgactcactataggggctgtgggtagctctggactgggtgaggtgaacagaggagacacctcatgcagtccagaaacctggcggcagcgcaaaagatg

SEQ ID NO: 126896 - DNA, 103 bp, Artificial Sequence
  Synthetic Polynucleotide
taatacgactcactatagggtgatggctctgctgtgggtagctctggactaacagaggagaagtccaatgctacccacaaacctggcggcagcgcaaaagatg

SEQ ID NO: 126897 - DNA, 103 bp, Artificial Sequence
  Synthetic Polynucleotide
taatacgactcactatagggggctgccaggtgatggctctgctgtgggtaaacagaggagatacccaatgcagagccataacctggcggcagcgcaaaagatg

SEQ ID NO: 126898 - DNA, 103 bp, Artificial Sequence
  Synthetic Polynucleotide
taatacgactcactatagggggctcatggaggctgccaggtgatggctctaacagaggagaagagccatgacctggcagaacctggcggcagcgcaaaagatg

SEQ ID NO: 126899 - DNA, 103 bp, Artificial Sequence
  Synthetic Polynucleotide
taatacgactcactatagggtagccctcctggctcatggaggctgccaggaacagaggagacctggcatgctccatgagaacctggcggcagcgcaaaagatg

SEQ ID NO: 126900 - DNA, 103 bp, Artificial Sequence
  Synthetic Polynucleotide
taatacgactcactatagggcaggatcccacttttggcttcttgcttctcaacagaggagagagaagatggaagccaaaaacctggcggcagcgcaaaagatg

SEQ ID NO: 126901 - DNA, 103 bp, Artificial Sequence
  Synthetic Polynucleotide
taatacgactcactatagggggagagcgtggggctgctgtgcacagaacgaacagaggagacgttctatgcacagcagcaacctggcggcagcgcaaaagatg

SEQ ID NO: 126902 - DNA, 103 bp, Artificial Sequence
  Synthetic Polynucleotide
taatacgactcactataggggacctggtggtagccctcctggctcatggaaacagaggagatccatgatgcaggagggcaacctggcggcagcgcaaaagatg

SEQ ID NO: 126903 - DNA, 103 bp, Artificial Sequence
  Synthetic Polynucleotide
taatacgactcactataggggaaggctggggacctggtggtagccctcctaacagaggagaaggaggatgaccaccaggaacctggcggcagcgcaaaagatg

SEQ ID NO: 126904 - DNA, 103 bp, Artificial Sequence
  Synthetic Polynucleotide
taatacgactcactatagggcgggcaggcagaaggctggggacctggtggaacagaggagaccaccaatgccccagcctaacctggcggcagcgcaaaagatg

SEQ ID NO: 126905 - DNA, 103 bp, Artificial Sequence
  Synthetic Polynucleotide
taatacgactcactataggggccaggctggcgggcaggcagaaggctgggaacagaggagacccagcatgctgcctgccaacctggcggcagcgcaaaagatg

SEQ ID NO: 126906 - DNA, 103 bp, Artificial Sequence
  Synthetic Polynucleotide
taatacgactcactataggggctccatgaagccaggctggcgggcaggcaaacagaggagatgcctgatggccagcctgaacctggcggcagcgcaaaagatg

SEQ ID NO: 126907 - DNA, 103 bp, Artificial Sequence
  Synthetic Polynucleotide
taatacgactcactatagggcctgtttggggctccatgaagccaggctggaacagaggagaccagccatgcttcatggaaacctggcggcagcgcaaaagatg

SEQ ID NO: 126908 - DNA, 103 bp, Artificial Sequence
  Synthetic Polynucleotide
taatacgactcactatagggccccatcgggcctgtttggggctccatgaaaacagaggagattcatgatgccccaaacaaacctggcggcagcgcaaaagatg

SEQ ID NO: 126909 - DNA, 103 bp, Artificial Sequence
  Synthetic Polynucleotide
taatacgactcactatagggctgtagccacccccatcgggcctgtttgggaacagaggagacccaaaatggcccgatggaacctggcggcagcgcaaaagatg

SEQ ID NO: 126910 - DNA, 103 bp, Artificial Sequence
  Synthetic Polynucleotide
taatacgactcactatagggccaaagcctgctgtagccacccccatcgggaacagaggagacccgatatgggtggctacaacctggcggcagcgcaaaagatg

SEQ ID NO: 126911 - DNA, 103 bp, Artificial Sequence
  Synthetic Polynucleotide
taatacgactcactatagggctgcactaggccaaagcctgctgtagccacaacagaggagagtggctatggcaggctttaacctggcggcagcgcaaaagatg

SEQ ID NO: 126912 - DNA, 103 bp, Artificial Sequence
  Synthetic Polynucleotide
taatacgactcactatagggcagagatcatggagagcgtggggctgctgtaacagaggagaacagcaatgccacgctctaacctggcggcagcgcaaaagatg

SEQ ID NO: 126913 - DNA, 103 bp, Artificial Sequence
  Synthetic Polynucleotide
taatacgactcactataggggaggccggggctgcactaggccaaagcctgaacagaggagacaggctatggcctagtgcaacctggcggcagcgcaaaagatg

SEQ ID NO: 126914 - DNA, 103 bp, Artificial Sequence
  Synthetic Polynucleotide
taatacgactcactatagggggctcgaggggaggccggggctgcactaggaacagaggagacctagtatggccccggccaacctggcggcagcgcaaaagatg

SEQ ID NO: 126915 - DNA, 103 bp, Artificial Sequence
  Synthetic Polynucleotide
taatacgactcactatagggagtggggctgggctcgaggggaggccggggaacagaggagaccccggatgcccctcgagaacctggcggcagcgcaaaagatg

SEQ ID NO: 126916 - DNA, 103 bp, Artificial Sequence
  Synthetic Polynucleotide
taatacgactcactatagggggtggcggccagtggggctgggctcgagggaacagaggagaccctcgatgccagccccaaacctggcggcagcgcaaaagatg

SEQ ID NO: 126917 - DNA, 103 bp, Artificial Sequence
  Synthetic Polynucleotide
taatacgactcactatagggcgtaccccacggtggcggccagtggggctgaacagaggagacagcccatgtggccgccaaacctggcggcagcgcaaaagatg

SEQ ID NO: 126918 - DNA, 103 bp, Artificial Sequence
  Synthetic Polynucleotide
taatacgactcactatagggctgcacagcacgtaccccacggtggcggccaacagaggagaggccgcatgcgtggggtaaacctggcggcagcgcaaaagatg

SEQ ID NO: 126919 - DNA, 103 bp, Artificial Sequence
  Synthetic Polynucleotide
taatacgactcactatagggccagctgctgctgcacagcacgtaccccacaacagaggagagtggggatggtgctgtgcaacctggcggcagcgcaaaagatg

SEQ ID NO: 126920 - DNA, 103 bp, Artificial Sequence
  Synthetic Polynucleotide
taatacgactcactatagggctggcgtaggccagctgctgctgcacagcaaacagaggagatgctgtatggcagcagctaacctggcggcagcgcaaaagatg

SEQ ID NO: 126921 - DNA, 103 bp, Artificial Sequence
  Synthetic Polynucleotide
taatacgactcactataggggcctgtggccctggcgtaggccagctgctgaacagaggagacagcagatggcctacgccaacctggcggcagcgcaaaagatg

SEQ ID NO: 126922 - DNA, 103 bp, Artificial Sequence
  Synthetic Polynucleotide
taatacgactcactatagggccatggcatggcctgtggccctggcgtaggaacagaggagacctacgatggggccacagaacctggcggcagcgcaaaagatg

SEQ ID NO: 126923 - DNA, 103 bp, Artificial Sequence
  Synthetic Polynucleotide
taatacgactcactatagggcccctggctgcagagatcatggagagcgtgaacagaggagacacgctatgcatgatctcaacctggcggcagcgcaaaagatg

SEQ ID NO: 126924 - DNA, 103 bp, Artificial Sequence
  Synthetic Polynucleotide
taatacgactcactatagggggcatggcagccatggcatggcctgtggccaacagaggagaggccacatgccatgccataacctggcggcagcgcaaaagatg

SEQ ID NO: 126925 - DNA, 103 bp, Artificial Sequence
  Synthetic Polynucleotide
taatacgactcactatagggctgactggacggcatggcagccatggcatgaacagaggagacatgccatggctgccatgaacctggcggcagcgcaaaagatg

SEQ ID NO: 126926 - DNA, 103 bp, Artificial Sequence
  Synthetic Polynucleotide
taatacgactcactatagggctgctgtttcctgactggacggcatggcagaacagaggagactgccaatgcgtccagtcaacctggcggcagcgcaaaagatg

SEQ ID NO: 126927 - DNA, 103 bp, Artificial Sequence
  Synthetic Polynucleotide
taatacgactcactatagggggcacagcctctgctgtttcctgactggacaacagaggagagtccagatgggaaacagcaacctggcggcagcgcaaaagatg

SEQ ID NO: 126928 - DNA, 103 bp, Artificial Sequence
  Synthetic Polynucleotide
taatacgactcactatagggcgctcccttgggcacagcctctgctgtttcaacagaggagagaaacaatggaggctgtgaacctggcggcagcgcaaaagatg

SEQ ID NO: 126929 - DNA, 103 bp, Artificial Sequence
  Synthetic Polynucleotide
taatacgactcactatagggtgttgcccatcgctcccttgggcacagcctaacagaggagaaggctgatgccaagggagaacctggcggcagcgcaaaagatg

SEQ ID NO: 126930 - DNA, 103 bp, Artificial Sequence
  Synthetic Polynucleotide
taatacgactcactatagggaccgaccccatgttgcccatcgctcccttgaacagaggagacaagggatggatgggcaaaacctggcggcagcgcaaaagatg

SEQ ID NO: 126931 - DNA, 103 bp, Artificial Sequence
  Synthetic Polynucleotide
taatacgactcactatagggctggggaggcaccgaccccatgttgcccataacagaggagaatgggcatgatggggtcgaacctggcggcagcgcaaaagatg

SEQ ID NO: 126932 - DNA, 103 bp, Artificial Sequence
  Synthetic Polynucleotide
taatacgactcactataggggcggaggcggctggggaggcaccgaccccaaacagaggagatggggtatgtgcctccccaacctggcggcagcgcaaaagatg

SEQ ID NO: 126933 - DNA, 103 bp, Artificial Sequence
  Synthetic Polynucleotide
taatacgactcactatagggcctgcgtcctgcggaggcggctggggaggcaacagaggagagcctccatggccgcctccaacctggcggcagcgcaaaagatg

SEQ ID NO: 126934 - DNA, 103 bp, Artificial Sequence
  Synthetic Polynucleotide
taatacgactcactatagggggggctgaggcccctggctgcagagatcataacagaggagaatgatcatggcagccaggaacctggcggcagcgcaaaagatg

SEQ ID NO: 126935 - DNA, 103 bp, Artificial Sequence
  Synthetic Polynucleotide
taatacgactcactatagggcggggccccacctgcgtcctgcggaggcggaacagaggagaccgcctatgcaggacgcaaacctggcggcagcgcaaaagatg

SEQ ID NO: 126936 - DNA, 103 bp, Artificial Sequence
  Synthetic Polynucleotide
taatacgactcactatagggtgctgtggtccggggccccacctgcgtcctaacagaggagaaggacgatggtggggcccaacctggcggcagcgcaaaagatg

SEQ ID NO: 126937 - DNA, 103 bp, Artificial Sequence
  Synthetic Polynucleotide
taatacgactcactatagggtagtagagcatgctgtggtccggggccccaaacagaggagatggggcatgggaccacagaacctggcggcagcgcaaaagatg

SEQ ID NO: 126938 - DNA, 103 bp, Artificial Sequence
  Synthetic Polynucleotide
taatacgactcactatagggctggccgtagtagtagagcatgctgtggtcaacagaggagagaccacatgatgctctacaacctggcggcagcgcaaaagatg

SEQ ID NO: 126939 - DNA, 103 bp, Artificial Sequence
  Synthetic Polynucleotide
taatacgactcactatagggacatgtggatctggccgtagtagtagagcaaacagaggagatgctctatgactacggccaacctggcggcagcgcaaaagatg

SEQ ID NO: 126940 - DNA, 103 bp, Artificial Sequence
  Synthetic Polynucleotide
taatacgactcactatagggtcctgttcgtacatgtggatctggccgtagaacagaggagactacggatggatccacataacctggcggcagcgcaaaagatg

SEQ ID NO: 126941 - DNA, 103 bp, Artificial Sequence
  Synthetic Polynucleotide
taatacgactcactatagggcaggcctccatcctgttcgtacatgtggataacagaggagaatccacatgtacgaacagaacctggcggcagcgcaaaagatg

SEQ ID NO: 126942 - DNA, 103 bp, Artificial Sequence
  Synthetic Polynucleotide
taatacgactcactatagggcgaggttctccaggcctccatcctgttcgtaacagaggagaacgaacatgatggaggccaacctggcggcagcgcaaaagatg

SEQ ID NO: 126943 - DNA, 103 bp, Artificial Sequence
  Synthetic Polynucleotide
taatacgactcactatagggtggcagctcccgaggttctccaggcctccaaacagaggagatggaggatgggagaacctaacctggcggcagcgcaaaagatg

SEQ ID NO: 126944 - DNA, 103 bp, Artificial Sequence
  Synthetic Polynucleotide
taatacgactcactatagggccgcatgacctggcagctcccgaggttctcaacagaggagagagaacatggggagctgcaacctggcggcagcgcaaaagatg

SEQ ID NO: 126945 - DNA, 103 bp, Artificial Sequence
  Synthetic Polynucleotide
taatacgactcactatagggccacatcagcggggctgaggcccctggctgaacagaggagacagccaatggcctcagccaacctggcggcagcgcaaaagatg

SEQ ID NO: 126946 - DNA, 103 bp, Artificial Sequence
  Synthetic Polynucleotide
taatacgactcactataggggtggctgggaccgcatgacctggcagctccaacagaggagaggagctatgaggtcatgcaacctggcggcagcgcaaaagatg

SEQ ID NO: 126947 - DNA, 103 bp, Artificial Sequence
  Synthetic Polynucleotide
taatacgactcactatagggtgtggctgtggtggctgggaccgcatgaccaacagaggagaggtcatatggtcccagccaacctggcggcagcgcaaaagatg

SEQ ID NO: 126948 - DNA, 103 bp, Artificial Sequence
  Synthetic Polynucleotide
taatacgactcactatagggctgacaggcctgtggctgtggtggctgggaaacagaggagatcccagatgccacagccaaacctggcggcagcgcaaaagatg

SEQ ID NO: 126949 - DNA, 103 bp, Artificial Sequence
  Synthetic Polynucleotide
taatacgactcactatagggggatgctgtcctgacaggcctgtggctgtgaacagaggagacacagcatgaggcctgtcaacctggcggcagcgcaaaagatg

SEQ ID NO: 126950 - DNA, 103 bp, Artificial Sequence
  Synthetic Polynucleotide
taatacgactcactatagggggctggggctggatgctgtcctgacaggccaacagaggagaggcctgatgggacagcataacctggcggcagcgcaaaagatg

SEQ ID NO: 126951 - DNA, 103 bp, Artificial Sequence
  Synthetic Polynucleotide
taatacgactcactatagggtgagggcaagggctggggctggatgctgtcaacagaggagagacagcatgcagccccagaacctggcggcagcgcaaaagatg

SEQ ID NO: 126952 - DNA, 103 bp, Artificial Sequence
  Synthetic Polynucleotide
taatacgactcactatagggtgacccctggtgagggcaagggctggggctaacagaggagaagccccatgccttgccctaacctggcggcagcgcaaaagatg

SEQ ID NO: 126953 - DNA, 103 bp, Artificial Sequence
  Synthetic Polynucleotide
taatacgactcactataggggacacctggttgacccctggtgagggcaagaacagaggagacttgccatgaccaggggtaacctggcggcagcgcaaaagatg

SEQ ID NO: 126954 - DNA, 103 bp, Artificial Sequence
  Synthetic Polynucleotide
taatacgactcactatagggcacagtgctggacacctggttgacccctggaacagaggagaccagggatgaaccaggtgaacctggcggcagcgcaaaagatg

SEQ ID NO: 126955 - DNA, 103 bp, Artificial Sequence
  Synthetic Polynucleotide
taatacgactcactataggggctgggagtccacagtgctggacacctggtaacagaggagaaccaggatgccagcactgaacctggcggcagcgcaaaagatg

SEQ ID NO: 126956 - DNA, 103 bp, Artificial Sequence
  Synthetic Polynucleotide
taatacgactcactatagggtgctcctgggccacatcagcggggctgaggaacagaggagacctcagatgcgctgatgtaacctggcggcagcgcaaaagatg

SEQ ID NO: 126957 - DNA, 103 bp, Artificial Sequence
  Synthetic Polynucleotide
taatacgactcactataggggcctccaggagctgggagtccacagtgctgaacagaggagacagcacatgggactcccaaacctggcggcagcgcaaaagatg

SEQ ID NO: 126958 - DNA, 103 bp, Artificial Sequence
  Synthetic Polynucleotide
taatacgactcactatagggaatctggggggcctccaggagctgggagtcaacagaggagagactccatgctcctggagaacctggcggcagcgcaaaagatg

SEQ ID NO: 126959 - DNA, 103 bp, Artificial Sequence
  Synthetic Polynucleotide
taatacgactcactatagggcatcgaagtcaatctggggggcctccaggaaacagaggagatcctggatgccccccagaaacctggcggcagcgcaaaagatg

SEQ ID NO: 126960 - DNA, 103 bp, Artificial Sequence
  Synthetic Polynucleotide
taatacgactcactatagggtccatgatggcatcgaagtcaatctgggggaacagaggagacccccaatgtgacttcgaaacctggcggcagcgcaaaagatg

SEQ ID NO: 126961 - DNA, 103 bp, Artificial Sequence
  Synthetic Polynucleotide
taatacgactcactatagggatcgccatcatccatgatggcatcgaagtcaacagaggagagacttcatggccatcatgaacctggcggcagcgcaaaagatg

SEQ ID NO: 126962 - DNA, 103 bp, Artificial Sequence
  Synthetic Polynucleotide
taatacgactcactatagggaactcgagtgatcgccatcatccatgatggaacagaggagaccatcaatgatgatggcgaacctggcggcagcgcaaaagatg

SEQ ID NO: 126963 - DNA, 103 bp, Artificial Sequence
  Synthetic Polynucleotide
taatacgactcactatagggcccgagaacaaactcgagtgatcgccatcaaacagaggagatgatggatgtcactcgagaacctggcggcagcgcaaaagatg

SEQ ID NO: 126964 - DNA, 103 bp, Artificial Sequence
  Synthetic Polynucleotide
taatacgactcactataggggctcagagcacccgagaacaaactcgagtgaacagaggagacactcgatgttgttctcgaacctggcggcagcgcaaaagatg

SEQ ID NO: 126965 - DNA, 103 bp, Artificial Sequence
  Synthetic Polynucleotide
taatacgactcactatagggggaggctggggctcagagcacccgagaacaaacagaggagatgttctatggtgctctgaaacctggcggcagcgcaaaagatg

SEQ ID NO: 126966 - DNA, 103 bp, Artificial Sequence
  Synthetic Polynucleotide
taatacgactcactatagggaggctgtggaggaggctggggctcagagcaaacagaggagatgctctatgccccagcctaacctggcggcagcgcaaaagatg

SEQ ID NO: 126967 - DNA, 103 bp, Artificial Sequence
  Synthetic Polynucleotide
taatacgactcactatagggctccttaaggtgctcctgggccacatcagcaacagaggagagctgatatggcccaggagaacctggcggcagcgcaaaagatg

SEQ ID NO: 126968 - DNA, 103 bp, Artificial Sequence
  Synthetic Polynucleotide
taatacgactcactataggggttctgggagaggctgtggaggaggctgggaacagaggagacccagcatgctccacagcaacctggcggcagcgcaaaagatg

SEQ ID NO: 126969 - DNA, 103 bp, Artificial Sequence
  Synthetic Polynucleotide
taatacgactcactatagggggcgggaggagttctgggagaggctgtggaaacagaggagatccacaatgtctcccagaaacctggcggcagcgcaaaagatg

SEQ ID NO: 126970 - DNA, 103 bp, Artificial Sequence
  Synthetic Polynucleotide
taatacgactcactatagggggggtggtgaggcgggaggagttctgggagaacagaggagactcccaatgctcctcccgaacctggcggcagcgcaaaagatg

SEQ ID NO: 126971 - DNA, 103 bp, Artificial Sequence
  Synthetic Polynucleotide
taatacgactcactatagggggagtttcggggggtggtgaggcgggaggaaacagaggagatcctccatgctcaccaccaacctggcggcagcgcaaaagatg

SEQ ID NO: 126972 - DNA, 103 bp, Artificial Sequence
  Synthetic Polynucleotide
taatacgactcactataggggcagggtcaaggagtttcggggggtggtgaaacagaggagatcaccaatgcccgaaactaacctggcggcagcgcaaaagatg

SEQ ID NO: 126973 - DNA, 103 bp, Artificial Sequence
  Synthetic Polynucleotide
taatacgactcactataggggggatggagggcagggtcaaggagtttcggaacagaggagaccgaaaatgcttgaccctaacctggcggcagcgcaaaagatg

SEQ ID NO: 126974 - DNA, 103 bp, Artificial Sequence
  Synthetic Polynucleotide
taatacgactcactataggggatgcctgcggggatggagggcagggtcaaaacagaggagattgaccatgccctccatcaacctggcggcagcgcaaaagatg

SEQ ID NO: 126975 - DNA, 103 bp, Artificial Sequence
  Synthetic Polynucleotide
taatacgactcactatagggccatgttgctgatgcctgcggggatggaggaacagaggagacctccaatgccgcaggcaaacctggcggcagcgcaaaagatg

SEQ ID NO: 126976 - DNA, 103 bp, Artificial Sequence
  Synthetic Polynucleotide
taatacgactcactatagggtccccgacagccatgttgctgatgcctgcgaacagaggagacgcaggatgcagcaacataacctggcggcagcgcaaaagatg

SEQ ID NO: 126977 - DNA, 103 bp, Artificial Sequence
  Synthetic Polynucleotide
taatacgactcactatagggggagctcatgtccccgacagccatgttgctaacagaggagaagcaacatggctgtcgggaacctggcggcagcgcaaaagatg

SEQ ID NO: 126978 - DNA, 103 bp, Artificial Sequence
  Synthetic Polynucleotide
taatacgactcactatagggacagtcccctctccttaaggtgctcctgggaacagaggagacccaggatgaccttaaggaacctggcggcagcgcaaaagatg

SEQ ID NO: 126979 - DNA, 103 bp, Artificial Sequence
  Synthetic Polynucleotide
taatacgactcactatagggtggtgagcatggagctcatgtccccgacagaacagaggagactgtcgatgacatgagctaacctggcggcagcgcaaaagatg

SEQ ID NO: 126980 - DNA, 103 bp, Artificial Sequence
  Synthetic Polynucleotide
taatacgactcactatagggtcggcgaggctggtgagcatggagctcatgaacagaggagacatgagatgcatgctcacaacctggcggcagcgcaaaagatg

SEQ ID NO: 126981 - DNA, 103 bp, Artificial Sequence
  Synthetic Polynucleotide
taatacgactcactatagggcttgctctcctcggcgaggctggtgagcataacagaggagaatgctcatgagcctcgccaacctggcggcagcgcaaaagatg

SEQ ID NO: 126982 - DNA, 103 bp, Artificial Sequence
  Synthetic Polynucleotide
taatacgactcactatagggtgttcaggaacttgctctcctcggcgaggcaacagaggagagcctcgatgaggagagcaaacctggcggcagcgcaaaagatg

SEQ ID NO: 126983 - DNA, 103 bp, Artificial Sequence
  Synthetic Polynucleotide
taatacgactcactatagggtaggtcatcatgttcaggaacttgctctccaacagaggagaggagagatggttcctgaaaacctggcggcagcgcaaaagatg

SEQ ID NO: 126984 - DNA, 103 bp, Artificial Sequence
  Synthetic Polynucleotide
taatacgactcactatagggggaaggccaaacagtcccctctccttaaggaacagaggagaccttaaatggaggggactaacctggcggcagcgcaaaagatg

SEQ ID NO: 126985 - DNA, 103 bp, Artificial Sequence
  Synthetic Polynucleotide
taatacgactcactataggggcctggagcaggaaggccaaacagtcccctaacagaggagaaggggaatgtttggccttaacctggcggcagcgcaaaagatg

SEQ ID NO: 126986 - DNA, 103 bp, Artificial Sequence
  Synthetic Polynucleotide
taatacgactcactatagggcagcggcctccaggatcccacttttggcttaacagaggagaaagccaatggtgggatccaacctggcggcagcgcaaaagatg

SEQ ID NO: 126987 - DNA, 103 bp, Artificial Sequence
  Synthetic Polynucleotide
taatacgactcactatagggagggggtggtgcctggagcaggaaggccaaaacagaggagattggccatgctgctccagaacctggcggcagcgcaaaagatg

SEQ ID NO: 126988 - DNA, 103 bp, Artificial Sequence
  Synthetic Polynucleotide
taatacgactcactatagggtaatagtctgagggggtggtgcctggagcaaacagaggagatgctccatgcaccaccccaacctggcggcagcgcaaaagatg

SEQ ID NO: 126989 - DNA, 103 bp, Artificial Sequence
  Synthetic Polynucleotide
taatacgactcactatagggcatctggtggtaatagtctgagggggtggtaacagaggagaaccaccatgtcagactataacctggcggcagcgcaaaagatg

SEQ ID NO: 126990 - DNA, 103 bp, Artificial Sequence
  Synthetic Polynucleotide
taatacgactcactatagggccacgagggtcatctggtggtaatagtctgaacagaggagacagactatgaccaccagaaacctggcggcagcgcaaaagatg

SEQ ID NO: 126991 - DNA, 103 bp, Artificial Sequence
  Synthetic Polynucleotide
taatacgactcactataggggggtggcctgccacgagggtcatctggtggaacagaggagaccaccaatggaccctcgtaacctggcggcagcgcaaaagatg

SEQ ID NO: 126992 - DNA, 103 bp, Artificial Sequence
  Synthetic Polynucleotide
taatacgactcactataggggtagggcgcggggtggcctgccacgagggtaacagaggagaaccctcatggcaggccacaacctggcggcagcgcaaaagatg

SEQ ID NO: 126993 - DNA, 103 bp, Artificial Sequence
  Synthetic Polynucleotide
taatacgactcactataggggcaggtccccgtagggcgcggggtggcctgaacagaggagacaggccatgccgcgccctaacctggcggcagcgcaaaagatg

SEQ ID NO: 126994 - DNA, 103 bp, Artificial Sequence
  Synthetic Polynucleotide
taatacgactcactatagggctctgcatcagcaggtccccgtagggcgcgaacagaggagacgcgccatgcggggacctaacctggcggcagcgcaaaagatg

SEQ ID NO: 126995 - DNA, 103 bp, Artificial Sequence
  Synthetic Polynucleotide
taatacgactcactatagggagcgcccccgctctgcatcagcaggtccccaacagaggagaggggacatgctgatgcagaacctggcggcagcgcaaaagatg

SEQ ID NO: 126996 - DNA, 103 bp, Artificial Sequence
  Synthetic Polynucleotide
taatacgactcactataggggtgcgctggcagcgcccccgctctgcatcaaacagaggagatgatgcatggcgggggcgaacctggcggcagcgcaaaagatg

SEQ ID NO: 126997 - DNA, 103 bp, Artificial Sequence
  Synthetic Polynucleotide
taatacgactcactatagggtcggggaagccagcggcctccaggatcccaaacagaggagatgggatatgggaggccgcaacctggcggcagcgcaaaagatg

SEQ ID NO: 126998 - DNA, 103 bp, Artificial Sequence
  Synthetic Polynucleotide
taatacgactcactatagggtggagatggggtgcgctggcagcgcccccgaacagaggagacgggggatgtgccagcgcaacctggcggcagcgcaaaagatg

SEQ ID NO: 126999 - DNA, 103 bp, Artificial Sequence
  Synthetic Polynucleotide
taatacgactcactataggggaggtagtcgtggagatggggtgcgctggcaacagaggagagccagcatgccccatctcaacctggcggcagcgcaaaagatg

SEQ ID NO: 127000 - DNA, 103 bp, Artificial Sequence
  Synthetic Polynucleotide
taatacgactcactatagggccacggggttgaggtagtcgtggagatgggaacagaggagacccatcatgacgactaccaacctggcggcagcgcaaaagatg

SEQ ID NO: 127001 - DNA, 103 bp, Artificial Sequence
  Synthetic Polynucleotide
taatacgactcactatagggcgggacacgtccacggggttgaggtagtcgaacagaggagacgactaatgcaaccccgtaacctggcggcagcgcaaaagatg

SEQ ID NO: 127002 - DNA, 103 bp, Artificial Sequence
  Synthetic Polynucleotide
taatacgactcactataggggctggagaaacgggacacgtccacggggttaacagaggagaaaccccatggacgtgtccaacctggcggcagcgcaaaagatg

SEQ ID NO: 127003 - DNA, 103 bp, Artificial Sequence
  Synthetic Polynucleotide
taatacgactcactatagggtcacccgcgggctggagaaacgggacacgtaacagaggagaacgtgtatggtttctccaaacctggcggcagcgcaaaagatg

SEQ ID NO: 127004 - DNA, 103 bp, Artificial Sequence
  Synthetic Polynucleotide
taatacgactcactatagggaggcggggcgtcacccgcgggctggagaaaaacagaggagatttctcatgcccgcgggtaacctggcggcagcgcaaaagatg

SEQ ID NO: 127005 - DNA, 103 bp, Artificial Sequence
  Synthetic Polynucleotide
taatacgactcactatagggcttgcggctcaggcggggcgtcacccgcggaacagaggagaccgcggatgacgccccgcaacctggcggcagcgcaaaagatg

SEQ ID NO: 127006 - DNA, 103 bp, Artificial Sequence
  Synthetic Polynucleotide
taatacgactcactatagggacagcgcccgcttgcggctcaggcggggcgaacagaggagacgccccatgtgagccgcaaacctggcggcagcgcaaaagatg

SEQ ID NO: 127007 - DNA, 103 bp, Artificial Sequence
  Synthetic Polynucleotide
taatacgactcactatagggggggagatggacagcgcccgcttgcggctcaacagaggagagagccgatggcgggcgctaacctggcggcagcgcaaaagatg

SEQ ID NO: 127008 - DNA, 103 bp, Artificial Sequence
  Synthetic Polynucleotide
taatacgactcactatagggtttacccgggtcggggaagccagcggcctcaacagaggagagaggccatgggcttccccaacctggcggcagcgcaaaagatg

SEQ ID NO: 127009 - DNA, 103 bp, Artificial Sequence
  Synthetic Polynucleotide
taatacgactcactataggggtctgagagtggggagatggacagcgcccgaacagaggagacgggcgatgtccatctccaacctggcggcagcgcaaaagatg

SEQ ID NO: 127010 - DNA, 103 bp, Artificial Sequence
  Synthetic Polynucleotide
taatacgactcactatagggccaggctggcgtctgagagtggggagatggaacagaggagaccatctatgcactctcagaacctggcggcagcgcaaaagatg

SEQ ID NO: 127011 - DNA, 103 bp, Artificial Sequence
  Synthetic Polynucleotide
taatacgactcactatagggcgctgcaggtccaggctggcgtctgagagtaacagaggagaactctcatgcgccagcctaacctggcggcagcgcaaaagatg

SEQ ID NO: 127012 - DNA, 103 bp, Artificial Sequence
  Synthetic Polynucleotide
taatacgactcactataggggcggatcatccgctgcaggtccaggctggcaacagaggagagccagcatggacctgcagaacctggcggcagcgcaaaagatg

SEQ ID NO: 127013 - DNA, 103 bp, Artificial Sequence
  Synthetic Polynucleotide
taatacgactcactatagggtgggtgaggtgcggatcatccgctgcaggtaacagaggagaacctgcatgggatgatccaacctggcggcagcgcaaaagatg

SEQ ID NO: 127014 - DNA, 103 bp, Artificial Sequence
  Synthetic Polynucleotide
taatacgactcactatagggactagcgagttgggtgaggtgcggatcatcaacagaggagagatgatatgcacctcaccaacctggcggcagcgcaaaagatg

SEQ ID NO: 127015 - DNA, 103 bp, Artificial Sequence
  Synthetic Polynucleotide
taatacgactcactataggggatgtaggccactagcgagttgggtgaggtaacagaggagaacctcaatgaactcgctaaacctggcggcagcgcaaaagatg

SEQ ID NO: 127016 - DNA, 103 bp, Artificial Sequence
  Synthetic Polynucleotide
taatacgactcactataggggggagttgttgatgtaggccactagcgagtaacagaggagaactcgcatgtggcctacaaacctggcggcagcgcaaaagatg

SEQ ID NO: 127017 - DNA, 103 bp, Artificial Sequence
  Synthetic Polynucleotide
taatacgactcactataggggagctgcttcgggagttgttgatgtaggccaacagaggagaggcctaatgcaacaactcaacctggcggcagcgcaaaagatg

SEQ ID NO: 127018 - DNA, 103 bp, Artificial Sequence
  Synthetic Polynucleotide
taatacgactcactataggggctggccgccgagctgcttcgggagttgttaacagaggagaaacaacatgcgaagcagcaacctggcggcagcgcaaaagatg

SEQ ID NO: 127019 - DNA, 103 bp, Artificial Sequence
  Synthetic Polynucleotide
taatacgactcactataggggagaggcctttttacccgggtcggggaagcaacagaggagagcttccatgacccgggtaaacctggcggcagcgcaaaagatg

SEQ ID NO: 127020 - DNA, 103 bp, Artificial Sequence
  Synthetic Polynucleotide
taatacgactcactatagggcgtaggaaccgctggccgccgagctgcttcaacagaggagagaagcaatgcggcggccaaacctggcggcagcgcaaaagatg

SEQ ID NO: 127021 - DNA, 103 bp, Artificial Sequence
  Synthetic Polynucleotide
taatacgactcactataggggacagatgcccgtaggaaccgctggccgccaacagaggagaggcggcatgcggttcctaaacctggcggcagcgcaaaagatg

SEQ ID NO: 127022 - DNA, 103 bp, Artificial Sequence
  Synthetic Polynucleotide
taatacgactcactatagggggcacccgctgacagatgcccgtaggaaccaacagaggagaggttccatggggcatctgaacctggcggcagcgcaaaagatg

SEQ ID NO: 127023 - DNA, 103 bp, Artificial Sequence
  Synthetic Polynucleotide
taatacgactcactatagggctgggctgagggcacccgctgacagatgccaacagaggagaggcatcatgcagcgggtgaacctggcggcagcgcaaaagatg

SEQ ID NO: 127024 - DNA, 103 bp, Artificial Sequence
  Synthetic Polynucleotide
taatacgactcactatagggaaggtgaaggctgggctgagggcacccgctaacagaggagaagcgggatgcctcagcccaacctggcggcagcgcaaaagatg

SEQ ID NO: 127025 - DNA, 103 bp, Artificial Sequence
  Synthetic Polynucleotide
taatacgactcactatagggggggtgggggaaggtgaaggctgggctgagaacagaggagactcagcatggccttcaccaacctggcggcagcgcaaaagatg

SEQ ID NO: 127026 - DNA, 103 bp, Artificial Sequence
  Synthetic Polynucleotide
taatacgactcactatagggcggggttgatggggtgggggaaggtgaaggaacagaggagaccttcaatgtcccccaccaacctggcggcagcgcaaaagatg

SEQ ID NO: 127027 - DNA, 103 bp, Artificial Sequence
  Synthetic Polynucleotide
taatacgactcactatagggtggtaggccacggggttgatggggtgggggaacagaggagacccccaatgcatcaacccaacctggcggcagcgcaaaagatg

SEQ ID NO: 127028 - DNA, 103 bp, Artificial Sequence
  Synthetic Polynucleotide
taatacgactcactatagggcagaatctgctggtaggccacggggttgataacagaggagaatcaacatggtggcctacaacctggcggcagcgcaaaagatg

SEQ ID NO: 127029 - DNA, 103 bp, Artificial Sequence
  Synthetic Polynucleotide
taatacgactcactatagggtctgctggctcagaatctgctggtaggccaaacagaggagatggcctatgagcagattcaacctggcggcagcgcaaaagatg

SEQ ID NO: 127030 - DNA, 103 bp, Artificial Sequence
  Synthetic Polynucleotide
taatacgactcactatagggaccaccaaaggagaggcctttttacccgggaacagaggagacccgggatgaaaggcctcaacctggcggcagcgcaaaagatg

SEQ ID NO: 127031 - DNA, 103 bp, Artificial Sequence
  Synthetic Polynucleotide
taatacgactcactatagggcccagacccctctgctggctcagaatctgcaacagaggagagcagatatggagccagcaaacctggcggcagcgcaaaagatg

SEQ ID NO: 127032 - DNA, 103 bp, Artificial Sequence
  Synthetic Polynucleotide
taatacgactcactatagggaaaggctgaccccagacccctctgctggctaacagaggagaagccagatgaggggtctgaacctggcggcagcgcaaaagatg

SEQ ID NO: 127033 - DNA, 103 bp, Artificial Sequence
  Synthetic Polynucleotide
taatacgactcactataggggtgtgtgtccaaaggctgaccccagaccccaacagaggagaggggtcatgggtcagcctaacctggcggcagcgcaaaagatg

SEQ ID NO: 127034 - DNA, 103 bp, Artificial Sequence
  Synthetic Polynucleotide
taatacgactcactatagggatcaggggtggtgtgtgtccaaaggctgacaacagaggagagtcagcatgtggacacacaacctggcggcagcgcaaaagatg

SEQ ID NO: 127035 - DNA, 103 bp, Artificial Sequence
  Synthetic Polynucleotide
taatacgactcactatagggtgagggctggatcaggggtggtgtgtgtccaacagaggagaggacacatgccacccctgaacctggcggcagcgcaaaagatg

SEQ ID NO: 127036 - DNA, 103 bp, Artificial Sequence
  Synthetic Polynucleotide
taatacgactcactatagggggaaggtgggtgagggctggatcaggggtgaacagaggagacaccccatgtccagccctaacctggcggcagcgcaaaagatg

SEQ ID NO: 127037 - DNA, 103 bp, Artificial Sequence
  Synthetic Polynucleotide
taatacgactcactatagggtgctgggccaggaaggtgggtgagggctggaacagaggagaccagccatgacccaccttaacctggcggcagcgcaaaagatg

SEQ ID NO: 127038 - DNA, 103 bp, Artificial Sequence
  Synthetic Polynucleotide
taatacgactcactatagggggccatgggctgctgggccaggaaggtgggaacagaggagacccaccatgctggcccagaacctggcggcagcgcaaaagatg

SEQ ID NO: 127039 - DNA, 103 bp, Artificial Sequence
  Synthetic Polynucleotide
taatacgactcactatagggtggaggtgagggccatgggctgctgggccaaacagaggagatggcccatgagcccatggaacctggcggcagcgcaaaagatg

SEQ ID NO: 127040 - DNA, 103 bp, Artificial Sequence
  Synthetic Polynucleotide
taatacgactcactataggggtggcattgatggaggtgagggccatgggcaacagaggagagcccatatgcctcacctcaacctggcggcagcgcaaaagatg

SEQ ID NO: 127041 - DNA, 103 bp, Artificial Sequence
  Synthetic Polynucleotide
taatacgactcactatagggggtcgtggagctgtgggactgggcctccataacagaggagaatggagatgcagtcccacaacctggcggcagcgcaaaagatg

SEQ ID NO: 127042 - DNA, 103 bp, Artificial Sequence
  Synthetic Polynucleotide
taatacgactcactatagggagaagtggtgctggaggcaacggctttctcaacagaggagagagaaaatggttgcctccaacctggcggcagcgcaaaagatg

SEQ ID NO: 127043 - DNA, 103 bp, Artificial Sequence
  Synthetic Polynucleotide
taatacgactcactatagggacttgcagataagtgaccataggagccactaacagaggagaagtggcatgtatggtcacaacctggcggcagcgcaaaagatg

SEQ ID NO: 127044 - DNA, 103 bp, Artificial Sequence
  Synthetic Polynucleotide
taatacgactcactatagggggctgattgcacttgcagataagtgaccataacagaggagaatggtcatgtatctgcaaaacctggcggcagcgcaaaagatg

SEQ ID NO: 127045 - DNA, 103 bp, Artificial Sequence
  Synthetic Polynucleotide
taatacgactcactatagggctcaaggcagggctgattgcacttgcagataacagaggagaatctgcatgtgcaatcagaacctggcggcagcgcaaaagatg

SEQ ID NO: 127046 - DNA, 103 bp, Artificial Sequence
  Synthetic Polynucleotide
taatacgactcactataggggtaggtgaagctcaaggcagggctgattgcaacagaggagagcaatcatgcctgccttgaacctggcggcagcgcaaaagatg

SEQ ID NO: 127047 - DNA, 103 bp, Artificial Sequence
  Synthetic Polynucleotide
taatacgactcactataggggcgcggaagagtaggtgaagctcaaggcagaacagaggagactgcctatggcttcacctaacctggcggcagcgcaaaagatg

SEQ ID NO: 127048 - DNA, 103 bp, Artificial Sequence
  Synthetic Polynucleotide
taatacgactcactatagggagagagacgggcgcggaagagtaggtgaagaacagaggagacttcacatgctcttccgcaacctggcggcagcgcaaaagatg

SEQ ID NO: 127049 - DNA, 103 bp, Artificial Sequence
  Synthetic Polynucleotide
taatacgactcactatagggatgcatgtggagagagacgggcgcggaagaaacagaggagatcttccatgcccgtctctaacctggcggcagcgcaaaagatg

SEQ ID NO: 127050 - DNA, 103 bp, Artificial Sequence
  Synthetic Polynucleotide
taatacgactcactatagggggatctgctgatgcatgtggagagagacggaacagaggagaccgtctatgtccacatgcaacctggcggcagcgcaaaagatg

SEQ ID NO: 127051 - DNA, 103 bp, Artificial Sequence
  Synthetic Polynucleotide
taatacgactcactatagggtgtcggcttaggatctgctgatgcatgtggaacagaggagaccacatatgtcagcagataacctggcggcagcgcaaaagatg

SEQ ID NO: 127052 - DNA, 103 bp, Artificial Sequence
  Synthetic Polynucleotide
taatacgactcactatagggtaagctctgttgtcggcttaggatctgctgaacagaggagacagcagatgctaagccgaaacctggcggcagcgcaaaagatg

SEQ ID NO: 127053 - DNA, 103 bp, Artificial Sequence
  Synthetic Polynucleotide
taatacgactcactatagggcatcctcattagaagtggtgctggaggcaaaacagaggagattgcctatggcaccacttaacctggcggcagcgcaaaagatg

SEQ ID NO: 127054 - DNA, 103 bp, Artificial Sequence
  Synthetic Polynucleotide
taatacgactcactatagggaggctgaacctaagctctgttgtcggcttaaacagaggagataagccatgaacagagctaacctggcggcagcgcaaaagatg

SEQ ID NO: 127055 - DNA, 103 bp, Artificial Sequence
  Synthetic Polynucleotide
taatacgactcactatagggctgtgtccaaaggctgaacctaagctctgtaacagaggagaacagagatgaggttcagcaacctggcggcagcgcaaaagatg

SEQ ID NO: 127056 - DNA, 103 bp, Artificial Sequence
  Synthetic Polynucleotide
taatacgactcactataggggagtggagggctgtgtccaaaggctgaaccaacagaggagaggttcaatgtttggacacaacctggcggcagcgcaaaagatg

SEQ ID NO: 127057 - DNA, 103 bp, Artificial Sequence
  Synthetic Polynucleotide
taatacgactcactatagggcagggtggatgagtggagggctgtgtccaaaacagaggagattggacatggccctccacaacctggcggcagcgcaaaagatg

SEQ ID NO: 127058 - DNA, 103 bp, Artificial Sequence
  Synthetic Polynucleotide
taatacgactcactatagggaaagttggggcagggtggatgagtggagggaacagaggagaccctccatgcatccacccaacctggcggcagcgcaaaagatg

SEQ ID NO: 127059 - DNA, 103 bp, Artificial Sequence
  Synthetic Polynucleotide
taatacgactcactatagggctgtgttggaaaagttggggcagggtggataacagaggagaatccacatggccccaactaacctggcggcagcgcaaaagatg

SEQ ID NO: 127060 - DNA, 103 bp, Artificial Sequence
  Synthetic Polynucleotide
taatacgactcactataggggaataggcctctgtgttggaaaagttggggaacagaggagaccccaaatgttccaacacaacctggcggcagcgcaaaagatg

SEQ ID NO: 127061 - DNA, 103 bp, Artificial Sequence
  Synthetic Polynucleotide
taatacgactcactataggggggatccctggaataggcctctgtgttggaaacagaggagatccaacatggaggcctataacctggcggcagcgcaaaagatg

SEQ ID NO: 127062 - DNA, 103 bp, Artificial Sequence
  Synthetic Polynucleotide
taatacgactcactatagggcagaaccgtagggatccctggaataggcctaacagaggagaaggcctatgccagggatcaacctggcggcagcgcaaaagatg

SEQ ID NO: 127063 - DNA, 103 bp, Artificial Sequence
  Synthetic Polynucleotide
taatacgactcactatagggggacggggttcagaaccgtagggatccctgaacagaggagacagggaatgctacggttcaacctggcggcagcgcaaaagatg

SEQ ID NO: 127064 - DNA, 103 bp, Artificial Sequence
  Synthetic Polynucleotide
taatacgactcactatagggccaggactttcatcctcattagaagtggtgaacagaggagacaccacatgtaatgaggaaacctggcggcagcgcaaaagatg

SEQ ID NO: 127065 - DNA, 103 bp, Artificial Sequence
  Synthetic Polynucleotide
taatacgactcactataggggagctgacctggacggggttcagaaccgtaaacagaggagatacggtatggaaccccgtaacctggcggcagcgcaaaagatg

SEQ ID NO: 127066 - DNA, 103 bp, Artificial Sequence
  Synthetic Polynucleotide
taatacgactcactatagggagaagggccggagctgacctggacggggttaacagaggagaaaccccatgcaggtcagcaacctggcggcagcgcaaaagatg

SEQ ID NO: 127067 - DNA, 103 bp, Artificial Sequence
  Synthetic Polynucleotide
taatacgactcactataggggtgaggactcagaagggccggagctgacctaacagaggagaaggtcaatgccggcccttaacctggcggcagcgcaaaagatg

SEQ ID NO: 127068 - DNA, 103 bp, Artificial Sequence
  Synthetic Polynucleotide
taatacgactcactatagggggcttgttctgtgaggactcagaagggccgaacagaggagacggcccatgtgagtcctcaacctggcggcagcgcaaaagatg

SEQ ID NO: 127069 - DNA, 103 bp, Artificial Sequence
  Synthetic Polynucleotide
taatacgactcactatagggctcactcgtgggcttgttctgtgaggactcaacagaggagagagtccatgcagaacaagaacctggcggcagcgcaaaagatg

SEQ ID NO: 127070 - DNA, 103 bp, Artificial Sequence
  Synthetic Polynucleotide
taatacgactcactatagggtcactgcagactcactcgtgggcttgttctaacagaggagaagaacaatgccacgagtgaacctggcggcagcgcaaaagatg

SEQ ID NO: 127071 - DNA, 103 bp, Artificial Sequence
  Synthetic Polynucleotide
taatacgactcactatagggccagtgctgctcactgcagactcactcgtgaacagaggagacacgagatggtctgcagtaacctggcggcagcgcaaaagatg

SEQ ID NO: 127072 - DNA, 103 bp, Artificial Sequence
  Synthetic Polynucleotide
taatacgactcactatagggcatcgggtcaccagtgctgctcactgcagaaacagaggagatctgcaatgagcagcactaacctggcggcagcgcaaaagatg

SEQ ID NO: 127073 - DNA, 103 bp, Artificial Sequence
  Synthetic Polynucleotide
taatacgactcactatagggtcttgttgtgcatcgggtcaccagtgctgcaacagaggagagcagcaatggtgacccgaaacctggcggcagcgcaaaagatg

SEQ ID NO: 127074 - DNA, 103 bp, Artificial Sequence
  Synthetic Polynucleotide
taatacgactcactatagggatcttggacctcttgttgtgcatcgggtcaaacagaggagatgacccatggcacaacaaaacctggcggcagcgcaaaagatg

SEQ ID NO: 127075 - DNA, 103 bp, Artificial Sequence
  Synthetic Polynucleotide
taatacgactcactatagggataagtctgtccaggactttcatcctcattaacagaggagaaatgagatggaaagtcctaacctggcggcagcgcaaaagatg

SEQ ID NO: 127076 - DNA, 103 bp, Artificial Sequence
  Synthetic Polynucleotide
taatacgactcactatagggatcgggtttgatcttggacctcttgttgtgaacagaggagacacaacatgaggtccaagaacctggcggcagcgcaaaagatg

SEQ ID NO: 127077 - DNA, 103 bp, Artificial Sequence
  Synthetic Polynucleotide
taatacgactcactatagggggaggtcttcatcgggtttgatcttggaccaacagaggagaggtccaatgtcaaacccgaacctggcggcagcgcaaaagatg

SEQ ID NO: 127078 - DNA, 103 bp, Artificial Sequence
  Synthetic Polynucleotide
taatacgactcactatagggcctgggctggggaggtcttcatcgggtttgaacagaggagacaaaccatgtgaagacctaacctggcggcagcgcaaaagatg

SEQ ID NO: 127079 - DNA, 103 bp, Artificial Sequence
  Synthetic Polynucleotide
taatacgactcactatagggcccccgagcccctgggctggggaggtcttcaacagaggagagaagacatgcccagcccaaacctggcggcagcgcaaaagatg

SEQ ID NO: 127080 - DNA, 103 bp, Artificial Sequence
  Synthetic Polynucleotide
taatacgactcactataggggttcctgctgcccccgagcccctgggctggaacagaggagaccagccatggggctcgggaacctggcggcagcgcaaaagatg

SEQ ID NO: 127081 - DNA, 103 bp, Artificial Sequence
  Synthetic Polynucleotide
taatacgactcactatagggccttcgggctgttcctgctgcccccgagccaacagaggagaggctcgatggcagcaggaaacctggcggcagcgcaaaagatg

SEQ ID NO: 127082 - DNA, 103 bp, Artificial Sequence
  Synthetic Polynucleotide
taatacgactcactatagggaagggttgttccttcgggctgttcctgctgaacagaggagacagcagatgcagcccgaaaacctggcggcagcgcaaaagatg

SEQ ID NO: 127083 - DNA, 103 bp, Artificial Sequence
  Synthetic Polynucleotide
taatacgactcactatagggcctccttgacaagggttgttccttcgggctaacagaggagaagcccgatggaacaacccaacctggcggcagcgcaaaagatg

SEQ ID NO: 127084 - DNA, 103 bp, Artificial Sequence
  Synthetic Polynucleotide
taatacgactcactatagggttgtccccttcctccttgacaagggttgttaacagaggagaaacaacatgtgtcaaggaaacctggcggcagcgcaaaagatg

SEQ ID NO: 127085 - DNA, 103 bp, Artificial Sequence
  Synthetic Polynucleotide
taatacgactcactataggggctttcatctttgtccccttcctccttgacaacagaggagagtcaagatggaaggggacaacctggcggcagcgcaaaagatg

SEQ ID NO: 127086 - DNA, 103 bp, Artificial Sequence
  Synthetic Polynucleotide
taatacgactcactatagggtctctctgtgataagtctgtccaggactttaacagaggagaaaagtcatggacagacttaacctggcggcagcgcaaaagatg

SEQ ID NO: 127087 - DNA, 103 bp, Artificial Sequence
  Synthetic Polynucleotide
taatacgactcactataggggctcctgtttgctttcatctttgtccccttaacagaggagaaaggggatgaagatgaaaaacctggcggcagcgcaaaagatg

SEQ ID NO: 127088 - DNA, 103 bp, Artificial Sequence
  Synthetic Polynucleotide
taatacgactcactatagggatgacttcaggctcctgtttgctttcatctaacagaggagaagatgaatgcaaacaggaaacctggcggcagcgcaaaagatg

SEQ ID NO: 127089 - DNA, 103 bp, Artificial Sequence
  Synthetic Polynucleotide
taatacgactcactatagggtgtctcatagatgacttcaggctcctgtttaacagaggagaaaacagatgcctgaagtcaacctggcggcagcgcaaaagatg

SEQ ID NO: 127090 - DNA, 103 bp, Artificial Sequence
  Synthetic Polynucleotide
taatacgactcactatagggagtggcagtttgtctcatagatgacttcagaacagaggagactgaagatgtctatgagaaacctggcggcagcgcaaaagatg

SEQ ID NO: 127091 - DNA, 103 bp, Artificial Sequence
  Synthetic Polynucleotide
taatacgactcactatagggcagccttcccagtggcagtttgtctcatagaacagaggagactatgaatgaaactgccaaacctggcggcagcgcaaaagatg

SEQ ID NO: 127092 - DNA, 103 bp, Artificial Sequence
  Synthetic Polynucleotide
taatacgactcactatagggctccctcgcgcagccttcccagtggcagttaacagaggagaaactgcatgtgggaaggcaacctggcggcagcgcaaaagatg

SEQ ID NO: 127093 - DNA, 103 bp, Artificial Sequence
  Synthetic Polynucleotide
taatacgactcactataggggggtgtcgaactccctcgcgcagccttcccaacagaggagagggaagatggcgcgagggaacctggcggcagcgcaaaagatg

SEQ ID NO: 127094 - DNA, 103 bp, Artificial Sequence
  Synthetic Polynucleotide
taatacgactcactatagggagctgctcttgggtgtcgaactccctcgcgaacagaggagacgcgagatggttcgacacaacctggcggcagcgcaaaagatg

SEQ ID NO: 127095 - DNA, 103 bp, Artificial Sequence
  Synthetic Polynucleotide
taatacgactcactatagggatggtgcacaagctgctcttgggtgtcgaaaacagaggagattcgacatgcaagagcagaacctggcggcagcgcaaaagatg

SEQ ID NO: 127096 - DNA, 103 bp, Artificial Sequence
  Synthetic Polynucleotide
taatacgactcactatagggcgttatttatatggtgcacaagctgctcttaacagaggagaaagagcatgttgtgcaccaacctggcggcagcgcaaaagatg

SEQ ID NO: 127097 - DNA, 103 bp, Artificial Sequence
  Synthetic Polynucleotide
taatacgactcactataggggcgtttcttctctctctgtgataagtctgtaacagaggagaacagacatgtcacagagaaacctggcggcagcgcaaaagatg

SEQ ID NO: 127098 - DNA, 103 bp, Artificial Sequence
  Synthetic Polynucleotide
taatacgactcactatagggtgaatatggtcgttatttatatggtgcacaaacagaggagatgtgcaatgtataaataaaacctggcggcagcgcaaaagatg

SEQ ID NO: 127099 - DNA, 103 bp, Artificial Sequence
  Synthetic Polynucleotide
taatacgactcactatagggcttctctccatgaatatggtcgttatttataacagaggagaataaatatggaccatattaacctggcggcagcgcaaaagatg

SEQ ID NO: 127100 - DNA, 103 bp, Artificial Sequence
  Synthetic Polynucleotide
taatacgactcactatagggcgaactccttcttctctccatgaatatggtaacagaggagaaccataatgatggagagaaacctggcggcagcgcaaaagatg

SEQ ID NO: 127101 - DNA, 103 bp, Artificial Sequence
  Synthetic Polynucleotide
taatacgactcactatagggcacctgcacacgaactccttcttctctccaaacagaggagatggagaatggaaggagttaacctggcggcagcgcaaaagatg

SEQ ID NO: 127102 - DNA, 103 bp, Artificial Sequence
  Synthetic Polynucleotide
taatacgactcactataggggcagtccagccacctgcacacgaactccttaacagaggagaaaggagatggtgtgcaggaacctggcggcagcgcaaaagatg

SEQ ID NO: 127103 - DNA, 103 bp, Artificial Sequence
  Synthetic Polynucleotide
taatacgactcactataggggctctcttgagcagtccagccacctgcacaaacagaggagatgtgcaatgggctggactaacctggcggcagcgcaaaagatg

SEQ ID NO: 127104 - DNA, 103 bp, Artificial Sequence
  Synthetic Polynucleotide
taatacgactcactatagggaagggtttctgctctcttgagcagtccagcaacagaggagagctggaatgctcaagagaaacctggcggcagcgcaaaagatg

SEQ ID NO: 127105 - DNA, 103 bp, Artificial Sequence
  Synthetic Polynucleotide
taatacgactcactatagggctgggctttgaagggtttctgctctcttgaaacagaggagatcaagaatgcagaaacccaacctggcggcagcgcaaaagatg

SEQ ID NO: 127106 - DNA, 103 bp, Artificial Sequence
  Synthetic Polynucleotide
taatacgactcactatagggccaacatatactgggctttgaagggtttctaacagaggagaagaaacatgtcaaagcccaacctggcggcagcgcaaaagatg

SEQ ID NO: 127107 - DNA, 103 bp, Artificial Sequence
  Synthetic Polynucleotide
taatacgactcactatagggatatgcactaccaacatatactgggctttgaacagaggagacaaagcatggtatatgttaacctggcggcagcgcaaaagatg

SEQ ID NO: 127108 - DNA, 103 bp, Artificial Sequence
  Synthetic Polynucleotide
taatacgactcactatagggcatagtgattgcgtttcttctctctctgtgaacagaggagacacagaatgagaagaaacaacctggcggcagcgcaaaagatg

SEQ ID NO: 127109 - DNA, 103 bp, Artificial Sequence
  Synthetic Polynucleotide
taatacgactcactataggggtgtcttctcatatgcactaccaacatataaacagaggagatatatgatggtagtgcataacctggcggcagcgcaaaagatg

SEQ ID NO: 127110 - DNA, 103 bp, Artificial Sequence
  Synthetic Polynucleotide
taatacgactcactatagggtctcgcccgtgtgtcttctcatatgcactaaacagaggagatagtgcatgtgagaagacaacctggcggcagcgcaaaagatg

SEQ ID NO: 127111 - DNA, 103 bp, Artificial Sequence
  Synthetic Polynucleotide
taatacgactcactatagggttgtgaggcttctcgcccgtgtgtcttctcaacagaggagagagaagatgcacgggcgaaacctggcggcagcgcaaaagatg

SEQ ID NO: 127112 - DNA, 103 bp, Artificial Sequence
  Synthetic Polynucleotide
taatacgactcactatagggaaaagtgcatttgtgaggcttctcgcccgtaacagaggagaacgggcatgaagcctcacaacctggcggcagcgcaaaagatg

SEQ ID NO: 127113 - DNA, 103 bp, Artificial Sequence
  Synthetic Polynucleotide
taatacgactcactatagggtgcaaccttcaaaagtgcatttgtgaggctaacagaggagaagcctcatgaatgcacttaacctggcggcagcgcaaaagatg

SEQ ID NO: 127114 - DNA, 103 bp, Artificial Sequence
  Synthetic Polynucleotide
taatacgactcactatagggtaggcctttgtgcaaccttcaaaagtgcataacagaggagaatgcacatgtgaaggttgaacctggcggcagcgcaaaagatg

SEQ ID NO: 127115 - DNA, 103 bp, Artificial Sequence
  Synthetic Polynucleotide
taatacgactcactatagggtagtctcgagtaggcctttgtgcaaccttcaacagaggagagaaggtatgacaaaggccaacctggcggcagcgcaaaagatg

SEQ ID NO: 127116 - DNA, 103 bp, Artificial Sequence
  Synthetic Polynucleotide
taatacgactcactatagggtcaagttttctagtctcgagtaggcctttgaacagaggagacaaaggatgactcgagacaacctggcggcagcgcaaaagatg

SEQ ID NO: 127117 - DNA, 103 bp, Artificial Sequence
  Synthetic Polynucleotide
taatacgactcactatagggaagtgtgttttcaagttttctagtctcgagaacagaggagactcgagatgagaaaacttaacctggcggcagcgcaaaagatg

SEQ ID NO: 127118 - DNA, 103 bp, Artificial Sequence
  Synthetic Polynucleotide
taatacgactcactataggggtgagatctcaagtgtgttttcaagttttcaacagaggagagaaaacatgaaaacacacaacctggcggcagcgcaaaagatg

SEQ ID NO: 127119 - DNA, 103 bp, Artificial Sequence
  Synthetic Polynucleotide
taatacgactcactatagggtctgtggctgcatagtgattgcgtttcttcaacagaggagagaagaaatgcaatcactaaacctggcggcagcgcaaaagatg

SEQ ID NO: 127120 - DNA, 103 bp, Artificial Sequence
  Synthetic Polynucleotide
taatacgactcactatagggtctctccagtgtgagatctcaagtgtgtttaacagaggagaaaacacatgtgagatctcaacctggcggcagcgcaaaagatg

SEQ ID NO: 127121 - DNA, 103 bp, Artificial Sequence
  Synthetic Polynucleotide
taatacgactcactatagggacgtatggtttctctccagtgtgagatctcaacagaggagagagatcatgcactggagaaacctggcggcagcgcaaaagatg

SEQ ID NO: 127122 - DNA, 103 bp, Artificial Sequence
  Synthetic Polynucleotide
taatacgactcactataggggtgctcacagacgtatggtttctctccagtaacagaggagaactggaatgaaaccatacaacctggcggcagcgcaaaagatg

SEQ ID NO: 127123 - DNA, 103 bp, Artificial Sequence
  Synthetic Polynucleotide
taatacgactcactatagggtgcaaccttcgtgctcacagacgtatggttaacagaggagaaaccatatgtctgtgagcaacctggcggcagcgcaaaagatg

SEQ ID NO: 127124 - DNA, 103 bp, Artificial Sequence
  Synthetic Polynucleotide
taatacgactcactatagggaaagccttgttgcaaccttcgtgctcacagaacagaggagactgtgaatgcgaaggttgaacctggcggcagcgcaaaagatg

SEQ ID NO: 127125 - DNA, 103 bp, Artificial Sequence
  Synthetic Polynucleotide
taatacgactcactatagggggcatttgagaaagccttgttgcaaccttcaacagaggagagaaggtatgaacaaggctaacctggcggcagcgcaaaagatg

SEQ ID NO: 127126 - DNA, 103 bp, Artificial Sequence
  Synthetic Polynucleotide
taatacgactcactatagggcgcgatcagaggcatttgagaaagccttgtaacagaggagaacaaggatgtctcaaatgaacctggcggcagcgcaaaagatg

SEQ ID NO: 127127 - DNA, 103 bp, Artificial Sequence
  Synthetic Polynucleotide
taatacgactcactatagggtggtgtttggcgcgatcagaggcatttgagaacagaggagactcaaaatgctctgatcgaacctggcggcagcgcaaaagatg

SEQ ID NO: 127128 - DNA, 103 bp, Artificial Sequence
  Synthetic Polynucleotide
taatacgactcactatagggcgttctgttttggtgtttggcgcgatcagaaacagaggagatctgatatggccaaacacaacctggcggcagcgcaaaagatg

SEQ ID NO: 127129 - DNA, 103 bp, Artificial Sequence
  Synthetic Polynucleotide
taatacgactcactatagggcattggaatgcgttctgttttggtgtttggaacagaggagaccaaacatgaaaacagaaaacctggcggcagcgcaaaagatg

SEQ ID NO: 127130 - DNA, 103 bp, Artificial Sequence
  Synthetic Polynucleotide
taatacgactcactatagggccctggacattctgtggctgcatagtgattaacagaggagaaatcacatggcagccacaaacctggcggcagcgcaaaagatg

SEQ ID NO: 127131 - DNA, 103 bp, Artificial Sequence
  Synthetic Polynucleotide
taatacgactcactatagggtatggtttctcattggaatgcgttctgtttaacagaggagaaaacagatggcattccaaaacctggcggcagcgcaaaagatg

SEQ ID NO: 127132 - DNA, 103 bp, Artificial Sequence
  Synthetic Polynucleotide
taatacgactcactatagggtttgcacacatatggtttctcattggaatgaacagaggagacattccatggagaaaccaaacctggcggcagcgcaaaagatg

SEQ ID NO: 127133 - DNA, 103 bp, Artificial Sequence
  Synthetic Polynucleotide
taatacgactcactatagggagcctgggattttgcacacatatggtttctaacagaggagaagaaacatgatgtgtgcaaacctggcggcagcgcaaaagatg

SEQ ID NO: 127134 - DNA, 103 bp, Artificial Sequence
  Synthetic Polynucleotide
taatacgactcactatagggcgcttagtgcagcctgggattttgcacacaaacagaggagatgtgtgatgaatcccaggaacctggcggcagcgcaaaagatg

SEQ ID NO: 127135 - DNA, 103 bp, Artificial Sequence
  Synthetic Polynucleotide
taatacgactcactataggggtctgtgtaacgcttagtgcagcctgggataacagaggagaatcccaatgtgcactaagaacctggcggcagcgcaaaagatg

SEQ ID NO: 127136 - DNA, 103 bp, Artificial Sequence
  Synthetic Polynucleotide
taatacgactcactataggggggagcttgggtctgtgtaacgcttagtgcaacagaggagagcactaatggttacacagaacctggcggcagcgcaaaagatg

SEQ ID NO: 127137 - DNA, 103 bp, Artificial Sequence
  Synthetic Polynucleotide
taatacgactcactatagggtgtttccggagggagcttgggtctgtgtaaaacagaggagattacacatgcccaagctcaacctggcggcagcgcaaaagatg

SEQ ID NO: 127138 - DNA, 103 bp, Artificial Sequence
  Synthetic Polynucleotide
taatacgactcactatagggtgtcttcacatgtttccggagggagcttggaacagaggagaccaagcatgctccggaaaaacctggcggcagcgcaaaagatg

SEQ ID NO: 127139 - DNA, 103 bp, Artificial Sequence
  Synthetic Polynucleotide
taatacgactcactatagggggccatgcactgtcttcacatgtttccggaaacagaggagatccggaatgatgtgaagaaacctggcggcagcgcaaaagatg

SEQ ID NO: 127140 - DNA, 103 bp, Artificial Sequence
  Synthetic Polynucleotide
taatacgactcactatagggtgagcctctgggccatgcactgtcttcacaaacagaggagatgtgaaatgagtgcatggaacctggcggcagcgcaaaagatg

SEQ ID NO: 127141 - DNA, 103 bp, Artificial Sequence
  Synthetic Polynucleotide
taatacgactcactatagggtttgctgagcccctggacattctgtggctgaacagaggagacagccaatgaatgtccagaacctggcggcagcgcaaaagatg

SEQ ID NO: 127142 - DNA, 103 bp, Artificial Sequence
  Synthetic Polynucleotide
taatacgactcactatagggcttggtgacatgagcctctgggccatgcacaacagaggagagtgcatatgccagaggctaacctggcggcagcgcaaaagatg

SEQ ID NO: 127143 - DNA, 103 bp, Artificial Sequence
  Synthetic Polynucleotide
taatacgactcactatagggctcgctgcttcttggtgacatgagcctctgaacagaggagacagaggatgatgtcaccaaacctggcggcagcgcaaaagatg

SEQ ID NO: 127144 - DNA, 103 bp, Artificial Sequence
  Synthetic Polynucleotide
taatacgactcactatagggtggatgtcccctcgctgcttcttggtgacaaacagaggagatgtcacatggaagcagcgaacctggcggcagcgcaaaagatg

SEQ ID NO: 127145 - DNA, 103 bp, Artificial Sequence
  Synthetic Polynucleotide
taatacgactcactatagggcggccgaggatggatgtcccctcgctgcttaacagaggagaaagcagatgggggacatcaacctggcggcagcgcaaaagatg

SEQ ID NO: 127146 - DNA, 103 bp, Artificial Sequence
  Synthetic Polynucleotide
taatacgactcactatagggtcgggggtggcggccgaggatggatgtcccaacagaggagagggacaatgatcctcggcaacctggcggcagcgcaaaagatg

SEQ ID NO: 127147 - DNA, 103 bp, Artificial Sequence
  Synthetic Polynucleotide
taatacgactcactatagggccggaatctctcgggggtggcggccgaggaaacagaggagatcctcgatggccacccccaacctggcggcagcgcaaaagatg

SEQ ID NO: 127148 - DNA, 103 bp, Artificial Sequence
  Synthetic Polynucleotide
taatacgactcactatagggtgaatggctgccggaatctctcgggggtggaacagaggagaccacccatgagagattccaacctggcggcagcgcaaaagatg

SEQ ID NO: 127149 - DNA, 103 bp, Artificial Sequence
  Synthetic Polynucleotide
taatacgactcactatagggacctggactgtgaatggctgccggaatctcaacagaggagagagattatggcagccattaacctggcggcagcgcaaaagatg

SEQ ID NO: 127150 - DNA, 103 bp, Artificial Sequence
  Synthetic Polynucleotide
taatacgactcactatagggcggccaggcgacctggactgtgaatggctgaacagaggagacagccaatgacagtccagaacctggcggcagcgcaaaagatg

SEQ ID NO: 127151 - DNA, 103 bp, Artificial Sequence
  Synthetic Polynucleotide
taatacgactcactatagggctgagtcggtcggccaggcgacctggactgaacagaggagacagtccatgtcgcctggcaacctggcggcagcgcaaaagatg

SEQ ID NO: 127152 - DNA, 103 bp, Artificial Sequence
  Synthetic Polynucleotide
taatacgactcactatagggtcttttcagtggtcgtggagctgtgggactaacagaggagaagtcccatggctccacgaaacctggcggcagcgcaaaagatg

SEQ ID NO: 127153 - DNA, 103 bp, Artificial Sequence
  Synthetic Polynucleotide
taatacgactcactatagggcctcactgactttgctgagcccctggacataacagaggagaatgtccatgggctcagcaaacctggcggcagcgcaaaagatg

SEQ ID NO: 127154 - DNA, 103 bp, Artificial Sequence
  Synthetic Polynucleotide
taatacgactcactatagggcaagggctccctgagtcggtcggccaggcgaacagaggagacgcctgatggaccgactcaacctggcggcagcgcaaaagatg

SEQ ID NO: 127155 - DNA, 103 bp, Artificial Sequence
  Synthetic Polynucleotide
taatacgactcactatagggtgctgctcaccaagggctccctgagtcggtaacagaggagaaccgacatggggagccctaacctggcggcagcgcaaaagatg

SEQ ID NO: 127156 - DNA, 103 bp, Artificial Sequence
  Synthetic Polynucleotide
taatacgactcactataggggctgaggtcctgctgctcaccaagggctccaacagaggagaggagccatgggtgagcagaacctggcggcagcgcaaaagatg

SEQ ID NO: 127157 - DNA, 103 bp, Artificial Sequence
  Synthetic Polynucleotide
taatacgactcactatagggaggtagtgttgctgaggtcctgctgctcacaacagaggagagtgagcatgaggacctcaaacctggcggcagcgcaaaagatg

SEQ ID NO: 127158 - DNA, 103 bp, Artificial Sequence
  Synthetic Polynucleotide
taatacgactcactatagggtcccgctttgaggtagtgttgctgaggtccaacagaggagaggacctatgcaacactacaacctggcggcagcgcaaaagatg

SEQ ID NO: 127159 - DNA, 103 bp, Artificial Sequence
  Synthetic Polynucleotide
taatacgactcactataggggaggcattcttcccgctttgaggtagtgttaacagaggagaaacactatgtcaaagcggaacctggcggcagcgcaaaagatg

SEQ ID NO: 127160 - DNA, 103 bp, Artificial Sequence
  Synthetic Polynucleotide
taatacgactcactatagggttttcacctggaggcattcttcccgctttgaacagaggagacaaagcatgaagaatgccaacctggcggcagcgcaaaagatg

SEQ ID NO: 127161 - DNA, 103 bp, Artificial Sequence
  Synthetic Polynucleotide
taatacgactcactataggggccttgacggttttcacctggaggcattctaacagaggagaagaatgatgccaggtgaaaacctggcggcagcgcaaaagatg

SEQ ID NO: 127162 - DNA, 103 bp, Artificial Sequence
  Synthetic Polynucleotide
taatacgactcactatagggtggcttctctgccttgacggttttcacctgaacagaggagacaggtgatgaccgtcaagaacctggcggcagcgcaaaagatg

SEQ ID NO: 127163 - DNA, 103 bp, Artificial Sequence
  Synthetic Polynucleotide
taatacgactcactataggggagatgtcattggcttctctgccttgacggaacagaggagaccgtcaatgcagagaagcaacctggcggcagcgcaaaagatg

SEQ ID NO: 127164 - DNA, 103 bp, Artificial Sequence
  Synthetic Polynucleotide
taatacgactcactataggggttgaaggttcctcactgactttgctgagcaacagaggagagctcagatgagtcagtgaaacctggcggcagcgcaaaagatg

SEQ ID NO: 127165 - DNA, 103 bp, Artificial Sequence
  Synthetic Polynucleotide
taatacgactcactataggggggcttggctgagatgtcattggcttctctaacagaggagaagagaaatgaatgacatcaacctggcggcagcgcaaaagatg

SEQ ID NO: 127166 - DNA, 103 bp, Artificial Sequence
  Synthetic Polynucleotide
taatacgactcactatagggctgaccaccagggcttggctgagatgtcataacagaggagaatgacaatgcagccaagcaacctggcggcagcgcaaaagatg

SEQ ID NO: 127167 - DNA, 103 bp, Artificial Sequence
  Synthetic Polynucleotide
taatacgactcactatagggtgcatgaagactgaccaccagggcttggctaacagaggagaagccaaatgctggtggtcaacctggcggcagcgcaaaagatg

SEQ ID NO: 127168 - DNA, 103 bp, Artificial Sequence
  Synthetic Polynucleotide
taatacgactcactatagggtgttggctgctgcatgaagactgaccaccaaacagaggagatggtggatggtcttcatgaacctggcggcagcgcaaaagatg

SEQ ID NO: 127169 - DNA, 103 bp, Artificial Sequence
  Synthetic Polynucleotide
taatacgactcactataggggatgggggactgttggctgctgcatgaagaaacagaggagatcttcaatgagcagccaaaacctggcggcagcgcaaaagatg

SEQ ID NO: 127170 - DNA, 103 bp, Artificial Sequence
  Synthetic Polynucleotide
taatacgactcactatagggaatagttgctgatgggggactgttggctgcaacagaggagagcagccatgagtcccccaaacctggcggcagcgcaaaagatg

SEQ ID NO: 127171 - DNA, 103 bp, Artificial Sequence
  Synthetic Polynucleotide
taatacgactcactatagggccactgttggaatagttgctgatgggggacaacagaggagagtccccatgcagcaactaaacctggcggcagcgcaaaagatg

SEQ ID NO: 127172 - DNA, 103 bp, Artificial Sequence
  Synthetic Polynucleotide
taatacgactcactatagggaagctcgagcccactgttggaatagttgctaacagaggagaagcaacatgtccaacagtaacctggcggcagcgcaaaagatg

SEQ ID NO: 127173 - DNA, 103 bp, Artificial Sequence
  Synthetic Polynucleotide
taatacgactcactatagggcggtcagaggaagctcgagcccactgttggaacagaggagaccaacaatgggctcgagcaacctggcggcagcgcaaaagatg

SEQ ID NO: 127174 - DNA, 103 bp, Artificial Sequence
  Synthetic Polynucleotide
taatacgactcactatagggctacctccatcggtcagaggaagctcgagcaacagaggagagctcgaatgtcctctgacaacctggcggcagcgcaaaagatg

SEQ ID NO: 127175 - DNA, 103 bp, Artificial Sequence
  Synthetic Polynucleotide
taatacgactcactataggggtcactcgatgttgaaggttcctcactgacaacagaggagagtcagtatggaaccttcaaacctggcggcagcgcaaaagatg

SEQ ID NO: 127176 - DNA, 103 bp, Artificial Sequence
  Synthetic Polynucleotide
taatacgactcactataggggtctcctatactacctccatcggtcagaggaacagaggagacctctgatggatggaggtaacctggcggcagcgcaaaagatg

SEQ ID NO: 127177 - DNA, 103 bp, Artificial Sequence
  Synthetic Polynucleotide
taatacgactcactatagggtggcactgaggtctcctatactacctccataacagaggagaatggagatggtataggagaacctggcggcagcgcaaaagatg

SEQ ID NO: 127178 - DNA, 103 bp, Artificial Sequence
  Synthetic Polynucleotide
taatacgactcactataggggtttcatcgatggcactgaggtctcctataaacagaggagatataggatgcctcagtgcaacctggcggcagcgcaaaagatg

SEQ ID NO: 127179 - DNA, 103 bp, Artificial Sequence
  Synthetic Polynucleotide
taatacgactcactatagggcatgattggggtttcatcgatggcactgagaacagaggagactcagtatgatcgatgaaaacctggcggcagcgcaaaagatg

SEQ ID NO: 127180 - DNA, 103 bp, Artificial Sequence
  Synthetic Polynucleotide
taatacgactcactatagggtggttgagtccatgattggggtttcatcgaaacagaggagatcgatgatgccccaatcaaacctggcggcagcgcaaaagatg

SEQ ID NO: 127181 - DNA, 103 bp, Artificial Sequence
  Synthetic Polynucleotide
taatacgactcactataggggcagtggaaatggttgagtccatgattgggaacagaggagacccaatatgggactcaacaacctggcggcagcgcaaaagatg

SEQ ID NO: 127182 - DNA, 103 bp, Artificial Sequence
  Synthetic Polynucleotide
taatacgactcactatagggggctgtggttgcagtggaaatggttgagtcaacagaggagagactcaatgatttccactaacctggcggcagcgcaaaagatg

SEQ ID NO: 127183 - DNA, 103 bp, Artificial Sequence
  Synthetic Polynucleotide
taatacgactcactataggggcaaagcaagggctgtggttgcagtggaaaaacagaggagatttccaatgcaaccacagaacctggcggcagcgcaaaagatg

SEQ ID NO: 127184 - DNA, 103 bp, Artificial Sequence
  Synthetic Polynucleotide
taatacgactcactatagggctcctggcttgcaaagcaagggctgtggttaacagaggagaaaccacatgccttgctttaacctggcggcagcgcaaaagatg

SEQ ID NO: 127185 - DNA, 103 bp, Artificial Sequence
  Synthetic Polynucleotide
taatacgactcactatagggtgccgggtttctcctggcttgcaaagcaagaacagaggagacttgctatgcaagccaggaacctggcggcagcgcaaaagatg

SEQ ID NO: 127186 - DNA, 103 bp, Artificial Sequence
  Synthetic Polynucleotide
taatacgactcactatagggaggccctctcgtcactcgatgttgaaggttaacagaggagaaaccttatgcatcgagtgaacctggcggcagcgcaaaagatg

SEQ ID NO: 127187 - DNA, 103 bp, Artificial Sequence
  Synthetic Polynucleotide
taatacgactcactatagggatttggtccctgccgggtttctcctggcttaacagaggagaaagccaatggaaacccggaacctggcggcagcgcaaaagatg

SEQ ID NO: 127188 - DNA, 103 bp, Artificial Sequence
  Synthetic Polynucleotide
taatacgactcactatagggtgctccatccatttggtccctgccgggtttaacagaggagaaaacccatgagggaccaaaacctggcggcagcgcaaaagatg

SEQ ID NO: 127189 - DNA, 103 bp, Artificial Sequence
  Synthetic Polynucleotide
taatacgactcactatagggtagttttacgtgctccatccatttggtcccaacagaggagagggaccatgtggatggagaacctggcggcagcgcaaaagatg

SEQ ID NO: 127190 - DNA, 103 bp, Artificial Sequence
  Synthetic Polynucleotide
taatacgactcactatagggttagcctttctagttttacgtgctccatccaacagaggagaggatggatgacgtaaaacaacctggcggcagcgcaaaagatg

SEQ ID NO: 127191 - DNA, 103 bp, Artificial Sequence
  Synthetic Polynucleotide
taatacgactcactatagggttcacttgttttagcctttctagttttacgaacagaggagacgtaaaatgagaaaggctaacctggcggcagcgcaaaagatg

SEQ ID NO: 127192 - DNA, 103 bp, Artificial Sequence
  Synthetic Polynucleotide
taatacgactcactatagggaaacattccattcacttgttttagcctttcaacagaggagagaaaggatgaaacaagtgaacctggcggcagcgcaaaagatg

SEQ ID NO: 127193 - DNA, 103 bp, Artificial Sequence
  Synthetic Polynucleotide
taatacgactcactatagggtcagtcgcggaaacattccattcacttgttaacagaggagaaacaagatgatggaatgtaacctggcggcagcgcaaaagatg

SEQ ID NO: 127194 - DNA, 103 bp, Artificial Sequence
  Synthetic Polynucleotide
taatacgactcactatagggagaatggggttcagtcgcggaaacattccaaacagaggagatggaatatgtccgcgactaacctggcggcagcgcaaaagatg

SEQ ID NO: 127195 - DNA, 103 bp, Artificial Sequence
  Synthetic Polynucleotide
taatacgactcactatagggtttagggggtagaatggggttcagtcgcggaacagaggagaccgcgaatgaaccccattaacctggcggcagcgcaaaagatg

SEQ ID NO: 127196 - DNA, 103 bp, Artificial Sequence
  Synthetic Polynucleotide
taatacgactcactatagggccgcaggggctttagggggtagaatggggtaacagaggagaaccccaatgtaccccctaaacctggcggcagcgcaaaagatg

SEQ ID NO: 127197 - DNA, 103 bp, Artificial Sequence
  Synthetic Polynucleotide
taatacgactcactatagggttgatcaatgaggccctctcgtcactcgataacagaggagaatcgagatgcgagagggcaacctggcggcagcgcaaaagatg

SEQ ID NO: 127198 - DNA, 103 bp, Artificial Sequence
  Synthetic Polynucleotide
taatacgactcactatagggagaggagagaccgcaggggctttagggggtaacagaggagaacccccatgagcccctgcaacctggcggcagcgcaaaagatg

SEQ ID NO: 127199 - DNA, 103 bp, Artificial Sequence
  Synthetic Polynucleotide
taatacgactcactatagggatttcctatgagaggagagaccgcaggggcaacagaggagagcccctatggtctctcctaacctggcggcagcgcaaaagatg

SEQ ID NO: 127200 - DNA, 103 bp, Artificial Sequence
  Synthetic Polynucleotide
taatacgactcactatagggactgtgtgccatttcctatgagaggagagaaacagaggagatctctcatgtcataggaaaacctggcggcagcgcaaaagatg

SEQ ID NO: 127201 - DNA, 103 bp, Artificial Sequence
  Synthetic Polynucleotide
taatacgactcactataggggtgttgttggactgtgtgccatttcctatgaacagaggagacataggatgtggcacacaaacctggcggcagcgcaaaagatg

SEQ ID NO: 127202 - DNA, 103 bp, Artificial Sequence
  Synthetic Polynucleotide
taatacgactcactatagggcaagctgcaggtgttgttggactgtgtgccaacagaggagaggcacaatgtccaacaacaacctggcggcagcgcaaaagatg

SEQ ID NO: 127203 - DNA, 103 bp, Artificial Sequence
  Synthetic Polynucleotide
taatacgactcactatagggtgggcccacccaagctgcaggtgttgttggaacagaggagaccaacaatgcctgcagctaacctggcggcagcgcaaaagatg

SEQ ID NO: 127204 - DNA, 103 bp, Artificial Sequence
  Synthetic Polynucleotide
taatacgactcactatagggagaagcgtcatgggcccacccaagctgcagaacagaggagactgcagatggggtgggccaacctggcggcagcgcaaaagatg

SEQ ID NO: 127205 - DNA, 103 bp, Artificial Sequence
  Synthetic Polynucleotide
taatacgactcactatagggtctgcccgggagaagcgtcatgggcccaccaacagaggagaggtgggatgatgacgcttaacctggcggcagcgcaaaagatg

SEQ ID NO: 127206 - DNA, 103 bp, Artificial Sequence
  Synthetic Polynucleotide
taatacgactcactatagggagaggtcgcttctgcccgggagaagcgtcaaacagaggagatgacgcatgtcccgggcaaacctggcggcagcgcaaaagatg

SEQ ID NO: 127207 - DNA, 103 bp, Artificial Sequence
  Synthetic Polynucleotide
taatacgactcactatagggtccaccccagagaggtcgcttctgcccgggaacagaggagacccgggatgaagcgacctaacctggcggcagcgcaaaagatg

SEQ ID NO: 127208 - DNA, 103 bp, Artificial Sequence
  Synthetic Polynucleotide
taatacgactcactataggggatctctttcttgatcaatgaggccctctcaacagaggagagagaggatgtcattgatcaacctggcggcagcgcaaaagatg

SEQ ID NO: 127209 - DNA, 103 bp, Artificial Sequence
  Synthetic Polynucleotide
taatacgactcactatagggcatagtgacgtccaccccagagaggtcgctaacagaggagaagcgacatgtctggggtgaacctggcggcagcgcaaaagatg

SEQ ID NO: 127210 - DNA, 103 bp, Artificial Sequence
  Synthetic Polynucleotide
taatacgactcactataggggcatgttcagcatagtgacgtccaccccagaacagaggagactggggatgacgtcactaaacctggcggcagcgcaaaagatg

SEQ ID NO: 127211 - DNA, 103 bp, Artificial Sequence
  Synthetic Polynucleotide
taatacgactcactatagggcttctgttgagcatgttcagcatagtgacgaacagaggagacgtcacatggctgaacataacctggcggcagcgcaaaagatg

SEQ ID NO: 127212 - DNA, 103 bp, Artificial Sequence
  Synthetic Polynucleotide
taatacgactcactataggggctgctgtcccttctgttgagcatgttcagaacagaggagactgaacatgctcaacagaaacctggcggcagcgcaaaagatg

SEQ ID NO: 127213 - DNA, 103 bp, Artificial Sequence
  Synthetic Polynucleotide
taatacgactcactatagggtggtgctggcgctgctgtcccttctgttgaaacagaggagatcaacaatggggacagcaaacctggcggcagcgcaaaagatg

SEQ ID NO: 127214 - DNA, 103 bp, Artificial Sequence
  Synthetic Polynucleotide
taatacgactcactataggggccgagctgatggtgctggcgctgctgtccaacagaggagaggacagatgcgccagcacaacctggcggcagcgcaaaagatg

SEQ ID NO: 127215 - DNA, 103 bp, Artificial Sequence
  Synthetic Polynucleotide
taatacgactcactataggggctcaggtaggccgagctgatggtgctggcaacagaggagagccagcatgatcagctcgaacctggcggcagcgcaaaagatg

SEQ ID NO: 127216 - DNA, 103 bp, Artificial Sequence
  Synthetic Polynucleotide
taatacgactcactatagggagcggcggctgctcaggtaggccgagctgaaacagaggagatcagctatgcctacctgaaacctggcggcagcgcaaaagatg

SEQ ID NO: 127217 - DNA, 103 bp, Artificial Sequence
  Synthetic Polynucleotide
taatacgactcactatagggatccctgaggagcggcggctgctcaggtagaacagaggagactacctatgcagccgccgaacctggcggcagcgcaaaagatg

SEQ ID NO: 127218 - DNA, 103 bp, Artificial Sequence
  Synthetic Polynucleotide
taatacgactcactataggggcagggcgagatccctgaggagcggcggctaacagaggagaagccgcatgtcctcagggaacctggcggcagcgcaaaagatg

SEQ ID NO: 127219 - DNA, 103 bp, Artificial Sequence
  Synthetic Polynucleotide
taatacgactcactataggggggacccatggatctctttcttgatcaatgaacagaggagacattgaatgagaaagagaaacctggcggcagcgcaaaagatg

SEQ ID NO: 127220 - DNA, 103 bp, Artificial Sequence
  Synthetic Polynucleotide
taatacgactcactatagggggctggagaagcagggcgagatccctgaggaacagaggagacctcagatgtctcgccctaacctggcggcagcgcaaaagatg

SEQ ID NO: 127221 - DNA, 103 bp, Artificial Sequence
  Synthetic Polynucleotide
taatacgactcactatagggctggagcggcggctggagaagcagggcgagaacagaggagactcgccatgcttctccagaacctggcggcagcgcaaaagatg

SEQ ID NO: 127222 - DNA, 103 bp, Artificial Sequence
  Synthetic Polynucleotide
taatacgactcactatagggtgacgcctcgctggagcggcggctggagaaaacagaggagattctccatgcgccgctccaacctggcggcagcgcaaaagatg

SEQ ID NO: 127223 - DNA, 103 bp, Artificial Sequence
  Synthetic Polynucleotide
taatacgactcactatagggcctcggcctgtgacgcctcgctggagcggcaacagaggagagccgctatggcgaggcgtaacctggcggcagcgcaaaagatg

SEQ ID NO: 127224 - DNA, 103 bp, Artificial Sequence
  Synthetic Polynucleotide
taatacgactcactatagggtgcggccggccctcggcctgtgacgcctcgaacagaggagacgaggcatgacaggccgaaacctggcggcagcgcaaaagatg

SEQ ID NO: 127225 - DNA, 103 bp, Artificial Sequence
  Synthetic Polynucleotide
taatacgactcactataggggctcacgttctgcggccggccctcggcctgaacagaggagacaggccatgggccggccgaacctggcggcagcgcaaaagatg

SEQ ID NO: 127226 - DNA, 103 bp, Artificial Sequence
  Synthetic Polynucleotide
taatacgactcactatagggagtcggccacgctcacgttctgcggccggcaacagaggagagccggcatgagaacgtgaaacctggcggcagcgcaaaagatg

SEQ ID NO: 127227 - DNA, 103 bp, Artificial Sequence
  Synthetic Polynucleotide
taatacgactcactataggggggtcgtaggagtcggccacgctcacgttcaacagaggagagaacgtatgcgtggccgaaacctggcggcagcgcaaaagatg

SEQ ID NO: 127228 - DNA, 103 bp, Artificial Sequence
  Synthetic Polynucleotide
taatacgactcactatagggggtggagatggggtcgtaggagtcggccacaacagaggagagtggccatgtcctacgacaacctggcggcagcgcaaaagatg

SEQ ID NO: 127229 - DNA, 103 bp, Artificial Sequence
  Synthetic Polynucleotide
taatacgactcactataggggcgaggcgtcggtggagatggggtcgtaggaacagaggagacctacgatgccatctccaaacctggcggcagcgcaaaagatg

SEQ ID NO: 127230 - DNA, 103 bp, Artificial Sequence
  Synthetic Polynucleotide
taatacgactcactatagggacgtgtggcagggacccatggatctctttcaacagaggagagaaagaatgccatgggtcaacctggcggcagcgcaaaagatg

SEQ ID NO: 127231 - DNA, 103 bp, Artificial Sequence
  Synthetic Polynucleotide
taatacgactcactatagggctggagcggcgcgaggcgtcggtggagatgaacagaggagacatctcatgcgacgcctcaacctggcggcagcgcaaaagatg

SEQ ID NO: 127232 - DNA, 103 bp, Artificial Sequence
  Synthetic Polynucleotide
taatacgactcactataggggctggcttcgctggagcggcgcgaggcgtcaacagaggagagacgccatgcgccgctccaacctggcggcagcgcaaaagatg

SEQ ID NO: 127233 - DNA, 103 bp, Artificial Sequence
  Synthetic Polynucleotide
taatacgactcactatagggcgtcgctctggctggcttcgctggagcggcaacagaggagagccgctatggcgaagccaaacctggcggcagcgcaaaagatg

SEQ ID NO: 127234 - DNA, 103 bp, Artificial Sequence
  Synthetic Polynucleotide
taatacgactcactatagggctgggcaggccgtcgctctggctggcttcgaacagaggagacgaagcatgccagagcgaaacctggcggcagcgcaaaagatg

SEQ ID NO: 127235 - DNA, 103 bp, Artificial Sequence
  Synthetic Polynucleotide
taatacgactcactataggggctgagcaggctgggcaggccgtcgctctgaacagaggagacagagcatgggcctgcccaacctggcggcagcgcaaaagatg

SEQ ID NO: 127236 - DNA, 103 bp, Artificial Sequence
  Synthetic Polynucleotide
taatacgactcactatagggcgggcgtgaggctgagcaggctgggcaggcaacagaggagagcctgcatggcctgctcaaacctggcggcagcgcaaaagatg

SEQ ID NO: 127237 - DNA, 103 bp, Artificial Sequence
  Synthetic Polynucleotide
taatacgactcactatagggtactgctgggcgggcgtgaggctgagcaggaacagaggagacctgctatgcctcacgccaacctggcggcagcgcaaaagatg

SEQ ID NO: 127238 - DNA, 103 bp, Artificial Sequence
  Synthetic Polynucleotide
taatacgactcactatagggcttgaggcggtactgctgggcgggcgtgagaacagaggagactcacgatggcccagcagaacctggcggcagcgcaaaagatg

SEQ ID NO: 127239 - DNA, 103 bp, Artificial Sequence
  Synthetic Polynucleotide
taatacgactcactatagggcgtacttggccttgaggcggtactgctgggaacagaggagacccagcatgaccgcctcaaacctggcggcagcgcaaaagatg

SEQ ID NO: 127240 - DNA, 103 bp, Artificial Sequence
  Synthetic Polynucleotide
taatacgactcactataggggtggcagccgcgtacttggccttgaggcggaacagaggagaccgcctatgggccaagtaaacctggcggcagcgcaaaagatg

SEQ ID NO: 127241 - DNA, 103 bp, Artificial Sequence
  Synthetic Polynucleotide
taatacgactcactataggggggctccgccacgtgtggcagggacccatgaacagaggagacatgggatgctgccacacaacctggcggcagcgcaaaagatg

SEQ ID NO: 127242 - DNA, 103 bp, Artificial Sequence
  Synthetic Polynucleotide
taatacgactcactatagggcggccctcctgtggcagccgcgtacttggcaacagaggagagccaagatggcggctgccaacctggcggcagcgcaaaagatg

SEQ ID NO: 127243 - DNA, 103 bp, Artificial Sequence
  Synthetic Polynucleotide
taatacgactcactataggggcgtcggcggcggccctcctgtggcagccgaacagaggagacggctgatgcaggagggcaacctggcggcagcgcaaaagatg

SEQ ID NO: 127244 - DNA, 103 bp, Artificial Sequence
  Synthetic Polynucleotide
taatacgactcactatagggttgggcaggggcgtcggcggcggccctcctaacagaggagaaggaggatggccgccgacaacctggcggcagcgcaaaagatg

SEQ ID NO: 127245 - DNA, 103 bp, Artificial Sequence
  Synthetic Polynucleotide
taatacgactcactatagggcctctccatgttgggcaggggcgtcggcggaacagaggagaccgccgatgcccctgcccaacctggcggcagcgcaaaagatg

SEQ ID NO: 127246 - DNA, 103 bp, Artificial Sequence
  Synthetic Polynucleotide
taatacgactcactatagggtcaggctcatcctctccatgttgggcagggaacagaggagaccctgcatgacatggagaaacctggcggcagcgcaaaagatg

SEQ ID NO: 127247 - DNA, 103 bp, Artificial Sequence
  Synthetic Polynucleotide
taatacgactcactatagggaggcgcgtcttcaggctcatcctctccatgaacagaggagacatggaatggatgagcctaacctggcggcagcgcaaaagatg

SEQ ID NO: 127248 - DNA, 103 bp, Artificial Sequence
  Synthetic Polynucleotide
taatacgactcactataggggagcagcgccaggcgcgtcttcaggctcataacagaggagaatgagcatgaagacgcgcaacctggcggcagcgcaaaagatg

SEQ ID NO: 127249 - DNA, 103 bp, Artificial Sequence
  Synthetic Polynucleotide
taatacgactcactataggggggcatccccgagcagcgccaggcgcgtctaacagaggagaagacgcatgtggcgctgcaacctggcggcagcgcaaaagatg

SEQ ID NO: 127250 - DNA, 103 bp, Artificial Sequence
  Synthetic Polynucleotide
taatacgactcactatagggccaggctcgagggcatccccgagcagcgccaacagaggagaggcgctatgcggggatgcaacctggcggcagcgcaaaagatg

SEQ ID NO: 127251 - DNA, 103 bp, Artificial Sequence
  Synthetic Polynucleotide
taatacgactcactatagggcagggccacgccaggctcgagggcatccccaacagaggagaggggatatgctcgagcctaacctggcggcagcgcaaaagatg

SEQ ID NO: 127252 - DNA, 103 bp, Artificial Sequence
  Synthetic Polynucleotide
taatacgactcactatagggacggcacagagggctccgccacgtgtggcaaacagaggagatgccacatgtggcggagcaacctggcggcagcgcaaaagatg

SEQ ID NO: 127253 - DNA, 103 bp, Artificial Sequence
  Synthetic Polynucleotide
taatacgactcactataggggaactggaggcagggccacgccaggctcgaaacagaggagatcgagcatggcgtggcccaacctggcggcagcgcaaaagatg

SEQ ID NO: 127254 - DNA, 103 bp, Artificial Sequence
  Synthetic Polynucleotide
taatacgactcactatagggctcggggcatgaactggaggcagggccacgaacagaggagacgtggcatggcctccagtaacctggcggcagcgcaaaagatg

SEQ ID NO: 127255 - DNA, 103 bp, Artificial Sequence
  Synthetic Polynucleotide
taatacgactcactataggggctgcacctcctcggggcatgaactggaggaacagaggagacctccaatgcatgccccgaacctggcggcagcgcaaaagatg

SEQ ID NO: 127256 - DNA, 103 bp, Artificial Sequence
  Synthetic Polynucleotide
taatacgactcactatagggctcccccgtcgctgcacctcctcggggcataacagaggagaatgcccatgggaggtgcaaacctggcggcagcgcaaaagatg

SEQ ID NO: 127257 - DNA, 103 bp, Artificial Sequence
  Synthetic Polynucleotide
taatacgactcactatagggtagccgtgggctcccccgtcgctgcacctcaacagaggagagaggtgatgcgacgggggaacctggcggcagcgcaaaagatg

SEQ ID NO: 127258 - DNA, 103 bp, Artificial Sequence
  Synthetic Polynucleotide
taatacgactcactataggggcgccgcccgtagccgtgggctcccccgtcaacagaggagagacgggatggcccacggcaacctggcggcagcgcaaaagatg

SEQ ID NO: 127259 - DNA, 103 bp, Artificial Sequence
  Synthetic Polynucleotide
taatacgactcactataggggctgcaggtggcgccgcccgtagccgtgggaacagaggagacccacgatgacgggcggcaacctggcggcagcgcaaaagatg

SEQ ID NO: 127260 - DNA, 103 bp, Artificial Sequence
  Synthetic Polynucleotide
taatacgactcactataggggcatcgtgcggctgcaggtggcgccgcccgaacagaggagacgggcgatgccacctgcaaacctggcggcagcgcaaaagatg

SEQ ID NO: 127261 - DNA, 103 bp, Artificial Sequence
  Synthetic Polynucleotide
taatacgactcactataggggtggcccggcgcatcgtgcggctgcaggtgaacagaggagacacctgatgccgcacgataacctggcggcagcgcaaaagatg

SEQ ID NO: 127262 - DNA, 103 bp, Artificial Sequence
  Synthetic Polynucleotide
taatacgactcactatagggtcctcacgccgtggcccggcgcatcgtgcgaacagaggagacgcacgatgcgccgggccaacctggcggcagcgcaaaagatg

SEQ ID NO: 127263 - DNA, 103 bp, Artificial Sequence
  Synthetic Polynucleotide
taatacgactcactatagggtcaacttttttcttttcagtggtcgtggagaacagaggagactccacatgcactgaaaaaacctggcggcagcgcaaaagatg

SEQ ID NO: 127264 - DNA, 103 bp, Artificial Sequence
  Synthetic Polynucleotide
taatacgactcactataggggtcccgcggtacggcacagagggctccgccaacagaggagaggcggaatgctctgtgccaacctggcggcagcgcaaaagatg

SEQ ID NO: 127265 - DNA, 103 bp, Artificial Sequence
  Synthetic Polynucleotide
taatacgactcactatagggtcgctggccctcctcacgccgtggcccggcaacagaggagagccgggatgcggcgtgagaacctggcggcagcgcaaaagatg

SEQ ID NO: 127266 - DNA, 103 bp, Artificial Sequence
  Synthetic Polynucleotide
taatacgactcactatagggccgcaccgggtcgctggccctcctcacgccaacagaggagaggcgtgatgagggccagcaacctggcggcagcgcaaaagatg

SEQ ID NO: 127267 - DNA, 103 bp, Artificial Sequence
  Synthetic Polynucleotide
taatacgactcactatagggcggagcctgtccgcaccgggtcgctggcccaacagaggagagggccaatgacccggtgcaacctggcggcagcgcaaaagatg

SEQ ID NO: 127268 - DNA, 103 bp, Artificial Sequence
  Synthetic Polynucleotide
taatacgactcactataggggccaggccctcggagcctgtccgcaccgggaacagaggagacccggtatggacaggctcaacctggcggcagcgcaaaagatg

SEQ ID NO: 127269 - DNA, 103 bp, Artificial Sequence
  Synthetic Polynucleotide
taatacgactcactatagggacgaggcagggccaggccctcggagcctgtaacagaggagaacaggcatggagggcctgaacctggcggcagcgcaaaagatg

SEQ ID NO: 127270 - DNA, 103 bp, Artificial Sequence
  Synthetic Polynucleotide
taatacgactcactatagggagcgcggcacacgaggcagggccaggccctaacagaggagaagggccatgccctgcctcaacctggcggcagcgcaaaagatg

SEQ ID NO: 127271 - DNA, 103 bp, Artificial Sequence
  Synthetic Polynucleotide
taatacgactcactatagggaggctgctgaagcgcggcacacgaggcaggaacagaggagacctgccatgtgtgccgcgaacctggcggcagcgcaaaagatg

SEQ ID NO: 127272 - DNA, 103 bp, Artificial Sequence
  Synthetic Polynucleotide
taatacgactcactataggggcagctgctgaggctgctgaagcgcggcacaacagaggagagtgccgatgttcagcagcaacctggcggcagcgcaaaagatg

SEQ ID NO: 127273 - DNA, 103 bp, Artificial Sequence
  Synthetic Polynucleotide
taatacgactcactatagggccggggggttgcagctgctgaggctgctgaaacagaggagatcagcaatgtcagcagctaacctggcggcagcgcaaaagatg

SEQ ID NO: 127274 - DNA, 103 bp, Artificial Sequence
  Synthetic Polynucleotide
taatacgactcactataggggtggccatcgccggggggttgcagctgctgaacagaggagacagcagatgcaaccccccaacctggcggcagcgcaaaagatg

SEQ ID NO: 127275 - DNA, 103 bp, Artificial Sequence
  Synthetic Polynucleotide
taatacgactcactatagggggcaaacaccgtcccgcggtacggcacagaaacagaggagatctgtgatgtaccgcgggaacctggcggcagcgcaaaagatg

SEQ ID NO: 127276 - DNA, 103 bp, Artificial Sequence
  Synthetic Polynucleotide
taatacgactcactatagggctccgcggacgtggccatcgccggggggttaacagaggagaaaccccatggcgatggccaacctggcggcagcgcaaaagatg

SEQ ID NO: 127277 - DNA, 103 bp, Artificial Sequence
  Synthetic Polynucleotide
taatacgactcactataggggactgcgcttctccgcggacgtggccatcgaacagaggagacgatggatgcgtccgcggaacctggcggcagcgcaaaagatg

SEQ ID NO: 127278 - DNA, 103 bp, Artificial Sequence
  Synthetic Polynucleotide
taatacgactcactatagggtgaagcacgagactgcgcttctccgcggacaacagaggagagtccgcatggaagcgcagaacctggcggcagcgcaaaagatg

SEQ ID NO: 127279 - DNA, 103 bp, Artificial Sequence
  Synthetic Polynucleotide
taatacgactcactatagggcgtgtaattctgaagcacgagactgcgcttaacagaggagaaagcgcatgctcgtgcttaacctggcggcagcgcaaaagatg

SEQ ID NO: 127280 - DNA, 103 bp, Artificial Sequence
  Synthetic Polynucleotide
taatacgactcactatagggcctcgggccgcgtgtaattctgaagcacgaaacagaggagatcgtgcatgagaattacaaacctggcggcagcgcaaaagatg

SEQ ID NO: 127281 - DNA, 103 bp, Artificial Sequence
  Synthetic Polynucleotide
taatacgactcactataggggactggccgccctcgggccgcgtgtaattcaacagaggagagaattaatggcggcccgaaacctggcggcagcgcaaaagatg

SEQ ID NO: 127282 - DNA, 103 bp, Artificial Sequence
  Synthetic Polynucleotide
taatacgactcactataggggaagtttcgggactggccgccctcgggccgaacagaggagacggcccatgggcggccagaacctggcggcagcgcaaaagatg

SEQ ID NO: 127283 - DNA, 103 bp, Artificial Sequence
  Synthetic Polynucleotide
taatacgactcactataggggggacgagtggaagtttcgggactggccgcaacagaggagagcggccatgcccgaaactaacctggcggcagcgcaaaagatg

SEQ ID NO: 127284 - DNA, 103 bp, Artificial Sequence
  Synthetic Polynucleotide
taatacgactcactatagggggaggacagggggacgagtggaagtttcggaacagaggagaccgaaaatgccactcgtcaacctggcggcagcgcaaaagatg

SEQ ID NO: 127285 - DNA, 103 bp, Artificial Sequence
  Synthetic Polynucleotide
taatacgactcactatagggggtgatgctgggaggacagggggacgagtgaacagaggagacactcgatgccctgtcctaacctggcggcagcgcaaaagatg

SEQ ID NO: 127286 - DNA, 103 bp, Artificial Sequence
  Synthetic Polynucleotide
taatacgactcactatagggtggggtccatggcaaacaccgtcccgcggtaacagaggagaaccgcgatgcggtgtttgaacctggcggcagcgcaaaagatg

SEQ ID NO: 127287 - DNA, 103 bp, Artificial Sequence
  Synthetic Polynucleotide
taatacgactcactatagggtgacgttctcggtgatgctgggaggacaggaacagaggagacctgtcatgccagcatcaaacctggcggcagcgcaaaagatg

SEQ ID NO: 127288 - DNA, 103 bp, Artificial Sequence
  Synthetic Polynucleotide
taatacgactcactataggggactccagggtgacgttctcggtgatgctgaacagaggagacagcatatgcgagaacgtaacctggcggcagcgcaaaagatg

SEQ ID NO: 127289 - DNA, 103 bp, Artificial Sequence
  Synthetic Polynucleotide
taatacgactcactatagggcatggtcagggactccagggtgacgttctcaacagaggagagagaacatgaccctggagaacctggcggcagcgcaaaagatg

SEQ ID NO: 127290 - DNA, 103 bp, Artificial Sequence
  Synthetic Polynucleotide
taatacgactcactatagggcatcagcgtccatggtcagggactccagggaacagaggagaccctggatgccctgaccaaacctggcggcagcgcaaaagatg

SEQ ID NO: 127291 - DNA, 103 bp, Artificial Sequence
  Synthetic Polynucleotide
taatacgactcactatagggttcaggttggcatcagcgtccatggtcaggaacagaggagacctgacatgggacgctgaaacctggcggcagcgcaaaagatg

SEQ ID NO: 127292 - DNA, 103 bp, Artificial Sequence
  Synthetic Polynucleotide
taatacgactcactatagggatcctcatcgttcaggttggcatcagcgtcaacagaggagagacgctatggccaacctgaacctggcggcagcgcaaaagatg

SEQ ID NO: 127293 - DNA, 103 bp, Artificial Sequence
  Synthetic Polynucleotide
taatacgactcactatagggccggcaggaaatcctcatcgttcaggttggaacagaggagaccaaccatgacgatgaggaacctggcggcagcgcaaaagatg

SEQ ID NO: 127294 - DNA, 103 bp, Artificial Sequence
  Synthetic Polynucleotide
taatacgactcactatagggaccacgtcgtccggcaggaaatcctcatcgaacagaggagacgatgaatgtttcctgccaacctggcggcagcgcaaaagatg

SEQ ID NO: 127295 - DNA, 103 bp, Artificial Sequence
  Synthetic Polynucleotide
taatacgactcactatagggtaaatactgcaccacgtcgtccggcaggaaaacagaggagattcctgatggacgacgtgaacctggcggcagcgcaaaagatg

SEQ ID NO: 127296 - DNA, 103 bp, Artificial Sequence
  Synthetic Polynucleotide
taatacgactcactatagggtctgggaatttaaatactgcaccacgtcgtaacagaggagaacgacgatgtgcagtattaacctggcggcagcgcaaaagatg

SEQ ID NO: 127297 - DNA, 103 bp, Artificial Sequence
  Synthetic Polynucleotide
taatacgactcactatagggtaaccattcctggggtccatggcaaacaccaacagaggagaggtgttatgcatggacccaacctggcggcagcgcaaaagatg

SEQ ID NO: 127298 - DNA, 103 bp, Artificial Sequence
  Synthetic Polynucleotide
taatacgactcactatagggcctgcttggttctgggaatttaaatactgcaacagaggagagcagtaatgaaattcccaaacctggcggcagcgcaaaagatg

SEQ ID NO: 127299 - DNA, 103 bp, Artificial Sequence
  Synthetic Polynucleotide
taatacgactcactatagggctgctcgtaccctgcttggttctgggaattaacagaggagaaattccatgaaccaagcaaacctggcggcagcgcaaaagatg

SEQ ID NO: 127300 - DNA, 103 bp, Artificial Sequence
  Synthetic Polynucleotide
taatacgactcactatagggtggggaagtgctgctcgtaccctgcttggtaacagaggagaaccaagatgggtacgagcaacctggcggcagcgcaaaagatg

SEQ ID NO: 127301 - DNA, 103 bp, Artificial Sequence
  Synthetic Polynucleotide
taatacgactcactataggggggagggcgctggggaagtgctgctcgtacaacagaggagagtacgaatggcacttcccaacctggcggcagcgcaaaagatg

SEQ ID NO: 127302 - DNA, 103 bp, Artificial Sequence
  Synthetic Polynucleotide
taatacgactcactataggggctgtcgtccgggagggcgctggggaagtgaacagaggagacacttcatgagcgccctcaacctggcggcagcgcaaaagatg

SEQ ID NO: 127303 - DNA, 103 bp, Artificial Sequence
  Synthetic Polynucleotide
taatacgactcactatagggggggcactttgctgtcgtccgggagggcgcaacagaggagagcgcccatgcggacgacaaacctggcggcagcgcaaaagatg

SEQ ID NO: 127304 - DNA, 103 bp, Artificial Sequence
  Synthetic Polynucleotide
taatacgactcactatagggccgggcccgtggggcactttgctgtcgtccaacagaggagaggacgaatgcaaagtgccaacctggcggcagcgcaaaagatg

SEQ ID NO: 127305 - DNA, 103 bp, Artificial Sequence
  Synthetic Polynucleotide
taatacgactcactataggggtcaaagtcaccgggcccgtggggcactttaacagaggagaaaagtgatgcacgggcccaacctggcggcagcgcaaaagatg

SEQ ID NO: 127306 - DNA, 103 bp, Artificial Sequence
  Synthetic Polynucleotide
taatacgactcactataggggcccgggcgcgtcaaagtcaccgggcccgtaacagaggagaacgggcatggtgactttgaacctggcggcagcgcaaaagatg

SEQ ID NO: 127307 - DNA, 103 bp, Artificial Sequence
  Synthetic Polynucleotide
taatacgactcactatagggctgtctggcagcccgggcgcgtcaaagtcaaacagaggagatgacttatgcgcgcccggaacctggcggcagcgcaaaagatg

SEQ ID NO: 127308 - DNA, 103 bp, Artificial Sequence
  Synthetic Polynucleotide
taatacgactcactataggggggctccatgtaaccattcctggggtccataacagaggagaatggacatgaggaatggtaacctggcggcagcgcaaaagatg

SEQ ID NO: 127309 - DNA, 103 bp, Artificial Sequence
  Synthetic Polynucleotide
taatacgactcactataggggccagcgtggctgtctggcagcccgggcgcaacagaggagagcgcccatgctgccagacaacctggcggcagcgcaaaagatg

SEQ ID NO: 127310 - DNA, 103 bp, Artificial Sequence
  Synthetic Polynucleotide
taatacgactcactatagggggaactgctggccagcgtggctgtctggcaaacagaggagatgccagatggccacgctgaacctggcggcagcgcaaaagatg

SEQ ID NO: 127311 - DNA, 103 bp, Artificial Sequence
  Synthetic Polynucleotide
taatacgactcactatagggtcgagggcatggaactgctggccagcgtggaacagaggagaccacgcatgccagcagttaacctggcggcagcgcaaaagatg

SEQ ID NO: 127312 - DNA, 103 bp, Artificial Sequence
  Synthetic Polynucleotide
taatacgactcactataggggcagggctgctcgagggcatggaactgctgaacagaggagacagcagatgcatgccctcaacctggcggcagcgcaaaagatg

SEQ ID NO: 127313 - DNA, 103 bp, Artificial Sequence
  Synthetic Polynucleotide
taatacgactcactatagggtgccctcggggcagggctgctcgagggcataacagaggagaatgcccatgagcagccctaacctggcggcagcgcaaaagatg

SEQ ID NO: 127314 - DNA, 103 bp, Artificial Sequence
  Synthetic Polynucleotide
taatacgactcactatagggtcggttttgctgccctcggggcagggctgcaacagaggagagcagccatgccccgagggaacctggcggcagcgcaaaagatg

SEQ ID NO: 127315 - DNA, 103 bp, Artificial Sequence
  Synthetic Polynucleotide
taatacgactcactatagggaatgggcaggtcggttttgctgccctcgggaacagaggagacccgagatgagcaaaaccaacctggcggcagcgcaaaagatg

SEQ ID NO: 127316 - DNA, 103 bp, Artificial Sequence
  Synthetic Polynucleotide
taatacgactcactatagggcgttccactgaatgggcaggtcggttttgcaacagaggagagcaaaaatgacctgcccaaacctggcggcagcgcaaaagatg

SEQ ID NO: 127317 - DNA, 103 bp, Artificial Sequence
  Synthetic Polynucleotide
taatacgactcactataggggagctgacttcgttccactgaatgggcaggaacagaggagacctgccatgtcagtggaaaacctggcggcagcgcaaaagatg

SEQ ID NO: 127318 - DNA, 103 bp, Artificial Sequence
  Synthetic Polynucleotide
taatacgactcactatagggggcgcttccggagctgacttcgttccactgaacagaggagacagtggatggaagtcagcaacctggcggcagcgcaaaagatg

SEQ ID NO: 127319 - DNA, 103 bp, Artificial Sequence
  Synthetic Polynucleotide
taatacgactcactatagggggtggtagtggggctccatgtaaccattccaacagaggagaggaatgatgacatggagcaacctggcggcagcgcaaaagatg

SEQ ID NO: 127320 - DNA, 103 bp, Artificial Sequence
  Synthetic Polynucleotide
taatacgactcactatagggaggacaggtcggcgcttccggagctgacttaacagaggagaaagtcaatgccggaagcgaacctggcggcagcgcaaaagatg

SEQ ID NO: 127321 - DNA, 103 bp, Artificial Sequence
  Synthetic Polynucleotide
taatacgactcactatagggagcttggaggaggacaggtcggcgcttccgaacagaggagacggaagatgcgacctgtcaacctggcggcagcgcaaaagatg

SEQ ID NO: 127322 - DNA, 103 bp, Artificial Sequence
  Synthetic Polynucleotide
taatacgactcactatagggcccacacttgagcttggaggaggacaggtcaacagaggagagacctgatgtcctccaagaacctggcggcagcgcaaaagatg

SEQ ID NO: 127323 - DNA, 103 bp, Artificial Sequence
  Synthetic Polynucleotide
taatacgactcactatagggcgggccgcggcccacacttgagcttggaggaacagaggagacctccaatgtcaagtgtgaacctggcggcagcgcaaaagatg

SEQ ID NO: 127324 - DNA, 103 bp, Artificial Sequence
  Synthetic Polynucleotide
taatacgactcactatagggtgcggcacagcgggccgcggcccacacttgaacagaggagacaagtgatggccgcggccaacctggcggcagcgcaaaagatg

SEQ ID NO: 127325 - DNA, 103 bp, Artificial Sequence
  Synthetic Polynucleotide
taatacgactcactatagggggcgcgagtctgcggcacagcgggccgcggaacagaggagaccgcggatggctgtgccgaacctggcggcagcgcaaaagatg

SEQ ID NO: 127326 - DNA, 103 bp, Artificial Sequence
  Synthetic Polynucleotide
taatacgactcactatagggagaacccaaaggcgcgagtctgcggcacagaacagaggagactgtgcatgagactcgcgaacctggcggcagcgcaaaagatg

SEQ ID NO: 127327 - DNA, 103 bp, Artificial Sequence
  Synthetic Polynucleotide
taatacgactcactatagggatgccgttgcagaacccaaaggcgcgagtcaacagaggagagactcgatgctttgggttaacctggcggcagcgcaaaagatg

SEQ ID NO: 127328 - DNA, 103 bp, Artificial Sequence
  Synthetic Polynucleotide
taatacgactcactataggggtggacgaccatgccgttgcagaacccaaaaacagaggagatttgggatgtgcaacggcaacctggcggcagcgcaaaagatg

SEQ ID NO: 127329 - DNA, 103 bp, Artificial Sequence
  Synthetic Polynucleotide
taatacgactcactatagggggttctgcgggtggacgaccatgccgttgcaacagaggagagcaacgatgtggtcgtccaacctggcggcagcgcaaaagatg

SEQ ID NO: 127330 - DNA, 103 bp, Artificial Sequence
  Synthetic Polynucleotide
taatacgactcactatagggagatgaggagggtggtagtggggctccatgaacagaggagacatggaatgccactaccaaacctggcggcagcgcaaaagatg

SEQ ID NO: 127331 - DNA, 103 bp, Artificial Sequence
  Synthetic Polynucleotide
taatacgactcactatagggctcctcaaggggttctgcgggtggacgaccaacagaggagaggtcgtatgcccgcagaaaacctggcggcagcgcaaaagatg

SEQ ID NO: 127332 - DNA, 103 bp, Artificial Sequence
  Synthetic Polynucleotide
taatacgactcactatagggagcaggcccgctcctcaaggggttctgcggaacagaggagaccgcagatgcccttgaggaacctggcggcagcgcaaaagatg

SEQ ID NO: 127333 - DNA, 103 bp, Artificial Sequence
  Synthetic Polynucleotide
taatacgactcactataggggatagcccccagcaggcccgctcctcaaggaacagaggagaccttgaatggcgggcctgaacctggcggcagcgcaaaagatg

SEQ ID NO: 127334 - DNA, 103 bp, Artificial Sequence
  Synthetic Polynucleotide
taatacgactcactatagggccgagggtctgatagcccccagcaggcccgaacagaggagacgggccatgtgggggctaaacctggcggcagcgcaaaagatg

SEQ ID NO: 127335 - DNA, 103 bp, Artificial Sequence
  Synthetic Polynucleotide
taatacgactcactataggggctgttctccccgagggtctgatagcccccaacagaggagagggggcatgcagaccctcaacctggcggcagcgcaaaagatg

SEQ ID NO: 127336 - DNA, 103 bp, Artificial Sequence
  Synthetic Polynucleotide
taatacgactcactatagggcgtaggggttgctgttctccccgagggtctaacagaggagaagacccatggggagaacaaacctggcggcagcgcaaaagatg

SEQ ID NO: 127337 - DNA, 103 bp, Artificial Sequence
  Synthetic Polynucleotide
taatacgactcactatagggtctgggccaccgtaggggttgctgttctccaacagaggagaggagaaatgcaacccctaaacctggcggcagcgcaaaagatg

SEQ ID NO: 127338 - DNA, 103 bp, Artificial Sequence
  Synthetic Polynucleotide
taatacgactcactatagggcatcaagtgctctgggccaccgtaggggttaacagaggagaaaccccatgggtggcccaaacctggcggcagcgcaaaagatg

SEQ ID NO: 127339 - DNA, 103 bp, Artificial Sequence
  Synthetic Polynucleotide
taatacgactcactatagggtgttgtggagcatcaagtgctctgggccacaacagaggagagtggccatgagcacttgaaacctggcggcagcgcaaaagatg

SEQ ID NO: 127340 - DNA, 103 bp, Artificial Sequence
  Synthetic Polynucleotide
taatacgactcactatagggcttccggggctgttgtggagcatcaagtgcaacagaggagagcacttatggctccacaaaacctggcggcagcgcaaaagatg

SEQ ID NO: 127341 - DNA, 103 bp, Artificial Sequence
  Synthetic Polynucleotide
taatacgactcactatagggggcagggaaaagatgaggagggtggtagtgaacagaggagacactacatgcctcctcataacctggcggcagcgcaaaagatg

SEQ ID NO: 127342 - DNA, 103 bp, Artificial Sequence
  Synthetic Polynucleotide
taatacgactcactatagggactggtgccacttccggggctgttgtggagaacagaggagactccacatgagccccggaaacctggcggcagcgcaaaagatg

SEQ ID NO: 127343 - DNA, 103 bp, Artificial Sequence
  Synthetic Polynucleotide
taatacgactcactatagggaggcgtttccactggtgccacttccggggcaacagaggagagccccgatggtggcaccaaacctggcggcagcgcaaaagatg

SEQ ID NO: 127344 - DNA, 103 bp, Artificial Sequence
  Synthetic Polynucleotide
taatacgactcactatagggtgttcatggaaggcgtttccactggtgccaaacagaggagatggcacatgtggaaacgcaacctggcggcagcgcaaaagatg

SEQ ID NO: 127345 - DNA, 103 bp, Artificial Sequence
  Synthetic Polynucleotide
taatacgactcactatagggcttacagggctgttcatggaaggcgtttccaacagaggagaggaaacatgttccatgaaaacctggcggcagcgcaaaagatg

SEQ ID NO: 127346 - DNA, 103 bp, Artificial Sequence
  Synthetic Polynucleotide
taatacgactcactatagggactgcggggccttacagggctgttcatggaaacagaggagatccatgatgagccctgtaaacctggcggcagcgcaaaagatg

SEQ ID NO: 127347 - DNA, 103 bp, Artificial Sequence
  Synthetic Polynucleotide
taatacgactcactatagggcagttcccatactgcggggccttacagggcaacagaggagagccctgatgggccccgcaaacctggcggcagcgcaaaagatg

SEQ ID NO: 127348 - DNA, 103 bp, Artificial Sequence
  Synthetic Polynucleotide
taatacgactcactatagggcctgttgagacagttcccatactgcggggcaacagaggagagccccgatgtatgggaacaacctggcggcagcgcaaaagatg

SEQ ID NO: 127349 - DNA, 103 bp, Artificial Sequence
  Synthetic Polynucleotide
taatacgactcactatagggccactggctgcctgttgagacagttcccataacagaggagaatgggaatggtctcaacaaacctggcggcagcgcaaaagatg

SEQ ID NO: 127350 - DNA, 103 bp, Artificial Sequence
  Synthetic Polynucleotide
taatacgactcactataggggcaccaggggccactggctgcctgttgagaaacagaggagatctcaaatggcagccagtaacctggcggcagcgcaaaagatg

SEQ ID NO: 127351 - DNA, 103 bp, Artificial Sequence
  Synthetic Polynucleotide
taatacgactcactatagggaccgtcgagtgcaccaggggccactggctgaacagaggagacagccaatggcccctggtaacctggcggcagcgcaaaagatg

SEQ ID NO: 127352 - DNA, 103 bp, Artificial Sequence
  Synthetic Polynucleotide
taatacgactcactataggggaggatggaaggcagggaaaagatgaggagaacagaggagactcctcatgttttccctgaacctggcggcagcgcaaaagatg

SEQ ID NO: 127353 - DNA, 103 bp, Artificial Sequence
  Synthetic Polynucleotide
taatacgactcactatagggcaccacaggcaccgtcgagtgcaccaggggaacagaggagacccctgatgcactcgacgaacctggcggcagcgcaaaagatg

SEQ ID NO: 127354 - DNA, 103 bp, Artificial Sequence
  Synthetic Polynucleotide
taatacgactcactatagggtgaatcccggcaccacaggcaccgtcgagtaacagaggagaactcgaatgtgcctgtggaacctggcggcagcgcaaaagatg

SEQ ID NO: 127355 - DNA, 103 bp, Artificial Sequence
  Synthetic Polynucleotide
taatacgactcactatagggctttgaggcttgaatcccggcaccacaggcaacagaggagagcctgtatggccgggattaacctggcggcagcgcaaaagatg

SEQ ID NO: 127356 - DNA, 103 bp, Artificial Sequence
  Synthetic Polynucleotide
taatacgactcactatagggtgctcttcagctttgaggcttgaatcccggaacagaggagaccgggaatgaagcctcaaaacctggcggcagcgcaaaagatg

SEQ ID NO: 127357 - DNA, 103 bp, Artificial Sequence
  Synthetic Polynucleotide
taatacgactcactatagggtgcatgggggtgctcttcagctttgaggctaacagaggagaagcctcatggctgaagagaacctggcggcagcgcaaaagatg

SEQ ID NO: 127358 - DNA, 103 bp, Artificial Sequence
  Synthetic Polynucleotide
taatacgactcactatagggcccgctcccttgcatgggggtgctcttcagaacagaggagactgaagatgacccccatgaacctggcggcagcgcaaaagatg

SEQ ID NO: 127359 - DNA, 103 bp, Artificial Sequence
  Synthetic Polynucleotide
taatacgactcactatagggtcagctggcccccgctcccttgcatgggggaacagaggagacccccaatgaagggagcgaacctggcggcagcgcaaaagatg

SEQ ID NO: 127360 - DNA, 103 bp, Artificial Sequence
  Synthetic Polynucleotide
taatacgactcactatagggaggccgaaattcagctggcccccgctccctaacagaggagaagggagatggggccagctaacctggcggcagcgcaaaagatg

SEQ ID NO: 127361 - DNA, 103 bp, Artificial Sequence
  Synthetic Polynucleotide
taatacgactcactatagggcgctaccggcaggccgaaattcagctggccaacagaggagaggccagatgaatttcggcaacctggcggcagcgcaaaagatg

SEQ ID NO: 127362 - DNA, 103 bp, Artificial Sequence
  Synthetic Polynucleotide
taatacgactcactatagggactcatttggcgctaccggcaggccgaaataacagaggagaatttcgatgtgccggtagaacctggcggcagcgcaaaagatg

SEQ ID NO: 127363 - DNA, 103 bp, Artificial Sequence
  Synthetic Polynucleotide
taatacgactcactatagggattggtacaggaggatggaaggcagggaaaaacagaggagatttcccatgcttccatccaacctggcggcagcgcaaaagatg

SEQ ID NO: 127364 - DNA, 103 bp, Artificial Sequence
  Synthetic Polynucleotide
taatacgactcactatagggctgccagctgactcatttggcgctaccggcaacagaggagagccggtatggccaaatgaaacctggcggcagcgcaaaagatg

SEQ ID NO: 127365 - DNA, 103 bp, Artificial Sequence
  Synthetic Polynucleotide
taatacgactcactatagggattcaccatgctgccagctgactcatttggaacagaggagaccaaatatgtcagctggcaacctggcggcagcgcaaaagatg

SEQ ID NO: 127366 - DNA, 103 bp, Artificial Sequence
  Synthetic Polynucleotide
taatacgactcactatagggtctgcatgccattcaccatgctgccagctgaacagaggagacagctgatggcatggtgaaacctggcggcagcgcaaaagatg

SEQ ID NO: 127367 - DNA, 103 bp, Artificial Sequence
  Synthetic Polynucleotide
taatacgactcactataggggggtcctggttctgcatgccattcaccatgaacagaggagacatggtatgtggcatgcaaacctggcggcagcgcaaaagatg

SEQ ID NO: 127368 - DNA, 103 bp, Artificial Sequence
  Synthetic Polynucleotide
taatacgactcactatagggctgtcccactgggtcctggttctgcatgccaacagaggagaggcatgatgaaccaggacaacctggcggcagcgcaaaagatg

SEQ ID NO: 127369 - DNA, 103 bp, Artificial Sequence
  Synthetic Polynucleotide
taatacgactcactatagggccaggtacccctgtcccactgggtcctggtaacagaggagaaccaggatgcagtgggacaacctggcggcagcgcaaaagatg

SEQ ID NO: 127370 - DNA, 103 bp, Artificial Sequence
  Synthetic Polynucleotide
taatacgactcactatagggagctggtgagccaggtacccctgtcccactaacagaggagaagtgggatgggggtacctaacctggcggcagcgcaaaagatg

SEQ ID NO: 127371 - DNA, 103 bp, Artificial Sequence
  Synthetic Polynucleotide
taatacgactcactataggggtcgccgaggagctggtgagccaggtacccaacagaggagagggtacatggctcaccagaacctggcggcagcgcaaaagatg

SEQ ID NO: 127372 - DNA, 103 bp, Artificial Sequence
  Synthetic Polynucleotide
taatacgactcactataggggctgcatgctgtcgccgaggagctggtgagaacagaggagactcaccatgtcctcggcgaacctggcggcagcgcaaaagatg

SEQ ID NO: 127373 - DNA, 103 bp, Artificial Sequence
  Synthetic Polynucleotide
taatacgactcactataggggcccccgggtgctgcatgctgtcgccgaggaacagaggagacctcggatgcagcatgcaaacctggcggcagcgcaaaagatg

SEQ ID NO: 127374 - DNA, 103 bp, Artificial Sequence
  Synthetic Polynucleotide
taatacgactcactatagggtatggaattctcaacttttttcttttcagtaacagaggagaactgaaatgaaaaaagttaacctggcggcagcgcaaaagatg

SEQ ID NO: 127375 - DNA, 103 bp, Artificial Sequence
  Synthetic Polynucleotide
taatacgactcactatagggtctggcatcaattggtacaggaggatggaaaacagaggagattccatatgcctgtaccaaacctggcggcagcgcaaaagatg

SEQ ID NO: 127376 - DNA, 103 bp, Artificial Sequence
  Synthetic Polynucleotide
taatacgactcactatagggggggcggcctgcccccgggtgctgcatgctaacagaggagaagcatgatgcacccggggaacctggcggcagcgcaaaagatg

SEQ ID NO: 127377 - DNA, 103 bp, Artificial Sequence
  Synthetic Polynucleotide
taatacgactcactatagggtctgctgaccggggcggcctgcccccgggtaacagaggagaacccggatgcaggccgccaacctggcggcagcgcaaaagatg

SEQ ID NO: 127378 - DNA, 103 bp, Artificial Sequence
  Synthetic Polynucleotide
taatacgactcactatagggtgcccaagcatctgctgaccggggcggcctaacagaggagaaggccgatgcggtcagcaaacctggcggcagcgcaaaagatg

SEQ ID NO: 127379 - DNA, 103 bp, Artificial Sequence
  Synthetic Polynucleotide
taatacgactcactatagggagcactaatctgcccaagcatctgctgaccaacagaggagaggtcagatgatgcttgggaacctggcggcagcgcaaaagatg

SEQ ID NO: 127380 - DNA, 103 bp, Artificial Sequence
  Synthetic Polynucleotide
taatacgactcactatagggtgtgtgaggtagcactaatctgcccaagcaaacagaggagatgcttgatgagattagtgaacctggcggcagcgcaaaagatg

SEQ ID NO: 127381 - DNA, 103 bp, Artificial Sequence
  Synthetic Polynucleotide
taatacgactcactatagggtagatgttgatgtgtgaggtagcactaatcaacagaggagagattagatgtacctcacaaacctggcggcagcgcaaaagatg

SEQ ID NO: 127382 - DNA, 103 bp, Artificial Sequence
  Synthetic Polynucleotide
taatacgactcactatagggtggcccttggtagatgttgatgtgtgaggtaacagaggagaacctcaatgatcaacatcaacctggcggcagcgcaaaagatg

SEQ ID NO: 127383 - DNA, 103 bp, Artificial Sequence
  Synthetic Polynucleotide
taatacgactcactatagggggcagctctctggcccttggtagatgttgaaacagaggagatcaacaatgaccaagggcaacctggcggcagcgcaaaagatg

SEQ ID NO: 127384 - DNA, 103 bp, Artificial Sequence
  Synthetic Polynucleotide
taatacgactcactataggggcccctggcaggcagctctctggcccttggaacagaggagaccaaggatgagagagctgaacctggcggcagcgcaaaagatg

SEQ ID NO: 127385 - DNA, 103 bp, Artificial Sequence
  Synthetic Polynucleotide
taatacgactcactatagggcatgccgtgagcccctggcaggcagctctcaacagaggagagagagcatgctgccagggaacctggcggcagcgcaaaagatg

SEQ ID NO: 127386 - DNA, 103 bp, Artificial Sequence
  Synthetic Polynucleotide
taatacgactcactatagggcctcatgatgtctggcatcaattggtacagaacagaggagactgtacatgttgatgccaaacctggcggcagcgcaaaagatg

SEQ ID NO: 127387 - DNA, 103 bp, Artificial Sequence
  Synthetic Polynucleotide
taatacgactcactataggggctggctgcccatgccgtgagcccctggcaaacagaggagatgccagatgctcacggcaaacctggcggcagcgcaaaagatg

SEQ ID NO: 127388 - DNA, 103 bp, Artificial Sequence
  Synthetic Polynucleotide
taatacgactcactatagggaagcttgacggctggctgcccatgccgtgaaacagaggagatcacggatggggcagccaaacctggcggcagcgcaaaagatg

SEQ ID NO: 127389 - DNA, 103 bp, Artificial Sequence
  Synthetic Polynucleotide
taatacgactcactataggggacaactgccaagcttgacggctggctgccaacagaggagaggcagcatgccgtcaagcaacctggcggcagcgcaaaagatg

SEQ ID NO: 127390 - DNA, 103 bp, Artificial Sequence
  Synthetic Polynucleotide
taatacgactcactatagggggtagcccctgacaactgccaagcttgacgaacagaggagacgtcaaatgtggcagttgaacctggcggcagcgcaaaagatg

SEQ ID NO: 127391 - DNA, 103 bp, Artificial Sequence
  Synthetic Polynucleotide
taatacgactcactataggggcacatggctggtagcccctgacaactgccaacagaggagaggcagtatgcaggggctaaacctggcggcagcgcaaaagatg

SEQ ID NO: 127392 - DNA, 103 bp, Artificial Sequence
  Synthetic Polynucleotide
taatacgactcactatagggcccaaagctggcacatggctggtagcccctaacagaggagaaggggcatgcagccatgtaacctggcggcagcgcaaaagatg

SEQ ID NO: 127393 - DNA, 103 bp, Artificial Sequence
  Synthetic Polynucleotide
taatacgactcactataggggcctgctgcccccaaagctggcacatggctaacagaggagaagccatatgccagctttgaacctggcggcagcgcaaaagatg

SEQ ID NO: 127394 - DNA, 103 bp, Artificial Sequence
  Synthetic Polynucleotide
taatacgactcactatagggatagcctggcgcctgctgcccccaaagctgaacagaggagacagcttatggggcagcagaacctggcggcagcgcaaaagatg

SEQ ID NO: 127395 - DNA, 103 bp, Artificial Sequence
  Synthetic Polynucleotide
taatacgactcactataggggtccctcggcatagcctggcgcctgctgccaacagaggagaggcagcatgcgccaggctaacctggcggcagcgcaaaagatg

SEQ ID NO: 127396 - DNA, 103 bp, Artificial Sequence
  Synthetic Polynucleotide
taatacgactcactataggggagcaaggctgtccctcggcatagcctggcaacagaggagagccaggatgtgccgagggaacctggcggcagcgcaaaagatg

SEQ ID NO: 127397 - DNA, 103 bp, Artificial Sequence
  Synthetic Polynucleotide
taatacgactcactatagggtggtaacggccctcatgatgtctggcatcaaacagaggagatgatgcatgacatcatgaaacctggcggcagcgcaaaagatg

SEQ ID NO: 127398 - DNA, 103 bp, Artificial Sequence
  Synthetic Polynucleotide
taatacgactcactatagggcctgactgcagagcaaggctgtccctcggcaacagaggagagccgagatgcagccttgcaacctggcggcagcgcaaaagatg

SEQ ID NO: 127399 - DNA, 103 bp, Artificial Sequence
  Synthetic Polynucleotide
taatacgactcactatagggactgagctgtcctgactgcagagcaaggctaacagaggagaagccttatgctgcagtcaaacctggcggcagcgcaaaagatg

SEQ ID NO: 127400 - DNA, 103 bp, Artificial Sequence
  Synthetic Polynucleotide
taatacgactcactataggggacttgtgtcactgagctgtcctgactgcaaacagaggagatgcagtatggacagctcaaacctggcggcagcgcaaaagatg

SEQ ID NO: 127401 - DNA, 103 bp, Artificial Sequence
  Synthetic Polynucleotide
taatacgactcactatagggctgcaggtctgacttgtgtcactgagctgtaacagaggagaacagctatgtgacacaagaacctggcggcagcgcaaaagatg

SEQ ID NO: 127402 - DNA, 103 bp, Artificial Sequence
  Synthetic Polynucleotide
taatacgactcactatagggaccattcaccctgcaggtctgacttgtgtcaacagaggagagacacaatgcagacctgcaacctggcggcagcgcaaaagatg

SEQ ID NO: 127403 - DNA, 103 bp, Artificial Sequence
  Synthetic Polynucleotide
taatacgactcactatagggccatcttgataccattcaccctgcaggtctaacagaggagaagacctatggggtgaatgaacctggcggcagcgcaaaagatg

SEQ ID NO: 127404 - DNA, 103 bp, Artificial Sequence
  Synthetic Polynucleotide
taatacgactcactatagggcctttcatctccatcttgataccattcaccaacagaggagaggtgaaatgtatcaagataacctggcggcagcgcaaaagatg

SEQ ID NO: 127405 - DNA, 103 bp, Artificial Sequence
  Synthetic Polynucleotide
taatacgactcactatagggatggggctgccctttcatctccatcttgataacagaggagaatcaagatggagatgaaaaacctggcggcagcgcaaaagatg

SEQ ID NO: 127406 - DNA, 103 bp, Artificial Sequence
  Synthetic Polynucleotide
taatacgactcactatagggagcacagcggatggggctgccctttcatctaacagaggagaagatgaatgggcagccccaacctggcggcagcgcaaaagatg

SEQ ID NO: 127407 - DNA, 103 bp, Artificial Sequence
  Synthetic Polynucleotide
taatacgactcactatagggtgcagattagagcacagcggatggggctgcaacagaggagagcagccatgtccgctgtgaacctggcggcagcgcaaaagatg

SEQ ID NO: 127408 - DNA, 103 bp, Artificial Sequence
  Synthetic Polynucleotide
taatacgactcactatagggtggatcgtaatggtaacggccctcatgatgaacagaggagacatcatatgggccgttacaacctggcggcagcgcaaaagatg

SEQ ID NO: 127409 - DNA, 103 bp, Artificial Sequence
  Synthetic Polynucleotide
taatacgactcactatagggagagtaattctgcagattagagcacagcggaacagaggagaccgctgatgtctaatctgaacctggcggcagcgcaaaagatg

SEQ ID NO: 127410 - DNA, 103 bp, Artificial Sequence
  Synthetic Polynucleotide
taatacgactcactatagggagaactgaccagagtaattctgcagattagaacagaggagactaatcatgagaattactaacctggcggcagcgcaaaagatg

SEQ ID NO: 127411 - DNA, 103 bp, Artificial Sequence
  Synthetic Polynucleotide
taatacgactcactataggggtttggtcatagaactgaccagagtaattcaacagaggagagaattaatgtggtcagttaacctggcggcagcgcaaaagatg

SEQ ID NO: 127412 - DNA, 103 bp, Artificial Sequence
  Synthetic Polynucleotide
taatacgactcactataggggaagcccacggtttggtcatagaactgaccaacagaggagaggtcagatgtatgaccaaaacctggcggcagcgcaaaagatg

SEQ ID NO: 127413 - DNA, 103 bp, Artificial Sequence
  Synthetic Polynucleotide
taatacgactcactatagggcttgctgactgaagcccacggtttggtcataacagaggagaatgaccatgccgtgggctaacctggcggcagcgcaaaagatg

SEQ ID NO: 127414 - DNA, 103 bp, Artificial Sequence
  Synthetic Polynucleotide
taatacgactcactataggggctttcgtgtcttgctgactgaagcccacgaacagaggagacgtgggatgcagtcagcaaacctggcggcagcgcaaaagatg

SEQ ID NO: 127415 - DNA, 103 bp, Artificial Sequence
  Synthetic Polynucleotide
taatacgactcactataggggaatgaaccagctttcgtgtcttgctgactaacagaggagaagtcagatggacacgaaaaacctggcggcagcgcaaaagatg

SEQ ID NO: 127416 - DNA, 103 bp, Artificial Sequence
  Synthetic Polynucleotide
taatacgactcactatagggctgaaatagagaatgaaccagctttcgtgtaacagaggagaacacgaatgctggttcataacctggcggcagcgcaaaagatg

SEQ ID NO: 127417 - DNA, 103 bp, Artificial Sequence
  Synthetic Polynucleotide
taatacgactcactatagggcagctggcgtctgaaatagagaatgaaccaaacagaggagatggttcatgctctatttcaacctggcggcagcgcaaaagatg

SEQ ID NO: 127418 - DNA, 103 bp, Artificial Sequence
  Synthetic Polynucleotide
taatacgactcactatagggctgtagcaggcagctggcgtctgaaatagaaacagaggagatctattatggacgccagcaacctggcggcagcgcaaaagatg

SEQ ID NO: 127419 - DNA, 103 bp, Artificial Sequence
  Synthetic Polynucleotide
taatacgactcactataggggaatcggagatggatcgtaatggtaacggcaacagaggagagccgttatgattacgatcaacctggcggcagcgcaaaagatg

SEQ ID NO: 127420 - DNA, 103 bp, Artificial Sequence
  Synthetic Polynucleotide
taatacgactcactatagggcgctggtcccctgtagcaggcagctggcgtaacagaggagaacgccaatggcctgctacaacctggcggcagcgcaaaagatg

SEQ ID NO: 127421 - DNA, 103 bp, Artificial Sequence
  Synthetic Polynucleotide
taatacgactcactataggggagtttttggcgctggtcccctgtagcaggaacagaggagacctgctatgggggaccagaacctggcggcagcgcaaaagatg

SEQ ID NO: 127422 - DNA, 103 bp, Artificial Sequence
  Synthetic Polynucleotide
taatacgactcactatagggaagtaactcagagtttttggcgctggtcccaacagaggagagggaccatggccaaaaacaacctggcggcagcgcaaaagatg

SEQ ID NO: 127423 - DNA, 103 bp, Artificial Sequence
  Synthetic Polynucleotide
taatacgactcactatagggcacctggggaaagtaactcagagtttttggaacagaggagaccaaaaatgctgagttacaacctggcggcagcgcaaaagatg

SEQ ID NO: 127424 - DNA, 103 bp, Artificial Sequence
  Synthetic Polynucleotide
taatacgactcactatagggacctgattagcacctggggaaagtaactcaaacagaggagatgagttatgttccccaggaacctggcggcagcgcaaaagatg

SEQ ID NO: 127425 - DNA, 103 bp, Artificial Sequence
  Synthetic Polynucleotide
taatacgactcactatagggtgtgcttgtcacctgattagcacctggggaaacagaggagatccccaatggctaatcagaacctggcggcagcgcaaaagatg

SEQ ID NO: 127426 - DNA, 103 bp, Artificial Sequence
  Synthetic Polynucleotide
taatacgactcactatagggggctgtccactgtgcttgtcacctgattagaacagaggagactaatcatgtgacaagcaaacctggcggcagcgcaaaagatg

SEQ ID NO: 127427 - DNA, 103 bp, Artificial Sequence
  Synthetic Polynucleotide
taatacgactcactatagggtggctgtcgaggctgtccactgtgcttgtcaacagaggagagacaagatgagtggacagaacctggcggcagcgcaaaagatg

SEQ ID NO: 127428 - DNA, 103 bp, Artificial Sequence
  Synthetic Polynucleotide
taatacgactcactatagggttccaggtcatggctgtcgaggctgtccacaacagaggagagtggacatgctcgacagcaacctggcggcagcgcaaaagatg

SEQ ID NO: 127429 - DNA, 103 bp, Artificial Sequence
  Synthetic Polynucleotide
taatacgactcactatagggtctgtaccccttccaggtcatggctgtcgaaacagaggagatcgacaatgatgacctggaacctggcggcagcgcaaaagatg

SEQ ID NO: 127430 - DNA, 103 bp, Artificial Sequence
  Synthetic Polynucleotide
taatacgactcactatagggtgcaatggaggaatcggagatggatcgtaaaacagaggagattacgaatgatctccgataacctggcggcagcgcaaaagatg

SEQ ID NO: 127431 - DNA, 103 bp, Artificial Sequence
  Synthetic Polynucleotide
taatacgactcactatagggtcgaagtcaatctgtaccccttccaggtcaaacagaggagatgacctatgaggggtacaaacctggcggcagcgcaaaagatg

SEQ ID NO: 127432 - DNA, 103 bp, Artificial Sequence
  Synthetic Polynucleotide
taatacgactcactatagggtatgatggcatcgaagtcaatctgtaccccaacagaggagaggggtaatgattgacttcaacctggcggcagcgcaaaagatg

SEQ ID NO: 127433 - DNA, 103 bp, Artificial Sequence
  Synthetic Polynucleotide
taatacgactcactatagggccccatcgtctatgatggcatcgaagtcaaaacagaggagattgactatgatgccatcaaacctggcggcagcgcaaaagatg

SEQ ID NO: 127434 - DNA, 103 bp, Artificial Sequence
  Synthetic Polynucleotide
taatacgactcactatagggctggagtggtccccatcgtctatgatggcaaacagaggagatgccatatgagacgatggaacctggcggcagcgcaaaagatg

SEQ ID NO: 127435 - DNA, 103 bp, Artificial Sequence
  Synthetic Polynucleotide
taatacgactcactatagggcgacatcaggctggagtggtccccatcgtcaacagaggagagacgatatggaccactccaacctggcggcagcgcaaaagatg

SEQ ID NO: 127436 - DNA, 103 bp, Artificial Sequence
  Synthetic Polynucleotide
taatacgactcactatagggtcagggcccccgacatcaggctggagtggtaacagaggagaaccactatggcctgatgtaacctggcggcagcgcaaaagatg

SEQ ID NO: 127437 - DNA, 103 bp, Artificial Sequence
  Synthetic Polynucleotide
taatacgactcactatagggatacttgggctcagggcccccgacatcaggaacagaggagacctgatatggggggccctaacctggcggcagcgcaaaagatg

SEQ ID NO: 127438 - DNA, 103 bp, Artificial Sequence
  Synthetic Polynucleotide
taatacgactcactataggggttctgaatgatacttgggctcagggccccaacagaggagaggggccatgagcccaagtaacctggcggcagcgcaaaagatg

SEQ ID NO: 127439 - DNA, 103 bp, Artificial Sequence
  Synthetic Polynucleotide
taatacgactcactatagggtatgggaaaggttctgaatgatacttgggcaacagaggagagcccaaatgtcattcagaaacctggcggcagcgcaaaagatg

SEQ ID NO: 127440 - DNA, 103 bp, Artificial Sequence
  Synthetic Polynucleotide
taatacgactcactatagggcgggaggagctatgggaaaggttctgaatgaacagaggagacattcaatgcctttcccaaacctggcggcagcgcaaaagatg

SEQ ID NO: 127441 - DNA, 103 bp, Artificial Sequence
  Synthetic Polynucleotide
taatacgactcactatagggggaagtcatatgcaatggaggaatcggagaaacagaggagatctccgatgcctccattgaacctggcggcagcgcaaaagatg

SEQ ID NO: 127442 - DNA, 103 bp, Artificial Sequence
  Synthetic Polynucleotide
taatacgactcactatagggcgtggtgaggcgggaggagctatgggaaagaacagaggagactttccatgagctcctccaacctggcggcagcgcaaaagatg

SEQ ID NO: 127443 - DNA, 103 bp, Artificial Sequence
  Synthetic Polynucleotide
taatacgactcactatagggacgcccgaggcgtggtgaggcgggaggagcaacagaggagagctcctatggcctcaccaaacctggcggcagcgcaaaagatg

SEQ ID NO: 127444 - DNA, 103 bp, Artificial Sequence
  Synthetic Polynucleotide
taatacgactcactatagggaatgggagggacgcccgaggcgtggtgaggaacagaggagacctcacatggcctcgggcaacctggcggcagcgcaaaagatg

SEQ ID NO: 127445 - DNA, 103 bp, Artificial Sequence
  Synthetic Polynucleotide
taatacgactcactatagggcagcgctgggaatgggagggacgcccgaggaacagaggagacctcggatgtccctcccaaacctggcggcagcgcaaaagatg

SEQ ID NO: 127446 - DNA, 103 bp, Artificial Sequence
  Synthetic Polynucleotide
taatacgactcactatagggtgctcatggacagcgctgggaatgggagggaacagaggagaccctccatgtcccagcgcaacctggcggcagcgcaaaagatg

SEQ ID NO: 127447 - DNA, 103 bp, Artificial Sequence
  Synthetic Polynucleotide
taatacgactcactatagggatgttggtggtgctcatggacagcgctgggaacagaggagacccagcatggtccatgagaacctggcggcagcgcaaaagatg

SEQ ID NO: 127448 - DNA, 103 bp, Artificial Sequence
  Synthetic Polynucleotide
taatacgactcactatagggcccgatagccatgttggtggtgctcatggaaacagaggagatccatgatgaccaccaacaacctggcggcagcgcaaaagatg

SEQ ID NO: 127449 - DNA, 103 bp, Artificial Sequence
  Synthetic Polynucleotide
taatacgactcactatagggaactcatgtccccgatagccatgttggtggaacagaggagaccaccaatgtggctatcgaacctggcggcagcgcaaaagatg

SEQ ID NO: 127450 - DNA, 103 bp, Artificial Sequence
  Synthetic Polynucleotide
taatacgactcactataggggtcagcaaagaactcatgtccccgatagccaacagaggagaggctatatgggacatgagaacctggcggcagcgcaaaagatg

SEQ ID NO: 127451 - DNA, 103 bp, Artificial Sequence
  Synthetic Polynucleotide
taatacgactcactatagggcgctagggaggtcagcaaagaactcatgtcaacagaggagagacatgatgtctttgctgaacctggcggcagcgcaaaagatg

SEQ ID NO: 127452 - DNA, 103 bp, Artificial Sequence
  Synthetic Polynucleotide
taatacgactcactatagggtagataaggcggaagtcatatgcaatggagaacagaggagactccatatgatatgacttaacctggcggcagcgcaaaagatg

SEQ ID NO: 127453 - DNA, 103 bp, Artificial Sequence
  Synthetic Polynucleotide
taatacgactcactatagggtgctttcttccgctagggaggtcagcaaagaacagaggagactttgcatgcctccctagaacctggcggcagcgcaaaagatg

SEQ ID NO: 127454 - DNA, 103 bp, Artificial Sequence
  Synthetic Polynucleotide
taatacgactcactataggggcaaggaatttgctttcttccgctagggagaacagaggagactccctatgggaagaaagaacctggcggcagcgcaaaagatg

SEQ ID NO: 127455 - DNA, 103 bp, Artificial Sequence
  Synthetic Polynucleotide
taatacgactcactatagggttgcataactgcaaggaatttgctttcttcaacagaggagagaagaaatgaaattccttaacctggcggcagcgcaaaagatg

SEQ ID NO: 127456 - DNA, 103 bp, Artificial Sequence
  Synthetic Polynucleotide
taatacgactcactataggggtagggctactagataaggcggaagtcataaacagaggagatatgacatgcgccttatcaacctggcggcagcgcaaaagatg

SEQ ID NO: 127457 - DNA, 103 bp, Artificial Sequence
  Synthetic Polynucleotide
taatacgactcactataggggtccggatacgtagggctactagataaggcaacagaggagagccttaatgagtagccctaacctggcggcagcgcaaaagatg

SEQ ID NO: 127458 - DNA, 103 bp, Artificial Sequence
  Synthetic Polynucleotide
taatacgactcactatagggagcacttcactatggaattctcaactttttaacagaggagaaaaaagatgagaattccaaacctggcggcagcgcaaaagatg

SEQ ID NO: 127459 - DNA, 103 bp, Artificial Sequence
  Synthetic Polynucleotide
taatacgactcactatagggtgaagggcaggtccggatacgtagggctacaacagaggagagtagccatgcgtatccggaacctggcggcagcgcaaaagatg

SEQ ID NO: 127460 - DNA, 103 bp, Artificial Sequence
  Synthetic Polynucleotide
taatacgactcactataggggagatcctaatgaagggcaggtccggatacaacagaggagagtatccatgcctgcccttaacctggcggcagcgcaaaagatg

SEQ ID NO: 127461 - DNA, 103 bp, Artificial Sequence
  Synthetic Polynucleotide
taatacgactcactatagggccggtgtggggagatcctaatgaagggcagaacagaggagactgcccatgattaggatcaacctggcggcagcgcaaaagatg

SEQ ID NO: 127462 - DNA, 103 bp, Artificial Sequence
  Synthetic Polynucleotide
taatacgactcactatagggcagtggggttccggtgtggggagatcctaaaacagaggagattaggaatgccccacaccaacctggcggcagcgcaaaagatg

SEQ ID NO: 127463 - DNA, 103 bp, Artificial Sequence
  Synthetic Polynucleotide
taatacgactcactatagggtcggaagcagcagtggggttccggtgtgggaacagaggagacccacaatggaaccccacaacctggcggcagcgcaaaagatg

SEQ ID NO: 127464 - DNA, 103 bp, Artificial Sequence
  Synthetic Polynucleotide
taatacgactcactataggggaagggagactcggaagcagcagtggggttaacagaggagaaaccccatggctgcttccaacctggcggcagcgcaaaagatg

SEQ ID NO: 127465 - DNA, 103 bp, Artificial Sequence
  Synthetic Polynucleotide
taatacgactcactataggggtggagggctgaagggagactcggaagcagaacagaggagactgcttatgagtctccctaacctggcggcagcgcaaaagatg

SEQ ID NO: 127466 - DNA, 103 bp, Artificial Sequence
  Synthetic Polynucleotide
taatacgactcactatagggatgtagggatgtggagggctgaagggagacaacagaggagagtctccatgcagccctccaacctggcggcagcgcaaaagatg

SEQ ID NO: 127467 - DNA, 103 bp, Artificial Sequence
  Synthetic Polynucleotide
taatacgactcactataggggtagggattaatgtagggatgtggagggctaacagaggagaagccctatgcatccctacaacctggcggcagcgcaaaagatg

SEQ ID NO: 127468 - DNA, 103 bp, Artificial Sequence
  Synthetic Polynucleotide
taatacgactcactatagggtatagtccatgtagggattaatgtagggataacagaggagaatccctatgttaatccctaacctggcggcagcgcaaaagatg

SEQ ID NO: 127469 - DNA, 103 bp, Artificial Sequence
  Synthetic Polynucleotide
taatacgactcactataggggttcgagtggagcacttcactatggaattcaacagaggagagaattcatgagtgaagtgaacctggcggcagcgcaaaagatg

SEQ ID NO: 127470 - DNA, 103 bp, Artificial Sequence
  Synthetic Polynucleotide
taatacgactcactatagggaaggagcggatatagtccatgtagggattaaacagaggagataatccatgcatggactaaacctggcggcagcgcaaaagatg

SEQ ID NO: 127471 - DNA, 103 bp, Artificial Sequence
  Synthetic Polynucleotide
taatacgactcactataggggctgctgtgcaaggagcggatatagtccataacagaggagaatggacatgatccgctccaacctggcggcagcgcaaaagatg

SEQ ID NO: 127472 - DNA, 103 bp, Artificial Sequence
  Synthetic Polynucleotide
taatacgactcactatagggagagcgatgggctgctgtgcaaggagcggaaacagaggagatccgctatgtgcacagcaaacctggcggcagcgcaaaagatg

SEQ ID NO: 127473 - DNA, 103 bp, Artificial Sequence
  Synthetic Polynucleotide
taatacgactcactataggggagatcatggagagcgatgggctgctgtgcaacagaggagagcacagatgcccatcgctaacctggcggcagcgcaaaagatg

SEQ ID NO: 127474 - DNA, 103 bp, Artificial Sequence
  Synthetic Polynucleotide
taatacgactcactatagggacgggttgctgagatcatggagagcgatggaacagaggagaccatcgatgtccatgatcaacctggcggcagcgcaaaagatg

SEQ ID NO: 127475 - DNA, 103 bp, Artificial Sequence
  Synthetic Polynucleotide
taatacgactcactatagggggctcagcccacgggttgctgagatcatggaacagaggagaccatgaatgcagcaacccaacctggcggcagcgcaaaagatg

SEQ ID NO: 127476 - DNA, 103 bp, Artificial Sequence
  Synthetic Polynucleotide
taatacgactcactataggggcatctgtagggctcagcccacgggttgctaacagaggagaagcaacatgtgggctgagaacctggcggcagcgcaaaagatg

SEQ ID NO: 127477 - DNA, 103 bp, Artificial Sequence
  Synthetic Polynucleotide
taatacgactcactatagggtgcatggggcgcatctgtagggctcagcccaacagaggagagggctgatgcctacagataacctggcggcagcgcaaaagatg

SEQ ID NO: 127478 - DNA, 103 bp, Artificial Sequence
  Synthetic Polynucleotide
taatacgactcactatagggggctgactcctgcatggggcgcatctgtagaacagaggagactacagatgcgccccatgaacctggcggcagcgcaaaagatg

SEQ ID NO: 127479 - DNA, 103 bp, Artificial Sequence
  Synthetic Polynucleotide
taatacgactcactatagggtattctgctgggctgactcctgcatggggcaacagaggagagccccaatgaggagtcagaacctggcggcagcgcaaaagatg

SEQ ID NO: 127480 - DNA, 103 bp, Artificial Sequence
  Synthetic Polynucleotide
taatacgactcactataggggctcacatctgttcgagtggagcacttcacaacagaggagagtgaagatgtccactcgaaacctggcggcagcgcaaaagatg

SEQ ID NO: 127481 - DNA, 103 bp, Artificial Sequence
  Synthetic Polynucleotide
taatacgactcactatagggctgatgatagtattctgctgggctgactccaacagaggagaggagtcatgccagcagaaaacctggcggcagcgcaaaagatg

SEQ ID NO: 127482 - DNA, 103 bp, Artificial Sequence
  Synthetic Polynucleotide
taatacgactcactataggggcagggccatctgatgatagtattctgctgaacagaggagacagcagatgactatcatcaacctggcggcagcgcaaaagatg

SEQ ID NO: 127483 - DNA, 103 bp, Artificial Sequence
  Synthetic Polynucleotide
taatacgactcactatagggtggccagttagcagggccatctgatgatagaacagaggagactatcaatggatggccctaacctggcggcagcgcaaaagatg

SEQ ID NO: 127484 - DNA, 103 bp, Artificial Sequence
  Synthetic Polynucleotide
taatacgactcactatagggggggctgcgctggccagttagcagggccataacagaggagaatggccatgctaactggcaacctggcggcagcgcaaaagatg

SEQ ID NO: 127485 - DNA, 103 bp, Artificial Sequence
  Synthetic Polynucleotide
taatacgactcactatagggtgtctgcataggggctgcgctggccagttaaacagaggagataactgatgagcgcagccaacctggcggcagcgcaaaagatg

SEQ ID NO: 127486 - DNA, 103 bp, Artificial Sequence
  Synthetic Polynucleotide
taatacgactcactataggggagggaataatgtctgcataggggctgcgcaacagaggagagcgcagatgctatgcagaaacctggcggcagcgcaaaagatg

SEQ ID NO: 127487 - DNA, 103 bp, Artificial Sequence
  Synthetic Polynucleotide
taatacgactcactatagggggtggcagctgagggaataatgtctgcataaacagaggagatatgcaatgattattcccaacctggcggcagcgcaaaagatg

SEQ ID NO: 127488 - DNA, 103 bp, Artificial Sequence
  Synthetic Polynucleotide
taatacgactcactatagggccgtgccggcggtggcagctgagggaataaaacagaggagattattcatgcagctgccaaacctggcggcagcgcaaaagatg

SEQ ID NO: 127489 - DNA, 103 bp, Artificial Sequence
  Synthetic Polynucleotide
taatacgactcactatagggtggatggcccccgtgccggcggtggcagctaacagaggagaagctgcatgcgccggcacaacctggcggcagcgcaaaagatg

SEQ ID NO: 127490 - DNA, 103 bp, Artificial Sequence
  Synthetic Polynucleotide
taatacgactcactatagggatattccatgtggatggcccccgtgccggcaacagaggagagccggcatgggggccatcaacctggcggcagcgcaaaagatg

SEQ ID NO: 127491 - DNA, 103 bp, Artificial Sequence
  Synthetic Polynucleotide
taatacgactcactatagggcggctttctcgctcacatctgttcgagtggaacagaggagaccactcatgcagatgtgaaacctggcggcagcgcaaaagatg

SEQ ID NO: 127492 - DNA, 103 bp, Artificial Sequence
  Synthetic Polynucleotide
taatacgactcactatagggtagcatgaagatattccatgtggatggcccaacagaggagagggccaatgacatggaataacctggcggcagcgcaaaagatg

SEQ ID NO: 127493 - DNA, 103 bp, Artificial Sequence
  Synthetic Polynucleotide
taatacgactcactataggggtgctatccatagcatgaagatattccatgaacagaggagacatggaatgtcttcatgcaacctggcggcagcgcaaaagatg

SEQ ID NO: 127494 - DNA, 103 bp, Artificial Sequence
  Synthetic Polynucleotide
taatacgactcactatagggggagaatctggtgctatccatagcatgaagaacagaggagacttcatatgatggatagcaacctggcggcagcgcaaaagatg

SEQ ID NO: 127495 - DNA, 103 bp, Artificial Sequence
  Synthetic Polynucleotide
taatacgactcactataggggcctggggctggagaatctggtgctatccaaacagaggagatggataatgccagattctaacctggcggcagcgcaaaagatg

SEQ ID NO: 127496 - DNA, 103 bp, Artificial Sequence
  Synthetic Polynucleotide
taatacgactcactatagggctggctgacagcctggggctggagaatctgaacagaggagacagattatgcagccccagaacctggcggcagcgcaaaagatg

SEQ ID NO: 127497 - DNA, 103 bp, Artificial Sequence
  Synthetic Polynucleotide
taatacgactcactatagggtcggctcggcctggctgacagcctggggctaacagaggagaagccccatgctgtcagccaacctggcggcagcgcaaaagatg

SEQ ID NO: 127498 - DNA, 103 bp, Artificial Sequence
  Synthetic Polynucleotide
taatacgactcactataggggtgtacgttttcggctcggcctggctgacaaacagaggagatgtcagatgggccgagccaacctggcggcagcgcaaaagatg

SEQ ID NO: 127499 - DNA, 103 bp, Artificial Sequence
  Synthetic Polynucleotide
taatacgactcactataggggatatggacagtgtacgttttcggctcggcaacagaggagagccgagatgaaaacgtacaacctggcggcagcgcaaaagatg

SEQ ID NO: 127500 - DNA, 103 bp, Artificial Sequence
  Synthetic Polynucleotide
taatacgactcactatagggggagagtggtgatatggacagtgtacgtttaacagaggagaaaacgtatgctgtccataaacctggcggcagcgcaaaagatg

SEQ ID NO: 127501 - DNA, 103 bp, Artificial Sequence
  Synthetic Polynucleotide
taatacgactcactatagggagctatgatcggagagtggtgatatggacaaacagaggagatgtccaatgcaccactctaacctggcggcagcgcaaaagatg

SEQ ID NO: 127502 - DNA, 103 bp, Artificial Sequence
  Synthetic Polynucleotide
taatacgactcactatagggctggaggcaacggctttctcgctcacatctaacagaggagaagatgtatgcgagaaagcaacctggcggcagcgcaaaagatg

SEQ ID NO: 127503 - DNA, 103 bp, Artificial Sequence
  Synthetic Polynucleotide
taatacgactcactatagggtgaaggtcaaagctatgatcggagagtggtaacagaggagaaccactatgcgatcatagaacctggcggcagcgcaaaagatg

SEQ ID NO: 127504 - DNA, 103 bp, Artificial Sequence
  Synthetic Polynucleotide
taatacgactcactatagggtatcatggtctgaaggtcaaagctatgatcaacagaggagagatcatatgtttgaccttaacctggcggcagcgcaaaagatg

SEQ ID NO: 127505 - DNA, 103 bp, Artificial Sequence
  Synthetic Polynucleotide
taatacgactcactataggggagacgtccttatcatggtctgaaggtcaaaacagaggagattgaccatgagaccatgaaacctggcggcagcgcaaaagatg

SEQ ID NO: 127506 - DNA, 103 bp, Artificial Sequence
  Synthetic Polynucleotide
taatacgactcactatagggaaggagttgggagacgtccttatcatggtcaacagaggagagaccatatgaaggacgtcaacctggcggcagcgcaaaagatg

SEQ ID NO: 127507 - DNA, 103 bp, Artificial Sequence
  Synthetic Polynucleotide
taatacgactcactatagggaatcgtgaccaaggagttgggagacgtcctaacagaggagaaggacgatgcccaactccaacctggcggcagcgcaaaagatg

SEQ ID NO: 127508 - DNA, 103 bp, Artificial Sequence
  Synthetic Polynucleotide
taatacgactcactatagggaattattgagaatcgtgaccaaggagttggaacagaggagaccaactatgtggtcacgaaacctggcggcagcgcaaaagatg

SEQ ID NO: 127509 - DNA, 103 bp, Artificial Sequence
  Synthetic Polynucleotide
taatacgactcactatagggctgctacgggaattattgagaatcgtgaccaacagaggagaggtcacatgtctcaataaaacctggcggcagcgcaaaagatg

SEQ ID NO: 127510 - DNA, 103 bp, Artificial Sequence
  Synthetic Polynucleotide
taatacgactcactatagggtgctgaagagctgctacgggaattattgagaacagaggagactcaatatgtcccgtagcaacctggcggcagcgcaaaagatg

SEQ ID NO: 127511 - DNA, 103 bp, Artificial Sequence
  Synthetic Polynucleotide
taatacgactcactatagggaggagccacttgctgaagagctgctacgggaacagaggagacccgtaatggctcttcagaacctggcggcagcgcaaaagatg

SEQ ID NO: 127512 - DNA, 103 bp, Artificial Sequence
  Synthetic Polynucleotide
taatacgactcactatagggaagtgaccataggagccacttgctgaagagaacagaggagactcttcatgaagtggctcaacctggcggcagcgcaaaagatg

SEQ ID NO: 127513 - DNA, 103 bp, Artificial Sequence
  Synthetic Polynucleotide
taatacgactcactatagggggcagacagggatgtgcgggcctctgccataacagaggagaatggcaatggcccgcacaaacctggcggcagcgcaaaagatg

SEQ ID NO: 127514 - DNA, 103 bp, Artificial Sequence
  Synthetic Polynucleotide
taatacgactcactatagggaaggtagcaggaaggcgcaggggtggcgagaacagaggagactcgccatgcctgcgcctaacctggcggcagcgcaaaagatg

SEQ ID NO: 127515 - DNA, 103 bp, Artificial Sequence
  Synthetic Polynucleotide
taatacgactcactataggggcggagggagctggggtctgtgtagcgcttaacagaggagaaagcgcatgacagaccccaacctggcggcagcgcaaaagatg

SEQ ID NO: 127516 - DNA, 103 bp, Artificial Sequence
  Synthetic Polynucleotide
taatacgactcactatagggtgacgtgcttgcggagggagctggggtctgaacagaggagacagaccatggctccctccaacctggcggcagcgcaaaagatg

SEQ ID NO: 127517 - DNA, 103 bp, Artificial Sequence
  Synthetic Polynucleotide
taatacgactcactataggggaatgggccttgacgtgcttgcggagggagaacagaggagactccctatgcaagcacgtaacctggcggcagcgcaaaagatg

SEQ ID NO: 127518 - DNA, 103 bp, Artificial Sequence
  Synthetic Polynucleotide
taatacgactcactatagggctctttggctgaatgggccttgacgtgcttaacagaggagaaagcacatgaaggcccataacctggcggcagcgcaaaagatg

SEQ ID NO: 127519 - DNA, 103 bp, Artificial Sequence
  Synthetic Polynucleotide
taatacgactcactataggggcacctgctgctctttggctgaatgggcctaacagaggagaaggcccatgcagccaaagaacctggcggcagcgcaaaagatg

SEQ ID NO: 127520 - DNA, 103 bp, Artificial Sequence
  Synthetic Polynucleotide
taatacgactcactatagggagcttcttacgcacctgctgctctttggctaacagaggagaagccaaatggcagcaggtaacctggcggcagcgcaaaagatg

SEQ ID NO: 127521 - DNA, 103 bp, Artificial Sequence
  Synthetic Polynucleotide
taatacgactcactataggggcccgcatgcagcttcttacgcacctgctgaacagaggagacagcagatgcgtaagaagaacctggcggcagcgcaaaagatg

SEQ ID NO: 127522 - DNA, 103 bp, Artificial Sequence
  Synthetic Polynucleotide
taatacgactcactatagggcggtgtcagggcccgcatgcagcttcttacaacagaggagagtaagaatgtgcatgcggaacctggcggcagcgcaaaagatg

SEQ ID NO: 127523 - DNA, 103 bp, Artificial Sequence
  Synthetic Polynucleotide
taatacgactcactatagggacgtcggcctcggtgtcagggcccgcatgcaacagaggagagcatgcatgccctgacacaacctggcggcagcgcaaaagatg

SEQ ID NO: 127524 - DNA, 103 bp, Artificial Sequence
  Synthetic Polynucleotide
taatacgactcactatagggctcggtcaggacgtcggcctcggtgtcaggaacagaggagacctgacatggaggccgacaacctggcggcagcgcaaaagatg

SEQ ID NO: 127525 - DNA, 103 bp, Artificial Sequence
  Synthetic Polynucleotide
taatacgactcactatagggcgctgcccagaaggtagcaggaaggcgcagaacagaggagactgcgcatgcctgctaccaacctggcggcagcgcaaaagatg

SEQ ID NO: 127526 - DNA, 103 bp, Artificial Sequence
  Synthetic Polynucleotide
taatacgactcactatagggggaccagacactcggtcaggacgtcggcctaacagaggagaaggccgatgtcctgaccgaacctggcggcagcgcaaaagatg

SEQ ID NO: 127527 - DNA, 103 bp, Artificial Sequence
  Synthetic Polynucleotide
taatacgactcactatagggagctgctgcaggaccagacactcggtcaggaacagaggagacctgacatggtgtctggtaacctggcggcagcgcaaaagatg

SEQ ID NO: 127528 - DNA, 103 bp, Artificial Sequence
  Synthetic Polynucleotide
taatacgactcactatagggggacgtgtggagctgctgcaggaccagacaaacagaggagatgtctgatgctgcagcagaacctggcggcagcgcaaaagatg

SEQ ID NO: 127529 - DNA, 103 bp, Artificial Sequence
  Synthetic Polynucleotide
taatacgactcactatagggccagctgtgtggacgtgtggagctgctgcaaacagaggagatgcagcatgtccacacgtaacctggcggcagcgcaaaagatg

SEQ ID NO: 127530 - DNA, 103 bp, Artificial Sequence
  Synthetic Polynucleotide
taatacgactcactatagggtcgctggcagccagctgtgtggacgtgtggaacagaggagaccacacatgcacacagctaacctggcggcagcgcaaaagatg

SEQ ID NO: 127531 - DNA, 103 bp, Artificial Sequence
  Synthetic Polynucleotide
taatacgactcactatagggacccttgccgtcgctggcagccagctgtgtaacagaggagaacacagatggctgccagcaacctggcggcagcgcaaaagatg

SEQ ID NO: 127532 - DNA, 103 bp, Artificial Sequence
  Synthetic Polynucleotide
taatacgactcactatagggggccacagccacccttgccgtcgctggcagaacagaggagactgccaatgacggcaaggaacctggcggcagcgcaaaagatg

SEQ ID NO: 127533 - DNA, 103 bp, Artificial Sequence
  Synthetic Polynucleotide
taatacgactcactatagggtcctggcccaggccacagccacccttgccgaacagaggagacggcaaatgtggctgtggaacctggcggcagcgcaaaagatg

SEQ ID NO: 127534 - DNA, 103 bp, Artificial Sequence
  Synthetic Polynucleotide
taatacgactcactatagggtgggagcagctcctggcccaggccacagccaacagaggagaggctgtatgctgggccagaacctggcggcagcgcaaaagatg

SEQ ID NO: 127535 - DNA, 103 bp, Artificial Sequence
  Synthetic Polynucleotide
taatacgactcactataggggatacacacctgggagcagctcctggcccaaacagaggagatgggccatgagctgctccaacctggcggcagcgcaaaagatg

SEQ ID NO: 127536 - DNA, 103 bp, Artificial Sequence
  Synthetic Polynucleotide
taatacgactcactataggggagctgggttcgctgcccagaaggtagcagaacagaggagactgctaatgtctgggcagaacctggcggcagcgcaaaagatg

SEQ ID NO: 127537 - DNA, 103 bp, Artificial Sequence
  Synthetic Polynucleotide
taatacgactcactatagggatggagccaggatacacacctgggagcagcaacagaggagagctgctatgaggtgtgtaaacctggcggcagcgcaaaagatg

SEQ ID NO: 127538 - DNA, 103 bp, Artificial Sequence
  Synthetic Polynucleotide
taatacgactcactatagggatggggggtgatggagccaggatacacaccaacagaggagaggtgtgatgcctggctccaacctggcggcagcgcaaaagatg

SEQ ID NO: 127539 - DNA, 103 bp, Artificial Sequence
  Synthetic Polynucleotide
taatacgactcactatagggcaagtccgttatggggggtgatggagccagaacagaggagactggctatgtcaccccccaacctggcggcagcgcaaaagatg

SEQ ID NO: 127540 - DNA, 103 bp, Artificial Sequence
  Synthetic Polynucleotide
taatacgactcactatagggaggcccgatgcaagtccgttatggggggtgaacagaggagacaccccatgtaacggactaacctggcggcagcgcaaaagatg

SEQ ID NO: 127541 - DNA, 103 bp, Artificial Sequence
  Synthetic Polynucleotide
taatacgactcactatagggtgggggcaggaggcccgatgcaagtccgttaacagaggagaaacggaatggcatcgggcaacctggcggcagcgcaaaagatg

SEQ ID NO: 127542 - DNA, 103 bp, Artificial Sequence
  Synthetic Polynucleotide
taatacgactcactatagggcgtcgtgcgctgggggcaggaggcccgatgaacagaggagacatcggatgtcctgccccaacctggcggcagcgcaaaagatg

SEQ ID NO: 127543 - DNA, 103 bp, Artificial Sequence
  Synthetic Polynucleotide
taatacgactcactatagggctggaaggtacgtcgtgcgctgggggcaggaacagaggagacctgccatgagcgcacgaaacctggcggcagcgcaaaagatg

SEQ ID NO: 127544 - DNA, 103 bp, Artificial Sequence
  Synthetic Polynucleotide
taatacgactcactatagggcgggtggtgcctggaaggtacgtcgtgcgcaacagaggagagcgcacatggtaccttccaacctggcggcagcgcaaaagatg

SEQ ID NO: 127545 - DNA, 103 bp, Artificial Sequence
  Synthetic Polynucleotide
taatacgactcactatagggtggcatccagcgggtggtgcctggaaggtaaacagaggagataccttatgggcaccaccaacctggcggcagcgcaaaagatg

SEQ ID NO: 127546 - DNA, 103 bp, Artificial Sequence
  Synthetic Polynucleotide
taatacgactcactataggggaactggtggtggcatccagcgggtggtgcaacagaggagagcaccaatggctggatgcaacctggcggcagcgcaaaagatg

SEQ ID NO: 127547 - DNA, 103 bp, Artificial Sequence
  Synthetic Polynucleotide
taatacgactcactataggggcccaggccagagctgggttcgctgcccagaacagaggagactgggcatggaacccagcaacctggcggcagcgcaaaagatg

SEQ ID NO: 127548 - DNA, 103 bp, Artificial Sequence
  Synthetic Polynucleotide
taatacgactcactatagggatggtggtgggaactggtggtggcatccagaacagaggagactggatatgaccaccagtaacctggcggcagcgcaaaagatg

SEQ ID NO: 127549 - DNA, 103 bp, Artificial Sequence
  Synthetic Polynucleotide
taatacgactcactataggggaggggacagatggtggtgggaactggtggaacagaggagaccaccaatgcccaccaccaacctggcggcagcgcaaaagatg

SEQ ID NO: 127550 - DNA, 103 bp, Artificial Sequence
  Synthetic Polynucleotide
taatacgactcactataggggccatgggcagaggggacagatggtggtggaacagaggagaccaccaatgtctgtccccaacctggcggcagcgcaaaagatg

SEQ ID NO: 127551 - DNA, 103 bp, Artificial Sequence
  Synthetic Polynucleotide
taatacgactcactatagggggtgctctcagccatgggcagaggggacagaacagaggagactgtccatgctgcccatgaacctggcggcagcgcaaaagatg

SEQ ID NO: 127552 - DNA, 103 bp, Artificial Sequence
  Synthetic Polynucleotide
taatacgactcactatagggacccatcccgggtgctctcagccatgggcaaacagaggagatgcccaatgctgagagcaaacctggcggcagcgcaaaagatg

SEQ ID NO: 127553 - DNA, 103 bp, Artificial Sequence
  Synthetic Polynucleotide
taatacgactcactatagggccgggccccaacccatcccgggtgctctcaaacagaggagatgagagatgccgggatggaacctggcggcagcgcaaaagatg

SEQ ID NO: 127554 - DNA, 103 bp, Artificial Sequence
  Synthetic Polynucleotide
taatacgactcactatagggtgagaggaggccgggccccaacccatcccgaacagaggagacgggatatgttggggcccaacctggcggcagcgcaaaagatg

SEQ ID NO: 127555 - DNA, 103 bp, Artificial Sequence
  Synthetic Polynucleotide
taatacgactcactatagggtgactattggtgagaggaggccgggccccaaacagaggagatggggcatggcctcctctaacctggcggcagcgcaaaagatg

SEQ ID NO: 127556 - DNA, 103 bp, Artificial Sequence
  Synthetic Polynucleotide
taatacgactcactatagggttcagggggctgactattggtgagaggaggaacagaggagacctcctatgaccaatagtaacctggcggcagcgcaaaagatg

SEQ ID NO: 127557 - DNA, 103 bp, Artificial Sequence
  Synthetic Polynucleotide
taatacgactcactatagggccccagccccttcagggggctgactattggaacagaggagaccaataatgagccccctgaacctggcggcagcgcaaaagatg

SEQ ID NO: 127558 - DNA, 103 bp, Artificial Sequence
  Synthetic Polynucleotide
taatacgactcactatagggcgggctggaggcccaggccagagctgggttaacagaggagaaacccaatgctggcctggaacctggcggcagcgcaaaagatg

SEQ ID NO: 127559 - DNA, 103 bp, Artificial Sequence
  Synthetic Polynucleotide
taatacgactcactataggggcggcggtggccccagccccttcagggggcaacagaggagagcccccatgaggggctggaacctggcggcagcgcaaaagatg

SEQ ID NO: 127560 - DNA, 103 bp, Artificial Sequence
  Synthetic Polynucleotide
taatacgactcactataggggatgggggcagcggcggtggccccagccccaacagaggagaggggctatggccaccgccaacctggcggcagcgcaaaagatg

SEQ ID NO: 127561 - DNA, 103 bp, Artificial Sequence
  Synthetic Polynucleotide
taatacgactcactataggggctctgagaggatgggggcagcggcggtggaacagaggagaccaccgatgctgcccccaaacctggcggcagcgcaaaagatg

SEQ ID NO: 127562 - DNA, 103 bp, Artificial Sequence
  Synthetic Polynucleotide
taatacgactcactatagggccggagaatggctctgagaggatgggggcaaacagaggagatgccccatgcctctcagaaacctggcggcagcgcaaaagatg

SEQ ID NO: 127563 - DNA, 103 bp, Artificial Sequence
  Synthetic Polynucleotide
taatacgactcactatagggggctggccccccggagaatggctctgagagaacagaggagactctcaatgccattctccaacctggcggcagcgcaaaagatg

SEQ ID NO: 127564 - DNA, 103 bp, Artificial Sequence
  Synthetic Polynucleotide
taatacgactcactatagggtgtggggaagggctggccccccggagaatgaacagaggagacattctatggggggccagaacctggcggcagcgcaaaagatg

SEQ ID NO: 127565 - DNA, 103 bp, Artificial Sequence
  Synthetic Polynucleotide
taatacgactcactatagggtgctggggagtgtggggaagggctggccccaacagaggagaggggccatgccttccccaaacctggcggcagcgcaaaagatg

SEQ ID NO: 127566 - DNA, 103 bp, Artificial Sequence
  Synthetic Polynucleotide
taatacgactcactatagggtaggacggcttgctggggagtgtggggaagaacagaggagacttcccatgactccccagaacctggcggcagcgcaaaagatg

SEQ ID NO: 127567 - DNA, 103 bp, Artificial Sequence
  Synthetic Polynucleotide
taatacgactcactataggggaagggtgggtaggacggcttgctggggagaacagaggagactccccatgaagccgtccaacctggcggcagcgcaaaagatg

SEQ ID NO: 127568 - DNA, 103 bp, Artificial Sequence
  Synthetic Polynucleotide
taatacgactcactataggggagggctctggaagggtgggtaggacggctaacagaggagaagccgtatgacccaccctaacctggcggcagcgcaaaagatg

SEQ ID NO: 127569 - DNA, 103 bp, Artificial Sequence
  Synthetic Polynucleotide
taatacgactcactatagggaggtgggtctcgggctggaggcccaggccaaacagaggagatggcctatgcctccagccaacctggcggcagcgcaaaagatg

SEQ ID NO: 127570 - DNA, 103 bp, Artificial Sequence
  Synthetic Polynucleotide
taatacgactcactatagggggcgggggtggagggctctggaagggtgggaacagaggagacccaccatgccagagcccaacctggcggcagcgcaaaagatg

SEQ ID NO: 127571 - DNA, 103 bp, Artificial Sequence
  Synthetic Polynucleotide
taatacgactcactataggggctgggcagaggcgggggtggagggctctgaacagaggagacagagcatgccacccccgaacctggcggcagcgcaaaagatg

SEQ ID NO: 127572 - DNA, 103 bp, Artificial Sequence
  Synthetic Polynucleotide
taatacgactcactatagggaaccttgtgggctgggcagaggcgggggtgaacagaggagacaccccatgctctgcccaaacctggcggcagcgcaaaagatg

SEQ ID NO: 127573 - DNA, 103 bp, Artificial Sequence
  Synthetic Polynucleotide
taatacgactcactatagggctgccctggtaaccttgtgggctgggcagaaacagaggagatctgccatgcccacaaggaacctggcggcagcgcaaaagatg

SEQ ID NO: 127574 - DNA, 103 bp, Artificial Sequence
  Synthetic Polynucleotide
taatacgactcactatagggggagtggaaactgccctggtaaccttgtggaacagaggagaccacaaatgtaccagggcaacctggcggcagcgcaaaagatg

SEQ ID NO: 127575 - DNA, 103 bp, Artificial Sequence
  Synthetic Polynucleotide
taatacgactcactatagggaactctggatggagtggaaactgccctggtaacagaggagaaccaggatggtttccactaacctggcggcagcgcaaaagatg

SEQ ID NO: 127576 - DNA, 103 bp, Artificial Sequence
  Synthetic Polynucleotide
taatacgactcactatagggtaggggaagcaactctggatggagtggaaaaacagaggagatttccaatgcatccagagaacctggcggcagcgcaaaagatg

SEQ ID NO: 127577 - DNA, 103 bp, Artificial Sequence
  Synthetic Polynucleotide
taatacgactcactataggggcagtcgccataggggaagcaactctggataacagaggagaatccagatgtgcttccccaacctggcggcagcgcaaaagatg

SEQ ID NO: 127578 - DNA, 103 bp, Artificial Sequence
  Synthetic Polynucleotide
taatacgactcactatagggccatccggtagcagtcgccataggggaagcaacagaggagagcttccatgatggcgactaacctggcggcagcgcaaaagatg

SEQ ID NO: 127579 - DNA, 103 bp, Artificial Sequence
  Synthetic Polynucleotide
taatacgactcactataggggctggttcagccatccggtagcagtcgccaaacagaggagatggcgaatgctaccggataacctggcggcagcgcaaaagatg

SEQ ID NO: 127580 - DNA, 103 bp, Artificial Sequence
  Synthetic Polynucleotide
taatacgactcactataggggccctcggggaggtgggtctcgggctggagaacagaggagactccagatggagacccacaacctggcggcagcgcaaaagatg

SEQ ID NO: 127581 - DNA, 103 bp, Artificial Sequence
  Synthetic Polynucleotide
taatacgactcactatagggcccaccggctgctggttcagccatccggtaaacagaggagataccggatggctgaaccaaacctggcggcagcgcaaaagatg

SEQ ID NO: 127582 - DNA, 103 bp, Artificial Sequence
  Synthetic Polynucleotide
taatacgactcactatagggccagtccgtccccaccggctgctggttcagaacagaggagactgaacatgcagccggtgaacctggcggcagcgcaaaagatg

SEQ ID NO: 127583 - DNA, 103 bp, Artificial Sequence
  Synthetic Polynucleotide
taatacgactcactataggggtctccccgaccagtccgtccccaccggctaacagaggagaagccggatgggacggactaacctggcggcagcgcaaaagatg

SEQ ID NO: 127584 - DNA, 103 bp, Artificial Sequence
  Synthetic Polynucleotide
taatacgactcactataggggaaaccgtgggtctccccgaccagtccgtcaacagaggagagacggaatggtcggggagaacctggcggcagcgcaaaagatg

SEQ ID NO: 127585 - DNA, 103 bp, Artificial Sequence
  Synthetic Polynucleotide
taatacgactcactataggggcagggggttgaaaccgtgggtctccccgaaacagaggagatcggggatgcccacggttaacctggcggcagcgcaaaagatg

SEQ ID NO: 127586 - DNA, 103 bp, Artificial Sequence
  Synthetic Polynucleotide
taatacgactcactatagggccattgggccgcagggggttgaaaccgtggaacagaggagaccacggatgcaaccccctaacctggcggcagcgcaaaagatg

SEQ ID NO: 127587 - DNA, 103 bp, Artificial Sequence
  Synthetic Polynucleotide
taatacgactcactataggggctgtggtagccattgggccgcagggggttaacagaggagaaaccccatgcggcccaataacctggcggcagcgcaaaagatg

SEQ ID NO: 127588 - DNA, 103 bp, Artificial Sequence
  Synthetic Polynucleotide
taatacgactcactataggggcgtgctgaggctgtggtagccattgggccaacagaggagaggcccaatggctaccacaaacctggcggcagcgcaaaagatg

SEQ ID NO: 127589 - DNA, 103 bp, Artificial Sequence
  Synthetic Polynucleotide
taatacgactcactataggggcaggcaagggcgtgctgaggctgtggtagaacagaggagactaccaatgcctcagcacaacctggcggcagcgcaaaagatg

SEQ ID NO: 127590 - DNA, 103 bp, Artificial Sequence
  Synthetic Polynucleotide
taatacgactcactatagggatagcctgtggcaggcaagggcgtgctgagaacagaggagactcagcatgcccttgcctaacctggcggcagcgcaaaagatg

SEQ ID NO: 127591 - DNA, 103 bp, Artificial Sequence
  Synthetic Polynucleotide
taatacgactcactataggggcttcaggctgccctcggggaggtgggtctaacagaggagaagacccatgtccccgaggaacctggcggcagcgcaaaagatg

SEQ ID NO: 127592 - DNA, 103 bp, Artificial Sequence
  Synthetic Polynucleotide
taatacgactcactatagggccagggcctcatagcctgtggcaggcaaggaacagaggagaccttgcatgccacaggctaacctggcggcagcgcaaaagatg

SEQ ID NO: 127593 - DNA, 103 bp, Artificial Sequence
  Synthetic Polynucleotide
taatacgactcactataggggaggcctcagccagggcctcatagcctgtgaacagaggagacacaggatgtgaggccctaacctggcggcagcgcaaaagatg

SEQ ID NO: 127594 - DNA, 103 bp, Artificial Sequence
  Synthetic Polynucleotide
taatacgactcactatagggtgtggggcatgaggcctcagccagggcctcaacagaggagagaggccatggctgaggccaacctggcggcagcgcaaaagatg

SEQ ID NO: 127595 - DNA, 103 bp, Artificial Sequence
  Synthetic Polynucleotide
taatacgactcactataggggtggcagcgctgtggggcatgaggcctcagaacagaggagactgaggatgcatgccccaaacctggcggcagcgcaaaagatg

SEQ ID NO: 127596 - DNA, 103 bp, Artificial Sequence
  Synthetic Polynucleotide
taatacgactcactataggggatggctgctgtggcagcgctgtggggcataacagaggagaatgcccatgagcgctgccaacctggcggcagcgcaaaagatg

SEQ ID NO: 127597 - DNA, 103 bp, Artificial Sequence
  Synthetic Polynucleotide
taatacgactcactatagggcacatcttcagatggctgctgtggcagcgcaacagaggagagcgctgatgcagcagccaaacctggcggcagcgcaaaagatg

SEQ ID NO: 127598 - DNA, 103 bp, Artificial Sequence
  Synthetic Polynucleotide
taatacgactcactatagggcgctggacaccacatcttcagatggctgctaacagaggagaagcagcatgctgaagatgaacctggcggcagcgcaaaagatg

SEQ ID NO: 127599 - DNA, 103 bp, Artificial Sequence
  Synthetic Polynucleotide
taatacgactcactatagggtcctcggggccgctggacaccacatcttcaaacagaggagatgaagaatgggtgtccagaacctggcggcagcgcaaaagatg

SEQ ID NO: 127600 - DNA, 103 bp, Artificial Sequence
  Synthetic Polynucleotide
taatacgactcactataggggaagccacagtcctcggggccgctggacacaacagaggagagtgtccatgggccccgagaacctggcggcagcgcaaaagatg

SEQ ID NO: 127601 - DNA, 103 bp, Artificial Sequence
  Synthetic Polynucleotide
taatacgactcactatagggcattggggaagaagccacagtcctcggggcaacagaggagagccccgatgactgtggctaacctggcggcagcgcaaaagatg

SEQ ID NO: 127602 - DNA, 103 bp, Artificial Sequence
  Synthetic Polynucleotide
taatacgactcactatagggacgcagcaccgcttcaggctgccctcggggaacagaggagaccccgaatgcagcctgaaaacctggcggcagcgcaaaagatg

SEQ ID NO: 127603 - DNA, 103 bp, Artificial Sequence
  Synthetic Polynucleotide
taatacgactcactatagggtcaaaggctccattggggaagaagccacagaacagaggagactgtggatgcttccccaaaacctggcggcagcgcaaaagatg

SEQ ID NO: 127604 - DNA, 103 bp, Artificial Sequence
  Synthetic Polynucleotide
taatacgactcactatagggcaggcagtggtcaaaggctccattggggaaaacagaggagattccccatgggagcctttaacctggcggcagcgcaaaagatg

SEQ ID NO: 127605 - DNA, 103 bp, Artificial Sequence
  Synthetic Polynucleotide
taatacgactcactatagggggatgtggcccaggcagtggtcaaaggctcaacagaggagagagcctatgaccactgccaacctggcggcagcgcaaaagatg

SEQ ID NO: 127606 - DNA, 103 bp, Artificial Sequence
  Synthetic Polynucleotide
taatacgactcactatagggtagatggaggggatgtggcccaggcagtggaacagaggagaccactgatggggccacataacctggcggcagcgcaaaagatg

SEQ ID NO: 127607 - DNA, 103 bp, Artificial Sequence
  Synthetic Polynucleotide
taatacgactcactatagggggtgtctgtgtagatggaggggatgtggccaacagaggagaggccacatgccctccatcaacctggcggcagcgcaaaagatg

SEQ ID NO: 127608 - DNA, 103 bp, Artificial Sequence
  Synthetic Polynucleotide
taatacgactcactatagggtaggcccaagacgcagcaccgcttcaggctaacagaggagaagcctgatgcggtgctgcaacctggcggcagcgcaaaagatg

SEQ ID NO: 127609 - DNA, 103 bp, Artificial Sequence
  Synthetic Polynucleotide
taatacgactcactatagggcccgacagtgggcagacagggatgtgcgggaacagaggagacccgcaatgccctgtctgaacctggcggcagcgcaaaagatg

SEQ ID NO: 127610 - DNA, 103 bp, Artificial Sequence
  Synthetic Polynucleotide
taatacgactcactatagggaggtggggggtaggcccaagacgcagcaccaacagaggagaggtgctatgtcttgggccaacctggcggcagcgcaaaagatg

SEQ ID NO: 127611 - DNA, 103 bp, Artificial Sequence
  Synthetic Polynucleotide
taatacgactcactataggggaggctggggaggtggggggtaggcccaagaacagaggagacttgggatgaccccccacaacctggcggcagcgcaaaagatg

SEQ ID NO: 127612 - DNA, 103 bp, Artificial Sequence
  Synthetic Polynucleotide
taatacgactcactataggggggtgaggaggaggctggggaggtggggggaacagaggagaccccccatgtccccagccaacctggcggcagcgcaaaagatg

SEQ ID NO: 127613 - DNA, 103 bp, Artificial Sequence
  Synthetic Polynucleotide
taatacgactcactatagggaggaggcacagggtgaggaggaggctggggaacagaggagaccccagatgcctcctcacaacctggcggcagcgcaaaagatg

SEQ ID NO: 127614 - DNA, 103 bp, Artificial Sequence
  Synthetic Polynucleotide
taatacgactcactataggggtgacgtcggaggaggcacagggtgaggagaacagaggagactcctcatgctgtgcctcaacctggcggcagcgcaaaagatg

SEQ ID NO: 127615 - DNA, 103 bp, Artificial Sequence
  Synthetic Polynucleotide
taatacgactcactataggggatgatggaggtgacgtcggaggaggcacaaacagaggagatgtgccatgtccgacgtcaacctggcggcagcgcaaaagatg

SEQ ID NO: 127616 - DNA, 103 bp, Artificial Sequence
  Synthetic Polynucleotide
taatacgactcactataggggggaggagcggatgatggaggtgacgtcggaacagaggagaccgacgatgcctccatcaaacctggcggcagcgcaaaagatg

SEQ ID NO: 127617 - DNA, 103 bp, Artificial Sequence
  Synthetic Polynucleotide
taatacgactcactatagggagagacgtctgggaggagcggatgatggagaacagaggagactccatatgccgctcctcaacctggcggcagcgcaaaagatg

SEQ ID NO: 127618 - DNA, 103 bp, Artificial Sequence
  Synthetic Polynucleotide
taatacgactcactatagggacaggtgaccagagacgtctgggaggagcgaacagaggagacgctccatgcagacgtctaacctggcggcagcgcaaaagatg

SEQ ID NO: 127619 - DNA, 103 bp, Artificial Sequence
  Synthetic Polynucleotide
taatacgactcactataggggtccatttacacaggtgaccagagacgtctaacagaggagaagacgtatgtggtcacctaacctggcggcagcgcaaaagatg

SEQ ID NO: 127620 - DNA, 103 bp, Artificial Sequence
  Synthetic Polynucleotide
taatacgactcactataggggccagcgggccccgacagtgggcagacaggaacagaggagacctgtcatgccactgtcgaacctggcggcagcgcaaaagatg

SEQ ID NO: 127621 - DNA, 103 bp, Artificial Sequence
  Synthetic Polynucleotide
taatacgactcactataggggggctccggagtccatttacacaggtgaccaacagaggagaggtcacatgtgtaaatggaacctggcggcagcgcaaaagatg

SEQ ID NO: 127622 - DNA, 103 bp, Artificial Sequence
  Synthetic Polynucleotide
taatacgactcactatagggcgtcagaggggggctccggagtccatttacaacagaggagagtaaatatgctccggagcaacctggcggcagcgcaaaagatg

SEQ ID NO: 127623 - DNA, 103 bp, Artificial Sequence
  Synthetic Polynucleotide
taatacgactcactatagggccagatctcccgtcagaggggggctccggaaacagaggagatccggaatgcccctctgaaacctggcggcagcgcaaaagatg

SEQ ID NO: 127624 - DNA, 103 bp, Artificial Sequence
  Synthetic Polynucleotide
taatacgactcactataggggaagggccccccagatctcccgtcagagggaacagaggagaccctctatggggagatctaacctggcggcagcgcaaaagatg

SEQ ID NO: 127625 - DNA, 103 bp, Artificial Sequence
  Synthetic Polynucleotide
taatacgactcactatagggggcccgcttggaagggccccccagatctccaacagaggagaggagatatggggggccctaacctggcggcagcgcaaaagatg

SEQ ID NO: 127626 - DNA, 103 bp, Artificial Sequence
  Synthetic Polynucleotide
taatacgactcactatagggggccaggccgggcccgcttggaagggccccaacagaggagaggggccatgccaagcgggaacctggcggcagcgcaaaagatg

SEQ ID NO: 127627 - DNA, 103 bp, Artificial Sequence
  Synthetic Polynucleotide
taatacgactcactataggggtcgatgcagggccaggccgggcccgcttgaacagaggagacaagcgatgccggcctggaacctggcggcagcgcaaaagatg

SEQ ID NO: 127628 - DNA, 103 bp, Artificial Sequence
  Synthetic Polynucleotide
taatacgactcactatagggatggctgtccgtcgatgcagggccaggccgaacagaggagacggcctatgcctgcatcgaacctggcggcagcgcaaaagatg

SEQ ID NO: 127629 - DNA, 103 bp, Artificial Sequence
  Synthetic Polynucleotide
taatacgactcactatagggagctgccctcatggctgtccgtcgatgcagaacagaggagactgcatatgcggacagccaacctggcggcagcgcaaaagatg

SEQ ID NO: 127630 - DNA, 103 bp, Artificial Sequence
  Synthetic Polynucleotide
taatacgactcactatagggtcaagttgcaagctgccctcatggctgtccaacagaggagaggacagatgtgagggcagaacctggcggcagcgcaaaagatg

SEQ ID NO: 127631 - DNA, 103 bp, Artificial Sequence
  Synthetic Polynucleotide
taatacgactcactatagggcaggccagtggccagcgggccccgacagtgaacagaggagacactgtatgggcccgctgaacctggcggcagcgcaaaagatg

SEQ ID NO: 127632 - DNA, 103 bp, Artificial Sequence
  Synthetic Polynucleotide
taatacgactcactatagggccggcaggcttcaagttgcaagctgccctcaacagaggagagagggcatgttgcaacttaacctggcggcagcgcaaaagatg

SEQ ID NO: 127633 - DNA, 103 bp, Artificial Sequence
  Synthetic Polynucleotide
taatacgactcactatagggagctcgccttccggcaggcttcaagttgcaaacagaggagatgcaacatgaagcctgccaacctggcggcagcgcaaaagatg

SEQ ID NO: 127634 - DNA, 103 bp, Artificial Sequence
  Synthetic Polynucleotide
taatacgactcactatagggtgcttcaggaagctcgccttccggcaggctaacagaggagaagcctgatggaaggcgagaacctggcggcagcgcaaaagatg

SEQ ID NO: 127635 - DNA, 103 bp, Artificial Sequence
  Synthetic Polynucleotide
taatacgactcactatagggcgcgggttcctgcttcaggaagctcgccttaacagaggagaaaggcgatgttcctgaagaacctggcggcagcgcaaaagatg

SEQ ID NO: 127636 - DNA, 103 bp, Artificial Sequence
  Synthetic Polynucleotide
taatacgactcactatagggaaaactcatccgcgggttcctgcttcaggaaacagaggagatcctgaatgaggaacccgaacctggcggcagcgcaaaagatg

SEQ ID NO: 127637 - DNA, 103 bp, Artificial Sequence
  Synthetic Polynucleotide
taatacgactcactatagggaagagctctgaaaactcatccgcgggttccaacagaggagaggaaccatgggatgagttaacctggcggcagcgcaaaagatg

SEQ ID NO: 127638 - DNA, 103 bp, Artificial Sequence
  Synthetic Polynucleotide
taatacgactcactataggggtgaggcccaaagagctctgaaaactcatcaacagaggagagatgagatgtcagagctcaacctggcggcagcgcaaaagatg

SEQ ID NO: 127639 - DNA, 103 bp, Artificial Sequence
  Synthetic Polynucleotide
taatacgactcactatagggggccctgctggtgaggcccaaagagctctgaacagaggagacagagcatgttgggcctcaacctggcggcagcgcaaaagatg

SEQ ID NO: 127640 - DNA, 103 bp, Artificial Sequence
  Synthetic Polynucleotide
taatacgactcactataggggggggcggcaggccctgctggtgaggcccaaacagaggagatgggccatgccagcagggaacctggcggcagcgcaaaagatg

SEQ ID NO: 127641 - DNA, 103 bp, Artificial Sequence
  Synthetic Polynucleotide
taatacgactcactatagggcaggggataggggggcggcaggccctgctgaacagaggagacagcagatgctgccgcccaacctggcggcagcgcaaaagatg

SEQ ID NO: 127642 - DNA, 103 bp, Artificial Sequence
  Synthetic Polynucleotide
taatacgactcactatagggggtctgggtgcaggccagtggccagcgggcaacagaggagagcccgcatgccactggccaacctggcggcagcgcaaaagatg

SEQ ID NO: 127643 - DNA, 103 bp, Artificial Sequence
  Synthetic Polynucleotide
taatacgactcactataggggcaactgagacaggggataggggggcggcaaacagaggagatgccgcatgcctatccccaacctggcggcagcgcaaaagatg

SEQ ID NO: 127644 - DNA, 103 bp, Artificial Sequence
  Synthetic Polynucleotide
taatacgactcactataggggggccaggcggcaactgagacaggggatagaacagaggagactatccatggtctcagttaacctggcggcagcgcaaaagatg

SEQ ID NO: 127645 - DNA, 103 bp, Artificial Sequence
  Synthetic Polynucleotide
taatacgactcactatagggtccaaggcttgggccaggcggcaactgagaaacagaggagatctcagatgccgcctggcaacctggcggcagcgcaaaagatg

SEQ ID NO: 127646 - DNA, 103 bp, Artificial Sequence
  Synthetic Polynucleotide
taatacgactcactataggggccccaggcctccaaggcttgggccaggcgaacagaggagacgcctgatgcaagccttgaacctggcggcagcgcaaaagatg

SEQ ID NO: 127647 - DNA, 103 bp, Artificial Sequence
  Synthetic Polynucleotide
taatacgactcactataggggccaggcccagccccaggcctccaaggcttaacagaggagaaagcctatgaggcctgggaacctggcggcagcgcaaaagatg

SEQ ID NO: 127648 - DNA, 103 bp, Artificial Sequence
  Synthetic Polynucleotide
taatacgactcactatagggcaccctgcctgccaggcccagccccaggccaacagaggagaggcctgatgctgggcctgaacctggcggcagcgcaaaagatg

SEQ ID NO: 127649 - DNA, 103 bp, Artificial Sequence
  Synthetic Polynucleotide
taatacgactcactataggggcccggccaccaccctgcctgccaggcccaaacagaggagatgggccatgcaggcagggaacctggcggcagcgcaaaagatg

SEQ ID NO: 127650 - DNA, 103 bp, Artificial Sequence
  Synthetic Polynucleotide
taatacgactcactatagggcacgcctgccgcccggccaccaccctgcctaacagaggagaaggcagatgggtggccggaacctggcggcagcgcaaaagatg

SEQ ID NO: 127651 - DNA, 103 bp, Artificial Sequence
  Synthetic Polynucleotide
taatacgactcactatagggcacccagcggcacgcctgccgcccggccacaacagaggagagtggccatgcggcaggcgaacctggcggcagcgcaaaagatg

SEQ ID NO: 127652 - DNA, 103 bp, Artificial Sequence
  Synthetic Polynucleotide
taatacgactcactatagggcacagcagtccacccagcggcacgcctgccaacagaggagaggcaggatggccgctgggaacctggcggcagcgcaaaagatg

SEQ ID NO: 127653 - DNA, 103 bp, Artificial Sequence
  Synthetic Polynucleotide
taatacgactcactataggggggaggtccaggtctgggtgcaggccagtgaacagaggagacactggatggcacccagaaacctggcggcagcgcaaaagatg

SEQ ID NO: 127654 - DNA, 103 bp, Artificial Sequence
  Synthetic Polynucleotide
taatacgactcactatagggtcataggctgcacagcagtccacccagcggaacagaggagaccgctgatgggactgctgaacctggcggcagcgcaaaagatg

SEQ ID NO: 127655 - DNA, 103 bp, Artificial Sequence
  Synthetic Polynucleotide
taatacgactcactatagggctcctgctgctcataggctgcacagcagtcaacagaggagagactgcatggcagcctataacctggcggcagcgcaaaagatg

SEQ ID NO: 127656 - DNA, 103 bp, Artificial Sequence
  Synthetic Polynucleotide
taatacgactcactataggggcaccagctcctcctgctgctcataggctgaacagaggagacagcctatgagcagcaggaacctggcggcagcgcaaaagatg

SEQ ID NO: 127657 - DNA, 103 bp, Artificial Sequence
  Synthetic Polynucleotide
taatacgactcactatagggtcgatgtgccgcaccagctcctcctgctgcaacagaggagagcagcaatgggagctggtaacctggcggcagcgcaaaagatg

SEQ ID NO: 127658 - DNA, 103 bp, Artificial Sequence
  Synthetic Polynucleotide
taatacgactcactataggggtggctcttctcgatgtgccgcaccagctcaacagaggagagagctgatgcggcacatcaacctggcggcagcgcaaaagatg

SEQ ID NO: 127659 - DNA, 103 bp, Artificial Sequence
  Synthetic Polynucleotide
taatacgactcactataggggctggtcgatgtggctcttctcgatgtgccaacagaggagaggcacaatgagaagagccaacctggcggcagcgcaaaagatg

SEQ ID NO: 127660 - DNA, 103 bp, Artificial Sequence
  Synthetic Polynucleotide
taatacgactcactatagggtcgcccttgcgctggtcgatgtggctcttcaacagaggagagaagagatgcatcgaccaaacctggcggcagcgcaaaagatg

SEQ ID NO: 127661 - DNA, 103 bp, Artificial Sequence
  Synthetic Polynucleotide
taatacgactcactatagggggtgaagtcctcgcccttgcgctggtcgataacagaggagaatcgacatgcgcaagggcaacctggcggcagcgcaaaagatg

SEQ ID NO: 127662 - DNA, 103 bp, Artificial Sequence
  Synthetic Polynucleotide
taatacgactcactatagggcccagaagcaggtgaagtcctcgcccttgcaacagaggagagcaaggatgaggacttcaaacctggcggcagcgcaaaagatg

SEQ ID NO: 127663 - DNA, 103 bp, Artificial Sequence
  Synthetic Polynucleotide
taatacgactcactatagggacgcagccagcccagaagcaggtgaagtccaacagaggagaggacttatgctgcttctgaacctggcggcagcgcaaaagatg

SEQ ID NO: 127664 - DNA, 103 bp, Artificial Sequence
  Synthetic Polynucleotide
taatacgactcactataggggcttcggcccgggaggtccaggtctgggtgaacagaggagacacccaatgctggacctcaacctggcggcagcgcaaaagatg

SEQ ID NO: 127665 - DNA, 103 bp, Artificial Sequence
  Synthetic Polynucleotide
taatacgactcactataggggtagcggcgcacgcagccagcccagaagcaaacagaggagatgcttcatggctggctgcaacctggcggcagcgcaaaagatg

SEQ ID NO: 127666 - DNA, 103 bp, Artificial Sequence
  Synthetic Polynucleotide
taatacgactcactatagggtgaagggcttgtagcggcgcacgcagccagaacagaggagactggctatgtgcgccgctaacctggcggcagcgcaaaagatg

SEQ ID NO: 127667 - DNA, 103 bp, Artificial Sequence
  Synthetic Polynucleotide
taatacgactcactatagggtagcgggcgttgaagggcttgtagcggcgcaacagaggagagcgccgatgcaagcccttaacctggcggcagcgcaaaagatg

SEQ ID NO: 127668 - DNA, 103 bp, Artificial Sequence
  Synthetic Polynucleotide
taatacgactcactataggggagcagcttgtagcgggcgttgaagggcttaacagaggagaaagcccatgaacgcccgcaacctggcggcagcgcaaaagatg

SEQ ID NO: 127669 - DNA, 103 bp, Artificial Sequence
  Synthetic Polynucleotide
taatacgactcactataggggcatgtggatgagcagcttgtagcgggcgtaacagaggagaacgcccatgacaagctgcaacctggcggcagcgcaaaagatg

SEQ ID NO: 127670 - DNA, 103 bp, Artificial Sequence
  Synthetic Polynucleotide
taatacgactcactataggggagtgcactcgcatgtggatgagcagcttgaacagaggagacaagctatgcatccacataacctggcggcagcgcaaaagatg

SEQ ID NO: 127671 - DNA, 103 bp, Artificial Sequence
  Synthetic Polynucleotide
taatacgactcactatagggcttctcgcccgagtgcactcgcatgtggataacagaggagaatccacatgcgagtgcacaacctggcggcagcgcaaaagatg

SEQ ID NO: 127672 - DNA, 103 bp, Artificial Sequence
  Synthetic Polynucleotide
taatacgactcactatagggacttgttgggcttctcgcccgagtgcactcaacagaggagagagtgcatgcgggcgagaaacctggcggcagcgcaaaagatg

SEQ ID NO: 127673 - DNA, 103 bp, Artificial Sequence
  Synthetic Polynucleotide
taatacgactcactatagggtcaaacatgcacttgttgggcttctcgcccaacagaggagagggcgaatggcccaacaaaacctggcggcagcgcaaaagatg

SEQ ID NO: 127674 - DNA, 103 bp, Artificial Sequence
  Synthetic Polynucleotide
taatacgactcactataggggctgcagccttcaaacatgcacttgttgggaacagaggagacccaacatgtgcatgtttaacctggcggcagcgcaaaagatg

SEQ ID NO: 127675 - DNA, 103 bp, Artificial Sequence
  Synthetic Polynucleotide
taatacgactcactataggggggtggcgaggcttcggcccgggaggtccaaacagaggagatggaccatgcgggccgaaaacctggcggcagcgcaaaagatg

SEQ ID NO: 127676 - DNA, 103 bp, Artificial Sequence
  Synthetic Polynucleotide
taatacgactcactatagggagaaggccttgctgcagccttcaaacatgcaacagaggagagcatgtatgaaggctgcaaacctggcggcagcgcaaaagatg

SEQ ID NO: 127677 - DNA, 103 bp, Artificial Sequence
  Synthetic Polynucleotide
taatacgactcactatagggtccagccgtgagaaggccttgctgcagcctaacagaggagaaggctgatgcaaggccttaacctggcggcagcgcaaaagatg

SEQ ID NO: 127678 - DNA, 103 bp, Artificial Sequence
  Synthetic Polynucleotide
taatacgactcactatagggcttgaggttctccagccgtgagaaggccttaacagaggagaaaggccatgtcacggctgaacctggcggcagcgcaaaagatg

SEQ ID NO: 127679 - DNA, 103 bp, Artificial Sequence
  Synthetic Polynucleotide
taatacgactcactatagggtcaggtggatcttgaggttctccagccgtgaacagaggagacacggcatgagaacctcaaacctggcggcagcgcaaaagatg

SEQ ID NO: 127680 - DNA, 103 bp, Artificial Sequence
  Synthetic Polynucleotide
taatacgactcactataggggtgtggctcctcaggtggatcttgaggttcaacagaggagagaacctatggatccacctaacctggcggcagcgcaaaagatg

SEQ ID NO: 127681 - DNA, 103 bp, Artificial Sequence
  Synthetic Polynucleotide
taatacgactcactatagggcttctcgcccgtgtggctcctcaggtggataacagaggagaatccacatgaggagccacaacctggcggcagcgcaaaagatg

SEQ ID NO: 127682 - DNA, 103 bp, Artificial Sequence
  Synthetic Polynucleotide
taatacgactcactatagggacaggtacggcttctcgcccgtgtggctccaacagaggagaggagccatgcgggcgagaaacctggcggcagcgcaaaagatg

SEQ ID NO: 127683 - DNA, 103 bp, Artificial Sequence
  Synthetic Polynucleotide
taatacgactcactataggggggtgctggcacaggtacggcttctcgcccaacagaggagagggcgaatggccgtacctaacctggcggcagcgcaaaagatg

SEQ ID NO: 127684 - DNA, 103 bp, Artificial Sequence
  Synthetic Polynucleotide
taatacgactcactatagggctggcaacccgggtgctggcacaggtacggaacagaggagaccgtacatgtgccagcacaacctggcggcagcgcaaaagatg

SEQ ID NO: 127685 - DNA, 103 bp, Artificial Sequence
  Synthetic Polynucleotide
taatacgactcactatagggtgaaggccttctggcaacccgggtgctggcaacagaggagagccagcatgcgggttgccaacctggcggcagcgcaaaagatg

SEQ ID NO: 127686 - DNA, 103 bp, Artificial Sequence
  Synthetic Polynucleotide
taatacgactcactataggggaaggcgcaggggtggcgaggcttcggcccaacagaggagagggccgatgcctcgccacaacctggcggcagcgcaaaagatg

SEQ ID NO: 127687 - DNA, 103 bp, Artificial Sequence
  Synthetic Polynucleotide
taatacgactcactatagggctggagttgctgaaggccttctggcaacccaacagaggagagggttgatggaaggccttaacctggcggcagcgcaaaagatg

SEQ ID NO: 127688 - DNA, 103 bp, Artificial Sequence
  Synthetic Polynucleotide
taatacgactcactatagggggcgcggtcgctggagttgctgaaggccttaacagaggagaaaggccatgagcaactccaacctggcggcagcgcaaaagatg

SEQ ID NO: 127689 - DNA, 103 bp, Artificial Sequence
  Synthetic Polynucleotide
taatacgactcactataggggctggtgcttggcgcggtcgctggagttgcaacagaggagagcaactatggcgaccgcgaacctggcggcagcgcaaaagatg

SEQ ID NO: 127690 - DNA, 103 bp, Artificial Sequence
  Synthetic Polynucleotide
taatacgactcactatagggaggtgggtgcgctggtgcttggcgcggtcgaacagaggagacgaccgatgcaagcaccaaacctggcggcagcgcaaaagatg

SEQ ID NO: 127691 - DNA, 103 bp, Artificial Sequence
  Synthetic Polynucleotide
taatacgactcactatagggcttcgtgtctaggtgggtgcgctggtgcttaacagaggagaaagcacatgcgcacccacaacctggcggcagcgcaaaagatg

SEQ ID NO: 127692 - DNA, 103 bp, Artificial Sequence
  Synthetic Polynucleotide
taatacgactcactatagggaggcgtacggcttcgtgtctaggtgggtgcaacagaggagagcacccatgtagacacgaaacctggcggcagcgcaaaagatg

SEQ ID NO: 127693 - DNA, 103 bp, Artificial Sequence
  Synthetic Polynucleotide
taatacgactcactataggggggatctgacaggcgtacggcttcgtgtctaacagaggagaagacacatggccgtacgcaacctggcggcagcgcaaaagatg

SEQ ID NO: 127694 - DNA, 103 bp, Artificial Sequence
  Synthetic Polynucleotide
taatacgactcactatagggggagcagccagggatctgacaggcgtacggaacagaggagaccgtacatgtgtcagatcaacctggcggcagcgcaaaagatg

SEQ ID NO: 127695 - DNA, 103 bp, Artificial Sequence
  Synthetic Polynucleotide
taatacgactcactatagggtgtagcgcttggagcagccagggatctgacaacagaggagagtcagaatgctggctgctaacctggcggcagcgcaaaagatg

SEQ ID NO: 127696 - DNA, 103 bp, Artificial Sequence
  Synthetic Polynucleotide
taatacgactcactatagggctggggtctgtgtagcgcttggagcagccaaacagaggagatggctgatgcaagcgctaaacctggcggcagcgcaaaagatg

SEQ ID NO: 127697 - DNA, 103 bp, Artificial Sequence
  Synthetic Polynucleotide
taatacgactcactatagggcaggtcgagcggctcgtccagggagtgcataacagaggagaatgcacatgctggacgagaacctggcggcagcgcaaaagatg

SEQ ID NO: 127698 - DNA, 103 bp, Artificial Sequence
  Synthetic Polynucleotide
taatacgactcactatagggcagctccctgtgcagagcacggggccggacaacagaggagagtccggatgcgtgctctgaacctggcggcagcgcaaaagatg

SEQ ID NO: 127699 - DNA, 103 bp, Artificial Sequence
  Synthetic Polynucleotide
taatacgactcactataggggggcagtggcggcttggggggtgggcgcagaacagaggagactgcgcatgccccccaagaacctggcggcagcgcaaaagatg

SEQ ID NO: 127700 - DNA, 103 bp, Artificial Sequence
  Synthetic Polynucleotide
taatacgactcactatagggcgtcgggggcgggcagtggcggcttgggggaacagaggagacccccaatgcgccactgcaacctggcggcagcgcaaaagatg

SEQ ID NO: 127701 - DNA, 103 bp, Artificial Sequence
  Synthetic Polynucleotide
taatacgactcactatagggtaggggccgccgtcgggggcgggcagtggcaacagaggagagccactatgcgcccccgaaacctggcggcagcgcaaaagatg

SEQ ID NO: 127702 - DNA, 103 bp, Artificial Sequence
  Synthetic Polynucleotide
taatacgactcactatagggcccactgacataggggccgccgtcgggggcaacagaggagagcccccatgggcggccccaacctggcggcagcgcaaaagatg

SEQ ID NO: 127703 - DNA, 103 bp, Artificial Sequence
  Synthetic Polynucleotide
taatacgactcactatagggtgatctgggccccactgacataggggccgcaacagaggagagcggccatgatgtcagtgaacctggcggcagcgcaaaagatg

SEQ ID NO: 127704 - DNA, 103 bp, Artificial Sequence
  Synthetic Polynucleotide
taatacgactcactatagggttggggatgatgatctgggccccactgacaaacagaggagatgtcagatgggcccagataacctggcggcagcgcaaaagatg

SEQ ID NO: 127705 - DNA, 103 bp, Artificial Sequence
  Synthetic Polynucleotide
taatacgactcactatagggggcagctgggttggggatgatgatctgggcaacagaggagagcccagatgatcatccccaacctggcggcagcgcaaaagatg

SEQ ID NO: 127706 - DNA, 103 bp, Artificial Sequence
  Synthetic Polynucleotide
taatacgactcactatagggctccaaagagggcagctgggttggggatgaaacagaggagatcatccatgacccagctgaacctggcggcagcgcaaaagatg

SEQ ID NO: 127707 - DNA, 103 bp, Artificial Sequence
  Synthetic Polynucleotide
taatacgactcactatagggaggccagggcctccaaagagggcagctgggaacagaggagacccagcatgcctctttggaacctggcggcagcgcaaaagatg

SEQ ID NO: 127708 - DNA, 103 bp, Artificial Sequence
  Synthetic Polynucleotide
taatacgactcactatagggtaagccgggcaggccagggcctccaaagagaacagaggagactctttatgggccctggcaacctggcggcagcgcaaaagatg

SEQ ID NO: 127709 - DNA, 103 bp, Artificial Sequence
  Synthetic Polynucleotide
taatacgactcactatagggccaccaggcccagctccctgtgcagagcacaacagaggagagtgctcatgacagggagcaacctggcggcagcgcaaaagatg

SEQ ID NO: 127710 - DNA, 103 bp, Artificial Sequence
  Synthetic Polynucleotide
taatacgactcactatagggggggtaggggtaagccgggcaggccagggcaacagaggagagccctgatgtgcccggctaacctggcggcagcgcaaaagatg

SEQ ID NO: 127711 - DNA, 103 bp, Artificial Sequence
  Synthetic Polynucleotide
taatacgactcactatagggccgggggccaggggtaggggtaagccgggcaacagaggagagcccggatgacccctaccaacctggcggcagcgcaaaagatg

SEQ ID NO: 127712 - DNA, 103 bp, Artificial Sequence
  Synthetic Polynucleotide
taatacgactcactataggggtcaagggggccgggggccaggggtaggggaacagaggagacccctaatgctggcccccaacctggcggcagcgcaaaagatg

SEQ ID NO: 127713 - DNA, 103 bp, Artificial Sequence
  Synthetic Polynucleotide
taatacgactcactataggggggcactgaggtcaagggggccgggggccaaacagaggagatggcccatggcccccttgaacctggcggcagcgcaaaagatg

SEQ ID NO: 127714 - DNA, 103 bp, Artificial Sequence
  Synthetic Polynucleotide
taatacgactcactatagggccacaggccagggcactgaggtcaagggggaacagaggagaccccctatgcctcagtgcaacctggcggcagcgcaaaagatg

SEQ ID NO: 127715 - DNA, 103 bp, Artificial Sequence
  Synthetic Polynucleotide
taatacgactcactatagggcccaccgttgccacaggccagggcactgagaacagaggagactcagtatgctggcctgtaacctggcggcagcgcaaaagatg

SEQ ID NO: 127716 - DNA, 103 bp, Artificial Sequence
  Synthetic Polynucleotide
taatacgactcactatagggccccactgcccccaccgttgccacaggccaaacagaggagatggcctatggcaacggtgaacctggcggcagcgcaaaagatg

SEQ ID NO: 127717 - DNA, 103 bp, Artificial Sequence
  Synthetic Polynucleotide
taatacgactcactatagggccccccccacccccactgcccccaccgttgaacagaggagacaacggatggggcagtggaacctggcggcagcgcaaaagatg

SEQ ID NO: 127718 - DNA, 103 bp, Artificial Sequence
  Synthetic Polynucleotide
taatacgactcactatagggagggcccatgccccccccacccccactgccaacagaggagaggcagtatgggtggggggaacctggcggcagcgcaaaagatg

SEQ ID NO: 127719 - DNA, 103 bp, Artificial Sequence
  Synthetic Polynucleotide
taatacgactcactatagggctggcagcccagggcccatgccccccccacaacagaggagagtggggatggcatgggccaacctggcggcagcgcaaaagatg

SEQ ID NO: 127720 - DNA, 103 bp, Artificial Sequence
  Synthetic Polynucleotide
taatacgactcactataggggggctgtcatccaccaggcccagctccctgaacagaggagacagggaatggggcctggtaacctggcggcagcgcaaaagatg

SEQ ID NO: 127721 - DNA, 103 bp, Artificial Sequence
  Synthetic Polynucleotide
taatacgactcactatagggaggacggggcctggcagcccagggcccatgaacagaggagacatgggatgtgggctgccaacctggcggcagcgcaaaagatg

SEQ ID NO: 127722 - DNA, 103 bp, Artificial Sequence
  Synthetic Polynucleotide
taatacgactcactatagggattgagaggcaggacggggcctggcagcccaacagaggagagggctgatgggccccgtcaacctggcggcagcgcaaaagatg

SEQ ID NO: 127723 - DNA, 103 bp, Artificial Sequence
  Synthetic Polynucleotide
taatacgactcactatagggtcttggccagattgagaggcaggacggggcaacagaggagagccccgatgtgcctctcaaacctggcggcagcgcaaaagatg

SEQ ID NO: 127724 - DNA, 103 bp, Artificial Sequence
  Synthetic Polynucleotide
taatacgactcactatagggagcagcgggttcttggccagattgagaggcaacagaggagagcctctatgtctggccaaaacctggcggcagcgcaaaagatg

SEQ ID NO: 127725 - DNA, 103 bp, Artificial Sequence
  Synthetic Polynucleotide
taatacgactcactataggggggcgagggcagcagcgggttcttggccagaacagaggagactggccatgaacccgctgaacctggcggcagcgcaaaagatg

SEQ ID NO: 127726 - DNA, 103 bp, Artificial Sequence
  Synthetic Polynucleotide
taatacgactcactatagggcagccccaaagggcgagggcagcagcgggtaacagaggagaacccgcatgtgccctcgcaacctggcggcagcgcaaaagatg

SEQ ID NO: 127727 - DNA, 103 bp, Artificial Sequence
  Synthetic Polynucleotide
taatacgactcactatagggcccagtccgccagccccaaagggcgagggcaacagaggagagccctcatgctttggggcaacctggcggcagcgcaaaagatg

SEQ ID NO: 127728 - DNA, 103 bp, Artificial Sequence
  Synthetic Polynucleotide
taatacgactcactatagggcacaggcaagcccagtccgccagccccaaaaacagaggagatttgggatgggcggactgaacctggcggcagcgcaaaagatg

SEQ ID NO: 127729 - DNA, 103 bp, Artificial Sequence
  Synthetic Polynucleotide
taatacgactcactatagggggagggagaccacaggcaagcccagtccgcaacagaggagagcggacatggcttgcctgaacctggcggcagcgcaaaagatg

SEQ ID NO: 127730 - DNA, 103 bp, Artificial Sequence
  Synthetic Polynucleotide
taatacgactcactataggggcgccagcaaggagggagaccacaggcaagaacagaggagacttgccatgggtctccctaacctggcggcagcgcaaaagatg

SEQ ID NO: 127731 - DNA, 103 bp, Artificial Sequence
  Synthetic Polynucleotide
taatacgactcactataggggccaggtgtggggctgtcatccaccaggccaacagaggagaggcctgatggatgacagcaacctggcggcagcgcaaaagatg

SEQ ID NO: 127732 - DNA, 103 bp, Artificial Sequence
  Synthetic Polynucleotide
taatacgactcactataggggccaccagctgcgccagcaaggagggagacaacagaggagagtctccatgcttgctggcaacctggcggcagcgcaaaagatg

SEQ ID NO: 127733 - DNA, 103 bp, Artificial Sequence
  Synthetic Polynucleotide
taatacgactcactatagggcctcggccttgccaccagctgcgccagcaaaacagaggagattgctgatgcagctggtgaacctggcggcagcgcaaaagatg

SEQ ID NO: 127734 - DNA, 103 bp, Artificial Sequence
  Synthetic Polynucleotide
taatacgactcactatagggcccttctccccctcggccttgccaccagctaacagaggagaagctggatgcaaggccgaaacctggcggcagcgcaaaagatg

SEQ ID NO: 127735 - DNA, 103 bp, Artificial Sequence
  Synthetic Polynucleotide
taatacgactcactatagggcgacccacgccccttctccccctcggccttaacagaggagaaaggccatgggggagaagaacctggcggcagcgcaaaagatg

SEQ ID NO: 127736 - DNA, 103 bp, Artificial Sequence
  Synthetic Polynucleotide
taatacgactcactatagggtggtgggcaccgacccacgccccttctcccaacagaggagagggagaatgggcgtgggtaacctggcggcagcgcaaaagatg

SEQ ID NO: 127737 - DNA, 103 bp, Artificial Sequence
  Synthetic Polynucleotide
taatacgactcactatagggcccagggccctggtgggcaccgacccacgcaacagaggagagcgtggatgggtgcccacaacctggcggcagcgcaaaagatg

SEQ ID NO: 127738 - DNA, 103 bp, Artificial Sequence
  Synthetic Polynucleotide
taatacgactcactataggggccctccatgcccagggccctggtgggcacaacagaggagagtgcccatgagggccctgaacctggcggcagcgcaaaagatg

SEQ ID NO: 127739 - DNA, 103 bp, Artificial Sequence
  Synthetic Polynucleotide
taatacgactcactataggggcgtcttgtggccctccatgcccagggcccaacagaggagagggcccatggcatggaggaacctggcggcagcgcaaaagatg

SEQ ID NO: 127740 - DNA, 103 bp, Artificial Sequence
  Synthetic Polynucleotide
taatacgactcactatagggctttcaaggggcgtcttgtggccctccatgaacagaggagacatggaatgccacaagacaacctggcggcagcgcaaaagatg

SEQ ID NO: 127741 - DNA, 103 bp, Artificial Sequence
  Synthetic Polynucleotide
taatacgactcactataggggctctccgtcctttcaaggggcgtcttgtgaacagaggagacacaagatgccccttgaaaacctggcggcagcgcaaaagatg

SEQ ID NO: 127742 - DNA, 103 bp, Artificial Sequence
  Synthetic Polynucleotide
taatacgactcactatagggagcctggagagccaggtgtggggctgtcataacagaggagaatgacaatgccacacctgaacctggcggcagcgcaaaagatg

SEQ ID NO: 127743 - DNA, 103 bp, Artificial Sequence
  Synthetic Polynucleotide
taatacgactcactataggggggagcagctgctctccgtcctttcaagggaacagaggagacccttgatgggacggagaaacctggcggcagcgcaaaagatg

SEQ ID NO: 127744 - DNA, 103 bp, Artificial Sequence
  Synthetic Polynucleotide
taatacgactcactataggggggcttggccgggagcagctgctctccgtcaacagaggagagacggaatgcagctgctcaacctggcggcagcgcaaaagatg

SEQ ID NO: 127745 - DNA, 103 bp, Artificial Sequence
  Synthetic Polynucleotide
taatacgactcactataggggagtccatcggggcttggccgggagcagctaacagaggagaagctgcatgcggccaagcaacctggcggcagcgcaaaagatg

SEQ ID NO: 127746 - DNA, 103 bp, Artificial Sequence
  Synthetic Polynucleotide
taatacgactcactataggggcagcagggggagtccatcggggcttggccaacagaggagaggccaaatgccgatggacaacctggcggcagcgcaaaagatg

SEQ ID NO: 127747 - DNA, 103 bp, Artificial Sequence
  Synthetic Polynucleotide
taatacgactcactatagggacggtgcctggcagcagggggagtccatcgaacagaggagacgatggatgccccctgctaacctggcggcagcgcaaaagatg

SEQ ID NO: 127748 - DNA, 103 bp, Artificial Sequence
  Synthetic Polynucleotide
taatacgactcactatagggcaggtccagcacggtgcctggcagcaggggaacagaggagacccctgatgccaggcaccaacctggcggcagcgcaaaagatg

SEQ ID NO: 127749 - DNA, 103 bp, Artificial Sequence
  Synthetic Polynucleotide
taatacgactcactatagggcgcccgtggacaggtccagcacggtgcctgaacagaggagacaggcaatgtgctggaccaacctggcggcagcgcaaaagatg

SEQ ID NO: 127750 - DNA, 103 bp, Artificial Sequence
  Synthetic Polynucleotide
taatacgactcactataggggctgagttgacgcccgtggacaggtccagcaacagaggagagctggaatggtccacgggaacctggcggcagcgcaaaagatg

SEQ ID NO: 127751 - DNA, 103 bp, Artificial Sequence
  Synthetic Polynucleotide
taatacgactcactataggggctgctggcagctgagttgacgcccgtggaaacagaggagatccacgatggtcaactcaaacctggcggcagcgcaaaagatg

SEQ ID NO: 127752 - DNA, 103 bp, Artificial Sequence
  Synthetic Polynucleotide
taatacgactcactatagggacgcctctgggctgctggcagctgagttgaaacagaggagatcaactatgctgccagcaaacctggcggcagcgcaaaagatg

SEQ ID NO: 127753 - DNA, 103 bp, Artificial Sequence
  Synthetic Polynucleotide
taatacgactcactataggggagggcggggagcctggagagccaggtgtgaacagaggagacacaccatgctctccaggaacctggcggcagcgcaaaagatg

SEQ ID NO: 127754 - DNA, 103 bp, Artificial Sequence
  Synthetic Polynucleotide
taatacgactcactatagggccaggggccaacgcctctgggctgctggcaaacagaggagatgccagatgcccagaggcaacctggcggcagcgcaaaagatg

SEQ ID NO: 127755 - DNA, 103 bp, Artificial Sequence
  Synthetic Polynucleotide
taatacgactcactataggggaccacccagccaggggccaacgcctctggaacagaggagaccagagatgttggcccctaacctggcggcagcgcaaaagatg

SEQ ID NO: 127756 - DNA, 103 bp, Artificial Sequence
  Synthetic Polynucleotide
taatacgactcactatagggccggcgggatgaccacccagccaggggccaaacagaggagatggcccatggctgggtggaacctggcggcagcgcaaaagatg

SEQ ID NO: 127757 - DNA, 103 bp, Artificial Sequence
  Synthetic Polynucleotide
taatacgactcactatagggagcaccgagcccggcgggatgaccacccagaacagaggagactgggtatgcatcccgccaacctggcggcagcgcaaaagatg

SEQ ID NO: 127758 - DNA, 103 bp, Artificial Sequence
  Synthetic Polynucleotide
taatacgactcactatagggcggtttgagcagcaccgagcccggcgggataacagaggagaatcccgatgggctcggtgaacctggcggcagcgcaaaagatg

SEQ ID NO: 127759 - DNA, 103 bp, Artificial Sequence
  Synthetic Polynucleotide
taatacgactcactatagggtcaccacagccggtttgagcagcaccgagcaacagaggagagctcggatgtgctcaaacaacctggcggcagcgcaaaagatg

SEQ ID NO: 127760 - DNA, 103 bp, Artificial Sequence
  Synthetic Polynucleotide
taatacgactcactatagggcaggaagcctgagggcggggagcctggagaaacagaggagatctccaatgtccccgcccaacctggcggcagcgcaaaagatg

SEQ ID NO: 127761 - DNA, 103 bp, Artificial Sequence
  Synthetic Polynucleotide
taatacgactcactatagggtggagttcagcaggaagcctgagggcggggaacagaggagaccccgcatgcaggcttccaacctggcggcagcgcaaaagatg

SEQ ID NO: 127762 - DNA, 103 bp, Artificial Sequence
  Synthetic Polynucleotide
taatacgactcactatagggtcggggaacttggagttcagcaggaagcctaacagaggagaaggcttatggctgaactcaacctggcggcagcgcaaaagatg

SEQ ID NO: 127763 - DNA, 103 bp, Artificial Sequence
  Synthetic Polynucleotide
taatacgactcactatagggctccaccttctcggggaacttggagttcagaacagaggagactgaacatgaagttccccaacctggcggcagcgcaaaagatg

SEQ ID NO: 127764 - DNA, 103 bp, Artificial Sequence
  Synthetic Polynucleotide
taatacgactcactatagggtactcagcttcaggtcgagcggctcgtccaaacagaggagatggacgatgcgctcgaccaacctggcggcagcgcaaaagatg

SEQ ID NO: 127765 - DNA, 103 bp, Artificial Sequence
  Synthetic Polynucleotide
taatacgactcactatagggaaaagcgtccctccaccttctcggggaactaacagaggagaagttccatgagaaggtggaacctggcggcagcgcaaaagatg

SEQ ID NO: 127766 - DNA, 103 bp, Artificial Sequence
  Synthetic Polynucleotide
taatacgactcactatagggggggctgctgaaaagcgtccctccaccttcaacagaggagagaaggtatggggacgcttaacctggcggcagcgcaaaagatg

SEQ ID NO: 127767 - DNA, 103 bp, Artificial Sequence
  Synthetic Polynucleotide
taatacgactcactataggggtccacgagaggggctgctgaaaagcgtccaacagaggagaggacgcatgtcagcagccaacctggcggcagcgcaaaagatg

SEQ ID NO: 127768 - DNA, 103 bp, Artificial Sequence
  Synthetic Polynucleotide
taatacgactcactatagggacaggctgaggtccacgagaggggctgctgaacagaggagacagcagatgctctcgtggaacctggcggcagcgcaaaagatg

SEQ ID NO: 127769 - DNA, 103 bp, Artificial Sequence
  Synthetic Polynucleotide
taatacgactcactataggggatggtggtgacaggctgaggtccacgagaaacagaggagatctcgtatgcctcagcctaacctggcggcagcgcaaaagatg

SEQ ID NO: 127770 - DNA, 103 bp, Artificial Sequence
  Synthetic Polynucleotide
taatacgactcactataggggtccagcccagatggtggtgacaggctgagaacagaggagactcagcatgtcaccaccaaacctggcggcagcgcaaaagatg

SEQ ID NO: 127771 - DNA, 103 bp, Artificial Sequence
  Synthetic Polynucleotide
taatacgactcactatagggcattgggggagtccagcccagatggtggtgaacagaggagacaccacatgctgggctggaacctggcggcagcgcaaaagatg

SEQ ID NO: 127772 - DNA, 103 bp, Artificial Sequence
  Synthetic Polynucleotide
taatacgactcactataggggagctgctgccattgggggagtccagcccaaacagaggagatgggctatgctcccccaaaacctggcggcagcgcaaaagatg

SEQ ID NO: 127773 - DNA, 103 bp, Artificial Sequence
  Synthetic Polynucleotide
taatacgactcactataggggggggacagcgagctgctgccattgggggaaacagaggagatcccccatgggcagcagcaacctggcggcagcgcaaaagatg

SEQ ID NO: 127774 - DNA, 103 bp, Artificial Sequence
  Synthetic Polynucleotide
taatacgactcactatagggcctggcgctcgggggacagcgagctgctgcaacagaggagagcagcaatgcgctgtcccaacctggcggcagcgcaaaagatg

SEQ ID NO: 127775 - DNA, 103 bp, Artificial Sequence
  Synthetic Polynucleotide
taatacgactcactatagggagcttggtgatactcagcttcaggtcgagcaacagaggagagctcgaatggaagctgagaacctggcggcagcgcaaaagatg

SEQ ID NO: 127776 - DNA, 103 bp, Artificial Sequence
  Synthetic Polynucleotide
taatacgactcactatagggtccccgttgccctggcgctcgggggacagcaacagaggagagctgtcatgcgagcgccaaacctggcggcagcgcaaaagatg

SEQ ID NO: 127777 - DNA, 103 bp, Artificial Sequence
  Synthetic Polynucleotide
taatacgactcactatagggtggaggcaggtccccgttgccctggcgctcaacagaggagagagcgcatgggcaacgggaacctggcggcagcgcaaaagatg

SEQ ID NO: 127778 - DNA, 103 bp, Artificial Sequence
  Synthetic Polynucleotide
taatacgactcactatagggcactgggcactggaggcaggtccccgttgcaacagaggagagcaacgatgacctgcctcaacctggcggcagcgcaaaagatg

SEQ ID NO: 127779 - DNA, 103 bp, Artificial Sequence
  Synthetic Polynucleotide
taatacgactcactatagggaagtccgaggcactgggcactggaggcaggaacagaggagacctgccatgagtgcccagaacctggcggcagcgcaaaagatg

SEQ ID NO: 127780 - DNA, 103 bp, Artificial Sequence
  Synthetic Polynucleotide
taatacgactcactatagggcagtggctggaagtccgaggcactgggcacaacagaggagagtgcccatggcctcggacaacctggcggcagcgcaaaagatg

SEQ ID NO: 127781 - DNA, 103 bp, Artificial Sequence
  Synthetic Polynucleotide
taatacgactcactatagggccaaatagcgcagtggctggaagtccgaggaacagaggagacctcggatgtccagccacaacctggcggcagcgcaaaagatg

SEQ ID NO: 127782 - DNA, 103 bp, Artificial Sequence
  Synthetic Polynucleotide
taatacgactcactataggggggacaccatccaaatagcgcagtggctggaacagaggagaccagccatggcgctatttaacctggcggcagcgcaaaagatg

SEQ ID NO: 127783 - DNA, 103 bp, Artificial Sequence
  Synthetic Polynucleotide
taatacgactcactataggggaaggagctggggacaccatccaaatagcgaacagaggagacgctatatggatggtgtcaacctggcggcagcgcaaaagatg

SEQ ID NO: 127784 - DNA, 103 bp, Artificial Sequence
  Synthetic Polynucleotide
taatacgactcactatagggggaagaactggaaggagctggggacaccataacagaggagaatggtgatgccagctcctaacctggcggcagcgcaaaagatg

SEQ ID NO: 127785 - DNA, 103 bp, Artificial Sequence
  Synthetic Polynucleotide
taatacgactcactatagggccgaggggcaggaagaactggaaggagctgaacagaggagacagctcatgccagttcttaacctggcggcagcgcaaaagatg

SEQ ID NO: 127786 - DNA, 103 bp, Artificial Sequence
  Synthetic Polynucleotide
taatacgactcactatagggtgccgcccggagcttggtgatactcagcttaacagaggagaaagctgatgatcaccaagaacctggcggcagcgcaaaagatg

SEQ ID NO: 127787 - DNA, 103 bp, Artificial Sequence
  Synthetic Polynucleotide
taatacgactcactatagggccccccggagccgaggggcaggaagaactgaacagaggagacagttcatgctgcccctcaacctggcggcagcgcaaaagatg

SEQ ID NO: 127788 - DNA, 103 bp, Artificial Sequence
  Synthetic Polynucleotide
taatacgactcactatagggggtgcagggcccccccggagccgaggggcaaacagaggagatgccccatggctccggggaacctggcggcagcgcaaaagatg

SEQ ID NO: 127789 - DNA, 103 bp, Artificial Sequence
  Synthetic Polynucleotide
taatacgactcactataggggaggcaggcaggtgcagggcccccccggagaacagaggagactccggatgggccctgcaaacctggcggcagcgcaaaagatg

SEQ ID NO: 127790 - DNA, 103 bp, Artificial Sequence
  Synthetic Polynucleotide
taatacgactcactatagggaaggaaggaggaggcaggcaggtgcagggcaacagaggagagccctgatgctgcctgccaacctggcggcagcgcaaaagatg

SEQ ID NO: 127791 - DNA, 103 bp, Artificial Sequence
  Synthetic Polynucleotide
taatacgactcactatagggtgggaggggtaaggaaggaggaggcaggcaaacagaggagatgcctgatgcctccttccaacctggcggcagcgcaaaagatg

SEQ ID NO: 127792 - DNA, 103 bp, Artificial Sequence
  Synthetic Polynucleotide
taatacgactcactatagggcacttgtccttgggaggggtaaggaaggagaacagaggagactccttatgtacccctccaacctggcggcagcgcaaaagatg

SEQ ID NO: 127793 - DNA, 103 bp, Artificial Sequence
  Synthetic Polynucleotide
taatacgactcactatagggtggcgagaggcacttgtccttgggaggggtaacagaggagaacccctatgaaggacaagaacctggcggcagcgcaaaagatg

SEQ ID NO: 127794 - DNA, 103 bp, Artificial Sequence
  Synthetic Polynucleotide
taatacgactcactatagggggggcaggtctggcgagaggcacttgtcctaacagaggagaaggacaatggcctctcgcaacctggcggcagcgcaaaagatg

SEQ ID NO: 127795 - DNA, 103 bp, Artificial Sequence
  Synthetic Polynucleotide
taatacgactcactatagggtgcttgggcaggggcaggtctggcgagaggaacagaggagacctctcatgagacctgccaacctggcggcagcgcaaaagatg

SEQ ID NO: 127796 - DNA, 103 bp, Artificial Sequence
  Synthetic Polynucleotide
taatacgactcactatagggacacaccagctgcttgggcaggggcaggtcaacagaggagagacctgatgctgcccaagaacctggcggcagcgcaaaagatg

SEQ ID NO: 127797 - DNA, 103 bp, Artificial Sequence
  Synthetic Polynucleotide
taatacgactcactataggggcttctctcttgccgcccggagcttggtgaaacagaggagatcaccaatgtccgggcggaacctggcggcagcgcaaaagatg

SEQ ID NO: 127798 - DNA, 103 bp, Artificial Sequence
  Synthetic Polynucleotide
taatacgactcactatagggtggcccagcgacacaccagctgcttgggcaaacagaggagatgcccaatgagctggtgtaacctggcggcagcgcaaaagatg

SEQ ID NO: 127799 - DNA, 103 bp, Artificial Sequence
  Synthetic Polynucleotide
taatacgactcactatagggtggttacacttggcccagcgacacaccagcaacagaggagagctggtatgtcgctgggcaacctggcggcagcgcaaaagatg

SEQ ID NO: 127800 - DNA, 103 bp, Artificial Sequence
  Synthetic Polynucleotide
taatacgactcactatagggctcaaagagctggttacacttggcccagcgaacagaggagacgctggatgaagtgtaacaacctggcggcagcgcaaaagatg

SEQ ID NO: 127801 - DNA, 103 bp, Artificial Sequence
  Synthetic Polynucleotide
taatacgactcactatagggcttgcaggagctcaaagagctggttacactaacagaggagaagtgtaatgagctctttgaacctggcggcagcgcaaaagatg

SEQ ID NO: 127802 - DNA, 103 bp, Artificial Sequence
  Synthetic Polynucleotide
taatacgactcactatagggtccaccaggtcttgcaggagctcaaagagcaacagaggagagctcttatggctcctgcaaacctggcggcagcgcaaaagatg

SEQ ID NO: 127803 - DNA, 103 bp, Artificial Sequence
  Synthetic Polynucleotide
taatacgactcactataggggttgacatggtccaccaggtcttgcaggagaacagaggagactcctgatggacctggtgaacctggcggcagcgcaaaagatg

SEQ ID NO: 127804 - DNA, 103 bp, Artificial Sequence
  Synthetic Polynucleotide
taatacgactcactatagggcatggtaatcgttgacatggtccaccaggtaacagaggagaacctggatgaccatgtcaaacctggcggcagcgcaaaagatg

SEQ ID NO: 127805 - DNA, 103 bp, Artificial Sequence
  Synthetic Polynucleotide
taatacgactcactatagggtcgggcttgacatggtaatcgttgacatggaacagaggagaccatgtatgcgattaccaaacctggcggcagcgcaaaagatg

SEQ ID NO: 127806 - DNA, 103 bp, Artificial Sequence
  Synthetic Polynucleotide
taatacgactcactatagggcgcatccttctcgggcttgacatggtaatcaacagaggagagattacatggtcaagcccaacctggcggcagcgcaaaagatg

SEQ ID NO: 127807 - DNA, 103 bp, Artificial Sequence
  Synthetic Polynucleotide
taatacgactcactatagggagcagtaccccgcatccttctcgggcttgaaacagaggagatcaagcatgagaaggatgaacctggcggcagcgcaaaagatg

SEQ ID NO: 127808 - DNA, 103 bp, Artificial Sequence
  Synthetic Polynucleotide
taatacgactcactataggggtcctctcccgcttctctcttgccgcccggaacagaggagaccgggcatgaagagagaaaacctggcggcagcgcaaaagatg

SEQ ID NO: 127809 - DNA, 103 bp, Artificial Sequence
  Synthetic Polynucleotide
taatacgactcactatagggtcccagtggcagcagtaccccgcatccttcaacagaggagagaaggaatgggggtactgaacctggcggcagcgcaaaagatg

SEQ ID NO: 127810 - DNA, 103 bp, Artificial Sequence
  Synthetic Polynucleotide
taatacgactcactatagggggcgcagccctcccagtggcagcagtacccaacagaggagagggtacatgtgccactggaacctggcggcagcgcaaaagatg

SEQ ID NO: 127811 - DNA, 103 bp, Artificial Sequence
  Synthetic Polynucleotide
taatacgactcactatagggggccatggcgggcgcagccctcccagtggcaacagaggagagccactatgagggctgcgaacctggcggcagcgcaaaagatg

SEQ ID NO: 127812 - DNA, 103 bp, Artificial Sequence
  Synthetic Polynucleotide
taatacgactcactatagggttgaaacctcggccatggcgggcgcagcccaacagaggagagggctgatgccgccatggaacctggcggcagcgcaaaagatg

SEQ ID NO: 127813 - DNA, 103 bp, Artificial Sequence
  Synthetic Polynucleotide
taatacgactcactataggggtacctggcgttgaaacctcggccatggcgaacagaggagacgccatatgcgaggtttcaacctggcggcagcgcaaaagatg

SEQ ID NO: 127814 - DNA, 103 bp, Artificial Sequence
  Synthetic Polynucleotide
taatacgactcactatagggtgagcatcttgtacctggcgttgaaacctcaacagaggagagaggttatgacgccaggtaacctggcggcagcgcaaaagatg

SEQ ID NO: 127815 - DNA, 103 bp, Artificial Sequence
  Synthetic Polynucleotide
taatacgactcactatagggcggatgtggatgagcatcttgtacctggcgaacagaggagacgccagatgcaagatgctaacctggcggcagcgcaaaagatg

SEQ ID NO: 127816 - DNA, 103 bp, Artificial Sequence
  Synthetic Polynucleotide
taatacgactcactatagggggtgtgtgtgcggatgtggatgagcatcttaacagaggagaaagatgatgatccacatcaacctggcggcagcgcaaaagatg

SEQ ID NO: 127817 - DNA, 103 bp, Artificial Sequence
  Synthetic Polynucleotide
taatacgactcactataggggcttctcgttggtgtgtgtgcggatgtggaaacagaggagatccacaatggcacacacaaacctggcggcagcgcaaaagatg

SEQ ID NO: 127818 - DNA, 103 bp, Artificial Sequence
  Synthetic Polynucleotide
taatacgactcactatagggcagcggtgtggcttctcgttggtgtgtgtgaacagaggagacacacaatgcaacgagaaaacctggcggcagcgcaaaagatg

SEQ ID NO: 127819 - DNA, 103 bp, Artificial Sequence
  Synthetic Polynucleotide
taatacgactcactatagggcacacccagcgtcctctcccgcttctctctaacagaggagaagagagatgcgggagaggaacctggcggcagcgcaaaagatg

SEQ ID NO: 127820 - DNA, 103 bp, Artificial Sequence
  Synthetic Polynucleotide
taatacgactcactataggggcaggtcggacagcggtgtggcttctcgttaacagaggagaaacgagatgccacaccgcaacctggcggcagcgcaaaagatg

SEQ ID NO: 127821 - DNA, 103 bp, Artificial Sequence
  Synthetic Polynucleotide
taatacgactcactatagggagctcttgctgcaggtcggacagcggtgtgaacagaggagacacaccatggtccgacctaacctggcggcagcgcaaaagatg

SEQ ID NO: 127822 - DNA, 103 bp, Artificial Sequence
  Synthetic Polynucleotide
taatacgactcactatagggaggcgggagaagctcttgctgcaggtcggaaacagaggagatccgacatgcagcaagagaacctggcggcagcgcaaaagatg

SEQ ID NO: 127823 - DNA, 103 bp, Artificial Sequence
  Synthetic Polynucleotide
taatacgactcactatagggcaggttctccaggcgggagaagctcttgctaacagaggagaagcaagatgttctcccgcaacctggcggcagcgcaaaagatg

SEQ ID NO: 127824 - DNA, 103 bp, Artificial Sequence
  Synthetic Polynucleotide
taatacgactcactatagggtgtggatcttcaggttctccaggcgggagaaacagaggagatctcccatgtggagaaccaacctggcggcagcgcaaaagatg

SEQ ID NO: 127825 - DNA, 103 bp, Artificial Sequence
  Synthetic Polynucleotide
taatacgactcactatagggtgcgaccggttgtggatcttcaggttctccaacagaggagaggagaaatggaagatccaaacctggcggcagcgcaaaagatg

SEQ ID NO: 127826 - DNA, 103 bp, Artificial Sequence
  Synthetic Polynucleotide
taatacgactcactatagggctcacctgtgtgcgaccggttgtggatcttaacagaggagaaagatcatgaaccggtcgaacctggcggcagcgcaaaagatg

SEQ ID NO: 127827 - DNA, 103 bp, Artificial Sequence
  Synthetic Polynucleotide
taatacgactcactatagggcgtagggcttctcacctgtgtgcgaccggtaacagaggagaaccggtatgacacaggtgaacctggcggcagcgcaaaagatg

SEQ ID NO: 127828 - DNA, 103 bp, Artificial Sequence
  Synthetic Polynucleotide
taatacgactcactatagggtaggggcagacgtagggcttctcacctgtgaacagaggagacacaggatggaagccctaaacctggcggcagcgcaaaagatg

SEQ ID NO: 127829 - DNA, 103 bp, Artificial Sequence
  Synthetic Polynucleotide
taatacgactcactataggggcagccctcgtaggggcagacgtagggcttaacagaggagaaagcccatggtctgccccaacctggcggcagcgcaaaagatg

SEQ ID NO: 127830 - DNA, 103 bp, Artificial Sequence
  Synthetic Polynucleotide
taatacgactcactatagggggggccggaccacacccagcgtcctctcccaacagaggagagggagaatgcgctgggtgaacctggcggcagcgcaaaagatg

SEQ ID NO: 127831 - DNA, 103 bp, Artificial Sequence
  Synthetic Polynucleotide
taatacgactcactatagggagcgcttgttgcagccctcgtaggggcagaaacagaggagatctgccatgacgagggctaacctggcggcagcgcaaaagatg

SEQ ID NO: 127832 - DNA, 103 bp, Artificial Sequence
  Synthetic Polynucleotide
taatacgactcactataggggagttggaatagcgcttgttgcagccctcgaacagaggagacgagggatgcaacaagcgaacctggcggcagcgcaaaagatg

SEQ ID NO: 127833 - DNA, 103 bp, Artificial Sequence
  Synthetic Polynucleotide
taatacgactcactataggggcggtcactggagttggaatagcgcttgttaacagaggagaaacaagatgtattccaacaacctggcggcagcgcaaaagatg

SEQ ID NO: 127834 - DNA, 103 bp, Artificial Sequence
  Synthetic Polynucleotide
taatacgactcactatagggtgtgcttaaagcggtcactggagttggaataacagaggagaattccaatgccagtgaccaacctggcggcagcgcaaaagatg

SEQ ID NO: 127835 - DNA, 103 bp, Artificial Sequence
  Synthetic Polynucleotide
taatacgactcactatagggtgggtgcgcgtgtgcttaaagcggtcactgaacagaggagacagtgaatgctttaagcaaacctggcggcagcgcaaaagatg

SEQ ID NO: 127836 - DNA, 103 bp, Artificial Sequence
  Synthetic Polynucleotide
taatacgactcactataggggtccacatagtgggtgcgcgtgtgcttaaaaacagaggagatttaagatgacgcgcaccaacctggcggcagcgcaaaagatg

SEQ ID NO: 127837 - DNA, 103 bp, Artificial Sequence
  Synthetic Polynucleotide
taatacgactcactatagggagtagggcttgtccacatagtgggtgcgcgaacagaggagacgcgcaatgactatgtggaacctggcggcagcgcaaaagatg

SEQ ID NO: 127838 - DNA, 103 bp, Artificial Sequence
  Synthetic Polynucleotide
taatacgactcactatagggatcttgcagtagtagggcttgtccacatagaacagaggagactatgtatgcaagccctaaacctggcggcagcgcaaaagatg

SEQ ID NO: 127839 - DNA, 103 bp, Artificial Sequence
  Synthetic Polynucleotide
taatacgactcactataggggcagccgggcatcttgcagtagtagggcttaacagaggagaaagcccatgtactgcaagaacctggcggcagcgcaaaagatg

SEQ ID NO: 127840 - DNA, 103 bp, Artificial Sequence
  Synthetic Polynucleotide
taatacgactcactatagggagcgcttgtggcagccgggcatcttgcagtaacagaggagaactgcaatgtgcccggctaacctggcggcagcgcaaaagatg

SEQ ID NO: 127841 - DNA, 103 bp, Artificial Sequence
  Synthetic Polynucleotide
taatacgactcactatagggtgcagagcacggggccggaccacacccagcaacagaggagagctgggatgggtccggccaacctggcggcagcgcaaaagatg

SEQ ID NO: 127842 - DNA, 103 bp, Artificial Sequence
  Synthetic Polynucleotide
taatacgactcactataggggggtccgtgtagcgcttgtggcagccgggcaacagaggagagcccggatgccacaagcgaacctggcggcagcgcaaaagatg

SEQ ID NO: 127843 - DNA, 103 bp, Artificial Sequence
  Synthetic Polynucleotide
taatacgactcactatagggcagtgagctggggtccgtgtagcgcttgtgaacagaggagacacaagatgtacacggacaacctggcggcagcgcaaaagatg

SEQ ID NO: 127844 - DNA, 103 bp, Artificial Sequence
  Synthetic Polynucleotide
taatacgactcactatagggtgtgcttgcgcagtgagctggggtccgtgtaacagaggagaacacggatgccagctcacaacctggcggcagcgcaaaagatg

SEQ ID NO: 127845 - DNA, 103 bp, Artificial Sequence
  Synthetic Polynucleotide
taatacgactcactatagggtgggccttgatgtgcttgcgcagtgagctgaacagaggagacagctcatggcgcaagcaaacctggcggcagcgcaaaagatg

SEQ ID NO: 127846 - DNA, 103 bp, Artificial Sequence
  Synthetic Polynucleotide
taatacgactcactatagggaaagtggccatgggccttgatgtgcttgcgaacagaggagacgcaagatgatcaaggccaacctggcggcagcgcaaaagatg

SEQ ID NO: 127847 - DNA, 103 bp, Artificial Sequence
  Synthetic Polynucleotide
taatacgactcactatagggcgtgggacacaaagtggccatgggccttgaaacagaggagatcaaggatgatggccactaacctggcggcagcgcaaaagatg

SEQ ID NO: 127848 - DNA, 103 bp, Artificial Sequence
  Synthetic Polynucleotide
taatacgactcactatagggtcttgctgctcgtgggacacaaagtggccaaacagaggagatggccaatgtgtgtcccaaacctggcggcagcgcaaaagatg

SEQ ID NO: 127849 - DNA, 103 bp, Artificial Sequence
  Synthetic Polynucleotide
taatacgactcactatagggctgcaggagctcttgctgctcgtgggacacaacagaggagagtgtccatggagcagcaaaacctggcggcagcgcaaaagatg

SEQ ID NO: 127850 - DNA, 103 bp, Artificial Sequence
  Synthetic Polynucleotide
taatacgactcactataggggtgggcgcagctgcaggagctcttgctgctaacagaggagaagcagcatgagctcctgcaacctggcggcagcgcaaaagatg

SEQ ID NO: 127851 - DNA, 103 bp, Artificial Sequence
  Synthetic Polynucleotide
taatacgactcactatagggggcttggggggtgggcgcagctgcaggagcaacagaggagagctcctatggctgcgcccaacctggcggcagcgcaaaagatg

SEQ ID NO: 127852 - DNA, 103 bp, Artificial Sequence
  Synthetic Polynucleotide
taatacgactcactatagggaccccaggtgcactccacagagccgcgcataacagaggagaatgcgcatgtctgtggagaacctggcggcagcgcaaaagatg

SEQ ID NO: 127853 - DNA, 103 bp, Artificial Sequence
  Synthetic Polynucleotide
taatacgactcactatagggctggcgggtcttctcccccagcaggccaaaaacagaggagatttggcatgctgggggagaacctggcggcagcgcaaaagatg

SEQ ID NO: 127854 - DNA, 103 bp, Artificial Sequence
  Synthetic Polynucleotide
taatacgactcactatagggtgtggaagccccgaacgtcagattgaaggcaacagaggagagccttcatgctgacgttcaacctggcggcagcgcaaaagatg

SEQ ID NO: 127855 - DNA, 103 bp, Artificial Sequence
  Synthetic Polynucleotide
taatacgactcactatagggagccagggcctgtggaagccccgaacgtcaaacagaggagatgacgtatggggcttccaaacctggcggcagcgcaaaagatg

SEQ ID NO: 127856 - DNA, 103 bp, Artificial Sequence
  Synthetic Polynucleotide
taatacgactcactatagggtggtcccaatagccagggcctgtggaagccaacagaggagaggcttcatgaggccctggaacctggcggcagcgcaaaagatg

SEQ ID NO: 127857 - DNA, 103 bp, Artificial Sequence
  Synthetic Polynucleotide
taatacgactcactataggggaggtagtgttggtcccaatagccagggccaacagaggagaggccctatgtattgggacaacctggcggcagcgcaaaagatg

SEQ ID NO: 127858 - DNA, 103 bp, Artificial Sequence
  Synthetic Polynucleotide
taatacgactcactatagggtcgaccagctgaggtagtgttggtcccaataacagaggagaattgggatgaacactaccaacctggcggcagcgcaaaagatg

SEQ ID NO: 127859 - DNA, 103 bp, Artificial Sequence
  Synthetic Polynucleotide
taatacgactcactatagggcccaggagcatcgaccagctgaggtagtgtaacagaggagaacactaatgcagctggtcaacctggcggcagcgcaaaagatg

SEQ ID NO: 127860 - DNA, 103 bp, Artificial Sequence
  Synthetic Polynucleotide
taatacgactcactataggggaagcccacacccaggagcatcgaccagctaacagaggagaagctggatgatgctcctgaacctggcggcagcgcaaaagatg

SEQ ID NO: 127861 - DNA, 103 bp, Artificial Sequence
  Synthetic Polynucleotide
taatacgactcactatagggccactggagggaagcccacacccaggagcaaacagaggagatgctccatggtgtgggctaacctggcggcagcgcaaaagatg

SEQ ID NO: 127862 - DNA, 103 bp, Artificial Sequence
  Synthetic Polynucleotide
taatacgactcactataggggacaagccgtccactggagggaagcccacaaacagaggagatgtgggatgccctccagtaacctggcggcagcgcaaaagatg

SEQ ID NO: 127863 - DNA, 103 bp, Artificial Sequence
  Synthetic Polynucleotide
taatacgactcactataggggactagtggggacaagccgtccactggaggaacagaggagacctccaatggacggcttgaacctggcggcagcgcaaaagatg

SEQ ID NO: 127864 - DNA, 103 bp, Artificial Sequence
  Synthetic Polynucleotide
taatacgactcactatagggccagagacacctggcgggtcttctcccccaaacagaggagatgggggatgagacccgccaacctggcggcagcgcaaaagatg

SEQ ID NO: 127865 - DNA, 103 bp, Artificial Sequence
  Synthetic Polynucleotide
taatacgactcactatagggtgatgcccaggactagtggggacaagccgtaacagaggagaacggctatgccccactagaacctggcggcagcgcaaaagatg

SEQ ID NO: 127866 - DNA, 103 bp, Artificial Sequence
  Synthetic Polynucleotide
taatacgactcactataggggccactgccatgatgcccaggactagtgggaacagaggagacccactatgcctgggcataacctggcggcagcgcaaaagatg

SEQ ID NO: 127867 - DNA, 103 bp, Artificial Sequence
  Synthetic Polynucleotide
taatacgactcactatagggggcacccagggccactgccatgatgcccagaacagaggagactgggcatgatggcagtgaacctggcggcagcgcaaaagatg

SEQ ID NO: 127868 - DNA, 103 bp, Artificial Sequence
  Synthetic Polynucleotide
taatacgactcactatagggtgagccctggggcacccagggccactgccaaacagaggagatggcagatgccctgggtgaacctggcggcagcgcaaaagatg

SEQ ID NO: 127869 - DNA, 103 bp, Artificial Sequence
  Synthetic Polynucleotide
taatacgactcactatagggcctagcagcatgagccctggggcacccaggaacagaggagacctgggatgcccagggctaacctggcggcagcgcaaaagatg

SEQ ID NO: 127870 - DNA, 103 bp, Artificial Sequence
  Synthetic Polynucleotide
taatacgactcactatagggcaagccgccccctagcagcatgagccctggaacagaggagaccagggatgatgctgctaaacctggcggcagcgcaaaagatg

SEQ ID NO: 127871 - DNA, 103 bp, Artificial Sequence
  Synthetic Polynucleotide
taatacgactcactataggggcagcagaaccaagccgccccctagcagcaaacagaggagatgctgcatgggggcggctaacctggcggcagcgcaaaagatg

SEQ ID NO: 127872 - DNA, 103 bp, Artificial Sequence
  Synthetic Polynucleotide
taatacgactcactatagggttgtggtgcagcagcagaaccaagccgcccaacagaggagagggcggatgggttctgctaacctggcggcagcgcaaaagatg

SEQ ID NO: 127873 - DNA, 103 bp, Artificial Sequence
  Synthetic Polynucleotide
taatacgactcactatagggtgagtacttcttgtggtgcagcagcagaacaacagaggagagttctgatgctgcaccacaacctggcggcagcgcaaaagatg

SEQ ID NO: 127874 - DNA, 103 bp, Artificial Sequence
  Synthetic Polynucleotide
taatacgactcactatagggactggtactctgagtacttcttgtggtgcaaacagaggagatgcaccatgagaagtactaacctggcggcagcgcaaaagatg

SEQ ID NO: 127875 - DNA, 103 bp, Artificial Sequence
  Synthetic Polynucleotide
taatacgactcactataggggggatgacctccagagacacctggcgggtcaacagaggagagacccgatgggtgtctctaacctggcggcagcgcaaaagatg

SEQ ID NO: 127876 - DNA, 103 bp, Artificial Sequence
  Synthetic Polynucleotide
taatacgactcactatagggtaatttatggactggtactctgagtacttcaacagaggagagaagtaatgagagtaccaaacctggcggcagcgcaaaagatg

SEQ ID NO: 127877 - DNA, 103 bp, Artificial Sequence
  Synthetic Polynucleotide
taatacgactcactatagggcagccagttagggatgacctccagagacacaacagaggagagtgtctatggaggtcatcaacctggcggcagcgcaaaagatg

SEQ ID NO: 127878 - DNA, 103 bp, Artificial Sequence
  Synthetic Polynucleotide
taatacgactcactataggggcagggggcccagccagttagggatgacctaacagaggagaaggtcaatgctaactggcaacctggcggcagcgcaaaagatg

SEQ ID NO: 127879 - DNA, 103 bp, Artificial Sequence
  Synthetic Polynucleotide
taatacgactcactatagggagcaggttctgcagggggcccagccagttaaacagaggagataactgatggggccccctaacctggcggcagcgcaaaagatg

SEQ ID NO: 127880 - DNA, 103 bp, Artificial Sequence
  Synthetic Polynucleotide
taatacgactcactatagggccgtatatgaagcaggttctgcagggggccaacagaggagaggccccatgcagaacctgaacctggcggcagcgcaaaagatg

SEQ ID NO: 127881 - DNA, 103 bp, Artificial Sequence
  Synthetic Polynucleotide
taatacgactcactatagggtgcccactgcccgtatatgaagcaggttctaacagaggagaagaaccatgttcatatacaacctggcggcagcgcaaaagatg

SEQ ID NO: 127882 - DNA, 103 bp, Artificial Sequence
  Synthetic Polynucleotide
taatacgactcactataggggtggaattggtgcccactgcccgtatatgaaacagaggagatcatatatgggcagtgggaacctggcggcagcgcaaaagatg

SEQ ID NO: 127883 - DNA, 103 bp, Artificial Sequence
  Synthetic Polynucleotide
taatacgactcactatagggatagtgcagtgtggaattggtgcccactgcaacagaggagagcagtgatgaccaattccaacctggcggcagcgcaaaagatg

SEQ ID NO: 127884 - DNA, 103 bp, Artificial Sequence
  Synthetic Polynucleotide
taatacgactcactatagggagtgcccccaaccccaggtgcactccacagaacagaggagactgtggatggcacctgggaacctggcggcagcgcaaaagatg

SEQ ID NO: 127885 - DNA, 103 bp, Artificial Sequence
  Synthetic Polynucleotide
taatacgactcactatagggtgctccacacatagtgcagtgtggaattggaacagaggagaccaattatgcactgcactaacctggcggcagcgcaaaagatg

SEQ ID NO: 127886 - DNA, 103 bp, Artificial Sequence
  Synthetic Polynucleotide
taatacgactcactatagggggccccaggctgctccacacatagtgcagtaacagaggagaactgcaatgtgtgtggagaacctggcggcagcgcaaaagatg

SEQ ID NO: 127887 - DNA, 103 bp, Artificial Sequence
  Synthetic Polynucleotide
taatacgactcactatagggcactgccagaggccccaggctgctccacacaacagaggagagtgtggatgagcctggggaacctggcggcagcgcaaaagatg

SEQ ID NO: 127888 - DNA, 103 bp, Artificial Sequence
  Synthetic Polynucleotide
taatacgactcactatagggccaccattaccactgccagaggccccaggcaacagaggagagcctggatgctctggcagaacctggcggcagcgcaaaagatg

SEQ ID NO: 127889 - DNA, 103 bp, Artificial Sequence
  Synthetic Polynucleotide
taatacgactcactataggggtgttggtggccaccattaccactgccagaaacagaggagatctggcatgggtaatggtaacctggcggcagcgcaaaagatg

SEQ ID NO: 127890 - DNA, 103 bp, Artificial Sequence
  Synthetic Polynucleotide
taatacgactcactataggggctgtggggggtgttggtggccaccattacaacagaggagagtaatgatggccaccaacaacctggcggcagcgcaaaagatg

SEQ ID NO: 127891 - DNA, 103 bp, Artificial Sequence
  Synthetic Polynucleotide
taatacgactcactatagggcgctcagggtgctgtggggggtgttggtggaacagaggagaccaccaatgccccccacaaacctggcggcagcgcaaaagatg

SEQ ID NO: 127892 - DNA, 103 bp, Artificial Sequence
  Synthetic Polynucleotide
taatacgactcactatagggctccagttgacgctcagggtgctgtgggggaacagaggagacccccaatgcaccctgagaacctggcggcagcgcaaaagatg

SEQ ID NO: 127893 - DNA, 103 bp, Artificial Sequence
  Synthetic Polynucleotide
taatacgactcactatagggtagcaggaggctccagttgacgctcagggtaacagaggagaaccctgatggtcaactggaacctggcggcagcgcaaaagatg

SEQ ID NO: 127894 - DNA, 103 bp, Artificial Sequence
  Synthetic Polynucleotide
taatacgactcactataggggctcaggggatagcaggaggctccagttgaaacagaggagatcaactatggcctcctgcaacctggcggcagcgcaaaagatg

SEQ ID NO: 127895 - DNA, 103 bp, Artificial Sequence
  Synthetic Polynucleotide
taatacgactcactatagggctgggggcacagtgcccccaaccccaggtgaacagaggagacacctgatgttgggggcaaacctggcggcagcgcaaaagatg

SEQ ID NO: 127896 - DNA, 103 bp, Artificial Sequence
  Synthetic Polynucleotide
taatacgactcactatagggcccccatcgggctcaggggatagcaggaggaacagaggagacctcctatgatcccctgaaacctggcggcagcgcaaaagatg

SEQ ID NO: 127897 - DNA, 103 bp, Artificial Sequence
  Synthetic Polynucleotide
taatacgactcactatagggcaccatcaggcccccatcgggctcaggggaaacagaggagatcccctatgcccgatgggaacctggcggcagcgcaaaagatg

SEQ ID NO: 127898 - DNA, 103 bp, Artificial Sequence
  Synthetic Polynucleotide
taatacgactcactatagggccttagggagcaccatcaggcccccatcggaacagaggagaccgatgatggcctgatggaacctggcggcagcgcaaaagatg

SEQ ID NO: 127899 - DNA, 103 bp, Artificial Sequence
  Synthetic Polynucleotide
taatacgactcactatagggtgaatgctgtccttagggagcaccatcaggaacagaggagacctgatatggctccctaaaacctggcggcagcgcaaaagatg

SEQ ID NO: 127900 - DNA, 103 bp, Artificial Sequence
  Synthetic Polynucleotide
taatacgactcactatagggagaagaaaactgaatgctgtccttagggagaacagaggagactccctatggacagcattaacctggcggcagcgcaaaagatg

SEQ ID NO: 127901 - DNA, 103 bp, Artificial Sequence
  Synthetic Polynucleotide
taatacgactcactatagggaaacaagggcagaagaaaactgaatgctgtaacagaggagaacagcaatgagttttcttaacctggcggcagcgcaaaagatg

SEQ ID NO: 127902 - DNA, 103 bp, Artificial Sequence
  Synthetic Polynucleotide
taatacgactcactatagggagcctggtaaaaacaagggcagaagaaaacaacagaggagagttttcatgtgcccttgtaacctggcggcagcgcaaaagatg

SEQ ID NO: 127903 - DNA, 103 bp, Artificial Sequence
  Synthetic Polynucleotide
taatacgactcactatagggaaactcaagcagcctggtaaaaacaagggcaacagaggagagcccttatgtttaccaggaacctggcggcagcgcaaaagatg

SEQ ID NO: 127904 - DNA, 103 bp, Artificial Sequence
  Synthetic Polynucleotide
taatacgactcactatagggtggtgctgtcaaactcaagcagcctggtaaaacagaggagattaccaatgtgcttgagtaacctggcggcagcgcaaaagatg

SEQ ID NO: 127905 - DNA, 103 bp, Artificial Sequence
  Synthetic Polynucleotide
taatacgactcactatagggtcggacacgttggtgctgtcaaactcaagcaacagaggagagcttgaatgtgacagcacaacctggcggcagcgcaaaagatg

SEQ ID NO: 127906 - DNA, 103 bp, Artificial Sequence
  Synthetic Polynucleotide
taatacgactcactataggggagcagggggctgggggcacagtgcccccaaacagaggagatgggggatgtgtgcccccaacctggcggcagcgcaaaagatg

SEQ ID NO: 127907 - DNA, 103 bp, Artificial Sequence
  Synthetic Polynucleotide
taatacgactcactatagggtgctgccgtatcggacacgttggtgctgtcaacagaggagagacagcatgaacgtgtccaacctggcggcagcgcaaaagatg

SEQ ID NO: 127908 - DNA, 103 bp, Artificial Sequence
  Synthetic Polynucleotide
taatacgactcactatagggccaaaggctttgctgccgtatcggacacgtaacagaggagaacgtgtatgatacggcagaacctggcggcagcgcaaaagatg

SEQ ID NO: 127909 - DNA, 103 bp, Artificial Sequence
  Synthetic Polynucleotide
taatacgactcactatagggtatggtcttcccaaaggctttgctgccgtaaacagaggagatacggcatgaaagcctttaacctggcggcagcgcaaaagatg

SEQ ID NO: 127910 - DNA, 103 bp, Artificial Sequence
  Synthetic Polynucleotide
taatacgactcactataggggtatggaggatatggtcttcccaaaggcttaacagaggagaaagcctatgggaagaccaaacctggcggcagcgcaaaagatg

SEQ ID NO: 127911 - DNA, 103 bp, Artificial Sequence
  Synthetic Polynucleotide
taatacgactcactatagggcggccaaggagtatggaggatatggtcttcaacagaggagagaagacatgatcctccataacctggcggcagcgcaaaagatg

SEQ ID NO: 127912 - DNA, 103 bp, Artificial Sequence
  Synthetic Polynucleotide
taatacgactcactatagggcaagagaaatcggccaaggagtatggaggaaacagaggagatcctccatgctccttggcaacctggcggcagcgcaaaagatg

SEQ ID NO: 127913 - DNA, 103 bp, Artificial Sequence
  Synthetic Polynucleotide
taatacgactcactataggggatgttgttccaagagaaatcggccaaggaaacagaggagatccttgatggatttctctaacctggcggcagcgcaaaagatg

SEQ ID NO: 127914 - DNA, 103 bp, Artificial Sequence
  Synthetic Polynucleotide
taatacgactcactatagggatgaatcagtgatgttgttccaagagaaataacagaggagaatttctatgggaacaacaaacctggcggcagcgcaaaagatg

SEQ ID NO: 127915 - DNA, 103 bp, Artificial Sequence
  Synthetic Polynucleotide
taatacgactcactataggggcaggatccaatgaatcagtgatgttgttcaacagaggagagaacaaatgcactgattcaacctggcggcagcgcaaaagatg

SEQ ID NO: 127916 - DNA, 103 bp, Artificial Sequence
  Synthetic Polynucleotide
taatacgactcactatagggactcagggtggcaggatccaatgaatcagtaacagaggagaactgatatgttggatcctaacctggcggcagcgcaaaagatg

SEQ ID NO: 127917 - DNA, 103 bp, Artificial Sequence
  Synthetic Polynucleotide
taatacgactcactataggggagtccaaaggagcagggggctgggggcacaacagaggagagtgcccatggccccctgcaacctggcggcagcgcaaaagatg

SEQ ID NO: 127918 - DNA, 103 bp, Artificial Sequence
  Synthetic Polynucleotide
taatacgactcactataggggaaatgtggcactcagggtggcaggatccaaacagaggagatggatcatgccaccctgaaacctggcggcagcgcaaaagatg

SEQ ID NO: 127919 - DNA, 103 bp, Artificial Sequence
  Synthetic Polynucleotide
taatacgactcactataggggggtggccttgaaatgtggcactcagggtgaacagaggagacaccctatgtgccacattaacctggcggcagcgcaaaagatg

SEQ ID NO: 127920 - DNA, 103 bp, Artificial Sequence
  Synthetic Polynucleotide
taatacgactcactataggggtcgttcatggggtggccttgaaatgtggcaacagaggagagccacaatgcaaggccacaacctggcggcagcgcaaaagatg

SEQ ID NO: 127921 - DNA, 103 bp, Artificial Sequence
  Synthetic Polynucleotide
taatacgactcactatagggtcctggtagggtcgttcatggggtggccttaacagaggagaaaggccatgccatgaacgaacctggcggcagcgcaaaagatg

SEQ ID NO: 127922 - DNA, 103 bp, Artificial Sequence
  Synthetic Polynucleotide
taatacgactcactatagggttggcaaaagtcctggtagggtcgttcatgaacagaggagacatgaaatgccctaccagaacctggcggcagcgcaaaagatg

SEQ ID NO: 127923 - DNA, 103 bp, Artificial Sequence
  Synthetic Polynucleotide
taatacgactcactatagggcaggctgccattggcaaaagtcctggtaggaacagaggagacctaccatgacttttgccaacctggcggcagcgcaaaagatg

SEQ ID NO: 127924 - DNA, 103 bp, Artificial Sequence
  Synthetic Polynucleotide
taatacgactcactatagggccctgaaggccaggctgccattggcaaaagaacagaggagacttttgatgatggcagccaacctggcggcagcgcaaaagatg

SEQ ID NO: 127925 - DNA, 103 bp, Artificial Sequence
  Synthetic Polynucleotide
taatacgactcactatagggaaggcctggaccctgaaggccaggctgccaaacagaggagatggcagatgggccttcagaacctggcggcagcgcaaaagatg

SEQ ID NO: 127926 - DNA, 103 bp, Artificial Sequence
  Synthetic Polynucleotide
taatacgactcactatagggggacctggaaaaggcctggaccctgaaggcaacagaggagagccttcatggtccaggccaacctggcggcagcgcaaaagatg

SEQ ID NO: 127927 - DNA, 103 bp, Artificial Sequence
  Synthetic Polynucleotide
taatacgactcactatagggctggtcggctggacctggaaaaggcctggaaacagaggagatccaggatgtttccaggtaacctggcggcagcgcaaaagatg

SEQ ID NO: 127928 - DNA, 103 bp, Artificial Sequence
  Synthetic Polynucleotide
taatacgactcactatagggaacagaagtagagtccaaaggagcagggggaacagaggagaccccctatgcctttggacaacctggcggcagcgcaaaagatg

SEQ ID NO: 127929 - DNA, 103 bp, Artificial Sequence
  Synthetic Polynucleotide
taatacgactcactataggggggggttgggctggtcggctggacctggaaaacagaggagattccagatgcagccgaccaacctggcggcagcgcaaaagatg

SEQ ID NO: 127930 - DNA, 103 bp, Artificial Sequence
  Synthetic Polynucleotide
taatacgactcactatagggcaggaggcgagggggttgggctggtcggctaacagaggagaagccgaatggcccaacccaacctggcggcagcgcaaaagatg

SEQ ID NO: 127931 - DNA, 103 bp, Artificial Sequence
  Synthetic Polynucleotide
taatacgactcactatagggctgctgtgtgcaggaggcgagggggttgggaacagaggagacccaacatgctcgcctccaacctggcggcagcgcaaaagatg

SEQ ID NO: 127932 - DNA, 103 bp, Artificial Sequence
  Synthetic Polynucleotide
taatacgactcactatagggtgacaggtgtctgctgtgtgcaggaggcgaaacagaggagatcgcctatggcacacagcaacctggcggcagcgcaaaagatg

SEQ ID NO: 127933 - DNA, 103 bp, Artificial Sequence
  Synthetic Polynucleotide
taatacgactcactatagggcacctctagctgacaggtgtctgctgtgtgaacagaggagacacacaatggacacctgtaacctggcggcagcgcaaaagatg

SEQ ID NO: 127934 - DNA, 103 bp, Artificial Sequence
  Synthetic Polynucleotide
taatacgactcactatagggcaatcagggccacctctagctgacaggtgtaacagaggagaacacctatgagctagaggaacctggcggcagcgcaaaagatg

SEQ ID NO: 127935 - DNA, 103 bp, Artificial Sequence
  Synthetic Polynucleotide
taatacgactcactatagggggagaggctccaatcagggccacctctagcaacagaggagagctagaatgggccctgataacctggcggcagcgcaaaagatg

SEQ ID NO: 127936 - DNA, 103 bp, Artificial Sequence
  Synthetic Polynucleotide
taatacgactcactataggggtttccccggggagaggctccaatcagggcaacagaggagagccctgatgggagcctctaacctggcggcagcgcaaaagatg

SEQ ID NO: 127937 - DNA, 103 bp, Artificial Sequence
  Synthetic Polynucleotide
taatacgactcactatagggacagggaacggtttccccggggagaggctcaacagaggagagagcctatgcccggggaaaacctggcggcagcgcaaaagatg

SEQ ID NO: 127938 - DNA, 103 bp, Artificial Sequence
  Synthetic Polynucleotide
taatacgactcactatagggtccagcccaaacagggaacggtttccccggaacagaggagaccggggatgccgttccctaacctggcggcagcgcaaaagatg

SEQ ID NO: 127939 - DNA, 103 bp, Artificial Sequence
  Synthetic Polynucleotide
taatacgactcactatagggtggggctgcaaacagaagtagagtccaaagaacagaggagactttggatgctacttctgaacctggcggcagcgcaaaagatg

SEQ ID NO: 127940 - DNA, 103 bp, Artificial Sequence
  Synthetic Polynucleotide
taatacgactcactatagggtgtggctacctccagcccaaacagggaacgaacagaggagacgttccatgtttgggctgaacctggcggcagcgcaaaagatg

SEQ ID NO: 127941 - DNA, 103 bp, Artificial Sequence
  Synthetic Polynucleotide
taatacgactcactatagggcctggcccaatgtggctacctccagcccaaaacagaggagattgggcatgaggtagccaaacctggcggcagcgcaaaagatg

SEQ ID NO: 127942 - DNA, 103 bp, Artificial Sequence
  Synthetic Polynucleotide
taatacgactcactatagggcagtcagggccctggcccaatgtggctaccaacagaggagaggtagcatgattgggccaaacctggcggcagcgcaaaagatg

SEQ ID NO: 127943 - DNA, 103 bp, Artificial Sequence
  Synthetic Polynucleotide
taatacgactcactatagggcattgaggggcagtcagggccctggcccaaaacagaggagattgggcatgggccctgacaacctggcggcagcgcaaaagatg

SEQ ID NO: 127944 - DNA, 103 bp, Artificial Sequence
  Synthetic Polynucleotide
taatacgactcactataggggctgctcctgcattgaggggcagtcagggcaacagaggagagccctgatggcccctcaaaacctggcggcagcgcaaaagatg

SEQ ID NO: 127945 - DNA, 103 bp, Artificial Sequence
  Synthetic Polynucleotide
taatacgactcactatagggtcgatggagtgctgctcctgcattgaggggaacagaggagacccctcatggcaggagcaaacctggcggcagcgcaaaagatg

SEQ ID NO: 127946 - DNA, 103 bp, Artificial Sequence
  Synthetic Polynucleotide
taatacgactcactatagggatattcatcgtcgatggagtgctgctcctgaacagaggagacaggagatgcactccatcaacctggcggcagcgcaaaagatg

SEQ ID NO: 127947 - DNA, 103 bp, Artificial Sequence
  Synthetic Polynucleotide
taatacgactcactatagggcggccggtgcatattcatcgtcgatggagtaacagaggagaactccaatgacgatgaataacctggcggcagcgcaaaagatg

SEQ ID NO: 127948 - DNA, 103 bp, Artificial Sequence
  Synthetic Polynucleotide
taatacgactcactatagggaactggaagacggccggtgcatattcatcgaacagaggagacgatgaatgtgcaccggcaacctggcggcagcgcaaaagatg

SEQ ID NO: 127949 - DNA, 103 bp, Artificial Sequence
  Synthetic Polynucleotide
taatacgactcactatagggtagctggtccaactggaagacggccggtgcaacagaggagagcaccgatggtcttccagaacctggcggcagcgcaaaagatg

SEQ ID NO: 127950 - DNA, 103 bp, Artificial Sequence
  Synthetic Polynucleotide
taatacgactcactataggggcaggccaaatggggctgcaaacagaagtaaacagaggagatacttcatgttgcagcccaacctggcggcagcgcaaaagatg

SEQ ID NO: 127951 - DNA, 103 bp, Artificial Sequence
  Synthetic Polynucleotide
taatacgactcactatagggagccccacagtagctggtccaactggaagaaacagaggagatcttccatgtggaccagcaacctggcggcagcgcaaaagatg

SEQ ID NO: 127952 - DNA, 103 bp, Artificial Sequence
  Synthetic Polynucleotide
taatacgactcactataggggatgggagggagccccacagtagctggtccaacagaggagaggaccaatgactgtggggaacctggcggcagcgcaaaagatg

SEQ ID NO: 127953 - DNA, 103 bp, Artificial Sequence
  Synthetic Polynucleotide
taatacgactcactatagggtgcaaagcctgatgggagggagccccacagaacagaggagactgtggatgtccctcccaaacctggcggcagcgcaaaagatg

SEQ ID NO: 127954 - DNA, 103 bp, Artificial Sequence
  Synthetic Polynucleotide
taatacgactcactataggggtcgccactgtgcaaagcctgatgggagggaacagaggagaccctccatgcaggctttgaacctggcggcagcgcaaaagatg

SEQ ID NO: 127955 - DNA, 103 bp, Artificial Sequence
  Synthetic Polynucleotide
taatacgactcactatagggtaagccactggtcgccactgtgcaaagcctaacagaggagaaggcttatgacagtggcgaacctggcggcagcgcaaaagatg

SEQ ID NO: 127956 - DNA, 103 bp, Artificial Sequence
  Synthetic Polynucleotide
taatacgactcactatagggcttctgggagtaagccactggtcgccactgaacagaggagacagtggatgccagtggctaacctggcggcagcgcaaaagatg

SEQ ID NO: 127957 - DNA, 103 bp, Artificial Sequence
  Synthetic Polynucleotide
taatacgactcactatagggggccccccggcttctgggagtaagccactgaacagaggagacagtggatgactcccagaaacctggcggcagcgcaaaagatg

SEQ ID NO: 127958 - DNA, 103 bp, Artificial Sequence
  Synthetic Polynucleotide
taatacgactcactataggggctgattctcggccccccggcttctgggagaacagaggagactcccaatggccggggggaacctggcggcagcgcaaaagatg

SEQ ID NO: 127959 - DNA, 103 bp, Artificial Sequence
  Synthetic Polynucleotide
taatacgactcactataggggcagggcagggctgattctcggccccccggaacagaggagaccggggatgcgagaatcaaacctggcggcagcgcaaaagatg

SEQ ID NO: 127960 - DNA, 103 bp, Artificial Sequence
  Synthetic Polynucleotide
taatacgactcactataggggggaagcttggcagggcagggctgattctcaacagaggagagagaatatgccctgccctaacctggcggcagcgcaaaagatg

SEQ ID NO: 127961 - DNA, 103 bp, Artificial Sequence
  Synthetic Polynucleotide
taatacgactcactatagggttctcccccagcaggccaaatggggctgcaaacagaggagatgcagcatgatttggcctaacctggcggcagcgcaaaagatg

SEQ ID NO: 127962 - DNA, 103 bp, Artificial Sequence
  Synthetic Polynucleotide
taatacgactcactatagggggatgaagaggggaagcttggcagggcaggaacagaggagacctgccatgccaagcttcaacctggcggcagcgcaaaagatg

SEQ ID NO: 127963 - DNA, 103 bp, Artificial Sequence
  Synthetic Polynucleotide
taatacgactcactatagggtgctaaggcaggatgaagaggggaagcttgaacagaggagacaagctatgcctcttcataacctggcggcagcgcaaaagatg

SEQ ID NO: 127964 - DNA, 103 bp, Artificial Sequence
  Synthetic Polynucleotide
taatacgactcactataggggaagagagtatgctaaggcaggatgaagagaacagaggagactcttcatgctgccttagaacctggcggcagcgcaaaagatg

SEQ ID NO: 127965 - DNA, 103 bp, Artificial Sequence
  Synthetic Polynucleotide
taatacgactcactatagggggtgactggggaagagagtatgctaaggcaaacagaggagatgccttatgatactctctaacctggcggcagcgcaaaagatg

SEQ ID NO: 127966 - DNA, 103 bp, Artificial Sequence
  Synthetic Polynucleotide
taatacgactcactatagggtcggacaatgggtgactggggaagagagtaaacagaggagatactctatgccccagtcaaacctggcggcagcgcaaaagatg

SEQ ID NO: 127967 - DNA, 103 bp, Artificial Sequence
  Synthetic Polynucleotide
taatacgactcactatagggcaaagaaggctcggacaatgggtgactgggaacagaggagacccagtatgccattgtccaacctggcggcagcgcaaaagatg

SEQ ID NO: 127968 - DNA, 103 bp, Artificial Sequence
  Synthetic Polynucleotide
taatacgactcactatagggttctgggacccaaagaaggctcggacaatgaacagaggagacattgtatgagccttcttaacctggcggcagcgcaaaagatg

SEQ ID NO: 127969 - DNA, 103 bp, Artificial Sequence
  Synthetic Polynucleotide
taatacgactcactatagggacagaagttattctgggacccaaagaaggcaacagaggagagccttcatggggtcccagaacctggcggcagcgcaaaagatg

SEQ ID NO: 127970 - DNA, 103 bp, Artificial Sequence
  Synthetic Polynucleotide
taatacgactcactataggggattgaaggcacagaagttattctgggaccaacagaggagaggtcccatgataacttctaacctggcggcagcgcaaaagatg

SEQ ID NO: 127971 - DNA, 103 bp, Artificial Sequence
  Synthetic Polynucleotide
taatacgactcactatagggccgaacgtcagattgaaggcacagaagttaaacagaggagataacttatgtgccttcaaaacctggcggcagcgcaaaagatg

SEQ ID NO: 127972 - DNA, 103 bp, Artificial Sequence
  Synthetic Polynucleotide
taatacgactcactatagggcactgggacactcacttctgcattagccataacagaggagaatggctatggcagaagtgaacctggcggcagcgcaaaagatg

SEQ ID NO: 127973 - DNA, 103 bp, Artificial Sequence
  Synthetic Polynucleotide
taatacgactcactatagggcacaggctgtaactgcaaaatcacttgggtaacagaggagaacccaaatgattttgcagaacctggcggcagcgcaaaagatg

SEQ ID NO: 127974 - DNA, 103 bp, Artificial Sequence
  Synthetic Polynucleotide
taatacgactcactatagggtgtcagagtatagagaaactgttcttctccaacagaggagaggagaaatgcagtttctcaacctggcggcagcgcaaaagatg

SEQ ID NO: 127975 - DNA, 103 bp, Artificial Sequence
  Synthetic Polynucleotide
taatacgactcactataggggttccaagtctgtcagagtatagagaaactaacagaggagaagtttcatgatactctgaaacctggcggcagcgcaaaagatg

SEQ ID NO: 127976 - DNA, 103 bp, Artificial Sequence
  Synthetic Polynucleotide
taatacgactcactatagggtccaactggcgttccaagtctgtcagagtaaacagaggagatactctatgagacttggaaacctggcggcagcgcaaaagatg

SEQ ID NO: 127977 - DNA, 103 bp, Artificial Sequence
  Synthetic Polynucleotide
taatacgactcactatagggcttctgctcctccaactggcgttccaagtcaacagaggagagacttgatgcgccagttgaacctggcggcagcgcaaaagatg

SEQ ID NO: 127978 - DNA, 103 bp, Artificial Sequence
  Synthetic Polynucleotide
taatacgactcactatagggggccttgcttcttctgctcctccaactggcaacagaggagagccagtatgaggagcagaaacctggcggcagcgcaaaagatg

SEQ ID NO: 127979 - DNA, 103 bp, Artificial Sequence
  Synthetic Polynucleotide
taatacgactcactatagggctgtgatcctggccttgcttcttctgctccaacagaggagaggagcaatggaagcaaggaacctggcggcagcgcaaaagatg

SEQ ID NO: 127980 - DNA, 103 bp, Artificial Sequence
  Synthetic Polynucleotide
taatacgactcactatagggagatttcagcctgtgatcctggccttgcttaacagaggagaaagcaaatgcaggatcacaacctggcggcagcgcaaaagatg

SEQ ID NO: 127981 - DNA, 103 bp, Artificial Sequence
  Synthetic Polynucleotide
taatacgactcactataggggaactgtctgagatttcagcctgtgatcctaacagaggagaaggatcatgggctgaaataacctggcggcagcgcaaaagatg

SEQ ID NO: 127982 - DNA, 103 bp, Artificial Sequence
  Synthetic Polynucleotide
taatacgactcactatagggaccacattttgaactgtctgagatttcagcaacagaggagagctgaaatgtcagacagtaacctggcggcagcgcaaaagatg

SEQ ID NO: 127983 - DNA, 103 bp, Artificial Sequence
  Synthetic Polynucleotide
taatacgactcactatagggaggcatcagtaccacattttgaactgtctgaacagaggagacagacaatgcaaaatgtgaacctggcggcagcgcaaaagatg

SEQ ID NO: 127984 - DNA, 103 bp, Artificial Sequence
  Synthetic Polynucleotide
taatacgactcactatagggaaccttgttgcacaggctgtaactgcaaaaaacagaggagattttgcatgtacagcctgaacctggcggcagcgcaaaagatg

SEQ ID NO: 127985 - DNA, 103 bp, Artificial Sequence
  Synthetic Polynucleotide
taatacgactcactataggggagtgctcacaggcatcagtaccacattttaacagaggagaaaaatgatgtactgatgcaacctggcggcagcgcaaaagatg

SEQ ID NO: 127986 - DNA, 103 bp, Artificial Sequence
  Synthetic Polynucleotide
taatacgactcactatagggggaggcttaggagtgctcacaggcatcagtaacagaggagaactgatatgtgtgagcacaacctggcggcagcgcaaaagatg

SEQ ID NO: 127987 - DNA, 103 bp, Artificial Sequence
  Synthetic Polynucleotide
taatacgactcactataggggggcctttttggaggcttaggagtgctcacaacagaggagagtgagcatgcctaagcctaacctggcggcagcgcaaaagatg

SEQ ID NO: 127988 - DNA, 103 bp, Artificial Sequence
  Synthetic Polynucleotide
taatacgactcactataggggctggagccggggcctttttggaggcttagaacagaggagactaagcatgcaaaaaggcaacctggcggcagcgcaaaagatg

SEQ ID NO: 127989 - DNA, 103 bp, Artificial Sequence
  Synthetic Polynucleotide
taatacgactcactataggggaggctggccgctggagccggggcctttttaacagaggagaaaaaagatgccggctccaaacctggcggcagcgcaaaagatg

SEQ ID NO: 127990 - DNA, 103 bp, Artificial Sequence
  Synthetic Polynucleotide
taatacgactcactataggggacagtggtggaggctggccgctggagccgaacagaggagacggctcatgcggccagccaacctggcggcagcgcaaaagatg

SEQ ID NO: 127991 - DNA, 103 bp, Artificial Sequence
  Synthetic Polynucleotide
taatacgactcactatagggaagggctcaagacagtggtggaggctggccaacagaggagaggccagatgccaccactgaacctggcggcagcgcaaaagatg

SEQ ID NO: 127992 - DNA, 103 bp, Artificial Sequence
  Synthetic Polynucleotide
taatacgactcactatagggacaggaggagaagggctcaagacagtggtgaacagaggagacaccacatgcttgagcccaacctggcggcagcgcaaaagatg

SEQ ID NO: 127993 - DNA, 103 bp, Artificial Sequence
  Synthetic Polynucleotide
taatacgactcactatagggaggctgctggacaggaggagaagggctcaaaacagaggagattgagcatgtctcctcctaacctggcggcagcgcaaaagatg

SEQ ID NO: 127994 - DNA, 103 bp, Artificial Sequence
  Synthetic Polynucleotide
taatacgactcactatagggctgtgaactgaggctgctggacaggaggagaacagaggagactcctcatgtccagcagcaacctggcggcagcgcaaaagatg

SEQ ID NO: 127995 - DNA, 103 bp, Artificial Sequence
  Synthetic Polynucleotide
taatacgactcactatagggtcgataaacaaaccttgttgcacaggctgtaacagaggagaacagccatggcaacaaggaacctggcggcagcgcaaaagatg

SEQ ID NO: 127996 - DNA, 103 bp, Artificial Sequence
  Synthetic Polynucleotide
taatacgactcactatagggggtgagatgactgtgaactgaggctgctggaacagaggagaccagcaatgtcagttcacaacctggcggcagcgcaaaagatg

SEQ ID NO: 127997 - DNA, 103 bp, Artificial Sequence
  Synthetic Polynucleotide
taatacgactcactataggggatggtgatgggtgagatgactgtgaactgaacagaggagacagttcatggtcatctcaaacctggcggcagcgcaaaagatg

SEQ ID NO: 127998 - DNA, 103 bp, Artificial Sequence
  Synthetic Polynucleotide
taatacgactcactatagggccactggggtgatggtgatgggtgagatgaaacagaggagatcatctatgccatcaccaaacctggcggcagcgcaaaagatg

SEQ ID NO: 127999 - DNA, 103 bp, Artificial Sequence
  Synthetic Polynucleotide
taatacgactcactatagggaatgactgacccactggggtgatggtgatgaacagaggagacatcacatgcaccccagtaacctggcggcagcgcaaaagatg

SEQ ID NO: 128000 - DNA, 103 bp, Artificial Sequence
  Synthetic Polynucleotide
taatacgactcactataggggcccatggaaaatgactgacccactggggtaacagaggagaaccccaatgggtcagtcaaacctggcggcagcgcaaaagatg

SEQ ID NO: 128001 - DNA, 103 bp, Artificial Sequence
  Synthetic Polynucleotide
taatacgactcactatagggctggaatattgcccatggaaaatgactgacaacagaggagagtcagtatgtttccatggaacctggcggcagcgcaaaagatg

SEQ ID NO: 128002 - DNA, 103 bp, Artificial Sequence
  Synthetic Polynucleotide
taatacgactcactatagggagggtggccactggaatattgcccatggaaaacagaggagattccatatgcaatattccaacctggcggcagcgcaaaagatg

SEQ ID NO: 128003 - DNA, 103 bp, Artificial Sequence
  Synthetic Polynucleotide
taatacgactcactataggggccctggctgagggtggccactggaatattaacagaggagaaatattatggtggccaccaacctggcggcagcgcaaaagatg

SEQ ID NO: 128004 - DNA, 103 bp, Artificial Sequence
  Synthetic Polynucleotide
taatacgactcactatagggcaggactggagccctggctgagggtggccaaacagaggagatggccaatgtcagccaggaacctggcggcagcgcaaaagatg

SEQ ID NO: 128005 - DNA, 103 bp, Artificial Sequence
  Synthetic Polynucleotide
taatacgactcactatagggtggacagtcacaggactggagccctggctgaacagaggagacagccaatgctccagtccaacctggcggcagcgcaaaagatg

SEQ ID NO: 128006 - DNA, 103 bp, Artificial Sequence
  Synthetic Polynucleotide
taatacgactcactatagggaaagtgtccatcgataaacaaaccttgttgaacagaggagacaacaaatgttgtttatcaacctggcggcagcgcaaaagatg

SEQ ID NO: 128007 - DNA, 103 bp, Artificial Sequence
  Synthetic Polynucleotide
taatacgactcactatagggaggcagtgtgtggacagtcacaggactggaaacagaggagatccagtatggtgactgtcaacctggcggcagcgcaaaagatg

SEQ ID NO: 128008 - DNA, 103 bp, Artificial Sequence
  Synthetic Polynucleotide
taatacgactcactataggggagggccagaaggcagtgtgtggacagtcaaacagaggagatgactgatgacacactgcaacctggcggcagcgcaaaagatg

SEQ ID NO: 128009 - DNA, 103 bp, Artificial Sequence
  Synthetic Polynucleotide
taatacgactcactatagggcggaagagctgagggccagaaggcagtgtgaacagaggagacacactatgttctggcccaacctggcggcagcgcaaaagatg

SEQ ID NO: 128010 - DNA, 103 bp, Artificial Sequence
  Synthetic Polynucleotide
taatacgactcactatagggtgtggcatagcggaagagctgagggccagaaacagaggagatctggcatgcagctcttcaacctggcggcagcgcaaaagatg

SEQ ID NO: 128011 - DNA, 103 bp, Artificial Sequence
  Synthetic Polynucleotide
taatacgactcactatagggaggagaccactgtggcatagcggaagagctaacagaggagaagctctatggctatgccaaacctggcggcagcgcaaaagatg

SEQ ID NO: 128012 - DNA, 103 bp, Artificial Sequence
  Synthetic Polynucleotide
taatacgactcactatagggctcttggcagaggagaccactgtggcatagaacagaggagactatgcatgagtggtctcaacctggcggcagcgcaaaagatg

SEQ ID NO: 128013 - DNA, 103 bp, Artificial Sequence
  Synthetic Polynucleotide
taatacgactcactatagggtggtgagctgctcttggcagaggagaccacaacagaggagagtggtcatgtctgccaagaacctggcggcagcgcaaaagatg

SEQ ID NO: 128014 - DNA, 103 bp, Artificial Sequence
  Synthetic Polynucleotide
taatacgactcactatagggtcactgtgtctggtgagctgctcttggcagaacagaggagactgccaatggcagctcacaacctggcggcagcgcaaaagatg

SEQ ID NO: 128015 - DNA, 103 bp, Artificial Sequence
  Synthetic Polynucleotide
taatacgactcactataggggggtggatggtcactgtgtctggtgagctgaacagaggagacagctcatgagacacagtaacctggcggcagcgcaaaagatg

SEQ ID NO: 128016 - DNA, 103 bp, Artificial Sequence
  Synthetic Polynucleotide
taatacgactcactataggggctagatgaagggtggatggtcactgtgtcaacagaggagagacacaatgaccatccacaacctggcggcagcgcaaaagatg

SEQ ID NO: 128017 - DNA, 103 bp, Artificial Sequence
  Synthetic Polynucleotide
taatacgactcactatagggtcctgttgtaaaagtgtccatcgataaacaaacagaggagatgtttaatgatggacactaacctggcggcagcgcaaaagatg

SEQ ID NO: 128018 - DNA, 103 bp, Artificial Sequence
  Synthetic Polynucleotide
taatacgactcactataggggcagcgccaagctagatgaagggtggatggaacagaggagaccatccatgcttcatctaaacctggcggcagcgcaaaagatg

SEQ ID NO: 128019 - DNA, 103 bp, Artificial Sequence
  Synthetic Polynucleotide
taatacgactcactataggggtagagctcagcagcgccaagctagatgaaaacagaggagattcatcatgcttggcgctaacctggcggcagcgcaaaagatg

SEQ ID NO: 128020 - DNA, 103 bp, Artificial Sequence
  Synthetic Polynucleotide
taatacgactcactatagggctgcatggcagtagagctcagcagcgccaaaacagaggagattggcgatgctgagctctaacctggcggcagcgcaaaagatg

SEQ ID NO: 128021 - DNA, 103 bp, Artificial Sequence
  Synthetic Polynucleotide
taatacgactcactatagggtactcccatcctgcatggcagtagagctcaaacagaggagatgagctatgctgccatgcaacctggcggcagcgcaaaagatg

SEQ ID NO: 128022 - DNA, 103 bp, Artificial Sequence
  Synthetic Polynucleotide
taatacgactcactatagggttgcccagtgtactcccatcctgcatggcaaacagaggagatgccatatgggatgggagaacctggcggcagcgcaaaagatg

SEQ ID NO: 128023 - DNA, 103 bp, Artificial Sequence
  Synthetic Polynucleotide
taatacgactcactatagggggtggtcatgttgcccagtgtactcccatcaacagaggagagatgggatgacactgggcaacctggcggcagcgcaaaagatg

SEQ ID NO: 128024 - DNA, 103 bp, Artificial Sequence
  Synthetic Polynucleotide
taatacgactcactatagggggctaaccatggtggtcatgttgcccagtgaacagaggagacactggatgacatgaccaaacctggcggcagcgcaaaagatg

SEQ ID NO: 128025 - DNA, 103 bp, Artificial Sequence
  Synthetic Polynucleotide
taatacgactcactatagggaattccacagggctaaccatggtggtcatgaacagaggagacatgacatgcatggttagaacctggcggcagcgcaaaagatg

SEQ ID NO: 128026 - DNA, 103 bp, Artificial Sequence
  Synthetic Polynucleotide
taatacgactcactatagggcatggccaccaattccacagggctaaccataacagaggagaatggttatgcctgtggaaaacctggcggcagcgcaaaagatg

SEQ ID NO: 128027 - DNA, 103 bp, Artificial Sequence
  Synthetic Polynucleotide
taatacgactcactatagggggccggactccatggccaccaattccacagaacagaggagactgtggatgtggtggccaaacctggcggcagcgcaaaagatg

SEQ ID NO: 128028 - DNA, 103 bp, Artificial Sequence
  Synthetic Polynucleotide
taatacgactcactataggggcttcataaatcctgttgtaaaagtgtccaaacagaggagatggacaatgttacaacagaacctggcggcagcgcaaaagatg

SEQ ID NO: 128029 - DNA, 103 bp, Artificial Sequence
  Synthetic Polynucleotide
taatacgactcactataggggccgaggttaggccggactccatggccaccaacagaggagaggtggcatgggagtccggaacctggcggcagcgcaaaagatg

SEQ ID NO: 128030 - DNA, 103 bp, Artificial Sequence
  Synthetic Polynucleotide
taatacgactcactatagggagcctgaattgccgaggttaggccggactcaacagaggagagagtccatgctaacctcgaacctggcggcagcgcaaaagatg

SEQ ID NO: 128031 - DNA, 103 bp, Artificial Sequence
  Synthetic Polynucleotide
taatacgactcactatagggtgctttcaacagcctgaattgccgaggttaaacagaggagataacctatgcaattcaggaacctggcggcagcgcaaaagatg

SEQ ID NO: 128032 - DNA, 103 bp, Artificial Sequence
  Synthetic Polynucleotide
taatacgactcactatagggtcctctgaggtgctttcaacagcctgaattaacagaggagaaattcaatgtgttgaaagaacctggcggcagcgcaaaagatg

SEQ ID NO: 128033 - DNA, 103 bp, Artificial Sequence
  Synthetic Polynucleotide
taatacgactcactatagggggtctgcccatcctctgaggtgctttcaacaacagaggagagttgaaatgacctcagagaacctggcggcagcgcaaaagatg

SEQ ID NO: 128034 - DNA, 103 bp, Artificial Sequence
  Synthetic Polynucleotide
taatacgactcactatagggtctcaatgatggtctgcccatcctctgaggaacagaggagacctcagatgatgggcagaaacctggcggcagcgcaaaagatg

SEQ ID NO: 128035 - DNA, 103 bp, Artificial Sequence
  Synthetic Polynucleotide
taatacgactcactataggggctggatcaatctcaatgatggtctgcccaaacagaggagatgggcaatgcatcattgaaacctggcggcagcgcaaaagatg

SEQ ID NO: 128036 - DNA, 103 bp, Artificial Sequence
  Synthetic Polynucleotide
taatacgactcactatagggtgggtccggggctggatcaatctcaatgataacagaggagaatcattatgattgatccaaacctggcggcagcgcaaaagatg

SEQ ID NO: 128037 - DNA, 103 bp, Artificial Sequence
  Synthetic Polynucleotide
taatacgactcactatagggcttcagcttctgggtccggggctggatcaaaacagaggagattgatcatgccccggaccaacctggcggcagcgcaaaagatg

SEQ ID NO: 128038 - DNA, 103 bp, Artificial Sequence
  Synthetic Polynucleotide
taatacgactcactatagggccctcagtatcttcagcttctgggtccgggaacagaggagacccggaatgagaagctgaaacctggcggcagcgcaaaagatg

SEQ ID NO: 128039 - DNA, 103 bp, Artificial Sequence
  Synthetic Polynucleotide
taatacgactcactatagggctccgacccagcttcataaatcctgttgtaaacagaggagatacaacatgatttatgaaaacctggcggcagcgcaaaagatg

SEQ ID NO: 128040 - DNA, 103 bp, Artificial Sequence
  Synthetic Polynucleotide
taatacgactcactataggggactgctttgccctcagtatcttcagcttcaacagaggagagaagctatggatactgagaacctggcggcagcgcaaaagatg

SEQ ID NO: 128041 - DNA, 103 bp, Artificial Sequence
  Synthetic Polynucleotide
taatacgactcactatagggtctccaagatgactgctttgccctcagtataacagaggagaatactgatggcaaagcagaacctggcggcagcgcaaaagatg

SEQ ID NO: 128042 - DNA, 103 bp, Artificial Sequence
  Synthetic Polynucleotide
taatacgactcactatagggctcagctctgtctccaagatgactgctttgaacagaggagacaaagcatgcatcttggaaacctggcggcagcgcaaaagatg

SEQ ID NO: 128043 - DNA, 103 bp, Artificial Sequence
  Synthetic Polynucleotide
taatacgactcactatagggctcctcagtcctcagctctgtctccaagataacagaggagaatcttgatgacagagctgaacctggcggcagcgcaaaagatg

SEQ ID NO: 128044 - DNA, 103 bp, Artificial Sequence
  Synthetic Polynucleotide
taatacgactcactatagggccacaactttctcctcagtcctcagctctgaacagaggagacagagcatgggactgaggaacctggcggcagcgcaaaagatg

SEQ ID NO: 128045 - DNA, 103 bp, Artificial Sequence
  Synthetic Polynucleotide
taatacgactcactatagggtccatctcagccacaactttctcctcagtcaacagaggagagactgaatggaaagttgtaacctggcggcagcgcaaaagatg

SEQ ID NO: 128046 - DNA, 103 bp, Artificial Sequence
  Synthetic Polynucleotide
taatacgactcactatagggctggtgttcttccatctcagccacaactttaacagaggagaaaagttatggctgagatgaacctggcggcagcgcaaaagatg

SEQ ID NO: 128047 - DNA, 103 bp, Artificial Sequence
  Synthetic Polynucleotide
taatacgactcactataggggaacttgatgctggtgttcttccatctcagaacagaggagactgagaatgaagaacaccaacctggcggcagcgcaaaagatg

SEQ ID NO: 128048 - DNA, 103 bp, Artificial Sequence
  Synthetic Polynucleotide
taatacgactcactatagggtccacattgtgaacttgatgctggtgttctaacagaggagaagaacaatggcatcaagtaacctggcggcagcgcaaaagatg

SEQ ID NO: 128049 - DNA, 103 bp, Artificial Sequence
  Synthetic Polynucleotide
taatacgactcactataggggaccacaatctccacattgtgaacttgatgaacagaggagacatcaaatgcacaatgtgaacctggcggcagcgcaaaagatg

SEQ ID NO: 128050 - DNA, 103 bp, Artificial Sequence
  Synthetic Polynucleotide
taatacgactcactatagggccgtgttgttctccgacccagcttcataaaaacagaggagatttatgatgctgggtcggaacctggcggcagcgcaaaagatg

SEQ ID NO: 128051 - DNA, 103 bp, Artificial Sequence
  Synthetic Polynucleotide
taatacgactcactatagggaatcctctaagaccacaatctccacattgtaacagaggagaacaatgatgagattgtggaacctggcggcagcgcaaaagatg

SEQ ID NO: 128052 - DNA, 103 bp, Artificial Sequence
  Synthetic Polynucleotide
taatacgactcactataggggctacaactgccgtgttgttctccgacccaaacagaggagatgggtcatggaacaacacaacctggcggcagcgcaaaagatg

SEQ ID NO: 128053 - DNA, 103 bp, Artificial Sequence
  Synthetic Polynucleotide
taatacgactcactatagggagtttctactgctacaactgccgtgttgttaacagaggagaaacaacatggcagttgtaaacctggcggcagcgcaaaagatg

SEQ ID NO: 128054 - DNA, 103 bp, Artificial Sequence
  Synthetic Polynucleotide
taatacgactcactatagggccacatcccccactgggacactcacttctgaacagaggagacagaagatggtgtcccagaacctggcggcagcgcaaaagatg

SEQ ID NO: 128055 - DNA, 103 bp, Artificial Sequence
  Synthetic Polynucleotide
taatacgactcactataggggtatcgtgtgagtttctactgctacaactgaacagaggagacagttgatgcagtagaaaaacctggcggcagcgcaaaagatg

SEQ ID NO: 128056 - DNA, 103 bp, Artificial Sequence
  Synthetic Polynucleotide
taatacgactcactatagggtcaattttgtgtatcgtgtgagtttctactaacagaggagaagtagaatgtcacacgataacctggcggcagcgcaaaagatg

SEQ ID NO: 128057 - DNA, 103 bp, Artificial Sequence
  Synthetic Polynucleotide
taatacgactcactatagggaatcccttcttcaattttgtgtatcgtgtgaacagaggagacacacgatgcacaaaattaacctggcggcagcgcaaaagatg

SEQ ID NO: 128058 - DNA, 103 bp, Artificial Sequence
  Synthetic Polynucleotide
taatacgactcactatagggtgcctgtatcaatcccttcttcaattttgtaacagaggagaacaaaaatgaagaagggaaacctggcggcagcgcaaaagatg

SEQ ID NO: 128059 - DNA, 103 bp, Artificial Sequence
  Synthetic Polynucleotide
taatacgactcactataggggcttctatagtgcctgtatcaatcccttctaacagaggagaagaaggatgtgatacaggaacctggcggcagcgcaaaagatg

SEQ ID NO: 128060 - DNA, 103 bp, Artificial Sequence
  Synthetic Polynucleotide
taatacgactcactatagggatcctcatttgcttctatagtgcctgtatcaacagaggagagatacaatgactatagaaaacctggcggcagcgcaaaagatg

SEQ ID NO: 128061 - DNA, 103 bp, Artificial Sequence
  Synthetic Polynucleotide
taatacgactcactatagggcaatttccatatcctcatttgcttctatagaacagaggagactatagatgcaaatgaggaacctggcggcagcgcaaaagatg

SEQ ID NO: 128062 - DNA, 103 bp, Artificial Sequence
  Synthetic Polynucleotide
taatacgactcactatagggatggggtaagcaatttccatatcctcatttaacagaggagaaaatgaatgtatggaaataacctggcggcagcgcaaaagatg

SEQ ID NO: 128063 - DNA, 103 bp, Artificial Sequence
  Synthetic Polynucleotide
taatacgactcactatagggcccacaagttatggggtaagcaatttccataacagaggagaatggaaatggcttaccccaacctggcggcagcgcaaaagatg

SEQ ID NO: 128064 - DNA, 103 bp, Artificial Sequence
  Synthetic Polynucleotide
taatacgactcactatagggctttgctctccccacaagttatggggtaagaacagaggagacttaccatgtaacttgtgaacctggcggcagcgcaaaagatg

SEQ ID NO: 128065 - DNA, 103 bp, Artificial Sequence
  Synthetic Polynucleotide
taatacgactcactatagggggtaccacaaccacatcccccactgggacaaacagaggagatgtcccatggggggatgtaacctggcggcagcgcaaaagatg

SEQ ID NO: 128066 - DNA, 103 bp, Artificial Sequence
  Synthetic Polynucleotide
taatacgactcactatagggaggaggatggctttgctctccccacaagttaacagaggagaaacttgatgggagagcaaaacctggcggcagcgcaaaagatg

SEQ ID NO: 128067 - DNA, 103 bp, Artificial Sequence
  Synthetic Polynucleotide
taatacgactcactatagggcttcttccagaggaggatggctttgctctcaacagaggagagagagcatggccatcctcaacctggcggcagcgcaaaagatg

SEQ ID NO: 128068 - DNA, 103 bp, Artificial Sequence
  Synthetic Polynucleotide
taatacgactcactataggggacatacaaacttcttccagaggaggatggaacagaggagaccatccatgtctggaagaaacctggcggcagcgcaaaagatg

SEQ ID NO: 128069 - DNA, 103 bp, Artificial Sequence
  Synthetic Polynucleotide
taatacgactcactatagggtttattcctggacatacaaacttcttccagaacagaggagactggaaatggtttgtatgaacctggcggcagcgcaaaagatg

SEQ ID NO: 128070 - DNA, 103 bp, Artificial Sequence
  Synthetic Polynucleotide
taatacgactcactatagggacacttcacgtttattcctggacatacaaaaacagaggagatttgtaatgccaggaataaacctggcggcagcgcaaaagatg

SEQ ID NO: 128071 - DNA, 103 bp, Artificial Sequence
  Synthetic Polynucleotide
taatacgactcactatagggtgaacttgacacacttcacgtttattcctgaacagaggagacaggaaatgacgtgaagtaacctggcggcagcgcaaaagatg

SEQ ID NO: 128072 - DNA, 103 bp, Artificial Sequence
  Synthetic Polynucleotide
taatacgactcactatagggaactgatcattgaacttgacacacttcacgaacagaggagacgtgaaatgtgtcaagttaacctggcggcagcgcaaaagatg

SEQ ID NO: 128073 - DNA, 103 bp, Artificial Sequence
  Synthetic Polynucleotide
taatacgactcactatagggggggctgatcaactgatcattgaacttgacaacagaggagagtcaagatgaatgatcagaacctggcggcagcgcaaaagatg

SEQ ID NO: 128074 - DNA, 103 bp, Artificial Sequence
  Synthetic Polynucleotide
taatacgactcactatagggcaaagtgcttggggctgatcaactgatcataacagaggagaatgatcatgtgatcagccaacctggcggcagcgcaaaagatg

SEQ ID NO: 128075 - DNA, 103 bp, Artificial Sequence
  Synthetic Polynucleotide
taatacgactcactataggggccagatgaacaaagtgcttggggctgatcaacagaggagagatcagatgcaagcacttaacctggcggcagcgcaaaagatg

SEQ ID NO: 128076 - DNA, 103 bp, Artificial Sequence
  Synthetic Polynucleotide
taatacgactcactatagggtccttcagtaggtaccacaaccacatccccaacagaggagaggggatatggttgtggtaaacctggcggcagcgcaaaagatg

SEQ ID NO: 128077 - DNA, 103 bp, Artificial Sequence
  Synthetic Polynucleotide
taatacgactcactatagggggacttgccagccagatgaacaaagtgcttaacagaggagaaagcacatggttcatctgaacctggcggcagcgcaaaagatg

SEQ ID NO: 128078 - DNA, 103 bp, Artificial Sequence
  Synthetic Polynucleotide
taatacgactcactatagggccttcagagtggacttgccagccagatgaaaacagaggagattcatcatgctggcaagtaacctggcggcagcgcaaaagatg

SEQ ID NO: 128079 - DNA, 103 bp, Artificial Sequence
  Synthetic Polynucleotide
taatacgactcactatagggctcttccagtccttcagagtggacttgccaaacagaggagatggcaaatgcactctgaaaacctggcggcagcgcaaaagatg

SEQ ID NO: 128080 - DNA, 103 bp, Artificial Sequence
  Synthetic Polynucleotide
taatacgactcactatagggacgaatagctctcttccagtccttcagagtaacagaggagaactctgatggactggaagaacctggcggcagcgcaaaagatg

SEQ ID NO: 128081 - DNA, 103 bp, Artificial Sequence
  Synthetic Polynucleotide
taatacgactcactatagggtcccacccagacgaatagctctcttccagtaacagaggagaactggaatggagctattcaacctggcggcagcgcaaaagatg

SEQ ID NO: 128082 - DNA, 103 bp, Artificial Sequence
  Synthetic Polynucleotide
taatacgactcactatagggctgagcatgatcccacccagacgaatagctaacagaggagaagctatatgtctgggtggaacctggcggcagcgcaaaagatg

SEQ ID NO: 128083 - DNA, 103 bp, Artificial Sequence
  Synthetic Polynucleotide
taatacgactcactatagggcatcattttcctgagcatgatcccacccagaacagaggagactgggtatgatcatgctcaacctggcggcagcgcaaaagatg

SEQ ID NO: 128084 - DNA, 103 bp, Artificial Sequence
  Synthetic Polynucleotide
taatacgactcactataggggtccggagtccatcattttcctgagcatgaaacagaggagatcatgcatgggaaaatgaaacctggcggcagcgcaaaagatg

SEQ ID NO: 128085 - DNA, 103 bp, Artificial Sequence
  Synthetic Polynucleotide
taatacgactcactatagggaaatcaatctgtccggagtccatcattttcaacagaggagagaaaatatgggactccggaacctggcggcagcgcaaaagatg

SEQ ID NO: 128086 - DNA, 103 bp, Artificial Sequence
  Synthetic Polynucleotide
taatacgactcactatagggatgttggtaaaaatcaatctgtccggagtcaacagaggagagactccatgcagattgataacctggcggcagcgcaaaagatg

SEQ ID NO: 128087 - DNA, 103 bp, Artificial Sequence
  Synthetic Polynucleotide
taatacgactcactatagggccccttcatttccttcagtaggtaccacaaaacagaggagattgtggatgctactgaagaacctggcggcagcgcaaaagatg

SEQ ID NO: 128088 - DNA, 103 bp, Artificial Sequence
  Synthetic Polynucleotide
taatacgactcactatagggaaactttgtcatgttggtaaaaatcaatctaacagaggagaagattgatgtttaccaacaacctggcggcagcgcaaaagatg

SEQ ID NO: 128089 - DNA, 103 bp, Artificial Sequence
  Synthetic Polynucleotide
taatacgactcactataggggtattggagcaaactttgtcatgttggtaaaacagaggagattaccaatgtgacaaagtaacctggcggcagcgcaaaagatg

SEQ ID NO: 128090 - DNA, 103 bp, Artificial Sequence
  Synthetic Polynucleotide
taatacgactcactataggggcttctgcaggtattggagcaaactttgtcaacagaggagagacaaaatgtgctccaataacctggcggcagcgcaaaagatg

SEQ ID NO: 128091 - DNA, 103 bp, Artificial Sequence
  Synthetic Polynucleotide
taatacgactcactatagggcaaatttggtgcttctgcaggtattggagcaacagaggagagctccaatgcctgcagaaaacctggcggcagcgcaaaagatg

SEQ ID NO: 128092 - DNA, 103 bp, Artificial Sequence
  Synthetic Polynucleotide
taatacgactcactatagggatcagaagatcaaatttggtgcttctgcagaacagaggagactgcagatgcaccaaattaacctggcggcagcgcaaaagatg

SEQ ID NO: 128093 - DNA, 103 bp, Artificial Sequence
  Synthetic Polynucleotide
taatacgactcactatagggtgcactgctgatcagaagatcaaatttggtaacagaggagaaccaaaatggatcttctgaacctggcggcagcgcaaaagatg

SEQ ID NO: 128094 - DNA, 103 bp, Artificial Sequence
  Synthetic Polynucleotide
taatacgactcactatagggctggagctcttgcactgctgatcagaagataacagaggagaatcttcatgtcagcagtgaacctggcggcagcgcaaaagatg

SEQ ID NO: 128095 - DNA, 103 bp, Artificial Sequence
  Synthetic Polynucleotide
taatacgactcactatagggtgtcctggcactggagctcttgcactgctgaacagaggagacagcagatgaagagctccaacctggcggcagcgcaaaagatg

SEQ ID NO: 128096 - DNA, 103 bp, Artificial Sequence
  Synthetic Polynucleotide
taatacgactcactatagggacttgtctgctgtcctggcactggagctctaacagaggagaagagctatggtgccaggaaacctggcggcagcgcaaaagatg

SEQ ID NO: 128097 - DNA, 103 bp, Artificial Sequence
  Synthetic Polynucleotide
taatacgactcactatagggtctgcaccacacttgtctgctgtcctggcaaacagaggagatgccagatgagcagacaaaacctggcggcagcgcaaaagatg

SEQ ID NO: 128098 - DNA, 103 bp, Artificial Sequence
  Synthetic Polynucleotide
taatacgactcactatagggtcaggattctccccttcatttccttcagtaaacagaggagatactgaatgaaatgaaggaacctggcggcagcgcaaaagatg

SEQ ID NO: 128099 - DNA, 103 bp, Artificial Sequence
  Synthetic Polynucleotide
taatacgactcactataggggaagtgggtgtctgcaccacacttgtctgcaacagaggagagcagacatgtgtggtgcaaacctggcggcagcgcaaaagatg

SEQ ID NO: 128100 - DNA, 103 bp, Artificial Sequence
  Synthetic Polynucleotide
taatacgactcactatagggaccatcagccgaagtgggtgtctgcaccacaacagaggagagtggtgatgacacccactaacctggcggcagcgcaaaagatg

SEQ ID NO: 128101 - DNA, 103 bp, Artificial Sequence
  Synthetic Polynucleotide
taatacgactcactataggggcgtgatgctaccatcagccgaagtgggtgaacagaggagacacccaatgcggctgatgaacctggcggcagcgcaaaagatg

SEQ ID NO: 128102 - DNA, 103 bp, Artificial Sequence
  Synthetic Polynucleotide
taatacgactcactatagggatggcaatctgcgtgatgctaccatcagccaacagaggagaggctgaatgtagcatcacaacctggcggcagcgcaaaagatg

SEQ ID NO: 128103 - DNA, 103 bp, Artificial Sequence
  Synthetic Polynucleotide
taatacgactcactatagggctcttctgagatggcaatctgcgtgatgctaacagaggagaagcatcatgcagattgccaacctggcggcagcgcaaaagatg

SEQ ID NO: 128104 - DNA, 103 bp, Artificial Sequence
  Synthetic Polynucleotide
taatacgactcactatagggcttccatgctctcttctgagatggcaatctaacagaggagaagattgatgtctcagaagaacctggcggcagcgcaaaagatg

SEQ ID NO: 128105 - DNA, 103 bp, Artificial Sequence
  Synthetic Polynucleotide
taatacgactcactatagggagccctgcctcttccatgctctcttctgagaacagaggagactcagaatggagcatggaaacctggcggcagcgcaaaagatg

SEQ ID NO: 128106 - DNA, 103 bp, Artificial Sequence
  Synthetic Polynucleotide
taatacgactcactataggggttccattccagccctgcctcttccatgctaacagaggagaagcatgatggaggcagggaacctggcggcagcgcaaaagatg

SEQ ID NO: 128107 - DNA, 103 bp, Artificial Sequence
  Synthetic Polynucleotide
taatacgactcactatagggtgagagctgagttccattccagccctgcctaacagaggagaaggcagatgtggaatggaaacctggcggcagcgcaaaagatg

SEQ ID NO: 128108 - DNA, 103 bp, Artificial Sequence
  Synthetic Polynucleotide
taatacgactcactatagggacagcagcggtgagagctgagttccattccaacagaggagaggaatgatgctcagctctaacctggcggcagcgcaaaagatg

SEQ ID NO: 128109 - DNA, 103 bp, Artificial Sequence
  Synthetic Polynucleotide
taatacgactcactatagggtttagtgtcttcaggattctccccttcattaacagaggagaaatgaaatggagaatcctaacctggcggcagcgcaaaagatg

SEQ ID NO: 128110 - DNA, 103 bp, Artificial Sequence
  Synthetic Polynucleotide
taatacgactcactatagggggccatggtgacagcagcggtgagagctgaaacagaggagatcagctatgaccgctgctaacctggcggcagcgcaaaagatg

SEQ ID NO: 128111 - DNA, 103 bp, Artificial Sequence
  Synthetic Polynucleotide
taatacgactcactatagggcctcctccgtggccatggtgacagcagcggaacagaggagaccgctgatgtcaccatggaacctggcggcagcgcaaaagatg

SEQ ID NO: 128112 - DNA, 103 bp, Artificial Sequence
  Synthetic Polynucleotide
taatacgactcactatagggttctttacaccctcctccgtggccatggtgaacagaggagacaccatatgcacggaggaaacctggcggcagcgcaaaagatg

SEQ ID NO: 128113 - DNA, 103 bp, Artificial Sequence
  Synthetic Polynucleotide
taatacgactcactatagggctctgagtctttctttacaccctcctccgtaacagaggagaacggagatgggtgtaaagaacctggcggcagcgcaaaagatg

SEQ ID NO: 128114 - DNA, 103 bp, Artificial Sequence
  Synthetic Polynucleotide
taatacgactcactatagggctgaaatttcctctgagtctttctttacacaacagaggagagtgtaaatgaagactcagaacctggcggcagcgcaaaagatg

SEQ ID NO: 128115 - DNA, 103 bp, Artificial Sequence
  Synthetic Polynucleotide
taatacgactcactatagggaaagtgtcctctgaaatttcctctgagtctaacagaggagaagactcatgggaaatttcaacctggcggcagcgcaaaagatg

SEQ ID NO: 128116 - DNA, 103 bp, Artificial Sequence
  Synthetic Polynucleotide
taatacgactcactatagggccagaacatcaaagtgtcctctgaaatttcaacagaggagagaaattatggaggacactaacctggcggcagcgcaaaagatg

SEQ ID NO: 128117 - DNA, 103 bp, Artificial Sequence
  Synthetic Polynucleotide
taatacgactcactatagggctattcctttccagaacatcaaagtgtcctaacagaggagaaggacaatgtgatgttctaacctggcggcagcgcaaaagatg

SEQ ID NO: 128118 - DNA, 103 bp, Artificial Sequence
  Synthetic Polynucleotide
taatacgactcactatagggcctacatcagctattcctttccagaacatcaacagaggagagatgttatggaaaggaataacctggcggcagcgcaaaagatg

SEQ ID NO: 128119 - DNA, 103 bp, Artificial Sequence
  Synthetic Polynucleotide
taatacgactcactatagggttccatcagccctacatcagctattcctttaacagaggagaaaaggaatggctgatgtaaacctggcggcagcgcaaaagatg

SEQ ID NO: 128120 - DNA, 103 bp, Artificial Sequence
  Synthetic Polynucleotide
taatacgactcactatagggtcacttgggttttagtgtcttcaggattctaacagaggagaagaatcatgaagacactaaacctggcggcagcgcaaaagatg

SEQ ID NO: 128121 - DNA, 103 bp, Artificial Sequence
  Synthetic Polynucleotide
taatacgactcactatagggagacaacctcttccatcagccctacatcagaacagaggagactgatgatgggctgatggaacctggcggcagcgcaaaagatg

SEQ ID NO: 128122 - DNA, 103 bp, Artificial Sequence
  Synthetic Polynucleotide
taatacgactcactatagggtgtatattgcagacaacctcttccatcagcaacagaggagagctgatatgagaggttgtaacctggcggcagcgcaaaagatg

SEQ ID NO: 128123 - DNA, 103 bp, Artificial Sequence
  Synthetic Polynucleotide
taatacgactcactatagggtatttccttctgtatattgcagacaacctcaacagaggagagaggttatgtgcaatataaacctggcggcagcgcaaaagatg

SEQ ID NO: 128124 - DNA, 103 bp, Artificial Sequence
  Synthetic Polynucleotide
taatacgactcactataggggtagctcctctatttccttctgtatattgcaacagaggagagcaataatgagaaggaaaaacctggcggcagcgcaaaagatg

SEQ ID NO: 128125 - DNA, 103 bp, Artificial Sequence
  Synthetic Polynucleotide
taatacgactcactatagggactcccctgagtagctcctctatttccttcaacagaggagagaaggaatgagaggagctaacctggcggcagcgcaaaagatg

SEQ ID NO: 128126 - DNA, 103 bp, Artificial Sequence
  Synthetic Polynucleotide
taatacgactcactatagggccgctgctgaactcccctgagtagctcctcaacagaggagagaggagatgctcaggggaaacctggcggcagcgcaaaagatg

SEQ ID NO: 128127 - DNA, 103 bp, Artificial Sequence
  Synthetic Polynucleotide
taatacgactcactatagggcctggatgagccgctgctgaactcccctgaaacagaggagatcagggatgttcagcagcaacctggcggcagcgcaaaagatg

SEQ ID NO: 128128 - DNA, 103 bp, Artificial Sequence
  Synthetic Polynucleotide
taatacgactcactatagggtggaagggagcctggatgagccgctgctgaaacagaggagatcagcaatggctcatccaaacctggcggcagcgcaaaagatg

SEQ ID NO: 128129 - DNA, 103 bp, Artificial Sequence
  Synthetic Polynucleotide
taatacgactcactatagggatctgtgacttggaagggagcctggatgagaacagaggagactcatcatggctcccttcaacctggcggcagcgcaaaagatg

SEQ ID NO: 128130 - DNA, 103 bp, Artificial Sequence
  Synthetic Polynucleotide
taatacgactcactataggggaacagcagcatctgtgacttggaagggagaacagaggagactccctatgaagtcacagaacctggcggcagcgcaaaagatg

SEQ ID NO: 128131 - DNA, 103 bp, Artificial Sequence
  Synthetic Polynucleotide
taatacgactcactatagggaactgcaaaatcacttgggttttagtgtctaacagaggagaagacacatgaacccaagtaacctggcggcagcgcaaaagatg

SEQ ID NO: 128132 - DNA, 103 bp, Artificial Sequence
  Synthetic Polynucleotide
taatacgactcactatagggacattgttgagaacagcagcatctgtgactaacagaggagaagtcacatgtgctgctgtaacctggcggcagcgcaaaagatg

SEQ ID NO: 128133 - DNA, 103 bp, Artificial Sequence
  Synthetic Polynucleotide
taatacgactcactatagggtgtgtgtgctacattgttgagaacagcagcaacagaggagagctgctatgctcaacaataacctggcggcagcgcaaaagatg

SEQ ID NO: 128134 - DNA, 103 bp, Artificial Sequence
  Synthetic Polynucleotide
taatacgactcactatagggttaggccaaatgtgtgtgctacattgttgaaacagaggagatcaacaatgtagcacacaaacctggcggcagcgcaaaagatg

SEQ ID NO: 128135 - DNA, 103 bp, Artificial Sequence
  Synthetic Polynucleotide
taatacgactcactatagggactgtgtccattaggccaaatgtgtgtgctaacagaggagaagcacaatgatttggcctaacctggcggcagcgcaaaagatg

SEQ ID NO: 128136 - DNA, 103 bp, Artificial Sequence
  Synthetic Polynucleotide
taatacgactcactatagggaaccttcttgactgtgtccattaggccaaaaacagaggagatttggcatgatggacacaaacctggcggcagcgcaaaagatg

SEQ ID NO: 128137 - DNA, 103 bp, Artificial Sequence
  Synthetic Polynucleotide
taatacgactcactatagggtgttgtctaaaaccttcttgactgtgtccaaacagaggagatggacaatgtcaagaaggaacctggcggcagcgcaaaagatg

SEQ ID NO: 128138 - DNA, 103 bp, Artificial Sequence
  Synthetic Polynucleotide
taatacgactcactatagggtggttccttctgttgtctaaaaccttcttgaacagaggagacaagaaatgtttagacaaaacctggcggcagcgcaaaagatg

SEQ ID NO: 128139 - DNA, 103 bp, Artificial Sequence
  Synthetic Polynucleotide
taatacgactcactatagggctgctctacttggttccttctgttgtctaaaacagaggagattagacatgagaaggaacaacctggcggcagcgcaaaagatg

SEQ ID NO: 128140 - DNA, 103 bp, Artificial Sequence
  Synthetic Polynucleotide
taatacgactcactataggggttcttctccctgctctacttggttccttcaacagaggagagaaggaatgaagtagagcaacctggcggcagcgcaaaagatg

SEQ ID NO: 128141 - DNA, 103 bp, Artificial Sequence
  Synthetic Polynucleotide
taatacgactcactatagggtagagaaactgttcttctccctgctctactaacagaggagaagtagaatggggagaagaaacctggcggcagcgcaaaagatg

SEQ ID NO: 128142 - DNA, 103 bp, Artificial Sequence
  Synthetic Polynucleotide
taatacgactcactatagggcatgtgcacactcacgtcgggagtcgccataacagaggagaatggcgatgcccgacgtgaacctggcggcagcgcaaaagatg

SEQ ID NO: 128143 - DNA, 103 bp, Artificial Sequence
  Synthetic Polynucleotide
taatacgactcactatagggcaagttggtcgtcaccaacacggtcttcacaacagaggagagtgaagatggtgttggtgaacctggcggcagcgcaaaagatg

SEQ ID NO: 128144 - DNA, 103 bp, Artificial Sequence
  Synthetic Polynucleotide
taatacgactcactataggggaggtgctgggacttgtgcttcagctccttaacagaggagaaaggagatgaagcacaagaacctggcggcagcgcaaaagatg

SEQ ID NO: 128145 - DNA, 103 bp, Artificial Sequence
  Synthetic Polynucleotide
taatacgactcactataggggcacgttgctgaggtgctgggacttgtgctaacagaggagaagcacaatgcccagcaccaacctggcggcagcgcaaaagatg

SEQ ID NO: 128146 - DNA, 103 bp, Artificial Sequence
  Synthetic Polynucleotide
taatacgactcactatagggagcgtcatgagcacgttgctgaggtgctggaacagaggagaccagcaatgcagcaacgtaacctggcggcagcgcaaaagatg

SEQ ID NO: 128147 - DNA, 103 bp, Artificial Sequence
  Synthetic Polynucleotide
taatacgactcactataggggaccggcgtcagcgtcatgagcacgttgctaacagaggagaagcaacatgctcatgacgaacctggcggcagcgcaaaagatg

SEQ ID NO: 128148 - DNA, 103 bp, Artificial Sequence
  Synthetic Polynucleotide
taatacgactcactataggggtggcagggagaccggcgtcagcgtcatgaaacagaggagatcatgaatgtgacgccggaacctggcggcagcgcaaaagatg

SEQ ID NO: 128149 - DNA, 103 bp, Artificial Sequence
  Synthetic Polynucleotide
taatacgactcactatagggttcacaggcggtggcagggagaccggcgtcaacagaggagagacgccatgctccctgccaacctggcggcagcgcaaaagatg

SEQ ID NO: 128150 - DNA, 103 bp, Artificial Sequence
  Synthetic Polynucleotide
taatacgactcactatagggccggggccgcttcacaggcggtggcagggaaacagaggagatccctgatgccgcctgtgaacctggcggcagcgcaaaagatg

SEQ ID NO: 128151 - DNA, 103 bp, Artificial Sequence
  Synthetic Polynucleotide
taatacgactcactatagggcacgtgcaagccggggccgcttcacaggcgaacagaggagacgcctgatgagcggccccaacctggcggcagcgcaaaagatg

SEQ ID NO: 128152 - DNA, 103 bp, Artificial Sequence
  Synthetic Polynucleotide
taatacgactcactatagggcctgatgtggcacgtgcaagccggggccgcaacagaggagagcggccatggcttgcacgaacctggcggcagcgcaaaagatg

SEQ ID NO: 128153 - DNA, 103 bp, Artificial Sequence
  Synthetic Polynucleotide
taatacgactcactatagggggcggccggtcctgatgtggcacgtgcaagaacagaggagacttgcaatggccacatcaaacctggcggcagcgcaaaagatg

SEQ ID NO: 128154 - DNA, 103 bp, Artificial Sequence
  Synthetic Polynucleotide
taatacgactcactatagggcgtgaggggccaagttggtcgtcaccaacaaacagaggagatgttggatgcgaccaactaacctggcggcagcgcaaaagatg

SEQ ID NO: 128155 - DNA, 103 bp, Artificial Sequence
  Synthetic Polynucleotide
taatacgactcactataggggcgaggccatggcggccggtcctgatgtggaacagaggagaccacatatggaccggccgaacctggcggcagcgcaaaagatg

SEQ ID NO: 128156 - DNA, 103 bp, Artificial Sequence
  Synthetic Polynucleotide
taatacgactcactataggggtgagcacctgcgaggccatggcggccggtaacagaggagaaccggcatgcatggcctcaacctggcggcagcgcaaaagatg

SEQ ID NO: 128157 - DNA, 103 bp, Artificial Sequence
  Synthetic Polynucleotide
taatacgactcactatagggggcagactgggtgagcacctgcgaggccataacagaggagaatggccatgcaggtgctcaacctggcggcagcgcaaaagatg

SEQ ID NO: 128158 - DNA, 103 bp, Artificial Sequence
  Synthetic Polynucleotide
taatacgactcactataggggcgccagctgggcagactgggtgagcacctaacagaggagaaggtgcatgcccagtctgaacctggcggcagcgcaaaagatg

SEQ ID NO: 128159 - DNA, 103 bp, Artificial Sequence
  Synthetic Polynucleotide
taatacgactcactatagggcccgggccaagcgccagctgggcagactggaacagaggagaccagtcatgccagctggcaacctggcggcagcgcaaaagatg

SEQ ID NO: 128160 - DNA, 103 bp, Artificial Sequence
  Synthetic Polynucleotide
taatacgactcactataggggacgggcacgcccgggccaagcgccagctgaacagaggagacagctgatgcttggcccgaacctggcggcagcgcaaaagatg

SEQ ID NO: 128161 - DNA, 103 bp, Artificial Sequence
  Synthetic Polynucleotide
taatacgactcactatagggtcagctgggggacgggcacgcccgggccaaaacagaggagattggccatggcgtgcccgaacctggcggcagcgcaaaagatg

SEQ ID NO: 128162 - DNA, 103 bp, Artificial Sequence
  Synthetic Polynucleotide
taatacgactcactatagggggcacgctggtcagctgggggacgggcacgaacagaggagacgtgccatgcccccagctaacctggcggcagcgcaaaagatg

SEQ ID NO: 128163 - DNA, 103 bp, Artificial Sequence
  Synthetic Polynucleotide
taatacgactcactatagggtttaccaaggggcacgctggtcagctggggaacagaggagaccccagatgaccagcgtgaacctggcggcagcgcaaaagatg

SEQ ID NO: 128164 - DNA, 103 bp, Artificial Sequence
  Synthetic Polynucleotide
taatacgactcactatagggtggacaccactttaccaaggggcacgctggaacagaggagaccagcgatgcccttggtaaacctggcggcagcgcaaaagatg

SEQ ID NO: 128165 - DNA, 103 bp, Artificial Sequence
  Synthetic Polynucleotide
taatacgactcactatagggaggtcgcccccgtgaggggccaagttggtcaacagaggagagaccaaatgggcccctcaaacctggcggcagcgcaaaagatg

SEQ ID NO: 128166 - DNA, 103 bp, Artificial Sequence
  Synthetic Polynucleotide
taatacgactcactataggggacggcagggtggacaccactttaccaaggaacagaggagaccttggatgagtggtgtcaacctggcggcagcgcaaaagatg

SEQ ID NO: 128167 - DNA, 103 bp, Artificial Sequence
  Synthetic Polynucleotide
taatacgactcactatagggcaggacggtggacggcagggtggacaccacaacagaggagagtggtgatgaccctgccgaacctggcggcagcgcaaaagatg

SEQ ID NO: 128168 - DNA, 103 bp, Artificial Sequence
  Synthetic Polynucleotide
taatacgactcactatagggaacccttgcccaggacggtggacggcagggaacagaggagaccctgcatgccaccgtccaacctggcggcagcgcaaaagatg

SEQ ID NO: 128169 - DNA, 103 bp, Artificial Sequence
  Synthetic Polynucleotide
taatacgactcactataggggcctgaagggaacccttgcccaggacggtgaacagaggagacaccgtatggggcaagggaacctggcggcagcgcaaaagatg

SEQ ID NO: 128170 - DNA, 103 bp, Artificial Sequence
  Synthetic Polynucleotide
taatacgactcactatagggggcggggggcgcctgaagggaacccttgccaacagaggagaggcaagatgtcccttcagaacctggcggcagcgcaaaagatg

SEQ ID NO: 128171 - DNA, 103 bp, Artificial Sequence
  Synthetic Polynucleotide
taatacgactcactatagggccggggagctggcggggggcgcctgaagggaacagaggagacccttcatgcgccccccgaacctggcggcagcgcaaaagatg

SEQ ID NO: 128172 - DNA, 103 bp, Artificial Sequence
  Synthetic Polynucleotide
taatacgactcactatagggagcggggaggccggggagctggcggggggcaacagaggagagcccccatgcagctccccaacctggcggcagcgcaaaagatg

SEQ ID NO: 128173 - DNA, 103 bp, Artificial Sequence
  Synthetic Polynucleotide
taatacgactcactatagggtcccccgagcagcggggaggccggggagctaacagaggagaagctccatggcctccccgaacctggcggcagcgcaaaagatg

SEQ ID NO: 128174 - DNA, 103 bp, Artificial Sequence
  Synthetic Polynucleotide
taatacgactcactatagggagactgtgtatcccccgagcagcggggaggaacagaggagacctcccatgtgctcggggaacctggcggcagcgcaaaagatg

SEQ ID NO: 128175 - DNA, 103 bp, Artificial Sequence
  Synthetic Polynucleotide
taatacgactcactataggggaagaggccaagactgtgtatcccccgagcaacagaggagagctcggatgatacacagtaacctggcggcagcgcaaaagatg

SEQ ID NO: 128176 - DNA, 103 bp, Artificial Sequence
  Synthetic Polynucleotide
taatacgactcactatagggatcttccgtcaggtcgcccccgtgaggggcaacagaggagagcccctatggggggcgacaacctggcggcagcgcaaaagatg

SEQ ID NO: 128177 - DNA, 103 bp, Artificial Sequence
  Synthetic Polynucleotide
taatacgactcactatagggggtggagccggaagaggccaagactgtgtaaacagaggagatacacaatgttggcctctaacctggcggcagcgcaaaagatg

SEQ ID NO: 128178 - DNA, 103 bp, Artificial Sequence
  Synthetic Polynucleotide
taatacgactcactatagggtgctggggtaggtggagccggaagaggccaaacagaggagatggcctatgccggctccaaacctggcggcagcgcaaaagatg

SEQ ID NO: 128179 - DNA, 103 bp, Artificial Sequence
  Synthetic Polynucleotide
taatacgactcactatagggatctccactgtgctggggtaggtggagccgaacagaggagacggctcatgctaccccagaacctggcggcagcgcaaaagatg

SEQ ID NO: 128180 - DNA, 103 bp, Artificial Sequence
  Synthetic Polynucleotide
taatacgactcactataggggtccgggtggatctccactgtgctggggtaaacagaggagataccccatgacagtggagaacctggcggcagcgcaaaagatg

SEQ ID NO: 128181 - DNA, 103 bp, Artificial Sequence
  Synthetic Polynucleotide
taatacgactcactatagggggctggacgcgtccgggtggatctccactgaacagaggagacagtggatgtccacccggaacctggcggcagcgcaaaagatg

SEQ ID NO: 128182 - DNA, 103 bp, Artificial Sequence
  Synthetic Polynucleotide
taatacgactcactatagggaggaccgtgaggctggacgcgtccgggtggaacagaggagaccacccatgcgcgtccagaacctggcggcagcgcaaaagatg

SEQ ID NO: 128183 - DNA, 103 bp, Artificial Sequence
  Synthetic Polynucleotide
taatacgactcactatagggggccgtgctcaggaccgtgaggctggacgcaacagaggagagcgtccatgctcacggtcaacctggcggcagcgcaaaagatg

SEQ ID NO: 128184 - DNA, 103 bp, Artificial Sequence
  Synthetic Polynucleotide
taatacgactcactatagggcctgcacggcggccgtgctcaggaccgtgaaacagaggagatcacggatgtgagcacggaacctggcggcagcgcaaaagatg

SEQ ID NO: 128185 - DNA, 103 bp, Artificial Sequence
  Synthetic Polynucleotide
taatacgactcactataggggtgctaccgtcctgcacggcggccgtgctcaacagaggagagagcacatgcgccgtgcaaacctggcggcagcgcaaaagatg

SEQ ID NO: 128186 - DNA, 103 bp, Artificial Sequence
  Synthetic Polynucleotide
taatacgactcactatagggcttgaacaccgtgctaccgtcctgcacggcaacagaggagagccgtgatggacggtagcaacctggcggcagcgcaaaagatg

SEQ ID NO: 128187 - DNA, 103 bp, Artificial Sequence
  Synthetic Polynucleotide
taatacgactcactatagggtctccatgttatcttccgtcaggtcgccccaacagaggagaggggcgatgtgacggaagaacctggcggcagcgcaaaagatg

SEQ ID NO: 128188 - DNA, 103 bp, Artificial Sequence
  Synthetic Polynucleotide
taatacgactcactatagggggctgaccaccttgaacaccgtgctaccgtaacagaggagaacggtaatgcggtgttcaaacctggcggcagcgcaaaagatg

SEQ ID NO: 128189 - DNA, 103 bp, Artificial Sequence
  Synthetic Polynucleotide
taatacgactcactatagggagctgtagcgggctgaccaccttgaacaccaacagaggagaggtgttatgggtggtcagaacctggcggcagcgcaaaagatg

SEQ ID NO: 128190 - DNA, 103 bp, Artificial Sequence
  Synthetic Polynucleotide
taatacgactcactatagggcaacgtgagcagctgtagcgggctgaccacaacagaggagagtggtcatgccgctacagaacctggcggcagcgcaaaagatg

SEQ ID NO: 128191 - DNA, 103 bp, Artificial Sequence
  Synthetic Polynucleotide
taatacgactcactatagggccaggccaggcaacgtgagcagctgtagcgaacagaggagacgctacatgtgctcacgtaacctggcggcagcgcaaaagatg

SEQ ID NO: 128192 - DNA, 103 bp, Artificial Sequence
  Synthetic Polynucleotide
taatacgactcactatagggagggtggggcccaggccaggcaacgtgagcaacagaggagagctcacatggcctggcctaacctggcggcagcgcaaaagatg

SEQ ID NO: 128193 - DNA, 103 bp, Artificial Sequence
  Synthetic Polynucleotide
taatacgactcactatagggcacgttctgcagggtggggcccaggccaggaacagaggagacctggcatgggccccaccaacctggcggcagcgcaaaagatg

SEQ ID NO: 128194 - DNA, 103 bp, Artificial Sequence
  Synthetic Polynucleotide
taatacgactcactatagggaggcctgggccacgttctgcagggtggggcaacagaggagagccccaatgtgcagaacgaacctggcggcagcgcaaaagatg

SEQ ID NO: 128195 - DNA, 103 bp, Artificial Sequence
  Synthetic Polynucleotide
taatacgactcactataggggagccaggcgaggcctgggccacgttctgcaacagaggagagcagaaatgggcccaggcaacctggcggcagcgcaaaagatg

SEQ ID NO: 128196 - DNA, 103 bp, Artificial Sequence
  Synthetic Polynucleotide
taatacgactcactatagggaattgtgctggagccaggcgaggcctgggcaacagaggagagcccagatgtcgcctggcaacctggcggcagcgcaaaagatg

SEQ ID NO: 128197 - DNA, 103 bp, Artificial Sequence
  Synthetic Polynucleotide
taatacgactcactataggggcactgtcacaattgtgctggagccaggcgaacagaggagacgcctgatgccagcacaaaacctggcggcagcgcaaaagatg

SEQ ID NO: 128198 - DNA, 103 bp, Artificial Sequence
  Synthetic Polynucleotide
taatacgactcactataggggcattttctgtctccatgttatcttccgtcaacagaggagagacggaatgtaacatggaaacctggcggcagcgcaaaagatg

SEQ ID NO: 128199 - DNA, 103 bp, Artificial Sequence
  Synthetic Polynucleotide
taatacgactcactataggggcccctgcgggcactgtcacaattgtgctgaacagaggagacagcacatgtgtgacagtaacctggcggcagcgcaaaagatg

SEQ ID NO: 128200 - DNA, 103 bp, Artificial Sequence
  Synthetic Polynucleotide
taatacgactcactatagggcccgggggcagcccctgcgggcactgtcacaacagaggagagtgacaatgcccgcagggaacctggcggcagcgcaaaagatg

SEQ ID NO: 128201 - DNA, 103 bp, Artificial Sequence
  Synthetic Polynucleotide
taatacgactcactataggggctcctcaggcccgggggcagcccctgcggaacagaggagaccgcagatgctgcccccgaacctggcggcagcgcaaaagatg

SEQ ID NO: 128202 - DNA, 103 bp, Artificial Sequence
  Synthetic Polynucleotide
taatacgactcactataggggtggccgtgtgctcctcaggcccgggggcaaacagaggagatgccccatggcctgaggaaacctggcggcagcgcaaaagatg

SEQ ID NO: 128203 - DNA, 103 bp, Artificial Sequence
  Synthetic Polynucleotide
taatacgactcactatagggcacctcaatggtggccgtgtgctcctcaggaacagaggagacctgagatgcacacggccaacctggcggcagcgcaaaagatg

SEQ ID NO: 128204 - DNA, 103 bp, Artificial Sequence
  Synthetic Polynucleotide
taatacgactcactatagggccatggcagccacctcaatggtggccgtgtaacagaggagaacacggatgccattgaggaacctggcggcagcgcaaaagatg

SEQ ID NO: 128205 - DNA, 103 bp, Artificial Sequence
  Synthetic Polynucleotide
taatacgactcactatagggtggtcctctgccatggcagccacctcaatgaacagaggagacattgaatgggctgccataacctggcggcagcgcaaaagatg

SEQ ID NO: 128206 - DNA, 103 bp, Artificial Sequence
  Synthetic Polynucleotide
taatacgactcactatagggcttccgctcgtggtcctctgccatggcagcaacagaggagagctgccatggcagaggacaacctggcggcagcgcaaaagatg

SEQ ID NO: 128207 - DNA, 103 bp, Artificial Sequence
  Synthetic Polynucleotide
taatacgactcactatagggtgctgccgctgcattttctgtctccatgttaacagaggagaaacatgatgacagaaaataacctggcggcagcgcaaaagatg

SEQ ID NO: 128208 - DNA, 103 bp, Artificial Sequence
  Synthetic Polynucleotide
taatacgactcactatagggccgcggcagctgctgccgctgcattttctgaacagaggagacagaaaatgcagcggcagaacctggcggcagcgcaaaagatg

SEQ ID NO: 128209 - DNA, 103 bp, Artificial Sequence
  Synthetic Polynucleotide
taatacgactcactataggggctgtgaaggccgcggcagctgctgccgctaacagaggagaagcggcatgagctgccgcaacctggcggcagcgcaaaagatg

SEQ ID NO: 128210 - DNA, 103 bp, Artificial Sequence
  Synthetic Polynucleotide
taatacgactcactatagggctgggaggaggctgtgaaggccgcggcagcaacagaggagagctgccatggccttcacaaacctggcggcagcgcaaaagatg

SEQ ID NO: 128211 - DNA, 103 bp, Artificial Sequence
  Synthetic Polynucleotide
taatacgactcactatagggccacctcctccatgtgcacactcacgtcggaacagaggagaccgacgatggtgtgcacaaacctggcggcagcgcaaaagatg

SEQ ID NO: 128212 - DNA, 103 bp, Artificial Sequence
  Synthetic Polynucleotide
taatacgactcactatagggcttccttgagctgggaggaggctgtgaaggaacagaggagaccttcaatgcctcctcccaacctggcggcagcgcaaaagatg

SEQ ID NO: 128213 - DNA, 103 bp, Artificial Sequence
  Synthetic Polynucleotide
taatacgactcactatagggactaacacggcttccttgagctgggaggagaacagaggagactcctcatggctcaaggaaacctggcggcagcgcaaaagatg

SEQ ID NO: 128214 - DNA, 103 bp, Artificial Sequence
  Synthetic Polynucleotide
taatacgactcactatagggagccatcttcactaacacggcttccttgagaacagaggagactcaagatggccgtgttaaacctggcggcagcgcaaaagatg

SEQ ID NO: 128215 - DNA, 103 bp, Artificial Sequence
  Synthetic Polynucleotide
taatacgactcactatagggccccctcttcagccatcttcactaacacggaacagaggagaccgtgtatgtgaagatggaacctggcggcagcgcaaaagatg

SEQ ID NO: 128216 - DNA, 103 bp, Artificial Sequence
  Synthetic Polynucleotide
taatacgactcactatagggtccaggttctccccctcttcagccatcttcaacagaggagagaagatatgtgaagagggaacctggcggcagcgcaaaagatg

SEQ ID NO: 128217 - DNA, 103 bp, Artificial Sequence
  Synthetic Polynucleotide
taatacgactcactatagggaatctcagcttccaggttctccccctcttcaacagaggagagaagagatggagaacctgaacctggcggcagcgcaaaagatg

SEQ ID NO: 128218 - DNA, 103 bp, Artificial Sequence
  Synthetic Polynucleotide
taatacgactcactatagggtggggtacacaatctcagcttccaggttctaacagaggagaagaaccatgaagctgagaaacctggcggcagcgcaaaagatg

SEQ ID NO: 128219 - DNA, 103 bp, Artificial Sequence
  Synthetic Polynucleotide
taatacgactcactatagggccacaggtgatggggtacacaatctcagctaacagaggagaagctgaatgtgtgtacccaacctggcggcagcgcaaaagatg

SEQ ID NO: 128220 - DNA, 103 bp, Artificial Sequence
  Synthetic Polynucleotide
taatacgactcactatagggtctgctgtctccacaggtgatggggtacacaacagaggagagtgtacatgatcacctgtaacctggcggcagcgcaaaagatg

SEQ ID NO: 128221 - DNA, 103 bp, Artificial Sequence
  Synthetic Polynucleotide
taatacgactcactatagggtgaggttggctctgctgtctccacaggtgaaacagaggagatcacctatggagacagcaaacctggcggcagcgcaaaagatg

SEQ ID NO: 128222 - DNA, 103 bp, Artificial Sequence
  Synthetic Polynucleotide
taatacgactcactataggggtcacaaccaccacctcctccatgtgcacaaacagaggagatgtgcaatgggaggaggtaacctggcggcagcgcaaaagatg

SEQ ID NO: 128223 - DNA, 103 bp, Artificial Sequence
  Synthetic Polynucleotide
taatacgactcactatagggttcctccagatgaggttggctctgctgtctaacagaggagaagacagatgagccaacctaacctggcggcagcgcaaaagatg

SEQ ID NO: 128224 - DNA, 103 bp, Artificial Sequence
  Synthetic Polynucleotide
taatacgactcactatagggacacacaaacttcctccagatgaggttggcaacagaggagagccaacatgatctggaggaacctggcggcagcgcaaaagatg

SEQ ID NO: 128225 - DNA, 103 bp, Artificial Sequence
  Synthetic Polynucleotide
taatacgactcactatagggtgatgccgggacacacaaacttcctccagaaacagaggagatctggaatgagtttgtgtaacctggcggcagcgcaaaagatg

SEQ ID NO: 128226 - DNA, 103 bp, Artificial Sequence
  Synthetic Polynucleotide
taatacgactcactatagggcatttcacattgatgccgggacacacaaacaacagaggagagtttgtatgtcccggcataacctggcggcagcgcaaaagatg

SEQ ID NO: 128227 - DNA, 103 bp, Artificial Sequence
  Synthetic Polynucleotide
taatacgactcactataggggtactgaacacatttcacattgatgccgggaacagaggagacccggcatgaatgtgaaaaacctggcggcagcgcaaaagatg

SEQ ID NO: 128228 - DNA, 103 bp, Artificial Sequence
  Synthetic Polynucleotide
taatacgactcactatagggcatgctcgtcgtactgaacacatttcacataacagaggagaatgtgaatggtgttcagtaacctggcggcagcgcaaaagatg

SEQ ID NO: 128229 - DNA, 103 bp, Artificial Sequence
  Synthetic Polynucleotide
taatacgactcactataggggggctgattacatgctcgtcgtactgaacaaacagaggagatgttcaatgcgacgagcaaacctggcggcagcgcaaaagatg

SEQ ID NO: 128230 - DNA, 103 bp, Artificial Sequence
  Synthetic Polynucleotide
taatacgactcactatagggaaattcctttgggctgattacatgctcgtcaacagaggagagacgagatggtaatcagcaacctggcggcagcgcaaaagatg

SEQ ID NO: 128231 - DNA, 103 bp, Artificial Sequence
  Synthetic Polynucleotide
taatacgactcactatagggccaggtgcacaaattcctttgggctgattaaacagaggagataatcaatgcaaaggaataacctggcggcagcgcaaaagatg

SEQ ID NO: 128232 - DNA, 103 bp, Artificial Sequence
  Synthetic Polynucleotide
taatacgactcactataggggacttcccggccaggtgcacaaattcctttaacagaggagaaaaggaatgtgtgcacctaacctggcggcagcgcaaaagatg

SEQ ID NO: 128233 - DNA, 103 bp, Artificial Sequence
  Synthetic Polynucleotide
taatacgactcactataggggtccggagttgtcacaaccaccacctcctcaacagaggagagaggagatggtggttgtgaacctggcggcagcgcaaaagatg

SEQ ID NO: 128234 - DNA, 103 bp, Artificial Sequence
  Synthetic Polynucleotide
taatacgactcactatagggcttcagggtggacttcccggccaggtgcacaacagaggagagtgcacatggccgggaagaacctggcggcagcgcaaaagatg

SEQ ID NO: 128235 - DNA, 103 bp, Artificial Sequence
  Synthetic Polynucleotide
taatacgactcactatagggtcttccagtccttcagggtggacttcccggaacagaggagaccgggaatgccaccctgaaacctggcggcagcgcaaaagatg

SEQ ID NO: 128236 - DNA, 103 bp, Artificial Sequence
  Synthetic Polynucleotide
taatacgactcactatagggcggatggctctcttccagtccttcagggtgaacagaggagacaccctatgggactggaaaacctggcggcagcgcaaaagatg

SEQ ID NO: 128237 - DNA, 103 bp, Artificial Sequence
  Synthetic Polynucleotide
taatacgactcactataggggccgttcatgcggatggctctcttccagtcaacagaggagagactggatgagagccatcaacctggcggcagcgcaaaagatg

SEQ ID NO: 128238 - DNA, 103 bp, Artificial Sequence
  Synthetic Polynucleotide
taatacgactcactatagggtgagcatgatgccgttcatgcggatggctcaacagaggagagagccaatggcatgaacgaacctggcggcagcgcaaaagatg

SEQ ID NO: 128239 - DNA, 103 bp, Artificial Sequence
  Synthetic Polynucleotide
taatacgactcactatagggatgatcttcctgagcatgatgccgttcatgaacagaggagacatgaaatgcatcatgctaacctggcggcagcgcaaaagatg

SEQ ID NO: 128240 - DNA, 103 bp, Artificial Sequence
  Synthetic Polynucleotide
taatacgactcactatagggcccggagtccatgatcttcctgagcatgataacagaggagaatcatgatgaggaagatcaacctggcggcagcgcaaaagatg

SEQ ID NO: 128241 - DNA, 103 bp, Artificial Sequence
  Synthetic Polynucleotide
taatacgactcactatagggagtccagttccccggagtccatgatcttccaacagaggagaggaagaatgtggactccgaacctggcggcagcgcaaaagatg

SEQ ID NO: 128242 - DNA, 103 bp, Artificial Sequence
  Synthetic Polynucleotide
taatacgactcactatagggtgctggtagaagtccagttccccggagtccaacagaggagaggactcatgggaactggaaacctggcggcagcgcaaaagatg

SEQ ID NO: 128243 - DNA, 103 bp, Artificial Sequence
  Synthetic Polynucleotide
taatacgactcactataggggaccttgtcatgctggtagaagtccagttcaacagaggagagaactgatgttctaccagaacctggcggcagcgcaaaagatg

SEQ ID NO: 128244 - DNA, 103 bp, Artificial Sequence
  Synthetic Polynucleotide
taatacgactcactatagggccactgcagtgtccggagttgtcacaaccaaacagaggagatggttgatgcaactccggaacctggcggcagcgcaaaagatg

SEQ ID NO: 128245 - DNA, 103 bp, Artificial Sequence
  Synthetic Polynucleotide
taatacgactcactatagggtgttggagcagaccttgtcatgctggtagaaacagaggagatctaccatgatgacaaggaacctggcggcagcgcaaaagatg

SEQ ID NO: 128246 - DNA, 103 bp, Artificial Sequence
  Synthetic Polynucleotide
taatacgactcactatagggctgcggcaggtgttggagcagaccttgtcaaacagaggagatgacaaatgctgctccaaaacctggcggcagcgcaaaagatg

SEQ ID NO: 128247 - DNA, 103 bp, Artificial Sequence
  Synthetic Polynucleotide
taatacgactcactatagggaatctttgtgctgcggcaggtgttggagcaaacagaggagatgctccatgacctgccgcaacctggcggcagcgcaaaagatg

SEQ ID NO: 128248 - DNA, 103 bp, Artificial Sequence
  Synthetic Polynucleotide
taatacgactcactatagggctgagaggtcaatctttgtgctgcggcaggaacagaggagacctgccatggcacaaagaaacctggcggcagcgcaaaagatg

SEQ ID NO: 128249 - DNA, 103 bp, Artificial Sequence
  Synthetic Polynucleotide
taatacgactcactatagggacacgggctcctgagaggtcaatctttgtgaacagaggagacacaaaatgtgacctctcaacctggcggcagcgcaaaagatg

SEQ ID NO: 128250 - DNA, 103 bp, Artificial Sequence
  Synthetic Polynucleotide
taatacgactcactataggggctcagggacacacgggctcctgagaggtcaacagaggagagacctcatgggagcccgtaacctggcggcagcgcaaaagatg

SEQ ID NO: 128251 - DNA, 103 bp, Artificial Sequence
  Synthetic Polynucleotide
taatacgactcactatagggacgtggggctgctcagggacacacgggctcaacagaggagagagcccatgtgtccctgaaacctggcggcagcgcaaaagatg

SEQ ID NO: 128252 - DNA, 103 bp, Artificial Sequence
  Synthetic Polynucleotide
taatacgactcactatagggtactcggccgacgtggggctgctcagggacaacagaggagagtccctatgcagccccacaacctggcggcagcgcaaaagatg

SEQ ID NO: 128253 - DNA, 103 bp, Artificial Sequence
  Synthetic Polynucleotide
taatacgactcactataggggaggggaatgtactcggccgacgtggggctaacagaggagaagccccatgtcggccgagaacctggcggcagcgcaaaagatg

SEQ ID NO: 128254 - DNA, 103 bp, Artificial Sequence
  Synthetic Polynucleotide
taatacgactcactatagggcggcgggcgtgaggggaatgtactcggccgaacagaggagacggccgatgacattccccaacctggcggcagcgcaaaagatg

SEQ ID NO: 128255 - DNA, 103 bp, Artificial Sequence
  Synthetic Polynucleotide
taatacgactcactatagggccactgccgtccactgcagtgtccggagttaacagaggagaaactccatgcactgcagtaacctggcggcagcgcaaaagatg

SEQ ID NO: 128256 - DNA, 103 bp, Artificial Sequence
  Synthetic Polynucleotide
taatacgactcactatagggacgtcggctgcggcgggcgtgaggggaatgaacagaggagacattccatgcacgcccgcaacctggcggcagcgcaaaagatg

SEQ ID NO: 128257 - DNA, 103 bp, Artificial Sequence
  Synthetic Polynucleotide
taatacgactcactatagggagacccattcacgtcggctgcggcgggcgtaacagaggagaacgcccatggcagccgacaacctggcggcagcgcaaaagatg

SEQ ID NO: 128258 - DNA, 103 bp, Artificial Sequence
  Synthetic Polynucleotide
taatacgactcactatagggtggtcgcaggagacccattcacgtcggctgaacagaggagacagccgatgtgaatgggtaacctggcggcagcgcaaaagatg

SEQ ID NO: 128259 - DNA, 103 bp, Artificial Sequence
  Synthetic Polynucleotide
taatacgactcactatagggtctatggtgatggtcgcaggagacccattcaacagaggagagaatggatgtcctgcgacaacctggcggcagcgcaaaagatg

SEQ ID NO: 128260 - DNA, 103 bp, Artificial Sequence
  Synthetic Polynucleotide
taatacgactcactatagggttcacaggtctctatggtgatggtcgcaggaacagaggagacctgcgatgatcaccataaacctggcggcagcgcaaaagatg

SEQ ID NO: 128261 - DNA, 103 bp, Artificial Sequence
  Synthetic Polynucleotide
taatacgactcactatagggcgccagggtcttcacaggtctctatggtgaaacagaggagatcaccaatgagacctgtgaacctggcggcagcgcaaaagatg

SEQ ID NO: 128262 - DNA, 103 bp, Artificial Sequence
  Synthetic Polynucleotide
taatacgactcactataggggcggtccagtcgccagggtcttcacaggtcaacagaggagagacctgatgagaccctggaacctggcggcagcgcaaaagatg

SEQ ID NO: 128263 - DNA, 103 bp, Artificial Sequence
  Synthetic Polynucleotide
taatacgactcactatagggtccaatggccgcggtccagtcgccagggtcaacagaggagagaccctatggactggaccaacctggcggcagcgcaaaagatg

SEQ ID NO: 128264 - DNA, 103 bp, Artificial Sequence
  Synthetic Polynucleotide
taatacgactcactatagggatgtgtcatctccaatggccgcggtccagtaacagaggagaactggaatgcggccattgaacctggcggcagcgcaaaagatg

SEQ ID NO: 128265 - DNA, 103 bp, Artificial Sequence
  Synthetic Polynucleotide
taatacgactcactatagggcagaaggtaaatgtgtcatctccaatggccaacagaggagaggccatatgagatgacacaacctggcggcagcgcaaaagatg

SEQ ID NO: 128266 - DNA, 103 bp, Artificial Sequence
  Synthetic Polynucleotide
taatacgactcactatagggcccctccacaccactgccgtccactgcagtaacagaggagaactgcaatggacggcagtaacctggcggcagcgcaaaagatg

SEQ ID NO: 128267 - DNA, 103 bp, Artificial Sequence
  Synthetic Polynucleotide
taatacgactcactatagggcagcccccgccagaaggtaaatgtgtcatcaacagaggagagatgacatgtttaccttcaacctggcggcagcgcaaaagatg

SEQ ID NO: 128268 - DNA, 103 bp, Artificial Sequence
  Synthetic Polynucleotide
taatacgactcactatagggcggcgtccttcagcccccgccagaaggtaaaacagaggagattacctatgggcgggggcaacctggcggcagcgcaaaagatg

SEQ ID NO: 128269 - DNA, 103 bp, Artificial Sequence
  Synthetic Polynucleotide
taatacgactcactatagggtccagcaggccggcgtccttcagcccccgcaacagaggagagcggggatggaaggacgcaacctggcggcagcgcaaaagatg

SEQ ID NO: 128270 - DNA, 103 bp, Artificial Sequence
  Synthetic Polynucleotide
taatacgactcactataggggatgacctcgtccagcaggccggcgtccttaacagaggagaaaggacatgggcctgctgaacctggcggcagcgcaaaagatg

SEQ ID NO: 128271 - DNA, 103 bp, Artificial Sequence
  Synthetic Polynucleotide
taatacgactcactatagggggaactcctggatgacctcgtccagcaggcaacagaggagagcctgcatgacgaggtcaaacctggcggcagcgcaaaagatg

SEQ ID NO: 128272 - DNA, 103 bp, Artificial Sequence
  Synthetic Polynucleotide
taatacgactcactatagggagctcctggtggaactcctggatgacctcgaacagaggagacgaggtatgccaggagttaacctggcggcagcgcaaaagatg

SEQ ID NO: 128273 - DNA, 103 bp, Artificial Sequence
  Synthetic Polynucleotide
taatacgactcactatagggggtctccaccagctcctggtggaactcctgaacagaggagacaggagatgcaccaggagaacctggcggcagcgcaaaagatg

SEQ ID NO: 128274 - DNA, 103 bp, Artificial Sequence
  Synthetic Polynucleotide
taatacgactcactatagggggcctctcatggtctccaccagctcctggtaacagaggagaaccaggatgtggtggagaaacctggcggcagcgcaaaagatg

SEQ ID NO: 128275 - DNA, 103 bp, Artificial Sequence
  Synthetic Polynucleotide
taatacgactcactatagggcgctgctgcaggcctctcatggtctccaccaacagaggagaggtggaatgcatgagaggaacctggcggcagcgcaaaagatg

SEQ ID NO: 128276 - DNA, 103 bp, Artificial Sequence
  Synthetic Polynucleotide
taatacgactcactataggggtcctggacccgctgctgcaggcctctcataacagaggagaatgagaatgctgcagcagaacctggcggcagcgcaaaagatg

SEQ ID NO: 128277 - DNA, 103 bp, Artificial Sequence
  Synthetic Polynucleotide
taatacgactcactatagggcggtcttcaccccctccacaccactgccgtaacagaggagaacggcaatggtgtggaggaacctggcggcagcgcaaaagatg

SEQ ID NO: 128278 - DNA, 103 bp, Artificial Sequence
  Synthetic Polynucleotide
taatacgactcactataggggcaggggagggtcctggacccgctgctgcaaacagaggagatgcagcatggggtccaggaacctggcggcagcgcaaaagatg

SEQ ID NO: 128279 - DNA, 103 bp, Artificial Sequence
  Synthetic Polynucleotide
taatacgactcactatagggtctcgaagctgcaggggagggtcctggaccaacagaggagaggtccaatgccctcccctaacctggcggcagcgcaaaagatg

SEQ ID NO: 128280 - DNA, 103 bp, Artificial Sequence
  Synthetic Polynucleotide
taatacgactcactatagggaagtacagcatctcgaagctgcaggggaggaacagaggagacctcccatgcagcttcgaaacctggcggcagcgcaaaagatg

SEQ ID NO: 128281 - DNA, 103 bp, Artificial Sequence
  Synthetic Polynucleotide
taatacgactcactatagggtgttgttgagaagtacagcatctcgaagctaacagaggagaagcttcatgatgctgtacaacctggcggcagcgcaaaagatg

SEQ ID NO: 128282 - DNA, 103 bp, Artificial Sequence
  Synthetic Polynucleotide
taatacgactcactatagggttctgcacgatgttgttgagaagtacagcaaacagaggagatgctgtatgtctcaacaaaacctggcggcagcgcaaaagatg

SEQ ID NO: 128283 - DNA, 103 bp, Artificial Sequence
  Synthetic Polynucleotide
taatacgactcactatagggcatgccgaagttctgcacgatgttgttgagaacagaggagactcaacatgatcgtgcagaacctggcggcagcgcaaaagatg

SEQ ID NO: 128284 - DNA, 103 bp, Artificial Sequence
  Synthetic Polynucleotide
taatacgactcactatagggccaggtccagcatgccgaagttctgcacgaaacagaggagatcgtgcatgacttcggcaaacctggcggcagcgcaaaagatg

SEQ ID NO: 128285 - DNA, 103 bp, Artificial Sequence
  Synthetic Polynucleotide
taatacgactcactatagggaccttcttcaccaggtccagcatgccgaagaacagaggagacttcggatggctggacctaacctggcggcagcgcaaaagatg

SEQ ID NO: 128286 - DNA, 103 bp, Artificial Sequence
  Synthetic Polynucleotide
taatacgactcactataggggctggccagcaccttcttcaccaggtccagaacagaggagactggacatggtgaagaagaacctggcggcagcgcaaaagatg

SEQ ID NO: 128287 - DNA, 103 bp, Artificial Sequence
  Synthetic Polynucleotide
taatacgactcactatagggggcacttgtggctggccagcaccttcttcaaacagaggagatgaagaatgtgctggccaaacctggcggcagcgcaaaagatg

SEQ ID NO: 128288 - DNA, 103 bp, Artificial Sequence
  Synthetic Polynucleotide
taatacgactcactataggggtcaccaacacggtcttcaccccctccacaaacagaggagatgtggaatgggtgaagacaacctggcggcagcgcaaaagatg

SEQ ID NO: 128289 - DNA, 103 bp, Artificial Sequence
  Synthetic Polynucleotide
taatacgactcactatagggcggtccatctggcacttgtggctggccagcaacagaggagagctggcatgccacaagtgaacctggcggcagcgcaaaagatg

SEQ ID NO: 128290 - DNA, 103 bp, Artificial Sequence
  Synthetic Polynucleotide
taatacgactcactatagggctcccgcgagcggtccatctggcacttgtgaacagaggagacacaagatgcagatggacaacctggcggcagcgcaaaagatg

SEQ ID NO: 128291 - DNA, 103 bp, Artificial Sequence
  Synthetic Polynucleotide
taatacgactcactataggggggcgtactgctcccgcgagcggtccatctaacagaggagaagatggatggctcgcgggaacctggcggcagcgcaaaagatg

SEQ ID NO: 128292 - DNA, 103 bp, Artificial Sequence
  Synthetic Polynucleotide
taatacgactcactataggggccaggtcccgggcgtactgctcccgcgagaacagaggagactcgcgatggcagtacgcaacctggcggcagcgcaaaagatg

SEQ ID NO: 128293 - DNA, 103 bp, Artificial Sequence
  Synthetic Polynucleotide
taatacgactcactatagggctccagggctgccaggtcccgggcgtactgaacagaggagacagtacatgcgggacctgaacctggcggcagcgcaaaagatg

SEQ ID NO: 128294 - DNA, 103 bp, Artificial Sequence
  Synthetic Polynucleotide
taatacgactcactatagggcacactgctgctccagggctgccaggtcccaacagaggagagggaccatgcagccctggaacctggcggcagcgcaaaagatg

SEQ ID NO: 128295 - DNA, 103 bp, Artificial Sequence
  Synthetic Polynucleotide
taatacgactcactatagggcgatgctcatcacactgctgctccagggctaacagaggagaagccctatggcagcagtgaacctggcggcagcgcaaaagatg

SEQ ID NO: 128296 - DNA, 103 bp, Artificial Sequence
  Synthetic Polynucleotide
taatacgactcactatagggggctcggcgacgatgctcatcacactgctgaacagaggagacagcagatggatgagcataacctggcggcagcgcaaaagatg

SEQ ID NO: 128297 - DNA, 103 bp, Artificial Sequence
  Synthetic Polynucleotide
taatacgactcactatagggtcagctccttggctcggcgacgatgctcataacagaggagaatgagcatggtcgccgagaacctggcggcagcgcaaaagatg

SEQ ID NO: 128298 - DNA, 103 bp, Artificial Sequence
  Synthetic Polynucleotide
taatacgactcactataggggacttgtgcttcagctccttggctcggcgaaacagaggagatcgccgatgcaaggagctaacctggcggcagcgcaaaagatg

SEQ ID NO: 128299 - DNA, 103 bp, Artificial Sequence
  Synthetic Polynucleotide
taatacgactcactatagggtggccgtttgttgtcgtactcctgtgtcataacagaggagaatgacaatggagtacgacaacctggcggcagcgcaaaagatg

SEQ ID NO: 128300 - DNA, 103 bp, Artificial Sequence
  Synthetic Polynucleotide
taatacgactcactatagggagggttttccaggaaggatttccaggcctcaacagaggagagaggccatgaaatccttcaacctggcggcagcgcaaaagatg

SEQ ID NO: 128301 - DNA, 103 bp, Artificial Sequence
  Synthetic Polynucleotide
taatacgactcactataggggtcagctatgtcaatgcatctttgtttagcaacagaggagagctaaaatgagatgcattaacctggcggcagcgcaaaagatg

SEQ ID NO: 128302 - DNA, 103 bp, Artificial Sequence
  Synthetic Polynucleotide
taatacgactcactatagggtttctttatagtcagctatgtcaatgcatcaacagaggagagatgcaatgacatagctgaacctggcggcagcgcaaaagatg

SEQ ID NO: 128303 - DNA, 103 bp, Artificial Sequence
  Synthetic Polynucleotide
taatacgactcactataggggtgttgaagctttctttatagtcagctatgaacagaggagacatagcatgctataaagaaacctggcggcagcgcaaaagatg

SEQ ID NO: 128304 - DNA, 103 bp, Artificial Sequence
  Synthetic Polynucleotide
taatacgactcactataggggttactgatagtgttgaagctttctttataaacagaggagatataaaatgagcttcaacaacctggcggcagcgcaaaagatg

SEQ ID NO: 128305 - DNA, 103 bp, Artificial Sequence
  Synthetic Polynucleotide
taatacgactcactatagggtctcctcgatgttactgatagtgttgaagcaacagaggagagcttcaatgctatcagtaaacctggcggcagcgcaaaagatg

SEQ ID NO: 128306 - DNA, 103 bp, Artificial Sequence
  Synthetic Polynucleotide
taatacgactcactatagggttatacgcaatctcctcgatgttactgataaacagaggagatatcagatgcatcgaggaaacctggcggcagcgcaaaagatg

SEQ ID NO: 128307 - DNA, 103 bp, Artificial Sequence
  Synthetic Polynucleotide
taatacgactcactatagggggaaatggcgttatacgcaatctcctcgataacagaggagaatcgagatgattgcgtataacctggcggcagcgcaaaagatg

SEQ ID NO: 128308 - DNA, 103 bp, Artificial Sequence
  Synthetic Polynucleotide
taatacgactcactatagggcccatgtgaaggaaatggcgttatacgcaaaacagaggagattgcgtatgacgccatttaacctggcggcagcgcaaaagatg

SEQ ID NO: 128309 - DNA, 103 bp, Artificial Sequence
  Synthetic Polynucleotide
taatacgactcactatagggtcgttgatgtcccatgtgaaggaaatggcgaacagaggagacgccatatgcttcacatgaacctggcggcagcgcaaaagatg

SEQ ID NO: 128310 - DNA, 103 bp, Artificial Sequence
  Synthetic Polynucleotide
taatacgactcactatagggctttgcttcatcgttgatgtcccatgtgaaaacagaggagattcacaatggacatcaacaacctggcggcagcgcaaaagatg

SEQ ID NO: 128311 - DNA, 103 bp, Artificial Sequence
  Synthetic Polynucleotide
taatacgactcactatagggctgcagtgagagggttttccaggaaggattaacagaggagaaatcctatgtggaaaaccaacctggcggcagcgcaaaagatg

SEQ ID NO: 128312 - DNA, 103 bp, Artificial Sequence
  Synthetic Polynucleotide
taatacgactcactatagggagatgaaaacctttgcttcatcgttgatgtaacagaggagaacatcaatgatgaagcaaaacctggcggcagcgcaaaagatg

SEQ ID NO: 128313 - DNA, 103 bp, Artificial Sequence
  Synthetic Polynucleotide
taatacgactcactatagggcagttcacagagatgaaaacctttgcttcaaacagaggagatgaagcatgggttttcataacctggcggcagcgcaaaagatg

SEQ ID NO: 128314 - DNA, 103 bp, Artificial Sequence
  Synthetic Polynucleotide
taatacgactcactatagggtgtgcttaagcagttcacagagatgaaaacaacagaggagagttttcatgtctgtgaacaacctggcggcagcgcaaaagatg

SEQ ID NO: 128315 - DNA, 103 bp, Artificial Sequence
  Synthetic Polynucleotide
taatacgactcactatagggaagagaaatctgtgcttaagcagttcacagaacagaggagactgtgaatggcttaagcaaacctggcggcagcgcaaaagatg

SEQ ID NO: 128316 - DNA, 103 bp, Artificial Sequence
  Synthetic Polynucleotide
taatacgactcactatagggcccttctgggaagagaaatctgtgcttaagaacagaggagacttaagatgagatttctcaacctggcggcagcgcaaaagatg

SEQ ID NO: 128317 - DNA, 103 bp, Artificial Sequence
  Synthetic Polynucleotide
taatacgactcactatagggccccttcactcccttctgggaagagaaatcaacagaggagagatttcatgtcccagaagaacctggcggcagcgcaaaagatg

SEQ ID NO: 128318 - DNA, 103 bp, Artificial Sequence
  Synthetic Polynucleotide
taatacgactcactatagggtaagaggcaaccccttcactcccttctgggaacagaggagacccagaatggagtgaaggaacctggcggcagcgcaaaagatg

SEQ ID NO: 128319 - DNA, 103 bp, Artificial Sequence
  Synthetic Polynucleotide
taatacgactcactatagggacttgaatgttaagaggcaaccccttcactaacagaggagaagtgaaatggttgcctctaacctggcggcagcgcaaaagatg

SEQ ID NO: 128320 - DNA, 103 bp, Artificial Sequence
  Synthetic Polynucleotide
taatacgactcactatagggataggtatcaacttgaatgttaagaggcaaaacagaggagattgcctatgaacattcaaaacctggcggcagcgcaaaagatg

SEQ ID NO: 128321 - DNA, 103 bp, Artificial Sequence
  Synthetic Polynucleotide
taatacgactcactatagggtgttgtaactataggtatcaacttgaatgtaacagaggagaacattcatgttgatacctaacctggcggcagcgcaaaagatg

SEQ ID NO: 128322 - DNA, 103 bp, Artificial Sequence
  Synthetic Polynucleotide
taatacgactcactataggggctttggtcgctgcagtgagagggttttccaacagaggagaggaaaaatgtctcactgcaacctggcggcagcgcaaaagatg

SEQ ID NO: 128323 - DNA, 103 bp, Artificial Sequence
  Synthetic Polynucleotide
taatacgactcactatagggttgctgcggttgttgtaactataggtatcaaacagaggagatgatacatgtagttacaaaacctggcggcagcgcaaaagatg

SEQ ID NO: 128324 - DNA, 103 bp, Artificial Sequence
  Synthetic Polynucleotide
taatacgactcactatagggcacaggcttgttgctgcggttgttgtaactaacagaggagaagttacatgaaccgcagcaacctggcggcagcgcaaaagatg

SEQ ID NO: 128325 - DNA, 103 bp, Artificial Sequence
  Synthetic Polynucleotide
taatacgactcactatagggaggcccggtgcacaggcttgttgctgcggtaacagaggagaaccgcaatgacaagcctgaacctggcggcagcgcaaaagatg

SEQ ID NO: 128326 - DNA, 103 bp, Artificial Sequence
  Synthetic Polynucleotide
taatacgactcactatagggatctggcagtaggcccggtgcacaggcttgaacagaggagacaagccatggcaccgggcaacctggcggcagcgcaaaagatg

SEQ ID NO: 128327 - DNA, 103 bp, Artificial Sequence
  Synthetic Polynucleotide
taatacgactcactataggggaagaccttgatctggcagtaggcccggtgaacagaggagacaccggatgtactgccagaacctggcggcagcgcaaaagatg

SEQ ID NO: 128328 - DNA, 103 bp, Artificial Sequence
  Synthetic Polynucleotide
taatacgactcactatagggccttgtcacagaagaccttgatctggcagtaacagaggagaactgccatgtcaaggtctaacctggcggcagcgcaaaagatg

SEQ ID NO: 128329 - DNA, 103 bp, Artificial Sequence
  Synthetic Polynucleotide
taatacgactcactatagggcgctcagctcccttgtcacagaagaccttgaacagaggagacaaggtatgctgtgacaaaacctggcggcagcgcaaaagatg

SEQ ID NO: 128330 - DNA, 103 bp, Artificial Sequence
  Synthetic Polynucleotide
taatacgactcactatagggcctgattttccgctcagctcccttgtcacaaacagaggagatgtgacatgggagctgagaacctggcggcagcgcaaaagatg

SEQ ID NO: 128331 - DNA, 103 bp, Artificial Sequence
  Synthetic Polynucleotide
taatacgactcactataggggttcttcatccctgattttccgctcagctcaacagaggagagagctgatgggaaaatcaaacctggcggcagcgcaaaagatg

SEQ ID NO: 128332 - DNA, 103 bp, Artificial Sequence
  Synthetic Polynucleotide
taatacgactcactatagggctttgctttcgttcttcatccctgattttcaacagaggagagaaaatatgggatgaagaaacctggcggcagcgcaaaagatg

SEQ ID NO: 128333 - DNA, 103 bp, Artificial Sequence
  Synthetic Polynucleotide
taatacgactcactataggggctcatcatcgctttggtcgctgcagtgagaacagaggagactcactatggcgaccaaaaacctggcggcagcgcaaaagatg

SEQ ID NO: 128334 - DNA, 103 bp, Artificial Sequence
  Synthetic Polynucleotide
taatacgactcactatagggttttcttttgctttgctttcgttcttcatcaacagaggagagatgaaatgcgaaagcaaaacctggcggcagcgcaaaagatg

SEQ ID NO: 128335 - DNA, 103 bp, Artificial Sequence
  Synthetic Polynucleotide
taatacgactcactatagggcatcagaaacttttcttttgctttgctttcaacagaggagagaaagcatggcaaaagaaaacctggcggcagcgcaaaagatg

SEQ ID NO: 128336 - DNA, 103 bp, Artificial Sequence
  Synthetic Polynucleotide
taatacgactcactatagggggcactttaacatcagaaacttttcttttgaacagaggagacaaaagatgagtttctgaaacctggcggcagcgcaaaagatg

SEQ ID NO: 128337 - DNA, 103 bp, Artificial Sequence
  Synthetic Polynucleotide
taatacgactcactataggggggaagcagtggcactttaacatcagaaacaacagaggagagtttctatggttaaagtgaacctggcggcagcgcaaaagatg

SEQ ID NO: 128338 - DNA, 103 bp, Artificial Sequence
  Synthetic Polynucleotide
taatacgactcactataggggcttgtgagagggaagcagtggcactttaaaacagaggagattaaagatgcactgcttcaacctggcggcagcgcaaaagatg

SEQ ID NO: 128339 - DNA, 103 bp, Artificial Sequence
  Synthetic Polynucleotide
taatacgactcactatagggatatccattcgcttgtgagagggaagcagtaacagaggagaactgctatgctctcacaaaacctggcggcagcgcaaaagatg

SEQ ID NO: 128340 - DNA, 103 bp, Artificial Sequence
  Synthetic Polynucleotide
taatacgactcactataggggaaaactgtgatatccattcgcttgtgagaaacagaggagatctcacatgcgaatggataacctggcggcagcgcaaaagatg

SEQ ID NO: 128341 - DNA, 103 bp, Artificial Sequence
  Synthetic Polynucleotide
taatacgactcactatagggtgaagggtttgaaaactgtgatatccattcaacagaggagagaatggatgtcacagtttaacctggcggcagcgcaaaagatg

SEQ ID NO: 128342 - DNA, 103 bp, Artificial Sequence
  Synthetic Polynucleotide
taatacgactcactatagggtcgagatcaatgaagggtttgaaaactgtgaacagaggagacacagtatgcaaacccttaacctggcggcagcgcaaaagatg

SEQ ID NO: 128343 - DNA, 103 bp, Artificial Sequence
  Synthetic Polynucleotide
taatacgactcactatagggaggctgagtatcgagatcaatgaagggtttaacagaggagaaaacccatgattgatctcaacctggcggcagcgcaaaagatg

SEQ ID NO: 128344 - DNA, 103 bp, Artificial Sequence
  Synthetic Polynucleotide
taatacgactcactatagggctccattgatgctcatcatcgctttggtcgaacagaggagacgaccaatgcgatgatgaaacctggcggcagcgcaaaagatg

SEQ ID NO: 128345 - DNA, 103 bp, Artificial Sequence
  Synthetic Polynucleotide
taatacgactcactatagggtgaagaggacaggctgagtatcgagatcaaaacagaggagattgatcatgatactcagcaacctggcggcagcgcaaaagatg

SEQ ID NO: 128346 - DNA, 103 bp, Artificial Sequence
  Synthetic Polynucleotide
taatacgactcactatagggacgtcaggaatgaagaggacaggctgagtaaacagaggagatactcaatgtgtcctcttaacctggcggcagcgcaaaagatg

SEQ ID NO: 128347 - DNA, 103 bp, Artificial Sequence
  Synthetic Polynucleotide
taatacgactcactatagggggcaaagtgcacgtcaggaatgaagaggacaacagaggagagtcctcatgattcctgacaacctggcggcagcgcaaaagatg

SEQ ID NO: 128348 - DNA, 103 bp, Artificial Sequence
  Synthetic Polynucleotide
taatacgactcactataggggctgcaagttggcaaagtgcacgtcaggaaaacagaggagattcctgatgtgcactttgaacctggcggcagcgcaaaagatg

SEQ ID NO: 128349 - DNA, 103 bp, Artificial Sequence
  Synthetic Polynucleotide
taatacgactcactatagggtgagtgccccgctgcaagttggcaaagtgcaacagaggagagcacttatgcaacttgcaaacctggcggcagcgcaaaagatg

SEQ ID NO: 128350 - DNA, 103 bp, Artificial Sequence
  Synthetic Polynucleotide
taatacgactcactataggggggaaggacatgagtgccccgctgcaagttaacagaggagaaacttgatgcggggcactaacctggcggcagcgcaaaagatg

SEQ ID NO: 128351 - DNA, 103 bp, Artificial Sequence
  Synthetic Polynucleotide
taatacgactcactatagggcagaggcaatgggaaggacatgagtgccccaacagaggagaggggcaatgatgtccttcaacctggcggcagcgcaaaagatg

SEQ ID NO: 128352 - DNA, 103 bp, Artificial Sequence
  Synthetic Polynucleotide
taatacgactcactatagggtccaattcttcagaggcaatgggaaggacaaacagaggagatgtcctatgcattgcctcaacctggcggcagcgcaaaagatg

SEQ ID NO: 128353 - DNA, 103 bp, Artificial Sequence
  Synthetic Polynucleotide
taatacgactcactataggggccttcaccctccaattcttcagaggcaataacagaggagaattgccatggaagaattgaacctggcggcagcgcaaaagatg

SEQ ID NO: 128354 - DNA, 103 bp, Artificial Sequence
  Synthetic Polynucleotide
taatacgactcactatagggtcaagacagagccttcaccctccaattcttaacagaggagaaagaatatgagggtgaagaacctggcggcagcgcaaaagatg

SEQ ID NO: 128355 - DNA, 103 bp, Artificial Sequence
  Synthetic Polynucleotide
taatacgactcactatagggctgtcttcatctccattgatgctcatcatcaacagaggagagatgatatgcatcaatggaacctggcggcagcgcaaaagatg

SEQ ID NO: 128356 - DNA, 103 bp, Artificial Sequence
  Synthetic Polynucleotide
taatacgactcactatagggggcccccttttcaagacagagccttcacccaacagaggagagggtgaatgctctgtcttaacctggcggcagcgcaaaagatg

SEQ ID NO: 128357 - DNA, 103 bp, Artificial Sequence
  Synthetic Polynucleotide
taatacgactcactatagggtgtgccgtacggcccccttttcaagacagaaacagaggagatctgtcatgaaaagggggaacctggcggcagcgcaaaagatg

SEQ ID NO: 128358 - DNA, 103 bp, Artificial Sequence
  Synthetic Polynucleotide
taatacgactcactatagggagtcatcttctgtgccgtacggccccctttaacagaggagaaaagggatgcgtacggcaaacctggcggcagcgcaaaagatg

SEQ ID NO: 128359 - DNA, 103 bp, Artificial Sequence
  Synthetic Polynucleotide
taatacgactcactataggggggacagcaaagtcatcttctgtgccgtacaacagaggagagtacggatgagaagatgaaacctggcggcagcgcaaaagatg

SEQ ID NO: 128360 - DNA, 103 bp, Artificial Sequence
  Synthetic Polynucleotide
taatacgactcactatagggggtagaaggagggacagcaaagtcatcttcaacagaggagagaagatatgtttgctgtcaacctggcggcagcgcaaaagatg

SEQ ID NO: 128361 - DNA, 103 bp, Artificial Sequence
  Synthetic Polynucleotide
taatacgactcactataggggggccagcttggtagaaggagggacagcaaaacagaggagattgctgatgctccttctaaacctggcggcagcgcaaaagatg

SEQ ID NO: 128362 - DNA, 103 bp, Artificial Sequence
  Synthetic Polynucleotide
taatacgactcactatagggtcttctatccgggccagcttggtagaaggaaacagaggagatccttcatgcaagctggcaacctggcggcagcgcaaaagatg

SEQ ID NO: 128363 - DNA, 103 bp, Artificial Sequence
  Synthetic Polynucleotide
taatacgactcactatagggtctctttggttcttctatccgggccagcttaacagaggagaaagctgatgcggatagaaaacctggcggcagcgcaaaagatg

SEQ ID NO: 128364 - DNA, 103 bp, Artificial Sequence
  Synthetic Polynucleotide
taatacgactcactatagggagagcagcactctctttggttcttctatccaacagaggagaggatagatgaaccaaagaaacctggcggcagcgcaaaagatg

SEQ ID NO: 128365 - DNA, 103 bp, Artificial Sequence
  Synthetic Polynucleotide
taatacgactcactatagggtttcgaacgtagagcagcactctctttggtaacagaggagaaccaaaatgagtgctgctaacctggcggcagcgcaaaagatg

SEQ ID NO: 128366 - DNA, 103 bp, Artificial Sequence
  Synthetic Polynucleotide
taatacgactcactatagggcgcagcggcgctgtcttcatctccattgataacagaggagaatcaatatggatgaagacaacctggcggcagcgcaaaagatg

SEQ ID NO: 128367 - DNA, 103 bp, Artificial Sequence
  Synthetic Polynucleotide
taatacgactcactatagggttctgactcctttcgaacgtagagcagcacaacagaggagagtgctgatgtacgttcgaaacctggcggcagcgcaaaagatg

SEQ ID NO: 128368 - DNA, 103 bp, Artificial Sequence
  Synthetic Polynucleotide
taatacgactcactatagggcaaagacttcttctgactcctttcgaacgtaacagaggagaacgttcatgaggagtcagaacctggcggcagcgcaaaagatg

SEQ ID NO: 128369 - DNA, 103 bp, Artificial Sequence
  Synthetic Polynucleotide
taatacgactcactatagggatcagggcatcaaagacttcttctgactccaacagaggagaggagtcatgagaagtcttaacctggcggcagcgcaaaagatg

SEQ ID NO: 128370 - DNA, 103 bp, Artificial Sequence
  Synthetic Polynucleotide
taatacgactcactatagggggttttgagcatcagggcatcaaagacttcaacagaggagagaagtcatggatgccctgaacctggcggcagcgcaaaagatg

SEQ ID NO: 128371 - DNA, 103 bp, Artificial Sequence
  Synthetic Polynucleotide
taatacgactcactatagggtcaaagatggggttttgagcatcagggcataacagaggagaatgcccatgtgctcaaaaaacctggcggcagcgcaaaagatg

SEQ ID NO: 128372 - DNA, 103 bp, Artificial Sequence
  Synthetic Polynucleotide
taatacgactcactatagggatcaagcccttcaaagatggggttttgagcaacagaggagagctcaaatgcccatctttaacctggcggcagcgcaaaagatg

SEQ ID NO: 128373 - DNA, 103 bp, Artificial Sequence
  Synthetic Polynucleotide
taatacgactcactataggggatagcttccatcaagcccttcaaagatggaacagaggagaccatctatgaagggcttgaacctggcggcagcgcaaaagatg

SEQ ID NO: 128374 - DNA, 103 bp, Artificial Sequence
  Synthetic Polynucleotide
taatacgactcactatagggatttgtctgagatagcttccatcaagccctaacagaggagaagggctatgtggaagctaaacctggcggcagcgcaaaagatg

SEQ ID NO: 128375 - DNA, 103 bp, Artificial Sequence
  Synthetic Polynucleotide
taatacgactcactatagggggaacatcgtatttgtctgagatagcttccaacagaggagaggaagcatgctcagacaaaacctggcggcagcgcaaaagatg

SEQ ID NO: 128376 - DNA, 103 bp, Artificial Sequence
  Synthetic Polynucleotide
taatacgactcactatagggcttgtcatggggaacatcgtatttgtctgaaacagaggagatcagacatgtacgatgttaacctggcggcagcgcaaaagatg

SEQ ID NO: 128377 - DNA, 103 bp, Artificial Sequence
  Synthetic Polynucleotide
taatacgactcactataggggcaggcccagcgcagcggcgctgtcttcataacagaggagaatgaagatggcgccgctgaacctggcggcagcgcaaaagatg

SEQ ID NO: 128378 - DNA, 103 bp, Artificial Sequence
  Synthetic Polynucleotide
taatacgactcactatagggttttcccaatcttgtcatggggaacatcgtaacagaggagaacgatgatgcccatgacaaacctggcggcagcgcaaaagatg

SEQ ID NO: 128379 - DNA, 103 bp, Artificial Sequence
  Synthetic Polynucleotide
taatacgactcactatagggttcttgaatattttcccaatcttgtcatggaacagaggagaccatgaatggattgggaaaacctggcggcagcgcaaaagatg

SEQ ID NO: 128380 - DNA, 103 bp, Artificial Sequence
  Synthetic Polynucleotide
taatacgactcactatagggctttttacacttcttgaatattttcccaataacagaggagaattgggatgatattcaagaacctggcggcagcgcaaaagatg

SEQ ID NO: 128381 - DNA, 103 bp, Artificial Sequence
  Synthetic Polynucleotide
taatacgactcactatagggccaggatcccctttttacacttcttgaataaacagaggagatattcaatgagtgtaaaaaacctggcggcagcgcaaaagatg

SEQ ID NO: 128382 - DNA, 103 bp, Artificial Sequence
  Synthetic Polynucleotide
taatacgactcactatagggtccatgttcaccaggatcccctttttacacaacagaggagagtgtaaatgggggatcctaacctggcggcagcgcaaaagatg

SEQ ID NO: 128383 - DNA, 103 bp, Artificial Sequence
  Synthetic Polynucleotide
taatacgactcactatagggaatgttgtcgtccatgttcaccaggatcccaacagaggagagggatcatggtgaacatgaacctggcggcagcgcaaaagatg

SEQ ID NO: 128384 - DNA, 103 bp, Artificial Sequence
  Synthetic Polynucleotide
taatacgactcactatagggaatgcttcacaatgttgtcgtccatgttcaaacagaggagatgaacaatgacgacaacaaacctggcggcagcgcaaaagatg

SEQ ID NO: 128385 - DNA, 103 bp, Artificial Sequence
  Synthetic Polynucleotide
taatacgactcactatagggtcattggagtaatgcttcacaatgttgtcgaacagaggagacgacaaatgtgtgaagcaaacctggcggcagcgcaaaagatg

SEQ ID NO: 128386 - DNA, 103 bp, Artificial Sequence
  Synthetic Polynucleotide
taatacgactcactataggggaaggtgtcctcattggagtaatgcttcacaacagaggagagtgaagatgtactccaataacctggcggcagcgcaaaagatg

SEQ ID NO: 128387 - DNA, 103 bp, Artificial Sequence
  Synthetic Polynucleotide
taatacgactcactatagggtctgcagctggaaggtgtcctcattggagtaacagaggagaactccaatgaggacacctaacctggcggcagcgcaaaagatg

SEQ ID NO: 128388 - DNA, 103 bp, Artificial Sequence
  Synthetic Polynucleotide
taatacgactcactatagggtagtcatagagcaggcccagcgcagcggcgaacagaggagacgccgcatggctgggcctaacctggcggcagcgcaaaagatg

SEQ ID NO: 128389 - DNA, 103 bp, Artificial Sequence
  Synthetic Polynucleotide
taatacgactcactataggggcttcttcaatctgcagctggaaggtgtccaacagaggagaggacacatgccagctgcaaacctggcggcagcgcaaaagatg

SEQ ID NO: 128390 - DNA, 103 bp, Artificial Sequence
  Synthetic Polynucleotide
taatacgactcactatagggagaccccccggcttcttcaatctgcagctgaacagaggagacagctgatgattgaagaaaacctggcggcagcgcaaaagatg

SEQ ID NO: 128391 - DNA, 103 bp, Artificial Sequence
  Synthetic Polynucleotide
taatacgactcactatagggtgagcttgtaagaccccccggcttcttcaaaacagaggagattgaagatgccggggggtaacctggcggcagcgcaaaagatg

SEQ ID NO: 128392 - DNA, 103 bp, Artificial Sequence
  Synthetic Polynucleotide
taatacgactcactatagggtccgtcagggtgagcttgtaagaccccccgaacagaggagacgggggatgttacaagctaacctggcggcagcgcaaaagatg

SEQ ID NO: 128393 - DNA, 103 bp, Artificial Sequence
  Synthetic Polynucleotide
taatacgactcactatagggaaccttgtagtagtcatagagcaggcccagaacagaggagactgggcatgctctatgacaacctggcggcagcgcaaaagatg

SEQ ID NO: 128394 - DNA, 103 bp, Artificial Sequence
  Synthetic Polynucleotide
taatacgactcactataggggaaccaacactggccgtttgttgtcgtactaacagaggagaagtacgatgacaaacggcaacctggcggcagcgcaaaagatg

SEQ ID NO: 128395 - DNA, 103 bp, Artificial Sequence
  Synthetic Polynucleotide
taatacgactcactatagggtctctcttggaaccttgtagtagtcatagaaacagaggagatctatgatgactacaaggaacctggcggcagcgcaaaagatg

SEQ ID NO: 128396 - DNA, 103 bp, Artificial Sequence
  Synthetic Polynucleotide
taatacgactcactataggggatgaccttctctctcttggaaccttgtagaacagaggagactacaaatgtccaagagaaacctggcggcagcgcaaaagatg

SEQ ID NO: 128397 - DNA, 103 bp, Artificial Sequence
  Synthetic Polynucleotide
taatacgactcactatagggctttgctgttgatgaccttctctctcttggaacagaggagaccaagaatgagaaggtcaaacctggcggcagcgcaaaagatg

SEQ ID NO: 128398 - DNA, 103 bp, Artificial Sequence
  Synthetic Polynucleotide
taatacgactcactatagggccacctctggctttgctgttgatgaccttcaacagaggagagaaggtatgcaacagcaaaacctggcggcagcgcaaaagatg

SEQ ID NO: 128399 - DNA, 103 bp, Artificial Sequence
  Synthetic Polynucleotide
taatacgactcactatagggtcagggtgctccacctctggctttgctgttaacagaggagaaacagcatggccagaggtaacctggcggcagcgcaaaagatg

SEQ ID NO: 128400 - DNA, 103 bp, Artificial Sequence
  Synthetic Polynucleotide
taatacgactcactataggggtgatctggctcagggtgctccacctctggaacagaggagaccagagatggagcaccctaacctggcggcagcgcaaaagatg

SEQ ID NO: 128401 - DNA, 103 bp, Artificial Sequence
  Synthetic Polynucleotide
taatacgactcactatagggttcttttgctgtgatctggctcagggtgctaacagaggagaagcaccatgagccagatcaacctggcggcagcgcaaaagatg

SEQ ID NO: 128402 - DNA, 103 bp, Artificial Sequence
  Synthetic Polynucleotide
taatacgactcactatagggggtatgctgtttcttttgctgtgatctggcaacagaggagagccagaatgcagcaaaagaacctggcggcagcgcaaaagatg

SEQ ID NO: 128403 - DNA, 103 bp, Artificial Sequence
  Synthetic Polynucleotide
taatacgactcactatagggtgtcacaattggtatgctgtttcttttgctaacagaggagaagcaaaatgaacagcataaacctggcggcagcgcaaaagatg

SEQ ID NO: 128404 - DNA, 103 bp, Artificial Sequence
  Synthetic Polynucleotide
taatacgactcactatagggggggctgctctgtcacaattggtatgctgtaacagaggagaacagcaatgcaattgtgaaacctggcggcagcgcaaaagatg

SEQ ID NO: 128405 - DNA, 103 bp, Artificial Sequence
  Synthetic Polynucleotide
taatacgactcactatagggtcattctgaagaaccaacactggccgtttgaacagaggagacaaacgatgagtgttggtaacctggcggcagcgcaaaagatg

SEQ ID NO: 128406 - DNA, 103 bp, Artificial Sequence
  Synthetic Polynucleotide
taatacgactcactataggggcagagatgaggggctgctctgtcacaattaacagaggagaaattgtatgagagcagccaacctggcggcagcgcaaaagatg

SEQ ID NO: 128407 - DNA, 103 bp, Artificial Sequence
  Synthetic Polynucleotide
taatacgactcactataggggttttctccagcagagatgaggggctgctcaacagaggagagagcagatgctcatctctaacctggcggcagcgcaaaagatg

SEQ ID NO: 128408 - DNA, 103 bp, Artificial Sequence
  Synthetic Polynucleotide
taatacgactcactatagggcttgcactctgttttctccagcagagatgaaacagaggagatcatctatgctggagaaaaacctggcggcagcgcaaaagatg

SEQ ID NO: 128409 - DNA, 103 bp, Artificial Sequence
  Synthetic Polynucleotide
taatacgactcactatagggtttttcagtacttgcactctgttttctccaaacagaggagatggagaatgcagagtgcaaacctggcggcagcgcaaaagatg

SEQ ID NO: 128410 - DNA, 103 bp, Artificial Sequence
  Synthetic Polynucleotide
taatacgactcactatagggaaatggcacatttttcagtacttgcactctaacagaggagaagagtgatggtactgaaaaacctggcggcagcgcaaaagatg

SEQ ID NO: 128411 - DNA, 103 bp, Artificial Sequence
  Synthetic Polynucleotide
taatacgactcactatagggggacaatgttaaatggcacatttttcagtaaacagaggagatactgaatgatgtgccataacctggcggcagcgcaaaagatg

SEQ ID NO: 128412 - DNA, 103 bp, Artificial Sequence
  Synthetic Polynucleotide
taatacgactcactatagggccatggggaaggacaatgttaaatggcacaaacagaggagatgtgccatgtaacattgtaacctggcggcagcgcaaaagatg

SEQ ID NO: 128413 - DNA, 103 bp, Artificial Sequence
  Synthetic Polynucleotide
taatacgactcactatagggcagctggttgccatggggaaggacaatgttaacagaggagaaacattatgcttccccataacctggcggcagcgcaaaagatg

SEQ ID NO: 128414 - DNA, 103 bp, Artificial Sequence
  Synthetic Polynucleotide
taatacgactcactatagggtatcaatgcccagctggttgccatggggaaaacagaggagattccccatggcaaccagcaacctggcggcagcgcaaaagatg

SEQ ID NO: 128415 - DNA, 103 bp, Artificial Sequence
  Synthetic Polynucleotide
taatacgactcactatagggtggcctctcttatcaatgcccagctggttgaacagaggagacaaccaatggggcattgaaacctggcggcagcgcaaaagatg

SEQ ID NO: 128416 - DNA, 103 bp, Artificial Sequence
  Synthetic Polynucleotide
taatacgactcactatagggataaagtgcttcattctgaagaaccaacacaacagaggagagtgttgatgcttcagaataacctggcggcagcgcaaaagatg

SEQ ID NO: 128417 - DNA, 103 bp, Artificial Sequence
  Synthetic Polynucleotide
taatacgactcactatagggagctgtcagatggcctctcttatcaatgccaacagaggagaggcattatgaagagaggcaacctggcggcagcgcaaaagatg

SEQ ID NO: 128418 - DNA, 103 bp, Artificial Sequence
  Synthetic Polynucleotide
taatacgactcactatagggtcgtatctggagctgtcagatggcctctctaacagaggagaagagagatgatctgacagaacctggcggcagcgcaaaagatg

SEQ ID NO: 128419 - DNA, 103 bp, Artificial Sequence
  Synthetic Polynucleotide
taatacgactcactatagggacagtgactgtcgtatctggagctgtcagaaacagaggagatctgacatgtccagatacaacctggcggcagcgcaaaagatg

SEQ ID NO: 128420 - DNA, 103 bp, Artificial Sequence
  Synthetic Polynucleotide
taatacgactcactatagggtgctatggagacagtgactgtcgtatctggaacagaggagaccagatatgacagtcactaacctggcggcagcgcaaaagatg

SEQ ID NO: 128421 - DNA, 103 bp, Artificial Sequence
  Synthetic Polynucleotide
taatacgactcactatagggtaggcatcgttgctatggagacagtgactgaacagaggagacagtcaatgtctccatagaacctggcggcagcgcaaaagatg

SEQ ID NO: 128422 - DNA, 103 bp, Artificial Sequence
  Synthetic Polynucleotide
taatacgactcactatagggatggagtgggtaggcatcgttgctatggagaacagaggagactccatatgaacgatgccaacctggcggcagcgcaaaagatg

SEQ ID NO: 128423 - DNA, 103 bp, Artificial Sequence
  Synthetic Polynucleotide
taatacgactcactatagggttctgtcttgatggagtgggtaggcatcgtaacagaggagaacgatgatgacccactccaacctggcggcagcgcaaaagatg

SEQ ID NO: 128424 - DNA, 103 bp, Artificial Sequence
  Synthetic Polynucleotide
taatacgactcactataggggtggctgggtttctgtcttgatggagtgggaacagaggagacccactatgtcaagacagaacctggcggcagcgcaaaagatg

SEQ ID NO: 128425 - DNA, 103 bp, Artificial Sequence
  Synthetic Polynucleotide
taatacgactcactataggggcgaagccatgtggctgggtttctgtcttgaacagaggagacaagacatgaacccagccaacctggcggcagcgcaaaagatg

SEQ ID NO: 128426 - DNA, 103 bp, Artificial Sequence
  Synthetic Polynucleotide
taatacgactcactataggggattcccacagcgaagccatgtggctgggtaacagaggagaacccagatgcatggcttcaacctggcggcagcgcaaaagatg

SEQ ID NO: 128427 - DNA, 103 bp, Artificial Sequence
  Synthetic Polynucleotide
taatacgactcactataggggccgctgtggataaagtgcttcattctgaaaacagaggagattcagaatgaagcactttaacctggcggcagcgcaaaagatg

SEQ ID NO: 128428 - DNA, 103 bp, Artificial Sequence
  Synthetic Polynucleotide
taatacgactcactatagggctgctggggggattcccacagcgaagccataacagaggagaatggctatgctgtgggaaaacctggcggcagcgcaaaagatg

SEQ ID NO: 128429 - DNA, 103 bp, Artificial Sequence
  Synthetic Polynucleotide
taatacgactcactatagggggatgatacactgctggggggattcccacaaacagaggagatgtgggatgccccccagcaacctggcggcagcgcaaaagatg

SEQ ID NO: 128430 - DNA, 103 bp, Artificial Sequence
  Synthetic Polynucleotide
taatacgactcactatagggagtgggctcaggatgatacactgctgggggaacagaggagacccccaatggtgtatcataacctggcggcagcgcaaaagatg

SEQ ID NO: 128431 - DNA, 103 bp, Artificial Sequence
  Synthetic Polynucleotide
taatacgactcactatagggccacccgctcagtgggctcaggatgatacaaacagaggagatgtatcatgctgagcccaaacctggcggcagcgcaaaagatg

SEQ ID NO: 128432 - DNA, 103 bp, Artificial Sequence
  Synthetic Polynucleotide
taatacgactcactatagggtcgaaaaccaccacccgctcagtgggctcaaacagaggagatgagccatgtgagcgggtaacctggcggcagcgcaaaagatg

SEQ ID NO: 128433 - DNA, 103 bp, Artificial Sequence
  Synthetic Polynucleotide
taatacgactcactataggggagattccgatcgaaaaccaccacccgctcaacagaggagagagcggatggtggttttcaacctggcggcagcgcaaaagatg

SEQ ID NO: 128434 - DNA, 103 bp, Artificial Sequence
  Synthetic Polynucleotide
taatacgactcactatagggggtcagtattgagattccgatcgaaaaccaaacagaggagatggtttatgatcggaatcaacctggcggcagcgcaaaagatg

SEQ ID NO: 128435 - DNA, 103 bp, Artificial Sequence
  Synthetic Polynucleotide
taatacgactcactataggggagctgaactggtcagtattgagattccgaaacagaggagatcggaaatgcaatactgaaacctggcggcagcgcaaaagatg

SEQ ID NO: 128436 - DNA, 103 bp, Artificial Sequence
  Synthetic Polynucleotide
taatacgactcactatagggttgagcaccagagctgaactggtcagtattaacagaggagaaatactatgcagttcagcaacctggcggcagcgcaaaagatg

SEQ ID NO: 128437 - DNA, 103 bp, Artificial Sequence
  Synthetic Polynucleotide
taatacgactcactatagggcatttggggcttgagcaccagagctgaactaacagaggagaagttcaatgctggtgctcaacctggcggcagcgcaaaagatg

SEQ ID NO: 128438 - DNA, 103 bp, Artificial Sequence
  Synthetic Polynucleotide
taatacgactcactataggggtgtaggaccgccgctgtggataaagtgctaacagaggagaagcactatgtccacagcgaacctggcggcagcgcaaaagatg

SEQ ID NO: 128439 - DNA, 103 bp, Artificial Sequence
  Synthetic Polynucleotide
taatacgactcactatagggcgcctttgagcatttggggcttgagcaccaaacagaggagatggtgcatgagccccaaaaacctggcggcagcgcaaaagatg

SEQ ID NO: 128440 - DNA, 103 bp, Artificial Sequence
  Synthetic Polynucleotide
taatacgactcactataggggtctggagttcgcctttgagcatttggggcaacagaggagagccccaatggctcaaaggaacctggcggcagcgcaaaagatg

SEQ ID NO: 128441 - DNA, 103 bp, Artificial Sequence
  Synthetic Polynucleotide
taatacgactcactatagggagaaggtcgagtctggagttcgcctttgagaacagaggagactcaaaatggaactccagaacctggcggcagcgcaaaagatg

SEQ ID NO: 128442 - DNA, 103 bp, Artificial Sequence
  Synthetic Polynucleotide
taatacgactcactatagggaaggtctctgagaaggtcgagtctggagttaacagaggagaaactccatgctcgaccttaacctggcggcagcgcaaaagatg

SEQ ID NO: 128443 - DNA, 103 bp, Artificial Sequence
  Synthetic Polynucleotide
taatacgactcactataggggccttccttgaaggtctctgagaaggtcgaaacagaggagatcgaccatgtcagagaccaacctggcggcagcgcaaaagatg

SEQ ID NO: 128444 - DNA, 103 bp, Artificial Sequence
  Synthetic Polynucleotide
taatacgactcactatagggcctcctgaacgccttccttgaaggtctctgaacagaggagacagagaatgtcaaggaagaacctggcggcagcgcaaaagatg

SEQ ID NO: 128445 - DNA, 103 bp, Artificial Sequence
  Synthetic Polynucleotide
taatacgactcactataggggggaagaaaacctcctgaacgccttccttgaacagaggagacaaggaatgcgttcaggaaacctggcggcagcgcaaaagatg

SEQ ID NO: 128446 - DNA, 103 bp, Artificial Sequence
  Synthetic Polynucleotide
taatacgactcactataggggagatccgaggggaagaaaacctcctgaacaacagaggagagttcagatggttttcttcaacctggcggcagcgcaaaagatg

SEQ ID NO: 128447 - DNA, 103 bp, Artificial Sequence
  Synthetic Polynucleotide
taatacgactcactatagggtccgcagactgagatccgaggggaagaaaaaacagaggagattttctatgcctcggatcaacctggcggcagcgcaaaagatg

SEQ ID NO: 128448 - DNA, 103 bp, Artificial Sequence
  Synthetic Polynucleotide
taatacgactcactatagggatgccaggcatccgcagactgagatccgagaacagaggagactcggaatgcagtctgcgaacctggcggcagcgcaaaagatg

SEQ ID NO: 128449 - DNA, 103 bp, Artificial Sequence
  Synthetic Polynucleotide
taatacgactcactatagggatcctcactagtgtaggaccgccgctgtggaacagaggagaccacagatgcggtcctacaacctggcggcagcgcaaaagatg

SEQ ID NO: 128450 - DNA, 103 bp, Artificial Sequence
  Synthetic Polynucleotide
taatacgactcactatagggctctgaattcatgccaggcatccgcagactaacagaggagaagtctgatgatgcctggcaacctggcggcagcgcaaaagatg

SEQ ID NO: 128451 - DNA, 103 bp, Artificial Sequence
  Synthetic Polynucleotide
taatacgactcactatagggaaacatagtcctctgaattcatgccaggcaaacagaggagatgcctgatgtgaattcagaacctggcggcagcgcaaaagatg

SEQ ID NO: 128452 - DNA, 103 bp, Artificial Sequence
  Synthetic Polynucleotide
taatacgactcactatagggacactgtcaaaaacatagtcctctgaattcaacagaggagagaattcatgggactatgtaacctggcggcagcgcaaaagatg

SEQ ID NO: 128453 - DNA, 103 bp, Artificial Sequence
  Synthetic Polynucleotide
taatacgactcactataggggttcccagaaacactgtcaaaaacatagtcaacagaggagagactatatgtttgacagtaacctggcggcagcgcaaaagatg

SEQ ID NO: 128454 - DNA, 103 bp, Artificial Sequence
  Synthetic Polynucleotide
taatacgactcactatagggattcaaagttgttcccagaaacactgtcaaaacagaggagattgacaatgtttctgggaaacctggcggcagcgcaaaagatg

SEQ ID NO: 128455 - DNA, 103 bp, Artificial Sequence
  Synthetic Polynucleotide
taatacgactcactatagggtctagggtatattcaaagttgttcccagaaaacagaggagattctggatgcaactttgaaacctggcggcagcgcaaaagatg

SEQ ID NO: 128456 - DNA, 103 bp, Artificial Sequence
  Synthetic Polynucleotide
taatacgactcactatagggttttgaagcttctagggtatattcaaagttaacagaggagaaactttatgtataccctaaacctggcggcagcgcaaaagatg

SEQ ID NO: 128457 - DNA, 103 bp, Artificial Sequence
  Synthetic Polynucleotide
taatacgactcactataggggtcgaagtgattttgaagcttctagggtataacagaggagaatacccatgaagcttcaaaacctggcggcagcgcaaaagatg

SEQ ID NO: 128458 - DNA, 103 bp, Artificial Sequence
  Synthetic Polynucleotide
taatacgactcactatagggcctggcttctgtcgaagtgattttgaagctaacagaggagaagcttcatgatcacttcgaacctggcggcagcgcaaaagatg

SEQ ID NO: 128459 - DNA, 103 bp, Artificial Sequence
  Synthetic Polynucleotide
taatacgactcactatagggggtactgtctcctggcttctgtcgaagtgaaacagaggagatcacttatgcagaagccaaacctggcggcagcgcaaaagatg

SEQ ID NO: 128460 - DNA, 103 bp, Artificial Sequence
  Synthetic Polynucleotide
taatacgactcactatagggtccaggcctcatcctcactagtgtaggaccaacagaggagaggtcctatgctagtgaggaacctggcggcagcgcaaaagatg

SEQ ID NO: 128461 - DNA, 103 bp, Artificial Sequence
  Synthetic Polynucleotide
taatacgactcactatagggggtacgtcatggtactgtctcctggcttctaacagaggagaagaagcatggagacagtaaacctggcggcagcgcaaaagatg

SEQ ID NO: 128462 - DNA, 103 bp, Artificial Sequence
  Synthetic Polynucleotide
taatacgactcactatagggcctttgttcaggtacgtcatggtactgtctaacagaggagaagacagatgcatgacgtaaacctggcggcagcgcaaaagatg

SEQ ID NO: 128463 - DNA, 103 bp, Artificial Sequence
  Synthetic Polynucleotide
taatacgactcactatagggatagaactggcctttgttcaggtacgtcataacagaggagaatgacgatgctgaacaaaaacctggcggcagcgcaaaagatg

SEQ ID NO: 128464 - DNA, 103 bp, Artificial Sequence
  Synthetic Polynucleotide
taatacgactcactatagggaggtgatgggatagaactggcctttgttcaaacagaggagatgaacaatggccagttctaacctggcggcagcgcaaaagatg

SEQ ID NO: 128465 - DNA, 103 bp, Artificial Sequence
  Synthetic Polynucleotide
taatacgactcactatagggacctccttcaaggtgatgggatagaactggaacagaggagaccagttatgtcccatcacaacctggcggcagcgcaaaagatg

SEQ ID NO: 128466 - DNA, 103 bp, Artificial Sequence
  Synthetic Polynucleotide
taatacgactcactatagggactgctgctcacctccttcaaggtgatgggaacagaggagacccatcatgttgaaggagaacctggcggcagcgcaaaagatg

SEQ ID NO: 128467 - DNA, 103 bp, Artificial Sequence
  Synthetic Polynucleotide
taatacgactcactatagggggattccttcactgctgctcacctccttcaaacagaggagatgaaggatgtgagcagcaaacctggcggcagcgcaaaagatg

SEQ ID NO: 128468 - DNA, 103 bp, Artificial Sequence
  Synthetic Polynucleotide
taatacgactcactatagggatgggatgatggattccttcactgctgctcaacagaggagagagcagatgtgaaggaataacctggcggcagcgcaaaagatg

SEQ ID NO: 128469 - DNA, 103 bp, Artificial Sequence
  Synthetic Polynucleotide
taatacgactcactatagggaactttgctgatgggatgatggattccttcaacagaggagagaaggaatgcatcatcccaacctggcggcagcgcaaaagatg

SEQ ID NO: 128470 - DNA, 103 bp, Artificial Sequence
  Synthetic Polynucleotide
taatacgactcactatagggtcacacttcgaactttgctgatgggatgataacagaggagaatcatcatgtcagcaaagaacctggcggcagcgcaaaagatg

SEQ ID NO: 128471 - DNA, 103 bp, Artificial Sequence
  Synthetic Polynucleotide
taatacgactcactatagggaggaaggatttccaggcctcatcctcactaaacagaggagatagtgaatgtgaggcctgaacctggcggcagcgcaaaagatg

SEQ ID NO: 128472 - DNA, 103 bp, Artificial Sequence
  Synthetic Polynucleotide
taatacgactcactatagggaccaccatgatcacacttcgaactttgctgaacagaggagacagcaaatgtcgaagtgtaacctggcggcagcgcaaaagatg

SEQ ID NO: 128473 - DNA, 103 bp, Artificial Sequence
  Synthetic Polynucleotide
taatacgactcactatagggttcagcaaaaaccaccatgatcacacttcgaacagaggagacgaagtatgatcatggtgaacctggcggcagcgcaaaagatg

SEQ ID NO: 128474 - DNA, 103 bp, Artificial Sequence
  Synthetic Polynucleotide
taatacgactcactatagggtgcttttgtcttcagcaaaaaccaccatgaaacagaggagatcatggatgtttttgctgaacctggcggcagcgcaaaagatg

SEQ ID NO: 128475 - DNA, 103 bp, Artificial Sequence
  Synthetic Polynucleotide
taatacgactcactatagggtgatcttctctgcttttgtcttcagcaaaaaacagaggagattttgcatgagacaaaagaacctggcggcagcgcaaaagatg

SEQ ID NO: 128476 - DNA, 103 bp, Artificial Sequence
  Synthetic Polynucleotide
taatacgactcactatagggatgccttaactgatcttctctgcttttgtcaacagaggagagacaaaatgagagaagataacctggcggcagcgcaaaagatg

SEQ ID NO: 128477 - DNA, 103 bp, Artificial Sequence
  Synthetic Polynucleotide
taatacgactcactatagggagtacttccaatgccttaactgatcttctcaacagaggagagagaagatgagttaaggcaacctggcggcagcgcaaaagatg

SEQ ID NO: 128478 - DNA, 103 bp, Artificial Sequence
  Synthetic Polynucleotide
taatacgactcactatagggcgggagtgccagtacttccaatgccttaacaacagaggagagttaagatgttggaagtaaacctggcggcagcgcaaaagatg

SEQ ID NO: 128479 - DNA, 103 bp, Artificial Sequence
  Synthetic Polynucleotide
taatacgactcactatagggggtgtgctgccgggagtgccagtacttccaaacagaggagatggaagatgtggcactccaacctggcggcagcgcaaaagatg

SEQ ID NO: 128480 - DNA, 103 bp, Artificial Sequence
  Synthetic Polynucleotide
taatacgactcactatagggtttgtttagcggtgtgctgccgggagtgccaacagaggagaggcactatgggcagcacaaacctggcggcagcgcaaaagatg

SEQ ID NO: 128481 - DNA, 103 bp, Artificial Sequence
  Synthetic Polynucleotide
taatacgactcactatagggtcaatgcatctttgtttagcggtgtgctgcaacagaggagagcagcaatgcgctaaacaaacctggcggcagcgcaaaagatg

SEQ ID NO: 128482 - DNA, 103 bp, Artificial Sequence
  Synthetic Polynucleotide
taatacgactcactatagggtcttttattattgtccgactcttgtgacataacagaggagaatgtcaatggagtcggacaacctggcggcagcgcaaaagatg

SEQ ID NO: 128483 - DNA, 103 bp, Artificial Sequence
  Synthetic Polynucleotide
taatacgactcactatagggcaagtatgacttccaggcttcatcctcactaacagaggagaagtgagatggaagcctggaacctggcggcagcgcaaaagatg

SEQ ID NO: 128484 - DNA, 103 bp, Artificial Sequence
  Synthetic Polynucleotide
taatacgactcactataggggctctccttgtaatcggcaatgtcaaggacaacagaggagagtccttatgattgccgataacctggcggcagcgcaaaagatg

SEQ ID NO: 128485 - DNA, 103 bp, Artificial Sequence
  Synthetic Polynucleotide
taatacgactcactatagggtcgtattaaagctctccttgtaatcggcaaaacagaggagattgccgatgacaaggagaaacctggcggcagcgcaaaagatg

SEQ ID NO: 128486 - DNA, 103 bp, Artificial Sequence
  Synthetic Polynucleotide
taatacgactcactatagggatgtttccaatcgtattaaagctctccttgaacagaggagacaaggaatgctttaatacaacctggcggcagcgcaaaagatg

SEQ ID NO: 128487 - DNA, 103 bp, Artificial Sequence
  Synthetic Polynucleotide
taatacgactcactatagggaatctcttcaatgtttccaatcgtattaaaaacagaggagatttaatatgattggaaacaacctggcggcagcgcaaaagatg

SEQ ID NO: 128488 - DNA, 103 bp, Artificial Sequence
  Synthetic Polynucleotide
taatacgactcactatagggcattatatgcaatctcttcaatgtttccaaaacagaggagattggaaatgttgaagagaaacctggcggcagcgcaaaagatg

SEQ ID NO: 128489 - DNA, 103 bp, Artificial Sequence
  Synthetic Polynucleotide
taatacgactcactatagggaaggaaacagcattatatgcaatctcttcaaacagaggagatgaagaatgtgcatataaaacctggcggcagcgcaaaagatg

SEQ ID NO: 128490 - DNA, 103 bp, Artificial Sequence
  Synthetic Polynucleotide
taatacgactcactataggggtcccaggtaaaggaaacagcattatatgcaacagaggagagcatatatggctgtttccaacctggcggcagcgcaaaagatg

SEQ ID NO: 128491 - DNA, 103 bp, Artificial Sequence
  Synthetic Polynucleotide
taatacgactcactatagggcttcattcacgtcccaggtaaaggaaacagaacagaggagactgtttatgttacctgggaacctggcggcagcgcaaaagatg

SEQ ID NO: 128492 - DNA, 103 bp, Artificial Sequence
  Synthetic Polynucleotide
taatacgactcactatagggatcttcgcctcttcattcacgtcccaggtaaacagaggagatacctgatgcgtgaatgaaacctggcggcagcgcaaaagatg

SEQ ID NO: 128493 - DNA, 103 bp, Artificial Sequence
  Synthetic Polynucleotide
taatacgactcactatagggggtgatgaaaatcttcgcctcttcattcacaacagaggagagtgaatatggaggcgaagaacctggcggcagcgcaaaagatg

SEQ ID NO: 128494 - DNA, 103 bp, Artificial Sequence
  Synthetic Polynucleotide
taatacgactcactatagggggggattctccaagtatgacttccaggcttaacagaggagaaagcctatgagtcatactaacctggcggcagcgcaaaagatg

SEQ ID NO: 128495 - DNA, 103 bp, Artificial Sequence
  Synthetic Polynucleotide
taatacgactcactatagggagcaattcacggtgatgaaaatcttcgcctaacagaggagaaggcgaatgttttcatcaaacctggcggcagcgcaaaagatg

SEQ ID NO: 128496 - DNA, 103 bp, Artificial Sequence
  Synthetic Polynucleotide
taatacgactcactatagggtctgtgctcaagcaattcacggtgatgaaaaacagaggagatttcatatgcgtgaattgaacctggcggcagcgcaaaagatg

SEQ ID NO: 128497 - DNA, 103 bp, Artificial Sequence
  Synthetic Polynucleotide
taatacgactcactatagggggaggagaaatctgtgctcaagcaattcacaacagaggagagtgaatatgttgagcacaaacctggcggcagcgcaaaagatg

SEQ ID NO: 128498 - DNA, 103 bp, Artificial Sequence
  Synthetic Polynucleotide
taatacgactcactatagggcccctttttgggaggagaaatctgtgctcaaacagaggagatgagcaatgatttctcctaacctggcggcagcgcaaaagatg

SEQ ID NO: 128499 - DNA, 103 bp, Artificial Sequence
  Synthetic Polynucleotide
taatacgactcactatagggagtcctttcacccctttttgggaggagaaaaacagaggagatttctcatgccaaaaaggaacctggcggcagcgcaaaagatg

SEQ ID NO: 128500 - DNA, 103 bp, Artificial Sequence
  Synthetic Polynucleotide
taatacgactcactatagggcatcaaaggaagtcctttcacccctttttgaacagaggagacaaaaaatggtgaaaggaaacctggcggcagcgcaaaagatg

SEQ ID NO: 128501 - DNA, 103 bp, Artificial Sequence
  Synthetic Polynucleotide
taatacgactcactatagggcaatctgaatcatcaaaggaagtcctttcaaacagaggagatgaaagatgttcctttgaaacctggcggcagcgcaaaagatg

SEQ ID NO: 128502 - DNA, 103 bp, Artificial Sequence
  Synthetic Polynucleotide
taatacgactcactatagggctgtatgtgtcaatctgaatcatcaaaggaaacagaggagatcctttatggattcagataacctggcggcagcgcaaaagatg

SEQ ID NO: 128503 - DNA, 103 bp, Artificial Sequence
  Synthetic Polynucleotide
taatacgactcactatagggattgttataactgtatgtgtcaatctgaataacagaggagaattcagatggacacatacaacctggcggcagcgcaaaagatg

SEQ ID NO: 128504 - DNA, 103 bp, Artificial Sequence
  Synthetic Polynucleotide
taatacgactcactatagggtattgctacgattgttataactgtatgtgtaacagaggagaacacatatggttataacaaacctggcggcagcgcaaaagatg

SEQ ID NO: 128505 - DNA, 103 bp, Artificial Sequence
  Synthetic Polynucleotide
taatacgactcactataggggctgctgtcaggggattctccaagtatgacaacagaggagagtcataatgggagaatccaacctggcggcagcgcaaaagatg

SEQ ID NO: 128506 - DNA, 103 bp, Artificial Sequence
  Synthetic Polynucleotide
taatacgactcactatagggtgaatgggtttattgctacgattgttataaaacagaggagattataaatgtcgtagcaaaacctggcggcagcgcaaaagatg

SEQ ID NO: 128507 - DNA, 103 bp, Artificial Sequence
  Synthetic Polynucleotide
taatacgactcactatagggataagctctatgaatgggtttattgctacgaacagaggagacgtagcatgaaacccattaacctggcggcagcgcaaaagatg

SEQ ID NO: 128508 - DNA, 103 bp, Artificial Sequence
  Synthetic Polynucleotide
taatacgactcactatagggtgatctggcaataagctctatgaatgggttaacagaggagaaacccaatgatagagcttaacctggcggcagcgcaaaagatg

SEQ ID NO: 128509 - DNA, 103 bp, Artificial Sequence
  Synthetic Polynucleotide
taatacgactcactatagggcagaagaccttgatctggcaataagctctaaacagaggagatagagcatgttgccagataacctggcggcagcgcaaaagatg

SEQ ID NO: 128510 - DNA, 103 bp, Artificial Sequence
  Synthetic Polynucleotide
taatacgactcactatagggtcctttgtcacagaagaccttgatctggcaaacagaggagatgccagatgaaggtcttcaacctggcggcagcgcaaaagatg

SEQ ID NO: 128511 - DNA, 103 bp, Artificial Sequence
  Synthetic Polynucleotide
taatacgactcactatagggttctttctgctcctttgtcacagaagacctaacagaggagaaggtctatggtgacaaagaacctggcggcagcgcaaaagatg

SEQ ID NO: 128512 - DNA, 103 bp, Artificial Sequence
  Synthetic Polynucleotide
taatacgactcactatagggtctcggatttttctttctgctcctttgtcaaacagaggagatgacaaatgagcagaaagaacctggcggcagcgcaaaagatg

SEQ ID NO: 128513 - DNA, 103 bp, Artificial Sequence
  Synthetic Polynucleotide
taatacgactcactatagggccgctcttcatctcggatttttctttctgcaacagaggagagcagaaatgaaaatccgaaacctggcggcagcgcaaaagatg

SEQ ID NO: 128514 - DNA, 103 bp, Artificial Sequence
  Synthetic Polynucleotide
taatacgactcactatagggtgttctgcttccgctcttcatctcggatttaacagaggagaaaatccatgatgaagagcaacctggcggcagcgcaaaagatg

SEQ ID NO: 128515 - DNA, 103 bp, Artificial Sequence
  Synthetic Polynucleotide
taatacgactcactatagggcctttcttcctgttctgcttccgctcttcaaacagaggagatgaagaatggaagcagaaaacctggcggcagcgcaaaagatg

SEQ ID NO: 128516 - DNA, 103 bp, Artificial Sequence
  Synthetic Polynucleotide
taatacgactcactatagggggccttggtggctgctgtcaggggattctcaacagaggagagagaatatgctgacagcaaacctggcggcagcgcaaaagatg

SEQ ID NO: 128517 - DNA, 103 bp, Artificial Sequence
  Synthetic Polynucleotide
taatacgactcactatagggctggcctttccctttcttcctgttctgcttaacagaggagaaagcagatgaggaagaaaaacctggcggcagcgcaaaagatg

SEQ ID NO: 128518 - DNA, 103 bp, Artificial Sequence
  Synthetic Polynucleotide
taatacgactcactatagggtttgggaggcctggcctttccctttcttccaacagaggagaggaagaatgggaaaggccaacctggcggcagcgcaaaagatg

SEQ ID NO: 128519 - DNA, 103 bp, Artificial Sequence
  Synthetic Polynucleotide
taatacgactcactatagggttgcattgagtttgggaggcctggcctttcaacagaggagagaaaggatgggcctcccaaacctggcggcagcgcaaaagatg

SEQ ID NO: 128520 - DNA, 103 bp, Artificial Sequence
  Synthetic Polynucleotide
taatacgactcactatagggagaggagctgttgcattgagtttgggaggcaacagaggagagcctccatgactcaatgcaacctggcggcagcgcaaaagatg

SEQ ID NO: 128521 - DNA, 103 bp, Artificial Sequence
  Synthetic Polynucleotide
taatacgactcactatagggacttcccatcagaggagctgttgcattgagaacagaggagactcaatatgacagctcctaacctggcggcagcgcaaaagatg

SEQ ID NO: 128522 - DNA, 103 bp, Artificial Sequence
  Synthetic Polynucleotide
taatacgactcactatagggatggcagccaacttcccatcagaggagctgaacagaggagacagctcatgtgatgggaaaacctggcggcagcgcaaaagatg

SEQ ID NO: 128523 - DNA, 103 bp, Artificial Sequence
  Synthetic Polynucleotide
taatacgactcactatagggctgtaaaggtatggcagccaacttcccatcaacagaggagagatgggatgttggctgccaacctggcggcagcgcaaaagatg

SEQ ID NO: 128524 - DNA, 103 bp, Artificial Sequence
  Synthetic Polynucleotide
taatacgactcactatagggcactcttcttctgtaaaggtatggcagccaaacagaggagatggctgatgtacctttacaacctggcggcagcgcaaaagatg

SEQ ID NO: 128525 - DNA, 103 bp, Artificial Sequence
  Synthetic Polynucleotide
taatacgactcactatagggtaggtgatgtcactcttcttctgtaaaggtaacagaggagaacctttatggaagaagagaacctggcggcagcgcaaaagatg

SEQ ID NO: 128526 - DNA, 103 bp, Artificial Sequence
  Synthetic Polynucleotide
taatacgactcactatagggggttttgaagtaggtgatgtcactcttcttaacagaggagaaagaagatggacatcaccaacctggcggcagcgcaaaagatg

SEQ ID NO: 128527 - DNA, 103 bp, Artificial Sequence
  Synthetic Polynucleotide
taatacgactcactatagggtgctcatcatggccttggtggctgctgtcaaacagaggagatgacagatgccaccaaggaacctggcggcagcgcaaaagatg

SEQ ID NO: 128528 - DNA, 103 bp, Artificial Sequence
  Synthetic Polynucleotide
taatacgactcactataggggatcaggcatggttttgaagtaggtgatgtaacagaggagaacatcaatgacttcaaaaaacctggcggcagcgcaaaagatg

SEQ ID NO: 128529 - DNA, 103 bp, Artificial Sequence
  Synthetic Polynucleotide
taatacgactcactatagggtgtgagtggagatcaggcatggttttgaagaacagaggagacttcaaatgcatgcctgaaacctggcggcagcgcaaaagatg

SEQ ID NO: 128530 - DNA, 103 bp, Artificial Sequence
  Synthetic Polynucleotide
taatacgactcactataggggagaactggctgtgagtggagatcaggcataacagaggagaatgcctatgctccactcaaacctggcggcagcgcaaaagatg

SEQ ID NO: 128531 - DNA, 103 bp, Artificial Sequence
  Synthetic Polynucleotide
taatacgactcactatagggcaggtatgaagagaactggctgtgagtggaaacagaggagatccactatgagccagttcaacctggcggcagcgcaaaagatg

SEQ ID NO: 128532 - DNA, 103 bp, Artificial Sequence
  Synthetic Polynucleotide
taatacgactcactatagggaagtgaacatcaggtatgaagagaactggcaacagaggagagccagtatgcttcataccaacctggcggcagcgcaaaagatg

SEQ ID NO: 128533 - DNA, 103 bp, Artificial Sequence
  Synthetic Polynucleotide
taatacgactcactatagggcaggtttgcaaagtgaacatcaggtatgaaaacagaggagattcataatggatgttcacaacctggcggcagcgcaaaagatg

SEQ ID NO: 128534 - DNA, 103 bp, Artificial Sequence
  Synthetic Polynucleotide
taatacgactcactatagggcggtcctctgcaggtttgcaaagtgaacataacagaggagaatgttcatgttgcaaaccaacctggcggcagcgcaaaagatg

SEQ ID NO: 128535 - DNA, 103 bp, Artificial Sequence
  Synthetic Polynucleotide
taatacgactcactatagggtacacctgtccggtcctctgcaggtttgcaaacagaggagatgcaaaatggcagaggacaacctggcggcagcgcaaaagatg

SEQ ID NO: 128536 - DNA, 103 bp, Artificial Sequence
  Synthetic Polynucleotide
taatacgactcactatagggcgtgttgtaatacacctgtccggtcctctgaacagaggagacagaggatgggacaggtgaacctggcggcagcgcaaaagatg

SEQ ID NO: 128537 - DNA, 103 bp, Artificial Sequence
  Synthetic Polynucleotide
taatacgactcactataggggttcatcatccgtgttgtaatacacctgtcaacagaggagagacaggatgattacaacaaacctggcggcagcgcaaaagatg

SEQ ID NO: 128538 - DNA, 103 bp, Artificial Sequence
  Synthetic Polynucleotide
taatacgactcactatagggtcaccattaatgctcatcatggccttggtgaacagaggagacaccaaatgcatgatgagaacctggcggcagcgcaaaagatg

SEQ ID NO: 128539 - DNA, 103 bp, Artificial Sequence
  Synthetic Polynucleotide
taatacgactcactatagggccaccttctcgttcatcatccgtgttgtaaaacagaggagattacaaatgggatgatgaaacctggcggcagcgcaaaagatg

SEQ ID NO: 128540 - DNA, 103 bp, Artificial Sequence
  Synthetic Polynucleotide
taatacgactcactatagggaaggacactgccaccttctcgttcatcatcaacagaggagagatgatatgcgagaaggtaacctggcggcagcgcaaaagatg

SEQ ID NO: 128541 - DNA, 103 bp, Artificial Sequence
  Synthetic Polynucleotide
taatacgactcactatagggtccgtttaacaaggacactgccaccttctcaacagaggagagagaagatggcagtgtccaacctggcggcagcgcaaaagatg

SEQ ID NO: 128542 - DNA, 103 bp, Artificial Sequence
  Synthetic Polynucleotide
taatacgactcactatagggggccggaacatccgtttaacaaggacactgaacagaggagacagtgtatgtgttaaacgaacctggcggcagcgcaaaagatg

SEQ ID NO: 128543 - DNA, 103 bp, Artificial Sequence
  Synthetic Polynucleotide
taatacgactcactatagggctcttccatgggccggaacatccgtttaacaacagaggagagttaaaatgatgttccggaacctggcggcagcgcaaaagatg

SEQ ID NO: 128544 - DNA, 103 bp, Artificial Sequence
  Synthetic Polynucleotide
taatacgactcactataggggaccaaactcctcttccatgggccggaacaaacagaggagatgttccatgccatggaagaacctggcggcagcgcaaaagatg

SEQ ID NO: 128545 - DNA, 103 bp, Artificial Sequence
  Synthetic Polynucleotide
taatacgactcactataggggaaggcactggaccaaactcctcttccatgaacagaggagacatggaatgggagtttggaacctggcggcagcgcaaaagatg

SEQ ID NO: 128546 - DNA, 103 bp, Artificial Sequence
  Synthetic Polynucleotide
taatacgactcactatagggcatctgctttgaaggcactggaccaaactcaacagaggagagagtttatgccagtgcctaacctggcggcagcgcaaaagatg

SEQ ID NO: 128547 - DNA, 103 bp, Artificial Sequence
  Synthetic Polynucleotide
taatacgactcactatagggcttcttctttcatctgctttgaaggcactgaacagaggagacagtgcatgcaaagcagaaacctggcggcagcgcaaaagatg

SEQ ID NO: 128548 - DNA, 103 bp, Artificial Sequence
  Synthetic Polynucleotide
taatacgactcactatagggcgctttgtcccttcttctttcatctgctttaacagaggagaaaagcaatggaaagaagaaacctggcggcagcgcaaaagatg

SEQ ID NO: 128549 - DNA, 103 bp, Artificial Sequence
  Synthetic Polynucleotide
taatacgactcactatagggactgtcctcatcaccattaatgctcatcataacagaggagaatgatgatgattaatggtaacctggcggcagcgcaaaagatg

SEQ ID NO: 128550 - DNA, 103 bp, Artificial Sequence
  Synthetic Polynucleotide
taatacgactcactatagggcaagagcactcgctttgtcccttcttctttaacagaggagaaaagaaatggggacaaagaacctggcggcagcgcaaaagatg

SEQ ID NO: 128551 - DNA, 103 bp, Artificial Sequence
  Synthetic Polynucleotide
taatacgactcactatagggtcctcacgtacaagagcactcgctttgtccaacagaggagaggacaaatggagtgctctaacctggcggcagcgcaaaagatg

SEQ ID NO: 128552 - DNA, 103 bp, Artificial Sequence
  Synthetic Polynucleotide
taatacgactcactatagggtcagtctccttcctcacgtacaagagcactaacagaggagaagtgctatggtacgtgagaacctggcggcagcgcaaaagatg

SEQ ID NO: 128553 - DNA, 103 bp, Artificial Sequence
  Synthetic Polynucleotide
taatacgactcactataggggaacacatcgtcagtctccttcctcacgtaaacagaggagatacgtgatgaaggagactaacctggcggcagcgcaaaagatg

SEQ ID NO: 128554 - DNA, 103 bp, Artificial Sequence
  Synthetic Polynucleotide
taatacgactcactatagggtcaatgcatcgaacacatcgtcagtctcctaacagaggagaaggagaatgacgatgtgtaacctggcggcagcgcaaaagatg

SEQ ID NO: 128555 - DNA, 103 bp, Artificial Sequence
  Synthetic Polynucleotide
taatacgactcactataggggacttcaacatcaatgcatcgaacacatcgaacagaggagacgatgtatgcgatgcattaacctggcggcagcgcaaaagatg

SEQ ID NO: 128556 - DNA, 103 bp, Artificial Sequence
  Synthetic Polynucleotide
taatacgactcactatagggcactgtgggagacttcaacatcaatgcatcaacagaggagagatgcaatgatgttgaagaacctggcggcagcgcaaaagatg

SEQ ID NO: 128557 - DNA, 103 bp, Artificial Sequence
  Synthetic Polynucleotide
taatacgactcactatagggtcaggcccttcactgtgggagacttcaacaaacagaggagatgttgaatgctcccacagaacctggcggcagcgcaaaagatg

SEQ ID NO: 128558 - DNA, 103 bp, Artificial Sequence
  Synthetic Polynucleotide
taatacgactcactatagggatcgcttccatcaggcccttcactgtgggaaacagaggagatcccacatggaagggcctaacctggcggcagcgcaaaagatg

SEQ ID NO: 128559 - DNA, 103 bp, Artificial Sequence
  Synthetic Polynucleotide
taatacgactcactatagggtttctcagatatcgcttccatcaggcccttaacagaggagaaagggcatgatggaagcgaacctggcggcagcgcaaaagatg

SEQ ID NO: 128560 - DNA, 103 bp, Artificial Sequence
  Synthetic Polynucleotide
taatacgactcactataggggggcagcagcactgtcctcatcaccattaaaacagaggagattaatgatgatgaggacaaacctggcggcagcgcaaaagatg

SEQ ID NO: 128561 - DNA, 103 bp, Artificial Sequence
  Synthetic Polynucleotide
taatacgactcactataggggcagcccatatttctcagatatcgcttccaaacagaggagatggaagatgtatctgagaaacctggcggcagcgcaaaagatg

SEQ ID NO: 128562 - DNA, 103 bp, Artificial Sequence
  Synthetic Polynucleotide
taatacgactcactatagggttctccacgggcagcccatatttctcagataacagaggagaatctgaatgatatgggctaacctggcggcagcgcaaaagatg

SEQ ID NO: 128563 - DNA, 103 bp, Artificial Sequence
  Synthetic Polynucleotide
taatacgactcactatagggctttgctatcttctccacgggcagcccataaacagaggagatatgggatgcccgtggagaacctggcggcagcgcaaaagatg

SEQ ID NO: 128564 - DNA, 103 bp, Artificial Sequence
  Synthetic Polynucleotide
taatacgactcactatagggtcttgtaaagctttgctatcttctccacggaacagaggagaccgtggatgagatagcaaaacctggcggcagcgcaaaagatg

SEQ ID NO: 128565 - DNA, 103 bp, Artificial Sequence
  Synthetic Polynucleotide
taatacgactcactatagggtttttgcttttcttgtaaagctttgctatcaacagaggagagatagcatggctttacaaaacctggcggcagcgcaaaagatg

SEQ ID NO: 128566 - DNA, 103 bp, Artificial Sequence
  Synthetic Polynucleotide
taatacgactcactatagggcaagatgccttttttgcttttcttgtaaagaacagaggagactttacatgaaaagcaaaaacctggcggcagcgcaaaagatg

SEQ ID NO: 128567 - DNA, 103 bp, Artificial Sequence
  Synthetic Polynucleotide
taatacgactcactatagggccatgttcaccaagatgccttttttgctttaacagaggagaaaagcaatgaaggcatctaacctggcggcagcgcaaaagatg

SEQ ID NO: 128568 - DNA, 103 bp, Artificial Sequence
  Synthetic Polynucleotide
taatacgactcactatagggatgttgtcatccatgttcaccaagatgcctaacagaggagaaggcatatgggtgaacataacctggcggcagcgcaaaagatg

SEQ ID NO: 128569 - DNA, 103 bp, Artificial Sequence
  Synthetic Polynucleotide
taatacgactcactataggggtgctcgatgatgttgtcatccatgttcacaacagaggagagtgaacatggatgacaacaacctggcggcagcgcaaaagatg

SEQ ID NO: 128570 - DNA, 103 bp, Artificial Sequence
  Synthetic Polynucleotide
taatacgactcactatagggcgttcgagtagtgctcgatgatgttgtcataacagaggagaatgacaatgtcatcgagcaacctggcggcagcgcaaaagatg

SEQ ID NO: 128571 - DNA, 103 bp, Artificial Sequence
  Synthetic Polynucleotide
taatacgactcactatagggagcaggccgagggcagcagcactgtcctcaaacagaggagatgaggaatgtgctgctgcaacctggcggcagcgcaaaagatg

SEQ ID NO: 128572 - DNA, 103 bp, Artificial Sequence
  Synthetic Polynucleotide
taatacgactcactatagggaaggtgtcctcgttcgagtagtgctcgatgaacagaggagacatcgaatgctactcgaaaacctggcggcagcgcaaaagatg

SEQ ID NO: 128573 - DNA, 103 bp, Artificial Sequence
  Synthetic Polynucleotide
taatacgactcactataggggttgaggatgaaggtgtcctcgttcgagtaaacagaggagatactcgatggaggacaccaacctggcggcagcgcaaaagatg

SEQ ID NO: 128574 - DNA, 103 bp, Artificial Sequence
  Synthetic Polynucleotide
taatacgactcactatagggtgctctccatgttgaggatgaaggtgtcctaacagaggagaaggacaatgtcatcctcaaacctggcggcagcgcaaaagatg

SEQ ID NO: 128575 - DNA, 103 bp, Artificial Sequence
  Synthetic Polynucleotide
taatacgactcactatagggccctccaccatgctctccatgttgaggatgaacagaggagacatcctatgcatggagagaacctggcggcagcgcaaaagatg

SEQ ID NO: 128576 - DNA, 103 bp, Artificial Sequence
  Synthetic Polynucleotide
taatacgactcactataggggaccttgaagccctccaccatgctctccataacagaggagaatggagatgatggtggagaacctggcggcagcgcaaaagatg

SEQ ID NO: 128577 - DNA, 103 bp, Artificial Sequence
  Synthetic Polynucleotide
taatacgactcactatagggccatgagcgtgaccttgaagccctccaccaaacagaggagatggtggatggcttcaaggaacctggcggcagcgcaaaagatg

SEQ ID NO: 128578 - DNA, 103 bp, Artificial Sequence
  Synthetic Polynucleotide
taatacgactcactataggggtagtcatagagcaggccgagggcagcagcaacagaggagagctgctatgctcggcctgaacctggcggcagcgcaaaagatg

SEQ ID NO: 128579 - DNA, 103 bp, Artificial Sequence
  Synthetic Polynucleotide
taatacgactcactatagggaggccactagtcttttattattgtccgactaacagaggagaagtcggatgataataaaaaacctggcggcagcgcaaaagatg

SEQ ID NO: 128580 - DNA, 103 bp, Artificial Sequence
  Synthetic Polynucleotide
taatacgactcactataggggaaccttgtagtagtcatagagcaggccgaaacagaggagatcggccatgtctatgactaacctggcggcagcgcaaaagatg

SEQ ID NO: 128581 - DNA, 103 bp, Artificial Sequence
  Synthetic Polynucleotide
taatacgactcactatagggttgtctcgaggaaccttgtagtagtcatagaacagaggagactatgaatgctacaaggtaacctggcggcagcgcaaaagatg

SEQ ID NO: 128582 - DNA, 103 bp, Artificial Sequence
  Synthetic Polynucleotide
taatacgactcactatagggcagcagcctcttgtctcgaggaaccttgtaaacagaggagatacaagatgcctcgagacaacctggcggcagcgcaaaagatg

SEQ ID NO: 128583 - DNA, 103 bp, Artificial Sequence
  Synthetic Polynucleotide
taatacgactcactatagggtgcttacagacagcagcctcttgtctcgagaacagaggagactcgagatgagaggctgcaacctggcggcagcgcaaaagatg

SEQ ID NO: 128584 - DNA, 103 bp, Artificial Sequence
  Synthetic Polynucleotide
taatacgactcactatagggtcacttgctttgcttacagacagcagcctcaacagaggagagaggctatggtctgtaagaacctggcggcagcgcaaaagatg

SEQ ID NO: 128585 - DNA, 103 bp, Artificial Sequence
  Synthetic Polynucleotide
taatacgactcactatagggttcttggctgtcacttgctttgcttacagaaacagaggagatctgtaatgaaagcaagtaacctggcggcagcgcaaaagatg

SEQ ID NO: 128586 - DNA, 103 bp, Artificial Sequence
  Synthetic Polynucleotide
taatacgactcactatagggtctcctggtcttcttggctgtcacttgcttaacagaggagaaagcaaatgacagccaagaacctggcggcagcgcaaaagatg

SEQ ID NO: 128587 - DNA, 103 bp, Artificial Sequence
  Synthetic Polynucleotide
taatacgactcactatagggcagtttcttttctcctggtcttcttggctgaacagaggagacagccaatgagaccaggaaacctggcggcagcgcaaaagatg

SEQ ID NO: 128588 - DNA, 103 bp, Artificial Sequence
  Synthetic Polynucleotide
taatacgactcactatagggggtgccaaggcagtttcttttctcctggtcaacagaggagagaccagatgaaaagaaacaacctggcggcagcgcaaaagatg

SEQ ID NO: 128589 - DNA, 103 bp, Artificial Sequence
  Synthetic Polynucleotide
taatacgactcactataggggggcttcactggtgccaaggcagtttctttaacagaggagaaaagaaatggccttggcaaacctggcggcagcgcaaaagatg

SEQ ID NO: 128590 - DNA, 103 bp, Artificial Sequence
  Synthetic Polynucleotide
taatacgactcactatagggatgggcactaaggccactagtcttttattaaacagaggagataataaatgactagtggcaacctggcggcagcgcaaaagatg

SEQ ID NO: 128591 - DNA, 103 bp, Artificial Sequence
  Synthetic Polynucleotide
taatacgactcactatagggaaattactctgggcttcactggtgccaaggaacagaggagaccttggatgcagtgaagcaacctggcggcagcgcaaaagatg

SEQ ID NO: 128592 - DNA, 103 bp, Artificial Sequence
  Synthetic Polynucleotide
taatacgactcactatagggtcctccactcaaattactctgggcttcactaacagaggagaagtgaaatgcagagtaataacctggcggcagcgcaaaagatg

SEQ ID NO: 128593 - DNA, 103 bp, Artificial Sequence
  Synthetic Polynucleotide
taatacgactcactatagggctcggttttctcctccactcaaattactctaacagaggagaagagtaatgtgagtggagaacctggcggcagcgcaaaagatg

SEQ ID NO: 128594 - DNA, 103 bp, Artificial Sequence
  Synthetic Polynucleotide
taatacgactcactatagggaggacttgcactcggttttctcctccactcaacagaggagagagtggatgagaaaaccgaacctggcggcagcgcaaaagatg

SEQ ID NO: 128595 - DNA, 103 bp, Artificial Sequence
  Synthetic Polynucleotide
taatacgactcactatagggaacagtctttaggacttgcactcggttttcaacagaggagagaaaacatggtgcaagtcaacctggcggcagcgcaaaagatg

SEQ ID NO: 128596 - DNA, 103 bp, Artificial Sequence
  Synthetic Polynucleotide
taatacgactcactatagggggttcactggaacagtctttaggacttgcaaacagaggagatgcaagatgtaaagactgaacctggcggcagcgcaaaagatg

SEQ ID NO: 128597 - DNA, 103 bp, Artificial Sequence
  Synthetic Polynucleotide
taatacgactcactatagggtttagggaaaggttcactggaacagtctttaacagaggagaaaagacatgtccagtgaaaacctggcggcagcgcaaaagatg

SEQ ID NO: 128598 - DNA, 103 bp, Artificial Sequence
  Synthetic Polynucleotide
taatacgactcactataggggtgatcttgatttagggaaaggttcactggaacagaggagaccagtgatgctttccctaaacctggcggcagcgcaaaagatg

SEQ ID NO: 128599 - DNA, 103 bp, Artificial Sequence
  Synthetic Polynucleotide
taatacgactcactatagggaattctccaggtgatcttgatttagggaaaaacagaggagatttcccatgatcaagatcaacctggcggcagcgcaaaagatg

SEQ ID NO: 128600 - DNA, 103 bp, Artificial Sequence
  Synthetic Polynucleotide
taatacgactcactatagggtcccgcttggaattctccaggtgatcttgaaacagaggagatcaagaatgcctggagaaaacctggcggcagcgcaaaagatg

SEQ ID NO: 128601 - DNA, 103 bp, Artificial Sequence
  Synthetic Polynucleotide
taatacgactcactataggggtcactgggcatgggcactaaggccactagaacagaggagactagtgatgttagtgcccaacctggcggcagcgcaaaagatg

SEQ ID NO: 128602 - DNA, 103 bp, Artificial Sequence
  Synthetic Polynucleotide
taatacgactcactataggggctgtactgttcccgcttggaattctccagaacagaggagactggagatgtccaagcggaacctggcggcagcgcaaaagatg

SEQ ID NO: 128603 - DNA, 103 bp, Artificial Sequence
  Synthetic Polynucleotide
taatacgactcactatagggggaagctgatgctgtactgttcccgcttggaacagaggagaccaagcatgaacagtacaaacctggcggcagcgcaaaagatg

SEQ ID NO: 128604 - DNA, 103 bp, Artificial Sequence
  Synthetic Polynucleotide
taatacgactcactataggggagctctcggggaagctgatgctgtactgtaacagaggagaacagtaatgcatcagcttaacctggcggcagcgcaaaagatg

SEQ ID NO: 128605 - DNA, 103 bp, Artificial Sequence
  Synthetic Polynucleotide
taatacgactcactataggggatgatggcagagctctcggggaagctgataacagaggagaatcagcatgcccgagagcaacctggcggcagcgcaaaagatg

SEQ ID NO: 128606 - DNA, 103 bp, Artificial Sequence
  Synthetic Polynucleotide
taatacgactcactatagggccgacaccgggatgatggcagagctctcggaacagaggagaccgagaatgctgccatcaaacctggcggcagcgcaaaagatg

SEQ ID NO: 128607 - DNA, 103 bp, Artificial Sequence
  Synthetic Polynucleotide
taatacgactcactatagggaccgtgattcccgacaccgggatgatggcaaacagaggagatgccatatgcccggtgtcaacctggcggcagcgcaaaagatg

SEQ ID NO: 128608 - DNA, 103 bp, Artificial Sequence
  Synthetic Polynucleotide
taatacgactcactatagggagctttcaccaccgtgattcccgacaccggaacagaggagaccggtgatgggaatcacgaacctggcggcagcgcaaaagatg

SEQ ID NO: 128609 - DNA, 103 bp, Artificial Sequence
  Synthetic Polynucleotide
taatacgactcactatagggtgaaatcttcagctttcaccaccgtgattcaacagaggagagaatcaatgtggtgaaagaacctggcggcagcgcaaaagatg

SEQ ID NO: 128610 - DNA, 103 bp, Artificial Sequence
  Synthetic Polynucleotide
taatacgactcactatagggaaaactggtgtgaaatcttcagctttcaccaacagaggagaggtgaaatgtgaagatttaacctggcggcagcgcaaaagatg

SEQ ID NO: 128611 - DNA, 103 bp, Artificial Sequence
  Synthetic Polynucleotide
taatacgactcactatagggtggggccatgaaaactggtgtgaaatcttcaacagaggagagaagatatgacaccagttaacctggcggcagcgcaaaagatg

SEQ ID NO: 128612 - DNA, 103 bp, Artificial Sequence
  Synthetic Polynucleotide
taatacgactcactatagggtgaatggagggtcactgggcatgggcactaaacagaggagatagtgcatgtgcccagtgaacctggcggcagcgcaaaagatg

SEQ ID NO: 128613 - DNA, 103 bp, Artificial Sequence
  Synthetic Polynucleotide
taatacgactcactatagggagtgcacaggtggggccatgaaaactggtgaacagaggagacaccagatgtcatggcccaacctggcggcagcgcaaaagatg

SEQ ID NO: 128614 - DNA, 103 bp, Artificial Sequence
  Synthetic Polynucleotide
taatacgactcactatagggccccggggatagtgcacaggtggggccatgaacagaggagacatggcatgacctgtgcaaacctggcggcagcgcaaaagatg

SEQ ID NO: 128615 - DNA, 103 bp, Artificial Sequence
  Synthetic Polynucleotide
taatacgactcactatagggttccccatctccccggggatagtgcacaggaacagaggagacctgtgatgtatccccggaacctggcggcagcgcaaaagatg

SEQ ID NO: 128616 - DNA, 103 bp, Artificial Sequence
  Synthetic Polynucleotide
taatacgactcactatagggctcgttgctcttccccatctccccggggataacagaggagaatccccatggagatggggaacctggcggcagcgcaaaagatg

SEQ ID NO: 128617 - DNA, 103 bp, Artificial Sequence
  Synthetic Polynucleotide
taatacgactcactatagggaagataaccactcgttgctcttccccatctaacagaggagaagatggatgagagcaacgaacctggcggcagcgcaaaagatg

SEQ ID NO: 128618 - DNA, 103 bp, Artificial Sequence
  Synthetic Polynucleotide
taatacgactcactatagggagtctgttcaaagataaccactcgttgctcaacagaggagagagcaaatggtggttatcaacctggcggcagcgcaaaagatg

SEQ ID NO: 128619 - DNA, 103 bp, Artificial Sequence
  Synthetic Polynucleotide
taatacgactcactatagggcgtcatactgagtctgttcaaagataaccaaacagaggagatggttaatgttgaacagaaacctggcggcagcgcaaaagatg

SEQ ID NO: 128620 - DNA, 103 bp, Artificial Sequence
  Synthetic Polynucleotide
taatacgactcactatagggagcgagggcacgtcatactgagtctgttcaaacagaggagatgaacaatgtcagtatgaaacctggcggcagcgcaaaagatg

SEQ ID NO: 128621 - DNA, 103 bp, Artificial Sequence
  Synthetic Polynucleotide
taatacgactcactataggggtgggtggccagcgagggcacgtcatactgaacagaggagacagtatatggtgccctcgaacctggcggcagcgcaaaagatg

SEQ ID NO: 128622 - DNA, 103 bp, Artificial Sequence
  Synthetic Polynucleotide
taatacgactcactataggggataggcgctgtgggtggccagcgagggcaaacagaggagatgccctatgtggccacccaacctggcggcagcgcaaaagatg

SEQ ID NO: 128623 - DNA, 103 bp, Artificial Sequence
  Synthetic Polynucleotide
taatacgactcactatagggcttcgggtattgaatggagggtcactgggcaacagaggagagcccagatgccctccattaacctggcggcagcgcaaaagatg

SEQ ID NO: 128624 - DNA, 103 bp, Artificial Sequence
  Synthetic Polynucleotide
taatacgactcactatagggtcgtctttgagataggcgctgtgggtggccaacagaggagaggccacatgcagcgcctaaacctggcggcagcgcaaaagatg

SEQ ID NO: 128625 - DNA, 103 bp, Artificial Sequence
  Synthetic Polynucleotide
taatacgactcactataggggctgcgctggtcgtctttgagataggcgctaacagaggagaagcgccatgctcaaagacaacctggcggcagcgcaaaagatg

SEQ ID NO: 128626 - DNA, 103 bp, Artificial Sequence
  Synthetic Polynucleotide
taatacgactcactatagggtgtccggagtgctgcgctggtcgtctttgaaacagaggagatcaaagatgaccagcgcaaacctggcggcagcgcaaaagatg

SEQ ID NO: 128627 - DNA, 103 bp, Artificial Sequence
  Synthetic Polynucleotide
taatacgactcactatagggctgtatgtgctgtccggagtgctgcgctggaacagaggagaccagcgatgcactccggaaacctggcggcagcgcaaaagatg

SEQ ID NO: 128628 - DNA, 103 bp, Artificial Sequence
  Synthetic Polynucleotide
taatacgactcactataggggaagctctcgctgtatgtgctgtccggagtaacagaggagaactccgatgagcacatacaacctggcggcagcgcaaaagatg

SEQ ID NO: 128629 - DNA, 103 bp, Artificial Sequence
  Synthetic Polynucleotide
taatacgactcactatagggctgcgtccttgaagctctcgctgtatgtgcaacagaggagagcacatatggcgagagctaacctggcggcagcgcaaaagatg

SEQ ID NO: 128630 - DNA, 103 bp, Artificial Sequence
  Synthetic Polynucleotide
taatacgactcactatagggttctctgtggctgcgtccttgaagctctcgaacagaggagacgagagatgcaaggacgcaacctggcggcagcgcaaaagatg

SEQ ID NO: 128631 - DNA, 103 bp, Artificial Sequence
  Synthetic Polynucleotide
taatacgactcactatagggactccgaaatttctctgtggctgcgtccttaacagaggagaaaggacatggccacagagaacctggcggcagcgcaaaagatg

SEQ ID NO: 128632 - DNA, 103 bp, Artificial Sequence
  Synthetic Polynucleotide
taatacgactcactatagggcaactgaagcactccgaaatttctctgtggaacagaggagaccacagatgaatttcggaaacctggcggcagcgcaaaagatg

SEQ ID NO: 128633 - DNA, 103 bp, Artificial Sequence
  Synthetic Polynucleotide
taatacgactcactatagggtcctcagccccaactgaagcactccgaaataacagaggagaatttcgatgtgcttcagtaacctggcggcagcgcaaaagatg

SEQ ID NO: 128634 - DNA, 103 bp, Artificial Sequence
  Synthetic Polynucleotide
taatacgactcactatagggggtgtaggctcttcgggtattgaatggaggaacagaggagacctccaatgaatacccgaaacctggcggcagcgcaaaagatg

SEQ ID NO: 128635 - DNA, 103 bp, Artificial Sequence
  Synthetic Polynucleotide
taatacgactcactatagggatacatgtactcctcagccccaactgaagcaacagaggagagcttcaatgggggctgagaacctggcggcagcgcaaaagatg

SEQ ID NO: 128636 - DNA, 103 bp, Artificial Sequence
  Synthetic Polynucleotide
taatacgactcactatagggatgtctgatcatacatgtactcctcagcccaacagaggagagggctgatgagtacatgtaacctggcggcagcgcaaaagatg

SEQ ID NO: 128637 - DNA, 103 bp, Artificial Sequence
  Synthetic Polynucleotide
taatacgactcactataggggtgccacttgatgtctgatcatacatgtacaacagaggagagtacatatgtgatcagacaacctggcggcagcgcaaaagatg

SEQ ID NO: 128638 - DNA, 103 bp, Artificial Sequence
  Synthetic Polynucleotide
taatacgactcactataggggtactgaaatgtgccacttgatgtctgatcaacagaggagagatcagatgtcaagtggcaacctggcggcagcgcaaaagatg

SEQ ID NO: 128639 - DNA, 103 bp, Artificial Sequence
  Synthetic Polynucleotide
taatacgactcactatagggcttccagggtgtactgaaatgtgccacttgaacagaggagacaagtgatgcatttcagtaacctggcggcagcgcaaaagatg

SEQ ID NO: 128640 - DNA, 103 bp, Artificial Sequence
  Synthetic Polynucleotide
taatacgactcactataggggatttggtggcttccagggtgtactgaaataacagaggagaatttcaatgcaccctggaaacctggcggcagcgcaaaagatg

SEQ ID NO: 128641 - DNA, 103 bp, Artificial Sequence
  Synthetic Polynucleotide
taatacgactcactatagggctgacggagagatttggtggcttccagggtaacagaggagaaccctgatggccaccaaaaacctggcggcagcgcaaaagatg

SEQ ID NO: 128642 - DNA, 103 bp, Artificial Sequence
  Synthetic Polynucleotide
taatacgactcactatagggccccctgcttctgacggagagatttggtggaacagaggagaccaccaatgctctccgtcaacctggcggcagcgcaaaagatg

SEQ ID NO: 128643 - DNA, 103 bp, Artificial Sequence
  Synthetic Polynucleotide
taatacgactcactatagggatggggccctccccctgcttctgacggagaaacagaggagatctccgatggaagcagggaacctggcggcagcgcaaaagatg

SEQ ID NO: 128644 - DNA, 103 bp, Artificial Sequence
  Synthetic Polynucleotide
taatacgactcactataggggaggtaggtcatggggccctccccctgcttaacagaggagaaagcagatggagggccccaacctggcggcagcgcaaaagatg

SEQ ID NO: 128645 - DNA, 103 bp, Artificial Sequence
  Synthetic Polynucleotide
taatacgactcactatagggcatcctcactggtgtaggctcttcgggtataacagaggagaatacccatggagcctacaaacctggcggcagcgcaaaagatg

SEQ ID NO: 128646 - DNA, 103 bp, Artificial Sequence
  Synthetic Polynucleotide
taatacgactcactataggggtcctttgttgaggtaggtcatggggccctaacagaggagaagggccatgtgacctaccaacctggcggcagcgcaaaagatg

SEQ ID NO: 128647 - DNA, 103 bp, Artificial Sequence
  Synthetic Polynucleotide
taatacgactcactataggggcatagaactgtcctttgttgaggtaggtcaacagaggagagacctaatgcaacaaaggaacctggcggcagcgcaaaagatg

SEQ ID NO: 128648 - DNA, 103 bp, Artificial Sequence
  Synthetic Polynucleotide
taatacgactcactataggggagtgttatggcatagaactgtcctttgttaacagaggagaaacaaaatgcagttctataacctggcggcagcgcaaaagatg

SEQ ID NO: 128649 - DNA, 103 bp, Artificial Sequence
  Synthetic Polynucleotide
taatacgactcactatagggcggtctcgctgagtgttatggcatagaactaacagaggagaagttctatgccataacacaacctggcggcagcgcaaaagatg

SEQ ID NO: 128650 - DNA, 103 bp, Artificial Sequence
  Synthetic Polynucleotide
taatacgactcactatagggttgttgtctccggtctcgctgagtgttatgaacagaggagacataacatgcagcgagacaacctggcggcagcgcaaaagatg

SEQ ID NO: 128651 - DNA, 103 bp, Artificial Sequence
  Synthetic Polynucleotide
taatacgactcactatagggtcggaagcatttgttgtctccggtctcgctaacagaggagaagcgagatgggagacaacaacctggcggcagcgcaaaagatg

SEQ ID NO: 128652 - DNA, 103 bp, Artificial Sequence
  Synthetic Polynucleotide
taatacgactcactatagggtgatggggtgtcggaagcatttgttgtctcaacagaggagagagacaatgaatgcttccaacctggcggcagcgcaaaagatg

SEQ ID NO: 128653 - DNA, 103 bp, Artificial Sequence
  Synthetic Polynucleotide
taatacgactcactatagggctgactttgctgatggggtgtcggaagcataacagaggagaatgcttatgacaccccataacctggcggcagcgcaaaagatg

SEQ ID NO: 128654 - DNA, 103 bp, Artificial Sequence
  Synthetic Polynucleotide
taatacgactcactatagggcaccacactcctgactttgctgatggggtgaacagaggagacaccccatgagcaaagtcaacctggcggcagcgcaaaagatg

SEQ ID NO: 128655 - DNA, 103 bp, Artificial Sequence
  Synthetic Polynucleotide
taatacgactcactatagggagaccaccatcaccacactcctgactttgcaacagaggagagcaaagatgggagtgtggaacctggcggcagcgcaaaagatg

SEQ ID NO: 128656 - DNA, 103 bp, Artificial Sequence
  Synthetic Polynucleotide
taatacgactcactatagggttccaggcttcatcctcactggtgtaggctaacagaggagaagcctaatgcagtgaggaaacctggcggcagcgcaaaagatg

SEQ ID NO: 128657 - DNA, 103 bp, Artificial Sequence
  Synthetic Polynucleotide
taatacgactcactatagggtcttcactgaagaccaccatcaccacactcaacagaggagagagtgtatggatggtggtaacctggcggcagcgcaaaagatg

SEQ ID NO: 128658 - DNA, 103 bp, Artificial Sequence
  Synthetic Polynucleotide
taatacgactcactatagggtctgtttttgtcttcactgaagaccaccataacagaggagaatggtgatgttcagtgaaaacctggcggcagcgcaaaagatg

SEQ ID NO: 128659 - DNA, 103 bp, Artificial Sequence
  Synthetic Polynucleotide
taatacgactcactataggggctgttcatctctgtttttgtcttcactgaaacagaggagatcagtgatgacaaaaacaaacctggcggcagcgcaaaagatg

SEQ ID NO: 128660 - DNA, 103 bp, Artificial Sequence
  Synthetic Polynucleotide
taatacgactcactatagggcagtatttgagctgttcatctctgtttttgaacagaggagacaaaaaatgagatgaacaaacctggcggcagcgcaaaagatg

SEQ ID NO: 128661 - DNA, 103 bp, Artificial Sequence
  Synthetic Polynucleotide
taatacgactcactatagggccagtatttccagtatttgagctgttcatcaacagaggagagatgaaatgctcaaatacaacctggcggcagcgcaaaagatg

SEQ ID NO: 128662 - DNA, 103 bp, Artificial Sequence
  Synthetic Polynucleotide
taatacgactcactataggggccgagagtgccagtatttccagtatttgaaacagaggagatcaaatatgggaaatactaacctggcggcagcgcaaaagatg

SEQ ID NO: 128663 - DNA, 103 bp, Artificial Sequence
  Synthetic Polynucleotide
taatacgactcactataggggccgtatgctgccgagagtgccagtatttcaacagaggagagaaataatggcactctcgaacctggcggcagcgcaaaagatg

SEQ ID NO: 128664 - DNA, 103 bp, Artificial Sequence
  Synthetic Polynucleotide
taatacgactcactatagggcctctgcttcgccgtatgctgccgagagtgaacagaggagacactctatgcagcatacgaacctggcggcagcgcaaaagatg

SEQ ID NO: 128665 - DNA, 103 bp, Artificial Sequence
  Synthetic Polynucleotide
taatacgactcactatagggtgtcaaggaccctctgcttcgccgtatgctaacagaggagaagcataatgcgaagcagaaacctggcggcagcgcaaaagatg

SEQ ID NO: 128666 - DNA, 103 bp, Artificial Sequence
  Synthetic Polynucleotide
taatacgactcactatagggtaatcggcaatgtcaaggaccctctgcttcaacagaggagagaagcaatgggtccttgaaacctggcggcagcgcaaaagatg

SEQ ID NO: 128667 - DNA, 103 bp, Artificial Sequence
  Synthetic Polynucleotide
taatacgactcactataggggttgtcgatgctgaacatgctggcgggcataacagaggagaatgcccatgagcatgttcaacctggcggcagcgcaaaagatg

SEQ ID NO: 128668 - DNA, 103 bp, Artificial Sequence
  Synthetic Polynucleotide
taatacgactcactatagggcccgtgcagggccgggaagacgacgggagcaacagaggagagctcccatggtcttcccgaacctggcggcagcgcaaaagatg

SEQ ID NO: 128669 - DNA, 103 bp, Artificial Sequence
  Synthetic Polynucleotide
taatacgactcactatagggagagcgagtccccgtgcagggccgggaagaaacagaggagatcttccatgccctgcacgaacctggcggcagcgcaaaagatg

SEQ ID NO: 128670 - DNA, 103 bp, Artificial Sequence
  Synthetic Polynucleotide
taatacgactcactatagggctggcgccgtagagcgagtccccgtgcaggaacagaggagacctgcaatgggactcgctaacctggcggcagcgcaaaagatg

SEQ ID NO: 128671 - DNA, 103 bp, Artificial Sequence
  Synthetic Polynucleotide
taatacgactcactatagggggcgccgccgctggcgccgtagagcgagtcaacagaggagagactcgatgtacggcgccaacctggcggcagcgcaaaagatg

SEQ ID NO: 128672 - DNA, 103 bp, Artificial Sequence
  Synthetic Polynucleotide
taatacgactcactatagggagtccgaggaggcgccgccgctggcgccgtaacagaggagaacggcgatggcggcggcgaacctggcggcagcgcaaaagatg

SEQ ID NO: 128673 - DNA, 103 bp, Artificial Sequence
  Synthetic Polynucleotide
taatacgactcactatagggaaggcgccatagtccgaggaggcgccgccgaacagaggagacggcggatgctcctcggaaacctggcggcagcgcaaaagatg

SEQ ID NO: 128674 - DNA, 103 bp, Artificial Sequence
  Synthetic Polynucleotide
taatacgactcactataggggcgcgggtagaaggcgccatagtccgaggaaacagaggagatcctcgatgtatggcgccaacctggcggcagcgcaaaagatg

SEQ ID NO: 128675 - DNA, 103 bp, Artificial Sequence
  Synthetic Polynucleotide
taatacgactcactataggggggccacggggcgcgggtagaaggcgccataacagaggagaatggcgatgtctacccgcaacctggcggcagcgcaaaagatg

SEQ ID NO: 128676 - DNA, 103 bp, Artificial Sequence
  Synthetic Polynucleotide
taatacgactcactataggggcgccgccgggggccacggggcgcgggtagaacagaggagactacccatgccccgtggcaacctggcggcagcgcaaaagatg

SEQ ID NO: 128677 - DNA, 103 bp, Artificial Sequence
  Synthetic Polynucleotide
taatacgactcactatagggcgggaggcccgcgccgccgggggccacgggaacagaggagacccgtgatgcccggcggcaacctggcggcagcgcaaaagatg

SEQ ID NO: 128678 - DNA, 103 bp, Artificial Sequence
  Synthetic Polynucleotide
taatacgactcactatagggcggctaggatgttgtcgatgctgaacatgcaacagaggagagcatgtatggcatcgacaaacctggcggcagcgcaaaagatg

SEQ ID NO: 128679 - DNA, 103 bp, Artificial Sequence
  Synthetic Polynucleotide
taatacgactcactatagggtgaccgcggccgggaggcccgcgccgccggaacagaggagaccggcgatgcgggcctccaacctggcggcagcgcaaaagatg

SEQ ID NO: 128680 - DNA, 103 bp, Artificial Sequence
  Synthetic Polynucleotide
taatacgactcactatagggcgggagccgctgaccgcggccgggaggcccaacagaggagagggcctatgggccgcggtaacctggcggcagcgcaaaagatg

SEQ ID NO: 128681 - DNA, 103 bp, Artificial Sequence
  Synthetic Polynucleotide
taatacgactcactataggggtagccgaggcgggagccgctgaccgcggcaacagaggagagccgcgatgagcggctccaacctggcggcagcgcaaaagatg

SEQ ID NO: 128682 - DNA, 103 bp, Artificial Sequence
  Synthetic Polynucleotide
taatacgactcactatagggagtagttgttgtagccgaggcgggagccgcaacagaggagagcggctatggcctcggctaacctggcggcagcgcaaaagatg

SEQ ID NO: 128683 - DNA, 103 bp, Artificial Sequence
  Synthetic Polynucleotide
taatacgactcactatagggtgcccgtagaagtagttgttgtagccgaggaacagaggagacctcggatgcaacaactaaacctggcggcagcgcaaaagatg

SEQ ID NO: 128684 - DNA, 103 bp, Artificial Sequence
  Synthetic Polynucleotide
taatacgactcactatagggcacgtgcagctgcccgtagaagtagttgttaacagaggagaaacaacatgttctacgggaacctggcggcagcgcaaaagatg

SEQ ID NO: 128685 - DNA, 103 bp, Artificial Sequence
  Synthetic Polynucleotide
taatacgactcactataggggcgccgcctgcacgtgcagctgcccgtagaaacagaggagatctacgatgagctgcacgaacctggcggcagcgcaaaagatg

SEQ ID NO: 128686 - DNA, 103 bp, Artificial Sequence
  Synthetic Polynucleotide
taatacgactcactataggggggcccacgggcgccgcctgcacgtgcagcaacagaggagagctgcaatggcaggcggcaacctggcggcagcgcaaaagatg

SEQ ID NO: 128687 - DNA, 103 bp, Artificial Sequence
  Synthetic Polynucleotide
taatacgactcactataggggcagcaggccgggcccacgggcgccgcctgaacagaggagacaggcgatgcccgtgggcaacctggcggcagcgcaaaagatg

SEQ ID NO: 128688 - DNA, 103 bp, Artificial Sequence
  Synthetic Polynucleotide
taatacgactcactataggggcacggccccgcagcaggccgggcccacggaacagaggagaccgtggatgcggcctgctaacctggcggcagcgcaaaagatg

SEQ ID NO: 128689 - DNA, 103 bp, Artificial Sequence
  Synthetic Polynucleotide
taatacgactcactatagggcgcggccgggcggctaggatgttgtcgatgaacagaggagacatcgaatgcatcctagcaacctggcggcagcgcaaaagatg

SEQ ID NO: 128690 - DNA, 103 bp, Artificial Sequence
  Synthetic Polynucleotide
taatacgactcactatagggcccagcggcggcacggccccgcagcaggccaacagaggagaggcctgatgcggggccgtaacctggcggcagcgcaaaagatg

SEQ ID NO: 128691 - DNA, 103 bp, Artificial Sequence
  Synthetic Polynucleotide
taatacgactcactatagggctgctgggcgcccagcggcggcacggccccaacagaggagaggggccatgccgccgctgaacctggcggcagcgcaaaagatg

SEQ ID NO: 128692 - DNA, 103 bp, Artificial Sequence
  Synthetic Polynucleotide
taatacgactcactatagggcgcaggagcactgctgggcgcccagcggcgaacagaggagacgccgcatggcgcccagcaacctggcggcagcgcaaaagatg

SEQ ID NO: 128693 - DNA, 103 bp, Artificial Sequence
  Synthetic Polynucleotide
taatacgactcactatagggggcgtcgggacgcaggagcactgctgggcgaacagaggagacgcccaatggtgctcctgaacctggcggcagcgcaaaagatg

SEQ ID NO: 128694 - DNA, 103 bp, Artificial Sequence
  Synthetic Polynucleotide
taatacgactcactataggggtagcctgggggcgtcgggacgcaggagcaaacagaggagatgctccatggtcccgacgaacctggcggcagcgcaaaagatg

SEQ ID NO: 128695 - DNA, 103 bp, Artificial Sequence
  Synthetic Polynucleotide
taatacgactcactatagggcggggccctcgtagcctgggggcgtcgggaaacagaggagatcccgaatgccccaggctaacctggcggcagcgcaaaagatg

SEQ ID NO: 128696 - DNA, 103 bp, Artificial Sequence
  Synthetic Polynucleotide
taatacgactcactatagggagcaccgaaccggggccctcgtagcctgggaacagaggagacccaggatgcgagggcccaacctggcggcagcgcaaaagatg

SEQ ID NO: 128697 - DNA, 103 bp, Artificial Sequence
  Synthetic Polynucleotide
taatacgactcactatagggcggggacaccagcaccgaaccggggccctcaacagaggagagagggcatgggttcggtgaacctggcggcagcgcaaaagatg

SEQ ID NO: 128698 - DNA, 103 bp, Artificial Sequence
  Synthetic Polynucleotide
taatacgactcactatagggggtgcggtaccggggacaccagcaccgaacaacagaggagagttcggatgtggtgtcccaacctggcggcagcgcaaaagatg

SEQ ID NO: 128699 - DNA, 103 bp, Artificial Sequence
  Synthetic Polynucleotide
taatacgactcactatagggggcagcatctggtgcggtaccggggacaccaacagaggagaggtgtcatgggtaccgcaaacctggcggcagcgcaaaagatg

SEQ ID NO: 128700 - DNA, 103 bp, Artificial Sequence
  Synthetic Polynucleotide
taatacgactcactataggggtccttgcagcgcggccgggcggctaggataacagaggagaatcctaatggcccggccgaacctggcggcagcgcaaaagatg

SEQ ID NO: 128701 - DNA, 103 bp, Artificial Sequence
  Synthetic Polynucleotide
taatacgactcactataggggttcatgtagggcagcatctggtgcggtacaacagaggagagtaccgatgcagatgctgaacctggcggcagcgcaaaagatg

SEQ ID NO: 128702 - DNA, 103 bp, Artificial Sequence
  Synthetic Polynucleotide
taatacgactcactataggggcgtgcccacgttcatgtagggcagcatctaacagaggagaagatgcatgcctacatgaaacctggcggcagcgcaaaagatg

SEQ ID NO: 128703 - DNA, 103 bp, Artificial Sequence
  Synthetic Polynucleotide
taatacgactcactataggggtgcgcgacagcgtgcccacgttcatgtagaacagaggagactacatatgcgtgggcacaacctggcggcagcgcaaaagatg

SEQ ID NO: 128704 - DNA, 103 bp, Artificial Sequence
  Synthetic Polynucleotide
taatacgactcactatagggctgcagctcggtgcgcgacagcgtgcccacaacagaggagagtgggcatgctgtcgcgcaacctggcggcagcgcaaaagatg

SEQ ID NO: 128705 - DNA, 103 bp, Artificial Sequence
  Synthetic Polynucleotide
taatacgactcactatagggggttgagaagctgcagctcggtgcgcgacaaacagaggagatgtcgcatgccgagctgcaacctggcggcagcgcaaaagatg

SEQ ID NO: 128706 - DNA, 103 bp, Artificial Sequence
  Synthetic Polynucleotide
taatacgactcactatagggcagtgcagctggttgagaagctgcagctcgaacagaggagacgagctatggcttctcaaaacctggcggcagcgcaaaagatg

SEQ ID NO: 128707 - DNA, 103 bp, Artificial Sequence
  Synthetic Polynucleotide
taatacgactcactatagggcttccgccgacagtgcagctggttgagaagaacagaggagacttctcatgcagctgcacaacctggcggcagcgcaaaagatg

SEQ ID NO: 128708 - DNA, 103 bp, Artificial Sequence
  Synthetic Polynucleotide
taatacgactcactatagggggtgccgccgcttccgccgacagtgcagctaacagaggagaagctgcatggtcggcggaaacctggcggcagcgcaaaagatg

SEQ ID NO: 128709 - DNA, 103 bp, Artificial Sequence
  Synthetic Polynucleotide
taatacgactcactatagggaagatggtgcggtgccgccgcttccgccgaaacagaggagatcggcgatggcggcggcaaacctggcggcagcgcaaaagatg

SEQ ID NO: 128710 - DNA, 103 bp, Artificial Sequence
  Synthetic Polynucleotide
taatacgactcactatagggctcgtcagtgaagatggtgcggtgccgccgaacagaggagacggcggatgcgcaccatcaacctggcggcagcgcaaaagatg

SEQ ID NO: 128711 - DNA, 103 bp, Artificial Sequence
  Synthetic Polynucleotide
taatacgactcactataggggcaacaccgagtccttgcagcgcggccgggaacagaggagacccggcatggctgcaaggaacctggcggcagcgcaaaagatg

SEQ ID NO: 128712 - DNA, 103 bp, Artificial Sequence
  Synthetic Polynucleotide
taatacgactcactatagggcttcgagctgctcgtcagtgaagatggtgcaacagaggagagcaccaatgtcactgacgaacctggcggcagcgcaaaagatg

SEQ ID NO: 128713 - DNA, 103 bp, Artificial Sequence
  Synthetic Polynucleotide
taatacgactcactatagggttctcgagagcttcgagctgctcgtcagtgaacagaggagacactgaatggcagctcgaaacctggcggcagcgcaaaagatg

SEQ ID NO: 128714 - DNA, 103 bp, Artificial Sequence
  Synthetic Polynucleotide
taatacgactcactatagggctggaagaggttctcgagagcttcgagctgaacagaggagacagctcatggctctcgagaacctggcggcagcgcaaaagatg

SEQ ID NO: 128715 - DNA, 103 bp, Artificial Sequence
  Synthetic Polynucleotide
taatacgactcactatagggacttggtctcctggaagaggttctcgagagaacagaggagactctcgatgacctcttccaacctggcggcagcgcaaaagatg

SEQ ID NO: 128716 - DNA, 103 bp, Artificial Sequence
  Synthetic Polynucleotide
taatacgactcactatagggacgtccgggtacttggtctcctggaagaggaacagaggagacctcttatgggagaccaaaacctggcggcagcgcaaaagatg

SEQ ID NO: 128717 - DNA, 103 bp, Artificial Sequence
  Synthetic Polynucleotide
taatacgactcactataggggcgcgtgcccacgtccgggtacttggtctcaacagaggagagagaccatgtacccggacaacctggcggcagcgcaaaagatg

SEQ ID NO: 128718 - DNA, 103 bp, Artificial Sequence
  Synthetic Polynucleotide
taatacgactcactatagggccagctgctcgcgcgtgcccacgtccgggtaacagaggagaacccggatgtgggcacgcaacctggcggcagcgcaaaagatg

SEQ ID NO: 128719 - DNA, 103 bp, Artificial Sequence
  Synthetic Polynucleotide
taatacgactcactatagggactttccgggccagctgctcgcgcgtgcccaacagaggagagggcacatgcgagcagctaacctggcggcagcgcaaaagatg

SEQ ID NO: 128720 - DNA, 103 bp, Artificial Sequence
  Synthetic Polynucleotide
taatacgactcactataggggcggaggtgcactttccgggccagctgctcaacagaggagagagcagatggcccggaaaaacctggcggcagcgcaaaagatg

SEQ ID NO: 128721 - DNA, 103 bp, Artificial Sequence
  Synthetic Polynucleotide
taatacgactcactatagggctttctcctcgcggaggtgcactttccgggaacagaggagacccggaatgtgcacctccaacctggcggcagcgcaaaagatg

SEQ ID NO: 128722 - DNA, 103 bp, Artificial Sequence
  Synthetic Polynucleotide
taatacgactcactatagggtgcgccaccggcaacaccgagtccttgcagaacagaggagactgcaaatgctcggtgttaacctggcggcagcgcaaaagatg

SEQ ID NO: 128723 - DNA, 103 bp, Artificial Sequence
  Synthetic Polynucleotide
taatacgactcactatagggcagacctccactttctcctcgcggaggtgcaacagaggagagcacctatgcgaggagaaaacctggcggcagcgcaaaagatg

SEQ ID NO: 128724 - DNA, 103 bp, Artificial Sequence
  Synthetic Polynucleotide
taatacgactcactataggggttcttaaaccagacctccactttctcctcaacagaggagagaggagatggtggaggtcaacctggcggcagcgcaaaagatg

SEQ ID NO: 128725 - DNA, 103 bp, Artificial Sequence
  Synthetic Polynucleotide
taatacgactcactatagggtggcgcggcggttcttaaaccagacctccaaacagaggagatggaggatgggtttaagaaacctggcggcagcgcaaaagatg

SEQ ID NO: 128726 - DNA, 103 bp, Artificial Sequence
  Synthetic Polynucleotide
taatacgactcactatagggcgcctccatttggcgcggcggttcttaaacaacagaggagagtttaaatgccgccgcgcaacctggcggcagcgcaaaagatg

SEQ ID NO: 128727 - DNA, 103 bp, Artificial Sequence
  Synthetic Polynucleotide
taatacgactcactatagggccgcttctgccgcctccatttggcgcggcgaacagaggagacgccgcatgaaatggaggaacctggcggcagcgcaaaagatg

SEQ ID NO: 128728 - DNA, 103 bp, Artificial Sequence
  Synthetic Polynucleotide
taatacgactcactatagggctgatgaggaccgcttctgccgcctccattaacagaggagaaatggaatgggcagaagcaacctggcggcagcgcaaaagatg

SEQ ID NO: 128729 - DNA, 103 bp, Artificial Sequence
  Synthetic Polynucleotide
taatacgactcactatagggtccgactcctctgatgaggaccgcttctgcaacagaggagagcagaaatggtcctcatcaacctggcggcagcgcaaaagatg

SEQ ID NO: 128730 - DNA, 103 bp, Artificial Sequence
  Synthetic Polynucleotide
taatacgactcactatagggctccgcgttctccgactcctctgatgaggaaacagaggagatcctcaatggaggagtcgaacctggcggcagcgcaaaagatg

SEQ ID NO: 128731 - DNA, 103 bp, Artificial Sequence
  Synthetic Polynucleotide
taatacgactcactatagggtgttccacttctccgcgttctccgactcctaacagaggagaaggagtatgagaacgcggaacctggcggcagcgcaaaagatg

SEQ ID NO: 128732 - DNA, 103 bp, Artificial Sequence
  Synthetic Polynucleotide
taatacgactcactataggggacgacgtcttgttccacttctccgcgttcaacagaggagagaacgcatggaagtggaaaacctggcggcagcgcaaaagatg

SEQ ID NO: 128733 - DNA, 103 bp, Artificial Sequence
  Synthetic Polynucleotide
taatacgactcactatagggcgccgcgctgtgcgccaccggcaacaccgaaacagaggagatcggtgatgccggtggcgaacctggcggcagcgcaaaagatg

SEQ ID NO: 128734 - DNA, 103 bp, Artificial Sequence
  Synthetic Polynucleotide
taatacgactcactatagggcgccttcgacgacgacgtcttgttccacttaacagaggagaaagtggatgaagacgtcgaacctggcggcagcgcaaaagatg

SEQ ID NO: 128735 - DNA, 103 bp, Artificial Sequence
  Synthetic Polynucleotide
taatacgactcactatagggtctccggtgacgccttcgacgacgacgtctaacagaggagaagacgtatgcgtcgaaggaacctggcggcagcgcaaaagatg

SEQ ID NO: 128736 - DNA, 103 bp, Artificial Sequence
  Synthetic Polynucleotide
taatacgactcactatagggtcttccctcttctccggtgacgccttcgacaacagaggagagtcgaaatggtcaccggaaacctggcggcagcgcaaaagatg

SEQ ID NO: 128737 - DNA, 103 bp, Artificial Sequence
  Synthetic Polynucleotide
taatacgactcactatagggtttaccttcctcttccctcttctccggtgaaacagaggagatcaccgatgaagagggaaaacctggcggcagcgcaaaagatg

SEQ ID NO: 128738 - DNA, 103 bp, Artificial Sequence
  Synthetic Polynucleotide
taatacgactcactatagggccaaatcgcttttaccttcctcttccctctaacagaggagaagagggatgaggaaggtaaacctggcggcagcgcaaaagatg

SEQ ID NO: 128739 - DNA, 103 bp, Artificial Sequence
  Synthetic Polynucleotide
taatacgactcactatagggctgtccgagtccaaatcgcttttaccttccaacagaggagaggaaggatgaagcgatttaacctggcggcagcgcaaaagatg

SEQ ID NO: 128740 - DNA, 103 bp, Artificial Sequence
  Synthetic Polynucleotide
taatacgactcactatagggcgacgggagccgccgcgctgtgcgccaccgaacagaggagacggtggatgacagcgcggaacctggcggcagcgcaaaagatg

SEQ ID NO: 128741 - DNA, 103 bp, Artificial Sequence
  Synthetic Polynucleotide
taatacgactcactataggggccgggaagacgacgggagccgccgcgctgaacagaggagacagcgcatgggctcccgtaacctggcggcagcgcaaaagatg

SEQ ID NO: 128742 - DNA, 103 bp, Artificial Sequence
  Synthetic Polynucleotide
taatacgactcactatagggtagcgagtccaccaggaaggagcgcggcataacagaggagaatgccgatgtccttcctgaacctggcggcagcgcaaaagatg

SEQ ID NO: 128743 - DNA, 103 bp, Artificial Sequence
  Synthetic Polynucleotide
taatacgactcactataggggtgcagcgcgtgcggcgggggcacagcgtaaacagaggagatacgctatgcccccgccgaacctggcggcagcgcaaaagatg

SEQ ID NO: 128744 - DNA, 103 bp, Artificial Sequence
  Synthetic Polynucleotide
taatacgactcactataggggcgagagaccgtgcagcgcgtgcggcggggaacagaggagaccccgcatgacgcgctgcaacctggcggcagcgcaaaagatg

SEQ ID NO: 128745 - DNA, 103 bp, Artificial Sequence
  Synthetic Polynucleotide
taatacgactcactatagggcaggcgccaggcgagagaccgtgcagcgcgaacagaggagacgcgctatgcggtctctcaacctggcggcagcgcaaaagatg

SEQ ID NO: 128746 - DNA, 103 bp, Artificial Sequence
  Synthetic Polynucleotide
taatacgactcactataggggcgcgcgtggcaggcgccaggcgagagaccaacagaggagaggtctcatgcctggcgccaacctggcggcagcgcaaaagatg

SEQ ID NO: 128747 - DNA, 103 bp, Artificial Sequence
  Synthetic Polynucleotide
taatacgactcactataggggcccagccttgcgcgcgtggcaggcgccagaacagaggagactggcgatggccacgcgcaacctggcggcagcgcaaaagatg

SEQ ID NO: 128748 - DNA, 103 bp, Artificial Sequence
  Synthetic Polynucleotide
taatacgactcactatagggacgcacagcagcccagccttgcgcgcgtggaacagaggagaccacgcatgcaaggctggaacctggcggcagcgcaaaagatg

SEQ ID NO: 128749 - DNA, 103 bp, Artificial Sequence
  Synthetic Polynucleotide
taatacgactcactataggggagcgggcacacgcacagcagcccagccttaacagaggagaaaggctatgctgctgtgcaacctggcggcagcgcaaaagatg

SEQ ID NO: 128750 - DNA, 103 bp, Artificial Sequence
  Synthetic Polynucleotide
taatacgactcactatagggcggtgacgcagagcgggcacacgcacagcaaacagaggagatgctgtatgtgtgcccgcaacctggcggcagcgcaaaagatg

SEQ ID NO: 128751 - DNA, 103 bp, Artificial Sequence
  Synthetic Polynucleotide
taatacgactcactatagggagctgcgaggcggtgacgcagagcgggcacaacagaggagagtgcccatgctgcgtcacaacctggcggcagcgcaaaagatg

SEQ ID NO: 128752 - DNA, 103 bp, Artificial Sequence
  Synthetic Polynucleotide
taatacgactcactataggggggcccatgcagctgcgaggcggtgacgcaaacagaggagatgcgtcatggcctcgcagaacctggcggcagcgcaaaagatg

SEQ ID NO: 128753 - DNA, 103 bp, Artificial Sequence
  Synthetic Polynucleotide
taatacgactcactatagggcgcgcagcactagcgagtccaccaggaaggaacagaggagaccttccatgtggactcgcaacctggcggcagcgcaaaagatg

SEQ ID NO: 128754 - DNA, 103 bp, Artificial Sequence
  Synthetic Polynucleotide
taatacgactcactataggggcggcccggggggcccatgcagctgcgaggaacagaggagacctcgcatgtgcatgggcaacctggcggcagcgcaaaagatg

SEQ ID NO: 128755 - DNA, 103 bp, Artificial Sequence
  Synthetic Polynucleotide
taatacgactcactatagggggcagcgcgggcggcccggggggcccatgcaacagaggagagcatggatgccccgggccaacctggcggcagcgcaaaagatg

SEQ ID NO: 128756 - DNA, 103 bp, Artificial Sequence
  Synthetic Polynucleotide
taatacgactcactatagggcttgagtagaggcagcgcgggcggcccgggaacagaggagacccgggatgcccgcgctgaacctggcggcagcgcaaaagatg

SEQ ID NO: 128757 - DNA, 103 bp, Artificial Sequence
  Synthetic Polynucleotide
taatacgactcactatagggggaaggaagccttgagtagaggcagcgcggaacagaggagaccgcgcatgctctactcaaacctggcggcagcgcaaaagatg

SEQ ID NO: 128758 - DNA, 103 bp, Artificial Sequence
  Synthetic Polynucleotide
taatacgactcactatagggccgaagggtgggaaggaagccttgagtagaaacagaggagatctactatgggcttccttaacctggcggcagcgcaaaagatg

SEQ ID NO: 128759 - DNA, 103 bp, Artificial Sequence
  Synthetic Polynucleotide
taatacgactcactataggggtactgcgagccgaagggtgggaaggaagcaacagaggagagcttccatgccacccttcaacctggcggcagcgcaaaagatg

SEQ ID NO: 128760 - DNA, 103 bp, Artificial Sequence
  Synthetic Polynucleotide
taatacgactcactataggggcgcgtggcagtactgcgagccgaagggtgaacagaggagacaccctatggctcgcagtaacctggcggcagcgcaaaagatg

SEQ ID NO: 128761 - DNA, 103 bp, Artificial Sequence
  Synthetic Polynucleotide
taatacgactcactatagggcggcccaggggcgcgtggcagtactgcgagaacagaggagactcgcaatgctgccacgcaacctggcggcagcgcaaaagatg

SEQ ID NO: 128762 - DNA, 103 bp, Artificial Sequence
  Synthetic Polynucleotide
taatacgactcactatagggagagtgctggcggcccaggggcgcgtggcaaacagaggagatgccacatgcccctgggcaacctggcggcagcgcaaaagatg

SEQ ID NO: 128763 - DNA, 103 bp, Artificial Sequence
  Synthetic Polynucleotide
taatacgactcactataggggcgacacagcagagtgctggcggcccagggaacagaggagaccctggatggccagcactaacctggcggcagcgcaaaagatg

SEQ ID NO: 128764 - DNA, 103 bp, Artificial Sequence
  Synthetic Polynucleotide
taatacgactcactatagggtcgcccgcctcgcgcagcactagcgagtccaacagaggagaggactcatgagtgctgcgaacctggcggcagcgcaaaagatg

SEQ ID NO: 128765 - DNA, 103 bp, Artificial Sequence
  Synthetic Polynucleotide
taatacgactcactataggggcgaccccgggcgacacagcagagtgctggaacagaggagaccagcaatgtgctgtgtcaacctggcggcagcgcaaaagatg

SEQ ID NO: 128766 - DNA, 103 bp, Artificial Sequence
  Synthetic Polynucleotide
taatacgactcactatagggcgggccgtgagcgaccccgggcgacacagcaacagaggagagctgtgatgcccggggtcaacctggcggcagcgcaaaagatg

SEQ ID NO: 128767 - DNA, 103 bp, Artificial Sequence
  Synthetic Polynucleotide
taatacgactcactatagggcagcggcggccgggccgtgagcgaccccggaacagaggagaccggggatgctcacggccaacctggcggcagcgcaaaagatg

SEQ ID NO: 128768 - DNA, 103 bp, Artificial Sequence
  Synthetic Polynucleotide
taatacgactcactataggggcggcagcagcagcggcggccgggccgtgaaacagaggagatcacggatgggccgccgcaacctggcggcagcgcaaaagatg

SEQ ID NO: 128769 - DNA, 103 bp, Artificial Sequence
  Synthetic Polynucleotide
taatacgactcactataggggtagagcgcggcggcagcagcagcggcggcaacagaggagagccgccatggctgctgccaacctggcggcagcgcaaaagatg

SEQ ID NO: 128770 - DNA, 103 bp, Artificial Sequence
  Synthetic Polynucleotide
taatacgactcactatagggaggaggtctggtagagcgcggcggcagcagaacagaggagactgctgatgccgcgctctaacctggcggcagcgcaaaagatg

SEQ ID NO: 128771 - DNA, 103 bp, Artificial Sequence
  Synthetic Polynucleotide
taatacgactcactatagggggcagcgggtaggaggtctggtagagcgcgaacagaggagacgcgctatgccagacctcaacctggcggcagcgcaaaagatg

SEQ ID NO: 128772 - DNA, 103 bp, Artificial Sequence
  Synthetic Polynucleotide
taatacgactcactatagggcctggggtcaggcagcgggtaggaggtctgaacagaggagacagaccatgtacccgctgaacctggcggcagcgcaaaagatg

SEQ ID NO: 128773 - DNA, 103 bp, Artificial Sequence
  Synthetic Polynucleotide
taatacgactcactatagggagtggaactgcctggggtcaggcagcgggtaacagaggagaacccgcatgctgaccccaaacctggcggcagcgcaaaagatg

SEQ ID NO: 128774 - DNA, 103 bp, Artificial Sequence
  Synthetic Polynucleotide
taatacgactcactatagggacagagatgcagtggaactgcctggggtcaaacagaggagatgacccatggcagttccaaacctggcggcagcgcaaaagatg

SEQ ID NO: 128775 - DNA, 103 bp, Artificial Sequence
  Synthetic Polynucleotide
taatacgactcactatagggcgccttcttctcgcccgcctcgcgcagcacaacagaggagagtgctgatggaggcgggcaacctggcggcagcgcaaaagatg

SEQ ID NO: 128776 - DNA, 103 bp, Artificial Sequence
  Synthetic Polynucleotide
taatacgactcactataggggctgctgtccacagagatgcagtggaactgaacagaggagacagttcatgtgcatctctaacctggcggcagcgcaaaagatg

SEQ ID NO: 128777 - DNA, 103 bp, Artificial Sequence
  Synthetic Polynucleotide
taatacgactcactataggggctggttagagctgctgtccacagagatgcaacagaggagagcatctatgtggacagcaaacctggcggcagcgcaaaagatg

SEQ ID NO: 128778 - DNA, 103 bp, Artificial Sequence
  Synthetic Polynucleotide
taatacgactcactatagggctgctgggcagctggttagagctgctgtccaacagaggagaggacagatgctctaaccaaacctggcggcagcgcaaaagatg

SEQ ID NO: 128779 - DNA, 103 bp, Artificial Sequence
  Synthetic Polynucleotide
taatacgactcactatagggcatcctcttgctgctgggcagctggttagaaacagaggagatctaacatgctgcccagcaacctggcggcagcgcaaaagatg

SEQ ID NO: 128780 - DNA, 103 bp, Artificial Sequence
  Synthetic Polynucleotide
taatacgactcactatagggaagccgtgcgcatcctcttgctgctgggcaaacagaggagatgcccaatggcaagaggaaacctggcggcagcgcaaaagatg

SEQ ID NO: 128781 - DNA, 103 bp, Artificial Sequence
  Synthetic Polynucleotide
taatacgactcactataggggtgctggtgaaagccgtgcgcatcctcttgaacagaggagacaagagatggcgcacggcaacctggcggcagcgcaaaagatg

SEQ ID NO: 128782 - DNA, 103 bp, Artificial Sequence
  Synthetic Polynucleotide
taatacgactcactatagggtagcagctgcgtgctggtgaaagccgtgcgaacagaggagacgcacgatgttcaccagcaacctggcggcagcgcaaaagatg

SEQ ID NO: 128783 - DNA, 103 bp, Artificial Sequence
  Synthetic Polynucleotide
taatacgactcactataggggctccagctctagcagctgcgtgctggtgaaacagaggagatcaccaatgcgcagctgcaacctggcggcagcgcaaaagatg

SEQ ID NO: 128784 - DNA, 103 bp, Artificial Sequence
  Synthetic Polynucleotide
taatacgactcactataggggcgaactcgcgctccagctctagcagctgcaacagaggagagcagctatgagagctggaaacctggcggcagcgcaaaagatg

SEQ ID NO: 128785 - DNA, 103 bp, Artificial Sequence
  Synthetic Polynucleotide
taatacgactcactatagggcatattagaagcgaactcgcgctccagctcaacagaggagagagctgatgcgcgagttcaacctggcggcagcgcaaaagatg

SEQ ID NO: 128786 - DNA, 103 bp, Artificial Sequence
  Synthetic Polynucleotide
taatacgactcactatagggtgccctcgggcgccttcttctcgcccgcctaacagaggagaaggcggatgagaagaaggaacctggcggcagcgcaaaagatg

SEQ ID NO: 128787 - DNA, 103 bp, Artificial Sequence
  Synthetic Polynucleotide
taatacgactcactataggggggacaggtacatattagaagcgaactcgcaacagaggagagcgagtatgcttctaataaacctggcggcagcgcaaaagatg

SEQ ID NO: 128788 - DNA, 103 bp, Artificial Sequence
  Synthetic Polynucleotide
taatacgactcactatagggcgacgtaggcgggacaggtacatattagaaaacagaggagattctaaatggtacctgtcaacctggcggcagcgcaaaagatg

SEQ ID NO: 128789 - DNA, 103 bp, Artificial Sequence
  Synthetic Polynucleotide
taatacgactcactataggggatctcgatgcgacgtaggcgggacaggtaaacagaggagatacctgatgcgcctacgtaacctggcggcagcgcaaaagatg

SEQ ID NO: 128790 - DNA, 103 bp, Artificial Sequence
  Synthetic Polynucleotide
taatacgactcactatagggggtaggtcgcgatctcgatgcgacgtaggcaacagaggagagcctacatggcatcgagaaacctggcggcagcgcaaaagatg

SEQ ID NO: 128791 - DNA, 103 bp, Artificial Sequence
  Synthetic Polynucleotide
taatacgactcactataggggacagattcaggtaggtcgcgatctcgatgaacagaggagacatcgaatgcgcgacctaaacctggcggcagcgcaaaagatg

SEQ ID NO: 128792 - DNA, 103 bp, Artificial Sequence
  Synthetic Polynucleotide
taatacgactcactatagggctgcttctcggacagattcaggtaggtcgcaacagaggagagcgaccatgctgaatctgaacctggcggcagcgcaaaagatg

SEQ ID NO: 128793 - DNA, 103 bp, Artificial Sequence
  Synthetic Polynucleotide
taatacgactcactatagggagatcttcacctgcttctcggacagattcaaacagaggagatgaatcatgccgagaagcaacctggcggcagcgcaaaagatg

SEQ ID NO: 128794 - DNA, 103 bp, Artificial Sequence
  Synthetic Polynucleotide
taatacgactcactatagggttctgaaaccagatcttcacctgcttctcgaacagaggagacgagaaatgggtgaagataacctggcggcagcgcaaaagatg

SEQ ID NO: 128795 - DNA, 103 bp, Artificial Sequence
  Synthetic Polynucleotide
taatacgactcactatagggcactcggcggttctgaaaccagatcttcacaacagaggagagtgaagatgtggtttcagaacctggcggcagcgcaaaagatg

SEQ ID NO: 128796 - DNA, 103 bp, Artificial Sequence
  Synthetic Polynucleotide
taatacgactcactatagggtcttgtgcttcactcggcggttctgaaaccaacagaggagaggtttcatgaccgccgagaacctggcggcagcgcaaaagatg

SEQ ID NO: 128797 - DNA, 103 bp, Artificial Sequence
  Synthetic Polynucleotide
taatacgactcactatagggggcggcgggctgccctcgggcgccttcttcaacagaggagagaagaaatggcccgagggaacctggcggcagcgcaaaagatg

SEQ ID NO: 128798 - DNA, 103 bp, Artificial Sequence
  Synthetic Polynucleotide
taatacgactcactatagggttgccctccttcttgtgcttcactcggcggaacagaggagaccgccgatggaagcacaaaacctggcggcagcgcaaaagatg

SEQ ID NO: 128799 - DNA, 103 bp, Artificial Sequence
  Synthetic Polynucleotide
taatacgactcactataggggttgctgcccttgccctccttcttgtgcttaacagaggagaaagcacatgaaggagggcaacctggcggcagcgcaaaagatg

SEQ ID NO: 128800 - DNA, 103 bp, Artificial Sequence
  Synthetic Polynucleotide
taatacgactcactatagggcgccacgatggttgctgcccttgccctcctaacagaggagaaggaggatgagggcagcaaacctggcggcagcgcaaaagatg

SEQ ID NO: 128801 - DNA, 103 bp, Artificial Sequence
  Synthetic Polynucleotide
taatacgactcactatagggccgccgccgccgccacgatggttgctgcccaacagaggagagggcagatgccatcgtggaacctggcggcagcgcaaaagatg

SEQ ID NO: 128802 - DNA, 103 bp, Artificial Sequence
  Synthetic Polynucleotide
taatacgactcactatagggaccggcacccccgccgccgccgccacgatgaacagaggagacatcgtatgggcggcggcaacctggcggcagcgcaaaagatg

SEQ ID NO: 128803 - DNA, 103 bp, Artificial Sequence
  Synthetic Polynucleotide
taatacgactcactatagggtcccgccaccaccggcacccccgccgccgcaacagaggagagcggcgatgggggtgccgaacctggcggcagcgcaaaagatg

SEQ ID NO: 128804 - DNA, 103 bp, Artificial Sequence
  Synthetic Polynucleotide
taatacgactcactatagggtgcggtgcgctcccgccaccaccggcacccaacagaggagagggtgcatgtggtggcggaacctggcggcagcgcaaaagatg

SEQ ID NO: 128805 - DNA, 103 bp, Artificial Sequence
  Synthetic Polynucleotide
taatacgactcactatagggcttgcagccttgcggtgcgctcccgccaccaacagaggagaggtggcatgagcgcaccgaacctggcggcagcgcaaaagatg

SEQ ID NO: 128806 - DNA, 103 bp, Artificial Sequence
  Synthetic Polynucleotide
taatacgactcactataggggcgatgcgcacttgcagccttgcggtgcgcaacagaggagagcgcacatgaaggctgcaaacctggcggcagcgcaaaagatg

SEQ ID NO: 128807 - DNA, 103 bp, Artificial Sequence
  Synthetic Polynucleotide
taatacgactcactataggggctgaggagagcgatgcgcacttgcagcctaacagaggagaaggctgatggtgcgcatcaacctggcggcagcgcaaaagatg

SEQ ID NO: 128808 - DNA, 103 bp, Artificial Sequence
  Synthetic Polynucleotide
taatacgactcactatagggggggaagagcggcggcgggctgccctcgggaacagaggagacccgagatgagcccgccgaacctggcggcagcgcaaaagatg

SEQ ID NO: 128809 - DNA, 103 bp, Artificial Sequence
  Synthetic Polynucleotide
taatacgactcactatagggggagcacttggctgaggagagcgatgcgcaaacagaggagatgcgcaatgctctcctcaaacctggcggcagcgcaaaagatg

SEQ ID NO: 128810 - DNA, 103 bp, Artificial Sequence
  Synthetic Polynucleotide
taatacgactcactatagggcgtcatcctcggagcacttggctgaggagaaacagaggagatctcctatgccaagtgctaacctggcggcagcgcaaaagatg

SEQ ID NO: 128811 - DNA, 103 bp, Artificial Sequence
  Synthetic Polynucleotide
taatacgactcactatagggggcaattcgtcgtcatcctcggagcacttgaacagaggagacaagtgatgcgaggatgaaacctggcggcagcgcaaaagatg

SEQ ID NO: 128812 - DNA, 103 bp, Artificial Sequence
  Synthetic Polynucleotide
taatacgactcactatagggcggagacatgggcaattcgtcgtcatcctcaacagaggagagaggatatggacgaattgaacctggcggcagcgcaaaagatg

SEQ ID NO: 128813 - DNA, 103 bp, Artificial Sequence
  Synthetic Polynucleotide
taatacgactcactatagggctgaggaggacggagacatgggcaattcgtaacagaggagaacgaatatgccatgtctcaacctggcggcagcgcaaaagatg

SEQ ID NO: 128814 - DNA, 103 bp, Artificial Sequence
  Synthetic Polynucleotide
taatacgactcactatagggtcgtccttccctgaggaggacggagacatgaacagaggagacatgtcatggtcctcctcaacctggcggcagcgcaaaagatg

SEQ ID NO: 128815 - DNA, 103 bp, Artificial Sequence
  Synthetic Polynucleotide
taatacgactcactatagggaagatcccggtcgtccttccctgaggaggaaacagaggagatcctccatggggaaggacaacctggcggcagcgcaaaagatg

SEQ ID NO: 128816 - DNA, 103 bp, Artificial Sequence
  Synthetic Polynucleotide
taatacgactcactataggggagtgaccgtaagatcccggtcgtccttccaacagaggagaggaaggatgaccgggatcaacctggcggcagcgcaaaagatg

SEQ ID NO: 128817 - DNA, 103 bp, Artificial Sequence
  Synthetic Polynucleotide
taatacgactcactataggggcacagcgtaggggaagagcggcggcgggcaacagaggagagcccgcatgcgctcttccaacctggcggcagcgcaaaagatg

SEQ ID NO: 128818 - DNA, 103 bp, Artificial Sequence
  Synthetic Polynucleotide
taatacgactcactatagggtgcggcgggggcacagcgtaggggaagagcaacagaggagagctcttatgctacgctgtaacctggcggcagcgcaaaagatg

SEQ ID NO: 128819 - DNA, 103 bp, Artificial Sequence
  Synthetic Polynucleotide
taatacgactcactatagggaagagcatccaaacggctggtagacgccataacagaggagaatggcgatgaccagccgtaacctggcggcagcgcaaaagatg

SEQ ID NO: 128820 - DNA, 103 bp, Artificial Sequence
  Synthetic Polynucleotide
taatacgactcactatagggaaccaagccacattcaggacagatcatatcaacagaggagagatatgatgtgtcctgaaaacctggcggcagcgcaaaagatg

SEQ ID NO: 128821 - DNA, 103 bp, Artificial Sequence
  Synthetic Polynucleotide
taatacgactcactatagggggtcacctacaaccaagccacattcaggacaacagaggagagtcctgatggtggcttggaacctggcggcagcgcaaaagatg

SEQ ID NO: 128822 - DNA, 103 bp, Artificial Sequence
  Synthetic Polynucleotide
taatacgactcactatagggtcaataacccggtcacctacaaccaagccaaacagaggagatggcttatgtgtaggtgaaacctggcggcagcgcaaaagatg

SEQ ID NO: 128823 - DNA, 103 bp, Artificial Sequence
  Synthetic Polynucleotide
taatacgactcactatagggagatcccacatcaataacccggtcacctacaacagaggagagtaggtatgcgggttattaacctggcggcagcgcaaaagatg

SEQ ID NO: 128824 - DNA, 103 bp, Artificial Sequence
  Synthetic Polynucleotide
taatacgactcactatagggttcgccattcagatcccacatcaataacccaacagaggagagggttaatgatgtgggataacctggcggcagcgcaaaagatg

SEQ ID NO: 128825 - DNA, 103 bp, Artificial Sequence
  Synthetic Polynucleotide
taatacgactcactatagggttgctgaaagttcgccattcagatcccacaaacagaggagatgtgggatgtgaatggcgaacctggcggcagcgcaaaagatg

SEQ ID NO: 128826 - DNA, 103 bp, Artificial Sequence
  Synthetic Polynucleotide
taatacgactcactatagggtgctttgtcattgctgaaagttcgccattcaacagaggagagaatggatgactttcagcaacctggcggcagcgcaaaagatg

SEQ ID NO: 128827 - DNA, 103 bp, Artificial Sequence
  Synthetic Polynucleotide
taatacgactcactataggggatcttttgttgctttgtcattgctgaaagaacagaggagactttcaatgatgacaaagaacctggcggcagcgcaaaagatg

SEQ ID NO: 128828 - DNA, 103 bp, Artificial Sequence
  Synthetic Polynucleotide
taatacgactcactatagggactcgagatggatcttttgttgctttgtcaaacagaggagatgacaaatgaacaaaagaaacctggcggcagcgcaaaagatg

SEQ ID NO: 128829 - DNA, 103 bp, Artificial Sequence
  Synthetic Polynucleotide
taatacgactcactatagggagaatctccaactcgagatggatcttttgtaacagaggagaacaaaaatgccatctcgaaacctggcggcagcgcaaaagatg

SEQ ID NO: 128830 - DNA, 103 bp, Artificial Sequence
  Synthetic Polynucleotide
taatacgactcactatagggtgactcttggaagagcatccaaacggctggaacagaggagaccagccatgtggatgctcaacctggcggcagcgcaaaagatg

SEQ ID NO: 128831 - DNA, 103 bp, Artificial Sequence
  Synthetic Polynucleotide
taatacgactcactataggggaggattctgagaatctccaactcgagatgaacagaggagacatctcatgttggagattaacctggcggcagcgcaaaagatg

SEQ ID NO: 128832 - DNA, 103 bp, Artificial Sequence
  Synthetic Polynucleotide
taatacgactcactatagggtcactcagaagaggattctgagaatctccaaacagaggagatggagaatgtcagaatccaacctggcggcagcgcaaaagatg

SEQ ID NO: 128833 - DNA, 103 bp, Artificial Sequence
  Synthetic Polynucleotide
taatacgactcactatagggcaaatctccatcactcagaagaggattctgaacagaggagacagaatatgcttctgagtaacctggcggcagcgcaaaagatg

SEQ ID NO: 128834 - DNA, 103 bp, Artificial Sequence
  Synthetic Polynucleotide
taatacgactcactatagggtcatggtagacaaatctccatcactcagaaaacagaggagattctgaatgatggagattaacctggcggcagcgcaaaagatg

SEQ ID NO: 128835 - DNA, 103 bp, Artificial Sequence
  Synthetic Polynucleotide
taatacgactcactatagggcccttgccaatcatggtagacaaatctccaaacagaggagatggagaatggtctaccataacctggcggcagcgcaaaagatg

SEQ ID NO: 128836 - DNA, 103 bp, Artificial Sequence
  Synthetic Polynucleotide
taatacgactcactatagggagctcctgtgcccttgccaatcatggtagaaacagaggagatctaccatgattggcaagaacctggcggcagcgcaaaagatg

SEQ ID NO: 128837 - DNA, 103 bp, Artificial Sequence
  Synthetic Polynucleotide
taatacgactcactatagggcaaaacttgcagctcctgtgcccttgccaaaacagaggagattggcaatggcacaggagaacctggcggcagcgcaaaagatg

SEQ ID NO: 128838 - DNA, 103 bp, Artificial Sequence
  Synthetic Polynucleotide
taatacgactcactatagggccaaattcgtcaaaacttgcagctcctgtgaacagaggagacacaggatgtgcaagtttaacctggcggcagcgcaaaagatg

SEQ ID NO: 128839 - DNA, 103 bp, Artificial Sequence
  Synthetic Polynucleotide
taatacgactcactatagggcttagaattgccaaattcgtcaaaacttgcaacagaggagagcaagtatggacgaatttaacctggcggcagcgcaaaagatg

SEQ ID NO: 128840 - DNA, 103 bp, Artificial Sequence
  Synthetic Polynucleotide
taatacgactcactataggggattctggtacttagaattgccaaattcgtaacagaggagaacgaatatggcaattctaaacctggcggcagcgcaaaagatg

SEQ ID NO: 128841 - DNA, 103 bp, Artificial Sequence
  Synthetic Polynucleotide
taatacgactcactatagggtttggacatgtgactcttggaagagcatccaacagaggagaggatgcatgtccaagagtaacctggcggcagcgcaaaagatg

SEQ ID NO: 128842 - DNA, 103 bp, Artificial Sequence
  Synthetic Polynucleotide
taatacgactcactatagggattgttctccgattctggtacttagaattgaacagaggagacaattcatggtaccagaaaacctggcggcagcgcaaaagatg

SEQ ID NO: 128843 - DNA, 103 bp, Artificial Sequence
  Synthetic Polynucleotide
taatacgactcactatagggagaactgctcattgttctccgattctggtaaacagaggagataccagatgcggagaacaaacctggcggcagcgcaaaagatg

SEQ ID NO: 128844 - DNA, 103 bp, Artificial Sequence
  Synthetic Polynucleotide
taatacgactcactatagggttgcccgatcagaactgctcattgttctccaacagaggagaggagaaatgtgagcagttaacctggcggcagcgcaaaagatg

SEQ ID NO: 128845 - DNA, 103 bp, Artificial Sequence
  Synthetic Polynucleotide
taatacgactcactataggggcattcatcattgcccgatcagaactgctcaacagaggagagagcagatgtgatcgggcaacctggcggcagcgcaaaagatg

SEQ ID NO: 128846 - DNA, 103 bp, Artificial Sequence
  Synthetic Polynucleotide
taatacgactcactatagggttctttgaatgcattcatcattgcccgatcaacagaggagagatcggatgatgatgaataacctggcggcagcgcaaaagatg

SEQ ID NO: 128847 - DNA, 103 bp, Artificial Sequence
  Synthetic Polynucleotide
taatacgactcactatagggtggtagtgatttctttgaatgcattcatcaaacagaggagatgatgaatgcattcaaagaacctggcggcagcgcaaaagatg

SEQ ID NO: 128848 - DNA, 103 bp, Artificial Sequence
  Synthetic Polynucleotide
taatacgactcactatagggctgtctgccatggtagtgatttctttgaataacagaggagaattcaaatgaatcactacaacctggcggcagcgcaaaagatg

SEQ ID NO: 128849 - DNA, 103 bp, Artificial Sequence
  Synthetic Polynucleotide
taatacgactcactatagggtagattgattctgtctgccatggtagtgataacagaggagaatcactatgatggcagacaacctggcggcagcgcaaaagatg

SEQ ID NO: 128850 - DNA, 103 bp, Artificial Sequence
  Synthetic Polynucleotide
taatacgactcactatagggtatttcgaggtagattgattctgtctgccaaacagaggagatggcagatggaatcaatcaacctggcggcagcgcaaaagatg

SEQ ID NO: 128851 - DNA, 103 bp, Artificial Sequence
  Synthetic Polynucleotide
taatacgactcactatagggcgatcaactatatttcgaggtagattgattaacagaggagaaatcaaatgacctcgaaaaacctggcggcagcgcaaaagatg

SEQ ID NO: 128852 - DNA, 103 bp, Artificial Sequence
  Synthetic Polynucleotide
taatacgactcactatagggatctggatggtttggacatgtgactcttggaacagaggagaccaagaatgacatgtccaaacctggcggcagcgcaaaagatg

SEQ ID NO: 128853 - DNA, 103 bp, Artificial Sequence
  Synthetic Polynucleotide
taatacgactcactatagggattatttgttcgatcaactatatttcgaggaacagaggagacctcgaatgatagttgataacctggcggcagcgcaaaagatg

SEQ ID NO: 128854 - DNA, 103 bp, Artificial Sequence
  Synthetic Polynucleotide
taatacgactcactataggggcttgaataaattatttgttcgatcaactaaacagaggagatagttgatggaacaaataaacctggcggcagcgcaaaagatg

SEQ ID NO: 128855 - DNA, 103 bp, Artificial Sequence
  Synthetic Polynucleotide
taatacgactcactatagggtcatatacttgcttgaataaattatttgttaacagaggagaaacaaaatgtttattcaaaacctggcggcagcgcaaaagatg

SEQ ID NO: 128856 - DNA, 103 bp, Artificial Sequence
  Synthetic Polynucleotide
taatacgactcactataggggctcttctgttcatatacttgcttgaataaaacagaggagattattcatgcaagtatataacctggcggcagcgcaaaagatg

SEQ ID NO: 128857 - DNA, 103 bp, Artificial Sequence
  Synthetic Polynucleotide
taatacgactcactatagggttcccttcaggctcttctgttcatatacttaacagaggagaaagtatatgaacagaagaaacctggcggcagcgcaaaagatg

SEQ ID NO: 128858 - DNA, 103 bp, Artificial Sequence
  Synthetic Polynucleotide
taatacgactcactatagggtcattagctcttcccttcaggctcttctgtaacagaggagaacagaaatgcctgaagggaacctggcggcagcgcaaaagatg

SEQ ID NO: 128859 - DNA, 103 bp, Artificial Sequence
  Synthetic Polynucleotide
taatacgactcactatagggagctatagcatcattagctcttcccttcagaacagaggagactgaagatgagagctaataacctggcggcagcgcaaaagatg

SEQ ID NO: 128860 - DNA, 103 bp, Artificial Sequence
  Synthetic Polynucleotide
taatacgactcactataggggacaagcagaagctatagcatcattagctcaacagaggagagagctaatgatgctatagaacctggcggcagcgcaaaagatg

SEQ ID NO: 128861 - DNA, 103 bp, Artificial Sequence
  Synthetic Polynucleotide
taatacgactcactataggggcaatatagagacaagcagaagctatagcaaacagaggagatgctatatgttctgcttgaacctggcggcagcgcaaaagatg

SEQ ID NO: 128862 - DNA, 103 bp, Artificial Sequence
  Synthetic Polynucleotide
taatacgactcactatagggttgtctacaggcaatatagagacaagcagaaacagaggagatctgctatgctctatattaacctggcggcagcgcaaaagatg

SEQ ID NO: 128863 - DNA, 103 bp, Artificial Sequence
  Synthetic Polynucleotide
taatacgactcactatagggctaaaatcgcatctggatggtttggacatgaacagaggagacatgtcatgaccatccagaacctggcggcagcgcaaaagatg

SEQ ID NO: 128864 - DNA, 103 bp, Artificial Sequence
  Synthetic Polynucleotide
taatacgactcactataggggaaccccttcttgtctacaggcaatatagaaacagaggagatctataatgcctgtagacaacctggcggcagcgcaaaagatg

SEQ ID NO: 128865 - DNA, 103 bp, Artificial Sequence
  Synthetic Polynucleotide
taatacgactcactatagggaatgtcctaggaaccccttcttgtctacagaacagaggagactgtagatgagaaggggtaacctggcggcagcgcaaaagatg

SEQ ID NO: 128866 - DNA, 103 bp, Artificial Sequence
  Synthetic Polynucleotide
taatacgactcactatagggtatttctttaaatgtcctaggaaccccttcaacagaggagagaagggatgcctaggacaaacctggcggcagcgcaaaagatg

SEQ ID NO: 128867 - DNA, 103 bp, Artificial Sequence
  Synthetic Polynucleotide
taatacgactcactatagggatacggcacatatttctttaaatgtcctagaacagaggagactaggaatgttaaagaaaaacctggcggcagcgcaaaagatg

SEQ ID NO: 128868 - DNA, 103 bp, Artificial Sequence
  Synthetic Polynucleotide
taatacgactcactataggggaaattcgtgatacggcacatatttctttaaacagaggagataaagaatgatgtgccgtaacctggcggcagcgcaaaagatg

SEQ ID NO: 128869 - DNA, 103 bp, Artificial Sequence
  Synthetic Polynucleotide
taatacgactcactatagggttctttcttagaaattcgtgatacggcacaaacagaggagatgtgccatgtcacgaattaacctggcggcagcgcaaaagatg

SEQ ID NO: 128870 - DNA, 103 bp, Artificial Sequence
  Synthetic Polynucleotide
taatacgactcactatagggaccgaccaatttctttcttagaaattcgtgaacagaggagacacgaaatgctaagaaagaacctggcggcagcgcaaaagatg

SEQ ID NO: 128871 - DNA, 103 bp, Artificial Sequence
  Synthetic Polynucleotide
taatacgactcactatagggagtttaaaacaccgaccaatttctttcttaaacagaggagataagaaatgaattggtcgaacctggcggcagcgcaaaagatg

SEQ ID NO: 128872 - DNA, 103 bp, Artificial Sequence
  Synthetic Polynucleotide
taatacgactcactatagggtttcaaaataagtttaaaacaccgaccaataacagaggagaattggtatgtgttttaaaaacctggcggcagcgcaaaagatg

SEQ ID NO: 128873 - DNA, 103 bp, Artificial Sequence
  Synthetic Polynucleotide
taatacgactcactatagggtttctagcgctttcaaaataagtttaaaacaacagaggagagttttaatgttattttgaaacctggcggcagcgcaaaagatg

SEQ ID NO: 128874 - DNA, 103 bp, Artificial Sequence
  Synthetic Polynucleotide
taatacgactcactatagggtagtcctccactaaaatcgcatctggatggaacagaggagaccatccatgtgcgattttaacctggcggcagcgcaaaagatg

SEQ ID NO: 128875 - DNA, 103 bp, Artificial Sequence
  Synthetic Polynucleotide
taatacgactcactatagggtccacactggtttctagcgctttcaaaataaacagaggagatattttatgagcgctagaaacctggcggcagcgcaaaagatg

SEQ ID NO: 128876 - DNA, 103 bp, Artificial Sequence
  Synthetic Polynucleotide
taatacgactcactatagggtgtaatcaaatccacactggtttctagcgcaacagaggagagcgctaatgaccagtgtgaacctggcggcagcgcaaaagatg

SEQ ID NO: 128877 - DNA, 103 bp, Artificial Sequence
  Synthetic Polynucleotide
taatacgactcactatagggagtccccagttgtaatcaaatccacactggaacagaggagaccagtgatgatttgattaaacctggcggcagcgcaaaagatg

SEQ ID NO: 128878 - DNA, 103 bp, Artificial Sequence
  Synthetic Polynucleotide
taatacgactcactatagggctggacatgaagtccccagttgtaatcaaaaacagaggagatttgatatgaactggggaaacctggcggcagcgcaaaagatg

SEQ ID NO: 128879 - DNA, 103 bp, Artificial Sequence
  Synthetic Polynucleotide
taatacgactcactatagggggaacagaacctggacatgaagtccccagtaacagaggagaactgggatgttcatgtccaacctggcggcagcgcaaaagatg

SEQ ID NO: 128880 - DNA, 103 bp, Artificial Sequence
  Synthetic Polynucleotide
taatacgactcactataggggacaaaggttggaacagaacctggacatgaaacagaggagatcatgtatgggttctgttaacctggcggcagcgcaaaagatg

SEQ ID NO: 128881 - DNA, 103 bp, Artificial Sequence
  Synthetic Polynucleotide
taatacgactcactatagggtgtttaggaagacaaaggttggaacagaacaacagaggagagttctgatgcaacctttgaacctggcggcagcgcaaaagatg

SEQ ID NO: 128882 - DNA, 103 bp, Artificial Sequence
  Synthetic Polynucleotide
taatacgactcactatagggcatctgtacttgtttaggaagacaaaggttaacagaggagaaaccttatgcttcctaaaaacctggcggcagcgcaaaagatg

SEQ ID NO: 128883 - DNA, 103 bp, Artificial Sequence
  Synthetic Polynucleotide
taatacgactcactataggggtgtagctgccatctgtacttgtttaggaaaacagaggagattcctaatgaagtacagaaacctggcggcagcgcaaaagatg

SEQ ID NO: 128884 - DNA, 103 bp, Artificial Sequence
  Synthetic Polynucleotide
taatacgactcactatagggcgggctatatgtgtagctgccatctgtactaacagaggagaagtacaatgggcagctacaacctggcggcagcgcaaaagatg

SEQ ID NO: 128885 - DNA, 103 bp, Artificial Sequence
  Synthetic Polynucleotide
taatacgactcactatagggaccggctctgtagtcctccactaaaatcgcaacagaggagagcgattatggtggaggacaacctggcggcagcgcaaaagatg

SEQ ID NO: 128886 - DNA, 103 bp, Artificial Sequence
  Synthetic Polynucleotide
taatacgactcactatagggcacagctttacgggctatatgtgtagctgcaacagaggagagcagctatgcatatagccaacctggcggcagcgcaaaagatg

SEQ ID NO: 128887 - DNA, 103 bp, Artificial Sequence
  Synthetic Polynucleotide
taatacgactcactatagggagtccagttccacagctttacgggctatataacagaggagaatatagatggtaaagctgaacctggcggcagcgcaaaagatg

SEQ ID NO: 128888 - DNA, 103 bp, Artificial Sequence
  Synthetic Polynucleotide
taatacgactcactatagggccaggaaccaagtccagttccacagctttaaacagaggagataaagcatgggaactggaaacctggcggcagcgcaaaagatg

SEQ ID NO: 128889 - DNA, 103 bp, Artificial Sequence
  Synthetic Polynucleotide
taatacgactcactatagggggggctcctcccaggaaccaagtccagttcaacagaggagagaactgatgttggttcctaacctggcggcagcgcaaaagatg

SEQ ID NO: 128890 - DNA, 103 bp, Artificial Sequence
  Synthetic Polynucleotide
taatacgactcactatagggccacagagatggggctcctcccaggaaccaaacagaggagatggttcatgggaggagccaacctggcggcagcgcaaaagatg

SEQ ID NO: 128891 - DNA, 103 bp, Artificial Sequence
  Synthetic Polynucleotide
taatacgactcactataggggctgccgctgccacagagatggggctcctcaacagaggagagaggagatgcatctctgtaacctggcggcagcgcaaaagatg

SEQ ID NO: 128892 - DNA, 103 bp, Artificial Sequence
  Synthetic Polynucleotide
taatacgactcactatagggcatgtaaatagctgccgctgccacagagataacagaggagaatctctatggcagcggcaaacctggcggcagcgcaaaagatg

SEQ ID NO: 128893 - DNA, 103 bp, Artificial Sequence
  Synthetic Polynucleotide
taatacgactcactatagggcctgtgaggccatgtaaatagctgccgctgaacagaggagacagcggatgctatttacaaacctggcggcagcgcaaaagatg

SEQ ID NO: 128894 - DNA, 103 bp, Artificial Sequence
  Synthetic Polynucleotide
taatacgactcactatagggtcagctgatgcctgtgaggccatgtaaataaacagaggagatatttaatgggcctcacaaacctggcggcagcgcaaaagatg

SEQ ID NO: 128895 - DNA, 103 bp, Artificial Sequence
  Synthetic Polynucleotide
taatacgactcactatagggggtcctcttttcagctgatgcctgtgaggcaacagaggagagcctcaatggcatcagctaacctggcggcagcgcaaaagatg

SEQ ID NO: 128896 - DNA, 103 bp, Artificial Sequence
  Synthetic Polynucleotide
taatacgactcactatagggagatcatatcaccggctctgtagtcctccaaacagaggagatggaggatgacagagccgaacctggcggcagcgcaaaagatg

SEQ ID NO: 128897 - DNA, 103 bp, Artificial Sequence
  Synthetic Polynucleotide
taatacgactcactatagggtttctttttgggtcctcttttcagctgatgaacagaggagacatcagatgaaaagaggaaacctggcggcagcgcaaaagatg

SEQ ID NO: 128898 - DNA, 103 bp, Artificial Sequence
  Synthetic Polynucleotide
taatacgactcactatagggatatctccaatttctttttgggtcctctttaacagaggagaaaagagatgccaaaaagaaacctggcggcagcgcaaaagatg

SEQ ID NO: 128899 - DNA, 103 bp, Artificial Sequence
  Synthetic Polynucleotide
taatacgactcactatagggaacaccagcaatatctccaatttctttttgaacagaggagacaaaaaatgattggagataacctggcggcagcgcaaaagatg

SEQ ID NO: 128900 - DNA, 103 bp, Artificial Sequence
  Synthetic Polynucleotide
taatacgactcactatagggtaacatcagcaacaccagcaatatctccaaaacagaggagattggagatgttgctggtgaacctggcggcagcgcaaaagatg

SEQ ID NO: 128901 - DNA, 103 bp, Artificial Sequence
  Synthetic Polynucleotide
taatacgactcactatagggtgtctgattgtaacatcagcaacaccagcaaacagaggagatgctggatgtgctgatgtaacctggcggcagcgcaaaagatg

SEQ ID NO: 128902 - DNA, 103 bp, Artificial Sequence
  Synthetic Polynucleotide
taatacgactcactatagggtctataggactgtctgattgtaacatcagcaacagaggagagctgatatgacaatcagaaacctggcggcagcgcaaaagatg

SEQ ID NO: 128903 - DNA, 103 bp, Artificial Sequence
  Synthetic Polynucleotide
taatacgactcactataggggatagatcagtctataggactgtctgattgaacagaggagacaatcaatgagtcctataaacctggcggcagcgcaaaagatg

SEQ ID NO: 128904 - DNA, 103 bp, Artificial Sequence
  Synthetic Polynucleotide
taatacgactcactatagggggggctcgaggatagatcagtctataggacaacagaggagagtcctaatgactgatctaaacctggcggcagcgcaaaagatg

SEQ ID NO: 128905 - DNA, 103 bp, Artificial Sequence
  Synthetic Polynucleotide
taatacgactcactatagggaaacagatctggggctcgaggatagatcagaacagaggagactgatcatgcctcgagccaacctggcggcagcgcaaaagatg

SEQ ID NO: 128906 - DNA, 103 bp, Artificial Sequence
  Synthetic Polynucleotide
taatacgactcactatagggagtctgtaggaaacagatctggggctcgagaacagaggagactcgagatgcagatctgtaacctggcggcagcgcaaaagatg

SEQ ID NO: 128907 - DNA, 103 bp, Artificial Sequence
  Synthetic Polynucleotide
taatacgactcactatagggcattcaggacagatcatatcaccggctctgaacagaggagacagagcatgtgatatgataacctggcggcagcgcaaaagatg

SEQ ID NO: 128908 - DNA, 103 bp, Artificial Sequence
  Synthetic Polynucleotide
taatacgactcactatagggtcaaatttgaagtctgtaggaaacagatctaacagaggagaagatctatgtcctacagaaacctggcggcagcgcaaaagatg

SEQ ID NO: 128909 - DNA, 103 bp, Artificial Sequence
  Synthetic Polynucleotide
taatacgactcactatagggcactggggtgtcaaatttgaagtctgtaggaacagaggagacctacaatgttcaaatttaacctggcggcagcgcaaaagatg

SEQ ID NO: 128910 - DNA, 103 bp, Artificial Sequence
  Synthetic Polynucleotide
taatacgactcactataggggtagtttgtccactggggtgtcaaatttgaaacagaggagatcaaatatgacaccccagaacctggcggcagcgcaaaagatg

SEQ ID NO: 128911 - DNA, 103 bp, Artificial Sequence
  Synthetic Polynucleotide
taatacgactcactatagggtatagctgtggtagtttgtccactggggtgaacagaggagacaccccatgggacaaactaacctggcggcagcgcaaaagatg

SEQ ID NO: 128912 - DNA, 103 bp, Artificial Sequence
  Synthetic Polynucleotide
taatacgactcactatagggttcgtccaacaacgactccagcgcgtccataacagaggagaatggacatgctggagtcgaacctggcggcagcgcaaaagatg

SEQ ID NO: 128913 - DNA, 103 bp, Artificial Sequence
  Synthetic Polynucleotide
taatacgactcactatagggttccaaaggcagcgggaagggcggcactcgaacagaggagacgagtgatgcccttcccgaacctggcggcagcgcaaaagatg

SEQ ID NO: 128914 - DNA, 103 bp, Artificial Sequence
  Synthetic Polynucleotide
taatacgactcactatagggtttaaattccttcagcagcttgaggcaccgaacagaggagacggtgcatgaagctgctgaacctggcggcagcgcaaaagatg

SEQ ID NO: 128915 - DNA, 103 bp, Artificial Sequence
  Synthetic Polynucleotide
taatacgactcactatagggggtcattccgtttaaattccttcagcagctaacagaggagaagctgcatgaggaatttaaacctggcggcagcgcaaaagatg

SEQ ID NO: 128916 - DNA, 103 bp, Artificial Sequence
  Synthetic Polynucleotide
taatacgactcactatagggtcatcatcatggtcattccgtttaaattccaacagaggagaggaattatgacggaatgaaacctggcggcagcgcaaaagatg

SEQ ID NO: 128917 - DNA, 103 bp, Artificial Sequence
  Synthetic Polynucleotide
taatacgactcactatagggctcgtcctcgtcatcatcatggtcattccgaacagaggagacggaatatgcatgatgataacctggcggcagcgcaaaagatg

SEQ ID NO: 128918 - DNA, 103 bp, Artificial Sequence
  Synthetic Polynucleotide
taatacgactcactatagggagatgacctcctcgtcctcgtcatcatcataacagaggagaatgatgatgacgaggacgaacctggcggcagcgcaaaagatg

SEQ ID NO: 128919 - DNA, 103 bp, Artificial Sequence
  Synthetic Polynucleotide
taatacgactcactatagggactgtcttggagatgacctcctcgtcctcgaacagaggagacgaggaatgggaggtcataacctggcggcagcgcaaaagatg

SEQ ID NO: 128920 - DNA, 103 bp, Artificial Sequence
  Synthetic Polynucleotide
taatacgactcactatagggcactggaggcactgtcttggagatgacctcaacagaggagagaggtcatgtccaagacaaacctggcggcagcgcaaaagatg

SEQ ID NO: 128921 - DNA, 103 bp, Artificial Sequence
  Synthetic Polynucleotide
taatacgactcactatagggacacaatgtccactggaggcactgtcttggaacagaggagaccaagaatgtgcctccagaacctggcggcagcgcaaaagatg

SEQ ID NO: 128922 - DNA, 103 bp, Artificial Sequence
  Synthetic Polynucleotide
taatacgactcactatagggtcccgctcgaacacaatgtccactggaggcaacagaggagagcctccatgggacattgtaacctggcggcagcgcaaaagatg

SEQ ID NO: 128923 - DNA, 103 bp, Artificial Sequence
  Synthetic Polynucleotide
taatacgactcactatagggtgtgagcatatcccgctcgaacacaatgtcaacagaggagagacattatgttcgagcggaacctggcggcagcgcaaaagatg

SEQ ID NO: 128924 - DNA, 103 bp, Artificial Sequence
  Synthetic Polynucleotide
taatacgactcactataggggcgtgcagggttccaaaggcagcgggaaggaacagaggagaccttccatgtgcctttggaacctggcggcagcgcaaaagatg

SEQ ID NO: 128925 - DNA, 103 bp, Artificial Sequence
  Synthetic Polynucleotide
taatacgactcactatagggcgtaggtctgtgtgagcatatcccgctcgaaacagaggagatcgagcatgatatgctcaaacctggcggcagcgcaaaagatg

SEQ ID NO: 128926 - DNA, 103 bp, Artificial Sequence
  Synthetic Polynucleotide
taatacgactcactatagggtcaatgaggtcgtaggtctgtgtgagcataaacagaggagatatgctatgacagacctaaacctggcggcagcgcaaaagatg

SEQ ID NO: 128927 - DNA, 103 bp, Artificial Sequence
  Synthetic Polynucleotide
taatacgactcactataggggcctctgcgctcaatgaggtcgtaggtctgaacagaggagacagaccatggacctcattaacctggcggcagcgcaaaagatg

SEQ ID NO: 128928 - DNA, 103 bp, Artificial Sequence
  Synthetic Polynucleotide
taatacgactcactatagggttcctttcgtgcctctgcgctcaatgaggtaacagaggagaacctcaatgagcgcagagaacctggcggcagcgcaaaagatg

SEQ ID NO: 128929 - DNA, 103 bp, Artificial Sequence
  Synthetic Polynucleotide
taatacgactcactataggggcttgggaaattcctttcgtgcctctgcgcaacagaggagagcgcagatgcacgaaaggaacctggcggcagcgcaaaagatg

SEQ ID NO: 128930 - DNA, 103 bp, Artificial Sequence
  Synthetic Polynucleotide
taatacgactcactatagggtcggatttcagcttgggaaattcctttcgtaacagaggagaacgaaaatgatttcccaaaacctggcggcagcgcaaaagatg

SEQ ID NO: 128931 - DNA, 103 bp, Artificial Sequence
  Synthetic Polynucleotide
taatacgactcactatagggtcatagccactcggatttcagcttgggaaaaacagaggagatttcccatgctgaaatccaacctggcggcagcgcaaaagatg

SEQ ID NO: 128932 - DNA, 103 bp, Artificial Sequence
  Synthetic Polynucleotide
taatacgactcactatagggtttcccacattcatagccactcggatttcaaacagaggagatgaaatatgagtggctataacctggcggcagcgcaaaagatg

SEQ ID NO: 128933 - DNA, 103 bp, Artificial Sequence
  Synthetic Polynucleotide
taatacgactcactatagggtgcttctagttttcccacattcatagccacaacagaggagagtggctatgaatgtgggaaacctggcggcagcgcaaaagatg

SEQ ID NO: 128934 - DNA, 103 bp, Artificial Sequence
  Synthetic Polynucleotide
taatacgactcactatagggacagcattcttgcttctagttttcccacataacagaggagaatgtggatgaactagaagaacctggcggcagcgcaaaagatg

SEQ ID NO: 128935 - DNA, 103 bp, Artificial Sequence
  Synthetic Polynucleotide
taatacgactcactatagggagaaactcctgcgtgcagggttccaaaggcaacagaggagagcctttatgaccctgcacaacctggcggcagcgcaaaagatg

SEQ ID NO: 128936 - DNA, 103 bp, Artificial Sequence
  Synthetic Polynucleotide
taatacgactcactatagggagaagtcggcacagcattcttgcttctagtaacagaggagaactagaatgaagaatgctaacctggcggcagcgcaaaagatg

SEQ ID NO: 128937 - DNA, 103 bp, Artificial Sequence
  Synthetic Polynucleotide
taatacgactcactataggggaatctttgaagaagtcggcacagcattctaacagaggagaagaatgatgtgccgacttaacctggcggcagcgcaaaagatg

SEQ ID NO: 128938 - DNA, 103 bp, Artificial Sequence
  Synthetic Polynucleotide
taatacgactcactatagggtgacaactttgaatctttgaagaagtcggcaacagaggagagccgacatgttcaaagataacctggcggcagcgcaaaagatg

SEQ ID NO: 128939 - DNA, 103 bp, Artificial Sequence
  Synthetic Polynucleotide
taatacgactcactatagggatgaatcccttgacaactttgaatctttgaaacagaggagatcaaagatgcaaagttgtaacctggcggcagcgcaaaagatg

SEQ ID NO: 128940 - DNA, 103 bp, Artificial Sequence
  Synthetic Polynucleotide
taatacgactcactatagggttcgtcttccatgaatcccttgacaactttaacagaggagaaaagttatgaagggattcaacctggcggcagcgcaaaagatg

SEQ ID NO: 128941 - DNA, 103 bp, Artificial Sequence
  Synthetic Polynucleotide
taatacgactcactataggggctgccgaccttcgtcttccatgaatccctaacagaggagaagggatatgtggaagacgaacctggcggcagcgcaaaagatg

SEQ ID NO: 128942 - DNA, 103 bp, Artificial Sequence
  Synthetic Polynucleotide
taatacgactcactatagggttggtggttcgctgccgaccttcgtcttccaacagaggagaggaagaatgaggtcggcaaacctggcggcagcgcaaaagatg

SEQ ID NO: 128943 - DNA, 103 bp, Artificial Sequence
  Synthetic Polynucleotide
taatacgactcactatagggggaaatgtacttggtggttcgctgccgaccaacagaggagaggtcggatgcgaaccaccaacctggcggcagcgcaaaagatg

SEQ ID NO: 128944 - DNA, 103 bp, Artificial Sequence
  Synthetic Polynucleotide
taatacgactcactatagggcaaacacgcaggaaatgtacttggtggttcaacagaggagagaaccaatgagtacatttaacctggcggcagcgcaaaagatg

SEQ ID NO: 128945 - DNA, 103 bp, Artificial Sequence
  Synthetic Polynucleotide
taatacgactcactatagggctctcctctgcaaacacgcaggaaatgtacaacagaggagagtacatatgctgcgtgttaacctggcggcagcgcaaaagatg

SEQ ID NO: 128946 - DNA, 103 bp, Artificial Sequence
  Synthetic Polynucleotide
taatacgactcactatagggggcccgccagagaaactcctgcgtgcagggaacagaggagaccctgcatgcaggagtttaacctggcggcagcgcaaaagatg

SEQ ID NO: 128947 - DNA, 103 bp, Artificial Sequence
  Synthetic Polynucleotide
taatacgactcactataggggcttaggtcgctctcctctgcaaacacgcaaacagaggagatgcgtgatggcagaggagaacctggcggcagcgcaaaagatg

SEQ ID NO: 128948 - DNA, 103 bp, Artificial Sequence
  Synthetic Polynucleotide
taatacgactcactatagggggtactgccggcttaggtcgctctcctctgaacagaggagacagaggatggcgacctaaaacctggcggcagcgcaaaagatg

SEQ ID NO: 128949 - DNA, 103 bp, Artificial Sequence
  Synthetic Polynucleotide
taatacgactcactatagggttctctctttggtactgccggcttaggtcgaacagaggagacgacctatgccggcagtaaacctggcggcagcgcaaaagatg

SEQ ID NO: 128950 - DNA, 103 bp, Artificial Sequence
  Synthetic Polynucleotide
taatacgactcactataggggctgcgggccttctctctttggtactgccgaacagaggagacggcagatgcaaagagagaacctggcggcagcgcaaaagatg

SEQ ID NO: 128951 - DNA, 103 bp, Artificial Sequence
  Synthetic Polynucleotide
taatacgactcactatagggtcaagagctcgctgcgggccttctctctttaacagaggagaaaagagatgaggcccgcaaacctggcggcagcgcaaaagatg

SEQ ID NO: 128952 - DNA, 103 bp, Artificial Sequence
  Synthetic Polynucleotide
taatacgactcactatagggctcacggtggtcaagagctcgctgcgggccaacagaggagaggcccgatgcgagctcttaacctggcggcagcgcaaaagatg

SEQ ID NO: 128953 - DNA, 103 bp, Artificial Sequence
  Synthetic Polynucleotide
taatacgactcactatagggagacgccaggctcacggtggtcaagagctcaacagaggagagagctcatgaccaccgtgaacctggcggcagcgcaaaagatg

SEQ ID NO: 128954 - DNA, 103 bp, Artificial Sequence
  Synthetic Polynucleotide
taatacgactcactatagggcctcctgcatagacgccaggctcacggtggaacagaggagaccaccgatggcctggcgtaacctggcggcagcgcaaaagatg

SEQ ID NO: 128955 - DNA, 103 bp, Artificial Sequence
  Synthetic Polynucleotide
taatacgactcactatagggagaagcgactcctcctgcatagacgccaggaacagaggagacctggcatgtatgcaggaaacctggcggcagcgcaaaagatg

SEQ ID NO: 128956 - DNA, 103 bp, Artificial Sequence
  Synthetic Polynucleotide
taatacgactcactataggggccttcaggcagaagcgactcctcctgcataacagaggagaatgcagatggagtcgcttaacctggcggcagcgcaaaagatg

SEQ ID NO: 128957 - DNA, 103 bp, Artificial Sequence
  Synthetic Polynucleotide
taatacgactcactataggggcgtggcgagggcccgccagagaaactcctaacagaggagaaggagtatgtctggcgggaacctggcggcagcgcaaaagatg

SEQ ID NO: 128958 - DNA, 103 bp, Artificial Sequence
  Synthetic Polynucleotide
taatacgactcactatagggaggtgtcctcgccttcaggcagaagcgactaacagaggagaagtcgcatgtgcctgaagaacctggcggcagcgcaaaagatg

SEQ ID NO: 128959 - DNA, 103 bp, Artificial Sequence
  Synthetic Polynucleotide
taatacgactcactatagggtcagagaggaaggtgtcctcgccttcaggcaacagaggagagcctgaatgcgaggacacaacctggcggcagcgcaaaagatg

SEQ ID NO: 128960 - DNA, 103 bp, Artificial Sequence
  Synthetic Polynucleotide
taatacgactcactatagggactgtccgactcagagaggaaggtgtcctcaacagaggagagaggacatgttcctctctaacctggcggcagcgcaaaagatg

SEQ ID NO: 128961 - DNA, 103 bp, Artificial Sequence
  Synthetic Polynucleotide
taatacgactcactatagggtctcctcctcactgtccgactcagagaggaaacagaggagatcctctatgagtcggacaaacctggcggcagcgcaaaagatg

SEQ ID NO: 128962 - DNA, 103 bp, Artificial Sequence
  Synthetic Polynucleotide
taatacgactcactatagggctgctgctcctctcctcctcactgtccgacaacagaggagagtcggaatgtgaggaggaaacctggcggcagcgcaaaagatg

SEQ ID NO: 128963 - DNA, 103 bp, Artificial Sequence
  Synthetic Polynucleotide
taatacgactcactatagggtctccgcttgctgctgctcctctcctcctcaacagaggagagaggagatgaggagcagcaacctggcggcagcgcaaaagatg

SEQ ID NO: 128964 - DNA, 103 bp, Artificial Sequence
  Synthetic Polynucleotide
taatacgactcactatagggaccctctgcctctccgcttgctgctgctccaacagaggagaggagcaatggcaagcggaaacctggcggcagcgcaaaagatg

SEQ ID NO: 128965 - DNA, 103 bp, Artificial Sequence
  Synthetic Polynucleotide
taatacgactcactatagggtctttctgggaccctctgcctctccgcttgaacagaggagacaagcgatgaggcagaggaacctggcggcagcgcaaaagatg

SEQ ID NO: 128966 - DNA, 103 bp, Artificial Sequence
  Synthetic Polynucleotide
taatacgactcactatagggggctcttgtgtctttctgggaccctctgccaacagaggagaggcagaatgtcccagaaaaacctggcggcagcgcaaaagatg

SEQ ID NO: 128967 - DNA, 103 bp, Artificial Sequence
  Synthetic Polynucleotide
taatacgactcactatagggggtttgcagaggctcttgtgtctttctgggaacagaggagacccagaatgacacaagagaacctggcggcagcgcaaaagatg

SEQ ID NO: 128968 - DNA, 103 bp, Artificial Sequence
  Synthetic Polynucleotide
taatacgactcactatagggatgcccgggtgcgtggcgagggcccgccagaacagaggagactggcgatgcctcgccacaacctggcggcagcgcaaaagatg

SEQ ID NO: 128969 - DNA, 103 bp, Artificial Sequence
  Synthetic Polynucleotide
taatacgactcactatagggttgggccggaggtttgcagaggctcttgtgaacagaggagacacaagatgctctgcaaaaacctggcggcagcgcaaaagatg

SEQ ID NO: 128970 - DNA, 103 bp, Artificial Sequence
  Synthetic Polynucleotide
taatacgactcactatagggaggctgggtcttgggccggaggtttgcagaaacagaggagatctgcaatgctccggcccaacctggcggcagcgcaaaagatg

SEQ ID NO: 128971 - DNA, 103 bp, Artificial Sequence
  Synthetic Polynucleotide
taatacgactcactatagggtggagtgatgaggctgggtcttgggccggaaacagaggagatccggcatgagacccagcaacctggcggcagcgcaaaagatg

SEQ ID NO: 128972 - DNA, 103 bp, Artificial Sequence
  Synthetic Polynucleotide
taatacgactcactatagggttggttggggtggagtgatgaggctgggtcaacagaggagagacccaatgtcatcactcaacctggcggcagcgcaaaagatg

SEQ ID NO: 128973 - DNA, 103 bp, Artificial Sequence
  Synthetic Polynucleotide
taatacgactcactatagggccacccacccttggttggggtggagtgatgaacagaggagacatcacatgaccccaaccaacctggcggcagcgcaaaagatg

SEQ ID NO: 128974 - DNA, 103 bp, Artificial Sequence
  Synthetic Polynucleotide
taatacgactcactatagggttacaactttccacccacccttggttggggaacagaggagaccccaaatgagggtgggtaacctggcggcagcgcaaaagatg

SEQ ID NO: 128975 - DNA, 103 bp, Artificial Sequence
  Synthetic Polynucleotide
taatacgactcactataggggggtgtaggtttacaactttccacccacccaacagaggagagggtggatggaaagttgtaacctggcggcagcgcaaaagatg

SEQ ID NO: 128976 - DNA, 103 bp, Artificial Sequence
  Synthetic Polynucleotide
taatacgactcactatagggctttttcaatgggtgtaggtttacaactttaacagaggagaaaagttatgaacctacacaacctggcggcagcgcaaaagatg

SEQ ID NO: 128977 - DNA, 103 bp, Artificial Sequence
  Synthetic Polynucleotide
taatacgactcactatagggagggcggctgctttttcaatgggtgtaggtaacagaggagaacctacatgcattgaaaaaacctggcggcagcgcaaaagatg

SEQ ID NO: 128978 - DNA, 103 bp, Artificial Sequence
  Synthetic Polynucleotide
taatacgactcactatagggcctgggaaggagggcggctgctttttcaataacagaggagaattgaaatggcagccgccaacctggcggcagcgcaaaagatg

SEQ ID NO: 128979 - DNA, 103 bp, Artificial Sequence
  Synthetic Polynucleotide
taatacgactcactatagggatagaagctgatgcccgggtgcgtggcgagaacagaggagactcgccatgcacccgggcaacctggcggcagcgcaaaagatg

SEQ ID NO: 128980 - DNA, 103 bp, Artificial Sequence
  Synthetic Polynucleotide
taatacgactcactatagggttcagcagctcctgggaaggagggcggctgaacagaggagacagccgatgtccttcccaaacctggcggcagcgcaaaagatg

SEQ ID NO: 128981 - DNA, 103 bp, Artificial Sequence
  Synthetic Polynucleotide
taatacgactcactatagggaggctctctcttcagcagctcctgggaaggaacagaggagaccttccatggagctgctgaacctggcggcagcgcaaaagatg

SEQ ID NO: 128982 - DNA, 103 bp, Artificial Sequence
  Synthetic Polynucleotide
taatacgactcactatagggaggctctggcaggctctctcttcagcagctaacagaggagaagctgcatgagagagagcaacctggcggcagcgcaaaagatg

SEQ ID NO: 128983 - DNA, 103 bp, Artificial Sequence
  Synthetic Polynucleotide
taatacgactcactatagggcctgctggcaaggctctggcaggctctctcaacagaggagagagagaatgtgccagagcaacctggcggcagcgcaaaagatg

SEQ ID NO: 128984 - DNA, 103 bp, Artificial Sequence
  Synthetic Polynucleotide
taatacgactcactatagggagaggctgtccctgctggcaaggctctggcaacagaggagagccagaatgttgccagcaaacctggcggcagcgcaaaagatg

SEQ ID NO: 128985 - DNA, 103 bp, Artificial Sequence
  Synthetic Polynucleotide
taatacgactcactatagggctggtatctaagaggctgtccctgctggcaaacagaggagatgccagatgggacagcctaacctggcggcagcgcaaaagatg

SEQ ID NO: 128986 - DNA, 103 bp, Artificial Sequence
  Synthetic Polynucleotide
taatacgactcactatagggtgagacgctgctggtatctaagaggctgtcaacagaggagagacagcatgttagataccaacctggcggcagcgcaaaagatg

SEQ ID NO: 128987 - DNA, 103 bp, Artificial Sequence
  Synthetic Polynucleotide
taatacgactcactatagggcgttgggttctgagacgctgctggtatctaaacagaggagatagataatggcagcgtctaacctggcggcagcgcaaaagatg

SEQ ID NO: 128988 - DNA, 103 bp, Artificial Sequence
  Synthetic Polynucleotide
taatacgactcactatagggacaaaggacacgttgggttctgagacgctgaacagaggagacagcgtatgagaacccaaaacctggcggcagcgcaaaagatg

SEQ ID NO: 128989 - DNA, 103 bp, Artificial Sequence
  Synthetic Polynucleotide
taatacgactcactatagggacagtgggagacaaaggacacgttgggttcaacagaggagagaacccatggtgtcctttaacctggcggcagcgcaaaagatg

SEQ ID NO: 128990 - DNA, 103 bp, Artificial Sequence
  Synthetic Polynucleotide
taatacgactcactataggggaggctcctcatagaagctgatgcccgggtaacagaggagaacccggatgtcagcttctaacctggcggcagcgcaaaagatg

SEQ ID NO: 128991 - DNA, 103 bp, Artificial Sequence
  Synthetic Polynucleotide
taatacgactcactatagggtgctgtccgcacagtgggagacaaaggacaaacagaggagatgtcctatgtctcccactaacctggcggcagcgcaaaagatg

SEQ ID NO: 128992 - DNA, 103 bp, Artificial Sequence
  Synthetic Polynucleotide
taatacgactcactatagggtcaccactgttgctgtccgcacagtgggagaacagaggagactcccaatgtgcggacagaacctggcggcagcgcaaaagatg

SEQ ID NO: 128993 - DNA, 103 bp, Artificial Sequence
  Synthetic Polynucleotide
taatacgactcactatagggcacagctatgtcaccactgttgctgtccgcaacagaggagagcggacatgaacagtggtaacctggcggcagcgcaaaagatg

SEQ ID NO: 128994 - DNA, 103 bp, Artificial Sequence
  Synthetic Polynucleotide
taatacgactcactatagggcctcctcgatcacagctatgtcaccactgtaacagaggagaacagtgatgacatagctgaacctggcggcagcgcaaaagatg

SEQ ID NO: 128995 - DNA, 103 bp, Artificial Sequence
  Synthetic Polynucleotide
taatacgactcactatagggtccatccggacctcctcgatcacagctatgaacagaggagacatagcatggatcgaggaaacctggcggcagcgcaaaagatg

SEQ ID NO: 128996 - DNA, 103 bp, Artificial Sequence
  Synthetic Polynucleotide
taatacgactcactatagggctttgggttttccatccggacctcctcgataacagaggagaatcgagatggtccggatgaacctggcggcagcgcaaaagatg

SEQ ID NO: 128997 - DNA, 103 bp, Artificial Sequence
  Synthetic Polynucleotide
taatacgactcactatagggtgctactctcctttgggttttccatccggaaacagaggagatccggaatgaaaacccaaaacctggcggcagcgcaaaagatg

SEQ ID NO: 128998 - DNA, 103 bp, Artificial Sequence
  Synthetic Polynucleotide
taatacgactcactatagggttcagggaactgctactctcctttgggtttaacagaggagaaaacccatgggagagtagaacctggcggcagcgcaaaagatg

SEQ ID NO: 128999 - DNA, 103 bp, Artificial Sequence
  Synthetic Polynucleotide
taatacgactcactatagggcctcccagtcttcagggaactgctactctcaacagaggagagagagtatgagttccctgaacctggcggcagcgcaaaagatg

SEQ ID NO: 129000 - DNA, 103 bp, Artificial Sequence
  Synthetic Polynucleotide
taatacgactcactatagggctgagctgtgcctcccagtcttcagggaacaacagaggagagttcccatgagactgggaaacctggcggcagcgcaaaagatg

SEQ ID NO: 129001 - DNA, 103 bp, Artificial Sequence
  Synthetic Polynucleotide
taatacgactcactatagggggtcgctcccgaggctcctcatagaagctgaacagaggagacagcttatgtgaggagccaacctggcggcagcgcaaaagatg

SEQ ID NO: 129002 - DNA, 103 bp, Artificial Sequence
  Synthetic Polynucleotide
taatacgactcactatagggttgtcttggcctgagctgtgcctcccagtcaacagaggagagactggatggcacagctcaacctggcggcagcgcaaaagatg

SEQ ID NO: 129003 - DNA, 103 bp, Artificial Sequence
  Synthetic Polynucleotide
taatacgactcactatagggttcgtgtggtttgtcttggcctgagctgtgaacagaggagacacagcatgggccaagacaacctggcggcagcgcaaaagatg

SEQ ID NO: 129004 - DNA, 103 bp, Artificial Sequence
  Synthetic Polynucleotide
taatacgactcactataggggtcggtaagtttcgtgtggtttgtcttggcaacagaggagagccaagatgaaccacacgaacctggcggcagcgcaaaagatg

SEQ ID NO: 129005 - DNA, 103 bp, Artificial Sequence
  Synthetic Polynucleotide
taatacgactcactatagggcgtttcagcagtcggtaagtttcgtgtggtaacagaggagaaccacaatgaacttaccgaacctggcggcagcgcaaaagatg

SEQ ID NO: 129006 - DNA, 103 bp, Artificial Sequence
  Synthetic Polynucleotide
taatacgactcactatagggcagattcctgcgtttcagcagtcggtaagtaacagaggagaacttacatgctgctgaaaaacctggcggcagcgcaaaagatg

SEQ ID NO: 129007 - DNA, 103 bp, Artificial Sequence
  Synthetic Polynucleotide
taatacgactcactatagggcttctatgatcagattcctgcgtttcagcaaacagaggagatgctgaatggcaggaatcaacctggcggcagcgcaaaagatg

SEQ ID NO: 129008 - DNA, 103 bp, Artificial Sequence
  Synthetic Polynucleotide
taatacgactcactatagggttggtgacagcttctatgatcagattcctgaacagaggagacaggaaatggatcatagaaacctggcggcagcgcaaaagatg

SEQ ID NO: 129009 - DNA, 103 bp, Artificial Sequence
  Synthetic Polynucleotide
taatacgactcactatagggtaagcgaagattggtgacagcttctatgataacagaggagaatcataatggctgtcaccaacctggcggcagcgcaaaagatg

SEQ ID NO: 129010 - DNA, 103 bp, Artificial Sequence
  Synthetic Polynucleotide
taatacgactcactatagggaactctcgattaagcgaagattggtgacagaacagaggagactgtcaatgatcttcgctaacctggcggcagcgcaaaagatg

SEQ ID NO: 129011 - DNA, 103 bp, Artificial Sequence
  Synthetic Polynucleotide
taatacgactcactatagggatcgtgaataaactctcgattaagcgaagaaacagaggagatcttcgatgaatcgagagaacctggcggcagcgcaaaagatg

SEQ ID NO: 129012 - DNA, 103 bp, Artificial Sequence
  Synthetic Polynucleotide
taatacgactcactatagggctgtaggtcgggtcgctcccgaggctcctcaacagaggagagaggagatgcgggagcgaaacctggcggcagcgcaaaagatg

SEQ ID NO: 129013 - DNA, 103 bp, Artificial Sequence
  Synthetic Polynucleotide
taatacgactcactatagggcatcttctgaatcgtgaataaactctcgataacagaggagaatcgagatgttattcacgaacctggcggcagcgcaaaagatg

SEQ ID NO: 129014 - DNA, 103 bp, Artificial Sequence
  Synthetic Polynucleotide
taatacgactcactataggggatccatgatcatcttctgaatcgtgaataaacagaggagatattcaatgttcagaagaaacctggcggcagcgcaaaagatg

SEQ ID NO: 129015 - DNA, 103 bp, Artificial Sequence
  Synthetic Polynucleotide
taatacgactcactatagggtgcttctcctgatccatgatcatcttctgaaacagaggagatcagaaatggatcatggaaacctggcggcagcgcaaaagatg

SEQ ID NO: 129016 - DNA, 103 bp, Artificial Sequence
  Synthetic Polynucleotide
taatacgactcactatagggcacgccttcctgcttctcctgatccatgataacagaggagaatcatgatgcaggagaagaacctggcggcagcgcaaaagatg

SEQ ID NO: 129017 - DNA, 103 bp, Artificial Sequence
  Synthetic Polynucleotide
taatacgactcactatagggacttggtggacacgccttcctgcttctcctaacagaggagaaggagaatgaggaaggcgaacctggcggcagcgcaaaagatg

SEQ ID NO: 129018 - DNA, 103 bp, Artificial Sequence
  Synthetic Polynucleotide
taatacgactcactatagggttcttgcagcacttggtggacacgccttccaacagaggagaggaaggatggtccaccaaaacctggcggcagcgcaaaagatg

SEQ ID NO: 129019 - DNA, 103 bp, Artificial Sequence
  Synthetic Polynucleotide
taatacgactcactataggggacaatggacttcttgcagcacttggtggaaacagaggagatccaccatgtgctgcaagaacctggcggcagcgcaaaagatg

SEQ ID NO: 129020 - DNA, 103 bp, Artificial Sequence
  Synthetic Polynucleotide
taatacgactcactataggggcaccaagcggacaatggacttcttgcagcaacagaggagagctgcaatgagtccattgaacctggcggcagcgcaaaagatg

SEQ ID NO: 129021 - DNA, 103 bp, Artificial Sequence
  Synthetic Polynucleotide
taatacgactcactataggggacaggttccgcaccaagcggacaatggacaacagaggagagtccatatgccgcttggtaacctggcggcagcgcaaaagatg

SEQ ID NO: 129022 - DNA, 103 bp, Artificial Sequence
  Synthetic Polynucleotide
taatacgactcactatagggaccttcctcagacaggttccgcaccaagcgaacagaggagacgcttgatgcggaacctgaacctggcggcagcgcaaaagatg

SEQ ID NO: 129023 - DNA, 103 bp, Artificial Sequence
  Synthetic Polynucleotide
taatacgactcactatagggccagagcgacttcgtccaacaacgactccaaacagaggagatggagtatgtgttggacgaacctggcggcagcgcaaaagatg

SEQ ID NO: 129024 - DNA, 103 bp, Artificial Sequence
  Synthetic Polynucleotide
taatacgactcactatagggggtcctggagctgtaggtcgggtcgctcccaacagaggagagggagcatgccgacctacaacctggcggcagcgcaaaagatg

SEQ ID NO: 129025 - DNA, 103 bp, Artificial Sequence
  Synthetic Polynucleotide
taatacgactcactatagggatcgcaagagaccttcctcagacaggttccaacagaggagaggaaccatgctgaggaagaacctggcggcagcgcaaaagatg

SEQ ID NO: 129026 - DNA, 103 bp, Artificial Sequence
  Synthetic Polynucleotide
taatacgactcactataggggtccgatacaatcgcaagagaccttcctcaaacagaggagatgaggaatgtctcttgcgaacctggcggcagcgcaaaagatg

SEQ ID NO: 129027 - DNA, 103 bp, Artificial Sequence
  Synthetic Polynucleotide
taatacgactcactatagggaatgacagtggtccgatacaatcgcaagagaacagaggagactcttgatgttgtatcggaacctggcggcagcgcaaaagatg

SEQ ID NO: 129028 - DNA, 103 bp, Artificial Sequence
  Synthetic Polynucleotide
taatacgactcactatagggtgccatcttgaatgacagtggtccgatacaaacagaggagatgtatcatgccactgtcaaacctggcggcagcgcaaaagatg

SEQ ID NO: 129029 - DNA, 103 bp, Artificial Sequence
  Synthetic Polynucleotide
taatacgactcactatagggttcttcttgatgccatcttgaatgacagtgaacagaggagacactgtatgtcaagatggaacctggcggcagcgcaaaagatg

SEQ ID NO: 129030 - DNA, 103 bp, Artificial Sequence
  Synthetic Polynucleotide
taatacgactcactatagggcagatccaccttcttcttgatgccatcttgaacagaggagacaagatatgatcaagaagaacctggcggcagcgcaaaagatg

SEQ ID NO: 129031 - DNA, 103 bp, Artificial Sequence
  Synthetic Polynucleotide
taatacgactcactatagggggtgcaccaccagatccaccttcttcttgaaacagaggagatcaagaatgaggtggatcaacctggcggcagcgcaaaagatg

SEQ ID NO: 129032 - DNA, 103 bp, Artificial Sequence
  Synthetic Polynucleotide
taatacgactcactatagggtccatggacgggtgcaccaccagatccaccaacagaggagaggtggaatgggtggtgcaaacctggcggcagcgcaaaagatg

SEQ ID NO: 129033 - DNA, 103 bp, Artificial Sequence
  Synthetic Polynucleotide
taatacgactcactataggggtcgttctggtccatggacgggtgcaccacaacagaggagagtggtgatgccgtccatgaacctggcggcagcgcaaaagatg

SEQ ID NO: 129034 - DNA, 103 bp, Artificial Sequence
  Synthetic Polynucleotide
taatacgactcactatagggtcactagagggtcgttctggtccatggacgaacagaggagacgtccaatgaccagaacgaacctggcggcagcgcaaaagatg

SEQ ID NO: 129035 - DNA, 103 bp, Artificial Sequence
  Synthetic Polynucleotide
taatacgactcactatagggtcttcataccggtcctggagctgtaggtcgaacagaggagacgacctatggctccaggaaacctggcggcagcgcaaaagatg

SEQ ID NO: 129036 - DNA, 103 bp, Artificial Sequence
  Synthetic Polynucleotide
taatacgactcactatagggatggcacttctcactagagggtcgttctggaacagaggagaccagaaatgccctctagtaacctggcggcagcgcaaaagatg

SEQ ID NO: 129037 - DNA, 103 bp, Artificial Sequence
  Synthetic Polynucleotide
taatacgactcactataggggacctgctcgatggcacttctcactagaggaacagaggagacctctaatgagaagtgccaacctggcggcagcgcaaaagatg

SEQ ID NO: 129038 - DNA, 103 bp, Artificial Sequence
  Synthetic Polynucleotide
taatacgactcactatagggtccggaagcggacctgctcgatggcacttcaacagaggagagaagtgatgtcgagcaggaacctggcggcagcgcaaaagatg

SEQ ID NO: 129039 - DNA, 103 bp, Artificial Sequence
  Synthetic Polynucleotide
taatacgactcactataggggaattggagatccggaagcggacctgctcgaacagaggagacgagcaatgccgcttccgaacctggcggcagcgcaaaagatg

SEQ ID NO: 129040 - DNA, 103 bp, Artificial Sequence
  Synthetic Polynucleotide
taatacgactcactatagggggctgtgcttgaattggagatccggaagcgaacagaggagacgcttcatgatctccaataacctggcggcagcgcaaaagatg

SEQ ID NO: 129041 - DNA, 103 bp, Artificial Sequence
  Synthetic Polynucleotide
taatacgactcactatagggtaaccctgttggctgtgcttgaattggagaaacagaggagatctccaatgcaagcacagaacctggcggcagcgcaaaagatg

SEQ ID NO: 129042 - DNA, 103 bp, Artificial Sequence
  Synthetic Polynucleotide
taatacgactcactatagggtgggaagttttaaccctgttggctgtgcttaacagaggagaaagcacatgcaacagggtaacctggcggcagcgcaaaagatg

SEQ ID NO: 129043 - DNA, 103 bp, Artificial Sequence
  Synthetic Polynucleotide
taatacgactcactatagggcactggaggctgggaagttttaaccctgttaacagaggagaaacaggatgaaaacttccaacctggcggcagcgcaaaagatg

SEQ ID NO: 129044 - DNA, 103 bp, Artificial Sequence
  Synthetic Polynucleotide
taatacgactcactatagggccccttggggcactggaggctgggaagtttaacagaggagaaaacttatgagcctccagaacctggcggcagcgcaaaagatg

SEQ ID NO: 129045 - DNA, 103 bp, Artificial Sequence
  Synthetic Polynucleotide
taatacgactcactatagggtcttctgcctccccttggggcactggaggcaacagaggagagcctccatggccccaaggaacctggcggcagcgcaaaagatg

SEQ ID NO: 129046 - DNA, 103 bp, Artificial Sequence
  Synthetic Polynucleotide
taatacgactcactatagggcaaatcaatttcttcataccggtcctggagaacagaggagactccagatgcggtatgaaaacctggcggcagcgcaaaagatg

SEQ ID NO: 129047 - DNA, 103 bp, Artificial Sequence
  Synthetic Polynucleotide
taatacgactcactatagggttgactgtcttcttctgcctccccttggggaacagaggagaccccaaatggaggcagaaaacctggcggcagcgcaaaagatg

SEQ ID NO: 129048 - DNA, 103 bp, Artificial Sequence
  Synthetic Polynucleotide
taatacgactcactatagggcctcttttccttgactgtcttcttctgcctaacagaggagaaggcagatgaagacagtcaacctggcggcagcgcaaaagatg

SEQ ID NO: 129049 - DNA, 103 bp, Artificial Sequence
  Synthetic Polynucleotide
taatacgactcactatagggccacttgggccctcttttccttgactgtctaacagaggagaagacagatgaggaaaagaaacctggcggcagcgcaaaagatg

SEQ ID NO: 129050 - DNA, 103 bp, Artificial Sequence
  Synthetic Polynucleotide
taatacgactcactataggggtcccctgatccacttgggccctcttttccaacagaggagaggaaaaatgggcccaagtaacctggcggcagcgcaaaagatg

SEQ ID NO: 129051 - DNA, 103 bp, Artificial Sequence
  Synthetic Polynucleotide
taatacgactcactatagggtcagctgagagtcccctgatccacttgggcaacagaggagagcccaaatggatcaggggaacctggcggcagcgcaaaagatg

SEQ ID NO: 129052 - DNA, 103 bp, Artificial Sequence
  Synthetic Polynucleotide
taatacgactcactataggggaggaagcactcagctgagagtcccctgataacagaggagaatcaggatgctctcagctaacctggcggcagcgcaaaagatg

SEQ ID NO: 129053 - DNA, 103 bp, Artificial Sequence
  Synthetic Polynucleotide
taatacgactcactatagggttctgatctagaggaagcactcagctgagaaacagaggagatctcagatgagtgcttccaacctggcggcagcgcaaaagatg

SEQ ID NO: 129054 - DNA, 103 bp, Artificial Sequence
  Synthetic Polynucleotide
taatacgactcactatagggtccgtccactttctgatctagaggaagcacaacagaggagagtgcttatgctagatcagaacctggcggcagcgcaaaagatg

SEQ ID NO: 129055 - DNA, 103 bp, Artificial Sequence
  Synthetic Polynucleotide
taatacgactcactatagggctttttttcatccgtccactttctgatctaaacagaggagatagatcatgaagtggacgaacctggcggcagcgcaaaagatg

SEQ ID NO: 129056 - DNA, 103 bp, Artificial Sequence
  Synthetic Polynucleotide
taatacgactcactatagggtttattatcactttttttcatccgtccactaacagaggagaagtggaatgatgaaaaaaaacctggcggcagcgcaaaagatg

SEQ ID NO: 129057 - DNA, 103 bp, Artificial Sequence
  Synthetic Polynucleotide
taatacgactcactatagggttccagtttccaaatcaatttcttcataccaacagaggagaggtatgatgaaattgattaacctggcggcagcgcaaaagatg

SEQ ID NO: 129058 - DNA, 103 bp, Artificial Sequence
  Synthetic Polynucleotide
taatacgactcactatagggttatgcccattttattatcactttttttcaaacagaggagatgaaaaatggtgataataaacctggcggcagcgcaaaagatg

SEQ ID NO: 129059 - DNA, 103 bp, Artificial Sequence
  Synthetic Polynucleotide
taatacgactcactatagggctaagcggggttatgcccattttattatcaaacagaggagatgataaatgaatgggcataacctggcggcagcgcaaaagatg

SEQ ID NO: 129060 - DNA, 103 bp, Artificial Sequence
  Synthetic Polynucleotide
taatacgactcactataggggtgataatttctaagcggggttatgcccataacagaggagaatgggcatgaccccgcttaacctggcggcagcgcaaaagatg

SEQ ID NO: 129061 - DNA, 103 bp, Artificial Sequence
  Synthetic Polynucleotide
taatacgactcactatagggctacaatggggtgataatttctaagcggggaacagaggagaccccgcatggaaattatcaacctggcggcagcgcaaaagatg

SEQ ID NO: 129062 - DNA, 103 bp, Artificial Sequence
  Synthetic Polynucleotide
taatacgactcactatagggagtccgggaactacaatggggtgataatttaacagaggagaaaattaatgccccattgtaacctggcggcagcgcaaaagatg

SEQ ID NO: 129063 - DNA, 103 bp, Artificial Sequence
  Synthetic Polynucleotide
taatacgactcactatagggagaacgccccagtccgggaactacaatgggaacagaggagacccattatggttcccggaaacctggcggcagcgcaaaagatg

SEQ ID NO: 129064 - DNA, 103 bp, Artificial Sequence
  Synthetic Polynucleotide
taatacgactcactataggggaaatcctagagaacgccccagtccgggaaaacagaggagattcccgatgtggggcgttaacctggcggcagcgcaaaagatg

SEQ ID NO: 129065 - DNA, 103 bp, Artificial Sequence
  Synthetic Polynucleotide
taatacgactcactatagggattttgggcagaaatcctagagaacgccccaacagaggagaggggcgatgtctaggattaacctggcggcagcgcaaaagatg

SEQ ID NO: 129066 - DNA, 103 bp, Artificial Sequence
  Synthetic Polynucleotide
taatacgactcactatagggcaggcgaggcattttgggcagaaatcctagaacagaggagactaggaatgctgcccaaaaacctggcggcagcgcaaaagatg

SEQ ID NO: 129067 - DNA, 103 bp, Artificial Sequence
  Synthetic Polynucleotide
taatacgactcactatagggggaccacccgcaggcgaggcattttgggcaaacagaggagatgcccaatgtgcctcgccaacctggcggcagcgcaaaagatg

SEQ ID NO: 129068 - DNA, 103 bp, Artificial Sequence
  Synthetic Polynucleotide
taatacgactcactataggggactccaaaattccagtttccaaatcaattaacagaggagaaattgaatgggaaactggaacctggcggcagcgcaaaagatg

SEQ ID NO: 129069 - DNA, 103 bp, Artificial Sequence
  Synthetic Polynucleotide
taatacgactcactatagggagaaacatgtggaccacccgcaggcgaggcaacagaggagagcctcgatggcgggtggtaacctggcggcagcgcaaaagatg

SEQ ID NO: 129070 - DNA, 103 bp, Artificial Sequence
  Synthetic Polynucleotide
taatacgactcactataggggaggtaccacagaaacatgtggaccacccgaacagaggagacgggtgatgcacatgtttaacctggcggcagcgcaaaagatg

SEQ ID NO: 129071 - DNA, 103 bp, Artificial Sequence
  Synthetic Polynucleotide
taatacgactcactataggggcccgtagatgaggtaccacagaaacatgtaacagaggagaacatgtatgtgtggtaccaacctggcggcagcgcaaaagatg

SEQ ID NO: 129072 - DNA, 103 bp, Artificial Sequence
  Synthetic Polynucleotide
taatacgactcactatagggctggcagggtgcccgtagatgaggtaccacaacagaggagagtggtaatgcatctacggaacctggcggcagcgcaaaagatg

SEQ ID NO: 129073 - DNA, 103 bp, Artificial Sequence
  Synthetic Polynucleotide
taatacgactcactatagggcacggtgttgctggcagggtgcccgtagataacagaggagaatctacatgcaccctgccaacctggcggcagcgcaaaagatg

SEQ ID NO: 129074 - DNA, 103 bp, Artificial Sequence
  Synthetic Polynucleotide
taatacgactcactatagggttggcttctccacggtgttgctggcagggtaacagaggagaaccctgatggcaacaccgaacctggcggcagcgcaaaagatg

SEQ ID NO: 129075 - DNA, 103 bp, Artificial Sequence
  Synthetic Polynucleotide
taatacgactcactatagggctgatgaagcttggcttctccacggtgttgaacagaggagacaacacatgggagaagccaacctggcggcagcgcaaaagatg

SEQ ID NO: 129076 - DNA, 103 bp, Artificial Sequence
  Synthetic Polynucleotide
taatacgactcactatagggtctccgttcactgatgaagcttggcttctcaacagaggagagagaagatgagcttcatcaacctggcggcagcgcaaaagatg

SEQ ID NO: 129077 - DNA, 103 bp, Artificial Sequence
  Synthetic Polynucleotide
taatacgactcactataggggctttatcgttctccgttcactgatgaagcaacagaggagagcttcaatggtgaacggaaacctggcggcagcgcaaaagatg

SEQ ID NO: 129078 - DNA, 103 bp, Artificial Sequence
  Synthetic Polynucleotide
taatacgactcactatagggcctgactcctgctttatcgttctccgttcaaacagaggagatgaacgatgaacgataaaaacctggcggcagcgcaaaagatg

SEQ ID NO: 129079 - DNA, 103 bp, Artificial Sequence
  Synthetic Polynucleotide
taatacgactcactataggggtccctcctagactccaaaattccagtttcaacagaggagagaaactatgattttggagaacctggcggcagcgcaaaagatg

SEQ ID NO: 129080 - DNA, 103 bp, Artificial Sequence
  Synthetic Polynucleotide
taatacgactcactataggggcctgccctgcctgactcctgctttatcgtaacagaggagaacgataatgcaggagtcaaacctggcggcagcgcaaaagatg

SEQ ID NO: 129081 - DNA, 103 bp, Artificial Sequence
  Synthetic Polynucleotide
taatacgactcactatagggacggccggacgcctgccctgcctgactcctaacagaggagaaggagtatggcagggcagaacctggcggcagcgcaaaagatg

SEQ ID NO: 129082 - DNA, 103 bp, Artificial Sequence
  Synthetic Polynucleotide
taatacgactcactatagggccagaggaggacggccggacgcctgccctgaacagaggagacagggcatgcgtccggccaacctggcggcagcgcaaaagatg

SEQ ID NO: 129083 - DNA, 103 bp, Artificial Sequence
  Synthetic Polynucleotide
taatacgactcactatagggccaggcacttccagaggaggacggccggacaacagaggagagtccggatgtcctcctctaacctggcggcagcgcaaaagatg

SEQ ID NO: 129084 - DNA, 103 bp, Artificial Sequence
  Synthetic Polynucleotide
taatacgactcactatagggagcaggcctcccaggcacttccagaggaggaacagaggagacctcctatggaagtgcctaacctggcggcagcgcaaaagatg

SEQ ID NO: 129085 - DNA, 103 bp, Artificial Sequence
  Synthetic Polynucleotide
taatacgactcactatagggggggcttcagagcaggcctcccaggcacttaacagaggagaaagtgcatgggaggcctgaacctggcggcagcgcaaaagatg

SEQ ID NO: 129086 - DNA, 103 bp, Artificial Sequence
  Synthetic Polynucleotide
taatacgactcactataggggcctttagatggggcttcagagcaggcctcaacagaggagagaggccatgtctgaagccaacctggcggcagcgcaaaagatg

SEQ ID NO: 129087 - DNA, 103 bp, Artificial Sequence
  Synthetic Polynucleotide
taatacgactcactatagggcatcttggctgcctttagatggggcttcagaacagaggagactgaagatgcatctaaagaacctggcggcagcgcaaaagatg

SEQ ID NO: 129088 - DNA, 103 bp, Artificial Sequence
  Synthetic Polynucleotide
taatacgactcactatagggcaggtgacaccatcttggctgcctttagataacagaggagaatctaaatgcagccaagaaacctggcggcagcgcaaaagatg

SEQ ID NO: 129089 - DNA, 103 bp, Artificial Sequence
  Synthetic Polynucleotide
taatacgactcactatagggttcagcctcccaggtgacaccatcttggctaacagaggagaagccaaatgggtgtcaccaacctggcggcagcgcaaaagatg

SEQ ID NO: 129090 - DNA, 103 bp, Artificial Sequence
  Synthetic Polynucleotide
taatacgactcactatagggaagccaccgggtccctcctagactccaaaaaacagaggagattttggatgctaggagggaacctggcggcagcgcaaaagatg

SEQ ID NO: 129091 - DNA, 103 bp, Artificial Sequence
  Synthetic Polynucleotide
taatacgactcactatagggcaagctccacttcagcctcccaggtgacacaacagaggagagtgtcaatggggaggctgaacctggcggcagcgcaaaagatg

SEQ ID NO: 129092 - DNA, 103 bp, Artificial Sequence
  Synthetic Polynucleotide
taatacgactcactataggggtctccgtggcaagctccacttcagcctccaacagaggagaggaggcatgagtggagctaacctggcggcagcgcaaaagatg

SEQ ID NO: 129093 - DNA, 103 bp, Artificial Sequence
  Synthetic Polynucleotide
taatacgactcactataggggacatacactgtctccgtggcaagctccacaacagaggagagtggagatggccacggagaacctggcggcagcgcaaaagatg

SEQ ID NO: 129094 - DNA, 103 bp, Artificial Sequence
  Synthetic Polynucleotide
taatacgactcactatagggaggcatcgtcgacatacactgtctccgtggaacagaggagaccacggatgcagtgtatgaacctggcggcagcgcaaaagatg

SEQ ID NO: 129095 - DNA, 103 bp, Artificial Sequence
  Synthetic Polynucleotide
taatacgactcactatagggcgcatccacgaggcatcgtcgacatacactaacagaggagaagtgtaatgcgacgatgcaacctggcggcagcgcaaaagatg

SEQ ID NO: 129096 - DNA, 103 bp, Artificial Sequence
  Synthetic Polynucleotide
taatacgactcactatagggggggatgtagcgcatccacgaggcatcgtcaacagaggagagacgatatgtcgtggatgaacctggcggcagcgcaaaagatg

SEQ ID NO: 129097 - DNA, 103 bp, Artificial Sequence
  Synthetic Polynucleotide
taatacgactcactatagggctgggattggggggatgtagcgcatccacgaacagaggagacgtggaatggctacatccaacctggcggcagcgcaaaagatg

SEQ ID NO: 129098 - DNA, 103 bp, Artificial Sequence
  Synthetic Polynucleotide
taatacgactcactatagggtccctgtggactgggattggggggatgtagaacagaggagactacatatgcccaatcccaacctggcggcagcgcaaaagatg

SEQ ID NO: 129099 - DNA, 103 bp, Artificial Sequence
  Synthetic Polynucleotide
taatacgactcactatagggaaagccgaagtccctgtggactgggattggaacagaggagaccaatcatggtccacaggaacctggcggcagcgcaaaagatg

SEQ ID NO: 129100 - DNA, 103 bp, Artificial Sequence
  Synthetic Polynucleotide
taatacgactcactataggggagcccagccaaagccgaagtccctgtggaaacagaggagatccacaatgacttcggctaacctggcggcagcgcaaaagatg

SEQ ID NO: 129101 - DNA, 103 bp, Artificial Sequence
  Synthetic Polynucleotide
taatacgactcactatagggacatcctccaaagccaccgggtccctcctaaacagaggagataggagatgcccggtggcaacctggcggcagcgcaaaagatg

SEQ ID NO: 129102 - DNA, 103 bp, Artificial Sequence
  Synthetic Polynucleotide
taatacgactcactatagggtcgctgacgagagcccagccaaagccgaagaacagaggagacttcggatgtggctgggcaacctggcggcagcgcaaaagatg

SEQ ID NO: 129103 - DNA, 103 bp, Artificial Sequence
  Synthetic Polynucleotide
taatacgactcactataggggaggaggatgtcgctgacgagagcccagccaacagaggagaggctggatgctcgtcagcaacctggcggcagcgcaaaagatg

SEQ ID NO: 129104 - DNA, 103 bp, Artificial Sequence
  Synthetic Polynucleotide
taatacgactcactatagggggggaaggcagaggaggatgtcgctgacgaaacagaggagatcgtcaatgacatcctccaacctggcggcagcgcaaaagatg

SEQ ID NO: 129105 - DNA, 103 bp, Artificial Sequence
  Synthetic Polynucleotide
taatacgactcactatagggaagatggagaggggaaggcagaggaggatgaacagaggagacatcctatgctgccttccaacctggcggcagcgcaaaagatg

SEQ ID NO: 129106 - DNA, 103 bp, Artificial Sequence
  Synthetic Polynucleotide
taatacgactcactatagggaatctggatgaagatggagaggggaaggcaaacagaggagatgccttatgctctccatcaacctggcggcagcgcaaaagatg

SEQ ID NO: 129107 - DNA, 103 bp, Artificial Sequence
  Synthetic Polynucleotide
taatacgactcactatagggtgacttgcacaatctggatgaagatggagaaacagaggagatctccaatgtcatccagaaacctggcggcagcgcaaaagatg

SEQ ID NO: 129108 - DNA, 103 bp, Artificial Sequence
  Synthetic Polynucleotide
taatacgactcactatagggaccttgtagctgacttgcacaatctggatgaacagaggagacatccaatgtgtgcaagtaacctggcggcagcgcaaaagatg

SEQ ID NO: 129109 - DNA, 103 bp, Artificial Sequence
  Synthetic Polynucleotide
taatacgactcactatagggcaggttgtccaccttgtagctgacttgcacaacagaggagagtgcaaatgagctacaagaacctggcggcagcgcaaaagatg

SEQ ID NO: 129110 - DNA, 103 bp, Artificial Sequence
  Synthetic Polynucleotide
taatacgactcactataggggaaattcctccaggttgtccaccttgtagcaacagaggagagctacaatgtggacaaccaacctggcggcagcgcaaaagatg

SEQ ID NO: 129111 - DNA, 103 bp, Artificial Sequence
  Synthetic Polynucleotide
taatacgactcactataggggggtcgttcagaaattcctccaggttgtccaacagaggagaggacaaatgggaggaattaacctggcggcagcgcaaaagatg

SEQ ID NO: 129112 - DNA, 103 bp, Artificial Sequence
  Synthetic Polynucleotide
taatacgactcactatagggaatggggtagacatcctccaaagccaccggaacagaggagaccggtgatgttggaggataacctggcggcagcgcaaaagatg

SEQ ID NO: 129113 - DNA, 103 bp, Artificial Sequence
  Synthetic Polynucleotide
taatacgactcactatagggcttcttcagcgggtcgttcagaaattcctcaacagaggagagaggaaatgctgaacgacaacctggcggcagcgcaaaagatg

SEQ ID NO: 129114 - DNA, 103 bp, Artificial Sequence
  Synthetic Polynucleotide
taatacgactcactatagggtcagcgtgtgcttcttcagcgggtcgttcaaacagaggagatgaacgatgcgctgaagaaacctggcggcagcgcaaaagatg

SEQ ID NO: 129115 - DNA, 103 bp, Artificial Sequence
  Synthetic Polynucleotide
taatacgactcactatagggagaaagcggatcagcgtgtgcttcttcagcaacagaggagagctgaaatggcacacgctaacctggcggcagcgcaaaagatg

SEQ ID NO: 129116 - DNA, 103 bp, Artificial Sequence
  Synthetic Polynucleotide
taatacgactcactataggggggcctggggagaaagcggatcagcgtgtgaacagaggagacacacgatgatccgctttaacctggcggcagcgcaaaagatg

SEQ ID NO: 129117 - DNA, 103 bp, Artificial Sequence
  Synthetic Polynucleotide
taatacgactcactataggggctgccgaatgggcctggggagaaagcggaaacagaggagatccgctatgtccccaggcaacctggcggcagcgcaaaagatg

SEQ ID NO: 129118 - DNA, 103 bp, Artificial Sequence
  Synthetic Polynucleotide
taatacgactcactatagggtacagaagctgctgccgaatgggcctggggaacagaggagaccccagatgcattcggcaaacctggcggcagcgcaaaagatg

SEQ ID NO: 129119 - DNA, 103 bp, Artificial Sequence
  Synthetic Polynucleotide
taatacgactcactatagggacgcctcttgtacagaagctgctgccgaataacagaggagaattcggatgcagcttctgaacctggcggcagcgcaaaagatg

SEQ ID NO: 129120 - DNA, 103 bp, Artificial Sequence
  Synthetic Polynucleotide
taatacgactcactatagggaaaaaatgtaacgcctcttgtacagaagctaacagaggagaagcttcatgacaagaggcaacctggcggcagcgcaaaagatg

SEQ ID NO: 129121 - DNA, 103 bp, Artificial Sequence
  Synthetic Polynucleotide
taatacgactcactatagggtccaccaccgaaaaaatgtaacgcctcttgaacagaggagacaagagatgttacattttaacctggcggcagcgcaaaagatg

SEQ ID NO: 129122 - DNA, 103 bp, Artificial Sequence
  Synthetic Polynucleotide
taatacgactcactatagggctgaaggttctccaccaccgaaaaaatgtaaacagaggagatacattatgtcggtggtgaacctggcggcagcgcaaaagatg

SEQ ID NO: 129123 - DNA, 103 bp, Artificial Sequence
  Synthetic Polynucleotide
taatacgactcactatagggagatcatatgaatggggtagacatcctccaaacagaggagatggaggatgtctaccccaaacctggcggcagcgcaaaagatg

SEQ ID NO: 129124 - DNA, 103 bp, Artificial Sequence
  Synthetic Polynucleotide
taatacgactcactatagggagcacagcctctgaaggttctccaccaccgaacagaggagacggtggatgagaaccttcaacctggcggcagcgcaaaagatg

SEQ ID NO: 129125 - DNA, 103 bp, Artificial Sequence
  Synthetic Polynucleotide
taatacgactcactatagggagccccatgtagcacagcctctgaaggttcaacagaggagagaacctatggaggctgtgaacctggcggcagcgcaaaagatg

SEQ ID NO: 129126 - DNA, 103 bp, Artificial Sequence
  Synthetic Polynucleotide
taatacgactcactatagggaaactgtagcagccccatgtagcacagcctaacagaggagaaggctgatgtacatggggaacctggcggcagcgcaaaagatg

SEQ ID NO: 129127 - DNA, 103 bp, Artificial Sequence
  Synthetic Polynucleotide
taatacgactcactatagggccgtgggaccaaactgtagcagccccatgtaacagaggagaacatggatgtgctacagtaacctggcggcagcgcaaaagatg

SEQ ID NO: 129128 - DNA, 103 bp, Artificial Sequence
  Synthetic Polynucleotide
taatacgactcactatagggtgaaacttttccgtgggaccaaactgtagcaacagaggagagctacaatgtggtcccacaacctggcggcagcgcaaaagatg

SEQ ID NO: 129129 - DNA, 103 bp, Artificial Sequence
  Synthetic Polynucleotide
taatacgactcactatagggatctttatcctgaaacttttccgtgggaccaacagaggagaggtcccatggaaaagtttaacctggcggcagcgcaaaagatg

SEQ ID NO: 129130 - DNA, 103 bp, Artificial Sequence
  Synthetic Polynucleotide
taatacgactcactatagggtaaagacctgatctttatcctgaaacttttaacagaggagaaaaagtatgaggataaagaacctggcggcagcgcaaaagatg

SEQ ID NO: 129131 - DNA, 103 bp, Artificial Sequence
  Synthetic Polynucleotide
taatacgactcactatagggttcaagaagataaagacctgatctttatccaacagaggagaggataaatgtcaggtcttaacctggcggcagcgcaaaagatg

SEQ ID NO: 129132 - DNA, 103 bp, Artificial Sequence
  Synthetic Polynucleotide
taatacgactcactatagggtgcattcttcttcaagaagataaagacctgaacagaggagacaggtcatgatcttcttgaacctggcggcagcgcaaaagatg

SEQ ID NO: 129133 - DNA, 103 bp, Artificial Sequence
  Synthetic Polynucleotide
taatacgactcactatagggcaacaatgactgcattcttcttcaagaagaaacagaggagatcttctatgagaagaatgaacctggcggcagcgcaaaagatg

SEQ ID NO: 129134 - DNA, 103 bp, Artificial Sequence
  Synthetic Polynucleotide
taatacgactcactatagggtcgagcccctccagagcgacttcgtccaacaacagaggagagttggaatgagtcgctctaacctggcggcagcgcaaaagatg

SEQ ID NO: 129135 - DNA, 103 bp, Artificial Sequence
  Synthetic Polynucleotide
taatacgactcactatagggttattctctaagatcatatgaatggggtagaacagaggagactacccatgtcatatgataacctggcggcagcgcaaaagatg

SEQ ID NO: 129136 - DNA, 103 bp, Artificial Sequence
  Synthetic Polynucleotide
taatacgactcactatagggatggtagtgtcaacaatgactgcattcttcaacagaggagagaagaaatgagtcattgtaacctggcggcagcgcaaaagatg

SEQ ID NO: 129137 - DNA, 103 bp, Artificial Sequence
  Synthetic Polynucleotide
taatacgactcactatagggtgggtcgcagatggtagtgtcaacaatgacaacagaggagagtcattatggacactaccaacctggcggcagcgcaaaagatg

SEQ ID NO: 129138 - DNA, 103 bp, Artificial Sequence
  Synthetic Polynucleotide
taatacgactcactatagggggttgtaatgtgggtcgcagatggtagtgtaacagaggagaacactaatgtctgcgaccaacctggcggcagcgcaaaagatg

SEQ ID NO: 129139 - DNA, 103 bp, Artificial Sequence
  Synthetic Polynucleotide
taatacgactcactatagggctgcgggccaggttgtaatgtgggtcgcagaacagaggagactgcgaatgacattacaaaacctggcggcagcgcaaaagatg

SEQ ID NO: 129140 - DNA, 103 bp, Artificial Sequence
  Synthetic Polynucleotide
taatacgactcactataggggggccggctgctgcgggccaggttgtaatgaacagaggagacattacatgctggcccgcaacctggcggcagcgcaaaagatg

SEQ ID NO: 129141 - DNA, 103 bp, Artificial Sequence
  Synthetic Polynucleotide
taatacgactcactataggggcctctcgaagggccggctgctgcgggccaaacagaggagatggcccatggcagccggcaacctggcggcagcgcaaaagatg

SEQ ID NO: 129142 - DNA, 103 bp, Artificial Sequence
  Synthetic Polynucleotide
taatacgactcactatagggacatagaggcgcctctcgaagggccggctgaacagaggagacagccgatgcttcgagagaacctggcggcagcgcaaaagatg

SEQ ID NO: 129143 - DNA, 103 bp, Artificial Sequence
  Synthetic Polynucleotide
taatacgactcactatagggtgagttcaggacatagaggcgcctctcgaaaacagaggagattcgagatgcgcctctataacctggcggcagcgcaaaagatg

SEQ ID NO: 129144 - DNA, 103 bp, Artificial Sequence
  Synthetic Polynucleotide
taatacgactcactatagggcatcctgcattgagttcaggacatagaggcaacagaggagagcctctatgtcctgaactaacctggcggcagcgcaaaagatg

SEQ ID NO: 129145 - DNA, 103 bp, Artificial Sequence
  Synthetic Polynucleotide
taatacgactcactatagggtagttttccacatcctgcattgagttcaggaacagaggagacctgaaatgaatgcaggaaacctggcggcagcgcaaaagatg

SEQ ID NO: 129146 - DNA, 103 bp, Artificial Sequence
  Synthetic Polynucleotide
taatacgactcactataggggatgccatccttattctctaagatcatatgaacagaggagacatatgatgttagagaataacctggcggcagcgcaaaagatg

SEQ ID NO: 129147 - DNA, 103 bp, Artificial Sequence
  Synthetic Polynucleotide
taatacgactcactataggggtcaaaccagtagttttccacatcctgcataacagaggagaatgcagatggtggaaaacaacctggcggcagcgcaaaagatg

SEQ ID NO: 129148 - DNA, 103 bp, Artificial Sequence
  Synthetic Polynucleotide
taatacgactcactatagggcgcactgcaggtcaaaccagtagttttccaaacagaggagatggaaaatgactggtttgaacctggcggcagcgcaaaagatg

SEQ ID NO: 129149 - DNA, 103 bp, Artificial Sequence
  Synthetic Polynucleotide
taatacgactcactatagggttgaggcagacgcactgcaggtcaaaccagaacagaggagactggttatgcctgcagtgaacctggcggcagcgcaaaagatg

SEQ ID NO: 129150 - DNA, 103 bp, Artificial Sequence
  Synthetic Polynucleotide
taatacgactcactatagggtagtggggtgttgaggcagacgcactgcagaacagaggagactgcagatggtctgcctcaacctggcggcagcgcaaaagatg

SEQ ID NO: 129151 - DNA, 103 bp, Artificial Sequence
  Synthetic Polynucleotide
taatacgactcactataggggcaccacgcctagtggggtgttgaggcagaaacagaggagatctgccatgacaccccacaacctggcggcagcgcaaaagatg

SEQ ID NO: 129152 - DNA, 103 bp, Artificial Sequence
  Synthetic Polynucleotide
taatacgactcactatagggcgcgggcagcgcaccacgcctagtggggtgaacagaggagacaccccatgaggcgtggtaacctggcggcagcgcaaaagatg

SEQ ID NO: 129153 - DNA, 103 bp, Artificial Sequence
  Synthetic Polynucleotide
taatacgactcactatagggcttcctgacgcgcgggcagcgcaccacgccaacagaggagaggcgtgatgcgctgcccgaacctggcggcagcgcaaaagatg

SEQ ID NO: 129154 - DNA, 103 bp, Artificial Sequence
  Synthetic Polynucleotide
taatacgactcactatagggtgctgctgttcttcctgacgcgcgggcagcaacagaggagagctgccatggcgtcaggaaacctggcggcagcgcaaaagatg

SEQ ID NO: 129155 - DNA, 103 bp, Artificial Sequence
  Synthetic Polynucleotide
taatacgactcactatagggccctggtctgtgctgctgttcttcctgacgaacagaggagacgtcagatggaacagcagaacctggcggcagcgcaaaagatg

SEQ ID NO: 129156 - DNA, 103 bp, Artificial Sequence
  Synthetic Polynucleotide
taatacgactcactatagggctcgtcgctgccctggtctgtgctgctgttaacagaggagaaacagcatgacagaccagaacctggcggcagcgcaaaagatg

SEQ ID NO: 129157 - DNA, 103 bp, Artificial Sequence
  Synthetic Polynucleotide
taatacgactcactatagggatgagccctggatgccatccttattctctaaacagaggagatagagaatgaggatggcaaacctggcggcagcgcaaaagatg

SEQ ID NO: 129158 - DNA, 103 bp, Artificial Sequence
  Synthetic Polynucleotide
taatacgactcactatagggggctgccctcctcgtcgctgccctggtctgaacagaggagacagaccatggcagcgacgaacctggcggcagcgcaaaagatg

SEQ ID NO: 129159 - DNA, 103 bp, Artificial Sequence
  Synthetic Polynucleotide
taatacgactcactatagggtccttctgcaggctgccctcctcgtcgctgaacagaggagacagcgaatgggagggcagaacctggcggcagcgcaaaagatg

SEQ ID NO: 129160 - DNA, 103 bp, Artificial Sequence
  Synthetic Polynucleotide
taatacgactcactataggggctctcctgctccttctgcaggctgccctcaacagaggagagagggcatgctgcagaagaacctggcggcagcgcaaaagatg

SEQ ID NO: 129161 - DNA, 103 bp, Artificial Sequence
  Synthetic Polynucleotide
taatacgactcactatagggtgtccatggcgctctcctgctccttctgcaaacagaggagatgcagaatgagcaggagaaacctggcggcagcgcaaaagatg

SEQ ID NO: 129162 - DNA, 103 bp, Artificial Sequence
  Synthetic Polynucleotide
taatacgactcactatagggaggttgtgcttgtccatggcgctctcctgcaacagaggagagcaggaatgcgccatggaaacctggcggcagcgcaaaagatg

SEQ ID NO: 129163 - DNA, 103 bp, Artificial Sequence
  Synthetic Polynucleotide
taatacgactcactatagggcttgcgctccaggttgtgcttgtccatggcaacagaggagagccatgatgaagcacaacaacctggcggcagcgcaaaagatg

SEQ ID NO: 129164 - DNA, 103 bp, Artificial Sequence
  Synthetic Polynucleotide
taatacgactcactataggggcatggcgcacttgcgctccaggttgtgctaacagaggagaagcacaatgtggagcgcaaacctggcggcagcgcaaaagatg

SEQ ID NO: 129165 - DNA, 103 bp, Artificial Sequence
  Synthetic Polynucleotide
taatacgactcactataggggtgtactccagcatggcgcacttgcgctccaacagaggagaggagcgatggtgcgccataacctggcggcagcgcaaaagatg

SEQ ID NO: 129166 - DNA, 103 bp, Artificial Sequence
  Synthetic Polynucleotide
taatacgactcactataggggcttccagtggtgtactccagcatggcgcaaacagaggagatgcgccatgctggagtacaacctggcggcagcgcaaaagatg

SEQ ID NO: 129167 - DNA, 103 bp, Artificial Sequence
  Synthetic Polynucleotide
taatacgactcactatagggccacctcacggcttccagtggtgtactccaaacagaggagatggagtatgccactggaaaacctggcggcagcgcaaaagatg

SEQ ID NO: 129168 - DNA, 103 bp, Artificial Sequence
  Synthetic Polynucleotide
taatacgactcactatagggaagtagcggcatgagccctggatgccatccaacagaggagaggatggatgccagggctcaacctggcggcagcgcaaaagatg

SEQ ID NO: 129169 - DNA, 103 bp, Artificial Sequence
  Synthetic Polynucleotide
taatacgactcactatagggccttcatccaccacctcacggcttccagtgaacagaggagacactggatgccgtgaggtaacctggcggcagcgcaaaagatg

SEQ ID NO: 129170 - DNA, 103 bp, Artificial Sequence
  Synthetic Polynucleotide
taatacgactcactatagggagggatcaagccttcatccaccacctcacgaacagaggagacgtgagatggtggatgaaaacctggcggcagcgcaaaagatg

SEQ ID NO: 129171 - DNA, 103 bp, Artificial Sequence
  Synthetic Polynucleotide
taatacgactcactataggggcccatctccagggatcaagccttcatccaaacagaggagatggatgatggcttgatccaacctggcggcagcgcaaaagatg

SEQ ID NO: 129172 - DNA, 103 bp, Artificial Sequence
  Synthetic Polynucleotide
taatacgactcactataggggcggcacccagcccatctccagggatcaagaacagaggagacttgatatgtggagatggaacctggcggcagcgcaaaagatg

SEQ ID NO: 129173 - DNA, 103 bp, Artificial Sequence
  Synthetic Polynucleotide
taatacgactcactatagggatcgagccctgcggcacccagcccatctccaacagaggagaggagatatgctgggtgccaacctggcggcagcgcaaaagatg

SEQ ID NO: 129174 - DNA, 103 bp, Artificial Sequence
  Synthetic Polynucleotide
taatacgactcactatagggagaagctggaatcgagccctgcggcacccaaacagaggagatgggtgatgcagggctcgaacctggcggcagcgcaaaagatg

SEQ ID NO: 129175 - DNA, 103 bp, Artificial Sequence
  Synthetic Polynucleotide
taatacgactcactatagggaggtgtccgtagaagctggaatcgagccctaacagaggagaagggctatgttccagcttaacctggcggcagcgcaaaagatg

SEQ ID NO: 129176 - DNA, 103 bp, Artificial Sequence
  Synthetic Polynucleotide
taatacgactcactataggggttgcgcttgaggtgtccgtagaagctggaaacagaggagatccagcatgtacggacacaacctggcggcagcgcaaaagatg

SEQ ID NO: 129177 - DNA, 103 bp, Artificial Sequence
  Synthetic Polynucleotide
taatacgactcactatagggtccagatccagttgcgcttgaggtgtccgtaacagaggagaacggacatgtcaagcgcaaacctggcggcagcgcaaaagatg

SEQ ID NO: 129178 - DNA, 103 bp, Artificial Sequence
  Synthetic Polynucleotide
taatacgactcactatagggatgtagctggtccagatccagttgcgcttgaacagaggagacaagcgatgctggatctgaacctggcggcagcgcaaaagatg

SEQ ID NO: 129179 - DNA, 103 bp, Artificial Sequence
  Synthetic Polynucleotide
taatacgactcactatagggcctctccttaaagtagcggcatgagccctgaacagaggagacagggcatgtgccgctacaacctggcggcagcgcaaaagatg

SEQ ID NO: 129180 - DNA, 103 bp, Artificial Sequence
  Synthetic Polynucleotide
taatacgactcactatagggctggttgatgatgtagctggtccagatccaaacagaggagatggatcatgaccagctacaacctggcggcagcgcaaaagatg

SEQ ID NO: 129181 - DNA, 103 bp, Artificial Sequence
  Synthetic Polynucleotide
taatacgactcactatagggcctttttggcctggttgatgatgtagctggaacagaggagaccagctatgtcatcaaccaacctggcggcagcgcaaaagatg

SEQ ID NO: 129182 - DNA, 103 bp, Artificial Sequence
  Synthetic Polynucleotide
taatacgactcactataggggcagtgttctcctttttggcctggttgatgaacagaggagacatcaaatgggccaaaaaaacctggcggcagcgcaaaagatg

SEQ ID NO: 129183 - DNA, 103 bp, Artificial Sequence
  Synthetic Polynucleotide
taatacgactcactatagggattctctgcggcagtgttctcctttttggcaacagaggagagccaaaatggagaacactaacctggcggcagcgcaaaagatg

SEQ ID NO: 129184 - DNA, 103 bp, Artificial Sequence
  Synthetic Polynucleotide
taatacgactcactatagggctgtgagtccattctctgcggcagtgttctaacagaggagaagaacaatgccgcagagaaacctggcggcagcgcaaaagatg

SEQ ID NO: 129185 - DNA, 103 bp, Artificial Sequence
  Synthetic Polynucleotide
taatacgactcactatagggtggagcctcactgtgagtccattctctgcgaacagaggagacgcagaatgtggactcacaacctggcggcagcgcaaaagatg

SEQ ID NO: 129186 - DNA, 103 bp, Artificial Sequence
  Synthetic Polynucleotide
taatacgactcactatagggcagaaatgtctggagcctcactgtgagtccaacagaggagaggactcatggtgaggctcaacctggcggcagcgcaaaagatg

SEQ ID NO: 129187 - DNA, 103 bp, Artificial Sequence
  Synthetic Polynucleotide
taatacgactcactatagggggcgcttggacagaaatgtctggagcctcaaacagaggagatgaggcatgagacatttcaacctggcggcagcgcaaaagatg

SEQ ID NO: 129188 - DNA, 103 bp, Artificial Sequence
  Synthetic Polynucleotide
taatacgactcactatagggaggggcattgggcgcttggacagaaatgtcaacagaggagagacattatggtccaagcgaacctggcggcagcgcaaaagatg

SEQ ID NO: 129189 - DNA, 103 bp, Artificial Sequence
  Synthetic Polynucleotide
taatacgactcactatagggtctggcactgaggggcattgggcgcttggaaacagaggagatccaagatgccaatgcccaacctggcggcagcgcaaaagatg

SEQ ID NO: 129190 - DNA, 103 bp, Artificial Sequence
  Synthetic Polynucleotide
taatacgactcactatagggtaatgtttttcctctccttaaagtagcggcaacagaggagagccgctatgttaaggagaaacctggcggcagcgcaaaagatg

SEQ ID NO: 129191 - DNA, 103 bp, Artificial Sequence
  Synthetic Polynucleotide
taatacgactcactatagggtgctgttgcctctggcactgaggggcattgaacagaggagacaatgcatgtcagtgccaaacctggcggcagcgcaaaagatg

SEQ ID NO: 129192 - DNA, 103 bp, Artificial Sequence
  Synthetic Polynucleotide
taatacgactcactatagggatattcaacctgctgttgcctctggcactgaacagaggagacagtgcatgaggcaacagaacctggcggcagcgcaaaagatg

SEQ ID NO: 129193 - DNA, 103 bp, Artificial Sequence
  Synthetic Polynucleotide
taatacgactcactatagggttccccccaaatattcaacctgctgttgccaacagaggagaggcaacatgaggttgaataacctggcggcagcgcaaaagatg

SEQ ID NO: 129194 - DNA, 103 bp, Artificial Sequence
  Synthetic Polynucleotide
taatacgactcactatagggctactcttgcttccccccaaatattcaaccaacagaggagaggttgaatgtttggggggaacctggcggcagcgcaaaagatg

SEQ ID NO: 129195 - DNA, 103 bp, Artificial Sequence
  Synthetic Polynucleotide
taatacgactcactatagggagctcggagcctactcttgcttccccccaaaacagaggagattggggatgagcaagagtaacctggcggcagcgcaaaagatg

SEQ ID NO: 129196 - DNA, 103 bp, Artificial Sequence
  Synthetic Polynucleotide
taatacgactcactataggggccagcacagagctcggagcctactcttgcaacagaggagagcaagaatgggctccgagaacctggcggcagcgcaaaagatg

SEQ ID NO: 129197 - DNA, 103 bp, Artificial Sequence
  Synthetic Polynucleotide
taatacgactcactataggggctcttcccagccagcacagagctcggagcaacagaggagagctccgatgtctgtgctgaacctggcggcagcgcaaaagatg

SEQ ID NO: 129198 - DNA, 103 bp, Artificial Sequence
  Synthetic Polynucleotide
taatacgactcactatagggacctcaaactgctcttcccagccagcacagaacagaggagactgtgcatgctgggaagaaacctggcggcagcgcaaaagatg

SEQ ID NO: 129199 - DNA, 103 bp, Artificial Sequence
  Synthetic Polynucleotide
taatacgactcactatagggctctcggtccacctcaaactgctcttcccaaacagaggagatgggaaatgcagtttgagaacctggcggcagcgcaaaagatg

SEQ ID NO: 129200 - DNA, 103 bp, Artificial Sequence
  Synthetic Polynucleotide
taatacgactcactatagggccagcgagggctctcggtccacctcaaactaacagaggagaagtttgatgtggaccgagaacctggcggcagcgcaaaagatg

SEQ ID NO: 129201 - DNA, 103 bp, Artificial Sequence
  Synthetic Polynucleotide
taatacgactcactatagggatgtcattggtaatgtttttcctctccttaaacagaggagataaggaatggaaaaacataacctggcggcagcgcaaaagatg

SEQ ID NO: 129202 - DNA, 103 bp, Artificial Sequence
  Synthetic Polynucleotide
taatacgactcactatagggcggtttcggtccagcgagggctctcggtccaacagaggagaggaccgatggccctcgctaacctggcggcagcgcaaaagatg

SEQ ID NO: 129203 - DNA, 103 bp, Artificial Sequence
  Synthetic Polynucleotide
taatacgactcactatagggcctcactctccggtttcggtccagcgagggaacagaggagaccctcgatggaccgaaacaacctggcggcagcgcaaaagatg

SEQ ID NO: 129204 - DNA, 103 bp, Artificial Sequence
  Synthetic Polynucleotide
taatacgactcactatagggttttcccacccctcactctccggtttcggtaacagaggagaaccgaaatgggagagtgaaacctggcggcagcgcaaaagatg

SEQ ID NO: 129205 - DNA, 103 bp, Artificial Sequence
  Synthetic Polynucleotide
taatacgactcactatagggcgcttctggcttttcccacccctcactctcaacagaggagagagagtatggggtgggaaaacctggcggcagcgcaaaagatg

SEQ ID NO: 129206 - DNA, 103 bp, Artificial Sequence
  Synthetic Polynucleotide
taatacgactcactatagggcagccgcttccgcttctggcttttcccaccaacagaggagaggtgggatgagccagaagaacctggcggcagcgcaaaagatg

SEQ ID NO: 129207 - DNA, 103 bp, Artificial Sequence
  Synthetic Polynucleotide
taatacgactcactatagggggtccttcttcagccgcttccgcttctggcaacagaggagagccagaatgggaagcggcaacctggcggcagcgcaaaagatg

SEQ ID NO: 129208 - DNA, 103 bp, Artificial Sequence
  Synthetic Polynucleotide
taatacgactcactatagggttcttcccagggtccttcttcagccgcttcaacagaggagagaagcgatggaagaaggaaacctggcggcagcgcaaaagatg

SEQ ID NO: 129209 - DNA, 103 bp, Artificial Sequence
  Synthetic Polynucleotide
taatacgactcactatagggtctcttgatcttcttcccagggtccttcttaacagaggagaaagaagatgcctgggaagaacctggcggcagcgcaaaagatg

SEQ ID NO: 129210 - DNA, 103 bp, Artificial Sequence
  Synthetic Polynucleotide
taatacgactcactatagggctttcttctttctcttgatcttcttcccagaacagaggagactgggaatgagatcaagaaacctggcggcagcgcaaaagatg

SEQ ID NO: 129211 - DNA, 103 bp, Artificial Sequence
  Synthetic Polynucleotide
taatacgactcactataggggggaactctcctttcttctttctcttgatcaacagaggagagatcaaatgaaagaagaaaacctggcggcagcgcaaaagatg

SEQ ID NO: 129212 - DNA, 103 bp, Artificial Sequence
  Synthetic Polynucleotide
taatacgactcactatagggcttggttctgatgtcattggtaatgtttttaacagaggagaaaaaacatgaccaatgacaacctggcggcagcgcaaaagatg

SEQ ID NO: 129213 - DNA, 103 bp, Artificial Sequence
  Synthetic Polynucleotide
taatacgactcactatagggtttttctcctgggaactctcctttcttcttaacagaggagaaagaagatgggagagttcaacctggcggcagcgcaaaagatg

SEQ ID NO: 129214 - DNA, 103 bp, Artificial Sequence
  Synthetic Polynucleotide
taatacgactcactataggggccttttgcttttttctcctgggaactctcaacagaggagagagagtatgcaggagaaaaacctggcggcagcgcaaaagatg

SEQ ID NO: 129215 - DNA, 103 bp, Artificial Sequence
  Synthetic Polynucleotide
taatacgactcactatagggtggtagcgcagccttttgcttttttctcctaacagaggagaaggagaatgaagcaaaagaacctggcggcagcgcaaaagatg

SEQ ID NO: 129216 - DNA, 103 bp, Artificial Sequence
  Synthetic Polynucleotide
taatacgactcactatagggggcttcatcatggtagcgcagccttttgctaacagaggagaagcaaaatgctgcgctacaacctggcggcagcgcaaaagatg

SEQ ID NO: 129217 - DNA, 103 bp, Artificial Sequence
  Synthetic Polynucleotide
taatacgactcactatagggcactctggtcggcttcatcatggtagcgcaaacagaggagatgcgctatgatgatgaagaacctggcggcagcgcaaaagatg

SEQ ID NO: 129218 - DNA, 103 bp, Artificial Sequence
  Synthetic Polynucleotide
taatacgactcactatagggcgctgcagggcactctggtcggcttcatcaaacagaggagatgatgaatgcgaccagagaacctggcggcagcgcaaaagatg

SEQ ID NO: 129219 - DNA, 103 bp, Artificial Sequence
  Synthetic Polynucleotide
taatacgactcactatagggccgcgtcatccgctgcagggcactctggtcaacagaggagagaccagatggccctgcagaacctggcggcagcgcaaaagatg

SEQ ID NO: 129220 - DNA, 103 bp, Artificial Sequence
  Synthetic Polynucleotide
taatacgactcactatagggtgacacgaagccgcgtcatccgctgcagggaacagaggagaccctgcatgggatgacgcaacctggcggcagcgcaaaagatg

SEQ ID NO: 129221 - DNA, 103 bp, Artificial Sequence
  Synthetic Polynucleotide
taatacgactcactatagggatagaccaggtgacacgaagccgcgtcatcaacagaggagagatgacatggcttcgtgtaacctggcggcagcgcaaaagatg

SEQ ID NO: 129222 - DNA, 103 bp, Artificial Sequence
  Synthetic Polynucleotide
taatacgactcactatagggatcctcctgcatagaccaggtgacacgaagaacagaggagacttcgtatgacctggtctaacctggcggcagcgcaaaagatg

SEQ ID NO: 129223 - DNA, 103 bp, Artificial Sequence
  Synthetic Polynucleotide
taatacgactcactataggggctgcaaggacttggttctgatgtcattggaacagaggagaccaatgatgtcagaaccaaacctggcggcagcgcaaaagatg

SEQ ID NO: 129224 - DNA, 103 bp, Artificial Sequence
  Synthetic Polynucleotide
taatacgactcactatagggcaagcagcccatcctcctgcatagaccaggaacagaggagacctggtatgtgcaggaggaacctggcggcagcgcaaaagatg

SEQ ID NO: 129225 - DNA, 103 bp, Artificial Sequence
  Synthetic Polynucleotide
taatacgactcactatagggcggcacagcacaagcagcccatcctcctgcaacagaggagagcaggaatgtgggctgctaacctggcggcagcgcaaaagatg

SEQ ID NO: 129226 - DNA, 103 bp, Artificial Sequence
  Synthetic Polynucleotide
taatacgactcactataggggctggcaatgcggcacagcacaagcagcccaacagaggagagggctgatggtgctgtgcaacctggcggcagcgcaaaagatg

SEQ ID NO: 129227 - DNA, 103 bp, Artificial Sequence
  Synthetic Polynucleotide
taatacgactcactatagggtgaggacattgctggcaatgcggcacagcaaacagaggagatgctgtatggcattgccaaacctggcggcagcgcaaaagatg

SEQ ID NO: 129228 - DNA, 103 bp, Artificial Sequence
  Synthetic Polynucleotide
taatacgactcactatagggaccttggtgttgaggacattgctggcaatgaacagaggagacattgcatgcaatgtcctaacctggcggcagcgcaaaagatg

SEQ ID NO: 129229 - DNA, 103 bp, Artificial Sequence
  Synthetic Polynucleotide
taatacgactcactatagggtgggcccttcaccttggtgttgaggacattaacagaggagaaatgtcatgaacaccaagaacctggcggcagcgcaaaagatg

SEQ ID NO: 129230 - DNA, 103 bp, Artificial Sequence
  Synthetic Polynucleotide
taatacgactcactatagggaggtgacaaatgggcccttcaccttggtgtaacagaggagaacaccaatgtgaagggccaacctggcggcagcgcaaaagatg

SEQ ID NO: 129231 - DNA, 103 bp, Artificial Sequence
  Synthetic Polynucleotide
taatacgactcactatagggaccacctgccaggtgacaaatgggcccttcaacagaggagagaagggatgatttgtcacaacctggcggcagcgcaaaagatg

SEQ ID NO: 129232 - DNA, 103 bp, Artificial Sequence
  Synthetic Polynucleotide
taatacgactcactatagggaatgtcccgtaccacctgccaggtgacaaaaacagaggagatttgtcatgtggcaggtgaacctggcggcagcgcaaaagatg

SEQ ID NO: 129233 - DNA, 103 bp, Artificial Sequence
  Synthetic Polynucleotide
taatacgactcactatagggtggcatgcaaaatgtcccgtaccacctgccaacagaggagaggcaggatgtacgggacaaacctggcggcagcgcaaaagatg

SEQ ID NO: 129234 - DNA, 103 bp, Artificial Sequence
  Synthetic Polynucleotide
taatacgactcactataggggtacagcgaggctgcaaggacttggttctgaacagaggagacagaacatggtccttgcaaacctggcggcagcgcaaaagatg

SEQ ID NO: 129235 - DNA, 103 bp, Artificial Sequence
  Synthetic Polynucleotide
taatacgactcactatagggtcttcaaacgtggcatgcaaaatgtcccgtaacagaggagaacgggaatgtttgcatgcaacctggcggcagcgcaaaagatg

SEQ ID NO: 129236 - DNA, 103 bp, Artificial Sequence
  Synthetic Polynucleotide
taatacgactcactatagggatccaaagactcttcaaacgtggcatgcaaaacagaggagattgcatatgacgtttgaaaacctggcggcagcgcaaaagatg

SEQ ID NO: 129237 - DNA, 103 bp, Artificial Sequence
  Synthetic Polynucleotide
taatacgactcactataggggagatgttttatccaaagactcttcaaacgaacagaggagacgtttgatgagtctttggaacctggcggcagcgcaaaagatg

SEQ ID NO: 129238 - DNA, 103 bp, Artificial Sequence
  Synthetic Polynucleotide
taatacgactcactatagggccaacggaatgagatgttttatccaaagacaacagaggagagtctttatgtaaaacatcaacctggcggcagcgcaaaagatg

SEQ ID NO: 129239 - DNA, 103 bp, Artificial Sequence
  Synthetic Polynucleotide
taatacgactcactatagggagctcttcgtccaacggaatgagatgttttaacagaggagaaaaacaatgcattccgttaacctggcggcagcgcaaaagatg

SEQ ID NO: 129240 - DNA, 103 bp, Artificial Sequence
  Synthetic Polynucleotide
taatacgactcactatagggctatgtagcgagctcttcgtccaacggaataacagaggagaattccgatggacgaagagaacctggcggcagcgcaaaagatg

SEQ ID NO: 129241 - DNA, 103 bp, Artificial Sequence
  Synthetic Polynucleotide
taatacgactcactataggggggtttttgactatgtagcgagctcttcgtaacagaggagaacgaagatgtcgctacataacctggcggcagcgcaaaagatg

SEQ ID NO: 129242 - DNA, 103 bp, Artificial Sequence
  Synthetic Polynucleotide
taatacgactcactatagggataggcctgtgggtttttgactatgtagcgaacagaggagacgctacatggtcaaaaacaacctggcggcagcgcaaaagatg

SEQ ID NO: 129243 - DNA, 103 bp, Artificial Sequence
  Synthetic Polynucleotide
taatacgactcactatagggtatagttgagataggcctgtgggtttttgaaacagaggagatcaaaaatgcacaggcctaacctggcggcagcgcaaaagatg

SEQ ID NO: 129244 - DNA, 103 bp, Artificial Sequence
  Synthetic Polynucleotide
taatacgactcactatagggaggcacactttatagttgagataggcctgtaacagaggagaacaggcatgtctcaactaaacctggcggcagcgcaaaagatg

SEQ ID NO: 129245 - DNA, 103 bp, Artificial Sequence
  Synthetic Polynucleotide
taatacgactcactatagggacacaggccatcgagcccctccagagcgacaacagaggagagtcgctatggaggggctcaacctggcggcagcgcaaaagatg

SEQ ID NO: 129246 - DNA, 103 bp, Artificial Sequence
  Synthetic Polynucleotide
taatacgactcactatagggttccaccattgtacagcgaggctgcaaggaaacagaggagatccttgatgcctcgctgtaacctggcggcagcgcaaaagatg

SEQ ID NO: 129247 - DNA, 103 bp, Artificial Sequence
  Synthetic Polynucleotide
taatacgactcactatagggcacctcggccaggcacactttatagttgagaacagaggagactcaacatgaaagtgtgcaacctggcggcagcgcaaaagatg

SEQ ID NO: 129248 - DNA, 103 bp, Artificial Sequence
  Synthetic Polynucleotide
taatacgactcactatagggtatcctggtacacctcggccaggcacacttaacagaggagaaagtgtatgtggccgaggaacctggcggcagcgcaaaagatg

SEQ ID NO: 129249 - DNA, 103 bp, Artificial Sequence
  Synthetic Polynucleotide
taatacgactcactatagggacaagtgctttatcctggtacacctcggccaacagaggagaggccgaatggtaccaggaaacctggcggcagcgcaaaagatg

SEQ ID NO: 129250 - DNA, 103 bp, Artificial Sequence
  Synthetic Polynucleotide
taatacgactcactataggggaaatctccaacaagtgctttatcctggtaaacagaggagataccagatgaaagcacttaacctggcggcagcgcaaaagatg

SEQ ID NO: 129251 - DNA, 103 bp, Artificial Sequence
  Synthetic Polynucleotide
taatacgactcactatagggttcgattcatgaaatctccaacaagtgcttaacagaggagaaagcacatgttggagattaacctggcggcagcgcaaaagatg

SEQ ID NO: 129252 - DNA, 103 bp, Artificial Sequence
  Synthetic Polynucleotide
taatacgactcactatagggtagtcacctcttcgattcatgaaatctccaaacagaggagatggagaatgcatgaatcgaacctggcggcagcgcaaaagatg

SEQ ID NO: 129253 - DNA, 103 bp, Artificial Sequence
  Synthetic Polynucleotide
taatacgactcactatagggtgggtcatcatagtcacctcttcgattcataacagaggagaatgaatatgagaggtgacaacctggcggcagcgcaaaagatg

SEQ ID NO: 129254 - DNA, 103 bp, Artificial Sequence
  Synthetic Polynucleotide
taatacgactcactatagggcacaaacctttgggtcatcatagtcacctcaacagaggagagaggtgatgatgatgaccaacctggcggcagcgcaaaagatg

SEQ ID NO: 129255 - DNA, 103 bp, Artificial Sequence
  Synthetic Polynucleotide
taatacgactcactatagggaactcgttggcacaaacctttgggtcatcaaacagaggagatgatgaatgaaaggtttgaacctggcggcagcgcaaaagatg

SEQ ID NO: 129256 - DNA, 103 bp, Artificial Sequence
  Synthetic Polynucleotide
taatacgactcactatagggaaattctttaaactcgttggcacaaaccttaacagaggagaaaggttatggccaacgagaacctggcggcagcgcaaaagatg

SEQ ID NO: 129257 - DNA, 103 bp, Artificial Sequence
  Synthetic Polynucleotide
taatacgactcactatagggtgtcaaaggcttccaccattgtacagcgagaacagaggagactcgctatgcaatggtggaacctggcggcagcgcaaaagatg

SEQ ID NO: 129258 - DNA, 103 bp, Artificial Sequence
  Synthetic Polynucleotide
taatacgactcactataggggcttctccacaaattctttaaactcgttggaacagaggagaccaacgatgttaaagaataacctggcggcagcgcaaaagatg

SEQ ID NO: 129259 - DNA, 103 bp, Artificial Sequence
  Synthetic Polynucleotide
taatacgactcactatagggttttctttaagcttctccacaaattctttaaacagaggagataaagaatgtgtggagaaaacctggcggcagcgcaaaagatg

SEQ ID NO: 129260 - DNA, 103 bp, Artificial Sequence
  Synthetic Polynucleotide
taatacgactcactatagggtgaactgaacttttctttaagcttctccacaacagaggagagtggagatgcttaaagaaaacctggcggcagcgcaaaagatg

SEQ ID NO: 129261 - DNA, 103 bp, Artificial Sequence
  Synthetic Polynucleotide
taatacgactcactatagggtccttagggctgaactgaacttttctttaaaacagaggagattaaagatgagttcagttaacctggcggcagcgcaaaagatg

SEQ ID NO: 129262 - DNA, 103 bp, Artificial Sequence
  Synthetic Polynucleotide
taatacgactcactatagggaggttagaattccttagggctgaactgaacaacagaggagagttcagatgagccctaagaacctggcggcagcgcaaaagatg

SEQ ID NO: 129263 - DNA, 103 bp, Artificial Sequence
  Synthetic Polynucleotide
taatacgactcactatagggtgggatttcaaggttagaattccttagggcaacagaggagagccctaatgaattctaacaacctggcggcagcgcaaaagatg

SEQ ID NO: 129264 - DNA, 103 bp, Artificial Sequence
  Synthetic Polynucleotide
taatacgactcactatagggggagtgtgtctgggatttcaaggttagaataacagaggagaattctaatgttgaaatccaacctggcggcagcgcaaaagatg

SEQ ID NO: 129265 - DNA, 103 bp, Artificial Sequence
  Synthetic Polynucleotide
taatacgactcactatagggaacagctcctggagtgtgtctgggatttcaaacagaggagatgaaatatgagacacactaacctggcggcagcgcaaaagatg

SEQ ID NO: 129266 - DNA, 103 bp, Artificial Sequence
  Synthetic Polynucleotide
taatacgactcactataggggtacctggcgaacagctcctggagtgtgtcaacagaggagagacacaatgcaggagctgaacctggcggcagcgcaaaagatg

SEQ ID NO: 129267 - DNA, 103 bp, Artificial Sequence
  Synthetic Polynucleotide
taatacgactcactatagggccaaaactcggtacctggcgaacagctcctaacagaggagaaggagcatgtcgccaggtaacctggcggcagcgcaaaagatg

SEQ ID NO: 129268 - DNA, 103 bp, Artificial Sequence
  Synthetic Polynucleotide
taatacgactcactatagggttcccccacctgtcaaaggcttccaccattaacagaggagaaatggtatgagcctttgaaacctggcggcagcgcaaaagatg

SEQ ID NO: 129269 - DNA, 103 bp, Artificial Sequence
  Synthetic Polynucleotide
taatacgactcactatagggtccccaattgccaaaactcggtacctggcgaacagaggagacgccagatgccgagttttaacctggcggcagcgcaaaagatg

SEQ ID NO: 129270 - DNA, 103 bp, Artificial Sequence
  Synthetic Polynucleotide
taatacgactcactatagggatctttttcatccccaattgccaaaactcgaacagaggagacgagttatggcaattgggaacctggcggcagcgcaaaagatg

SEQ ID NO: 129271 - DNA, 103 bp, Artificial Sequence
  Synthetic Polynucleotide
taatacgactcactatagggtcctggtttgatctttttcatccccaattgaacagaggagacaattgatgatgaaaaagaacctggcggcagcgcaaaagatg

SEQ ID NO: 129272 - DNA, 103 bp, Artificial Sequence
  Synthetic Polynucleotide
taatacgactcactatagggtcatcctctttcctggtttgatctttttcaaacagaggagatgaaaaatgtcaaaccagaacctggcggcagcgcaaaagatg

SEQ ID NO: 129273 - DNA, 103 bp, Artificial Sequence
  Synthetic Polynucleotide
taatacgactcactataggggctgttaagttcatcctctttcctggtttgaacagaggagacaaaccatgaaagaggataacctggcggcagcgcaaaagatg

SEQ ID NO: 129274 - DNA, 103 bp, Artificial Sequence
  Synthetic Polynucleotide
taatacgactcactatagggtgtcatccacgctgttaagttcatcctcttaacagaggagaaagaggatgaacttaacaaacctggcggcagcgcaaaagatg

SEQ ID NO: 129275 - DNA, 103 bp, Artificial Sequence
  Synthetic Polynucleotide
taatacgactcactatagggagaaagtggatgtcatccacgctgttaagtaacagaggagaacttaaatgcgtggatgaaacctggcggcagcgcaaaagatg

SEQ ID NO: 129276 - DNA, 103 bp, Artificial Sequence
  Synthetic Polynucleotide
taatacgactcactatagggctgaagcaccagaaagtggatgtcatccacaacagaggagagtggatatgatccactttaacctggcggcagcgcaaaagatg

SEQ ID NO: 129277 - DNA, 103 bp, Artificial Sequence
  Synthetic Polynucleotide
taatacgactcactatagggggatcaggttctgaagcaccagaaagtggaaacagaggagatccactatgtggtgcttcaacctggcggcagcgcaaaagatg

SEQ ID NO: 129278 - DNA, 103 bp, Artificial Sequence
  Synthetic Polynucleotide
taatacgactcactatagggagcgtgctctggatcaggttctgaagcaccaacagaggagaggtgctatggaacctgataacctggcggcagcgcaaaagatg

SEQ ID NO: 129279 - DNA, 103 bp, Artificial Sequence
  Synthetic Polynucleotide
taatacgactcactataggggatcagtttcttcccccacctgtcaaaggcaacagaggagagcctttatgaggtgggggaacctggcggcagcgcaaaagatg

SEQ ID NO: 129280 - DNA, 103 bp, Artificial Sequence
  Synthetic Polynucleotide
taatacgactcactatagggtgagagggccagcgtgctctggatcaggttaacagaggagaaacctgatgcagagcacgaacctggcggcagcgcaaaagatg

SEQ ID NO: 129281 - DNA, 103 bp, Artificial Sequence
  Synthetic Polynucleotide
taatacgactcactatagggtctgactgtctgagagggccagcgtgctctaacagaggagaagagcaatgtggccctctaacctggcggcagcgcaaaagatg

SEQ ID NO: 129282 - DNA, 103 bp, Artificial Sequence
  Synthetic Polynucleotide
taatacgactcactatagggtaggacttcatctgactgtctgagagggccaacagaggagaggccctatgagacagtcaaacctggcggcagcgcaaaagatg

SEQ ID NO: 129283 - DNA, 103 bp, Artificial Sequence
  Synthetic Polynucleotide
taatacgactcactataggggaatgactggtaggacttcatctgactgtcaacagaggagagacagtatgatgaagtccaacctggcggcagcgcaaaagatg

SEQ ID NO: 129284 - DNA, 103 bp, Artificial Sequence
  Synthetic Polynucleotide
taatacgactcactatagggggaaagtctggaatgactggtaggacttcaaacagaggagatgaagtatgaccagtcataacctggcggcagcgcaaaagatg

SEQ ID NO: 129285 - DNA, 103 bp, Artificial Sequence
  Synthetic Polynucleotide
taatacgactcactatagggcgatagaggcggaaagtctggaatgactggaacagaggagaccagtcatgccagactttaacctggcggcagcgcaaaagatg

SEQ ID NO: 129286 - DNA, 103 bp, Artificial Sequence
  Synthetic Polynucleotide
taatacgactcactatagggcttgtactcccgatagaggcggaaagtctgaacagaggagacagactatgcgcctctataacctggcggcagcgcaaaagatg

SEQ ID NO: 129287 - DNA, 103 bp, Artificial Sequence
  Synthetic Polynucleotide
taatacgactcactataggggaacgtggtccttgtactcccgatagaggcaacagaggagagcctctatggggagtacaaacctggcggcagcgcaaaagatg

SEQ ID NO: 129288 - DNA, 103 bp, Artificial Sequence
  Synthetic Polynucleotide
taatacgactcactataggggccttcacaagaacgtggtccttgtactccaacagaggagaggagtaatgggaccacgtaacctggcggcagcgcaaaagatg

SEQ ID NO: 129289 - DNA, 103 bp, Artificial Sequence
  Synthetic Polynucleotide
taatacgactcactatagggctccatgaaggccttcacaagaacgtggtcaacagaggagagaccacatgcttgtgaagaacctggcggcagcgcaaaagatg

SEQ ID NO: 129290 - DNA, 103 bp, Artificial Sequence
  Synthetic Polynucleotide
taatacgactcactatagggaggcaacgatgatcagtttcttcccccaccaacagaggagaggtgggatgagaaactgaaacctggcggcagcgcaaaagatg

SEQ ID NO: 129291 - DNA, 103 bp, Artificial Sequence
  Synthetic Polynucleotide
taatacgactcactatagggtcttctggcactccatgaaggccttcacaaaacagaggagattgtgaatgccttcatggaacctggcggcagcgcaaaagatg

SEQ ID NO: 129292 - DNA, 103 bp, Artificial Sequence
  Synthetic Polynucleotide
taatacgactcactatagggaccaagctcctcttctggcactccatgaagaacagaggagacttcatatggtgccagaaaacctggcggcagcgcaaaagatg

SEQ ID NO: 129293 - DNA, 103 bp, Artificial Sequence
  Synthetic Polynucleotide
taatacgactcactataggggcgccggttgaccaagctcctcttctggcaaacagaggagatgccagatgaggagcttgaacctggcggcagcgcaaaagatg

SEQ ID NO: 129294 - DNA, 103 bp, Artificial Sequence
  Synthetic Polynucleotide
taatacgactcactatagggggttgacccggcgccggttgaccaagctccaacagaggagaggagctatgtcaaccggcaacctggcggcagcgcaaaagatg

SEQ ID NO: 129295 - DNA, 103 bp, Artificial Sequence
  Synthetic Polynucleotide
taatacgactcactatagggcccagcgtgtggttgacccggcgccggttgaacagaggagacaaccgatgccgggtcaaaacctggcggcagcgcaaaagatg

SEQ ID NO: 129296 - DNA, 103 bp, Artificial Sequence
  Synthetic Polynucleotide
taatacgactcactatagggcttcttggggcccagcgtgtggttgacccgaacagaggagacgggtcatgcacacgctgaacctggcggcagcgcaaaagatg

SEQ ID NO: 129297 - DNA, 103 bp, Artificial Sequence
  Synthetic Polynucleotide
taatacgactcactataggggggcccggttcttcttggggcccagcgtgtaacagaggagaacacgcatggccccaagaaacctggcggcagcgcaaaagatg

SEQ ID NO: 129298 - DNA, 103 bp, Artificial Sequence
  Synthetic Polynucleotide
taatacgactcactatagggacgaaggggagggcccggttcttcttggggaacagaggagaccccaaatggaaccgggcaacctggcggcagcgcaaaagatg

SEQ ID NO: 129299 - DNA, 103 bp, Artificial Sequence
  Synthetic Polynucleotide
taatacgactcactatagggggacattggcacgaaggggagggcccggttaacagaggagaaaccggatgctccccttcaacctggcggcagcgcaaaagatg

SEQ ID NO: 129300 - DNA, 103 bp, Artificial Sequence
  Synthetic Polynucleotide
taatacgactcactatagggatagctggtaggacattggcacgaaggggaaacagaggagatcccctatgtgccaatgtaacctggcggcagcgcaaaagatg

SEQ ID NO: 129301 - DNA, 103 bp, Artificial Sequence
  Synthetic Polynucleotide
taatacgactcactatagggatggcctgggaggcaacgatgatcagtttcaacagaggagagaaactatgcatcgttgcaacctggcggcagcgcaaaagatg

SEQ ID NO: 129302 - DNA, 103 bp, Artificial Sequence
  Synthetic Polynucleotide
taatacgactcactatagggtaggtctgggatagctggtaggacattggcaacagaggagagccaatatgctaccagctaacctggcggcagcgcaaaagatg

SEQ ID NO: 129303 - DNA, 103 bp, Artificial Sequence
  Synthetic Polynucleotide
taatacgactcactatagggaatcctgtagtaggtctgggatagctggtaaacagaggagataccagatgtcccagaccaacctggcggcagcgcaaaagatg

SEQ ID NO: 129304 - DNA, 103 bp, Artificial Sequence
  Synthetic Polynucleotide
taatacgactcactataggggccacgtaaaaatcctgtagtaggtctgggaacagaggagacccagaatgactacaggaaacctggcggcagcgcaaaagatg

SEQ ID NO: 129305 - DNA, 103 bp, Artificial Sequence
  Synthetic Polynucleotide
taatacgactcactatagggcttggaaatcgccacgtaaaaatcctgtagaacagaggagactacagatgttttacgtgaacctggcggcagcgcaaaagatg

SEQ ID NO: 129306 - DNA, 103 bp, Artificial Sequence
  Synthetic Polynucleotide
taatacgactcactataggggcagatggtgcttggaaatcgccacgtaaaaacagaggagatttacgatgcgatttccaaacctggcggcagcgcaaaagatg

SEQ ID NO: 129307 - DNA, 103 bp, Artificial Sequence
  Synthetic Polynucleotide
taatacgactcactatagggatgactccgtgcagatggtgcttggaaatcaacagaggagagatttcatggcaccatctaacctggcggcagcgcaaaagatg

SEQ ID NO: 129308 - DNA, 103 bp, Artificial Sequence
  Synthetic Polynucleotide
taatacgactcactatagggaaaaactggaatgactccgtgcagatggtgaacagaggagacaccatatgcacggagtcaacctggcggcagcgcaaaagatg

SEQ ID NO: 129309 - DNA, 103 bp, Artificial Sequence
  Synthetic Polynucleotide
taatacgactcactatagggcattctgtccaaaaactggaatgactccgtaacagaggagaacggagatgttccagtttaacctggcggcagcgcaaaagatg

SEQ ID NO: 129310 - DNA, 103 bp, Artificial Sequence
  Synthetic Polynucleotide
taatacgactcactatagggcggcagcccgcattctgtccaaaaactggaaacagaggagatccagtatgtggacagaaaacctggcggcagcgcaaaagatg

SEQ ID NO: 129311 - DNA, 103 bp, Artificial Sequence
  Synthetic Polynucleotide
taatacgactcactatagggtccaacttgccggcagcccgcattctgtccaacagaggagaggacagatggcgggctgcaacctggcggcagcgcaaaagatg

SEQ ID NO: 129312 - DNA, 103 bp, Artificial Sequence
  Synthetic Polynucleotide
taatacgactcactatagggcctgtaccgcatggcctgggaggcaacgataacagaggagaatcgttatgtcccaggccaacctggcggcagcgcaaaagatg

SEQ ID NO: 129313 - DNA, 103 bp, Artificial Sequence
  Synthetic Polynucleotide
taatacgactcactatagggatcaggctggtccaacttgccggcagcccgaacagaggagacgggctatgggcaagttgaacctggcggcagcgcaaaagatg

SEQ ID NO: 129314 - DNA, 103 bp, Artificial Sequence
  Synthetic Polynucleotide
taatacgactcactatagggaagagaaacgatcaggctggtccaacttgcaacagaggagagcaagtatgaccagcctgaacctggcggcagcgcaaaagatg

SEQ ID NO: 129315 - DNA, 103 bp, Artificial Sequence
  Synthetic Polynucleotide
taatacgactcactatagggtggtctttgaaagagaaacgatcaggctggaacagaggagaccagccatgtcgtttctcaacctggcggcagcgcaaaagatg

SEQ ID NO: 129316 - DNA, 103 bp, Artificial Sequence
  Synthetic Polynucleotide
taatacgactcactataggggttattatcctggtctttgaaagagaaacgaacagaggagacgtttcatgttcaaagacaacctggcggcagcgcaaaagatg

SEQ ID NO: 129317 - DNA, 103 bp, Artificial Sequence
  Synthetic Polynucleotide
taatacgactcactatagggttgtgggctcgttattatcctggtctttgaaacagaggagatcaaagatgaggataataaacctggcggcagcgcaaaagatg

SEQ ID NO: 129318 - DNA, 103 bp, Artificial Sequence
  Synthetic Polynucleotide
taatacgactcactatagggaccatgtcgtttgtgggctcgttattatccaacagaggagaggataaatgcgagcccacaacctggcggcagcgcaaaagatg

SEQ ID NO: 129319 - DNA, 103 bp, Artificial Sequence
  Synthetic Polynucleotide
taatacgactcactatagggtgaaaaggccaccatgtcgtttgtgggctcaacagaggagagagcccatgaacgacatgaacctggcggcagcgcaaaagatg

SEQ ID NO: 129320 - DNA, 103 bp, Artificial Sequence
  Synthetic Polynucleotide
taatacgactcactatagggggccgtccagtgaaaaggccaccatgtcgtaacagaggagaacgacaatgtggccttttaacctggcggcagcgcaaaagatg

SEQ ID NO: 129321 - DNA, 103 bp, Artificial Sequence
  Synthetic Polynucleotide
taatacgactcactatagggtttcctccagggccgtccagtgaaaaggccaacagaggagaggccttatgactggacggaacctggcggcagcgcaaaagatg

SEQ ID NO: 129322 - DNA, 103 bp, Artificial Sequence
  Synthetic Polynucleotide
taatacgactcactatagggggccacacaatttcctccagggccgtccagaacagaggagactggacatgcctggaggaaacctggcggcagcgcaaaagatg

SEQ ID NO: 129323 - DNA, 103 bp, Artificial Sequence
  Synthetic Polynucleotide
taatacgactcactatagggctatcaaggccctgtaccgcatggcctgggaacagaggagacccaggatgtgcggtacaaacctggcggcagcgcaaaagatg

SEQ ID NO: 129324 - DNA, 103 bp, Artificial Sequence
  Synthetic Polynucleotide
taatacgactcactataggggggtcaggacggccacacaatttcctccagaacagaggagactggagatgattgtgtggaacctggcggcagcgcaaaagatg

SEQ ID NO: 129325 - DNA, 103 bp, Artificial Sequence
  Synthetic Polynucleotide
taatacgactcactatagggagagagaagagggtcaggacggccacacaaaacagaggagattgtgtatgcgtcctgacaacctggcggcagcgcaaaagatg

SEQ ID NO: 129326 - DNA, 103 bp, Artificial Sequence
  Synthetic Polynucleotide
taatacgactcactatagggaatgaggcccagagagaagagggtcaggacaacagaggagagtcctgatgctcttctctaacctggcggcagcgcaaaagatg

SEQ ID NO: 129327 - DNA, 103 bp, Artificial Sequence
  Synthetic Polynucleotide
taatacgactcactatagggcatccacagaaatgaggcccagagagaagaaacagaggagatcttctatgtgggcctcaaacctggcggcagcgcaaaagatg

SEQ ID NO: 129328 - DNA, 103 bp, Artificial Sequence
  Synthetic Polynucleotide
taatacgactcactataggggggatcctgacatccacagaaatgaggcccaacagaggagagggcctatgttctgtggaaacctggcggcagcgcaaaagatg

SEQ ID NO: 129329 - DNA, 103 bp, Artificial Sequence
  Synthetic Polynucleotide
taatacgactcactataggggatctgctccgggatcctgacatccacagaaacagaggagatctgtgatggtcaggatcaacctggcggcagcgcaaaagatg

SEQ ID NO: 129330 - DNA, 103 bp, Artificial Sequence
  Synthetic Polynucleotide
taatacgactcactatagggctaccacgatgatctgctccgggatcctgaaacagaggagatcaggaatgcggagcagaaacctggcggcagcgcaaaagatg

SEQ ID NO: 129331 - DNA, 103 bp, Artificial Sequence
  Synthetic Polynucleotide
taatacgactcactatagggattgagctgtctaccacgatgatctgctccaacagaggagaggagcaatgcatcgtggtaacctggcggcagcgcaaaagatg

SEQ ID NO: 129332 - DNA, 103 bp, Artificial Sequence
  Synthetic Polynucleotide
taatacgactcactatagggattctccaccattgagctgtctaccacgataacagaggagaatcgtgatggacagctcaaacctggcggcagcgcaaaagatg

SEQ ID NO: 129333 - DNA, 103 bp, Artificial Sequence
  Synthetic Polynucleotide
taatacgactcactatagggtgatgacctcattctccaccattgagctgtaacagaggagaacagctatgtggtggagaaacctggcggcagcgcaaaagatg

SEQ ID NO: 129334 - DNA, 103 bp, Artificial Sequence
  Synthetic Polynucleotide
taatacgactcactatagggccctcctggcctatcaaggccctgtaccgcaacagaggagagcggtaatgggccttgataacctggcggcagcgcaaaagatg

SEQ ID NO: 129335 - DNA, 103 bp, Artificial Sequence
  Synthetic Polynucleotide
taatacgactcactatagggcccaagcttttgatgacctcattctccaccaacagaggagaggtggaatgtgaggtcataacctggcggcagcgcaaaagatg

SEQ ID NO: 129336 - DNA, 103 bp, Artificial Sequence
  Synthetic Polynucleotide
taatacgactcactataggggccgtccttccccaagcttttgatgacctcaacagaggagagaggtcatgaaaagcttgaacctggcggcagcgcaaaagatg

SEQ ID NO: 129337 - DNA, 103 bp, Artificial Sequence
  Synthetic Polynucleotide
taatacgactcactatagggcctccaggctgccgtccttccccaagctttaacagaggagaaaagctatgggaaggacgaacctggcggcagcgcaaaagatg

SEQ ID NO: 129338 - DNA, 103 bp, Artificial Sequence
  Synthetic Polynucleotide
taatacgactcactatagggtcctcgtcatcctccaggctgccgtccttcaacagaggagagaaggaatgcagcctggaaacctggcggcagcgcaaaagatg

SEQ ID NO: 129339 - DNA, 103 bp, Artificial Sequence
  Synthetic Polynucleotide
taatacgactcactatagggatcctcttcatcctcgtcatcctccaggctaacagaggagaagcctgatggatgacgagaacctggcggcagcgcaaaagatg

SEQ ID NO: 129340 - DNA, 103 bp, Artificial Sequence
  Synthetic Polynucleotide
taatacgactcactatagggcgtccaagtcatcctcttcatcctcgtcataacagaggagaatgacgatgatgaagaggaacctggcggcagcgcaaaagatg

SEQ ID NO: 129341 - DNA, 103 bp, Artificial Sequence
  Synthetic Polynucleotide
taatacgactcactatagggcctacaccttcgtccaagtcatcctcttcaaacagaggagatgaagaatgtgacttggaaacctggcggcagcgcaaaagatg

SEQ ID NO: 129342 - DNA, 103 bp, Artificial Sequence
  Synthetic Polynucleotide
taatacgactcactataggggcgcttgccccctacaccttcgtccaagtcaacagaggagagacttgatggaaggtgtaaacctggcggcagcgcaaaagatg

SEQ ID NO: 129343 - DNA, 103 bp, Artificial Sequence
  Synthetic Polynucleotide
taatacgactcactatagggccatgctccggcgcttgccccctacaccttaacagaggagaaaggtgatgggggcaagcaacctggcggcagcgcaaaagatg

SEQ ID NO: 129344 - DNA, 103 bp, Artificial Sequence
  Synthetic Polynucleotide
taatacgactcactatagggggtttcacctccatgctccggcgcttgcccaacagaggagagggcaaatgccggagcataacctggcggcagcgcaaaagatg

SEQ ID NO: 129345 - DNA, 103 bp, Artificial Sequence
  Synthetic Polynucleotide
taatacgactcactataggggtcgggatccccctcctggcctatcaaggcaacagaggagagccttgatgggccaggagaacctggcggcagcgcaaaagatg

SEQ ID NO: 129346 - DNA, 103 bp, Artificial Sequence
  Synthetic Polynucleotide
taatacgactcactatagggggcttgcgcaggtttcacctccatgctccgaacagaggagacggagcatggaggtgaaaaacctggcggcagcgcaaaagatg

SEQ ID NO: 129347 - DNA, 103 bp, Artificial Sequence
  Synthetic Polynucleotide
taatacgactcactatagggtggtgtgggaggcttgcgcaggtttcacctaacagaggagaaggtgaatgctgcgcaagaacctggcggcagcgcaaaagatg

SEQ ID NO: 129348 - DNA, 103 bp, Artificial Sequence
  Synthetic Polynucleotide
taatacgactcactatagggagcaggtagttggtgtgggaggcttgcgcaaacagaggagatgcgcaatgctcccacacaacctggcggcagcgcaaaagatg

SEQ ID NO: 129349 - DNA, 103 bp, Artificial Sequence
  Synthetic Polynucleotide
taatacgactcactataggggcccctcatcagcaggtagttggtgtgggaaacagaggagatcccacatgaactacctgaacctggcggcagcgcaaaagatg

SEQ ID NO: 129350 - DNA, 103 bp, Artificial Sequence
  Synthetic Polynucleotide
taatacgactcactataggggggagtagtagcccctcatcagcaggtagtaacagaggagaactaccatgtgatgagggaacctggcggcagcgcaaaagatg

SEQ ID NO: 129351 - DNA, 103 bp, Artificial Sequence
  Synthetic Polynucleotide
taatacgactcactatagggacgatgccgggggagtagtagcccctcatcaacagaggagagatgagatgctactactcaacctggcggcagcgcaaaagatg

SEQ ID NO: 129352 - DNA, 103 bp, Artificial Sequence
  Synthetic Polynucleotide
taatacgactcactataggggcgggtgctgacgatgccgggggagtagtaaacagaggagatactacatgcccggcatcaacctggcggcagcgcaaaagatg

SEQ ID NO: 129353 - DNA, 103 bp, Artificial Sequence
  Synthetic Polynucleotide
taatacgactcactatagggggttgaggttgcgggtgctgacgatgccggaacagaggagaccggcaatgtcagcacccaacctggcggcagcgcaaaagatg

SEQ ID NO: 129354 - DNA, 103 bp, Artificial Sequence
  Synthetic Polynucleotide
taatacgactcactatagggctgtcgttggggttgaggttgcgggtgctgaacagaggagacagcacatgcaacctcaaaacctggcggcagcgcaaaagatg

SEQ ID NO: 129355 - DNA, 103 bp, Artificial Sequence
  Synthetic Polynucleotide
taatacgactcactataggggaccacaatgctgtcgttggggttgaggttaacagaggagaaacctcatgcccaacgacaacctggcggcagcgcaaaagatg

SEQ ID NO: 129356 - DNA, 103 bp, Artificial Sequence
  Synthetic Polynucleotide
taatacgactcactataggggcgctggcagacacaggccatcgagcccctaacagaggagaaggggcatgatggcctgtaacctggcggcagcgcaaaagatg

SEQ ID NO: 129357 - DNA, 103 bp, Artificial Sequence
  Synthetic Polynucleotide
taatacgactcactataggggcagcttcaggtcgggatccccctcctggcaacagaggagagccaggatggggatcccgaacctggcggcagcgcaaaagatg

SEQ ID NO: 129358 - DNA, 103 bp, Artificial Sequence
  Synthetic Polynucleotide
taatacgactcactatagggggcaggagttgaccacaatgctgtcgttggaacagaggagaccaacgatggcattgtggaacctggcggcagcgcaaaagatg

SEQ ID NO: 129359 - DNA, 103 bp, Artificial Sequence
  Synthetic Polynucleotide
taatacgactcactatagggaacttcatctggcaggagttgaccacaatgaacagaggagacattgtatgcaactcctgaacctggcggcagcgcaaaagatg

SEQ ID NO: 129360 - DNA, 103 bp, Artificial Sequence
  Synthetic Polynucleotide
taatacgactcactataggggcggagctggaacttcatctggcaggagttaacagaggagaaactccatgcagatgaagaacctggcggcagcgcaaaagatg

SEQ ID NO: 129361 - DNA, 103 bp, Artificial Sequence
  Synthetic Polynucleotide
taatacgactcactatagggcaggggtgcagcggagctggaacttcatctaacagaggagaagatgaatgtccagctccaacctggcggcagcgcaaaagatg

SEQ ID NO: 129362 - DNA, 103 bp, Artificial Sequence
  Synthetic Polynucleotide
taatacgactcactatagggcgggcgggcacaggggtgcagcggagctggaacagaggagaccagctatgctgcaccccaacctggcggcagcgcaaaagatg

SEQ ID NO: 129363 - DNA, 103 bp, Artificial Sequence
  Synthetic Polynucleotide
taatacgactcactataggggggcctgagccgggcgggcacaggggtgcaaacagaggagatgcaccatggtgcccgccaacctggcggcagcgcaaaagatg

SEQ ID NO: 129364 - DNA, 103 bp, Artificial Sequence
  Synthetic Polynucleotide
taatacgactcactataggggagcggcagcgggcctgagccgggcgggcaaacagaggagatgcccgatgggctcaggcaacctggcggcagcgcaaaagatg

SEQ ID NO: 129365 - DNA, 103 bp, Artificial Sequence
  Synthetic Polynucleotide
taatacgactcactatagggtcttccagaggagcggcagcgggcctgagcaacagaggagagctcagatgcgctgccgcaacctggcggcagcgcaaaagatg

SEQ ID NO: 129366 - DNA, 103 bp, Artificial Sequence
  Synthetic Polynucleotide
taatacgactcactatagggcattgttagctcttccagaggagcggcagcaacagaggagagctgccatgcctctggaaaacctggcggcagcgcaaaagatg

SEQ ID NO: 129367 - DNA, 103 bp, Artificial Sequence
  Synthetic Polynucleotide
taatacgactcactatagggaggaggttcccattgttagctcttccagagaacagaggagactctggatgagctaacaaaacctggcggcagcgcaaaagatg

SEQ ID NO: 129368 - DNA, 103 bp, Artificial Sequence
  Synthetic Polynucleotide
taatacgactcactataggggagaagtcgggcagcttcaggtcgggatccaacagaggagaggatccatgcctgaagctaacctggcggcagcgcaaaagatg

SEQ ID NO: 129369 - DNA, 103 bp, Artificial Sequence
  Synthetic Polynucleotide
taatacgactcactatagggtcagggaggcaggaggttcccattgttagcaacagaggagagctaacatggggaacctcaacctggcggcagcgcaaaagatg

SEQ ID NO: 129370 - DNA, 103 bp, Artificial Sequence
  Synthetic Polynucleotide
taatacgactcactatagggggtgaacgtatcagggaggcaggaggttccaacagaggagaggaaccatgtgcctccctaacctggcggcagcgcaaaagatg

SEQ ID NO: 129371 - DNA, 103 bp, Artificial Sequence
  Synthetic Polynucleotide
taatacgactcactatagggttatcagcttggtgaacgtatcagggaggcaacagaggagagcctccatgatacgttcaaacctggcggcagcgcaaaagatg

SEQ ID NO: 129372 - DNA, 103 bp, Artificial Sequence
  Synthetic Polynucleotide
taatacgactcactatagggtcctgggggtttatcagcttggtgaacgtaaacagaggagatacgttatgcaagctgataacctggcggcagcgcaaaagatg

SEQ ID NO: 129373 - DNA, 103 bp, Artificial Sequence
  Synthetic Polynucleotide
taatacgactcactataggggcaggtgttttcctgggggtttatcagcttaacagaggagaaagctgatgaacccccagaacctggcggcagcgcaaaagatg

SEQ ID NO: 129374 - DNA, 103 bp, Artificial Sequence
  Synthetic Polynucleotide
taatacgactcactatagggcctccaagctgcaggtgttttcctgggggtaacagaggagaacccccatgaaaacacctaacctggcggcagcgcaaaagatg

SEQ ID NO: 129375 - DNA, 103 bp, Artificial Sequence
  Synthetic Polynucleotide
taatacgactcactatagggaggacaaactcctccaagctgcaggtgtttaacagaggagaaaacacatgcagcttggaaacctggcggcagcgcaaaagatg

SEQ ID NO: 129376 - DNA, 103 bp, Artificial Sequence
  Synthetic Polynucleotide
taatacgactcactatagggctccagctggaggacaaactcctccaagctaacagaggagaagcttgatggagtttgtcaacctggcggcagcgcaaaagatg

SEQ ID NO: 129377 - DNA, 103 bp, Artificial Sequence
  Synthetic Polynucleotide
taatacgactcactatagggacccagacagctccagctggaggacaaactaacagaggagaagtttgatgtccagctggaacctggcggcagcgcaaaagatg

SEQ ID NO: 129378 - DNA, 103 bp, Artificial Sequence
  Synthetic Polynucleotide
taatacgactcactatagggtcgggactatacccagacagctccagctggaacagaggagaccagctatggctgtctggaacctggcggcagcgcaaaagatg

SEQ ID NO: 129379 - DNA, 103 bp, Artificial Sequence
  Synthetic Polynucleotide
taatacgactcactataggggatgcagtaggagaagtcgggcagcttcagaacagaggagactgaagatgcccgacttcaacctggcggcagcgcaaaagatg

SEQ ID NO: 129380 - DNA, 103 bp, Artificial Sequence
  Synthetic Polynucleotide
taatacgactcactatagggagtcaggtcttcgggactatacccagacagaacagaggagactgtctatgtatagtcccaacctggcggcagcgcaaaagatg

SEQ ID NO: 129381 - DNA, 103 bp, Artificial Sequence
  Synthetic Polynucleotide
taatacgactcactatagggccaaggcagcagtcaggtcttcgggactataacagaggagaatagtcatgaagacctgaaacctggcggcagcgcaaaagatg

SEQ ID NO: 129382 - DNA, 103 bp, Artificial Sequence
  Synthetic Polynucleotide
taatacgactcactatagggtccaagatctccaaggcagcagtcaggtctaacagaggagaagacctatgtgctgccttaacctggcggcagcgcaaaagatg

SEQ ID NO: 129383 - DNA, 103 bp, Artificial Sequence
  Synthetic Polynucleotide
taatacgactcactatagggtataatggcttccaagatctccaaggcagcaacagaggagagctgccatggagatcttgaacctggcggcagcgcaaaagatg

SEQ ID NO: 129384 - DNA, 103 bp, Artificial Sequence
  Synthetic Polynucleotide
taatacgactcactatagggaacccgtggctataatggcttccaagatctaacagaggagaagatctatgaagccattaaacctggcggcagcgcaaaagatg

SEQ ID NO: 129385 - DNA, 103 bp, Artificial Sequence
  Synthetic Polynucleotide
taatacgactcactatagggatcccaaaacaacccgtggctataatggctaacagaggagaagccatatgagccacgggaacctggcggcagcgcaaaagatg

SEQ ID NO: 129386 - DNA, 103 bp, Artificial Sequence
  Synthetic Polynucleotide
taatacgactcactatagggctccttgtcaatcccaaaacaacccgtggcaacagaggagagccacgatgtgttttgggaacctggcggcagcgcaaaagatg

SEQ ID NO: 129387 - DNA, 103 bp, Artificial Sequence
  Synthetic Polynucleotide
taatacgactcactatagggtgcgcagctcctccttgtcaatcccaaaacaacagaggagagttttgatgttgacaaggaacctggcggcagcgcaaaagatg

SEQ ID NO: 129388 - DNA, 103 bp, Artificial Sequence
  Synthetic Polynucleotide
taatacgactcactataggggagaaccgtctgcgcagctcctccttgtcaaacagaggagatgacaaatgggagctgcgaacctggcggcagcgcaaaagatg

SEQ ID NO: 129389 - DNA, 103 bp, Artificial Sequence
  Synthetic Polynucleotide
taatacgactcactatagggctccaaggccgagaaccgtctgcgcagctcaacagaggagagagctgatgagacggttcaacctggcggcagcgcaaaagatg

SEQ ID NO: 129390 - DNA, 103 bp, Artificial Sequence
  Synthetic Polynucleotide
taatacgactcactataggggccgttccaggatgcagtaggagaagtcggaacagaggagaccgactatgcctactgcaaacctggcggcagcgcaaaagatg

SEQ ID NO: 129391 - DNA, 103 bp, Artificial Sequence
  Synthetic Polynucleotide
taatacgactcactatagggcacctgccttctccaaggccgagaaccgtcaacagaggagagacggtatgcggccttggaacctggcggcagcgcaaaagatg

SEQ ID NO: 129392 - DNA, 103 bp, Artificial Sequence
  Synthetic Polynucleotide
taatacgactcactataggggtgcgcccaccacctgccttctccaaggccaacagaggagaggccttatggaaggcaggaacctggcggcagcgcaaaagatg

SEQ ID NO: 129393 - DNA, 103 bp, Artificial Sequence
  Synthetic Polynucleotide
taatacgactcactataggggaatgtcctggtgcgcccaccacctgccttaacagaggagaaaggcaatgggtgggcgcaacctggcggcagcgcaaaagatg

SEQ ID NO: 129394 - DNA, 103 bp, Artificial Sequence
  Synthetic Polynucleotide
taatacgactcactatagggtgcaatctgcgaatgtcctggtgcgcccacaacagaggagagtgggcatgccaggacataacctggcggcagcgcaaaagatg

SEQ ID NO: 129395 - DNA, 103 bp, Artificial Sequence
  Synthetic Polynucleotide
taatacgactcactatagggagggcctggatgcaatctgcgaatgtcctgaacagaggagacaggacatgcgcagattgaacctggcggcagcgcaaaagatg

SEQ ID NO: 129396 - DNA, 103 bp, Artificial Sequence
  Synthetic Polynucleotide
taatacgactcactatagggctgctccaggagggcctggatgcaatctgcaacagaggagagcagatatgatccaggccaacctggcggcagcgcaaaagatg

SEQ ID NO: 129397 - DNA, 103 bp, Artificial Sequence
  Synthetic Polynucleotide
taatacgactcactataggggcacctgatgctgctccaggagggcctggaaacagaggagatccaggatgtcctggagcaacctggcggcagcgcaaaagatg

SEQ ID NO: 129398 - DNA, 103 bp, Artificial Sequence
  Synthetic Polynucleotide
taatacgactcactatagggccgacctccagcacctgatgctgctccaggaacagaggagacctggaatggcatcaggtaacctggcggcagcgcaaaagatg

SEQ ID NO: 129399 - DNA, 103 bp, Artificial Sequence
  Synthetic Polynucleotide
taatacgactcactatagggagtgttgccaccgacctccagcacctgatgaacagaggagacatcagatgctggaggtcaacctggcggcagcgcaaaagatg

SEQ ID NO: 129400 - DNA, 103 bp, Artificial Sequence
  Synthetic Polynucleotide
taatacgactcactatagggccaggcgcgcagtgttgccaccgacctccaaacagaggagatggaggatggtggcaacaaacctggcggcagcgcaaaagatg

SEQ ID NO: 129401 - DNA, 103 bp, Artificial Sequence
  Synthetic Polynucleotide
taatacgactcactataggggaccggcctagccgttccaggatgcagtagaacagaggagactactgatgcctggaacgaacctggcggcagcgcaaaagatg

SEQ ID NO: 129402 - DNA, 103 bp, Artificial Sequence
  Synthetic Polynucleotide
taatacgactcactatagggcccatggctaccaggcgcgcagtgttgccaaacagaggagatggcaaatgtgcgcgcctaacctggcggcagcgcaaaagatg

SEQ ID NO: 129403 - DNA, 103 bp, Artificial Sequence
  Synthetic Polynucleotide
taatacgactcactatagggccaggcagagcccatggctaccaggcgcgcaacagaggagagcgcgcatggtagccatgaacctggcggcagcgcaaaagatg

SEQ ID NO: 129404 - DNA, 103 bp, Artificial Sequence
  Synthetic Polynucleotide
taatacgactcactatagggggagccaaggccaggcagagcccatggctaaacagaggagatagccaatggctctgcctaacctggcggcagcgcaaaagatg

SEQ ID NO: 129405 - DNA, 103 bp, Artificial Sequence
  Synthetic Polynucleotide
taatacgactcactatagggacggagtgcaggagccaaggccaggcagagaacagaggagactctgcatggccttggctaacctggcggcagcgcaaaagatg

SEQ ID NO: 129406 - DNA, 103 bp, Artificial Sequence
  Synthetic Polynucleotide
taatacgactcactatagggtttcagccgcacggagtgcaggagccaaggaacagaggagaccttggatgctgcactccaacctggcggcagcgcaaaagatg

SEQ ID NO: 129407 - DNA, 103 bp, Artificial Sequence
  Synthetic Polynucleotide
taatacgactcactatagggcttctctgtctttcagccgcacggagtgcaaacagaggagatgcactatgtgcggctgaaacctggcggcagcgcaaaagatg

SEQ ID NO: 129408 - DNA, 103 bp, Artificial Sequence
  Synthetic Polynucleotide
taatacgactcactatagggatgtcggcgtcttctctgtctttcagccgcaacagaggagagcggctatgagacagagaaacctggcggcagcgcaaaagatg

SEQ ID NO: 129409 - DNA, 103 bp, Artificial Sequence
  Synthetic Polynucleotide
taatacgactcactatagggttctctctggatgtcggcgtcttctctgtcaacagaggagagacagaatggacgccgacaacctggcggcagcgcaaaagatg

SEQ ID NO: 129410 - DNA, 103 bp, Artificial Sequence
  Synthetic Polynucleotide
taatacgactcactatagggcctgggggtcttctctctggatgtcggcgtaacagaggagaacgccgatgtccagagagaacctggcggcagcgcaaaagatg

SEQ ID NO: 129411 - DNA, 103 bp, Artificial Sequence
  Synthetic Polynucleotide
taatacgactcactatagggaggggtctggcctgggggtcttctctctggaacagaggagaccagagatgagacccccaaacctggcggcagcgcaaaagatg

SEQ ID NO: 129412 - DNA, 103 bp, Artificial Sequence
  Synthetic Polynucleotide
taatacgactcactatagggttgccacctggaccggcctagccgttccagaacagaggagactggaaatgctaggccggaacctggcggcagcgcaaaagatg

SEQ ID NO: 129413 - DNA, 103 bp, Artificial Sequence
  Synthetic Polynucleotide
taatacgactcactatagggagacccctccaggggtctggcctgggggtcaacagaggagagaccccatggccagacccaacctggcggcagcgcaaaagatg

SEQ ID NO: 129414 - DNA, 103 bp, Artificial Sequence
  Synthetic Polynucleotide
taatacgactcactatagggcctcactggaagacccctccaggggtctggaacagaggagaccagacatgtggaggggtaacctggcggcagcgcaaaagatg

SEQ ID NO: 129415 - DNA, 103 bp, Artificial Sequence
  Synthetic Polynucleotide
taatacgactcactatagggggggggctgtcctcactggaagacccctccaacagaggagaggagggatgttccagtgaaacctggcggcagcgcaaaagatg

SEQ ID NO: 129416 - DNA, 103 bp, Artificial Sequence
  Synthetic Polynucleotide
taatacgactcactatagggctgcccctcgggggggctgtcctcactggaaacagaggagatccagtatggacagccccaacctggcggcagcgcaaaagatg

SEQ ID NO: 129417 - DNA, 103 bp, Artificial Sequence
  Synthetic Polynucleotide
taatacgactcactatagggaaggaggtgcctgcccctcgggggggctgtaacagaggagaacagccatgccgaggggcaacctggcggcagcgcaaaagatg

SEQ ID NO: 129418 - DNA, 103 bp, Artificial Sequence
  Synthetic Polynucleotide
taatacgactcactataggggggctgtgagaaggaggtgcctgcccctcgaacagaggagacgagggatgggcacctccaacctggcggcagcgcaaaagatg

SEQ ID NO: 129419 - DNA, 103 bp, Artificial Sequence
  Synthetic Polynucleotide
taatacgactcactatagggggtgccccgggggctgtgagaaggaggtgcaacagaggagagcacctatgtctcacagcaacctggcggcagcgcaaaagatg

SEQ ID NO: 129420 - DNA, 103 bp, Artificial Sequence
  Synthetic Polynucleotide
taatacgactcactatagggcgcgcctcttggtgccccgggggctgtgagaacagaggagactcacaatgcccggggcaaacctggcggcagcgcaaaagatg

SEQ ID NO: 129421 - DNA, 103 bp, Artificial Sequence
  Synthetic Polynucleotide
taatacgactcactataggggcccagctggcgcgcctcttggtgccccggaacagaggagaccggggatgcaagaggcgaacctggcggcagcgcaaaagatg

SEQ ID NO: 129422 - DNA, 103 bp, Artificial Sequence
  Synthetic Polynucleotide
taatacgactcactatagggattctcactggcccagctggcgcgcctcttaacagaggagaaagaggatggccagctggaacctggcggcagcgcaaaagatg

SEQ ID NO: 129423 - DNA, 103 bp, Artificial Sequence
  Synthetic Polynucleotide
taatacgactcactatagggggagctccccttgccacctggaccggcctaaacagaggagataggccatgccaggtggcaacctggcggcagcgcaaaagatg

SEQ ID NO: 129424 - DNA, 103 bp, Artificial Sequence
  Synthetic Polynucleotide
taatacgactcactatagggcggtctccccattctcactggcccagctggaacagaggagaccagctatgccagtgagaaacctggcggcagcgcaaaagatg

SEQ ID NO: 129425 - DNA, 103 bp, Artificial Sequence
  Synthetic Polynucleotide
taatacgactcactatagggccctcggcgtcggtctccccattctcactgaacagaggagacagtgaatgtggggagacaacctggcggcagcgcaaaagatg

SEQ ID NO: 129426 - DNA, 103 bp, Artificial Sequence
  Synthetic Polynucleotide
taatacgactcactatagggcatctgggtgccctcggcgtcggtctccccaacagaggagaggggagatggacgccgagaacctggcggcagcgcaaaagatg

SEQ ID NO: 129427 - DNA, 103 bp, Artificial Sequence
  Synthetic Polynucleotide
taatacgactcactatagggtggcaggggtcatctgggtgccctcggcgtaacagaggagaacgccgatggcacccagaaacctggcggcagcgcaaaagatg

SEQ ID NO: 129428 - DNA, 103 bp, Artificial Sequence
  Synthetic Polynucleotide
taatacgactcactataggggctggcctcttggcaggggtcatctgggtgaacagaggagacacccaatggacccctgcaacctggcggcagcgcaaaagatg

SEQ ID NO: 129429 - DNA, 103 bp, Artificial Sequence
  Synthetic Polynucleotide
taatacgactcactataggggtcctggagcgctggcctcttggcaggggtaacagaggagaacccctatgaagaggccaaacctggcggcagcgcaaaagatg

SEQ ID NO: 129430 - DNA, 103 bp, Artificial Sequence
  Synthetic Polynucleotide
taatacgactcactatagggccaaatttgagtcctggagcgctggcctctaacagaggagaagaggcatgcgctccaggaacctggcggcagcgcaaaagatg

SEQ ID NO: 129431 - DNA, 103 bp, Artificial Sequence
  Synthetic Polynucleotide
taatacgactcactatagggaggctgggggccaaatttgagtcctggagcaacagaggagagctccaatgctcaaatttaacctggcggcagcgcaaaagatg

SEQ ID NO: 129432 - DNA, 103 bp, Artificial Sequence
  Synthetic Polynucleotide
taatacgactcactatagggtccgggcccaaggctgggggccaaatttgaaacagaggagatcaaatatggcccccagcaacctggcggcagcgcaaaagatg

SEQ ID NO: 129433 - DNA, 103 bp, Artificial Sequence
  Synthetic Polynucleotide
taatacgactcactatagggcatcttcagctccgggcccaaggctgggggaacagaggagacccccaatgttgggcccgaacctggcggcagcgcaaaagatg

SEQ ID NO: 129434 - DNA, 103 bp, Artificial Sequence
  Synthetic Polynucleotide
taatacgactcactatagggaggtctcgctggagctccccttgccacctgaacagaggagacaggtgatgaggggagctaacctggcggcagcgcaaaagatg

SEQ ID NO: 129435 - DNA, 103 bp, Artificial Sequence
  Synthetic Polynucleotide
taatacgactcactataggggcttctgccccatcttcagctccgggcccaaacagaggagatgggccatgagctgaagaaacctggcggcagcgcaaaagatg

SEQ ID NO: 129436 - DNA, 103 bp, Artificial Sequence
  Synthetic Polynucleotide
taatacgactcactatagggtggggcctgggcttctgccccatcttcagcaacagaggagagctgaaatgggggcagaaaacctggcggcagcgcaaaagatg

SEQ ID NO: 129437 - DNA, 103 bp, Artificial Sequence
  Synthetic Polynucleotide
taatacgactcactatagggggggtggagatggggcctgggcttctgcccaacagaggagagggcagatgcccaggcccaacctggcggcagcgcaaaagatg

SEQ ID NO: 129438 - DNA, 103 bp, Artificial Sequence
  Synthetic Polynucleotide
taatacgactcactatagggtcaagagctgggggtggagatggggcctggaacagaggagaccaggcatgatctccaccaacctggcggcagcgcaaaagatg

SEQ ID NO: 129439 - DNA, 103 bp, Artificial Sequence
  Synthetic Polynucleotide
taatacgactcactatagggagcggtgtcttcaagagctgggggtggagaaacagaggagatctccaatgccagctcttaacctggcggcagcgcaaaagatg

SEQ ID NO: 129440 - DNA, 103 bp, Artificial Sequence
  Synthetic Polynucleotide
taatacgactcactatagggctcccgctgcagcggtgtcttcaagagctgaacagaggagacagctcatgaagacaccgaacctggcggcagcgcaaaagatg

SEQ ID NO: 129441 - DNA, 103 bp, Artificial Sequence
  Synthetic Polynucleotide
taatacgactcactatagggtcctgtgctgctcccgctgcagcggtgtctaacagaggagaagacacatgtgcagcgggaacctggcggcagcgcaaaagatg

SEQ ID NO: 129442 - DNA, 103 bp, Artificial Sequence
  Synthetic Polynucleotide
taatacgactcactatagggctcttggtcttcctgtgctgctcccgctgcaacagaggagagcagcgatggcagcacagaacctggcggcagcgcaaaagatg

SEQ ID NO: 129443 - DNA, 103 bp, Artificial Sequence
  Synthetic Polynucleotide
taatacgactcactatagggcaccgacaccctcttggtcttcctgtgctgaacagaggagacagcacatgaagaccaagaacctggcggcagcgcaaaagatg

SEQ ID NO: 129444 - DNA, 103 bp, Artificial Sequence
  Synthetic Polynucleotide
taatacgactcactataggggaactgaactcaccgacaccctcttggtctaacagaggagaagaccaatggggtgtcggaacctggcggcagcgcaaaagatg

SEQ ID NO: 129445 - DNA, 103 bp, Artificial Sequence
  Synthetic Polynucleotide
taatacgactcactatagggagtggtgtgaaggtctcgctggagctccccaacagaggagaggggagatgcagcgagacaacctggcggcagcgcaaaagatg

SEQ ID NO: 129446 - DNA, 103 bp, Artificial Sequence
  Synthetic Polynucleotide
taatacgactcactatagggttggcctggggaactgaactcaccgacaccaacagaggagaggtgtcatggagttcagtaacctggcggcagcgcaaaagatg

SEQ ID NO: 129447 - DNA, 103 bp, Artificial Sequence
  Synthetic Polynucleotide
taatacgactcactatagggtcagctgctcttggcctggggaactgaactaacagaggagaagttcaatgccccaggccaacctggcggcagcgcaaaagatg

SEQ ID NO: 129448 - DNA, 103 bp, Artificial Sequence
  Synthetic Polynucleotide
taatacgactcactataggggcctggccgctcagctgctcttggcctgggaacagaggagacccaggatgagagcagctaacctggcggcagcgcaaaagatg

SEQ ID NO: 129449 - DNA, 103 bp, Artificial Sequence
  Synthetic Polynucleotide
taatacgactcactatagggtggaggctgcgcctggccgctcagctgctcaacagaggagagagcagatgagcggccagaacctggcggcagcgcaaaagatg

SEQ ID NO: 129450 - DNA, 103 bp, Artificial Sequence
  Synthetic Polynucleotide
taatacgactcactatagggcagagccctctggaggctgcgcctggccgcaacagaggagagcggccatgcgcagcctcaacctggcggcagcgcaaaagatg

SEQ ID NO: 129451 - DNA, 103 bp, Artificial Sequence
  Synthetic Polynucleotide
taatacgactcactatagggctggggtcttcagagccctctggaggctgcaacagaggagagcagccatgagagggctcaacctggcggcagcgcaaaagatg

SEQ ID NO: 129452 - DNA, 103 bp, Artificial Sequence
  Synthetic Polynucleotide
taatacgactcactatagggtgtgaaccctctggggtcttcagagccctcaacagaggagagagggcatggaagaccccaacctggcggcagcgcaaaagatg

SEQ ID NO: 129453 - DNA, 103 bp, Artificial Sequence
  Synthetic Polynucleotide
taatacgactcactatagggcgaaactctctgtgaaccctctggggtcttaacagaggagaaagaccatggagggttcaaacctggcggcagcgcaaaagatg

SEQ ID NO: 129454 - DNA, 103 bp, Artificial Sequence
  Synthetic Polynucleotide
taatacgactcactatagggttggcagctccgaaactctctgtgaaccctaacagaggagaagggttatgagagagtttaacctggcggcagcgcaaaagatg

SEQ ID NO: 129455 - DNA, 103 bp, Artificial Sequence
  Synthetic Polynucleotide
taatacgactcactatagggctgggagatgttggcagctccgaaactctcaacagaggagagagagtatgggagctgccaacctggcggcagcgcaaaagatg

SEQ ID NO: 129456 - DNA, 103 bp, Artificial Sequence
  Synthetic Polynucleotide
taatacgactcactatagggccttgaaagcagtggtgtgaaggtctcgctaacagaggagaagcgagatgttcacaccaaacctggcggcagcgcaaaagatg

SEQ ID NO: 129457 - DNA, 103 bp, Artificial Sequence
  Synthetic Polynucleotide
taatacgactcactatagggcccgtgctgcctgggagatgttggcagctcaacagaggagagagctgatgacatctcccaacctggcggcagcgcaaaagatg

SEQ ID NO: 129458 - DNA, 103 bp, Artificial Sequence
  Synthetic Polynucleotide
taatacgactcactatagggcagtccctttcccgtgctgcctgggagatgaacagaggagacatctcatgggcagcacgaacctggcggcagcgcaaaagatg

SEQ ID NO: 129459 - DNA, 103 bp, Artificial Sequence
  Synthetic Polynucleotide
taatacgactcactataggggacactctcacagtccctttcccgtgctgcaacagaggagagcagcaatggaaagggacaacctggcggcagcgcaaaagatg

SEQ ID NO: 129460 - DNA, 103 bp, Artificial Sequence
  Synthetic Polynucleotide
taatacgactcactatagggcgatgaagcagacactctcacagtccctttaacagaggagaaaagggatggtgagagtgaacctggcggcagcgcaaaagatg

SEQ ID NO: 129461 - DNA, 103 bp, Artificial Sequence
  Synthetic Polynucleotide
taatacgactcactatagggcacggccggccgatgaagcagacactctcaaacagaggagatgagagatgctgcttcataacctggcggcagcgcaaaagatg

SEQ ID NO: 129462 - DNA, 103 bp, Artificial Sequence
  Synthetic Polynucleotide
taatacgactcactatagggcacgacacgccacggccggccgatgaagcaaacagaggagatgcttcatgggccggccgaacctggcggcagcgcaaaagatg

SEQ ID NO: 129463 - DNA, 103 bp, Artificial Sequence
  Synthetic Polynucleotide
taatacgactcactatagggggtggccatccacgacacgccacggccggcaacagaggagagccggcatgggcgtgtcgaacctggcggcagcgcaaaagatg

SEQ ID NO: 129464 - DNA, 103 bp, Artificial Sequence
  Synthetic Polynucleotide
taatacgactcactatagggggaaggttcaggtggccatccacgacacgcaacagaggagagcgtgtatgggatggccaaacctggcggcagcgcaaaagatg

SEQ ID NO: 129465 - DNA, 103 bp, Artificial Sequence
  Synthetic Polynucleotide
taatacgactcactatagggcttgcatacaggaaggttcaggtggccatcaacagaggagagatggcatgctgaaccttaacctggcggcagcgcaaaagatg

SEQ ID NO: 129466 - DNA, 103 bp, Artificial Sequence
  Synthetic Polynucleotide
taatacgactcactatagggccatcatacccttgcatacaggaaggttcaaacagaggagatgaaccatgctgtatgcaaacctggcggcagcgcaaaagatg

SEQ ID NO: 129467 - DNA, 103 bp, Artificial Sequence
  Synthetic Polynucleotide
taatacgactcactatagggcggctccacagcgctggcagacacaggccaaacagaggagatggcctatgtctgccagcaacctggcggcagcgcaaaagatg

SEQ ID NO: 129468 - DNA, 103 bp, Artificial Sequence
  Synthetic Polynucleotide
taatacgactcactatagggccagcatcaaccttgaaagcagtggtgtgaaacagaggagatcacacatgtgctttcaaaacctggcggcagcgcaaaagatg

SEQ ID NO: 129469 - DNA, 103 bp, Artificial Sequence
  Synthetic Polynucleotide
taatacgactcactatagggagcatggcctccatcatacccttgcatacaaacagaggagatgtatgatggggtatgataacctggcggcagcgcaaaagatg

SEQ ID NO: 129470 - DNA, 103 bp, Artificial Sequence
  Synthetic Polynucleotide
taatacgactcactataggggatgtggtacagcatggcctccatcataccaacagaggagaggtatgatggaggccatgaacctggcggcagcgcaaaagatg

SEQ ID NO: 129471 - DNA, 103 bp, Artificial Sequence
  Synthetic Polynucleotide
taatacgactcactataggggcctggtcatgatgtggtacagcatggcctaacagaggagaaggccaatgtgtaccacaaacctggcggcagcgcaaaagatg

SEQ ID NO: 129472 - DNA, 103 bp, Artificial Sequence
  Synthetic Polynucleotide
taatacgactcactataggggggatgccaggcctggtcatgatgtggtacaacagaggagagtaccaatgcatgaccagaacctggcggcagcgcaaaagatg

SEQ ID NO: 129473 - DNA, 103 bp, Artificial Sequence
  Synthetic Polynucleotide
taatacgactcactatagggggagctctcggggatgccaggcctggtcataacagaggagaatgaccatgcctggcatcaacctggcggcagcgcaaaagatg

SEQ ID NO: 129474 - DNA, 103 bp, Artificial Sequence
  Synthetic Polynucleotide
taatacgactcactatagggggcgcagcagggagctctcggggatgccagaacagaggagactggcaatgccgagagctaacctggcggcagcgcaaaagatg

SEQ ID NO: 129475 - DNA, 103 bp, Artificial Sequence
  Synthetic Polynucleotide
taatacgactcactatagggccctggtagtggcgcagcagggagctctcgaacagaggagacgagagatgcctgctgcgaacctggcggcagcgcaaaagatg

SEQ ID NO: 129476 - DNA, 103 bp, Artificial Sequence
  Synthetic Polynucleotide
taatacgactcactatagggctgcaggaccccctggtagtggcgcagcagaacagaggagactgctgatgcactaccagaacctggcggcagcgcaaaagatg

SEQ ID NO: 129477 - DNA, 103 bp, Artificial Sequence
  Synthetic Polynucleotide
taatacgactcactatagggcggcgacgggctgcaggaccccctggtagtaacagaggagaactaccatggggtcctgcaacctggcggcagcgcaaaagatg

SEQ ID NO: 129478 - DNA, 103 bp, Artificial Sequence
  Synthetic Polynucleotide
taatacgactcactatagggaactccagcacggcgacgggctgcaggaccaacagaggagaggtcctatggcccgtcgcaacctggcggcagcgcaaaagatg

SEQ ID NO: 129479 - DNA, 103 bp, Artificial Sequence
  Synthetic Polynucleotide
taatacgactcactataggggtgcagcttcccagcatcaaccttgaaagcaacagaggagagctttcatggttgatgctaacctggcggcagcgcaaaagatg

SEQ ID NO: 129480 - DNA, 103 bp, Artificial Sequence
  Synthetic Polynucleotide
taatacgactcactataggggccctggagcaactccagcacggcgacgggaacagaggagacccgtcatggtgctggagaacctggcggcagcgcaaaagatg

SEQ ID NO: 129481 - DNA, 103 bp, Artificial Sequence
  Synthetic Polynucleotide
taatacgactcactataggggggactccaggccctggagcaactccagcaaacagaggagatgctggatgtgctccaggaacctggcggcagcgcaaaagatg

SEQ ID NO: 129482 - DNA, 103 bp, Artificial Sequence
  Synthetic Polynucleotide
taatacgactcactatagggatgcagccgagggactccaggccctggagcaacagaggagagctccaatgcctggagtcaacctggcggcagcgcaaaagatg

SEQ ID NO: 129483 - DNA, 103 bp, Artificial Sequence
  Synthetic Polynucleotide
taatacgactcactataggggcgcttccggatgcagccgagggactccagaacagaggagactggagatgctcggctgcaacctggcggcagcgcaaaagatg

SEQ ID NO: 129484 - DNA, 103 bp, Artificial Sequence
  Synthetic Polynucleotide
taatacgactcactatagggttctcagccagcgcttccggatgcagccgaaacagaggagatcggctatgtccggaagcaacctggcggcagcgcaaaagatg

SEQ ID NO: 129485 - DNA, 103 bp, Artificial Sequence
  Synthetic Polynucleotide
taatacgactcactatagggggccttggctttctcagccagcgcttccggaacagaggagaccggaaatgctggctgagaacctggcggcagcgcaaaagatg

SEQ ID NO: 129486 - DNA, 103 bp, Artificial Sequence
  Synthetic Polynucleotide
taatacgactcactataggggagcgagacaggccttggctttctcagccaaacagaggagatggctgatgaagccaaggaacctggcggcagcgcaaaagatg

SEQ ID NO: 129487 - DNA, 103 bp, Artificial Sequence
  Synthetic Polynucleotide
taatacgactcactataggggtgtagagaagagcgagacaggccttggctaacagaggagaagccaaatgctgtctcgcaacctggcggcagcgcaaaagatg

SEQ ID NO: 129488 - DNA, 103 bp, Artificial Sequence
  Synthetic Polynucleotide
taatacgactcactatagggtccaccacgggtgtagagaagagcgagacaaacagaggagatgtctcatgcttctctacaacctggcggcagcgcaaaagatg

SEQ ID NO: 129489 - DNA, 103 bp, Artificial Sequence
  Synthetic Polynucleotide
taatacgactcactatagggttccacctcttccaccacgggtgtagagaaaacagaggagattctctatgcccgtggtgaacctggcggcagcgcaaaagatg

SEQ ID NO: 129490 - DNA, 103 bp, Artificial Sequence
  Synthetic Polynucleotide
taatacgactcactatagggttctgtgatagtgcagcttcccagcatcaaaacagaggagattgatgatgggaagctgcaacctggcggcagcgcaaaagatg

SEQ ID NO: 129491 - DNA, 103 bp, Artificial Sequence
  Synthetic Polynucleotide
taatacgactcactatagggtggagggcacttccacctcttccaccacggaacagaggagaccgtggatgaagaggtggaacctggcggcagcgcaaaagatg

SEQ ID NO: 129492 - DNA, 103 bp, Artificial Sequence
  Synthetic Polynucleotide
taatacgactcactatagggtcgtccaggctggagggcacttccacctctaacagaggagaagaggtatgagtgccctcaacctggcggcagcgcaaaagatg

SEQ ID NO: 129493 - DNA, 103 bp, Artificial Sequence
  Synthetic Polynucleotide
taatacgactcactatagggcatggggctctcgtccaggctggagggcacaacagaggagagtgcccatgagcctggacaacctggcggcagcgcaaaagatg

SEQ ID NO: 129494 - DNA, 103 bp, Artificial Sequence
  Synthetic Polynucleotide
taatacgactcactatagggcatagaaagccatggggctctcgtccaggcaacagaggagagcctggatgagagccccaaacctggcggcagcgcaaaagatg

SEQ ID NO: 129495 - DNA, 103 bp, Artificial Sequence
  Synthetic Polynucleotide
taatacgactcactatagggaaggtgggctcatagaaagccatggggctcaacagaggagagagcccatgggctttctaaacctggcggcagcgcaaaagatg

SEQ ID NO: 129496 - DNA, 103 bp, Artificial Sequence
  Synthetic Polynucleotide
taatacgactcactatagggggtacagtccaaggtgggctcatagaaagcaacagaggagagctttcatggagcccaccaacctggcggcagcgcaaaagatg

SEQ ID NO: 129497 - DNA, 103 bp, Artificial Sequence
  Synthetic Polynucleotide
taatacgactcactatagggccagccggagggtacagtccaaggtgggctaacagaggagaagcccaatgtggactgtaaacctggcggcagcgcaaaagatg

SEQ ID NO: 129498 - DNA, 103 bp, Artificial Sequence
  Synthetic Polynucleotide
taatacgactcactatagggaacacacggcccagccggagggtacagtccaacagaggagaggactgatgcctccggctaacctggcggcagcgcaaaagatg

SEQ ID NO: 129499 - DNA, 103 bp, Artificial Sequence
  Synthetic Polynucleotide
taatacgactcactatagggctcgtgggggaacacacggcccagccggagaacagaggagactccggatgggccgtgtgaacctggcggcagcgcaaaagatg

SEQ ID NO: 129500 - DNA, 103 bp, Artificial Sequence
  Synthetic Polynucleotide
taatacgactcactatagggtccagttgacctcgtgggggaacacacggcaacagaggagagccgtgatgtcccccacgaacctggcggcagcgcaaaagatg

SEQ ID NO: 129501 - DNA, 103 bp, Artificial Sequence
  Synthetic Polynucleotide
taatacgactcactatagggttcaaaatttttctgtgatagtgcagcttcaacagaggagagaagctatgctatcacagaacctggcggcagcgcaaaagatg

SEQ ID NO: 129502 - DNA, 103 bp, Artificial Sequence
  Synthetic Polynucleotide
taatacgactcactatagggatccacttgttccagttgacctcgtgggggaacagaggagacccccaatgggtcaactgaacctggcggcagcgcaaaagatg

SEQ ID NO: 129503 - DNA, 103 bp, Artificial Sequence
  Synthetic Polynucleotide
taatacgactcactatagggctagaggtggatccacttgttccagttgacaacagaggagagtcaacatgaacaagtggaacctggcggcagcgcaaaagatg

SEQ ID NO: 129504 - DNA, 103 bp, Artificial Sequence
  Synthetic Polynucleotide
taatacgactcactatagggcccgtttttgttcaaaatttttctgtgataaacagaggagatatcacatgaaaattttgaacctggcggcagcgcaaaagatg

SEQ ID NO: 129505 - DNA, 103 bp, Artificial Sequence
  Synthetic Polynucleotide
taatacgactcactatagggttgtaatcagcccgtttttgttcaaaatttaacagaggagaaaatttatgacaaaaacgaacctggcggcagcgcaaaagatg

SEQ ID NO: 129506 - DNA, 103 bp, Artificial Sequence
  Synthetic Polynucleotide
taatacgactcactatagggtgggactgcattgtaatcagcccgtttttgaacagaggagacaaaaaatggctgattacaacctggcggcagcgcaaaagatg

SEQ ID NO: 129507 - DNA, 103 bp, Artificial Sequence
  Synthetic Polynucleotide
taatacgactcactatagggtcggatcacatgggactgcattgtaatcagaacagaggagactgattatgatgcagtccaacctggcggcagcgcaaaagatg

SEQ ID NO: 129508 - DNA, 103 bp, Artificial Sequence
  Synthetic Polynucleotide
taatacgactcactatagggcagtgggtaatcggatcacatgggactgcaaacagaggagatgcagtatgatgtgatccaacctggcggcagcgcaaaagatg

SEQ ID NO: 129509 - DNA, 103 bp, Artificial Sequence
  Synthetic Polynucleotide
taatacgactcactatagggtgctgggctccagtgggtaatcggatcacaaacagaggagatgtgatatgattacccacaacctggcggcagcgcaaaagatg

SEQ ID NO: 129510 - DNA, 103 bp, Artificial Sequence
  Synthetic Polynucleotide
taatacgactcactatagggcgtctccagccggctccacagcgctggcagaacagaggagactgccaatgctgtggagcaacctggcggcagcgcaaaagatg

SEQ ID NO: 129511 - DNA, 103 bp, Artificial Sequence
  Synthetic Polynucleotide
taatacgactcactataggggattgagtgttgctgggctccagtgggtaaaacagaggagattacccatgggagcccagaacctggcggcagcgcaaaagatg

SEQ ID NO: 129512 - DNA, 103 bp, Artificial Sequence
  Synthetic Polynucleotide
taatacgactcactataggggtaggaggaggattgagtgttgctgggctcaacagaggagagagcccatgaacactcaaaacctggcggcagcgcaaaagatg

SEQ ID NO: 129513 - DNA, 103 bp, Artificial Sequence
  Synthetic Polynucleotide
taatacgactcactatagggaaccggttcagtaggaggaggattgagtgtaacagaggagaacactcatgcctcctcctaacctggcggcagcgcaaaagatg

SEQ ID NO: 129514 - DNA, 103 bp, Artificial Sequence
  Synthetic Polynucleotide
taatacgactcactataggggtccacatgaaaccggttcagtaggaggagaacagaggagactcctcatgctgaaccggaacctggcggcagcgcaaaagatg

SEQ ID NO: 129515 - DNA, 103 bp, Artificial Sequence
  Synthetic Polynucleotide
taatacgactcactatagggtgctcctcctgtccacatgaaaccggttcaaacagaggagatgaaccatgttcatgtggaacctggcggcagcgcaaaagatg

SEQ ID NO: 129516 - DNA, 103 bp, Artificial Sequence
  Synthetic Polynucleotide
taatacgactcactatagggatgtcgtatttgctcctcctgtccacatgaaacagaggagatcatgtatgcaggaggagaacctggcggcagcgcaaaagatg

SEQ ID NO: 129517 - DNA, 103 bp, Artificial Sequence
  Synthetic Polynucleotide
taatacgactcactatagggctccatgaggatgtcgtatttgctcctcctaacagaggagaaggaggatgaaatacgacaacctggcggcagcgcaaaagatg

SEQ ID NO: 129518 - DNA, 103 bp, Artificial Sequence
  Synthetic Polynucleotide
taatacgactcactatagggccgaaagcttctccatgaggatgtcgtattaacagaggagaaatacgatgtcctcatggaacctggcggcagcgcaaaagatg

SEQ ID NO: 129519 - DNA, 103 bp, Artificial Sequence
  Synthetic Polynucleotide
taatacgactcactatagggctcagcatgaccgaaagcttctccatgaggaacagaggagacctcatatggaagctttcaacctggcggcagcgcaaaagatg

SEQ ID NO: 129520 - DNA, 103 bp, Artificial Sequence
  Synthetic Polynucleotide
taatacgactcactatagggagtccgtgtgctcagcatgaccgaaagcttaacagaggagaaagcttatggtcatgctgaacctggcggcagcgcaaaagatg

SEQ ID NO: 129521 - DNA, 103 bp, Artificial Sequence
  Synthetic Polynucleotide
taatacgactcactataggggcggcactcgcgtctccagccggctccacaaacagaggagatgtggaatgggctggagaaacctggcggcagcgcaaaagatg

SEQ ID NO: 129522 - DNA, 103 bp, Artificial Sequence
  Synthetic Polynucleotide
taatacgactcactatagggctatgtggttagtccgtgtgctcagcatgaaacagaggagatcatgcatggcacacggaaacctggcggcagcgcaaaagatg

SEQ ID NO: 129523 - DNA, 103 bp, Artificial Sequence
  Synthetic Polynucleotide
taatacgactcactatagggcccagcgtctctatgtggttagtccgtgtgaacagaggagacacacgatgtaaccacataacctggcggcagcgcaaaagatg

SEQ ID NO: 129524 - DNA, 103 bp, Artificial Sequence
  Synthetic Polynucleotide
taatacgactcactatagggcctcagctttcccagcgtctctatgtggttaacagaggagaaaccacatggagacgctgaacctggcggcagcgcaaaagatg

SEQ ID NO: 129525 - DNA, 103 bp, Artificial Sequence
  Synthetic Polynucleotide
taatacgactcactatagggccagctcttccctcagctttcccagcgtctaacagaggagaagacgcatggaaagctgaaacctggcggcagcgcaaaagatg

SEQ ID NO: 129526 - DNA, 103 bp, Artificial Sequence
  Synthetic Polynucleotide
taatacgactcactatagggtcgcacagccccagctcttccctcagctttaacagaggagaaaagctatgggaagagctaacctggcggcagcgcaaaagatg

SEQ ID NO: 129527 - DNA, 103 bp, Artificial Sequence
  Synthetic Polynucleotide
taatacgactcactatagggaaacgtcctttcgcacagccccagctcttcaacagaggagagaagagatggggctgtgcaacctggcggcagcgcaaaagatg

SEQ ID NO: 129528 - DNA, 103 bp, Artificial Sequence
  Synthetic Polynucleotide
taatacgactcactatagggacagacgcttaaacgtcctttcgcacagccaacagaggagaggctgtatgaaaggacgtaacctggcggcagcgcaaaagatg

SEQ ID NO: 129529 - DNA, 103 bp, Artificial Sequence
  Synthetic Polynucleotide
taatacgactcactatagggatatactggtacagacgcttaaacgtccttaacagaggagaaaggacatgtaagcgtctaacctggcggcagcgcaaaagatg

SEQ ID NO: 129530 - DNA, 103 bp, Artificial Sequence
  Synthetic Polynucleotide
taatacgactcactatagggggcgttcagcatatactggtacagacgcttaacagaggagaaagcgtatgtaccagtataacctggcggcagcgcaaaagatg

SEQ ID NO: 129531 - DNA, 103 bp, Artificial Sequence
  Synthetic Polynucleotide
taatacgactcactatagggtggctagcccggcgttcagcatatactggtaacagaggagaaccagtatgtgctgaacgaacctggcggcagcgcaaaagatg

SEQ ID NO: 129532 - DNA, 103 bp, Artificial Sequence
  Synthetic Polynucleotide
taatacgactcactatagggagcgggaagggcggcactcgcgtctccagcaacagaggagagctggaatggcgagtgccaacctggcggcagcgcaaaagatg

SEQ ID NO: 129533 - DNA, 103 bp, Artificial Sequence
  Synthetic Polynucleotide
taatacgactcactataggggacaccaccttggctagcccggcgttcagcaacagaggagagctgaaatgcgggctagcaacctggcggcagcgcaaaagatg

SEQ ID NO: 129534 - DNA, 103 bp, Artificial Sequence
  Synthetic Polynucleotide
taatacgactcactatagggcaagcgaagagacaccaccttggctagcccaacagaggagagggctaatgaaggtggtgaacctggcggcagcgcaaaagatg

SEQ ID NO: 129535 - DNA, 103 bp, Artificial Sequence
  Synthetic Polynucleotide
taatacgactcactatagggggatctcttgcaagcgaagagacaccacctaacagaggagaaggtggatgctcttcgctaacctggcggcagcgcaaaagatg

SEQ ID NO: 129536 - DNA, 103 bp, Artificial Sequence
  Synthetic Polynucleotide
taatacgactcactatagggcattcagggtggatctcttgcaagcgaagaaacagaggagatcttcgatggcaagagataacctggcggcagcgcaaaagatg

SEQ ID NO: 129537 - DNA, 103 bp, Artificial Sequence
  Synthetic Polynucleotide
taatacgactcactatagggacaaggtccacattcagggtggatctcttgaacagaggagacaagagatgcaccctgaaaacctggcggcagcgcaaaagatg

SEQ ID NO: 129538 - DNA, 103 bp, Artificial Sequence
  Synthetic Polynucleotide
taatacgactcactatagggtctttgtcttacaaggtccacattcagggtaacagaggagaaccctgatggtggaccttaacctggcggcagcgcaaaagatg

SEQ ID NO: 129539 - DNA, 103 bp, Artificial Sequence
  Synthetic Polynucleotide
taatacgactcactatagggtcggtccctttctttgtcttacaaggtccaaacagaggagatggaccatgtaagacaaaaacctggcggcagcgcaaaagatg

SEQ ID NO: 129540 - DNA, 103 bp, Artificial Sequence
  Synthetic Polynucleotide
taatacgactcactatagggaaccatgacgtcggtccctttctttgtcttaacagaggagaaagacaatgaaagggaccaacctggcggcagcgcaaaagatg

SEQ ID NO: 129541 - DNA, 103 bp, Artificial Sequence
  Synthetic Polynucleotide
taatacgactcactatagggtgaggcaccgaaccatgacgtcggtcccttaacagaggagaaagggaatgacgtcatggaacctggcggcagcgcaaaagatg

SEQ ID NO: 129542 - DNA, 103 bp, Artificial Sequence
  Synthetic Polynucleotide
taatacgactcactatagggttcagcagcttgaggcaccgaaccatgacgaacagaggagacgtcatatgtcggtgcctaacctggcggcagcgcaaaagatg

SEQ ID NO: 129543 - DNA, 103 bp, Artificial Sequence
  Synthetic Polynucleotide
taatacgactcactatagggggattccagcagaactgcaccgctttccataacagaggagaatggaaatgggtgcagttaacctggcggcagcgcaaaagatg

SEQ ID NO: 129544 - DNA, 103 bp, Artificial Sequence
  Synthetic Polynucleotide
taatacgactcactatagggctgatactccacgctgactgtcacgtcacaaacagaggagatgtgacatgacagtcagcaacctggcggcagcgcaaaagatg

SEQ ID NO: 129545 - DNA, 103 bp, Artificial Sequence
  Synthetic Polynucleotide
taatacgactcactataggggtggcggtgcttgctgtgcttcaggaagctaacagaggagaagcttcatgaagcacagcaacctggcggcagcgcaaaagatg

SEQ ID NO: 129546 - DNA, 103 bp, Artificial Sequence
  Synthetic Polynucleotide
taatacgactcactatagggtggccacgccgtggcggtgcttgctgtgctaacagaggagaagcacaatgagcaccgccaacctggcggcagcgcaaaagatg

SEQ ID NO: 129547 - DNA, 103 bp, Artificial Sequence
  Synthetic Polynucleotide
taatacgactcactatagggaccacctcggtggccacgccgtggcggtgcaacagaggagagcaccgatgcggcgtggcaacctggcggcagcgcaaaagatg

SEQ ID NO: 129548 - DNA, 103 bp, Artificial Sequence
  Synthetic Polynucleotide
taatacgactcactataggggcagcggtacaccacctcggtggccacgccaacagaggagaggcgtgatgaccgaggtgaacctggcggcagcgcaaaagatg

SEQ ID NO: 129549 - DNA, 103 bp, Artificial Sequence
  Synthetic Polynucleotide
taatacgactcactatagggcgcaggtgtcgcagcggtacaccacctcggaacagaggagaccgaggatgtgtaccgctaacctggcggcagcgcaaaagatg

SEQ ID NO: 129550 - DNA, 103 bp, Artificial Sequence
  Synthetic Polynucleotide
taatacgactcactatagggaaggtctggccgcaggtgtcgcagcggtacaacagaggagagtaccgatgcgacacctgaacctggcggcagcgcaaaagatg

SEQ ID NO: 129551 - DNA, 103 bp, Artificial Sequence
  Synthetic Polynucleotide
taatacgactcactataggggcggttggcgaaggtctggccgcaggtgtcaacagaggagagacaccatgggccagaccaacctggcggcagcgcaaaagatg

SEQ ID NO: 129552 - DNA, 103 bp, Artificial Sequence
  Synthetic Polynucleotide
taatacgactcactatagggtcaggttgcagcggttggcgaaggtctggcaacagaggagagccagaatgtcgccaaccaacctggcggcagcgcaaaagatg

SEQ ID NO: 129553 - DNA, 103 bp, Artificial Sequence
  Synthetic Polynucleotide
taatacgactcactatagggtggtggctcttcaggttgcagcggttggcgaacagaggagacgccaaatgctgcaacctaacctggcggcagcgcaaaagatg

SEQ ID NO: 129554 - DNA, 103 bp, Artificial Sequence
  Synthetic Polynucleotide
taatacgactcactatagggcacgtggcgctggtggctcttcaggttgcaaacagaggagatgcaacatgaagagccacaacctggcggcagcgcaaaagatg

SEQ ID NO: 129555 - DNA, 103 bp, Artificial Sequence
  Synthetic Polynucleotide
taatacgactcactatagggtgcggacaccctgatactccacgctgactgaacagaggagacagtcaatgtggagtatcaacctggcggcagcgcaaaagatg

SEQ ID NO: 129556 - DNA, 103 bp, Artificial Sequence
  Synthetic Polynucleotide
taatacgactcactatagggcgctgctgtgcacgtggcgctggtggctctaacagaggagaagagccatgagcgccacgaacctggcggcagcgcaaaagatg

SEQ ID NO: 129557 - DNA, 103 bp, Artificial Sequence
  Synthetic Polynucleotide
taatacgactcactatagggaaatggcgctcgctgctgtgcacgtggcgcaacagaggagagcgccaatggcacagcagaacctggcggcagcgcaaaagatg

SEQ ID NO: 129558 - DNA, 103 bp, Artificial Sequence
  Synthetic Polynucleotide
taatacgactcactatagggctcgcatgggaaatggcgctcgctgctgtgaacagaggagacacagcatggagcgccataacctggcggcagcgcaaaagatg

SEQ ID NO: 129559 - DNA, 103 bp, Artificial Sequence
  Synthetic Polynucleotide
taatacgactcactatagggtcccgcacagctcgcatgggaaatggcgctaacagaggagaagcgccatgtcccatgcgaacctggcggcagcgcaaaagatg

SEQ ID NO: 129560 - DNA, 103 bp, Artificial Sequence
  Synthetic Polynucleotide
taatacgactcactatagggttgaacttcttcccgcacagctcgcatgggaacagaggagacccatgatggctgtgcggaacctggcggcagcgcaaaagatg

SEQ ID NO: 129561 - DNA, 103 bp, Artificial Sequence
  Synthetic Polynucleotide
taatacgactcactatagggcttcttgcgcttgaacttcttcccgcacagaacagaggagactgtgcatgaagaagttcaacctggcggcagcgcaaaagatg

SEQ ID NO: 129562 - DNA, 103 bp, Artificial Sequence
  Synthetic Polynucleotide
taatacgactcactataggggcttcacgtccttcttgcgcttgaacttctaacagaggagaagaagtatgagcgcaagaaacctggcggcagcgcaaaagatg

SEQ ID NO: 129563 - DNA, 103 bp, Artificial Sequence
  Synthetic Polynucleotide
taatacgactcactatagggagcacgtgccgcttcacgtccttcttgcgcaacagaggagagcgcaaatgggacgtgaaaacctggcggcagcgcaaaagatg

SEQ ID NO: 129564 - DNA, 103 bp, Artificial Sequence
  Synthetic Polynucleotide
taatacgactcactatagggatgcacctgcagcacgtgccgcttcacgtcaacagaggagagacgtgatgcggcacgtgaacctggcggcagcgcaaaagatg

SEQ ID NO: 129565 - DNA, 103 bp, Artificial Sequence
  Synthetic Polynucleotide
taatacgactcactatagggcgccgccctcatgcacctgcagcacgtgccaacagaggagaggcacgatgtgcaggtgcaacctggcggcagcgcaaaagatg

SEQ ID NO: 129566 - DNA, 103 bp, Artificial Sequence
  Synthetic Polynucleotide
taatacgactcactatagggatgaagtctttgcggacaccctgatactccaacagaggagaggagtaatggggtgtccgaacctggcggcagcgcaaaagatg

SEQ ID NO: 129567 - DNA, 103 bp, Artificial Sequence
  Synthetic Polynucleotide
taatacgactcactatagggtgccgctcgccgccgccctcatgcacctgcaacagaggagagcaggtatgtgagggcggaacctggcggcagcgcaaaagatg

SEQ ID NO: 129568 - DNA, 103 bp, Artificial Sequence
  Synthetic Polynucleotide
taatacgactcactataggggccgcagcggtgccgctcgccgccgccctcaacagaggagagagggcatgggcgagcggaacctggcggcagcgcaaaagatg

SEQ ID NO: 129569 - DNA, 103 bp, Artificial Sequence
  Synthetic Polynucleotide
taatacgactcactatagggtgccgcactggccgcagcggtgccgctcgcaacagaggagagcgagcatgaccgctgcgaacctggcggcagcgcaaaagatg

SEQ ID NO: 129570 - DNA, 103 bp, Artificial Sequence
  Synthetic Polynucleotide
taatacgactcactatagggctcaggcccttgccgcactggccgcagcggaacagaggagaccgctgatgccagtgcggaacctggcggcagcgcaaaagatg

SEQ ID NO: 129571 - DNA, 103 bp, Artificial Sequence
  Synthetic Polynucleotide
taatacgactcactatagggtgtcttggaactcaggcccttgccgcactgaacagaggagacagtgcatgaagggcctgaacctggcggcagcgcaaaagatg

SEQ ID NO: 129572 - DNA, 103 bp, Artificial Sequence
  Synthetic Polynucleotide
taatacgactcactataggggccgcagcgctgtcttggaactcaggccctaacagaggagaagggccatggttccaagaaacctggcggcagcgcaaaagatg

SEQ ID NO: 129573 - DNA, 103 bp, Artificial Sequence
  Synthetic Polynucleotide
taatacgactcactatagggcgctcgtgcagccgcagcgctgtcttggaaaacagaggagattccaaatgagcgctgcgaacctggcggcagcgcaaaagatg

SEQ ID NO: 129574 - DNA, 103 bp, Artificial Sequence
  Synthetic Polynucleotide
taatacgactcactatagggcgtgtgtgtgcgctcgtgcagccgcagcgcaacagaggagagcgctgatgctgcacgagaacctggcggcagcgcaaaagatg

SEQ ID NO: 129575 - DNA, 103 bp, Artificial Sequence
  Synthetic Polynucleotide
taatacgactcactataggggccggtctcccgtgtgtgtgcgctcgtgcaaacagaggagatgcacgatggcacacacaaacctggcggcagcgcaaaagatg

SEQ ID NO: 129576 - DNA, 103 bp, Artificial Sequence
  Synthetic Polynucleotide
taatacgactcactatagggcagccgtagggccggtctcccgtgtgtgtgaacagaggagacacacaatggggagaccgaacctggcggcagcgcaaaagatg

SEQ ID NO: 129577 - DNA, 103 bp, Artificial Sequence
  Synthetic Polynucleotide
taatacgactcactatagggcttgtgggccatgaagtctttgcggacaccaacagaggagaggtgtcatgaaagacttcaacctggcggcagcgcaaaagatg

SEQ ID NO: 129578 - DNA, 103 bp, Artificial Sequence
  Synthetic Polynucleotide
taatacgactcactataggggcactcggtgcagccgtagggccggtctccaacagaggagaggagacatgccctacggcaacctggcggcagcgcaaaagatg

SEQ ID NO: 129579 - DNA, 103 bp, Artificial Sequence
  Synthetic Polynucleotide
taatacgactcactatagggacctggcgccgcactcggtgcagccgtaggaacagaggagacctacgatggcaccgagtaacctggcggcagcgcaaaagatg

SEQ ID NO: 129580 - DNA, 103 bp, Artificial Sequence
  Synthetic Polynucleotide
taatacgactcactatagggggctgcgagaacctggcgccgcactcggtgaacagaggagacaccgaatgcggcgccagaacctggcggcagcgcaaaagatg

SEQ ID NO: 129581 - DNA, 103 bp, Artificial Sequence
  Synthetic Polynucleotide
taatacgactcactataggggagcgcggacggctgcgagaacctggcgccaacagaggagaggcgccatgttctcgcagaacctggcggcagcgcaaaagatg

SEQ ID NO: 129582 - DNA, 103 bp, Artificial Sequence
  Synthetic Polynucleotide
taatacgactcactatagggtgtgcgtcttgagcgcggacggctgcgagaaacagaggagatctcgcatgcgtccgcgcaacctggcggcagcgcaaaagatg

SEQ ID NO: 129583 - DNA, 103 bp, Artificial Sequence
  Synthetic Polynucleotide
taatacgactcactatagggtgaattctcatgtgcgtcttgagcgcggacaacagaggagagtccgcatgcaagacgcaaacctggcggcagcgcaaaagatg

SEQ ID NO: 129584 - DNA, 103 bp, Artificial Sequence
  Synthetic Polynucleotide
taatacgactcactatagggttcccctgtatgaattctcatgtgcgtcttaacagaggagaaagacgatgatgagaattaacctggcggcagcgcaaaagatg

SEQ ID NO: 129585 - DNA, 103 bp, Artificial Sequence
  Synthetic Polynucleotide
taatacgactcactatagggcaaaaggtttttcccctgtatgaattctcaaacagaggagatgagaaatgatacaggggaacctggcggcagcgcaaaagatg

SEQ ID NO: 129586 - DNA, 103 bp, Artificial Sequence
  Synthetic Polynucleotide
taatacgactcactatagggtcatcacagacaaaaggtttttcccctgtaaacagaggagatacaggatgaaaacctttaacctggcggcagcgcaaaagatg

SEQ ID NO: 129587 - DNA, 103 bp, Artificial Sequence
  Synthetic Polynucleotide
taatacgactcactatagggtgcaccacattcatcacagacaaaaggtttaacagaggagaaaacctatggtctgtgataacctggcggcagcgcaaaagatg

SEQ ID NO: 129588 - DNA, 103 bp, Artificial Sequence
  Synthetic Polynucleotide
taatacgactcactatagggccagcactgccttgtgggccatgaagtcttaacagaggagaaagactatgtggcccacaaacctggcggcagcgcaaaagatg

SEQ ID NO: 129589 - DNA, 103 bp, Artificial Sequence
  Synthetic Polynucleotide
taatacgactcactataggggagtgaatcttgcaccacattcatcacagaaacagaggagatctgtgatgaatgtggtgaacctggcggcagcgcaaaagatg

SEQ ID NO: 129590 - DNA, 103 bp, Artificial Sequence
  Synthetic Polynucleotide
taatacgactcactatagggatgtggttctgagtgaatcttgcaccacataacagaggagaatgtggatgaagattcacaacctggcggcagcgcaaaagatg

SEQ ID NO: 129591 - DNA, 103 bp, Artificial Sequence
  Synthetic Polynucleotide
taatacgactcactatagggataaatcagcatgtggttctgagtgaatctaacagaggagaagattcatgcagaaccacaacctggcggcagcgcaaaagatg

SEQ ID NO: 129592 - DNA, 103 bp, Artificial Sequence
  Synthetic Polynucleotide
taatacgactcactatagggaccttttatgataaatcagcatgtggttctaacagaggagaagaaccatgtgctgatttaacctggcggcagcgcaaaagatg

SEQ ID NO: 129593 - DNA, 103 bp, Artificial Sequence
  Synthetic Polynucleotide
taatacgactcactatagggcctgtgtgacaccttttatgataaatcagcaacagaggagagctgatatgtcataaaagaacctggcggcagcgcaaaagatg

SEQ ID NO: 129594 - DNA, 103 bp, Artificial Sequence
  Synthetic Polynucleotide
taatacgactcactatagggaggtctttcacctgtgtgacaccttttatgaacagaggagacataaaatgtgtcacacaaacctggcggcagcgcaaaagatg

SEQ ID NO: 129595 - DNA, 103 bp, Artificial Sequence
  Synthetic Polynucleotide
taatacgactcactatagggcacacataaaaggtctttcacctgtgtgacaacagaggagagtcacaatggtgaaagacaacctggcggcagcgcaaaagatg

SEQ ID NO: 129596 - DNA, 103 bp, Artificial Sequence
  Synthetic Polynucleotide
taatacgactcactatagggccacatgtttcacacataaaaggtctttcaaacagaggagatgaaagatgttttatgtgaacctggcggcagcgcaaaagatg

SEQ ID NO: 129597 - DNA, 103 bp, Artificial Sequence
  Synthetic Polynucleotide
taatacgactcactatagggaaaactcttgccacatgtttcacacataaaaacagaggagatttatgatggaaacatgtaacctggcggcagcgcaaaagatg

SEQ ID NO: 129598 - DNA, 103 bp, Artificial Sequence
  Synthetic Polynucleotide
taatacgactcactatagggccttagaagcaaaactcttgccacatgtttaacagaggagaaaacatatggcaagagttaacctggcggcagcgcaaaagatg

SEQ ID NO: 129599 - DNA, 103 bp, Artificial Sequence
  Synthetic Polynucleotide
taatacgactcactatagggctggtggcagccagcactgccttgtgggccaacagaggagaggcccaatgggcagtgctaacctggcggcagcgcaaaagatg

SEQ ID NO: 129600 - DNA, 103 bp, Artificial Sequence
  Synthetic Polynucleotide
taatacgactcactatagggtttaagtactccttagaagcaaaactcttgaacagaggagacaagagatgtgcttctaaaacctggcggcagcgcaaaagatg

SEQ ID NO: 129601 - DNA, 103 bp, Artificial Sequence
  Synthetic Polynucleotide
taatacgactcactatagggattgtggtgttttaagtactccttagaagcaacagaggagagcttctatggagtacttaaacctggcggcagcgcaaaagatg

SEQ ID NO: 129602 - DNA, 103 bp, Artificial Sequence
  Synthetic Polynucleotide
taatacgactcactatagggtatggattctattgtggtgttttaagtactaacagaggagaagtactatgaacaccacaaacctggcggcagcgcaaaagatg

SEQ ID NO: 129603 - DNA, 103 bp, Artificial Sequence
  Synthetic Polynucleotide
taatacgactcactatagggttggatccagtatggattctattgtggtgtaacagaggagaacaccaatgtagaatccaaacctggcggcagcgcaaaagatg

SEQ ID NO: 129604 - DNA, 103 bp, Artificial Sequence
  Synthetic Polynucleotide
taatacgactcactatagggtttaaagggtttggatccagtatggattctaacagaggagaagaatcatgactggatccaacctggcggcagcgcaaaagatg

SEQ ID NO: 129605 - DNA, 103 bp, Artificial Sequence
  Synthetic Polynucleotide
taatacgactcactatagggatacttcacatttaaagggtttggatccagaacagaggagactggatatgaaccctttaaacctggcggcagcgcaaaagatg

SEQ ID NO: 129606 - DNA, 103 bp, Artificial Sequence
  Synthetic Polynucleotide
taatacgactcactataggggtcctgaaacatacttcacatttaaagggtaacagaggagaacccttatgatgtgaagtaacctggcggcagcgcaaaagatg

SEQ ID NO: 129607 - DNA, 103 bp, Artificial Sequence
  Synthetic Polynucleotide
taatacgactcactatagggctgggcaaaagtcctgaaacatacttcacaaacagaggagatgtgaaatgtgtttcaggaacctggcggcagcgcaaaagatg

SEQ ID NO: 129608 - DNA, 103 bp, Artificial Sequence
  Synthetic Polynucleotide
taatacgactcactataggggtgaattccgctgggcaaaagtcctgaaacaacagaggagagtttcaatgcttttgcccaacctggcggcagcgcaaaagatg

SEQ ID NO: 129609 - DNA, 103 bp, Artificial Sequence
  Synthetic Polynucleotide
taatacgactcactatagggtgctggtacagtgaattccgctgggcaaaaaacagaggagattttgcatggcggaattcaacctggcggcagcgcaaaagatg

SEQ ID NO: 129610 - DNA, 103 bp, Artificial Sequence
  Synthetic Polynucleotide
taatacgactcactatagggaaaaaacttgctggtggcagccagcactgcaacagaggagagcagtgatggctgccaccaacctggcggcagcgcaaaagatg

SEQ ID NO: 129611 - DNA, 103 bp, Artificial Sequence
  Synthetic Polynucleotide
taatacgactcactataggggactttaatatgctggtacagtgaattccgaacagaggagacggaatatgctgtaccagaacctggcggcagcgcaaaagatg

SEQ ID NO: 129612 - DNA, 103 bp, Artificial Sequence
  Synthetic Polynucleotide
taatacgactcactatagggcccctgtgtggactttaatatgctggtacaaacagaggagatgtaccatgatattaaagaacctggcggcagcgcaaaagatg

SEQ ID NO: 129613 - DNA, 103 bp, Artificial Sequence
  Synthetic Polynucleotide
taatacgactcactatagggtagggacgctcccctgtgtggactttaataaacagaggagatattaaatgccacacaggaacctggcggcagcgcaaaagatg

SEQ ID NO: 129614 - DNA, 103 bp, Artificial Sequence
  Synthetic Polynucleotide
taatacgactcactataggggtcacagcagtagggacgctcccctgtgtgaacagaggagacacacaatggagcgtcccaacctggcggcagcgcaaaagatg

SEQ ID NO: 129615 - DNA, 103 bp, Artificial Sequence
  Synthetic Polynucleotide
taatacgactcactatagggtgccgcactggtcacagcagtagggacgctaacagaggagaagcgtcatgactgctgtgaacctggcggcagcgcaaaagatg

SEQ ID NO: 129616 - DNA, 103 bp, Artificial Sequence
  Synthetic Polynucleotide
taatacgactcactataggggtgaactgcttgccgcactggtcacagcagaacagaggagactgctgatgccagtgcggaacctggcggcagcgcaaaagatg

SEQ ID NO: 129617 - DNA, 103 bp, Artificial Sequence
  Synthetic Polynucleotide
taatacgactcactataggggttgagctgggtgaactgcttgccgcactgaacagaggagacagtgcatgaagcagttcaacctggcggcagcgcaaaagatg

SEQ ID NO: 129618 - DNA, 103 bp, Artificial Sequence
  Synthetic Polynucleotide
taatacgactcactataggggctggagggcgttgagctgggtgaactgctaacagaggagaagcagtatgcccagctcaaacctggcggcagcgcaaaagatg

SEQ ID NO: 129619 - DNA, 103 bp, Artificial Sequence
  Synthetic Polynucleotide
taatacgactcactatagggcggcggtggcgctggagggcgttgagctggaacagaggagaccagctatgcgccctccaaacctggcggcagcgcaaaagatg

SEQ ID NO: 129620 - DNA, 103 bp, Artificial Sequence
  Synthetic Polynucleotide
taatacgactcactatagggtgtgtggatgcggcggtggcgctggagggcaacagaggagagccctcatgcgccaccgcaacctggcggcagcgcaaaagatg

SEQ ID NO: 129621 - DNA, 103 bp, Artificial Sequence
  Synthetic Polynucleotide
taatacgactcactatagggacacttccttaaaaaacttgctggtggcagaacagaggagactgccaatggcaagttttaacctggcggcagcgcaaaagatg

SEQ ID NO: 129622 - DNA, 103 bp, Artificial Sequence
  Synthetic Polynucleotide
taatacgactcactataggggcctctcccctgtgtggatgcggcggtggcaacagaggagagccaccatggcatccacaaacctggcggcagcgcaaaagatg

SEQ ID NO: 129623 - DNA, 103 bp, Artificial Sequence
  Synthetic Polynucleotide
taatacgactcactatagggcacatgaatggcctctcccctgtgtggatgaacagaggagacatccaatgaggggagagaacctggcggcagcgcaaaagatg

SEQ ID NO: 129624 - DNA, 103 bp, Artificial Sequence
  Synthetic Polynucleotide
taatacgactcactataggggcacgcattgcacatgaatggcctctccccaacagaggagaggggagatgccattcatgaacctggcggcagcgcaaaagatg

SEQ ID NO: 129625 - DNA, 103 bp, Artificial Sequence
  Synthetic Polynucleotide
taatacgactcactatagggatgtccgtccgcacgcattgcacatgaatgaacagaggagacattcaatggcaatgcgtaacctggcggcagcgcaaaagatg

SEQ ID NO: 129626 - DNA, 103 bp, Artificial Sequence
  Synthetic Polynucleotide
taatacgactcactatagggttgtcggtgaatgtccgtccgcacgcattgaacagaggagacaatgcatgcggacggacaacctggcggcagcgcaaaagatg

SEQ ID NO: 129627 - DNA, 103 bp, Artificial Sequence
  Synthetic Polynucleotide
taatacgactcactatagggaagagtggacttgtcggtgaatgtccgtccaacagaggagaggacggatgttcaccgacaacctggcggcagcgcaaaagatg

SEQ ID NO: 129628 - DNA, 103 bp, Artificial Sequence
  Synthetic Polynucleotide
taatacgactcactatagggtgtgccgccgaagagtggacttgtcggtgaaacagaggagatcaccgatgagtccactcaacctggcggcagcgcaaaagatg

SEQ ID NO: 129629 - DNA, 103 bp, Artificial Sequence
  Synthetic Polynucleotide
taatacgactcactatagggtgtattgaggtgtgccgccgaagagtggacaacagaggagagtccacatgtcggcggcaaacctggcggcagcgcaaaagatg

SEQ ID NO: 129630 - DNA, 103 bp, Artificial Sequence
  Synthetic Polynucleotide
taatacgactcactatagggattcttatcgtgtattgaggtgtgccgccgaacagaggagacggcggatgacctcaataaacctggcggcagcgcaaaagatg

SEQ ID NO: 129631 - DNA, 103 bp, Artificial Sequence
  Synthetic Polynucleotide
taatacgactcactatagggtccatggagtattcttatcgtgtattgaggaacagaggagacctcaaatgacgataagaaacctggcggcagcgcaaaagatg

SEQ ID NO: 129632 - DNA, 103 bp, Artificial Sequence
  Synthetic Polynucleotide
taatacgactcactatagggtcattaaggaacacttccttaaaaaacttgaacagaggagacaagttatgtaaggaagtaacctggcggcagcgcaaaagatg

SEQ ID NO: 129633 - DNA, 103 bp, Artificial Sequence
  Synthetic Polynucleotide
taatacgactcactatagggaggaaagacttccatggagtattcttatcgaacagaggagacgataaatgtactccatgaacctggcggcagcgcaaaagatg

SEQ ID NO: 129634 - DNA, 103 bp, Artificial Sequence
  Synthetic Polynucleotide
taatacgactcactatagggtacaatgacaaggaaagacttccatggagtaacagaggagaactccaatgaagtctttcaacctggcggcagcgcaaaagatg

SEQ ID NO: 129635 - DNA, 103 bp, Artificial Sequence
  Synthetic Polynucleotide
taatacgactcactataggggcgagccatctacaatgacaaggaaagactaacagaggagaagtcttatgttgtcattgaacctggcggcagcgcaaaagatg

SEQ ID NO: 129636 - DNA, 103 bp, Artificial Sequence
  Synthetic Polynucleotide
taatacgactcactatagggtcgttcttgggcgagccatctacaatgacaaacagaggagatgtcatatgagatggctcaacctggcggcagcgcaaaagatg

SEQ ID NO: 129637 - DNA, 103 bp, Artificial Sequence
  Synthetic Polynucleotide
taatacgactcactataggggtgtccgtcatcgttcttgggcgagccatcaacagaggagagatggcatgcccaagaacaacctggcggcagcgcaaaagatg

SEQ ID NO: 129638 - DNA, 103 bp, Artificial Sequence
  Synthetic Polynucleotide
taatacgactcactataggggttcagtcttgtgtccgtcatcgttcttggaacagaggagaccaagaatgatgacggacaacctggcggcagcgcaaaagatg

SEQ ID NO: 129639 - DNA, 103 bp, Artificial Sequence
  Synthetic Polynucleotide
taatacgactcactatagggtcgtcaggctgttcagtcttgtgtccgtcaaacagaggagatgacggatgcaagactgaaacctggcggcagcgcaaaagatg

SEQ ID NO: 129640 - DNA, 103 bp, Artificial Sequence
  Synthetic Polynucleotide
taatacgactcactatagggcacatactcttcgtcaggctgttcagtcttaacagaggagaaagactatgcagcctgacaacctggcggcagcgcaaaagatg

SEQ ID NO: 129641 - DNA, 103 bp, Artificial Sequence
  Synthetic Polynucleotide
taatacgactcactataggggcttggatgacacatactcttcgtcaggctaacagaggagaagcctgatgaagagtatgaacctggcggcagcgcaaaagatg

SEQ ID NO: 129642 - DNA, 103 bp, Artificial Sequence
  Synthetic Polynucleotide
taatacgactcactatagggttatccgaaagcttggatgacacatactctaacagaggagaagagtaatggtcatccaaaacctggcggcagcgcaaaagatg

SEQ ID NO: 129643 - DNA, 103 bp, Artificial Sequence
  Synthetic Polynucleotide
taatacgactcactatagggcacactcttctcattaaggaacacttccttaacagaggagaaaggaaatgttccttaataacctggcggcagcgcaaaagatg

SEQ ID NO: 129644 - DNA, 103 bp, Artificial Sequence
  Synthetic Polynucleotide
taatacgactcactatagggagacagcaatttatccgaaagcttggatgaaacagaggagatcatccatgctttcggataacctggcggcagcgcaaaagatg

SEQ ID NO: 129645 - DNA, 103 bp, Artificial Sequence
  Synthetic Polynucleotide
taatacgactcactatagggtttctgcaaaagacagcaatttatccgaaaaacagaggagatttcggatgaattgctgtaacctggcggcagcgcaaaagatg

SEQ ID NO: 129646 - DNA, 103 bp, Artificial Sequence
  Synthetic Polynucleotide
taatacgactcactatagggaaatggccattttctgcaaaagacagcaataacagaggagaattgctatgttttgcagaaacctggcggcagcgcaaaagatg

SEQ ID NO: 129647 - DNA, 103 bp, Artificial Sequence
  Synthetic Polynucleotide
taatacgactcactatagggcaggttgtggaaatggccattttctgcaaaaacagaggagatttgcaatgaatggccataacctggcggcagcgcaaaagatg

SEQ ID NO: 129648 - DNA, 103 bp, Artificial Sequence
  Synthetic Polynucleotide
taatacgactcactatagggggactgcagccaggttgtggaaatggccataacagaggagaatggccatgtccacaaccaacctggcggcagcgcaaaagatg

SEQ ID NO: 129649 - DNA, 103 bp, Artificial Sequence
  Synthetic Polynucleotide
taatacgactcactatagggacagtgtcttggactgcagccaggttgtggaacagaggagaccacaaatgggctgcagtaacctggcggcagcgcaaaagatg

SEQ ID NO: 129650 - DNA, 103 bp, Artificial Sequence
  Synthetic Polynucleotide
taatacgactcactatagggcatggtaggtacagtgtcttggactgcagcaacagaggagagctgcaatgcaagacactaacctggcggcagcgcaaaagatg

SEQ ID NO: 129651 - DNA, 103 bp, Artificial Sequence
  Synthetic Polynucleotide
taatacgactcactatagggtgttctcctgcatggtaggtacagtgtcttaacagaggagaaagacaatgtacctaccaaacctggcggcagcgcaaaagatg

SEQ ID NO: 129652 - DNA, 103 bp, Artificial Sequence
  Synthetic Polynucleotide
taatacgactcactatagggtcagcagaactgttctcctgcatggtaggtaacagaggagaacctacatggcaggagaaaacctggcggcagcgcaaaagatg

SEQ ID NO: 129653 - DNA, 103 bp, Artificial Sequence
  Synthetic Polynucleotide
taatacgactcactataggggcaggctgtgtcagcagaactgttctcctgaacagaggagacaggagatgagttctgctaacctggcggcagcgcaaaagatg

SEQ ID NO: 129654 - DNA, 103 bp, Artificial Sequence
  Synthetic Polynucleotide
taatacgactcactataggggggaggatttggattccagcagaactgcacaacagaggagagtgcagatgtgctggaataacctggcggcagcgcaaaagatg

SEQ ID NO: 129655 - DNA, 103 bp, Artificial Sequence
  Synthetic Polynucleotide
taatacgactcactatagggtagtaccatccacactcttctcattaaggaaacagaggagatccttaatgagaagagtgaacctggcggcagcgcaaaagatg

SEQ ID NO: 129656 - DNA, 103 bp, Artificial Sequence
  Synthetic Polynucleotide
taatacgactcactatagggcatctgccttgcaggctgtgtcagcagaacaacagaggagagttctgatgacacagcctaacctggcggcagcgcaaaagatg

SEQ ID NO: 129657 - DNA, 103 bp, Artificial Sequence
  Synthetic Polynucleotide
taatacgactcactatagggaccacggagtcatctgccttgcaggctgtgaacagaggagacacagcatgcaaggcagaaacctggcggcagcgcaaaagatg

SEQ ID NO: 129658 - DNA, 103 bp, Artificial Sequence
  Synthetic Polynucleotide
taatacgactcactataggggtcctgggacaccacggagtcatctgccttaacagaggagaaaggcaatggactccgtgaacctggcggcagcgcaaaagatg

SEQ ID NO: 129659 - DNA, 103 bp, Artificial Sequence
  Synthetic Polynucleotide
taatacgactcactatagggccaggagggtgtcctgggacaccacggagtaacagaggagaactccgatgtgtcccaggaacctggcggcagcgcaaaagatg

SEQ ID NO: 129660 - DNA, 103 bp, Artificial Sequence
  Synthetic Polynucleotide
taatacgactcactatagggatggtggtggccaggagggtgtcctgggacaacagaggagagtcccaatgcaccctcctaacctggcggcagcgcaaaagatg

SEQ ID NO: 129661 - DNA, 103 bp, Artificial Sequence
  Synthetic Polynucleotide
taatacgactcactatagggaagctcactgatggtggtggccaggagggtaacagaggagaaccctcatggccaccaccaacctggcggcagcgcaaaagatg

SEQ ID NO: 129662 - DNA, 103 bp, Artificial Sequence
  Synthetic Polynucleotide
taatacgactcactatagggtcagctcgctaagctcactgatggtggtggaacagaggagaccaccaatgtcagtgagcaacctggcggcagcgcaaaagatg

SEQ ID NO: 129663 - DNA, 103 bp, Artificial Sequence
  Synthetic Polynucleotide
taatacgactcactataggggtctgtggggtcagctcgctaagctcactgaacagaggagacagtgaatgtagcgagctaacctggcggcagcgcaaaagatg

SEQ ID NO: 129664 - DNA, 103 bp, Artificial Sequence
  Synthetic Polynucleotide
taatacgactcactatagggcatcgagtctgtctgtggggtcagctcgctaacagaggagaagcgagatgaccccacagaacctggcggcagcgcaaaagatg

SEQ ID NO: 129665 - DNA, 103 bp, Artificial Sequence
  Synthetic Polynucleotide
taatacgactcactataggggctgtgtgggcatcgagtctgtctgtggggaacagaggagaccccacatgcagactcgaaacctggcggcagcgcaaaagatg

SEQ ID NO: 129666 - DNA, 103 bp, Artificial Sequence
  Synthetic Polynucleotide
taatacgactcactatagggacattagtcctagtaccatccacactcttcaacagaggagagaagagatgggatggtacaacctggcggcagcgcaaaagatg

SEQ ID NO: 129667 - DNA, 103 bp, Artificial Sequence
  Synthetic Polynucleotide
taatacgactcactatagggaaagagtgaagctgtgtgggcatcgagtctaacagaggagaagactcatggcccacacaaacctggcggcagcgcaaaagatg

SEQ ID NO: 129668 - DNA, 103 bp, Artificial Sequence
  Synthetic Polynucleotide
taatacgactcactatagggcatgttgctcaaagagtgaagctgtgtgggaacagaggagacccacaatgcttcactctaacctggcggcagcgcaaaagatg

SEQ ID NO: 129669 - DNA, 103 bp, Artificial Sequence
  Synthetic Polynucleotide
taatacgactcactatagggatttaagtagacattagtcctagtaccatcaacagaggagagatggtatgaggactaataacctggcggcagcgcaaaagatg

SEQ ID NO: 129670 - DNA, 103 bp, Artificial Sequence
  Synthetic Polynucleotide
taatacgactcactatagggcctgcacttcatttaagtagacattagtccaacagaggagaggactaatgtctacttaaaacctggcggcagcgcaaaagatg

SEQ ID NO: 129671 - DNA, 103 bp, Artificial Sequence
  Synthetic Polynucleotide
taatacgactcactatagggaagtcagcaacctgcacttcatttaagtagaacagaggagactacttatgtgaagtgcaaacctggcggcagcgcaaaagatg

SEQ ID NO: 129672 - DNA, 103 bp, Artificial Sequence
  Synthetic Polynucleotide
taatacgactcactatagggaaatgaagcaaagtcagcaacctgcacttcaacagaggagagaagtgatggttgctgacaacctggcggcagcgcaaaagatg

SEQ ID NO: 129673 - DNA, 103 bp, Artificial Sequence
  Synthetic Polynucleotide
taatacgactcactatagggcaaactcaagaaatgaagcaaagtcagcaaaacagaggagattgctgatgttgcttcataacctggcggcagcgcaaaagatg

SEQ ID NO: 129674 - DNA, 103 bp, Artificial Sequence
  Synthetic Polynucleotide
taatacgactcactataggggcagtgtagacaaactcaagaaatgaagcaaacagaggagatgcttcatgtcttgagttaacctggcggcagcgcaaaagatg

SEQ ID NO: 129675 - DNA, 103 bp, Artificial Sequence
  Synthetic Polynucleotide
taatacgactcactatagggctgtacctttgcagtgtagacaaactcaagaacagaggagacttgagatggtctacactaacctggcggcagcgcaaaagatg

SEQ ID NO: 129676 - DNA, 103 bp, Artificial Sequence
  Synthetic Polynucleotide
taatacgactcactatagggcttcttccacctgtacctttgcagtgtagaaacagaggagatctacaatgcaaaggtacaacctggcggcagcgcaaaagatg

SEQ ID NO: 129677 - DNA, 103 bp, Artificial Sequence
  Synthetic Polynucleotide
taatacgactcactatagggaggttaaatggggaggatttggattccagcaacagaggagagctggaatgcaaatcctcaacctggcggcagcgcaaaagatg

SEQ ID NO: 129678 - DNA, 103 bp, Artificial Sequence
  Synthetic Polynucleotide
taatacgactcactatagggtgcacccgatcttcttccacctgtacctttaacagaggagaaaaggtatgggtggaagaaacctggcggcagcgcaaaagatg

SEQ ID NO: 129679 - DNA, 103 bp, Artificial Sequence
  Synthetic Polynucleotide
taatacgactcactatagggcagcattcgctgcacccgatcttcttccacaacagaggagagtggaaatggatcgggtgaacctggcggcagcgcaaaagatg

SEQ ID NO: 129680 - DNA, 103 bp, Artificial Sequence
  Synthetic Polynucleotide
taatacgactcactatagggcagccacttccagcattcgctgcacccgataacagaggagaatcgggatgagcgaatgcaacctggcggcagcgcaaaagatg

SEQ ID NO: 129681 - DNA, 103 bp, Artificial Sequence
  Synthetic Polynucleotide
taatacgactcactatagggttcagcttttcagccacttccagcattcgcaacagaggagagcgaatatgggaagtggcaacctggcggcagcgcaaaagatg

SEQ ID NO: 129682 - DNA, 103 bp, Artificial Sequence
  Synthetic Polynucleotide
taatacgactcactatagggatccaaacatttcagcttttcagccacttcaacagaggagagaagtgatggaaaagctgaacctggcggcagcgcaaaagatg

SEQ ID NO: 129683 - DNA, 103 bp, Artificial Sequence
  Synthetic Polynucleotide
taatacgactcactatagggtttctgataaatccaaacatttcagcttttaacagaggagaaaaagcatgaatgtttggaacctggcggcagcgcaaaagatg

SEQ ID NO: 129684 - DNA, 103 bp, Artificial Sequence
  Synthetic Polynucleotide
taatacgactcactatagggtgaaaacaagtttctgataaatccaaacataacagaggagaatgtttatgtttatcagaaacctggcggcagcgcaaaagatg

SEQ ID NO: 129685 - DNA, 103 bp, Artificial Sequence
  Synthetic Polynucleotide
taatacgactcactatagggtttctttaattgaaaacaagtttctgataaaacagaggagattatcaatgacttgttttaacctggcggcagcgcaaaagatg

SEQ ID NO: 129686 - DNA, 103 bp, Artificial Sequence
  Synthetic Polynucleotide
taatacgactcactatagggctaacatctgtttctttaattgaaaacaagaacagaggagacttgttatgaattaaagaaacctggcggcagcgcaaaagatg

SEQ ID NO: 129687 - DNA, 103 bp, Artificial Sequence
  Synthetic Polynucleotide
taatacgactcactatagggagtactgactctaacatctgtttctttaataacagaggagaattaaaatgacagatgttaacctggcggcagcgcaaaagatg

SEQ ID NO: 129688 - DNA, 103 bp, Artificial Sequence
  Synthetic Polynucleotide
taatacgactcactatagggctcatgcagtaggttaaatggggaggatttaacagaggagaaaatccatgccatttaacaacctggcggcagcgcaaaagatg

SEQ ID NO: 129689 - DNA, 103 bp, Artificial Sequence
  Synthetic Polynucleotide
taatacgactcactatagggcaactccaaaagtactgactctaacatctgaacagaggagacagatgatggagtcagtaaacctggcggcagcgcaaaagatg

SEQ ID NO: 129690 - DNA, 103 bp, Artificial Sequence
  Synthetic Polynucleotide
taatacgactcactatagggagaaattttgcaactccaaaagtactgactaacagaggagaagtcagatgttttggagtaacctggcggcagcgcaaaagatg

SEQ ID NO: 129691 - DNA, 103 bp, Artificial Sequence
  Synthetic Polynucleotide
taatacgactcactatagggtgagactctgagaaattttgcaactccaaaaacagaggagatttggaatggcaaaatttaacctggcggcagcgcaaaagatg

SEQ ID NO: 129692 - DNA, 103 bp, Artificial Sequence
  Synthetic Polynucleotide
taatacgactcactatagggctccacctcctgagactctgagaaattttgaacagaggagacaaaatatgtcagagtctaacctggcggcagcgcaaaagatg

SEQ ID NO: 129693 - DNA, 103 bp, Artificial Sequence
  Synthetic Polynucleotide
taatacgactcactatagggcactgctcacctccacctcctgagactctgaacagaggagacagagtatgaggaggtggaacctggcggcagcgcaaaagatg

SEQ ID NO: 129694 - DNA, 103 bp, Artificial Sequence
  Synthetic Polynucleotide
taatacgactcactatagggacttgggagccactgctcacctccacctccaacagaggagaggaggtatgggtgagcagaacctggcggcagcgcaaaagatg

SEQ ID NO: 129695 - DNA, 103 bp, Artificial Sequence
  Synthetic Polynucleotide
taatacgactcactatagggagcagcactaacttgggagccactgctcacaacagaggagagtgagcatgggctcccaaaacctggcggcagcgcaaaagatg

SEQ ID NO: 129696 - DNA, 103 bp, Artificial Sequence
  Synthetic Polynucleotide
taatacgactcactatagggtgggggcaggagcagcactaacttgggagcaacagaggagagctcccatgttagtgctgaacctggcggcagcgcaaaagatg

SEQ ID NO: 129697 - DNA, 103 bp, Artificial Sequence
  Synthetic Polynucleotide
taatacgactcactatagggacacttgccctgggggcaggagcagcactaaacagaggagatagtgcatgtcctgccccaacctggcggcagcgcaaaagatg

SEQ ID NO: 129698 - DNA, 103 bp, Artificial Sequence
  Synthetic Polynucleotide
taatacgactcactatagggatcggtggccacacttgccctgggggcaggaacagaggagacctgccatgagggcaagtaacctggcggcagcgcaaaagatg

SEQ ID NO: 129699 - DNA, 103 bp, Artificial Sequence
  Synthetic Polynucleotide
taatacgactcactataggggctcatgcatctcatgcagtaggttaaatgaacagaggagacatttaatgtactgcatgaacctggcggcagcgcaaaagatg

SEQ ID NO: 129700 - DNA, 103 bp, Artificial Sequence
  Synthetic Polynucleotide
taatacgactcactatagggggtgagggccatcggtggccacacttgcccaacagaggagagggcaaatgtggccaccgaacctggcggcagcgcaaaagatg

SEQ ID NO: 129701 - DNA, 103 bp, Artificial Sequence
  Synthetic Polynucleotide
taatacgactcactatagggagaccactggggtgagggccatcggtggccaacagaggagaggccacatgtggccctcaaacctggcggcagcgcaaaagatg

SEQ ID NO: 129702 - DNA, 103 bp, Artificial Sequence
  Synthetic Polynucleotide
taatacgactcactatagggggaatccgtgagaccactggggtgagggccaacagaggagaggccctatgcccagtggtaacctggcggcagcgcaaaagatg

SEQ ID NO: 129703 - DNA, 103 bp, Artificial Sequence
  Synthetic Polynucleotide
taatacgactcactatagggggtagtccaaggaatccgtgagaccactggaacagaggagaccagtgatgtcacggattaacctggcggcagcgcaaaagatg

SEQ ID NO: 129704 - DNA, 103 bp, Artificial Sequence
  Synthetic Polynucleotide
taatacgactcactatagggctctctcctgggtagtccaaggaatccgtgaacagaggagacacggaatgcttggactaaacctggcggcagcgcaaaagatg

SEQ ID NO: 129705 - DNA, 103 bp, Artificial Sequence
  Synthetic Polynucleotide
taatacgactcactatagggattgctggctctctctcctgggtagtccaaaacagaggagattggacatgccaggagagaacctggcggcagcgcaaaagatg

SEQ ID NO: 129706 - DNA, 103 bp, Artificial Sequence
  Synthetic Polynucleotide
taatacgactcactatagggaagacatgccattgctggctctctctcctgaacagaggagacaggagatggagccagcaaacctggcggcagcgcaaaagatg

SEQ ID NO: 129707 - DNA, 103 bp, Artificial Sequence
  Synthetic Polynucleotide
taatacgactcactatagggggcaaatctgaagacatgccattgctggctaacagaggagaagccagatgtggcatgtcaacctggcggcagcgcaaaagatg

SEQ ID NO: 129708 - DNA, 103 bp, Artificial Sequence
  Synthetic Polynucleotide
taatacgactcactatagggcttcttcggtggcaaatctgaagacatgccaacagaggagaggcatgatgtcagatttgaacctggcggcagcgcaaaagatg

SEQ ID NO: 129709 - DNA, 103 bp, Artificial Sequence
  Synthetic Polynucleotide
taatacgactcactatagggtgtccttggacttcttcggtggcaaatctgaacagaggagacagattatgcaccgaagaaacctggcggcagcgcaaaagatg

SEQ ID NO: 129710 - DNA, 103 bp, Artificial Sequence
  Synthetic Polynucleotide
taatacgactcactatagggaggaggcgaagctcatgcatctcatgcagtaacagaggagaactgcaatggatgcatgaaacctggcggcagcgcaaaagatg

SEQ ID NO: 129711 - DNA, 103 bp, Artificial Sequence
  Synthetic Polynucleotide
taatacgactcactatagggttgtctagtttgtccttggacttcttcggtaacagaggagaaccgaaatggtccaaggaaacctggcggcagcgcaaaagatg

SEQ ID NO: 129712 - DNA, 103 bp, Artificial Sequence
  Synthetic Polynucleotide
taatacgactcactatagggctctttcttcttgtctagtttgtccttggaaacagaggagatccaagatgaaactagacaacctggcggcagcgcaaaagatg

SEQ ID NO: 129713 - DNA, 103 bp, Artificial Sequence
  Synthetic Polynucleotide
taatacgactcactataggggtttaactacctctttcttcttgtctagttaacagaggagaaactagatgagaagaaagaacctggcggcagcgcaaaagatg

SEQ ID NO: 129714 - DNA, 103 bp, Artificial Sequence
  Synthetic Polynucleotide
taatacgactcactataggggggtagggaggtttaactacctctttcttcaacagaggagagaagaaatgggtagttaaaacctggcggcagcgcaaaagatg

SEQ ID NO: 129715 - DNA, 103 bp, Artificial Sequence
  Synthetic Polynucleotide
taatacgactcactatagggcctgattttagggtagggaggtttaactacaacagaggagagtagttatgcctccctacaacctggcggcagcgcaaaagatg

SEQ ID NO: 129716 - DNA, 103 bp, Artificial Sequence
  Synthetic Polynucleotide
taatacgactcactatagggcactagctctcctgattttagggtagggagaacagaggagactccctatgctaaaatcaaacctggcggcagcgcaaaagatg

SEQ ID NO: 129717 - DNA, 103 bp, Artificial Sequence
  Synthetic Polynucleotide
taatacgactcactataggggccagccttccactagctctcctgattttaaacagaggagataaaatatggagagctagaacctggcggcagcgcaaaagatg

SEQ ID NO: 129718 - DNA, 103 bp, Artificial Sequence
  Synthetic Polynucleotide
taatacgactcactatagggcttcctcccagccagccttccactagctctaacagaggagaagagctatgggaaggctgaacctggcggcagcgcaaaagatg

SEQ ID NO: 129719 - DNA, 103 bp, Artificial Sequence
  Synthetic Polynucleotide
taatacgactcactatagggccacaaagaccttcctcccagccagccttcaacagaggagagaaggcatgctgggaggaaacctggcggcagcgcaaaagatg

SEQ ID NO: 129720 - DNA, 103 bp, Artificial Sequence
  Synthetic Polynucleotide
taatacgactcactatagggttagggatctccacaaagaccttcctcccaaacagaggagatgggagatgggtctttgtaacctggcggcagcgcaaaagatg

SEQ ID NO: 129721 - DNA, 103 bp, Artificial Sequence
  Synthetic Polynucleotide
taatacgactcactatagggcaggtgacccaggaggcgaagctcatgcataacagaggagaatgcatatgcttcgcctcaacctggcggcagcgcaaaagatg

SEQ ID NO: 129722 - DNA, 103 bp, Artificial Sequence
  Synthetic Polynucleotide
taatacgactcactatagggatatttctttttagggatctccacaaagacaacagaggagagtctttatggagatccctaacctggcggcagcgcaaaagatg

SEQ ID NO: 129723 - DNA, 103 bp, Artificial Sequence
  Synthetic Polynucleotide
taatacgactcactataggggtcttctcgtatatttctttttagggatctaacagaggagaagatccatgaaaagaaataacctggcggcagcgcaaaagatg

SEQ ID NO: 129724 - DNA, 103 bp, Artificial Sequence
  Synthetic Polynucleotide
taatacgactcactatagggtgctctcggagtcttctcgtatatttctttaacagaggagaaaagaaatgtacgagaagaacctggcggcagcgcaaaagatg

SEQ ID NO: 129725 - DNA, 103 bp, Artificial Sequence
  Synthetic Polynucleotide
taatacgactcactatagggagttttctgctgctctcggagtcttctcgtaacagaggagaacgagaatgctccgagagaacctggcggcagcgcaaaagatg

SEQ ID NO: 129726 - DNA, 103 bp, Artificial Sequence
  Synthetic Polynucleotide
taatacgactcactatagggcaccctcagcagttttctgctgctctcggaaacagaggagatccgagatgagcagaaaaaacctggcggcagcgcaaaagatg

SEQ ID NO: 129727 - DNA, 103 bp, Artificial Sequence
  Synthetic Polynucleotide
taatacgactcactatagggtcccccacatcaccctcagcagttttctgcaacagaggagagcagaaatgtgctgagggaacctggcggcagcgcaaaagatg

SEQ ID NO: 129728 - DNA, 103 bp, Artificial Sequence
  Synthetic Polynucleotide
taatacgactcactatagggacacctgtagtcccccacatcaccctcagcaacagaggagagctgagatggatgtggggaacctggcggcagcgcaaaagatg

SEQ ID NO: 129729 - DNA, 103 bp, Artificial Sequence
  Synthetic Polynucleotide
taatacgactcactatagggggtcctggggacacctgtagtcccccacataacagaggagaatgtggatgactacaggtaacctggcggcagcgcaaaagatg

SEQ ID NO: 129730 - DNA, 103 bp, Artificial Sequence
  Synthetic Polynucleotide
taatacgactcactatagggtccgggctttggtcctggggacacctgtagaacagaggagactacagatgtccccaggaaacctggcggcagcgcaaaagatg

SEQ ID NO: 129731 - DNA, 103 bp, Artificial Sequence
  Synthetic Polynucleotide
taatacgactcactataggggcccaccctgtccgggctttggtcctggggaacagaggagaccccagatgcaaagcccgaacctggcggcagcgcaaaagatg

SEQ ID NO: 129732 - DNA, 103 bp, Artificial Sequence
  Synthetic Polynucleotide
taatacgactcactatagggtcacgtcacacaggtgacccaggaggcgaaaacagaggagattcgccatgtgggtcaccaacctggcggcagcgcaaaagatg

SEQ ID NO: 129733 - DNA, 103 bp, Artificial Sequence
  Synthetic Polynucleotide
taatacgactcactatagggccatctccgtgcccaccctgtccgggctttaacagaggagaaaagccatgacagggtggaacctggcggcagcgcaaaagatg

SEQ ID NO: 129734 - DNA, 103 bp, Artificial Sequence
  Synthetic Polynucleotide
taatacgactcactataggggaaacctgctccatctccgtgcccaccctgaacagaggagacagggtatgcacggagataacctggcggcagcgcaaaagatg

SEQ ID NO: 129735 - DNA, 103 bp, Artificial Sequence
  Synthetic Polynucleotide
taatacgactcactatagggctcatttttggaaacctgctccatctccgtaacagaggagaacggagatggagcaggttaacctggcggcagcgcaaaagatg

SEQ ID NO: 129736 - DNA, 103 bp, Artificial Sequence
  Synthetic Polynucleotide
taatacgactcactatagggcctggcaaccctcatttttggaaacctgctaacagaggagaagcaggatgccaaaaatgaacctggcggcagcgcaaaagatg

SEQ ID NO: 129737 - DNA, 103 bp, Artificial Sequence
  Synthetic Polynucleotide
taatacgactcactatagggtcagcacctgcctggcaaccctcatttttgaacagaggagacaaaaaatggggttgccaaacctggcggcagcgcaaaagatg

SEQ ID NO: 129738 - DNA, 103 bp, Artificial Sequence
  Synthetic Polynucleotide
taatacgactcactatagggttcctccaactcagcacctgcctggcaaccaacagaggagaggttgcatggcaggtgctaacctggcggcagcgcaaaagatg

SEQ ID NO: 129739 - DNA, 103 bp, Artificial Sequence
  Synthetic Polynucleotide
taatacgactcactatagggtctttgacaattcctccaactcagcacctgaacagaggagacaggtgatgagttggaggaacctggcggcagcgcaaaagatg

SEQ ID NO: 129740 - DNA, 103 bp, Artificial Sequence
  Synthetic Polynucleotide
taatacgactcactatagggggccctgctttctttgacaattcctccaacaacagaggagagttggaatgattgtcaaaaacctggcggcagcgcaaaagatg

SEQ ID NO: 129741 - DNA, 103 bp, Artificial Sequence
  Synthetic Polynucleotide
taatacgactcactatagggttcctcctccggccctgctttctttgacaaaacagaggagattgtcaatgaaagcagggaacctggcggcagcgcaaaagatg

SEQ ID NO: 129742 - DNA, 103 bp, Artificial Sequence
  Synthetic Polynucleotide
taatacgactcactatagggcctcctcctcttcctcctccggccctgcttaacagaggagaaagcagatgcggaggaggaacctggcggcagcgcaaaagatg

SEQ ID NO: 129743 - DNA, 103 bp, Artificial Sequence
  Synthetic Polynucleotide
taatacgactcactatagggacgctgactgtcacgtcacacaggtgacccaacagaggagagggtcaatggtgtgacgtaacctggcggcagcgcaaaagatg

SEQ ID NO: 129744 - DNA, 103 bp, Artificial Sequence
  Synthetic Polynucleotide
taatacgactcactatagggtcctcctcctcctcctcctcttcctcctccaacagaggagaggaggaatgagaggaggaaacctggcggcagcgcaaaagatg

SEQ ID NO: 129745 - DNA, 103 bp, Artificial Sequence
  Synthetic Polynucleotide
taatacgactcactatagggcccttcttcgtcctcctcctcctcctcctcaacagaggagagaggagatggaggaggagaacctggcggcagcgcaaaagatg

SEQ ID NO: 129746 - DNA, 103 bp, Artificial Sequence
  Synthetic Polynucleotide
taatacgactcactatagggtcttcttctccccttcttcgtcctcctcctaacagaggagaaggaggatgacgaagaagaacctggcggcagcgcaaaagatg

SEQ ID NO: 129747 - DNA, 103 bp, Artificial Sequence
  Synthetic Polynucleotide
taatacgactcactatagggaagttgctcttcttcttctccccttcttcgaacagaggagacgaagaatgggagaagaaaacctggcggcagcgcaaaagatg

SEQ ID NO: 129748 - DNA, 103 bp, Artificial Sequence
  Synthetic Polynucleotide
taatacgactcactataggggctgcacttaaagttgctcttcttcttctcaacagaggagagagaagatgaagagcaacaacctggcggcagcgcaaaagatg

SEQ ID NO: 129749 - DNA, 103 bp, Artificial Sequence
  Synthetic Polynucleotide
taatacgactcactatagggtctcgcaaatgctgcacttaaagttgctctaacagaggagaagagcaatgttaagtgcaaacctggcggcagcgcaaaagatg

SEQ ID NO: 129750 - DNA, 103 bp, Artificial Sequence
  Synthetic Polynucleotide
taatacgactcactatagggagaaacgccttctcgcaaatgctgcacttaaacagaggagataagtgatgcatttgcgaaacctggcggcagcgcaaaagatg

SEQ ID NO: 129751 - DNA, 103 bp, Artificial Sequence
  Synthetic Polynucleotide
taatacgactcactatagggcttctcatacagaaacgccttctcgcaaataacagaggagaatttgcatgaaggcgtttaacctggcggcagcgcaaaagatg

SEQ ID NO: 129752 - DNA, 103 bp, Artificial Sequence
  Synthetic Polynucleotide
taatacgactcactatagggtcaggaagctcttctcatacagaaacgcctaacagaggagaaggcgtatgtgtatgagaaacctggcggcagcgcaaaagatg

SEQ ID NO: 129753 - DNA, 103 bp, Artificial Sequence
  Synthetic Polynucleotide
taatacgactcactatagggttgctgtgcttcaggaagctcttctcatacaacagaggagagtatgaatggagcttcctaacctggcggcagcgcaaaagatg

SEQ ID NO: 129754 - DNA, 103 bp, Artificial Sequence
  Synthetic Polynucleotide
taatacgactcactatagggggacttcttcttcccaccgcggctcgacataacagaggagaatgtcgatgcgcggtgggaacctggcggcagcgcaaaagatg

SEQ ID NO: 129755 - DNA, 103 bp, Artificial Sequence
  Synthetic Polynucleotide
taatacgactcactatagggcctgtacttggggtggcctttcttgatgtaaacagaggagatacatcatgaaaggccacaacctggcggcagcgcaaaagatg

SEQ ID NO: 129756 - DNA, 103 bp, Artificial Sequence
  Synthetic Polynucleotide
taatacgactcactatagggtgtagacacgaagtaactggagatggccttaacagaggagaaaggccatgtccagttacaacctggcggcagcgcaaaagatg

SEQ ID NO: 129757 - DNA, 103 bp, Artificial Sequence
  Synthetic Polynucleotide
taatacgactcactatagggaagaggacattgtagacacgaagtaactggaacagaggagaccagttatgtcgtgtctaaacctggcggcagcgcaaaagatg

SEQ ID NO: 129758 - DNA, 103 bp, Artificial Sequence
  Synthetic Polynucleotide
taatacgactcactataggggttttgatggaagaggacattgtagacacgaacagaggagacgtgtcatgaatgtcctcaacctggcggcagcgcaaaagatg

SEQ ID NO: 129759 - DNA, 103 bp, Artificial Sequence
  Synthetic Polynucleotide
taatacgactcactataggggaagtacaccgttttgatggaagaggacataacagaggagaatgtccatgtccatcaaaaacctggcggcagcgcaaaagatg

SEQ ID NO: 129760 - DNA, 103 bp, Artificial Sequence
  Synthetic Polynucleotide
taatacgactcactatagggcaaaaagcacgaagtacaccgttttgatggaacagaggagaccatcaatgcggtgtactaacctggcggcagcgcaaaagatg

SEQ ID NO: 129761 - DNA, 103 bp, Artificial Sequence
  Synthetic Polynucleotide
taatacgactcactatagggctctcgctgtcaaaaagcacgaagtacaccaacagaggagaggtgtaatgcgtgcttttaacctggcggcagcgcaaaagatg

SEQ ID NO: 129762 - DNA, 103 bp, Artificial Sequence
  Synthetic Polynucleotide
taatacgactcactataggggatgcctatactctcgctgtcaaaaagcacaacagaggagagtgcttatggacagcgagaacctggcggcagcgcaaaagatg

SEQ ID NO: 129763 - DNA, 103 bp, Artificial Sequence
  Synthetic Polynucleotide
taatacgactcactatagggcctgcacatagatgcctatactctcgctgtaacagaggagaacagcgatggtataggcaaacctggcggcagcgcaaaagatg

SEQ ID NO: 129764 - DNA, 103 bp, Artificial Sequence
  Synthetic Polynucleotide
taatacgactcactatagggttggccatttcctgcacatagatgcctataaacagaggagatataggatgctatgtgcaaacctggcggcagcgcaaaagatg

SEQ ID NO: 129765 - DNA, 103 bp, Artificial Sequence
  Synthetic Polynucleotide
taatacgactcactatagggggcgtccagcttggccatttcctgcacataaacagaggagatatgtgatggaaatggccaacctggcggcagcgcaaaagatg

SEQ ID NO: 129766 - DNA, 103 bp, Artificial Sequence
  Synthetic Polynucleotide
taatacgactcactatagggccactccaatcctgtacttggggtggccttaacagaggagaaaggccatgccaagtacaaacctggcggcagcgcaaaagatg

SEQ ID NO: 129767 - DNA, 103 bp, Artificial Sequence
  Synthetic Polynucleotide
taatacgactcactatagggacgggtgcccccactccaatcctgtacttgaacagaggagacaagtaatggattggagtaacctggcggcagcgcaaaagatg

SEQ ID NO: 129768 - DNA, 103 bp, Artificial Sequence
  Synthetic Polynucleotide
taatacgactcactatagggggccatgtacacgggtgcccccactccaataacagaggagaattggaatgggggcacccaacctggcggcagcgcaaaagatg

SEQ ID NO: 129769 - DNA, 103 bp, Artificial Sequence
  Synthetic Polynucleotide
taatacgactcactatagggccaggacggcggccatgtacacgggtgcccaacagaggagagggcacatgtgtacatggaacctggcggcagcgcaaaagatg

SEQ ID NO: 129770 - DNA, 103 bp, Artificial Sequence
  Synthetic Polynucleotide
taatacgactcactataggggtcaggtattccaggacggcggccatgtacaacagaggagagtacatatgcgccgtcctaacctggcggcagcgcaaaagatg

SEQ ID NO: 129771 - DNA, 103 bp, Artificial Sequence
  Synthetic Polynucleotide
taatacgactcactatagggaatctccgctgtcaggtattccaggacggcaacagaggagagccgtcatggaatacctgaacctggcggcagcgcaaaagatg

SEQ ID NO: 129772 - DNA, 103 bp, Artificial Sequence
  Synthetic Polynucleotide
taatacgactcactatagggccagctccagaatctccgctgtcaggtattaacagaggagaaataccatgcagcggagaaacctggcggcagcgcaaaagatg

SEQ ID NO: 129773 - DNA, 103 bp, Artificial Sequence
  Synthetic Polynucleotide
taatacgactcactataggggcattgccagccagctccagaatctccgctaacagaggagaagcggaatgtctggagctaacctggcggcagcgcaaaagatg

SEQ ID NO: 129774 - DNA, 103 bp, Artificial Sequence
  Synthetic Polynucleotide
taatacgactcactataggggtctctcgctgcattgccagccagctccagaacagaggagactggagatggctggcaataacctggcggcagcgcaaaagatg

SEQ ID NO: 129775 - DNA, 103 bp, Artificial Sequence
  Synthetic Polynucleotide
taatacgactcactatagggacgtcttggtggacttcttcttcccaccgcaacagaggagagcggtgatgagaagaagtaacctggcggcagcgcaaaagatg

SEQ ID NO: 129776 - DNA, 103 bp, Artificial Sequence
  Synthetic Polynucleotide
taatacgactcactatagggccttcttgttgtctctcgctgcattgccagaacagaggagactggcaatgcagcgagagaacctggcggcagcgcaaaagatg

SEQ ID NO: 129777 - DNA, 103 bp, Artificial Sequence
  Synthetic Polynucleotide
taatacgactcactataggggtgacccgtcccttcttgttgtctctcgctaacagaggagaagcgagatgcaacaagaaaacctggcggcagcgcaaaagatg

SEQ ID NO: 129778 - DNA, 103 bp, Artificial Sequence
  Synthetic Polynucleotide
taatacgactcactataggggtgccggggtgtgacccgtcccttcttgttaacagaggagaaacaagatgggacgggtcaacctggcggcagcgcaaaagatg

SEQ ID NO: 129779 - DNA, 103 bp, Artificial Sequence
  Synthetic Polynucleotide
taatacgactcactatagggccagcaggatgtgccggggtgtgacccgtcaacagaggagagacgggatgcaccccggcaacctggcggcagcgcaaaagatg

SEQ ID NO: 129780 - DNA, 103 bp, Artificial Sequence
  Synthetic Polynucleotide
taatacgactcactatagggttggccacagccagcaggatgtgccggggtaacagaggagaaccccgatgcatcctgctaacctggcggcagcgcaaaagatg

SEQ ID NO: 129781 - DNA, 103 bp, Artificial Sequence
  Synthetic Polynucleotide
taatacgactcactatagggctcttcatcattggccacagccagcaggataacagaggagaatcctgatggctgtggccaacctggcggcagcgcaaaagatg

SEQ ID NO: 129782 - DNA, 103 bp, Artificial Sequence
  Synthetic Polynucleotide
taatacgactcactataggggctgattcagctcttcatcattggccacagaacagaggagactgtggatgatgatgaagaacctggcggcagcgcaaaagatg

SEQ ID NO: 129783 - DNA, 103 bp, Artificial Sequence
  Synthetic Polynucleotide
taatacgactcactatagggccttttagcagctgattcagctcttcatcaaacagaggagatgatgaatggctgaatcaaacctggcggcagcgcaaaagatg

SEQ ID NO: 129784 - DNA, 103 bp, Artificial Sequence
  Synthetic Polynucleotide
taatacgactcactatagggtatggtgactccttttagcagctgattcagaacagaggagactgaatatgctgctaaaaaacctggcggcagcgcaaaagatg

SEQ ID NO: 129785 - DNA, 103 bp, Artificial Sequence
  Synthetic Polynucleotide
taatacgactcactatagggccccactggctatggtgactccttttagcaaacagaggagatgctaaatggagtcaccaaacctggcggcagcgcaaaagatg

SEQ ID NO: 129786 - DNA, 103 bp, Artificial Sequence
  Synthetic Polynucleotide
taatacgactcactataggggcagacctggacgtcttggtggacttcttcaacagaggagagaagaaatgcaccaagacaacctggcggcagcgcaaaagatg

SEQ ID NO: 129787 - DNA, 103 bp, Artificial Sequence
  Synthetic Polynucleotide
taatacgactcactatagggggtaacacacccccactggctatggtgactaacagaggagaagtcacatgagccagtggaacctggcggcagcgcaaaagatg

SEQ ID NO: 129788 - DNA, 103 bp, Artificial Sequence
  Synthetic Polynucleotide
taatacgactcactataggggtggatgttgggtaacacacccccactggcaacagaggagagccagtatgggtgtgttaaacctggcggcagcgcaaaagatg

SEQ ID NO: 129789 - DNA, 103 bp, Artificial Sequence
  Synthetic Polynucleotide
taatacgactcactataggggcaactcggggtggatgttgggtaacacacaacagaggagagtgtgtatgccaacatccaacctggcggcagcgcaaaagatg

SEQ ID NO: 129790 - DNA, 103 bp, Artificial Sequence
  Synthetic Polynucleotide
taatacgactcactatagggttcttcgctagcaactcggggtggatgttgaacagaggagacaacatatgccccgagttaacctggcggcagcgcaaaagatg

SEQ ID NO: 129791 - DNA, 103 bp, Artificial Sequence
  Synthetic Polynucleotide
taatacgactcactatagggggatccccgcttcttcgctagcaactcgggaacagaggagacccgagatgctagcgaagaacctggcggcagcgcaaaagatg

SEQ ID NO: 129792 - DNA, 103 bp, Artificial Sequence
  Synthetic Polynucleotide
taatacgactcactatagggactttcctttggatccccgcttcttcgctaaacagaggagatagcgaatgagcggggataacctggcggcagcgcaaaagatg

SEQ ID NO: 129793 - DNA, 103 bp, Artificial Sequence
  Synthetic Polynucleotide
taatacgactcactatagggatggcttccaactttcctttggatccccgcaacagaggagagcggggatgcaaaggaaaaacctggcggcagcgcaaaagatg

SEQ ID NO: 129794 - DNA, 103 bp, Artificial Sequence
  Synthetic Polynucleotide
taatacgactcactatagggtggtgtgatgatggcttccaactttcctttaacagaggagaaaaggaatgttggaagccaacctggcggcagcgcaaaagatg

SEQ ID NO: 129795 - DNA, 103 bp, Artificial Sequence
  Synthetic Polynucleotide
taatacgactcactatagggtggctgggggtggtgtgatgatggcttccaaacagaggagatggaagatgtcatcacacaacctggcggcagcgcaaaagatg

SEQ ID NO: 129796 - DNA, 103 bp, Artificial Sequence
  Synthetic Polynucleotide
taatacgactcactatagggttggcctttttggctgggggtggtgtgatgaacagaggagacatcacatgacccccagcaacctggcggcagcgcaaaagatg

SEQ ID NO: 129797 - DNA, 103 bp, Artificial Sequence
  Synthetic Polynucleotide
taatacgactcactatagggtcctgctttggcagacctggacgtcttggtaacagaggagaaccaagatgtccaggtctaacctggcggcagcgcaaaagatg

SEQ ID NO: 129798 - DNA, 103 bp, Artificial Sequence
  Synthetic Polynucleotide
taatacgactcactatagggggatggagacttggcctttttggctgggggaacagaggagacccccaatgaaaaaggccaacctggcggcagcgcaaaagatg

SEQ ID NO: 129799 - DNA, 103 bp, Artificial Sequence
  Synthetic Polynucleotide
taatacgactcactataggggcttcttctgggatggagacttggccttttaacagaggagaaaaaggatgagtctccataacctggcggcagcgcaaaagatg

SEQ ID NO: 129800 - DNA, 103 bp, Artificial Sequence
  Synthetic Polynucleotide
taatacgactcactatagggttagatacaggcttcttctgggatggagacaacagaggagagtctccatgccagaagaaaacctggcggcagcgcaaaagatg

SEQ ID NO: 129801 - DNA, 103 bp, Artificial Sequence
  Synthetic Polynucleotide
taatacgactcactatagggtcctgcttttttagatacaggcttcttctgaacagaggagacagaagatgcctgtatctaacctggcggcagcgcaaaagatg

SEQ ID NO: 129802 - DNA, 103 bp, Artificial Sequence
  Synthetic Polynucleotide
taatacgactcactatagggctttcttgcctcctgcttttttagatacagaacagaggagactgtatatgaaaaagcagaacctggcggcagcgcaaaagatg

SEQ ID NO: 129803 - DNA, 103 bp, Artificial Sequence
  Synthetic Polynucleotide
taatacgactcactatagggttccgggcccctttcttgcctcctgcttttaacagaggagaaaaagcatgaggcaagaaaacctggcggcagcgcaaaagatg

SEQ ID NO: 129804 - DNA, 103 bp, Artificial Sequence
  Synthetic Polynucleotide
taatacgactcactatagggcttcttggatttccgggcccctttcttgccaacagaggagaggcaagatgggggcccggaacctggcggcagcgcaaaagatg

SEQ ID NO: 129805 - DNA, 103 bp, Artificial Sequence
  Synthetic Polynucleotide
taatacgactcactatagggcttcaccctgcttcttggatttccgggcccaacagaggagagggcccatgaatccaagaaacctggcggcagcgcaaaagatg

SEQ ID NO: 129806 - DNA, 103 bp, Artificial Sequence
  Synthetic Polynucleotide
taatacgactcactataggggccttactgacttcaccctgcttcttggataacagaggagaatccaaatggcagggtgaaacctggcggcagcgcaaaagatg

SEQ ID NO: 129807 - DNA, 103 bp, Artificial Sequence
  Synthetic Polynucleotide
taatacgactcactatagggggcgctggctgccttactgacttcaccctgaacagaggagacagggtatggtcagtaagaacctggcggcagcgcaaaagatg

SEQ ID NO: 129808 - DNA, 103 bp, Artificial Sequence
  Synthetic Polynucleotide
taatacgactcactataggggaaagatgactcctgctttggcagacctggaacagaggagaccaggtatgccaaagcagaacctggcggcagcgcaaaagatg

SEQ ID NO: 129809 - DNA, 103 bp, Artificial Sequence
  Synthetic Polynucleotide
taatacgactcactatagggttgtgctgtcggcgctggctgccttactgaaacagaggagatcagtaatgcagccagcgaacctggcggcagcgcaaaagatg

SEQ ID NO: 129810 - DNA, 103 bp, Artificial Sequence
  Synthetic Polynucleotide
taatacgactcactataggggtgccctcggttgtgctgtcggcgctggctaacagaggagaagccagatgcgacagcacaacctggcggcagcgcaaaagatg

SEQ ID NO: 129811 - DNA, 103 bp, Artificial Sequence
  Synthetic Polynucleotide
taatacgactcactataggggtcggcaggtgtgccctcggttgtgctgtcaacagaggagagacagcatgaccgagggcaacctggcggcagcgcaaaagatg

SEQ ID NO: 129812 - DNA, 103 bp, Artificial Sequence
  Synthetic Polynucleotide
taatacgactcactatagggctgtgaagccgtcggcaggtgtgccctcggaacagaggagaccgaggatgcacctgccgaacctggcggcagcgcaaaagatg

SEQ ID NO: 129813 - DNA, 103 bp, Artificial Sequence
  Synthetic Polynucleotide
taatacgactcactataggggtggagaggactgtgaagccgtcggcaggtaacagaggagaacctgcatgcggcttcacaacctggcggcagcgcaaaagatg

SEQ ID NO: 129814 - DNA, 103 bp, Artificial Sequence
  Synthetic Polynucleotide
taatacgactcactataggggaggctcttggtggagaggactgtgaagccaacagaggagaggcttcatggtcctctccaacctggcggcagcgcaaaagatg

SEQ ID NO: 129815 - DNA, 103 bp, Artificial Sequence
  Synthetic Polynucleotide
taatacgactcactatagggggccaaggaagaggctcttggtggagaggaaacagaggagatcctctatgccaagagccaacctggcggcagcgcaaaagatg

SEQ ID NO: 129816 - DNA, 103 bp, Artificial Sequence
  Synthetic Polynucleotide
taatacgactcactatagggttcagcttctggccaaggaagaggctcttgaacagaggagacaagagatgcttccttggaacctggcggcagcgcaaaagatg

SEQ ID NO: 129817 - DNA, 103 bp, Artificial Sequence
  Synthetic Polynucleotide
taatacgactcactataggggtgaataaggttcagcttctggccaaggaaaacagaggagattccttatgcagaagctgaacctggcggcagcgcaaaagatg

SEQ ID NO: 129818 - DNA, 103 bp, Artificial Sequence
  Synthetic Polynucleotide
taatacgactcactatagggtgatttcactgtgaataaggttcagcttctaacagaggagaagaagcatgaccttattcaacctggcggcagcgcaaaagatg

SEQ ID NO: 129819 - DNA, 103 bp, Artificial Sequence
  Synthetic Polynucleotide
taatacgactcactatagggcgccccacgggaaagatgactcctgctttgaacagaggagacaaagcatgagtcatcttaacctggcggcagcgcaaaagatg

SEQ ID NO: 129820 - DNA, 103 bp, Artificial Sequence
  Synthetic Polynucleotide
taatacgactcactataggggctaaattactgatttcactgtgaataaggaacagaggagaccttatatgcagtgaaataacctggcggcagcgcaaaagatg

SEQ ID NO: 129821 - DNA, 103 bp, Artificial Sequence
  Synthetic Polynucleotide
taatacgactcactatagggctcaaagccggctaaattactgatttcactaacagaggagaagtgaaatgagtaatttaaacctggcggcagcgcaaaagatg

SEQ ID NO: 129822 - DNA, 103 bp, Artificial Sequence
  Synthetic Polynucleotide
taatacgactcactatagggtggcctccacctcaaagccggctaaattacaacagaggagagtaattatgccggctttgaacctggcggcagcgcaaaagatg

SEQ ID NO: 129823 - DNA, 103 bp, Artificial Sequence
  Synthetic Polynucleotide
taatacgactcactatagggggattgattatggcctccacctcaaagccgaacagaggagacggcttatgggtggaggcaacctggcggcagcgcaaaagatg

SEQ ID NO: 129824 - DNA, 103 bp, Artificial Sequence
  Synthetic Polynucleotide
taatacgactcactatagggagcattggtaggattgattatggcctccacaacagaggagagtggagatgataatcaataacctggcggcagcgcaaaagatg

SEQ ID NO: 129825 - DNA, 103 bp, Artificial Sequence
  Synthetic Polynucleotide
taatacgactcactatagggggtcaatgtcagcattggtaggattgattaaacagaggagataatcaatgctaccaatgaacctggcggcagcgcaaaagatg

SEQ ID NO: 129826 - DNA, 103 bp, Artificial Sequence
  Synthetic Polynucleotide
taatacgactcactatagggtcatctttaaggtcaatgtcagcattggtaaacagaggagataccaaatgtgacattgaaacctggcggcagcgcaaaagatg

SEQ ID NO: 129827 - DNA, 103 bp, Artificial Sequence
  Synthetic Polynucleotide
taatacgactcactataggggtttcctaggtcatctttaaggtcaatgtcaacagaggagagacattatgcttaaagataacctggcggcagcgcaaaagatg

SEQ ID NO: 129828 - DNA, 103 bp, Artificial Sequence
  Synthetic Polynucleotide
taatacgactcactatagggtctccagcgtgtttcctaggtcatctttaaaacagaggagattaaagatgacctaggaaaacctggcggcagcgcaaaagatg

SEQ ID NO: 129829 - DNA, 103 bp, Artificial Sequence
  Synthetic Polynucleotide
taatacgactcactatagggccacctttcttctccagcgtgtttcctaggaacagaggagacctaggatgcacgctggaaacctggcggcagcgcaaaagatg

SEQ ID NO: 129830 - DNA, 103 bp, Artificial Sequence
  Synthetic Polynucleotide
taatacgactcactatagggccgcagcatccgccccacgggaaagatgacaacagaggagagtcatcatgcccgtggggaacctggcggcagcgcaaaagatg

SEQ ID NO: 129831 - DNA, 103 bp, Artificial Sequence
  Synthetic Polynucleotide
taatacgactcactatagggaaactccttgccacctttcttctccagcgtaacagaggagaacgctgatgaagaaaggtaacctggcggcagcgcaaaagatg

SEQ ID NO: 129832 - DNA, 103 bp, Artificial Sequence
  Synthetic Polynucleotide
taatacgactcactatagggcagcttccacaaactccttgccacctttctaacagaggagaagaaagatggcaaggagtaacctggcggcagcgcaaaagatg

SEQ ID NO: 129833 - DNA, 103 bp, Artificial Sequence
  Synthetic Polynucleotide
taatacgactcactatagggagttccaggacagcttccacaaactccttgaacagaggagacaaggaatgtgtggaagcaacctggcggcagcgcaaaagatg

SEQ ID NO: 129834 - DNA, 103 bp, Artificial Sequence
  Synthetic Polynucleotide
taatacgactcactatagggctttttccggagttccaggacagcttccacaacagaggagagtggaaatggtcctggaaaacctggcggcagcgcaaaagatg

SEQ ID NO: 129835 - DNA, 103 bp, Artificial Sequence
  Synthetic Polynucleotide
taatacgactcactatagggagggcccgttctttttccggagttccaggaaacagaggagatcctggatgtccggaaaaaacctggcggcagcgcaaaagatg

SEQ ID NO: 129836 - DNA, 103 bp, Artificial Sequence
  Synthetic Polynucleotide
taatacgactcactataggggctacttccaagggcccgttctttttccggaacagaggagaccggaaatggaacgggccaacctggcggcagcgcaaaagatg

SEQ ID NO: 129837 - DNA, 103 bp, Artificial Sequence
  Synthetic Polynucleotide
taatacgactcactatagggagcagctccagctacttccaagggcccgttaacagaggagaaacgggatgttggaagtaaacctggcggcagcgcaaaagatg

SEQ ID NO: 129838 - DNA, 103 bp, Artificial Sequence
  Synthetic Polynucleotide
taatacgactcactatagggctgcgctgacagcagctccagctacttccaaacagaggagatggaagatgctggagctgaacctggcggcagcgcaaaagatg

SEQ ID NO: 129839 - DNA, 103 bp, Artificial Sequence
  Synthetic Polynucleotide
taatacgactcactatagggaggccatggcctgcgctgacagcagctccaaacagaggagatggagcatgtgtcagcgcaacctggcggcagcgcaaaagatg

SEQ ID NO: 129840 - DNA, 103 bp, Artificial Sequence
  Synthetic Polynucleotide
taatacgactcactatagggcttggcaggcaggccatggcctgcgctgacaacagaggagagtcagcatgggccatggcaacctggcggcagcgcaaaagatg

SEQ ID NO: 129841 - DNA, 103 bp, Artificial Sequence
  Synthetic Polynucleotide
taatacgactcactatagggtcttgatgtaccgcagcatccgccccacggaacagaggagaccgtggatgggatgctgcaacctggcggcagcgcaaaagatg

SEQ ID NO: 129842 - DNA, 103 bp, Artificial Sequence
  Synthetic Polynucleotide
taatacgactcactatagggggatcacaaacttggcaggcaggccatggcaacagaggagagccatgatgtgcctgccaaacctggcggcagcgcaaaagatg

SEQ ID NO: 129843 - DNA, 103 bp, Artificial Sequence
  Synthetic Polynucleotide
taatacgactcactatagggctattacagtggatcacaaacttggcaggcaacagaggagagcctgcatggtttgtgataacctggcggcagcgcaaaagatg

SEQ ID NO: 129844 - DNA, 103 bp, Artificial Sequence
  Synthetic Polynucleotide
taatacgactcactatagggccaaactggactattacagtggatcacaaaaacagaggagatttgtgatgcactgtaataacctggcggcagcgcaaaagatg

SEQ ID NO: 129845 - DNA, 103 bp, Artificial Sequence
  Synthetic Polynucleotide
taatacgactcactatagggtgtctgcaccccaaactggactattacagtaacagaggagaactgtaatggtccagtttaacctggcggcagcgcaaaagatg

SEQ ID NO: 129846 - DNA, 103 bp, Artificial Sequence
  Synthetic Polynucleotide
taatacgactcactatagggtcttcacacttgtctgcaccccaaactggaaacagaggagatccagtatggggtgcagaaacctggcggcagcgcaaaagatg

SEQ ID NO: 129847 - DNA, 103 bp, Artificial Sequence
  Synthetic Polynucleotide
taatacgactcactatagggttccagaagttcttcacacttgtctgcaccaacagaggagaggtgcaatgaagtgtgaaaacctggcggcagcgcaaaagatg

SEQ ID NO: 129848 - DNA, 103 bp, Artificial Sequence
  Synthetic Polynucleotide
taatacgactcactatagggtcactgtcttttccagaagttcttcacactaacagaggagaagtgtgatgaacttctggaacctggcggcagcgcaaaagatg

SEQ ID NO: 129849 - DNA, 103 bp, Artificial Sequence
  Synthetic Polynucleotide
taatacgactcactatagggaagcagtttttcactgtcttttccagaagtaacagaggagaacttctatgaaagacagtaacctggcggcagcgcaaaagatg

SEQ ID NO: 129850 - DNA, 103 bp, Artificial Sequence
  Synthetic Polynucleotide
taatacgactcactatagggagccagggccaagcagtttttcactgtcttaacagaggagaaagacaatgaaaaactgcaacctggcggcagcgcaaaagatg

SEQ ID NO: 129851 - DNA, 103 bp, Artificial Sequence
  Synthetic Polynucleotide
taatacgactcactatagggtcttatcatcagccagggccaagcagttttaacagaggagaaaaactatgtggccctggaacctggcggcagcgcaaaagatg

SEQ ID NO: 129852 - DNA, 103 bp, Artificial Sequence
  Synthetic Polynucleotide
taatacgactcactataggggggtggcctttcttgatgtaccgcagcatcaacagaggagagatgctatggtacatcaaaacctggcggcagcgcaaaagatg

SEQ ID NO: 129853 - DNA, 103 bp, Artificial Sequence
  Synthetic Polynucleotide
taatacgactcactataggggatttcagcttcttatcatcagccagggccaacagaggagaggccctatgtgatgataaaacctggcggcagcgcaaaagatg

SEQ ID NO: 129854 - DNA, 103 bp, Artificial Sequence
  Synthetic Polynucleotide
taatacgactcactatagggaaatgcaatggatttcagcttcttatcatcaacagaggagagatgatatgaagctgaaaaacctggcggcagcgcaaaagatg

SEQ ID NO: 129855 - DNA, 103 bp, Artificial Sequence
  Synthetic Polynucleotide
taatacgactcactatagggcgatggatggaaatgcaatggatttcagctaacagaggagaagctgaatgccattgcataacctggcggcagcgcaaaagatg

SEQ ID NO: 129856 - DNA, 103 bp, Artificial Sequence
  Synthetic Polynucleotide
taatacgactcactatagggctgccgctgccgatggatggaaatgcaatgaacagaggagacattgcatgtccatccataacctggcggcagcgcaaaagatg

SEQ ID NO: 129857 - DNA, 103 bp, Artificial Sequence
  Synthetic Polynucleotide
taatacgactcactatagggaaaaccgttcctgccgctgccgatggatggaacagaggagaccatccatgggcagcggcaacctggcggcagcgcaaaagatg

SEQ ID NO: 129858 - DNA, 103 bp, Artificial Sequence
  Synthetic Polynucleotide
taatacgactcactatagggtctgctttggaaaaccgttcctgccgctgcaacagaggagagcagcgatgggaacggttaacctggcggcagcgcaaaagatg

SEQ ID NO: 129859 - DNA, 103 bp, Artificial Sequence
  Synthetic Polynucleotide
taatacgactcactatagggtgagctgctgtctgctttggaaaaccgttcaacagaggagagaacggatgtccaaagcaaacctggcggcagcgcaaaagatg

SEQ ID NO: 129860 - DNA, 103 bp, Artificial Sequence
  Synthetic Polynucleotide
taatacgactcactatagggcagaatcagctgagctgctgtctgctttggaacagaggagaccaaagatgacagcagctaacctggcggcagcgcaaaagatg

SEQ ID NO: 129861 - DNA, 103 bp, Artificial Sequence
  Synthetic Polynucleotide
taatacgactcactatagggagatggccttcagaatcagctgagctgctgaacagaggagacagcagatgagctgattcaacctggcggcagcgcaaaagatg

SEQ ID NO: 129862 - DNA, 103 bp, Artificial Sequence
  Synthetic Polynucleotide
taatacgactcactatagggaagtaactggagatggccttcagaatcagcaacagaggagagctgatatggaaggccataacctggcggcagcgcaaaagatg

SEQ ID NO: 129863 - DNA, 103 bp, Artificial Sequence
  Synthetic Polynucleotide
taatacgactcactatagggcattttcttcttcccactccggcccgacataacagaggagaatgtcgatgcggagtgggaacctggcggcagcgcaaaagatg

SEQ ID NO: 129864 - DNA, 103 bp, Artificial Sequence
  Synthetic Polynucleotide
taatacgactcactatagggccggtacttgaacgtccctttcttcagataaacagaggagatatctgatgaaagggacgaacctggcggcagcgcaaaagatg

SEQ ID NO: 129865 - DNA, 103 bp, Artificial Sequence
  Synthetic Polynucleotide
taatacgactcactataggggtcatcaaagtgggctgagatggctttgagaacagaggagactcaaaatgatctcagccaacctggcggcagcgcaaaagatg

SEQ ID NO: 129866 - DNA, 103 bp, Artificial Sequence
  Synthetic Polynucleotide
taatacgactcactatagggacgcgctcgagtcatcaaagtgggctgagaaacagaggagatctcagatgactttgatgaacctggcggcagcgcaaaagatg

SEQ ID NO: 129867 - DNA, 103 bp, Artificial Sequence
  Synthetic Polynucleotide
taatacgactcactatagggttcagcgaggacgcgctcgagtcatcaaagaacagaggagactttgaatgctcgagcgcaacctggcggcagcgcaaaagatg

SEQ ID NO: 129868 - DNA, 103 bp, Artificial Sequence
  Synthetic Polynucleotide
taatacgactcactataggggtacacgttcttcagcgaggacgcgctcgaaacagaggagatcgagcatgtcctcgctgaacctggcggcagcgcaaaagatg

SEQ ID NO: 129869 - DNA, 103 bp, Artificial Sequence
  Synthetic Polynucleotide
taatacgactcactatagggagagcaggaagtacacgttcttcagcgaggaacagaggagacctcgcatgagaacgtgtaacctggcggcagcgcaaaagatg

SEQ ID NO: 129870 - DNA, 103 bp, Artificial Sequence
  Synthetic Polynucleotide
taatacgactcactatagggtcgctgtcgaagagcaggaagtacacgttcaacagaggagagaacgtatgcttcctgctaacctggcggcagcgcaaaagatg

SEQ ID NO: 129871 - DNA, 103 bp, Artificial Sequence
  Synthetic Polynucleotide
taatacgactcactataggggccgatgctctcgctgtcgaagagcaggaaaacagaggagattcctgatgttcgacagcaacctggcggcagcgcaaaagatg

SEQ ID NO: 129872 - DNA, 103 bp, Artificial Sequence
  Synthetic Polynucleotide
taatacgactcactataggggcacgtagatgccgatgctctcgctgtcgaaacagaggagatcgacaatgagagcatcgaacctggcggcagcgcaaaagatg

SEQ ID NO: 129873 - DNA, 103 bp, Artificial Sequence
  Synthetic Polynucleotide
taatacgactcactataggggccatctcctgcacgtagatgccgatgctcaacagaggagagagcatatgcatctacgtaacctggcggcagcgcaaaagatg

SEQ ID NO: 129874 - DNA, 103 bp, Artificial Sequence
  Synthetic Polynucleotide
taatacgactcactataggggtcgagcttggccatctcctgcacgtagataacagaggagaatctacatgcaggagatgaacctggcggcagcgcaaaagatg

SEQ ID NO: 129875 - DNA, 103 bp, Artificial Sequence
  Synthetic Polynucleotide
taatacgactcactatagggccacgctgatccggtacttgaacgtcccttaacagaggagaaagggaatgtcaagtaccaacctggcggcagcgcaaaagatg

SEQ ID NO: 129876 - DNA, 103 bp, Artificial Sequence
  Synthetic Polynucleotide
taatacgactcactatagggacaggggcgcccacgctgatccggtacttgaacagaggagacaagtaatggatcagcgtaacctggcggcagcgcaaaagatg

SEQ ID NO: 129877 - DNA, 103 bp, Artificial Sequence
  Synthetic Polynucleotide
taatacgactcactatagggcgccatgtagacaggggcgcccacgctgataacagaggagaatcagcatgggcgcccctaacctggcggcagcgcaaaagatg

SEQ ID NO: 129878 - DNA, 103 bp, Artificial Sequence
  Synthetic Polynucleotide
taatacgactcactatagggcaatgactgccgccatgtagacaggggcgcaacagaggagagcgcccatgtctacatggaacctggcggcagcgcaaaagatg

SEQ ID NO: 129879 - DNA, 103 bp, Artificial Sequence
  Synthetic Polynucleotide
taatacgactcactataggggccaggtactcaatgactgccgccatgtagaacagaggagactacatatgggcagtcataacctggcggcagcgcaaaagatg

SEQ ID NO: 129880 - DNA, 103 bp, Artificial Sequence
  Synthetic Polynucleotide
taatacgactcactatagggaatttccgctgccaggtactcaatgactgcaacagaggagagcagtcatggagtacctgaacctggcggcagcgcaaaagatg

SEQ ID NO: 129881 - DNA, 103 bp, Artificial Sequence
  Synthetic Polynucleotide
taatacgactcactatagggccaattctagaatttccgctgccaggtactaacagaggagaagtaccatgcagcggaaaaacctggcggcagcgcaaaagatg

SEQ ID NO: 129882 - DNA, 103 bp, Artificial Sequence
  Synthetic Polynucleotide
taatacgactcactataggggcattgccggccaattctagaatttccgctaacagaggagaagcggaatgtctagaattaacctggcggcagcgcaaaagatg

SEQ ID NO: 129883 - DNA, 103 bp, Artificial Sequence
  Synthetic Polynucleotide
taatacgactcactataggggtccctcgcggcattgccggccaattctagaacagaggagactagaaatggccggcaataacctggcggcagcgcaaaagatg

SEQ ID NO: 129884 - DNA, 103 bp, Artificial Sequence
  Synthetic Polynucleotide
taatacgactcactatagggacagcttggacattttcttcttcccactccaacagaggagaggagtgatgagaagaaaaaacctggcggcagcgcaaaagatg

SEQ ID NO: 129885 - DNA, 103 bp, Artificial Sequence
  Synthetic Polynucleotide
taatacgactcactatagggccttcttgttgtccctcgcggcattgccggaacagaggagaccggcaatgccgcgagggaacctggcggcagcgcaaaagatg

SEQ ID NO: 129886 - DNA, 103 bp, Artificial Sequence
  Synthetic Polynucleotide
taatacgactcactataggggctatccgggccttcttgttgtccctcgcgaacagaggagacgcgagatgcaacaagaaaacctggcggcagcgcaaaagatg

SEQ ID NO: 129887 - DNA, 103 bp, Artificial Sequence
  Synthetic Polynucleotide
taatacgactcactataggggtgtctcggggctatccgggccttcttgttaacagaggagaaacaagatggcccggataaacctggcggcagcgcaaaagatg

SEQ ID NO: 129888 - DNA, 103 bp, Artificial Sequence
  Synthetic Polynucleotide
taatacgactcactatagggccagcaagatgtgtctcggggctatccgggaacagaggagacccggaatgccccgagacaacctggcggcagcgcaaaagatg

SEQ ID NO: 129889 - DNA, 103 bp, Artificial Sequence
  Synthetic Polynucleotide
taatacgactcactatagggttggcaactgccagcaagatgtgtctcgggaacagaggagacccgagatgcatcttgctaacctggcggcagcgcaaaagatg

SEQ ID NO: 129890 - DNA, 103 bp, Artificial Sequence
  Synthetic Polynucleotide
taatacgactcactatagggctcctcgtcattggcaactgccagcaagataacagaggagaatcttgatggcagttgccaacctggcggcagcgcaaaagatg

SEQ ID NO: 129891 - DNA, 103 bp, Artificial Sequence
  Synthetic Polynucleotide
taatacgactcactataggggctggttgagctcctcgtcattggcaactgaacagaggagacagttgatgatgacgaggaacctggcggcagcgcaaaagatg

SEQ ID NO: 129892 - DNA, 103 bp, Artificial Sequence
  Synthetic Polynucleotide
taatacgactcactatagggccttttagcagctggttgagctcctcgtcaaacagaggagatgacgaatggctcaaccaaacctggcggcagcgcaaaagatg

SEQ ID NO: 129893 - DNA, 103 bp, Artificial Sequence
  Synthetic Polynucleotide
taatacgactcactataggggatggtcactccttttagcagctggttgagaacagaggagactcaacatgctgctaaaaaacctggcggcagcgcaaaagatg

SEQ ID NO: 129894 - DNA, 103 bp, Artificial Sequence
  Synthetic Polynucleotide
taatacgactcactatagggctccactggcgatggtcactccttttagcaaacagaggagatgctaaatggagtgaccaaacctggcggcagcgcaaaagatg

SEQ ID NO: 129895 - DNA, 103 bp, Artificial Sequence
  Synthetic Polynucleotide
taatacgactcactataggggctgaacgggacagcttggacattttcttcaacagaggagagaagaaatggtccaagctaacctggcggcagcgcaaaagatg

SEQ ID NO: 129896 - DNA, 103 bp, Artificial Sequence
  Synthetic Polynucleotide
taatacgactcactatagggggcaggacgcctccactggcgatggtcactaacagaggagaagtgacatgcgccagtggaacctggcggcagcgcaaaagatg

SEQ ID NO: 129897 - DNA, 103 bp, Artificial Sequence
  Synthetic Polynucleotide
taatacgactcactataggggtgaattctgggcaggacgcctccactggcaacagaggagagccagtatgggcgtcctgaacctggcggcagcgcaaaagatg

SEQ ID NO: 129898 - DNA, 103 bp, Artificial Sequence
  Synthetic Polynucleotide
taatacgactcactataggggcagttcggggtgaattctgggcaggacgcaacagaggagagcgtccatgccagaattcaacctggcggcagcgcaaaagatg

SEQ ID NO: 129899 - DNA, 103 bp, Artificial Sequence
  Synthetic Polynucleotide
taatacgactcactatagggtttttggccagcagttcggggtgaattctgaacagaggagacagaatatgccccgaactaacctggcggcagcgcaaaagatg

SEQ ID NO: 129900 - DNA, 103 bp, Artificial Sequence
  Synthetic Polynucleotide
taatacgactcactatagggggtccctcgctttttggccagcagttcgggaacagaggagacccgaaatgctggccaaaaacctggcggcagcgcaaaagatg

SEQ ID NO: 129901 - DNA, 103 bp, Artificial Sequence
  Synthetic Polynucleotide
taatacgactcactatagggacttgcctttggtccctcgctttttggccaaacagaggagatggccaatgagcgagggaaacctggcggcagcgcaaaagatg

SEQ ID NO: 129902 - DNA, 103 bp, Artificial Sequence
  Synthetic Polynucleotide
taatacgactcactatagggatcgtttccgacttgcctttggtccctcgcaacagaggagagcgaggatgcaaaggcaaaacctggcggcagcgcaaaagatg

SEQ ID NO: 129903 - DNA, 103 bp, Artificial Sequence
  Synthetic Polynucleotide
taatacgactcactatagggtggggagaggatcgtttccgacttgcctttaacagaggagaaaaggcatgtcggaaacgaacctggcggcagcgcaaaagatg

SEQ ID NO: 129904 - DNA, 103 bp, Artificial Sequence
  Synthetic Polynucleotide
taatacgactcactatagggtctctgggggtggggagaggatcgtttccgaacagaggagacggaaaatgtcctctcccaacctggcggcagcgcaaaagatg

SEQ ID NO: 129905 - DNA, 103 bp, Artificial Sequence
  Synthetic Polynucleotide
taatacgactcactatagggctgcctcttttctctgggggtggggagaggaacagaggagacctctcatgacccccagaaacctggcggcagcgcaaaagatg

SEQ ID NO: 129906 - DNA, 103 bp, Artificial Sequence
  Synthetic Polynucleotide
taatacgactcactatagggacctgccctagctgaacgggacagcttggaaacagaggagatccaagatgtcccgttcaaacctggcggcagcgcaaaagatg

SEQ ID NO: 129907 - DNA, 103 bp, Artificial Sequence
  Synthetic Polynucleotide
taatacgactcactatagggcgtggccttcctgcctcttttctctgggggaacagaggagacccccaatgaaaagaggcaacctggcggcagcgcaaaagatg

SEQ ID NO: 129908 - DNA, 103 bp, Artificial Sequence
  Synthetic Polynucleotide
taatacgactcactatagggtcttgcctgacgtggccttcctgcctctttaacagaggagaaaagagatgggaaggccaaacctggcggcagcgcaaaagatg

SEQ ID NO: 129909 - DNA, 103 bp, Artificial Sequence
  Synthetic Polynucleotide
taatacgactcactatagggttcccccccttcttgcctgacgtggccttcaacagaggagagaaggcatggtcaggcaaaacctggcggcagcgcaaaagatg

SEQ ID NO: 129910 - DNA, 103 bp, Artificial Sequence
  Synthetic Polynucleotide
taatacgactcactatagggcttggatttcttcccccccttcttgcctgaaacagaggagatcaggcatgaagggggggaacctggcggcagcgcaaaagatg

SEQ ID NO: 129911 - DNA, 103 bp, Artificial Sequence
  Synthetic Polynucleotide
taatacgactcactataggggtttggcagccttggatttcttccccccctaacagaggagaagggggatgagaaatccaaacctggcggcagcgcaaaagatg

SEQ ID NO: 129912 - DNA, 103 bp, Artificial Sequence
  Synthetic Polynucleotide
taatacgactcactataggggacgtccgtggtttggcagccttggatttcaacagaggagagaaatcatgggctgccaaaacctggcggcagcgcaaaagatg

SEQ ID NO: 129913 - DNA, 103 bp, Artificial Sequence
  Synthetic Polynucleotide
taatacgactcactatagggggactttttggacgtccgtggtttggcagcaacagaggagagctgccatgccacggacgaacctggcggcagcgcaaaagatg

SEQ ID NO: 129914 - DNA, 103 bp, Artificial Sequence
  Synthetic Polynucleotide
taatacgactcactatagggcctttggtttggactttttggacgtccgtgaacagaggagacacggaatgccaaaaagtaacctggcggcagcgcaaaagatg

SEQ ID NO: 129915 - DNA, 103 bp, Artificial Sequence
  Synthetic Polynucleotide
taatacgactcactatagggttatcgctgtcctttggtttggactttttgaacagaggagacaaaaaatgcaaaccaaaaacctggcggcagcgcaaaagatg

SEQ ID NO: 129916 - DNA, 103 bp, Artificial Sequence
  Synthetic Polynucleotide
taatacgactcactatagggagttccttctttatcgctgtcctttggtttaacagaggagaaaaccaatggacagcgataacctggcggcagcgcaaaagatg

SEQ ID NO: 129917 - DNA, 103 bp, Artificial Sequence
  Synthetic Polynucleotide
taatacgactcactataggggaaagatgacacctgccctagctgaacgggaacagaggagacccgttatgctagggcagaacctggcggcagcgcaaaagatg

SEQ ID NO: 129918 - DNA, 103 bp, Artificial Sequence
  Synthetic Polynucleotide
taatacgactcactatagggtggaatttgaagttccttctttatcgctgtaacagaggagaacagcgatgaagaaggaaaacctggcggcagcgcaaaagatg

SEQ ID NO: 129919 - DNA, 103 bp, Artificial Sequence
  Synthetic Polynucleotide
taatacgactcactatagggtcttcagaggtggaatttgaagttccttctaacagaggagaagaaggatgttcaaattcaacctggcggcagcgcaaaagatg

SEQ ID NO: 129920 - DNA, 103 bp, Artificial Sequence
  Synthetic Polynucleotide
taatacgactcactatagggccctggcccatcttcagaggtggaatttgaaacagaggagatcaaatatgacctctgaaaacctggcggcagcgcaaaagatg

SEQ ID NO: 129921 - DNA, 103 bp, Artificial Sequence
  Synthetic Polynucleotide
taatacgactcactatagggtgaatccatcccctggcccatcttcagaggaacagaggagacctctgatgatgggccagaacctggcggcagcgcaaaagatg

SEQ ID NO: 129922 - DNA, 103 bp, Artificial Sequence
  Synthetic Polynucleotide
taatacgactcactataggggacagaatggtgaatccatcccctggcccaaacagaggagatgggccatgggatggattaacctggcggcagcgcaaaagatg

SEQ ID NO: 129923 - DNA, 103 bp, Artificial Sequence
  Synthetic Polynucleotide
taatacgactcactataggggctcttagaagacagaatggtgaatccatcaacagaggagagatggaatgaccattctgaacctggcggcagcgcaaaagatg

SEQ ID NO: 129924 - DNA, 103 bp, Artificial Sequence
  Synthetic Polynucleotide
taatacgactcactatagggccagaacaaggctcttagaagacagaatggaacagaggagaccattcatgcttctaagaaacctggcggcagcgcaaaagatg

SEQ ID NO: 129925 - DNA, 103 bp, Artificial Sequence
  Synthetic Polynucleotide
taatacgactcactatagggagcttctgtcccagaacaaggctcttagaaaacagaggagattctaaatgccttgttctaacctggcggcagcgcaaaagatg

SEQ ID NO: 129926 - DNA, 103 bp, Artificial Sequence
  Synthetic Polynucleotide
taatacgactcactatagggggttaaggacagcttctgtcccagaacaagaacagaggagacttgttatgggacagaagaacctggcggcagcgcaaaagatg

SEQ ID NO: 129927 - DNA, 103 bp, Artificial Sequence
  Synthetic Polynucleotide
taatacgactcactatagggtgtcactctgggttaaggacagcttctgtcaacagaggagagacagaatgtgtccttaaaacctggcggcagcgcaaaagatg

SEQ ID NO: 129928 - DNA, 103 bp, Artificial Sequence
  Synthetic Polynucleotide
taatacgactcactatagggctccccactggaaagatgacacctgccctaaacagaggagatagggcatgtgtcatcttaacctggcggcagcgcaaaagatg

SEQ ID NO: 129929 - DNA, 103 bp, Artificial Sequence
  Synthetic Polynucleotide
taatacgactcactatagggatatggctgatgtcactctgggttaaggacaacagaggagagtccttatgccagagtgaaacctggcggcagcgcaaaagatg

SEQ ID NO: 129930 - DNA, 103 bp, Artificial Sequence
  Synthetic Polynucleotide
taatacgactcactatagggcatggagccaatatggctgatgtcactctgaacagaggagacagagtatgatcagccataacctggcggcagcgcaaaagatg

SEQ ID NO: 129931 - DNA, 103 bp, Artificial Sequence
  Synthetic Polynucleotide
taatacgactcactatagggcctccactctcatggagccaatatggctgaaacagaggagatcagccatgttggctccaaacctggcggcagcgcaaaagatg

SEQ ID NO: 129932 - DNA, 103 bp, Artificial Sequence
  Synthetic Polynucleotide
taatacgactcactatagggtggacaatgccctccactctcatggagccaaacagaggagatggctcatggagagtggaaacctggcggcagcgcaaaagatg

SEQ ID NO: 129933 - DNA, 103 bp, Artificial Sequence
  Synthetic Polynucleotide
taatacgactcactatagggtgtggttgggtggacaatgccctccactctaacagaggagaagagtgatgggcattgtcaacctggcggcagcgcaaaagatg

SEQ ID NO: 129934 - DNA, 103 bp, Artificial Sequence
  Synthetic Polynucleotide
taatacgactcactatagggcaatttcggctgtggttgggtggacaatgcaacagaggagagcattgatgacccaaccaaacctggcggcagcgcaaaagatg

SEQ ID NO: 129935 - DNA, 103 bp, Artificial Sequence
  Synthetic Polynucleotide
taatacgactcactatagggtctttgaggtcaatttcggctgtggttgggaacagaggagacccaacatgagccgaaataacctggcggcagcgcaaaagatg

SEQ ID NO: 129936 - DNA, 103 bp, Artificial Sequence
  Synthetic Polynucleotide
taatacgactcactatagggacctatatcttctttgaggtcaatttcggcaacagaggagagccgaaatggacctcaaaaacctggcggcagcgcaaaagatg

SEQ ID NO: 129937 - DNA, 103 bp, Artificial Sequence
  Synthetic Polynucleotide
taatacgactcactatagggccaaggctttacctatatcttctttgaggtaacagaggagaacctcaatgaagatatagaacctggcggcagcgcaaaagatg

SEQ ID NO: 129938 - DNA, 103 bp, Artificial Sequence
  Synthetic Polynucleotide
taatacgactcactatagggccagccttttccaaggctttacctatatctaacagaggagaagatatatgtaaagccttaacctggcggcagcgcaaaagatg

SEQ ID NO: 129939 - DNA, 103 bp, Artificial Sequence
  Synthetic Polynucleotide
taatacgactcactatagggacgcatcagcctccccactggaaagatgacaacagaggagagtcatcatgccagtggggaacctggcggcagcgcaaaagatg

SEQ ID NO: 129940 - DNA, 103 bp, Artificial Sequence
  Synthetic Polynucleotide
taatacgactcactatagggctcttttcccccagccttttccaaggctttaacagaggagaaaagccatggaaaaggctaacctggcggcagcgcaaaagatg

SEQ ID NO: 129941 - DNA, 103 bp, Artificial Sequence
  Synthetic Polynucleotide
taatacgactcactatagggtttccaagaactcttttcccccagccttttaacagaggagaaaaaggatgggggaaaagaacctggcggcagcgcaaaagatg

SEQ ID NO: 129942 - DNA, 103 bp, Artificial Sequence
  Synthetic Polynucleotide
taatacgactcactatagggtcctttaccgtttccaagaactcttttcccaacagaggagagggaaaatggttcttggaaacctggcggcagcgcaaaagatg

SEQ ID NO: 129943 - DNA, 103 bp, Artificial Sequence
  Synthetic Polynucleotide
taatacgactcactatagggtttgcgaagctcctttaccgtttccaagaaaacagaggagattcttgatgacggtaaagaacctggcggcagcgcaaaagatg

SEQ ID NO: 129944 - DNA, 103 bp, Artificial Sequence
  Synthetic Polynucleotide
taatacgactcactatagggggccttgggatttgcgaagctcctttaccgaacagaggagacggtaaatgagcttcgcaaacctggcggcagcgcaaaagatg

SEQ ID NO: 129945 - DNA, 103 bp, Artificial Sequence
  Synthetic Polynucleotide
taatacgactcactatagggacttccaaagggccttgggatttgcgaagcaacagaggagagcttcgatgatcccaaggaacctggcggcagcgcaaaagatg

SEQ ID NO: 129946 - DNA, 103 bp, Artificial Sequence
  Synthetic Polynucleotide
taatacgactcactatagggggcttcggcgacttccaaagggccttgggaaacagaggagatcccaaatgcctttggaaaacctggcggcagcgcaaaagatg

SEQ ID NO: 129947 - DNA, 103 bp, Artificial Sequence
  Synthetic Polynucleotide
taatacgactcactatagggggctgacggcggcttcggcgacttccaaagaacagaggagactttggatgtcgccgaagaacctggcggcagcgcaaaagatg

SEQ ID NO: 129948 - DNA, 103 bp, Artificial Sequence
  Synthetic Polynucleotide
taatacgactcactatagggccactggattggctgacggcggcttcggcgaacagaggagacgccgaatgcgccgtcagaacctggcggcagcgcaaaagatg

SEQ ID NO: 129949 - DNA, 103 bp, Artificial Sequence
  Synthetic Polynucleotide
taatacgactcactatagggggctgcgagtccactggattggctgacggcaacagaggagagccgtcatgcaatccagtaacctggcggcagcgcaaaagatg

SEQ ID NO: 129950 - DNA, 103 bp, Artificial Sequence
  Synthetic Polynucleotide
taatacgactcactatagggtcttcagataacgcatcagcctccccactgaacagaggagacagtggatgggctgatgcaacctggcggcagcgcaaaagatg

SEQ ID NO: 129951 - DNA, 103 bp, Artificial Sequence
  Synthetic Polynucleotide
taatacgactcactatagggtgacaaatttggctgcgagtccactggattaacagaggagaaatccaatggactcgcagaacctggcggcagcgcaaaagatg

SEQ ID NO: 129952 - DNA, 103 bp, Artificial Sequence
  Synthetic Polynucleotide
taatacgactcactatagggtgacagtggatgacaaatttggctgcgagtaacagaggagaactcgcatgcaaatttgtaacctggcggcagcgcaaaagatg

SEQ ID NO: 129953 - DNA, 103 bp, Artificial Sequence
  Synthetic Polynucleotide
taatacgactcactatagggctgagggatgtgacagtggatgacaaatttaacagaggagaaaatttatgatccactgtaacctggcggcagcgcaaaagatg

SEQ ID NO: 129954 - DNA, 103 bp, Artificial Sequence
  Synthetic Polynucleotide
taatacgactcactatagggcggagccccactgagggatgtgacagtggaaacagaggagatccactatgacatccctcaacctggcggcagcgcaaaagatg

SEQ ID NO: 129955 - DNA, 103 bp, Artificial Sequence
  Synthetic Polynucleotide
taatacgactcactatagggtcacatttgtcggagccccactgagggatgaacagaggagacatcccatggtggggctcaacctggcggcagcgcaaaagatg

SEQ ID NO: 129956 - DNA, 103 bp, Artificial Sequence
  Synthetic Polynucleotide
taatacgactcactatagggaagctgttcttcacatttgtcggagccccaaacagaggagatggggcatggacaaatgtaacctggcggcagcgcaaaagatg

SEQ ID NO: 129957 - DNA, 103 bp, Artificial Sequence
  Synthetic Polynucleotide
taatacgactcactatagggtggtctcttcaagctgttcttcacatttgtaacagaggagaacaaatatgaagaacagcaacctggcggcagcgcaaaagatg

SEQ ID NO: 129958 - DNA, 103 bp, Artificial Sequence
  Synthetic Polynucleotide
taatacgactcactatagggcagtttttgatggtctcttcaagctgttctaacagaggagaagaacaatgtgaagagacaacctggcggcagcgcaaaagatg

SEQ ID NO: 129959 - DNA, 103 bp, Artificial Sequence
  Synthetic Polynucleotide
taatacgactcactatagggcgctgacaggcagtttttgatggtctcttcaacagaggagagaagagatgatcaaaaacaacctggcggcagcgcaaaagatg

SEQ ID NO: 129960 - DNA, 103 bp, Artificial Sequence
  Synthetic Polynucleotide
taatacgactcactatagggtgtcctccgccgctgacaggcagtttttgaaacagaggagatcaaaaatggcctgtcagaacctggcggcagcgcaaaagatg

SEQ ID NO: 129961 - DNA, 103 bp, Artificial Sequence
  Synthetic Polynucleotide
taatacgactcactatagggaacgtccctttcttcagataacgcatcagcaacagaggagagctgatatgttatctgaaaacctggcggcagcgcaaaagatg

SEQ ID NO: 129962 - DNA, 103 bp, Artificial Sequence
  Synthetic Polynucleotide
taatacgactcactatagggtttagcttcttgtcctccgccgctgacaggaacagaggagacctgtcatgggcggaggaaacctggcggcagcgcaaaagatg

SEQ ID NO: 129963 - DNA, 103 bp, Artificial Sequence
  Synthetic Polynucleotide
taatacgactcactatagggcgcgacggactttagcttcttgtcctccgcaacagaggagagcggagatgaagaagctaaacctggcggcagcgcaaaagatg

SEQ ID NO: 129964 - DNA, 103 bp, Artificial Sequence
  Synthetic Polynucleotide
taatacgactcactatagggaaggcgggaacgcgacggactttagcttctaacagaggagaagaagcatgagtccgtcgaacctggcggcagcgcaaaagatg

SEQ ID NO: 129965 - DNA, 103 bp, Artificial Sequence
  Synthetic Polynucleotide
taatacgactcactatagggccgctggggaaaggcgggaacgcgacggacaacagaggagagtccgtatggttcccgccaacctggcggcagcgcaaaagatg

SEQ ID NO: 129966 - DNA, 103 bp, Artificial Sequence
  Synthetic Polynucleotide
taatacgactcactataggggcagtttctgccgctggggaaaggcgggaaaacagaggagattcccgatgttccccagcaacctggcggcagcgcaaaagatg

SEQ ID NO: 129967 - DNA, 103 bp, Artificial Sequence
  Synthetic Polynucleotide
taatacgactcactataggggtttgggaaagcagtttctgccgctggggaaacagaggagatccccaatggcagaaactaacctggcggcagcgcaaaagatg

SEQ ID NO: 129968 - DNA, 103 bp, Artificial Sequence
  Synthetic Polynucleotide
taatacgactcactataggggccgcagtctgtttgggaaagcagtttctgaacagaggagacagaaaatgctttcccaaaacctggcggcagcgcaaaagatg

SEQ ID NO: 129969 - DNA, 103 bp, Artificial Sequence
  Synthetic Polynucleotide
taatacgactcactatagggggtcacctgggccgcagtctgtttgggaaaaacagaggagatttcccatgcagactgcgaacctggcggcagcgcaaaagatg

SEQ ID NO: 129970 - DNA, 103 bp, Artificial Sequence
  Synthetic Polynucleotide
taatacgactcactatagggtggctttgagggtcacctgggccgcagtctaacagaggagaagactgatgcccaggtgaaacctggcggcagcgcaaaagatg

SEQ ID NO: 129971 - DNA, 103 bp, Artificial Sequence
  Synthetic Polynucleotide
taatacgactcactatagggtgggctgagatggctttgagggtcacctggaacagaggagaccaggtatgcctcaaagcaacctggcggcagcgcaaaagatg

SEQ ID NO: 129972 - DNA, 103 bp, Artificial Sequence
  Synthetic Polynucleotide
taatacgactcactatagggggagtcctttccagccttaccgccagccataacagaggagaatggctatgggtaaggctaacctggcggcagcgcaaaagatg

SEQ ID NO: 129973 - DNA, 103 bp, Artificial Sequence
  Synthetic Polynucleotide
taatacgactcactatagggcctagattttaggtgtcgatgaatacggccaacagaggagaggccgtatgcatcgacacaacctggcggcagcgcaaaagatg

SEQ ID NO: 129974 - DNA, 103 bp, Artificial Sequence
  Synthetic Polynucleotide
taatacgactcactataggggactggtcgtcctagattttaggtgtcgataacagaggagaatcgacatgtaaaatctaaacctggcggcagcgcaaaagatg

SEQ ID NO: 129975 - DNA, 103 bp, Artificial Sequence
  Synthetic Polynucleotide
taatacgactcactatagggacacgtccatgactggtcgtcctagattttaacagaggagaaaaatcatggacgaccagaacctggcggcagcgcaaaagatg

SEQ ID NO: 129976 - DNA, 103 bp, Artificial Sequence
  Synthetic Polynucleotide
taatacgactcactatagggagtcgcgcccacacgtccatgactggtcgtaacagaggagaacgaccatgcatggacgtaacctggcggcagcgcaaaagatg

SEQ ID NO: 129977 - DNA, 103 bp, Artificial Sequence
  Synthetic Polynucleotide
taatacgactcactatagggacacagcggcagtcgcgcccacacgtccataacagaggagaatggacatgtgggcgcgaaacctggcggcagcgcaaaagatg

SEQ ID NO: 129978 - DNA, 103 bp, Artificial Sequence
  Synthetic Polynucleotide
taatacgactcactataggggctgcgctgtacacagcggcagtcgcgcccaacagaggagagggcgcatgtgccgctgtaacctggcggcagcgcaaaagatg

SEQ ID NO: 129979 - DNA, 103 bp, Artificial Sequence
  Synthetic Polynucleotide
taatacgactcactatagggctccaggatggctgcgctgtacacagcggcaacagaggagagccgctatgtacagcgcaaacctggcggcagcgcaaaagatg

SEQ ID NO: 129980 - DNA, 103 bp, Artificial Sequence
  Synthetic Polynucleotide
taatacgactcactatagggcggtgaggtactccaggatggctgcgctgtaacagaggagaacagcgatgccatcctggaacctggcggcagcgcaaaagatg

SEQ ID NO: 129981 - DNA, 103 bp, Artificial Sequence
  Synthetic Polynucleotide
taatacgactcactatagggagtacctctgcggtgaggtactccaggatgaacagaggagacatcctatggtacctcacaacctggcggcagcgcaaaagatg

SEQ ID NO: 129982 - DNA, 103 bp, Artificial Sequence
  Synthetic Polynucleotide
taatacgactcactatagggtgccagttcaagtacctctgcggtgaggtaaacagaggagatacctcatggcagaggtaaacctggcggcagcgcaaaagatg

SEQ ID NO: 129983 - DNA, 103 bp, Artificial Sequence
  Synthetic Polynucleotide
taatacgactcactatagggtggcctttccggagtcctttccagccttacaacagaggagagtaaggatggaaaggactaacctggcggcagcgcaaaagatg

SEQ ID NO: 129984 - DNA, 103 bp, Artificial Sequence
  Synthetic Polynucleotide
taatacgactcactatagggatgcatttcctgccagttcaagtacctctgaacagaggagacagaggatgttgaactggaacctggcggcagcgcaaaagatg

SEQ ID NO: 129985 - DNA, 103 bp, Artificial Sequence
  Synthetic Polynucleotide
taatacgactcactatagggaagtcttttgatgcatttcctgccagttcaaacagaggagatgaactatgaggaaatgcaacctggcggcagcgcaaaagatg

SEQ ID NO: 129986 - DNA, 103 bp, Artificial Sequence
  Synthetic Polynucleotide
taatacgactcactatagggctttacctttaagtcttttgatgcatttccaacagaggagaggaaatatgtcaaaagacaacctggcggcagcgcaaaagatg

SEQ ID NO: 129987 - DNA, 103 bp, Artificial Sequence
  Synthetic Polynucleotide
taatacgactcactataggggggtaatacgctttacctttaagtcttttgaacagaggagacaaaagatgtaaaggtaaaacctggcggcagcgcaaaagatg

SEQ ID NO: 129988 - DNA, 103 bp, Artificial Sequence
  Synthetic Polynucleotide
taatacgactcactatagggaagtgacgaggggtaatacgctttacctttaacagaggagaaaaggtatggcgtattacaacctggcggcagcgcaaaagatg

SEQ ID NO: 129989 - DNA, 103 bp, Artificial Sequence
  Synthetic Polynucleotide
taatacgactcactatagggagcaagttgcaagtgacgaggggtaatacgaacagaggagacgtattatgcctcgtcacaacctggcggcagcgcaaaagatg

SEQ ID NO: 129990 - DNA, 103 bp, Artificial Sequence
  Synthetic Polynucleotide
taatacgactcactatagggctccacgaatagcaagttgcaagtgacgagaacagaggagactcgtcatgtgcaacttgaacctggcggcagcgcaaaagatg

SEQ ID NO: 129991 - DNA, 103 bp, Artificial Sequence
  Synthetic Polynucleotide
taatacgactcactatagggaattcttcatctccacgaatagcaagttgcaacagaggagagcaactatgtattcgtggaacctggcggcagcgcaaaagatg

SEQ ID NO: 129992 - DNA, 103 bp, Artificial Sequence
  Synthetic Polynucleotide
taatacgactcactataggggagagaatccaattcttcatctccacgaataacagaggagaattcgtatggatgaagaaaacctggcggcagcgcaaaagatg

SEQ ID NO: 129993 - DNA, 103 bp, Artificial Sequence
  Synthetic Polynucleotide
taatacgactcactatagggtagccttgatgagagaatccaattcttcataacagaggagaatgaagatgtggattctcaacctggcggcagcgcaaaagatg

SEQ ID NO: 129994 - DNA, 103 bp, Artificial Sequence
  Synthetic Polynucleotide
taatacgactcactataggggcctttgtcttggcctttccggagtcctttaacagaggagaaaaggaatgcggaaaggcaacctggcggcagcgcaaaagatg

SEQ ID NO: 129995 - DNA, 103 bp, Artificial Sequence
  Synthetic Polynucleotide
taatacgactcactatagggccagcaattgtagccttgatgagagaatccaacagaggagaggattcatgcatcaaggcaacctggcggcagcgcaaaagatg

SEQ ID NO: 129996 - DNA, 103 bp, Artificial Sequence
  Synthetic Polynucleotide
taatacgactcactataggggacaccaccaccagcaattgtagccttgataacagaggagaatcaagatgacaattgctaacctggcggcagcgcaaaagatg

SEQ ID NO: 129997 - DNA, 103 bp, Artificial Sequence
  Synthetic Polynucleotide
taatacgactcactatagggtgtgtggaatgacaccaccaccagcaattgaacagaggagacaattgatggtggtggtgaacctggcggcagcgcaaaagatg

SEQ ID NO: 129998 - DNA, 103 bp, Artificial Sequence
  Synthetic Polynucleotide
taatacgactcactataggggatttgtggatgtgtggaatgacaccaccaaacagaggagatggtggatgcattccacaaacctggcggcagcgcaaaagatg

SEQ ID NO: 129999 - DNA, 103 bp, Artificial Sequence
  Synthetic Polynucleotide
taatacgactcactatagggcccaatcagagatttgtggatgtgtggaataacagaggagaattccaatgatccacaaaaacctggcggcagcgcaaaagatg

SEQ ID NO: 130000 - DNA, 103 bp, Artificial Sequence
  Synthetic Polynucleotide
taatacgactcactataggggtcctttcttcccaatcagagatttgtggaaacagaggagatccacaatgctctgattgaacctggcggcagcgcaaaagatg

SEQ ID NO: 130001 - DNA, 103 bp, Artificial Sequence
  Synthetic Polynucleotide
taatacgactcactataggggtcttctgttgtcctttcttcccaatcagaaacagaggagatctgatatggaagaaaggaacctggcggcagcgcaaaagatg

SEQ ID NO: 130002 - DNA, 103 bp, Artificial Sequence
  Synthetic Polynucleotide
taatacgactcactataggggcgggaaaccgcctttgtcttggcctttccaacagaggagaggaaagatgaagacaaagaacctggcggcagcgcaaaagatg

SEQ ID NO: 130003 - DNA, 103 bp, Artificial Sequence
  Synthetic Polynucleotide
taatacgactcactatagggctctctgcgagcgggaaaccgcctttgtctaacagaggagaagacaaatgcggtttcccaacctggcggcagcgcaaaagatg

SEQ ID NO: 130004 - DNA, 103 bp, Artificial Sequence
  Synthetic Polynucleotide
taatacgactcactatagggtgcaagccggctctctgcgagcgggaaaccaacagaggagaggtttcatgctcgcagagaacctggcggcagcgcaaaagatg

SEQ ID NO: 130005 - DNA, 103 bp, Artificial Sequence
  Synthetic Polynucleotide
taatacgactcactatagggcactgggaactgcaagccggctctctgcgaaacagaggagatcgcagatggccggcttgaacctggcggcagcgcaaaagatg

SEQ ID NO: 130006 - DNA, 103 bp, Artificial Sequence
  Synthetic Polynucleotide
taatacgactcactataggggaatacggcccactgggaactgcaagccggaacagaggagaccggctatgagttcccagaacctggcggcagcgcaaaagatg

SEQ ID NO: 130007 - DNA, 103 bp, Artificial Sequence
  Synthetic Polynucleotide
taatacgactcactatagggaggtgtcgatgaatacggcccactgggaacaacagaggagagttcccatggggccgtataacctggcggcagcgcaaaagatg

SEQ ID NO: 130008 - DNA, 103 bp, Artificial Sequence
  Synthetic Polynucleotide
taatacgactcactatagggtttgcgggcagtctgctttgtacgagccataacagaggagaatggctatgacaaagcagaacctggcggcagcgcaaaagatg

SEQ ID NO: 130009 - DNA, 103 bp, Artificial Sequence
  Synthetic Polynucleotide
taatacgactcactatagggatgaggtttcttcacccctccagtagagggaacagaggagaccctctatgggaggggtgaacctggcggcagcgcaaaagatg

SEQ ID NO: 130010 - DNA, 103 bp, Artificial Sequence
  Synthetic Polynucleotide
taatacgactcactataggggcctgtaacgatgaggtttcttcacccctcaacagaggagagaggggatgagaaacctcaacctggcggcagcgcaaaagatg

SEQ ID NO: 130011 - DNA, 103 bp, Artificial Sequence
  Synthetic Polynucleotide
taatacgactcactatagggacagtaccaggcctgtaacgatgaggtttcaacagaggagagaaaccatgtcgttacagaacctggcggcagcgcaaaagatg

SEQ ID NO: 130012 - DNA, 103 bp, Artificial Sequence
  Synthetic Polynucleotide
taatacgactcactatagggacggagcgccacagtaccaggcctgtaacgaacagaggagacgttacatgcctggtactaacctggcggcagcgcaaaagatg

SEQ ID NO: 130013 - DNA, 103 bp, Artificial Sequence
  Synthetic Polynucleotide
taatacgactcactataggggtctaatttcacggagcgccacagtaccagaacagaggagactggtaatgtggcgctccaacctggcggcagcgcaaaagatg

SEQ ID NO: 130014 - DNA, 103 bp, Artificial Sequence
  Synthetic Polynucleotide
taatacgactcactatagggttctgataacgtctaatttcacggagcgccaacagaggagaggcgctatgtgaaattagaacctggcggcagcgcaaaagatg

SEQ ID NO: 130015 - DNA, 103 bp, Artificial Sequence
  Synthetic Polynucleotide
taatacgactcactatagggttcagtggacttctgataacgtctaatttcaacagaggagagaaattatgcgttatcagaacctggcggcagcgcaaaagatg

SEQ ID NO: 130016 - DNA, 103 bp, Artificial Sequence
  Synthetic Polynucleotide
taatacgactcactataggggaatcagaagttcagtggacttctgataacaacagaggagagttatcatgagtccactgaacctggcggcagcgcaaaagatg

SEQ ID NO: 130017 - DNA, 103 bp, Artificial Sequence
  Synthetic Polynucleotide
taatacgactcactatagggggaagtttgcgaatcagaagttcagtggacaacagaggagagtccacatgacttctgataacctggcggcagcgcaaaagatg

SEQ ID NO: 130018 - DNA, 103 bp, Artificial Sequence
  Synthetic Polynucleotide
taatacgactcactatagggacgctggaagggaagtttgcgaatcagaagaacagaggagacttctgatgcgcaaacttaacctggcggcagcgcaaaagatg

SEQ ID NO: 130019 - DNA, 103 bp, Artificial Sequence
  Synthetic Polynucleotide
taatacgactcactatagggcaccggtcgatttgcgggcagtctgctttgaacagaggagacaaagcatgctgcccgcaaacctggcggcagcgcaaaagatg

SEQ ID NO: 130020 - DNA, 103 bp, Artificial Sequence
  Synthetic Polynucleotide
taatacgactcactatagggctcgcaccagacgctggaagggaagtttgcaacagaggagagcaaacatgccttccagcaacctggcggcagcgcaaaagatg

SEQ ID NO: 130021 - DNA, 103 bp, Artificial Sequence
  Synthetic Polynucleotide
taatacgactcactatagggtgagcaatttctcgcaccagacgctggaagaacagaggagacttccaatgtctggtgcgaacctggcggcagcgcaaaagatg

SEQ ID NO: 130022 - DNA, 103 bp, Artificial Sequence
  Synthetic Polynucleotide
taatacgactcactatagggtttaaagtcctgagcaatttctcgcaccagaacagaggagactggtgatggaaattgctaacctggcggcagcgcaaaagatg

SEQ ID NO: 130023 - DNA, 103 bp, Artificial Sequence
  Synthetic Polynucleotide
taatacgactcactataggggcagatctgttttaaagtcctgagcaatttaacagaggagaaaattgatgaggactttaaacctggcggcagcgcaaaagatg

SEQ ID NO: 130024 - DNA, 103 bp, Artificial Sequence
  Synthetic Polynucleotide
taatacgactcactatagggctctggaagcgcagatctgttttaaagtccaacagaggagaggacttatgaacagatctaacctggcggcagcgcaaaagatg

SEQ ID NO: 130025 - DNA, 103 bp, Artificial Sequence
  Synthetic Polynucleotide
taatacgactcactataggggatagctgcgctctggaagcgcagatctgtaacagaggagaacagatatgcgcttccagaacctggcggcagcgcaaaagatg

SEQ ID NO: 130026 - DNA, 103 bp, Artificial Sequence
  Synthetic Polynucleotide
taatacgactcactataggggcaaagcaccgatagctgcgctctggaagcaacagaggagagcttccatggcgcagctaaacctggcggcagcgcaaaagatg

SEQ ID NO: 130027 - DNA, 103 bp, Artificial Sequence
  Synthetic Polynucleotide
taatacgactcactatagggcttgcctcctgcaaagcaccgatagctgcgaacagaggagacgcagcatgcggtgctttaacctggcggcagcgcaaaagatg

SEQ ID NO: 130028 - DNA, 103 bp, Artificial Sequence
  Synthetic Polynucleotide
taatacgactcactatagggataggcctcacttgcctcctgcaaagcaccaacagaggagaggtgctatgcaggaggcaaacctggcggcagcgcaaaagatg

SEQ ID NO: 130029 - DNA, 103 bp, Artificial Sequence
  Synthetic Polynucleotide
taatacgactcactatagggggccaaccagataggcctcacttgcctcctaacagaggagaaggaggatggtgaggcctaacctggcggcagcgcaaaagatg

SEQ ID NO: 130030 - DNA, 103 bp, Artificial Sequence
  Synthetic Polynucleotide
taatacgactcactatagggggtgctttaccaccggtcgatttgcgggcaaacagaggagatgcccgatgatcgaccggaacctggcggcagcgcaaaagatg

SEQ ID NO: 130031 - DNA, 103 bp, Artificial Sequence
  Synthetic Polynucleotide
taatacgactcactatagggtcttcaaaaaggccaaccagataggcctcaaacagaggagatgaggcatgtctggttggaacctggcggcagcgcaaaagatg

SEQ ID NO: 130032 - DNA, 103 bp, Artificial Sequence
  Synthetic Polynucleotide
taatacgactcactatagggcaggttggtgtcttcaaaaaggccaaccagaacagaggagactggttatgctttttgaaaacctggcggcagcgcaaaagatg

SEQ ID NO: 130033 - DNA, 103 bp, Artificial Sequence
  Synthetic Polynucleotide
taatacgactcactatagggggatagcacacaggttggtgtcttcaaaaaaacagaggagatttttgatgacaccaaccaacctggcggcagcgcaaaagatg

SEQ ID NO: 130034 - DNA, 103 bp, Artificial Sequence
  Synthetic Polynucleotide
taatacgactcactatagggcgtttggcatggatagcacacaggttggtgaacagaggagacaccaaatggtgtgctataacctggcggcagcgcaaaagatg

SEQ ID NO: 130035 - DNA, 103 bp, Artificial Sequence
  Synthetic Polynucleotide
taatacgactcactatagggaattgttacacgtttggcatggatagcacaaacagaggagatgtgctatgcatgccaaaaacctggcggcagcgcaaaagatg

SEQ ID NO: 130036 - DNA, 103 bp, Artificial Sequence
  Synthetic Polynucleotide
taatacgactcactatagggcttttggcataattgttacacgtttggcataacagaggagaatgccaatggtgtaacaaaacctggcggcagcgcaaaagatg

SEQ ID NO: 130037 - DNA, 103 bp, Artificial Sequence
  Synthetic Polynucleotide
taatacgactcactatagggagctggatgtcttttggcataattgttacaaacagaggagatgtaacatgtatgccaaaaacctggcggcagcgcaaaagatg

SEQ ID NO: 130038 - DNA, 103 bp, Artificial Sequence
  Synthetic Polynucleotide
taatacgactcactataggggcggcgtgctagctggatgtcttttggcataacagaggagaatgccaatggacatccagaacctggcggcagcgcaaaagatg

SEQ ID NO: 130039 - DNA, 103 bp, Artificial Sequence
  Synthetic Polynucleotide
taatacgactcactatagggctccacgtatgcggcgtgctagctggatgtaacagaggagaacatccatgtagcacgccaacctggcggcagcgcaaaagatg

SEQ ID NO: 130040 - DNA, 103 bp, Artificial Sequence
  Synthetic Polynucleotide
taatacgactcactatagggtaagcacgttctccacgtatgcggcgtgctaacagaggagaagcacgatgcatacgtggaacctggcggcagcgcaaaagatg

SEQ ID NO: 130041 - DNA, 103 bp, Artificial Sequence
  Synthetic Polynucleotide
taatacgactcactatagggttgcttcctgggtgctttaccaccggtcgaaacagaggagatcgaccatgggtaaagcaaacctggcggcagcgcaaaagatg

SEQ ID NO: 130042 - DNA, 103 bp, Artificial Sequence
  Synthetic Polynucleotide
taatacgactcactatagggttgtagccagttgcttcctgggtgctttacaacagaggagagtaaagatgccaggaagcaacctggcggcagcgcaaaagatg

SEQ ID NO: 130043 - DNA, 103 bp, Artificial Sequence
  Synthetic Polynucleotide
taatacgactcactatagggcgagcggcttttgtagccagttgcttcctgaacagaggagacaggaaatgactggctacaacctggcggcagcgcaaaagatg

SEQ ID NO: 130044 - DNA, 103 bp, Artificial Sequence
  Synthetic Polynucleotide
taatacgactcactatagggcgcactcttgcgagcggcttttgtagccagaacagaggagactggctatgaaagccgctaacctggcggcagcgcaaaagatg

SEQ ID NO: 130045 - DNA, 103 bp, Artificial Sequence
  Synthetic Polynucleotide
taatacgactcactatagggcagtagagggcgcactcttgcgagcggcttaacagaggagaaagccgatggcaagagtgaacctggcggcagcgcaaaagatg

SEQ ID NO: 130046 - DNA, 103 bp, Artificial Sequence
  Synthetic Polynucleotide
taatacgactcactatagggttcacccctccagtagagggcgcactcttgaacagaggagacaagagatggccctctacaacctggcggcagcgcaaaagatg

SEQ ID NO: 130047 - DNA, 103 bp, Artificial Sequence
  Synthetic Polynucleotide
taatacgactcactatagggcttacgagcagtctgcttggttcgggccataacagaggagaatggccatgaccaagcagaacctggcggcagcgcaaaagatg

SEQ ID NO: 130048 - DNA, 103 bp, Artificial Sequence
  Synthetic Polynucleotide
taatacgactcactatagggatgaggcttcttcaccccgccggtagagggaacagaggagaccctctatgggcggggtgaacctggcggcagcgcaaaagatg

SEQ ID NO: 130049 - DNA, 103 bp, Artificial Sequence
  Synthetic Polynucleotide
taatacgactcactataggggcctgtagcgatgaggcttcttcaccccgcaacagaggagagcggggatgagaagcctcaacctggcggcagcgcaaaagatg

SEQ ID NO: 130050 - DNA, 103 bp, Artificial Sequence
  Synthetic Polynucleotide
taatacgactcactatagggacggtcccgggcctgtagcgatgaggcttcaacagaggagagaagccatgtcgctacagaacctggcggcagcgcaaaagatg

SEQ ID NO: 130051 - DNA, 103 bp, Artificial Sequence
  Synthetic Polynucleotide
taatacgactcactatagggtcgaagcgccacggtcccgggcctgtagcgaacagaggagacgctacatgcccgggaccaacctggcggcagcgcaaaagatg

SEQ ID NO: 130052 - DNA, 103 bp, Artificial Sequence
  Synthetic Polynucleotide
taatacgactcactataggggacgaatctctcgaagcgccacggtcccggaacagaggagaccgggaatgtggcgcttcaacctggcggcagcgcaaaagatg

SEQ ID NO: 130053 - DNA, 103 bp, Artificial Sequence
  Synthetic Polynucleotide
taatacgactcactatagggttctgataacgacgaatctctcgaagcgccaacagaggagaggcgctatgagagattcgaacctggcggcagcgcaaaagatg

SEQ ID NO: 130054 - DNA, 103 bp, Artificial Sequence
  Synthetic Polynucleotide
taatacgactcactatagggctcggtcgacttctgataacgacgaatctcaacagaggagagagattatgcgttatcagaacctggcggcagcgcaaaagatg

SEQ ID NO: 130055 - DNA, 103 bp, Artificial Sequence
  Synthetic Polynucleotide
taatacgactcactatagggggatgagcagctcggtcgacttctgataacaacagaggagagttatcatgagtcgaccgaacctggcggcagcgcaaaagatg

SEQ ID NO: 130056 - DNA, 103 bp, Artificial Sequence
  Synthetic Polynucleotide
taatacgactcactatagggggcagcttccggatgagcagctcggtcgacaacagaggagagtcgacatggctgctcataacctggcggcagcgcaaaagatg

SEQ ID NO: 130057 - DNA, 103 bp, Artificial Sequence
  Synthetic Polynucleotide
taatacgactcactatagggcctctggaagggcagcttccggatgagcagaacagaggagactgctcatgcggaagctgaacctggcggcagcgcaaaagatg

SEQ ID NO: 130058 - DNA, 103 bp, Artificial Sequence
  Synthetic Polynucleotide
taatacgactcactatagggcaccggtggacttacgagcagtctgcttggaacagaggagaccaagcatgctgctcgtaaacctggcggcagcgcaaaagatg

SEQ ID NO: 130059 - DNA, 103 bp, Artificial Sequence
  Synthetic Polynucleotide
taatacgactcactatagggccctcaccaacctctggaagggcagcttccaacagaggagaggaagcatgccttccagaaacctggcggcagcgcaaaagatg

SEQ ID NO: 130060 - DNA, 103 bp, Artificial Sequence
  Synthetic Polynucleotide
taatacgactcactatagggtgcgcgatctccctcaccaacctctggaagaacagaggagacttccaatggttggtgagaacctggcggcagcgcaaaagatg

SEQ ID NO: 130061 - DNA, 103 bp, Artificial Sequence
  Synthetic Polynucleotide
taatacgactcactatagggtttgaaatcctgcgcgatctccctcaccaaaacagaggagattggtgatggagatcgcgaacctggcggcagcgcaaaagatg

SEQ ID NO: 130062 - DNA, 103 bp, Artificial Sequence
  Synthetic Polynucleotide
taatacgactcactatagggtcaggtcggttttgaaatcctgcgcgatctaacagaggagaagatcgatgaggatttcaaacctggcggcagcgcaaaagatg

SEQ ID NO: 130063 - DNA, 103 bp, Artificial Sequence
  Synthetic Polynucleotide
taatacgactcactatagggctctgaaacctcaggtcggttttgaaatccaacagaggagaggatttatgaaccgacctaacctggcggcagcgcaaaagatg

SEQ ID NO: 130064 - DNA, 103 bp, Artificial Sequence
  Synthetic Polynucleotide
taatacgactcactataggggatggctgcgctctgaaacctcaggtcggtaacagaggagaaccgacatgaggtttcagaacctggcggcagcgcaaaagatg

SEQ ID NO: 130065 - DNA, 103 bp, Artificial Sequence
  Synthetic Polynucleotide
taatacgactcactataggggcagcgcaccgatggctgcgctctgaaaccaacagaggagaggtttcatggcgcagccaaacctggcggcagcgcaaaagatg

SEQ ID NO: 130066 - DNA, 103 bp, Artificial Sequence
  Synthetic Polynucleotide
taatacgactcactatagggctagcctcctgcagcgcaccgatggctgcgaacagaggagacgcagcatgcggtgcgctaacctggcggcagcgcaaaagatg

SEQ ID NO: 130067 - DNA, 103 bp, Artificial Sequence
  Synthetic Polynucleotide
taatacgactcactataggggtacgcttcgctagcctcctgcagcgcaccaacagaggagaggtgcgatgcaggaggctaacctggcggcagcgcaaaagatg

SEQ ID NO: 130068 - DNA, 103 bp, Artificial Sequence
  Synthetic Polynucleotide
taatacgactcactataggggacccaccaggtacgcttcgctagcctcctaacagaggagaaggaggatggcgaagcgtaacctggcggcagcgcaaaagatg

SEQ ID NO: 130069 - DNA, 103 bp, Artificial Sequence
  Synthetic Polynucleotide
taatacgactcactatagggggggctttcccaccggtggacttacgagcaaacagaggagatgctcgatggtccaccggaacctggcggcagcgcaaaagatg

SEQ ID NO: 130070 - DNA, 103 bp, Artificial Sequence
  Synthetic Polynucleotide
taatacgactcactatagggtcttcgaacagacccaccaggtacgcttcgaacagaggagacgaagcatgcctggtgggaacctggcggcagcgcaaaagatg

SEQ ID NO: 130071 - DNA, 103 bp, Artificial Sequence
  Synthetic Polynucleotide
taatacgactcactatagggcaggttggtatcttcgaacagacccaccagaacagaggagactggtgatgctgttcgaaaacctggcggcagcgcaaaagatg

SEQ ID NO: 130072 - DNA, 103 bp, Artificial Sequence
  Synthetic Polynucleotide
taatacgactcactatagggggatggcacacaggttggtatcttcgaacaaacagaggagatgttcgatgataccaaccaacctggcggcagcgcaaaagatg

SEQ ID NO: 130073 - DNA, 103 bp, Artificial Sequence
  Synthetic Polynucleotide
taatacgactcactatagggctcttagcgtggatggcacacaggttggtaaacagaggagataccaaatggtgtgccataacctggcggcagcgcaaaagatg

SEQ ID NO: 130074 - DNA, 103 bp, Artificial Sequence
  Synthetic Polynucleotide
taatacgactcactataggggatggtgactctcttagcgtggatggcacaaacagaggagatgtgccatgcacgctaagaacctggcggcagcgcaaaagatg

SEQ ID NO: 130075 - DNA, 103 bp, Artificial Sequence
  Synthetic Polynucleotide
taatacgactcactatagggctttgggcatgatggtgactctcttagcgtaacagaggagaacgctaatggagtcaccaaacctggcggcagcgcaaaagatg

SEQ ID NO: 130076 - DNA, 103 bp, Artificial Sequence
  Synthetic Polynucleotide
taatacgactcactatagggaactggatgtctttgggcatgatggtgactaacagaggagaagtcacatgcatgcccaaaacctggcggcagcgcaaaagatg

SEQ ID NO: 130077 - DNA, 103 bp, Artificial Sequence
  Synthetic Polynucleotide
taatacgactcactatagggccggcgagccaactggatgtctttgggcataacagaggagaatgcccatggacatccagaacctggcggcagcgcaaaagatg

SEQ ID NO: 130078 - DNA, 103 bp, Artificial Sequence
  Synthetic Polynucleotide
taatacgactcactatagggctccccgtatccggcgagccaactggatgtaacagaggagaacatccatgtggctcgccaacctggcggcagcgcaaaagatg

SEQ ID NO: 130079 - DNA, 103 bp, Artificial Sequence
  Synthetic Polynucleotide
taatacgactcactatagggtaagctctctctccccgtatccggcgagccaacagaggagaggctcgatggatacggggaacctggcggcagcgcaaaagatg

SEQ ID NO: 130080 - DNA, 103 bp, Artificial Sequence
  Synthetic Polynucleotide
taatacgactcactatagggctgtttgcggggggctttcccaccggtggaaacagaggagatccaccatggggaaagccaacctggcggcagcgcaaaagatg

SEQ ID NO: 130081 - DNA, 103 bp, Artificial Sequence
  Synthetic Polynucleotide
taatacgactcactatagggtcgtggccagctgtttgcggggggctttccaacagaggagaggaaagatgcccgcaaacaacctggcggcagcgcaaaagatg

SEQ ID NO: 130082 - DNA, 103 bp, Artificial Sequence
  Synthetic Polynucleotide
taatacgactcactatagggctggcggctttcgtggccagctgtttgcggaacagaggagaccgcaaatggctggccacaacctggcggcagcgcaaaagatg

SEQ ID NO: 130083 - DNA, 103 bp, Artificial Sequence
  Synthetic Polynucleotide
taatacgactcactatagggagcgcttttcctggcggctttcgtggccagaacagaggagactggccatgaaagccgccaacctggcggcagcgcaaaagatg

SEQ ID NO: 130084 - DNA, 103 bp, Artificial Sequence
  Synthetic Polynucleotide
taatacgactcactatagggcggtagagggagcgcttttcctggcggcttaacagaggagaaagccgatgggaaaagcgaacctggcggcagcgcaaaagatg

SEQ ID NO: 130085 - DNA, 103 bp, Artificial Sequence
  Synthetic Polynucleotide
taatacgactcactatagggttcaccccgccggtagagggagcgcttttcaacagaggagagaaaagatgtccctctacaacctggcggcagcgcaaaagatg

SEQ ID NO: 130086 - DNA, 103 bp, Artificial Sequence
  Synthetic Polynucleotide
taatacgactcactatagggatggtgtgcgtagctgcccacgaggttcataacagaggagaatgaacatggtgggcagcaacctggcggcagcgcaaaagatg

SEQ ID NO: 130087 - DNA, 103 bp, Artificial Sequence
  Synthetic Polynucleotide
taatacgactcactataggggggcctttcctgatgacagcgcgaggccggaacagaggagaccggccatgcgctgtcataacctggcggcagcgcaaaagatg

SEQ ID NO: 130088 - DNA, 103 bp, Artificial Sequence
  Synthetic Polynucleotide
taatacgactcactatagggtctggaagtagggcctttcctgatgacagcaacagaggagagctgtcatgaggaaaggcaacctggcggcagcgcaaaagatg

SEQ ID NO: 130089 - DNA, 103 bp, Artificial Sequence
  Synthetic Polynucleotide
taatacgactcactatagggagcagccagctctggaagtagggcctttccaacagaggagaggaaagatgctacttccaaacctggcggcagcgcaaaagatg

SEQ ID NO: 130090 - DNA, 103 bp, Artificial Sequence
  Synthetic Polynucleotide
taatacgactcactatagggagccgggctcagcagccagctctggaagtaaacagaggagatacttcatgagctggctgaacctggcggcagcgcaaaagatg

SEQ ID NO: 130091 - DNA, 103 bp, Artificial Sequence
  Synthetic Polynucleotide
taatacgactcactataggggggcagcgtcagccgggctcagcagccagcaacagaggagagctggcatgtgagcccggaacctggcggcagcgcaaaagatg

SEQ ID NO: 130092 - DNA, 103 bp, Artificial Sequence
  Synthetic Polynucleotide
taatacgactcactataggggggaagtccggggcagcgtcagccgggctcaacagaggagagagcccatgtgacgctgcaacctggcggcagcgcaaaagatg

SEQ ID NO: 130093 - DNA, 103 bp, Artificial Sequence
  Synthetic Polynucleotide
taatacgactcactatagggcccgcccgcagggaagtccggggcagcgtcaacagaggagagacgctatgccggacttcaacctggcggcagcgcaaaagatg

SEQ ID NO: 130094 - DNA, 103 bp, Artificial Sequence
  Synthetic Polynucleotide
taatacgactcactatagggcgggcggcggcccgcccgcagggaagtccgaacagaggagacggactatgctgcgggcgaacctggcggcagcgcaaaagatg

SEQ ID NO: 130095 - DNA, 103 bp, Artificial Sequence
  Synthetic Polynucleotide
taatacgactcactataggggcagcggccgcgggcggcggcccgcccgcaaacagaggagatgcgggatggccgccgccaacctggcggcagcgcaaaagatg

SEQ ID NO: 130096 - DNA, 103 bp, Artificial Sequence
  Synthetic Polynucleotide
taatacgactcactatagggggtggcggctgcagcggccgcgggcggcggaacagaggagaccgccgatggcggccgctaacctggcggcagcgcaaaagatg

SEQ ID NO: 130097 - DNA, 103 bp, Artificial Sequence
  Synthetic Polynucleotide
taatacgactcactataggggatggtggtgatggtgtgcgtagctgcccaaacagaggagatgggcaatgacgcacaccaacctggcggcagcgcaaaagatg

SEQ ID NO: 130098 - DNA, 103 bp, Artificial Sequence
  Synthetic Polynucleotide
taatacgactcactataggggaccataggcggtggcggctgcagcggccgaacagaggagacggccgatgcagccgccaaacctggcggcagcgcaaaagatg

SEQ ID NO: 130099 - DNA, 103 bp, Artificial Sequence
  Synthetic Polynucleotide
taatacgactcactatagggctggcgtcaggaccataggcggtggcggctaacagaggagaagccgcatgcgcctatggaacctggcggcagcgcaaaagatg

SEQ ID NO: 130100 - DNA, 103 bp, Artificial Sequence
  Synthetic Polynucleotide
taatacgactcactatagggctgcccaggcctggcgtcaggaccataggcaacagaggagagcctatatgcctgacgccaacctggcggcagcgcaaaagatg

SEQ ID NO: 130101 - DNA, 103 bp, Artificial Sequence
  Synthetic Polynucleotide
taatacgactcactataggggcccggggctctgcccaggcctggcgtcagaacagaggagactgacgatgggcctgggcaacctggcggcagcgcaaaagatg

SEQ ID NO: 130102 - DNA, 103 bp, Artificial Sequence
  Synthetic Polynucleotide
taatacgactcactataggggcctccagccgcccggggctctgcccaggcaacagaggagagcctggatggagccccggaacctggcggcagcgcaaaagatg

SEQ ID NO: 130103 - DNA, 103 bp, Artificial Sequence
  Synthetic Polynucleotide
taatacgactcactataggggccgccaagcgcctccagccgcccggggctaacagaggagaagccccatgcggctggagaacctggcggcagcgcaaaagatg

SEQ ID NO: 130104 - DNA, 103 bp, Artificial Sequence
  Synthetic Polynucleotide
taatacgactcactatagggggccaagacggccgccaagcgcctccagccaacagaggagaggctggatgcgcttggcgaacctggcggcagcgcaaaagatg

SEQ ID NO: 130105 - DNA, 103 bp, Artificial Sequence
  Synthetic Polynucleotide
taatacgactcactatagggcctttccgccggccaagacggccgccaagcaacagaggagagcttggatgccgtcttggaacctggcggcagcgcaaaagatg

SEQ ID NO: 130106 - DNA, 103 bp, Artificial Sequence
  Synthetic Polynucleotide
taatacgactcactataggggggtcctgagcctttccgccggccaagacgaacagaggagacgtcttatgcggcggaaaaacctggcggcagcgcaaaagatg

SEQ ID NO: 130107 - DNA, 103 bp, Artificial Sequence
  Synthetic Polynucleotide
taatacgactcactataggggctccttcttgggtcctgagcctttccgccaacagaggagaggcggaatggctcaggacaacctggcggcagcgcaaaagatg

SEQ ID NO: 130108 - DNA, 103 bp, Artificial Sequence
  Synthetic Polynucleotide
taatacgactcactatagggtgcgggtggtgatggtggtgatggtgtgcgaacagaggagacgcacaatgtcaccaccaaacctggcggcagcgcaaaagatg

SEQ ID NO: 130109 - DNA, 103 bp, Artificial Sequence
  Synthetic Polynucleotide
taatacgactcactataggggtgcgtctccgctccttcttgggtcctgagaacagaggagactcaggatgcaagaaggaaacctggcggcagcgcaaaagatg

SEQ ID NO: 130110 - DNA, 103 bp, Artificial Sequence
  Synthetic Polynucleotide
taatacgactcactatagggaatgctctcagtgcgtctccgctccttcttaacagaggagaaagaagatgcggagacgcaacctggcggcagcgcaaaagatg

SEQ ID NO: 130111 - DNA, 103 bp, Artificial Sequence
  Synthetic Polynucleotide
taatacgactcactatagggatgcgctgttaatgctctcagtgcgtctccaacagaggagaggagacatgctgagagcaaacctggcggcagcgcaaaagatg

SEQ ID NO: 130112 - DNA, 103 bp, Artificial Sequence
  Synthetic Polynucleotide
taatacgactcactatagggaactccgcgaatgcgctgttaatgctctcaaacagaggagatgagagatgtaacagcgcaacctggcggcagcgcaaaagatg

SEQ ID NO: 130113 - DNA, 103 bp, Artificial Sequence
  Synthetic Polynucleotide
taatacgactcactataggggcactcgcgcaactccgcgaatgcgctgttaacagaggagaaacagcatgttcgcggagaacctggcggcagcgcaaaagatg

SEQ ID NO: 130114 - DNA, 103 bp, Artificial Sequence
  Synthetic Polynucleotide
taatacgactcactatagggcgttggggatgcactcgcgcaactccgcgaaacagaggagatcgcggatgtgcgcgagtaacctggcggcagcgcaaaagatg

SEQ ID NO: 130115 - DNA, 103 bp, Artificial Sequence
  Synthetic Polynucleotide
taatacgactcactatagggtcggccggcacgttggggatgcactcgcgcaacagaggagagcgcgaatgcatccccaaaacctggcggcagcgcaaaagatg

SEQ ID NO: 130116 - DNA, 103 bp, Artificial Sequence
  Synthetic Polynucleotide
taatacgactcactataggggagcttggtgtcggccggcacgttggggataacagaggagaatccccatggtgccggccaacctggcggcagcgcaaaagatg

SEQ ID NO: 130117 - DNA, 103 bp, Artificial Sequence
  Synthetic Polynucleotide
taatacgactcactatagggtgatcttggagagcttggtgtcggccggcaaacagaggagatgccggatgacaccaagcaacctggcggcagcgcaaaagatg

SEQ ID NO: 130118 - DNA, 103 bp, Artificial Sequence
  Synthetic Polynucleotide
taatacgactcactatagggcgcagagtcttgatcttggagagcttggtgaacagaggagacaccaaatgctccaagataacctggcggcagcgcaaaagatg

SEQ ID NO: 130119 - DNA, 103 bp, Artificial Sequence
  Synthetic Polynucleotide
taatacgactcactataggggtgcgcagggtgcgggtggtgatggtggtgaacagaggagacaccacatgcaccacccgaacctggcggcagcgcaaaagatg

SEQ ID NO: 130120 - DNA, 103 bp, Artificial Sequence
  Synthetic Polynucleotide
taatacgactcactatagggggtggctaggcgcagagtcttgatcttggaaacagaggagatccaagatgaagactctgaacctggcggcagcgcaaaagatg

SEQ ID NO: 130121 - DNA, 103 bp, Artificial Sequence
  Synthetic Polynucleotide
taatacgactcactatagggcgatgtagctggtggctaggcgcagagtctaacagaggagaagactcatggcctagccaaacctggcggcagcgcaaaagatg

SEQ ID NO: 130122 - DNA, 103 bp, Artificial Sequence
  Synthetic Polynucleotide
taatacgactcactatagggatcaggtaggcgatgtagctggtggctaggaacagaggagacctagcatgcagctacataacctggcggcagcgcaaaagatg

SEQ ID NO: 130123 - DNA, 103 bp, Artificial Sequence
  Synthetic Polynucleotide
taatacgactcactatagggcagcacgtccatcaggtaggcgatgtagctaacagaggagaagctacatggcctacctgaacctggcggcagcgcaaaagatg

SEQ ID NO: 130124 - DNA, 103 bp, Artificial Sequence
  Synthetic Polynucleotide
taatacgactcactatagggcatccttggccagcacgtccatcaggtaggaacagaggagacctaccatgtggacgtgcaacctggcggcagcgcaaaagatg

SEQ ID NO: 130125 - DNA, 103 bp, Artificial Sequence
  Synthetic Polynucleotide
taatacgactcactatagggccagactgtgcatccttggccagcacgtccaacagaggagaggacgtatgggccaaggaaacctggcggcagcgcaaaagatg

SEQ ID NO: 130126 - DNA, 103 bp, Artificial Sequence
  Synthetic Polynucleotide
taatacgactcactatagggctcgggatcgccagactgtgcatccttggcaacagaggagagccaagatggcacagtctaacctggcggcagcgcaaaagatg

SEQ ID NO: 130127 - DNA, 103 bp, Artificial Sequence
  Synthetic Polynucleotide
taatacgactcactatagggccttgaaggcctcgggatcgccagactgtgaacagaggagacacagtatggcgatcccgaacctggcggcagcgcaaaagatg

SEQ ID NO: 130128 - DNA, 103 bp, Artificial Sequence
  Synthetic Polynucleotide
taatacgactcactatagggttgagttcagccttgaaggcctcgggatcgaacagaggagacgatccatgggccttcaaaacctggcggcagcgcaaaagatg

SEQ ID NO: 130129 - DNA, 103 bp, Artificial Sequence
  Synthetic Polynucleotide
taatacgactcactatagggatccgccttcttgagttcagccttgaaggcaacagaggagagccttcatggctgaactcaacctggcggcagcgcaaaagatg

SEQ ID NO: 130130 - DNA, 103 bp, Artificial Sequence
  Synthetic Polynucleotide
taatacgactcactatagggggagcatggggtgcgcagggtgcgggtggtaacagaggagaaccaccatgaccctgcgcaacctggcggcagcgcaaaagatg

SEQ ID NO: 130131 - DNA, 103 bp, Artificial Sequence
  Synthetic Polynucleotide
taatacgactcactatagggcacggccgccatccgccttcttgagttcagaacagaggagactgaacatgagaaggcggaacctggcggcagcgcaaaagatg

SEQ ID NO: 130132 - DNA, 103 bp, Artificial Sequence
  Synthetic Polynucleotide
taatacgactcactatagggcgcttgctctcacggccgccatccgccttcaacagaggagagaaggcatgtggcggccgaacctggcggcagcgcaaaagatg

SEQ ID NO: 130133 - DNA, 103 bp, Artificial Sequence
  Synthetic Polynucleotide
taatacgactcactatagggctcccttttccgcttgctctcacggccgccaacagaggagaggcggcatggagagcaagaacctggcggcagcgcaaaagatg

SEQ ID NO: 130134 - DNA, 103 bp, Artificial Sequence
  Synthetic Polynucleotide
taatacgactcactataggggctgctgcagctcccttttccgcttgctctaacagaggagaagagcaatgggaaaagggaacctggcggcagcgcaaaagatg

SEQ ID NO: 130135 - DNA, 103 bp, Artificial Sequence
  Synthetic Polynucleotide
taatacgactcactatagggaaaccttcgtgctgctgcagctcccttttcaacagaggagagaaaagatggctgcagcaaacctggcggcagcgcaaaagatg

SEQ ID NO: 130136 - DNA, 103 bp, Artificial Sequence
  Synthetic Polynucleotide
taatacgactcactatagggggcaggaggaaaaccttcgtgctgctgcagaacagaggagactgcagatgcacgaaggtaacctggcggcagcgcaaaagatg

SEQ ID NO: 130137 - DNA, 103 bp, Artificial Sequence
  Synthetic Polynucleotide
taatacgactcactatagggctgggcccagggcaggaggaaaaccttcgtaacagaggagaacgaagatgttcctcctgaacctggcggcagcgcaaaagatg

SEQ ID NO: 130138 - DNA, 103 bp, Artificial Sequence
  Synthetic Polynucleotide
taatacgactcactatagggctcttctcgactgggcccagggcaggaggaaacagaggagatcctccatgcctgggcccaacctggcggcagcgcaaaagatg

SEQ ID NO: 130139 - DNA, 103 bp, Artificial Sequence
  Synthetic Polynucleotide
taatacgactcactatagggtcctttaatcctcttctcgactgggcccagaacagaggagactgggcatggtcgagaagaacctggcggcagcgcaaaagatg

SEQ ID NO: 130140 - DNA, 103 bp, Artificial Sequence
  Synthetic Polynucleotide
taatacgactcactatagggagccggtgcgtcctttaatcctcttctcgaaacagaggagatcgagaatgggattaaagaacctggcggcagcgcaaaagatg

SEQ ID NO: 130141 - DNA, 103 bp, Artificial Sequence
  Synthetic Polynucleotide
taatacgactcactatagggaagggttcgtggagcatggggtgcgcagggaacagaggagaccctgcatgccccatgctaacctggcggcagcgcaaaagatg

SEQ ID NO: 130142 - DNA, 103 bp, Artificial Sequence
  Synthetic Polynucleotide
taatacgactcactatagggtgctgcggccagccggtgcgtcctttaatcaacagaggagagattaaatgacgcaccggaacctggcggcagcgcaaaagatg

SEQ ID NO: 130143 - DNA, 103 bp, Artificial Sequence
  Synthetic Polynucleotide
taatacgactcactatagggcgcccagacttgctgcggccagccggtgcgaacagaggagacgcaccatgtggccgcagaacctggcggcagcgcaaaagatg

SEQ ID NO: 130144 - DNA, 103 bp, Artificial Sequence
  Synthetic Polynucleotide
taatacgactcactatagggttaactccagcgcccagacttgctgcggccaacagaggagaggccgcatgaagtctgggaacctggcggcagcgcaaaagatg

SEQ ID NO: 130145 - DNA, 103 bp, Artificial Sequence
  Synthetic Polynucleotide
taatacgactcactatagggaccgaagaggaagggttcgtggagcatgggaacagaggagacccatgatgcacgaacccaacctggcggcagcgcaaaagatg

SEQ ID NO: 130146 - DNA, 103 bp, Artificial Sequence
  Synthetic Polynucleotide
taatacgactcactataggggcgaggccggaccgaagaggaagggttcgtaacagaggagaacgaacatgtcctcttcgaacctggcggcagcgcaaaagatg

SEQ ID NO: 130147 - DNA, 103 bp, Artificial Sequence
  Synthetic Polynucleotide
taatacgactcactatagggtgatgacagcgcgaggccggaccgaagaggaacagaggagacctcttatgtccggcctcaacctggcggcagcgcaaaagatg

SEQ ID NO: 130148 - DNA, 103 bp, Artificial Sequence
  Synthetic Polynucleotide
taatacgactcactataggggtggtggggaaaaccacctaccagactcataacagaggagaatgagtatggtaggtggtaacctggcggcagcgcaaaagatg

SEQ ID NO: 130149 - DNA, 103 bp, Artificial Sequence
  Synthetic Polynucleotide
taatacgactcactataggggttctcctcatggctgcagcggctggcggcaacagaggagagccgccatgcgctgcagcaacctggcggcagcgcaaaagatg

SEQ ID NO: 130150 - DNA, 103 bp, Artificial Sequence
  Synthetic Polynucleotide
taatacgactcactatagggggaagtaggggttctcctcatggctgcagcaacagaggagagctgcaatgatgaggagaaacctggcggcagcgcaaaagatg

SEQ ID NO: 130151 - DNA, 103 bp, Artificial Sequence
  Synthetic Polynucleotide
taatacgactcactatagggagccagccatggaagtaggggttctcctcaaacagaggagatgaggaatgcccctacttaacctggcggcagcgcaaaagatg

SEQ ID NO: 130152 - DNA, 103 bp, Artificial Sequence
  Synthetic Polynucleotide
taatacgactcactataggggtggccgatgagccagccatggaagtagggaacagaggagaccctacatgcatggctggaacctggcggcagcgcaaaagatg

SEQ ID NO: 130153 - DNA, 103 bp, Artificial Sequence
  Synthetic Polynucleotide
taatacgactcactatagggacatctcggggtggccgatgagccagccataacagaggagaatggctatgtcatcggccaacctggcggcagcgcaaaagatg

SEQ ID NO: 130154 - DNA, 103 bp, Artificial Sequence
  Synthetic Polynucleotide
taatacgactcactatagggtcggggggcgacatctcggggtggccgatgaacagaggagacatcggatgccccgagataacctggcggcagcgcaaaagatg

SEQ ID NO: 130155 - DNA, 103 bp, Artificial Sequence
  Synthetic Polynucleotide
taatacgactcactatagggcatgctgtagtcggggggcgacatctcgggaacagaggagacccgagatgtcgccccccaacctggcggcagcgcaaaagatg

SEQ ID NO: 130156 - DNA, 103 bp, Artificial Sequence
  Synthetic Polynucleotide
taatacgactcactatagggaggacagggccatgctgtagtcggggggcgaacagaggagacgccccatgactacagcaaacctggcggcagcgcaaaagatg

SEQ ID NO: 130157 - DNA, 103 bp, Artificial Sequence
  Synthetic Polynucleotide
taatacgactcactatagggtcggggctgtaggacagggccatgctgtagaacagaggagactacagatgggccctgtcaacctggcggcagcgcaaaagatg

SEQ ID NO: 130158 - DNA, 103 bp, Artificial Sequence
  Synthetic Polynucleotide
taatacgactcactataggggctggcatactcggggctgtaggacagggcaacagaggagagccctgatgtacagccccaacctggcggcagcgcaaaagatg

SEQ ID NO: 130159 - DNA, 103 bp, Artificial Sequence
  Synthetic Polynucleotide
taatacgactcactataggggcaccaccgggtggtggggaaaaccacctaaacagaggagataggtgatgttccccaccaacctggcggcagcgcaaaagatg

SEQ ID NO: 130160 - DNA, 103 bp, Artificial Sequence
  Synthetic Polynucleotide
taatacgactcactatagggcggcggcgccgctggcatactcggggctgtaacagaggagaacagccatgagtatgccaaacctggcggcagcgcaaaagatg

SEQ ID NO: 130161 - DNA, 103 bp, Artificial Sequence
  Synthetic Polynucleotide
taatacgactcactatagggtggtccaggccggcggcgccgctggcatacaacagaggagagtatgcatgcggcgccgcaacctggcggcagcgcaaaagatg

SEQ ID NO: 130162 - DNA, 103 bp, Artificial Sequence
  Synthetic Polynucleotide
taatacgactcactataggggtaatgggagtggtccaggccggcggcgccaacagaggagaggcgccatgggcctggacaacctggcggcagcgcaaaagatg

SEQ ID NO: 130163 - DNA, 103 bp, Artificial Sequence
  Synthetic Polynucleotide
taatacgactcactataggggcacccccccgtaatgggagtggtccaggcaacagaggagagcctggatgactcccattaacctggcggcagcgcaaaagatg

SEQ ID NO: 130164 - DNA, 103 bp, Artificial Sequence
  Synthetic Polynucleotide
taatacgactcactataggggcgcccggcggcacccccccgtaatgggagaacagaggagactcccaatgcgggggggtaacctggcggcagcgcaaaagatg

SEQ ID NO: 130165 - DNA, 103 bp, Artificial Sequence
  Synthetic Polynucleotide
taatacgactcactatagggcgggggcccggcgcccggcggcacccccccaacagaggagaggggggatgccgccgggcaacctggcggcagcgcaaaagatg

SEQ ID NO: 130166 - DNA, 103 bp, Artificial Sequence
  Synthetic Polynucleotide
taatacgactcactatagggcccccaggcccgggggcccggcgcccggcgaacagaggagacgccggatgccgggccccaacctggcggcagcgcaaaagatg

SEQ ID NO: 130167 - DNA, 103 bp, Artificial Sequence
  Synthetic Polynucleotide
taatacgactcactataggggggcgcggcccccccaggcccgggggcccgaacagaggagacgggccatggggcctgggaacctggcggcagcgcaaaagatg

SEQ ID NO: 130168 - DNA, 103 bp, Artificial Sequence
  Synthetic Polynucleotide
taatacgactcactataggggcgcttcaccgggcgcggcccccccaggccaacagaggagaggcctgatggggccgcgcaacctggcggcagcgcaaaagatg

SEQ ID NO: 130169 - DNA, 103 bp, Artificial Sequence
  Synthetic Polynucleotide
taatacgactcactatagggcggtgcctcggcgcttcaccgggcgcggccaacagaggagaggccgcatgcggtgaagcaacctggcggcagcgcaaaagatg

SEQ ID NO: 130170 - DNA, 103 bp, Artificial Sequence
  Synthetic Polynucleotide
taatacgactcactatagggccctcgtggtgcaccaccgggtggtggggaaacagaggagatccccaatgcccggtggtaacctggcggcagcgcaaaagatg

SEQ ID NO: 130171 - DNA, 103 bp, Artificial Sequence
  Synthetic Polynucleotide
taatacgactcactatagggttgcggttggcggtgcctcggcgcttcaccaacagaggagaggtgaaatgccgaggcacaacctggcggcagcgcaaaagatg

SEQ ID NO: 130172 - DNA, 103 bp, Artificial Sequence
  Synthetic Polynucleotide
taatacgactcactataggggcgccgctccttgcggttggcggtgcctcgaacagaggagacgaggcatggccaaccgcaacctggcggcagcgcaaaagatg

SEQ ID NO: 130173 - DNA, 103 bp, Artificial Sequence
  Synthetic Polynucleotide
taatacgactcactatagggtctgagtcctgcgccgctccttgcggttggaacagaggagaccaaccatgaggagcggcaacctggcggcagcgcaaaagatg

SEQ ID NO: 130174 - DNA, 103 bp, Artificial Sequence
  Synthetic Polynucleotide
taatacgactcactatagggctgttgatgctctgagtcctgcgccgctccaacagaggagaggagcgatgcaggactcaaacctggcggcagcgcaaaagatg

SEQ ID NO: 130175 - DNA, 103 bp, Artificial Sequence
  Synthetic Polynucleotide
taatacgactcactatagggggcgaaggcgctgttgatgctctgagtcctaacagaggagaaggactatgagcatcaacaacctggcggcagcgcaaaagatg

SEQ ID NO: 130176 - DNA, 103 bp, Artificial Sequence
  Synthetic Polynucleotide
taatacgactcactatagggcgcgcagttcggcgaaggcgctgttgatgcaacagaggagagcatcaatggcgccttcgaacctggcggcagcgcaaaagatg

SEQ ID NO: 130177 - DNA, 103 bp, Artificial Sequence
  Synthetic Polynucleotide
taatacgactcactataggggggatgcactcgcgcagttcggcgaaggcgaacagaggagacgccttatgcgaactgcgaacctggcggcagcgcaaaagatg

SEQ ID NO: 130178 - DNA, 103 bp, Artificial Sequence
  Synthetic Polynucleotide
taatacgactcactataggggggtacgttggggatgcactcgcgcagttcaacagaggagagaactgatggagtgcatcaacctggcggcagcgcaaaagatg

SEQ ID NO: 130179 - DNA, 103 bp, Artificial Sequence
  Synthetic Polynucleotide
taatacgactcactatagggtggtgtcggcgggtacgttggggatgcactaacagaggagaagtgcaatgccaacgtacaacctggcggcagcgcaaaagatg

SEQ ID NO: 130180 - DNA, 103 bp, Artificial Sequence
  Synthetic Polynucleotide
taatacgactcactatagggttggagagtttggtgtcggcgggtacgttgaacagaggagacaacgtatgcgccgacacaacctggcggcagcgcaaaagatg

SEQ ID NO: 130181 - DNA, 103 bp, Artificial Sequence
  Synthetic Polynucleotide
taatacgactcactatagggaaacgggtagccctcgtggtgcaccaccggaacagaggagaccggtgatgcaccacgagaacctggcggcagcgcaaaagatg

SEQ ID NO: 130182 - DNA, 103 bp, Artificial Sequence
  Synthetic Polynucleotide
taatacgactcactatagggggtcttgattttggagagtttggtgtcggcaacagaggagagccgacatgaaactctccaacctggcggcagcgcaaaagatg

SEQ ID NO: 130183 - DNA, 103 bp, Artificial Sequence
  Synthetic Polynucleotide
taatacgactcactatagggccaggcgcagggtcttgattttggagagttaacagaggagaaactctatgaaatcaagaaacctggcggcagcgcaaaagatg

SEQ ID NO: 130184 - DNA, 103 bp, Artificial Sequence
  Synthetic Polynucleotide
taatacgactcactatagggtagctggtggccaggcgcagggtcttgattaacagaggagaaatcaaatgcctgcgcctaacctggcggcagcgcaaaagatg

SEQ ID NO: 130185 - DNA, 103 bp, Artificial Sequence
  Synthetic Polynucleotide
taatacgactcactataggggtaggcgatgtagctggtggccaggcgcagaacagaggagactgcgcatggccaccagcaacctggcggcagcgcaaaagatg

SEQ ID NO: 130186 - DNA, 103 bp, Artificial Sequence
  Synthetic Polynucleotide
taatacgactcactatagggggtccatgaggtaggcgatgtagctggtggaacagaggagaccaccaatgacatcgcctaacctggcggcagcgcaaaagatg

SEQ ID NO: 130187 - DNA, 103 bp, Artificial Sequence
  Synthetic Polynucleotide
taatacgactcactatagggttggccagcaggtccatgaggtaggcgatgaacagaggagacatcgcatgcctcatggaaacctggcggcagcgcaaaagatg

SEQ ID NO: 130188 - DNA, 103 bp, Artificial Sequence
  Synthetic Polynucleotide
taatacgactcactatagggctggtcgtccttggccagcaggtccatgagaacagaggagactcatgatgctgctggccaacctggcggcagcgcaaaagatg

SEQ ID NO: 130189 - DNA, 103 bp, Artificial Sequence
  Synthetic Polynucleotide
taatacgactcactatagggcctcgccattctggtcgtccttggccagcaaacagaggagatgctggatgaggacgaccaacctggcggcagcgcaaaagatg

SEQ ID NO: 130190 - DNA, 103 bp, Artificial Sequence
  Synthetic Polynucleotide
taatacgactcactatagggaaggcctccgcctcgccattctggtcgtccaacagaggagaggacgaatggaatggcgaaacctggcggcagcgcaaaagatg

SEQ ID NO: 130191 - DNA, 103 bp, Artificial Sequence
  Synthetic Polynucleotide
taatacgactcactatagggctctgccttgaaggcctccgcctcgccattaacagaggagaaatggcatggcggaggccaacctggcggcagcgcaaaagatg

SEQ ID NO: 130192 - DNA, 103 bp, Artificial Sequence
  Synthetic Polynucleotide
taatacgactcactatagggcggcggcggcaaacgggtagccctcgtggtaacagaggagaaccacgatggctacccgtaacctggcggcagcgcaaaagatg

SEQ ID NO: 130193 - DNA, 103 bp, Artificial Sequence
  Synthetic Polynucleotide
taatacgactcactatagggtcttcttgatctctgccttgaaggcctccgaacagaggagacggaggatgtcaaggcagaacctggcggcagcgcaaaagatg

SEQ ID NO: 130194 - DNA, 103 bp, Artificial Sequence
  Synthetic Polynucleotide
taatacgactcactatagggttcacgtcggtcttcttgatctctgccttgaacagaggagacaaggcatggatcaagaaaacctggcggcagcgcaaaagatg

SEQ ID NO: 130195 - DNA, 103 bp, Artificial Sequence
  Synthetic Polynucleotide
taatacgactcactatagggcttctcctctttcacgtcggtcttcttgataacagaggagaatcaagatgaccgacgtgaacctggcggcagcgcaaaagatg

SEQ ID NO: 130196 - DNA, 103 bp, Artificial Sequence
  Synthetic Polynucleotide
taatacgactcactatagggccttcttcctcttctcctctttcacgtcggaacagaggagaccgacgatgaagaggagaaacctggcggcagcgcaaaagatg

SEQ ID NO: 130197 - DNA, 103 bp, Artificial Sequence
  Synthetic Polynucleotide
taatacgactcactatagggtcgttcagctccttcttcctcttctcctctaacagaggagaagaggaatggaggaagaaaacctggcggcagcgcaaaagatg

SEQ ID NO: 130198 - DNA, 103 bp, Artificial Sequence
  Synthetic Polynucleotide
taatacgactcactatagggtttcaagatttcgttcagctccttcttcctaacagaggagaaggaagatggagctgaacaacctggcggcagcgcaaaagatg

SEQ ID NO: 130199 - DNA, 103 bp, Artificial Sequence
  Synthetic Polynucleotide
taatacgactcactatagggtcactgtgcttttcaagatttcgttcagctaacagaggagaagctgaatgaaatcttgaaacctggcggcagcgcaaaagatg

SEQ ID NO: 130200 - DNA, 103 bp, Artificial Sequence
  Synthetic Polynucleotide
taatacgactcactatagggtcgttgctgctcactgtgcttttcaagattaacagaggagaaatcttatgaagcacagtaacctggcggcagcgcaaaagatg

SEQ ID NO: 130201 - DNA, 103 bp, Artificial Sequence
  Synthetic Polynucleotide
taatacgactcactatagggggttttcttgtcgttgctgctcactgtgctaacagaggagaagcacaatgagcagcaacaacctggcggcagcgcaaaagatg

SEQ ID NO: 130202 - DNA, 103 bp, Artificial Sequence
  Synthetic Polynucleotide
taatacgactcactatagggtccggcctttggttttcttgtcgttgctgcaacagaggagagcagcaatgacaagaaaaaacctggcggcagcgcaaaagatg

SEQ ID NO: 130203 - DNA, 103 bp, Artificial Sequence
  Synthetic Polynucleotide
taatacgactcactataggggctgcggcggcggcggcggcaaacgggtagaacagaggagactacccatgtgccgccgcaacctggcggcagcgcaaaagatg

SEQ ID NO: 130204 - DNA, 103 bp, Artificial Sequence
  Synthetic Polynucleotide
taatacgactcactatagggggccagcccgtccggcctttggttttcttgaacagaggagacaagaaatgcaaaggccgaacctggcggcagcgcaaaagatg

SEQ ID NO: 130205 - DNA, 103 bp, Artificial Sequence
  Synthetic Polynucleotide
taatacgactcactataggggacgtgctgcggccagcccgtccggcctttaacagaggagaaaaggcatgacgggctggaacctggcggcagcgcaaaagatg

SEQ ID NO: 130206 - DNA, 103 bp, Artificial Sequence
  Synthetic Polynucleotide
taatacgactcactatagggccagggcccagacgtgctgcggccagcccgaacagaggagacgggctatgcgcagcacgaacctggcggcagcgcaaaagatg

SEQ ID NO: 130207 - DNA, 103 bp, Artificial Sequence
  Synthetic Polynucleotide
taatacgactcactatagggtgcttgagctccagggcccagacgtgctgcaacagaggagagcagcaatgctgggccctaacctggcggcagcgcaaaagatg

SEQ ID NO: 130208 - DNA, 103 bp, Artificial Sequence
  Synthetic Polynucleotide
taatacgactcactatagggggcggcggcagctgcggcggcggcggcggcaacagaggagagccgccatggccgccgcaaacctggcggcagcgcaaaagatg

SEQ ID NO: 130209 - DNA, 103 bp, Artificial Sequence
  Synthetic Polynucleotide
taatacgactcactatagggggctggcggcggcggcggcagctgcggcggaacagaggagaccgccgatgctgccgccgaacctggcggcagcgcaaaagatg

SEQ ID NO: 130210 - DNA, 103 bp, Artificial Sequence
  Synthetic Polynucleotide
taatacgactcactatagggtggctgcagcggctggcggcggcggcggcaaacagaggagatgccgcatgcgccgccagaacctggcggcagcgcaaaagatg

SEQ ID NO: 130211 - DNA, 103 bp, Artificial Sequence
  Synthetic Polynucleotide
taatacgactcactatagggtttcctccgggtgccctgcgtctgcgccataacagaggagaatggcgatgacgcagggcaacctggcggcagcgcaaaagatg

SEQ ID NO: 130212 - DNA, 103 bp, Artificial Sequence
  Synthetic Polynucleotide
taatacgactcactatagggattatgagtcatgcggattcggtgaggcttaacagaggagaaagcctatgcgaatccgcaacctggcggcagcgcaaaagatg

SEQ ID NO: 130213 - DNA, 103 bp, Artificial Sequence
  Synthetic Polynucleotide
taatacgactcactatagggatctggtccaaagtattcaaagtagtcattaacagaggagaaatgacatgtttgaatacaacctggcggcagcgcaaaagatg

SEQ ID NO: 130214 - DNA, 103 bp, Artificial Sequence
  Synthetic Polynucleotide
taatacgactcactatagggggagcttgaaatctggtccaaagtattcaaaacagaggagattgaatatgttggaccagaacctggcggcagcgcaaaagatg

SEQ ID NO: 130215 - DNA, 103 bp, Artificial Sequence
  Synthetic Polynucleotide
taatacgactcactatagggggactgatgtggagcttgaaatctggtccaaacagaggagatggaccatgtttcaagctaacctggcggcagcgcaaaagatg

SEQ ID NO: 130216 - DNA, 103 bp, Artificial Sequence
  Synthetic Polynucleotide
taatacgactcactatagggcatattggaaggactgatgtggagcttgaaaacagaggagattcaagatgcacatcagtaacctggcggcagcgcaaaagatg

SEQ ID NO: 130217 - DNA, 103 bp, Artificial Sequence
  Synthetic Polynucleotide
taatacgactcactatagggtctggttagtcatattggaaggactgatgtaacagaggagaacatcaatgcttccaataaacctggcggcagcgcaaaagatg

SEQ ID NO: 130218 - DNA, 103 bp, Artificial Sequence
  Synthetic Polynucleotide
taatacgactcactatagggtcattcgtgttctggttagtcatattggaaaacagaggagattccaaatggactaaccaaacctggcggcagcgcaaaagatg

SEQ ID NO: 130219 - DNA, 103 bp, Artificial Sequence
  Synthetic Polynucleotide
taatacgactcactatagggctccaggtactcattcgtgttctggttagtaacagaggagaactaacatgaacacgaataacctggcggcagcgcaaaagatg

SEQ ID NO: 130220 - DNA, 103 bp, Artificial Sequence
  Synthetic Polynucleotide
taatacgactcactataggggtttgatcttctccaggtactcattcgtgtaacagaggagaacacgaatgagtacctggaacctggcggcagcgcaaaagatg

SEQ ID NO: 130221 - DNA, 103 bp, Artificial Sequence
  Synthetic Polynucleotide
taatacgactcactatagggaacagtcgctgtttgatcttctccaggtacaacagaggagagtacctatggaagatcaaaacctggcggcagcgcaaaagatg

SEQ ID NO: 130222 - DNA, 103 bp, Artificial Sequence
  Synthetic Polynucleotide
taatacgactcactatagggaaggttctcaaacagtcgctgtttgatcttaacagaggagaaagatcatgcagcgactgaacctggcggcagcgcaaaagatg

SEQ ID NO: 130223 - DNA, 103 bp, Artificial Sequence
  Synthetic Polynucleotide
taatacgactcactatagggtgagcagcaaattatgagtcatgcggattcaacagaggagagaatccatgtgactcataaacctggcggcagcgcaaaagatg

SEQ ID NO: 130224 - DNA, 103 bp, Artificial Sequence
  Synthetic Polynucleotide
taatacgactcactataggggcagcattctaaggttctcaaacagtcgctaacagaggagaagcgacatgttgagaaccaacctggcggcagcgcaaaagatg

SEQ ID NO: 130225 - DNA, 103 bp, Artificial Sequence
  Synthetic Polynucleotide
taatacgactcactatagggggtgcgtgcggcagcattctaaggttctcaaacagaggagatgagaaatgtagaatgctaacctggcggcagcgcaaaagatg

SEQ ID NO: 130226 - DNA, 103 bp, Artificial Sequence
  Synthetic Polynucleotide
taatacgactcactatagggttggaccccaggtgcgtgcggcagcattctaacagaggagaagaatgatgccgcacgcaaacctggcggcagcgcaaaagatg

SEQ ID NO: 130227 - DNA, 103 bp, Artificial Sequence
  Synthetic Polynucleotide
taatacgactcactatagggtcgcctgcatttggaccccaggtgcgtgcgaacagaggagacgcacgatgctggggtccaacctggcggcagcgcaaaagatg

SEQ ID NO: 130228 - DNA, 103 bp, Artificial Sequence
  Synthetic Polynucleotide
taatacgactcactatagggtcctcaggaatcgcctgcatttggaccccaaacagaggagatggggtatgaatgcaggcaacctggcggcagcgcaaaagatg

SEQ ID NO: 130229 - DNA, 103 bp, Artificial Sequence
  Synthetic Polynucleotide
taatacgactcactatagggagggatggcgtcctcaggaatcgcctgcataacagaggagaatgcagatgattcctgagaacctggcggcagcgcaaaagatg

SEQ ID NO: 130230 - DNA, 103 bp, Artificial Sequence
  Synthetic Polynucleotide
taatacgactcactatagggcactctcctcagggatggcgtcctcaggaaaacagaggagattcctgatgacgccatccaacctggcggcagcgcaaaagatg

SEQ ID NO: 130231 - DNA, 103 bp, Artificial Sequence
  Synthetic Polynucleotide
taatacgactcactatagggtcctcatcgccactctcctcagggatggcgaacagaggagacgccatatgtgaggagagaacctggcggcagcgcaaaagatg

SEQ ID NO: 130232 - DNA, 103 bp, Artificial Sequence
  Synthetic Polynucleotide
taatacgactcactataggggtcgtcttcgtcctcatcgccactctcctcaacagaggagagaggagatgggcgatgagaacctggcggcagcgcaaaagatg

SEQ ID NO: 130233 - DNA, 103 bp, Artificial Sequence
  Synthetic Polynucleotide
taatacgactcactataggggcttgtcagggtcgtcttcgtcctcatcgcaacagaggagagcgatgatgacgaagacgaacctggcggcagcgcaaaagatg

SEQ ID NO: 130234 - DNA, 103 bp, Artificial Sequence
  Synthetic Polynucleotide
taatacgactcactatagggagaccatagttgagcagcaaattatgagtcaacagaggagagactcaatgtttgctgctaacctggcggcagcgcaaaagatg

SEQ ID NO: 130235 - DNA, 103 bp, Artificial Sequence
  Synthetic Polynucleotide
taatacgactcactatagggatcgagatgcgcttgtcagggtcgtcttcgaacagaggagacgaagaatgccctgacaaaacctggcggcagcgcaaaagatg

SEQ ID NO: 130236 - DNA, 103 bp, Artificial Sequence
  Synthetic Polynucleotide
taatacgactcactatagggagaggagcagatcgagatgcgcttgtcaggaacagaggagacctgacatgcgcatctcgaacctggcggcagcgcaaaagatg

SEQ ID NO: 130237 - DNA, 103 bp, Artificial Sequence
  Synthetic Polynucleotide
taatacgactcactatagggttcgtttgtcagaggagcagatcgagatgcaacagaggagagcatctatgtctgctcctaacctggcggcagcgcaaaagatg

SEQ ID NO: 130238 - DNA, 103 bp, Artificial Sequence
  Synthetic Polynucleotide
taatacgactcactatagggtcacaggcaattcgtttgtcagaggagcagaacagaggagactgctcatgtgacaaacgaacctggcggcagcgcaaaagatg

SEQ ID NO: 130239 - DNA, 103 bp, Artificial Sequence
  Synthetic Polynucleotide
taatacgactcactataggggaactcttcctcacaggcaattcgtttgtcaacagaggagagacaaaatgattgcctgtaacctggcggcagcgcaaaagatg

SEQ ID NO: 130240 - DNA, 103 bp, Artificial Sequence
  Synthetic Polynucleotide
taatacgactcactatagggcagaatcggagaactcttcctcacaggcaaaacagaggagattgcctatgaggaagagtaacctggcggcagcgcaaaagatg

SEQ ID NO: 130241 - DNA, 103 bp, Artificial Sequence
  Synthetic Polynucleotide
taatacgactcactatagggccctcctcttcagaatcggagaactcttccaacagaggagaggaagaatgctccgattcaacctggcggcagcgcaaaagatg

SEQ ID NO: 130242 - DNA, 103 bp, Artificial Sequence
  Synthetic Polynucleotide
taatacgactcactataggggcccccctctccctcctcttcagaatcggaaacagaggagatccgatatggaagaggagaacctggcggcagcgcaaaagatg

SEQ ID NO: 130243 - DNA, 103 bp, Artificial Sequence
  Synthetic Polynucleotide
taatacgactcactatagggagttcttgcggcccccctctccctcctcttaacagaggagaaagaggatggagagggggaacctggcggcagcgcaaaagatg

SEQ ID NO: 130244 - DNA, 103 bp, Artificial Sequence
  Synthetic Polynucleotide
taatacgactcactatagggaagttggaagagttcttgcggcccccctctaacagaggagaagagggatgccgcaagaaaacctggcggcagcgcaaaagatg

SEQ ID NO: 130245 - DNA, 103 bp, Artificial Sequence
  Synthetic Polynucleotide
taatacgactcactatagggttttcggtagagaccatagttgagcagcaaaacagaggagattgctgatgaactatggtaacctggcggcagcgcaaaagatg

SEQ ID NO: 130246 - DNA, 103 bp, Artificial Sequence
  Synthetic Polynucleotide
taatacgactcactatagggggcttttttgaagttggaagagttcttgcgaacagaggagacgcaagatgtcttccaacaacctggcggcagcgcaaaagatg

SEQ ID NO: 130247 - DNA, 103 bp, Artificial Sequence
  Synthetic Polynucleotide
taatacgactcactatagggtgactctcttggcttttttgaagttggaagaacagaggagacttccaatgtcaaaaaagaacctggcggcagcgcaaaagatg

SEQ ID NO: 130248 - DNA, 103 bp, Artificial Sequence
  Synthetic Polynucleotide
taatacgactcactatagggtcctctgttttgactctcttggcttttttgaacagaggagacaaaaaatgcaagagagtaacctggcggcagcgcaaaagatg

SEQ ID NO: 130249 - DNA, 103 bp, Artificial Sequence
  Synthetic Polynucleotide
taatacgactcactatagggctctttttcatcctctgttttgactctcttaacagaggagaaagagaatgaaaacagagaacctggcggcagcgcaaaagatg

SEQ ID NO: 130250 - DNA, 103 bp, Artificial Sequence
  Synthetic Polynucleotide
taatacgactcactatagggctgggtctttctctttttcatcctctgtttaacagaggagaaaacagatgatgaaaaagaacctggcggcagcgcaaaagatg

SEQ ID NO: 130251 - DNA, 103 bp, Artificial Sequence
  Synthetic Polynucleotide
taatacgactcactatagggttcttctcctctgggtctttctctttttcaaacagaggagatgaaaaatggaaagacccaacctggcggcagcgcaaaagatg

SEQ ID NO: 130252 - DNA, 103 bp, Artificial Sequence
  Synthetic Polynucleotide
taatacgactcactatagggggtgacttctttcttctcctctgggtctttaacagaggagaaaagacatggaggagaagaacctggcggcagcgcaaaagatg

SEQ ID NO: 130253 - DNA, 103 bp, Artificial Sequence
  Synthetic Polynucleotide
taatacgactcactatagggtctcctcttcggtgacttctttcttctcctaacagaggagaaggagaatgaagaagtcaaacctggcggcagcgcaaaagatg

SEQ ID NO: 130254 - DNA, 103 bp, Artificial Sequence
  Synthetic Polynucleotide
taatacgactcactatagggtccttggttttctcctcttcggtgacttctaacagaggagaagaagtatgcgaagaggaaacctggcggcagcgcaaaagatg

SEQ ID NO: 130255 - DNA, 103 bp, Artificial Sequence
  Synthetic Polynucleotide
taatacgactcactatagggtggcttctcctccttggttttctcctcttcaacagaggagagaagagatgaaaaccaagaacctggcggcagcgcaaaagatg

SEQ ID NO: 130256 - DNA, 103 bp, Artificial Sequence
  Synthetic Polynucleotide
taatacgactcactatagggagatttccatttttcggtagagaccatagtaacagaggagaactatgatgtctaccgaaaacctggcggcagcgcaaaagatg

SEQ ID NO: 130257 - DNA, 103 bp, Artificial Sequence
  Synthetic Polynucleotide
taatacgactcactatagggctttggcttctggcttctcctccttggtttaacagaggagaaaaccaatgaggagaagcaacctggcggcagcgcaaaagatg

SEQ ID NO: 130258 - DNA, 103 bp, Artificial Sequence
  Synthetic Polynucleotide
taatacgactcactatagggtccttgacccctttggcttctggcttctccaacagaggagaggagaaatgagaagccaaaacctggcggcagcgcaaaagatg

SEQ ID NO: 130259 - DNA, 103 bp, Artificial Sequence
  Synthetic Polynucleotide
taatacgactcactatagggcttgacctcctccttgacccctttggcttcaacagaggagagaagccatgggggtcaagaacctggcggcagcgcaaaagatg

SEQ ID NO: 130260 - DNA, 103 bp, Artificial Sequence
  Synthetic Polynucleotide
taatacgactcactatagggtgagggcgatagatttccatttttcggtagaacagaggagactaccgatgaatggaaataacctggcggcagcgcaaaagatg

SEQ ID NO: 130261 - DNA, 103 bp, Artificial Sequence
  Synthetic Polynucleotide
taatacgactcactatagggattggctttgtgagggcgatagatttccataacagaggagaatggaaatgtatcgccctaacctggcggcagcgcaaaagatg

SEQ ID NO: 130262 - DNA, 103 bp, Artificial Sequence
  Synthetic Polynucleotide
taatacgactcactatagggtctcctcagcattggctttgtgagggcgataacagaggagaatcgccatgacaaagccaaacctggcggcagcgcaaaagatg

SEQ ID NO: 130263 - DNA, 103 bp, Artificial Sequence
  Synthetic Polynucleotide
taatacgactcactatagggtacttggtcatctcctcagcattggctttgaacagaggagacaaagcatgtgctgaggaaacctggcggcagcgcaaaagatg

SEQ ID NO: 130264 - DNA, 103 bp, Artificial Sequence
  Synthetic Polynucleotide
taatacgactcactatagggatcgctgtggtacttggtcatctcctcagcaacagaggagagctgagatgatgaccaagaacctggcggcagcgcaaaagatg

SEQ ID NO: 130265 - DNA, 103 bp, Artificial Sequence
  Synthetic Polynucleotide
taatacgactcactatagggagtaacagactttcctccgggtgccctgcgaacagaggagacgcaggatgcccggaggaaacctggcggcagcgcaaaagatg

SEQ ID NO: 130266 - DNA, 103 bp, Artificial Sequence
  Synthetic Polynucleotide
taatacgactcactatagggtaatgtagtcatcgctgtggtacttggtcaaacagaggagatgaccaatgaccacagcgaacctggcggcagcgcaaaagatg

SEQ ID NO: 130267 - DNA, 103 bp, Artificial Sequence
  Synthetic Polynucleotide
taatacgactcactatagggcgcaagaatttaatgtagtcatcgctgtggaacagaggagaccacagatgtgactacataacctggcggcagcgcaaaagatg

SEQ ID NO: 130268 - DNA, 103 bp, Artificial Sequence
  Synthetic Polynucleotide
taatacgactcactatagggacggatggagcgcaagaatttaatgtagtcaacagaggagagactacatgaaattcttgaacctggcggcagcgcaaaagatg

SEQ ID NO: 130269 - DNA, 103 bp, Artificial Sequence
  Synthetic Polynucleotide
taatacgactcactatagggtgttatctggacggatggagcgcaagaattaacagaggagaaattctatggctccatccaacctggcggcagcgcaaaagatg

SEQ ID NO: 130270 - DNA, 103 bp, Artificial Sequence
  Synthetic Polynucleotide
taatacgactcactatagggtactccgacatgttatctggacggatggagaacagaggagactccatatgtccagataaaacctggcggcagcgcaaaagatg

SEQ ID NO: 130271 - DNA, 103 bp, Artificial Sequence
  Synthetic Polynucleotide
taatacgactcactatagggctgcttgctgtactccgacatgttatctggaacagaggagaccagatatgatgtcggagaacctggcggcagcgcaaaagatg

SEQ ID NO: 130272 - DNA, 103 bp, Artificial Sequence
  Synthetic Polynucleotide
taatacgactcactatagggatctctgcatctgcttgctgtactccgacaaacagaggagatgtcggatgacagcaagcaacctggcggcagcgcaaaagatg

SEQ ID NO: 130273 - DNA, 103 bp, Artificial Sequence
  Synthetic Polynucleotide
taatacgactcactatagggccaacgttgaatctctgcatctgcttgctgaacagaggagacagcaaatggatgcagagaacctggcggcagcgcaaaagatg

SEQ ID NO: 130274 - DNA, 103 bp, Artificial Sequence
  Synthetic Polynucleotide
taatacgactcactatagggacagtcctcaccaacgttgaatctctgcataacagaggagaatgcagatgttcaacgttaacctggcggcagcgcaaaagatg

SEQ ID NO: 130275 - DNA, 103 bp, Artificial Sequence
  Synthetic Polynucleotide
taatacgactcactatagggcgaatactggacagtcctcaccaacgttgaaacagaggagatcaacgatggtgaggactaacctggcggcagcgcaaaagatg

SEQ ID NO: 130276 - DNA, 103 bp, Artificial Sequence
  Synthetic Polynucleotide
taatacgactcactatagggccgtcgtagtagtaacagactttcctccggaacagaggagaccggagatgagtctgttaaacctggcggcagcgcaaaagatg

SEQ ID NO: 130277 - DNA, 103 bp, Artificial Sequence
  Synthetic Polynucleotide
taatacgactcactatagggaacaggccatcgaatactggacagtcctcaaacagaggagatgaggaatgtccagtattaacctggcggcagcgcaaaagatg

SEQ ID NO: 130278 - DNA, 103 bp, Artificial Sequence
  Synthetic Polynucleotide
taatacgactcactatagggacagaactcaaacaggccatcgaatactggaacagaggagaccagtaatggatggcctgaacctggcggcagcgcaaaagatg

SEQ ID NO: 130279 - DNA, 103 bp, Artificial Sequence
  Synthetic Polynucleotide
taatacgactcactatagggtagacaactgacagaactcaaacaggccataacagaggagaatggccatgttgagttctaacctggcggcagcgcaaaagatg

SEQ ID NO: 130280 - DNA, 103 bp, Artificial Sequence
  Synthetic Polynucleotide
taatacgactcactataggggaaccaccagtagacaactgacagaactcaaacagaggagatgagttatgtcagttgtcaacctggcggcagcgcaaaagatg

SEQ ID NO: 130281 - DNA, 103 bp, Artificial Sequence
  Synthetic Polynucleotide
taatacgactcactatagggacttgccacagaaccaccagtagacaactgaacagaggagacagttgatgactggtggtaacctggcggcagcgcaaaagatg

SEQ ID NO: 130282 - DNA, 103 bp, Artificial Sequence
  Synthetic Polynucleotide
taatacgactcactataggggtttcacagcacttgccacagaaccaccagaacagaggagactggtgatgctgtggcaaaacctggcggcagcgcaaaagatg

SEQ ID NO: 130283 - DNA, 103 bp, Artificial Sequence
  Synthetic Polynucleotide
taatacgactcactatagggtgcttattaagtttcacagcacttgccacaaacagaggagatgtggcatgtgctgtgaaaacctggcggcagcgcaaaagatg

SEQ ID NO: 130284 - DNA, 103 bp, Artificial Sequence
  Synthetic Polynucleotide
taatacgactcactataggggtccgtctgctgcttattaagtttcacagcaacagaggagagctgtgatgcttaataagaacctggcggcagcgcaaaagatg

SEQ ID NO: 130285 - DNA, 103 bp, Artificial Sequence
  Synthetic Polynucleotide
taatacgactcactatagggtcacagcgatgtccgtctgctgcttattaaaacagaggagattaataatgagcagacggaacctggcggcagcgcaaaagatg

SEQ ID NO: 130286 - DNA, 103 bp, Artificial Sequence
  Synthetic Polynucleotide
taatacgactcactatagggccagcccaattcacagcgatgtccgtctgcaacagaggagagcagacatgcatcgctgtaacctggcggcagcgcaaaagatg

SEQ ID NO: 130287 - DNA, 103 bp, Artificial Sequence
  Synthetic Polynucleotide
taatacgactcactatagggtccaacatccccgtcgtagtagtaacagacaacagaggagagtctgtatgtactacgacaacctggcggcagcgcaaaagatg

SEQ ID NO: 130288 - DNA, 103 bp, Artificial Sequence
  Synthetic Polynucleotide
taatacgactcactataggggtgcaggcccccagcccaattcacagcgataacagaggagaatcgctatgaattgggctaacctggcggcagcgcaaaagatg

SEQ ID NO: 130289 - DNA, 103 bp, Artificial Sequence
  Synthetic Polynucleotide
taatacgactcactatagggtctttgcatggtgcaggcccccagcccaataacagaggagaattgggatgggggcctgcaacctggcggcagcgcaaaagatg

SEQ ID NO: 130290 - DNA, 103 bp, Artificial Sequence
  Synthetic Polynucleotide
taatacgactcactataggggcctcggacttctttgcatggtgcaggcccaacagaggagagggcctatgccatgcaaaaacctggcggcagcgcaaaagatg

SEQ ID NO: 130291 - DNA, 103 bp, Artificial Sequence
  Synthetic Polynucleotide
taatacgactcactataggggaagccagatgcctcggacttctttgcatgaacagaggagacatgcaatgaagtccgagaacctggcggcagcgcaaaagatg

SEQ ID NO: 130292 - DNA, 103 bp, Artificial Sequence
  Synthetic Polynucleotide
taatacgactcactatagggtgacgtaacagaagccagatgcctcggactaacagaggagaagtccgatgcatctggctaacctggcggcagcgcaaaagatg

SEQ ID NO: 130293 - DNA, 103 bp, Artificial Sequence
  Synthetic Polynucleotide
taatacgactcactatagggacgatatcattgacgtaacagaagccagataacagaggagaatctggatgctgttacgtaacctggcggcagcgcaaaagatg

SEQ ID NO: 130294 - DNA, 103 bp, Artificial Sequence
  Synthetic Polynucleotide
taatacgactcactataggggatggccaagacgatatcattgacgtaacaaacagaggagatgttacatgaatgatatcaacctggcggcagcgcaaaagatg

SEQ ID NO: 130295 - DNA, 103 bp, Artificial Sequence
  Synthetic Polynucleotide
taatacgactcactataggggcagttccaggatggccaagacgatatcataacagaggagaatgataatgtcttggccaaacctggcggcagcgcaaaagatg

SEQ ID NO: 130296 - DNA, 103 bp, Artificial Sequence
  Synthetic Polynucleotide
taatacgactcactatagggtgatactttagcagttccaggatggccaagaacagaggagacttggcatgcctggaactaacctggcggcagcgcaaaagatg

SEQ ID NO: 130297 - DNA, 103 bp, Artificial Sequence
  Synthetic Polynucleotide
taatacgactcactatagggcaccctctggtgatactttagcagttccagaacagaggagactggaaatgctaaagtataacctggcggcagcgcaaaagatg

SEQ ID NO: 130298 - DNA, 103 bp, Artificial Sequence
  Synthetic Polynucleotide
taatacgactcactatagggaatagtaatttccaacatccccgtcgtagtaacagaggagaactacgatggggatgttgaacctggcggcagcgcaaaagatg

SEQ ID NO: 130299 - DNA, 103 bp, Artificial Sequence
  Synthetic Polynucleotide
taatacgactcactatagggcaatgtacagcaccctctggtgatactttaaacagaggagataaagtatgaccagagggaacctggcggcagcgcaaaagatg

SEQ ID NO: 130300 - DNA, 103 bp, Artificial Sequence
  Synthetic Polynucleotide
taatacgactcactatagggatatcaatgtcaatgtacagcaccctctggaacagaggagaccagagatggctgtacataacctggcggcagcgcaaaagatg

SEQ ID NO: 130301 - DNA, 103 bp, Artificial Sequence
  Synthetic Polynucleotide
taatacgactcactatagggaccatggtgaatatcaatgtcaatgtacagaacagaggagactgtacatggacattgataacctggcggcagcgcaaaagatg

SEQ ID NO: 130302 - DNA, 103 bp, Artificial Sequence
  Synthetic Polynucleotide
taatacgactcactatagggccacgccgtcaccatggtgaatatcaatgtaacagaggagaacattgatgttcaccatgaacctggcggcagcgcaaaagatg

SEQ ID NO: 130303 - DNA, 103 bp, Artificial Sequence
  Synthetic Polynucleotide
taatacgactcactatagggaaggcctcttccacgccgtcaccatggtgaaacagaggagatcaccaatgtgacggcgtaacctggcggcagcgcaaaagatg

SEQ ID NO: 130304 - DNA, 103 bp, Artificial Sequence
  Synthetic Polynucleotide
taatacgactcactatagggcgtggtgtagaaggcctcttccacgccgtcaacagaggagagacggcatggaagaggccaacctggcggcagcgcaaaagatg

SEQ ID NO: 130305 - DNA, 103 bp, Artificial Sequence
  Synthetic Polynucleotide
taatacgactcactatagggtgacccggtccgtggtgtagaaggcctcttaacagaggagaaagaggatgtctacaccaaacctggcggcagcgcaaaagatg

SEQ ID NO: 130306 - DNA, 103 bp, Artificial Sequence
  Synthetic Polynucleotide
taatacgactcactataggggacacagtcatgacccggtccgtggtgtagaacagaggagactacacatgggaccgggtaacctggcggcagcgcaaaagatg

SEQ ID NO: 130307 - DNA, 103 bp, Artificial Sequence
  Synthetic Polynucleotide
taatacgactcactatagggcttatgaaaggacacagtcatgacccggtcaacagaggagagaccggatgatgactgtgaacctggcggcagcgcaaaagatg

SEQ ID NO: 130308 - DNA, 103 bp, Artificial Sequence
  Synthetic Polynucleotide
taatacgactcactatagggactctccatacttatgaaaggacacagtcaaacagaggagatgactgatgcctttcataaacctggcggcagcgcaaaagatg

SEQ ID NO: 130309 - DNA, 103 bp, Artificial Sequence
  Synthetic Polynucleotide
taatacgactcactatagggccttgtccataatagtaatttccaacatccaacagaggagaggatgtatgaaattactaaacctggcggcagcgcaaaagatg

SEQ ID NO: 130310 - DNA, 103 bp, Artificial Sequence
  Synthetic Polynucleotide
taatacgactcactatagggcctgggaagtactctccatacttatgaaagaacagaggagactttcaatggtatggagaaacctggcggcagcgcaaaagatg

SEQ ID NO: 130311 - DNA, 103 bp, Artificial Sequence
  Synthetic Polynucleotide
taatacgactcactataggggtccccagttcctgggaagtactctccataaacagaggagatatggaatgtacttcccaaacctggcggcagcgcaaaagatg

SEQ ID NO: 130312 - DNA, 103 bp, Artificial Sequence
  Synthetic Polynucleotide
taatacgactcactatagggtatcccgtaggtccccagttcctgggaagtaacagaggagaacttccatggaactggggaacctggcggcagcgcaaaagatg

SEQ ID NO: 130313 - DNA, 103 bp, Artificial Sequence
  Synthetic Polynucleotide
taatacgactcactatagggccagccccgatatcccgtaggtccccagttaacagaggagaaactggatgcctacgggaaacctggcggcagcgcaaaagatg

SEQ ID NO: 130314 - DNA, 103 bp, Artificial Sequence
  Synthetic Polynucleotide
taatacgactcactatagggcttgcctttgccagccccgatatcccgtagaacagaggagactacggatgatcggggctaacctggcggcagcgcaaaagatg

SEQ ID NO: 130315 - DNA, 103 bp, Artificial Sequence
  Synthetic Polynucleotide
taatacgactcactatagggcagcataatacttgcctttgccagccccgaaacagaggagatcggggatggcaaaggcaaacctggcggcagcgcaaaagatg

SEQ ID NO: 130316 - DNA, 103 bp, Artificial Sequence
  Synthetic Polynucleotide
taatacgactcactataggggggtagttaacagcataatacttgcctttgaacagaggagacaaaggatggtattatgcaacctggcggcagcgcaaaagatg

SEQ ID NO: 130317 - DNA, 103 bp, Artificial Sequence
  Synthetic Polynucleotide
taatacgactcactataggggtctcggagcgggtagttaacagcataataaacagaggagatattatatggttaactacaacctggcggcagcgcaaaagatg

SEQ ID NO: 130318 - DNA, 103 bp, Artificial Sequence
  Synthetic Polynucleotide
taatacgactcactatagggcatcaatcccgtctcggagcgggtagttaaaacagaggagattaactatgcgctccgagaacctggcggcagcgcaaaagatg

SEQ ID NO: 130319 - DNA, 103 bp, Artificial Sequence
  Synthetic Polynucleotide
taatacgactcactatagggtaggactcgtcatcaatcccgtctcggagcaacagaggagagctccgatgcgggattgaaacctggcggcagcgcaaaagatg

SEQ ID NO: 130320 - DNA, 103 bp, Artificial Sequence
  Synthetic Polynucleotide
taatacgactcactatagggcattgggtggccttgtccataatagtaattaacagaggagaaattacatgtatggacaaaacctggcggcagcgcaaaagatg

SEQ ID NO: 130321 - DNA, 103 bp, Artificial Sequence
  Synthetic Polynucleotide
taatacgactcactatagggaatggcctcataggactcgtcatcaatcccaacagaggagagggattatggacgagtccaacctggcggcagcgcaaaagatg

SEQ ID NO: 130322 - DNA, 103 bp, Artificial Sequence
  Synthetic Polynucleotide
taatacgactcactatagggccggcttgaaaatggcctcataggactcgtaacagaggagaacgagtatgatgaggccaaacctggcggcagcgcaaaagatg

SEQ ID NO: 130323 - DNA, 103 bp, Artificial Sequence
  Synthetic Polynucleotide
taatacgactcactatagggttggacatgaccggcttgaaaatggcctcaaacagaggagatgaggcatgtttcaagccaacctggcggcagcgcaaaagatg

SEQ ID NO: 130324 - DNA, 103 bp, Artificial Sequence
  Synthetic Polynucleotide
taatacgactcactatagggctccattactttggacatgaccggcttgaaaacagaggagattcaagatggtcatgtccaacctggcggcagcgcaaaagatg

SEQ ID NO: 130325 - DNA, 103 bp, Artificial Sequence
  Synthetic Polynucleotide
taatacgactcactataggggctggaacatctccattactttggacatgaaacagaggagatcatgtatgaagtaatggaacctggcggcagcgcaaaagatg

SEQ ID NO: 130326 - DNA, 103 bp, Artificial Sequence
  Synthetic Polynucleotide
taatacgactcactatagggaccgcactaggctggaacatctccattactaacagaggagaagtaatatggatgttccaaacctggcggcagcgcaaaagatg

SEQ ID NO: 130327 - DNA, 103 bp, Artificial Sequence
  Synthetic Polynucleotide
taatacgactcactatagggctgtaagaccaccgcactaggctggaacataacagaggagaatgttcatgcctagtgcgaacctggcggcagcgcaaaagatg

SEQ ID NO: 130328 - DNA, 103 bp, Artificial Sequence
  Synthetic Polynucleotide
taatacgactcactatagggctgagccacactgtaagaccaccgcactagaacagaggagactagtgatgtggtcttacaacctggcggcagcgcaaaagatg

SEQ ID NO: 130329 - DNA, 103 bp, Artificial Sequence
  Synthetic Polynucleotide
taatacgactcactataggggatagggagtctgagccacactgtaagaccaacagaggagaggtcttatggtgtggctcaacctggcggcagcgcaaaagatg

SEQ ID NO: 130330 - DNA, 103 bp, Artificial Sequence
  Synthetic Polynucleotide
taatacgactcactatagggccgatccccagatagggagtctgagccacaaacagaggagatgtggcatggactccctaaacctggcggcagcgcaaaagatg

SEQ ID NO: 130331 - DNA, 103 bp, Artificial Sequence
  Synthetic Polynucleotide
taatacgactcactatagggggtgaggcttcattgggtggccttgtccataacagaggagaatggacatggccacccaaaacctggcggcagcgcaaaagatg

SEQ ID NO: 130332 - DNA, 103 bp, Artificial Sequence
  Synthetic Polynucleotide
taatacgactcactatagggagcaacctaaccgatccccagatagggagtaacagaggagaactcccatgctggggatcaacctggcggcagcgcaaaagatg

SEQ ID NO: 130333 - DNA, 103 bp, Artificial Sequence
  Synthetic Polynucleotide
taatacgactcactataggggttagattgaagcaacctaaccgatccccaaacagaggagatggggaatggttaggttgaacctggcggcagcgcaaaagatg

SEQ ID NO: 130334 - DNA, 103 bp, Artificial Sequence
  Synthetic Polynucleotide
taatacgactcactatagggtcctttgatagttagattgaagcaacctaaaacagaggagattaggtatgttcaatctaaacctggcggcagcgcaaaagatg

SEQ ID NO: 130335 - DNA, 103 bp, Artificial Sequence
  Synthetic Polynucleotide
taatacgactcactatagggacttggcgtgtcctttgatagttagattgaaacagaggagatcaatcatgctatcaaagaacctggcggcagcgcaaaagatg

SEQ ID NO: 130336 - DNA, 103 bp, Artificial Sequence
  Synthetic Polynucleotide
taatacgactcactatagggaattccacacacttggcgtgtcctttgataaacagaggagatatcaaatgacacgccaaaacctggcggcagcgcaaaagatg

SEQ ID NO: 130337 - DNA, 103 bp, Artificial Sequence
  Synthetic Polynucleotide
taatacgactcactataggggctcttgacaaattccacacacttggcgtgaacagaggagacacgccatgtgtgtggaaaacctggcggcagcgcaaaagatg

SEQ ID NO: 130338 - DNA, 103 bp, Artificial Sequence
  Synthetic Polynucleotide
taatacgactcactataggggcaggttaaagctcttgacaaattccacacaacagaggagagtgtggatgttgtcaagaaacctggcggcagcgcaaaagatg

SEQ ID NO: 130339 - DNA, 103 bp, Artificial Sequence
  Synthetic Polynucleotide
taatacgactcactatagggatcagcataggcaggttaaagctcttgacaaacagaggagatgtcaaatgctttaacctaacctggcggcagcgcaaaagatg

SEQ ID NO: 130340 - DNA, 103 bp, Artificial Sequence
  Synthetic Polynucleotide
taatacgactcactataggggcctcccagcatcagcataggcaggttaaaaacagaggagatttaacatgcctatgctgaacctggcggcagcgcaaaagatg

SEQ ID NO: 130341 - DNA, 103 bp, Artificial Sequence
  Synthetic Polynucleotide
taatacgactcactatagggtgtaaccaccgcctcccagcatcagcatagaacagaggagactatgcatgtgctgggagaacctggcggcagcgcaaaagatg

SEQ ID NO: 130342 - DNA, 103 bp, Artificial Sequence
  Synthetic Polynucleotide
taatacgactcactatagggatgcggattcggtgaggcttcattgggtggaacagaggagaccacccatggaagcctcaaacctggcggcagcgcaaaagatg

SEQ ID NO: 130343 - DNA, 103 bp, Artificial Sequence
  Synthetic Polynucleotide
taatacgactcactatagggttacgaatggtgtaaccaccgcctcccagcaacagaggagagctgggatgcggtggttaaacctggcggcagcgcaaaagatg

SEQ ID NO: 130344 - DNA, 103 bp, Artificial Sequence
  Synthetic Polynucleotide
taatacgactcactatagggccgggcaacgttacgaatggtgtaaccaccaacagaggagaggtggtatgaccattcgtaacctggcggcagcgcaaaagatg

SEQ ID NO: 130345 - DNA, 103 bp, Artificial Sequence
  Synthetic Polynucleotide
taatacgactcactatagggatgtccagcaccgggcaacgttacgaatggaacagaggagaccattcatgacgttgcccaacctggcggcagcgcaaaagatg

SEQ ID NO: 130346 - DNA, 103 bp, Artificial Sequence
  Synthetic Polynucleotide
taatacgactcactataggggctgtctcatatgtccagcaccgggcaacgaacagaggagacgttgcatggtgctggacaacctggcggcagcgcaaaagatg

SEQ ID NO: 130347 - DNA, 103 bp, Artificial Sequence
  Synthetic Polynucleotide
taatacgactcactatagggcagggccacagctgtctcatatgtccagcaaacagaggagatgctggatgtatgagacaaacctggcggcagcgcaaaagatg

SEQ ID NO: 130348 - DNA, 103 bp, Artificial Sequence
  Synthetic Polynucleotide
taatacgactcactatagggtctccgtatccagggccacagctgtctcataacagaggagaatgagaatgctgtggcccaacctggcggcagcgcaaaagatg

SEQ ID NO: 130349 - DNA, 103 bp, Artificial Sequence
  Synthetic Polynucleotide
taatacgactcactatagggtcattagggatctccgtatccagggccacaaacagaggagatgtggcatgggatacggaaacctggcggcagcgcaaaagatg

SEQ ID NO: 130350 - DNA, 103 bp, Artificial Sequence
  Synthetic Polynucleotide
taatacgactcactataggggtatggaagctcattagggatctccgtatcaacagaggagagatacgatgatccctaataacctggcggcagcgcaaaagatg

SEQ ID NO: 130351 - DNA, 103 bp, Artificial Sequence
  Synthetic Polynucleotide
taatacgactcactatagggagtagtcattgtatggaagctcattagggaaacagaggagatccctaatgagcttccataacctggcggcagcgcaaaagatg

SEQ ID NO: 130352 - DNA, 103 bp, Artificial Sequence
  Synthetic Polynucleotide
taatacgactcactatagggaagtattcaaagtagtcattgtatggaagcaacagaggagagcttccatgcaatgactaaacctggcggcagcgcaaaagatg

SEQ ID NO: 130353 - DNA, 103 bp, Artificial Sequence
  Synthetic Polynucleotide
taatacgactcactatagggatgggtcatgcggattctatgaggcttcataacagaggagaatgaagatgcatagaatcaacctggcggcagcgcaaaagatg

SEQ ID NO: 130354 - DNA, 103 bp, Artificial Sequence
  Synthetic Polynucleotide
taatacgactcactatagggactgtgatattttgtcatttcttcggcagtaacagaggagaactgccatggaaatgacaaacctggcggcagcgcaaaagatg

SEQ ID NO: 130355 - DNA, 103 bp, Artificial Sequence
  Synthetic Polynucleotide
taatacgactcactatagggattttcaaacaaacgctgttttatcttttcaacagaggagagaaaagatgaaacagcgtaacctggcggcagcgcaaaagatg

SEQ ID NO: 130356 - DNA, 103 bp, Artificial Sequence
  Synthetic Polynucleotide
taatacgactcactatagggacatgcgcaaattttcaaacaaacgctgttaacagaggagaaacagcatgtgtttgaaaaacctggcggcagcgcaaaagatg

SEQ ID NO: 130357 - DNA, 103 bp, Artificial Sequence
  Synthetic Polynucleotide
taatacgactcactataggggcatgaggtaacatgcgcaaattttcaaacaacagaggagagtttgaatgtttgcgcataacctggcggcagcgcaaaagatg

SEQ ID NO: 130358 - DNA, 103 bp, Artificial Sequence
  Synthetic Polynucleotide
taatacgactcactataggggacaccaggtgcatgaggtaacatgcgcaaaacagaggagattgcgcatgttacctcataacctggcggcagcgcaaaagatg

SEQ ID NO: 130359 - DNA, 103 bp, Artificial Sequence
  Synthetic Polynucleotide
taatacgactcactatagggcttgcatctggacaccaggtgcatgaggtaaacagaggagatacctcatgcacctggtgaacctggcggcagcgcaaaagatg

SEQ ID NO: 130360 - DNA, 103 bp, Artificial Sequence
  Synthetic Polynucleotide
taatacgactcactatagggtctggaatagcttgcatctggacaccaggtaacagaggagaacctggatgccagatgcaaacctggcggcagcgcaaaagatg

SEQ ID NO: 130361 - DNA, 103 bp, Artificial Sequence
  Synthetic Polynucleotide
taatacgactcactatagggaacagcatcttctggaatagcttgcatctgaacagaggagacagatgatggctattccaaacctggcggcagcgcaaaagatg

SEQ ID NO: 130362 - DNA, 103 bp, Artificial Sequence
  Synthetic Polynucleotide
taatacgactcactatagggtgtcttcatgaacagcatcttctggaatagaacagaggagactattcatgaagatgctgaacctggcggcagcgcaaaagatg

SEQ ID NO: 130363 - DNA, 103 bp, Artificial Sequence
  Synthetic Polynucleotide
taatacgactcactatagggtcatctccactgtcttcatgaacagcatctaacagaggagaagatgcatgtcatgaagaaacctggcggcagcgcaaaagatg

SEQ ID NO: 130364 - DNA, 103 bp, Artificial Sequence
  Synthetic Polynucleotide
taatacgactcactatagggttctccatcttcatctccactgtcttcatgaacagaggagacatgaaatgagtggagataacctggcggcagcgcaaaagatg

SEQ ID NO: 130365 - DNA, 103 bp, Artificial Sequence
  Synthetic Polynucleotide
taatacgactcactatagggtatactcatcactgtgatattttgtcatttaacagaggagaaaatgaatgaatatcacaaacctggcggcagcgcaaaagatg

SEQ ID NO: 130366 - DNA, 103 bp, Artificial Sequence
  Synthetic Polynucleotide
taatacgactcactatagggtgtctggatcttctccatcttcatctccacaacagaggagagtggagatgaagatggagaacctggcggcagcgcaaaagatg

SEQ ID NO: 130367 - DNA, 103 bp, Artificial Sequence
  Synthetic Polynucleotide
taatacgactcactataggggaaattctcttgtctggatcttctccatctaacagaggagaagatggatgagatccagaaacctggcggcagcgcaaaagatg

SEQ ID NO: 130368 - DNA, 103 bp, Artificial Sequence
  Synthetic Polynucleotide
taatacgactcactatagggtgctcgaatagaaattctcttgtctggatcaacagaggagagatccaatgaagagaattaacctggcggcagcgcaaaagatg

SEQ ID NO: 130369 - DNA, 103 bp, Artificial Sequence
  Synthetic Polynucleotide
taatacgactcactataggggcttgtctgatgctcgaatagaaattctctaacagaggagaagagaaatgctattcgagaacctggcggcagcgcaaaagatg

SEQ ID NO: 130370 - DNA, 103 bp, Artificial Sequence
  Synthetic Polynucleotide
taatacgactcactatagggcaagctatccgcttgtctgatgctcgaataaacagaggagatattcgatgatcagacaaaacctggcggcagcgcaaaagatg

SEQ ID NO: 130371 - DNA, 103 bp, Artificial Sequence
  Synthetic Polynucleotide
taatacgactcactatagggttcttcatcacaagctatccgcttgtctgaaacagaggagatcagacatgcggatagctaacctggcggcagcgcaaaagatg

SEQ ID NO: 130372 - DNA, 103 bp, Artificial Sequence
  Synthetic Polynucleotide
taatacgactcactatagggaatctgagaattcttcatcacaagctatccaacagaggagaggatagatggtgatgaagaacctggcggcagcgcaaaagatg

SEQ ID NO: 130373 - DNA, 103 bp, Artificial Sequence
  Synthetic Polynucleotide
taatacgactcactatagggtcatcctcagaatctgagaattcttcatcaaacagaggagatgatgaatgattctcagaaacctggcggcagcgcaaaagatg

SEQ ID NO: 130374 - DNA, 103 bp, Artificial Sequence
  Synthetic Polynucleotide
taatacgactcactatagggtccttctccttcatcctcagaatctgagaaaacagaggagattctcaatgtctgaggataacctggcggcagcgcaaaagatg

SEQ ID NO: 130375 - DNA, 103 bp, Artificial Sequence
  Synthetic Polynucleotide
taatacgactcactatagggttcttcgacctccttctccttcatcctcagaacagaggagactgaggatgaaggagaagaacctggcggcagcgcaaaagatg

SEQ ID NO: 130376 - DNA, 103 bp, Artificial Sequence
  Synthetic Polynucleotide
taatacgactcactatagggagaaatttgatatactcatcactgtgatataacagaggagaatatcaatgtgatgagtaaacctggcggcagcgcaaaagatg

SEQ ID NO: 130377 - DNA, 103 bp, Artificial Sequence
  Synthetic Polynucleotide
taatacgactcactatagggtcagccacatttcttcgacctccttctcctaacagaggagaaggagaatgaggtcgaagaacctggcggcagcgcaaaagatg

SEQ ID NO: 130378 - DNA, 103 bp, Artificial Sequence
  Synthetic Polynucleotide
taatacgactcactatagggtttcttatgatcagccacatttcttcgaccaacagaggagaggtcgaatgaatgtggctaacctggcggcagcgcaaaagatg

SEQ ID NO: 130379 - DNA, 103 bp, Artificial Sequence
  Synthetic Polynucleotide
taatacgactcactatagggtctttgctcctttcttatgatcagccacataacagaggagaatgtggatgatcataagaaacctggcggcagcgcaaaagatg

SEQ ID NO: 130380 - DNA, 103 bp, Artificial Sequence
  Synthetic Polynucleotide
taatacgactcactatagggattctagctttctttgctcctttcttatgaaacagaggagatcataaatgaggagcaaaaacctggcggcagcgcaaaagatg

SEQ ID NO: 130381 - DNA, 103 bp, Artificial Sequence
  Synthetic Polynucleotide
taatacgactcactatagggatcttcttcaattctagctttctttgctccaacagaggagaggagcaatgaaagctagaaacctggcggcagcgcaaaagatg

SEQ ID NO: 130382 - DNA, 103 bp, Artificial Sequence
  Synthetic Polynucleotide
taatacgactcactatagggtttctttcttatcttcttcaattctagcttaacagaggagaaagctaatgttgaagaagaacctggcggcagcgcaaaagatg

SEQ ID NO: 130383 - DNA, 103 bp, Artificial Sequence
  Synthetic Polynucleotide
taatacgactcactatagggttgtcctctgtttctttcttatcttcttcaaacagaggagatgaagaatgtaagaaagaaacctggcggcagcgcaaaagatg

SEQ ID NO: 130384 - DNA, 103 bp, Artificial Sequence
  Synthetic Polynucleotide
taatacgactcactataggggtctgtttttttgtcctctgtttctttcttaacagaggagaaagaaaatgacagaggacaacctggcggcagcgcaaaagatg

SEQ ID NO: 130385 - DNA, 103 bp, Artificial Sequence
  Synthetic Polynucleotide
taatacgactcactatagggcttccttaacgtctgtttttttgtcctctgaacagaggagacagaggatgaaaaaacagaacctggcggcagcgcaaaagatg

SEQ ID NO: 130386 - DNA, 103 bp, Artificial Sequence
  Synthetic Polynucleotide
taatacgactcactataggggatttatcttcttccttaacgtctgtttttaacagaggagaaaaaacatgcgttaaggaaacctggcggcagcgcaaaagatg

SEQ ID NO: 130387 - DNA, 103 bp, Artificial Sequence
  Synthetic Polynucleotide
taatacgactcactatagggtattgaccgtagaaatttgatatactcatcaacagaggagagatgagatgatcaaatttaacctggcggcagcgcaaaagatg

SEQ ID NO: 130388 - DNA, 103 bp, Artificial Sequence
  Synthetic Polynucleotide
taatacgactcactataggggttgtccttggatttatcttcttccttaacaacagaggagagttaagatggaagataaaaacctggcggcagcgcaaaagatg

SEQ ID NO: 130389 - DNA, 103 bp, Artificial Sequence
  Synthetic Polynucleotide
taatacgactcactatagggtttcaccactgttgtccttggatttatcttaacagaggagaaagataatgccaaggacaaacctggcggcagcgcaaaagatg

SEQ ID NO: 130390 - DNA, 103 bp, Artificial Sequence
  Synthetic Polynucleotide
taatacgactcactataggggtatctgttttttcaccactgttgtccttgaacagaggagacaaggaatgcagtggtgaaacctggcggcagcgcaaaagatg

SEQ ID NO: 130391 - DNA, 103 bp, Artificial Sequence
  Synthetic Polynucleotide
taatacgactcactatagggggttcctttggtatctgttttttcaccactaacagaggagaagtggtatgaaaacagataacctggcggcagcgcaaaagatg

SEQ ID NO: 130392 - DNA, 103 bp, Artificial Sequence
  Synthetic Polynucleotide
taatacgactcactataggggttctgatttggttcctttggtatctgtttaacagaggagaaaacagatgccaaaggaaaacctggcggcagcgcaaaagatg

SEQ ID NO: 130393 - DNA, 103 bp, Artificial Sequence
  Synthetic Polynucleotide
taatacgactcactatagggttgctgagctgttctgatttggttcctttgaacagaggagacaaaggatgcaaatcagaaacctggcggcagcgcaaaagatg

SEQ ID NO: 130394 - DNA, 103 bp, Artificial Sequence
  Synthetic Polynucleotide
taatacgactcactatagggtatctggtcttattgaccgtagaaatttgaaacagaggagatcaaatatgtacggtcaaaacctggcggcagcgcaaaagatg

SEQ ID NO: 130395 - DNA, 103 bp, Artificial Sequence
  Synthetic Polynucleotide
taatacgactcactatagggtcagacatgttatctggtcttattgaccgtaacagaggagaacggtcatgaagaccagaaacctggcggcagcgcaaaagatg

SEQ ID NO: 130396 - DNA, 103 bp, Artificial Sequence
  Synthetic Polynucleotide
taatacgactcactatagggcttactatactcagacatgttatctggtctaacagaggagaagaccaatgaacatgtctaacctggcggcagcgcaaaagatg

SEQ ID NO: 130397 - DNA, 103 bp, Artificial Sequence
  Synthetic Polynucleotide
taatacgactcactatagggtctgcatctgcttactatactcagacatgtaacagaggagaacatgtatgagtatagtaaacctggcggcagcgcaaaagatg

SEQ ID NO: 130398 - DNA, 103 bp, Artificial Sequence
  Synthetic Polynucleotide
taatacgactcactatagggacattaaatctctgcatctgcttactatacaacagaggagagtatagatggcagatgcaaacctggcggcagcgcaaaagatg

SEQ ID NO: 130399 - DNA, 103 bp, Artificial Sequence
  Synthetic Polynucleotide
taatacgactcactatagggatcttctccaacattaaatctctgcatctgaacagaggagacagatgatgagatttaataacctggcggcagcgcaaaagatg

SEQ ID NO: 130400 - DNA, 103 bp, Artificial Sequence
  Synthetic Polynucleotide
taatacgactcactatagggacagcaagttatgggtcatgcggattctataacagaggagaatagaaatggcatgacccaacctggcggcagcgcaaaagatg

SEQ ID NO: 130401 - DNA, 103 bp, Artificial Sequence
  Synthetic Polynucleotide
taatacgactcactatagggacactggacaatcttctccaacattaaatcaacagaggagagatttaatgttggagaagaacctggcggcagcgcaaaagatg

SEQ ID NO: 130402 - DNA, 103 bp, Artificial Sequence
  Synthetic Polynucleotide
taatacgactcactatagggagtccatcaaacactggacaatcttctccaaacagaggagatggagaatgttgtccagtaacctggcggcagcgcaaaagatg

SEQ ID NO: 130403 - DNA, 103 bp, Artificial Sequence
  Synthetic Polynucleotide
taatacgactcactatagggaaactcaaagagtccatcaaacactggacaaacagaggagatgtccaatgtttgatggaaacctggcggcagcgcaaaagatg

SEQ ID NO: 130404 - DNA, 103 bp, Artificial Sequence
  Synthetic Polynucleotide
taatacgactcactatagggagagctgacaaaactcaaagagtccatcaaaacagaggagattgatgatgtctttgagtaacctggcggcagcgcaaaagatg

SEQ ID NO: 130405 - DNA, 103 bp, Artificial Sequence
  Synthetic Polynucleotide
taatacgactcactatagggccgccagttgagagctgacaaaactcaaagaacagaggagactttgaatgttgtcagctaacctggcggcagcgcaaaagatg

SEQ ID NO: 130406 - DNA, 103 bp, Artificial Sequence
  Synthetic Polynucleotide
taatacgactcactatagggagcaactgaaccgccagttgagagctgacaaacagaggagatgtcagatgtcaactggcaacctggcggcagcgcaaaagatg

SEQ ID NO: 130407 - DNA, 103 bp, Artificial Sequence
  Synthetic Polynucleotide
taatacgactcactatagggtcacagctccagcaactgaaccgccagttgaacagaggagacaactgatggttcagttgaacctggcggcagcgcaaaagatg

SEQ ID NO: 130408 - DNA, 103 bp, Artificial Sequence
  Synthetic Polynucleotide
taatacgactcactatagggcggtttaacttcacagctccagcaactgaaaacagaggagattcagtatgtggagctgtaacctggcggcagcgcaaaagatg

SEQ ID NO: 130409 - DNA, 103 bp, Artificial Sequence
  Synthetic Polynucleotide
taatacgactcactatagggagtctgttgtcggtttaacttcacagctccaacagaggagaggagctatgaagttaaacaacctggcggcagcgcaaaagatg

SEQ ID NO: 130410 - DNA, 103 bp, Artificial Sequence
  Synthetic Polynucleotide
taatacgactcactatagggcagccatatcagtctgttgtcggtttaactaacagaggagaagttaaatggacaacagaaacctggcggcagcgcaaaagatg

SEQ ID NO: 130411 - DNA, 103 bp, Artificial Sequence
  Synthetic Polynucleotide
taatacgactcactatagggccataatttaacagcaagttatgggtcatgaacagaggagacatgacatgtaacttgctaacctggcggcagcgcaaaagatg

SEQ ID NO: 130412 - DNA, 103 bp, Artificial Sequence
  Synthetic Polynucleotide
taatacgactcactataggggcccaattaacagccatatcagtctgttgtaacagaggagaacaacaatgtgatatggcaacctggcggcagcgcaaaagatg

SEQ ID NO: 130413 - DNA, 103 bp, Artificial Sequence
  Synthetic Polynucleotide
taatacgactcactatagggtaatcctccagcccaattaacagccatatcaacagaggagagatatgatggttaattggaacctggcggcagcgcaaaagatg

SEQ ID NO: 130414 - DNA, 103 bp, Artificial Sequence
  Synthetic Polynucleotide
taatacgactcactatagggtagcatgatgtaatcctccagcccaattaaaacagaggagattaattatgctggaggataacctggcggcagcgcaaaagatg

SEQ ID NO: 130415 - DNA, 103 bp, Artificial Sequence
  Synthetic Polynucleotide
taatacgactcactatagggtctgatttcttagcatgatgtaatcctccaaacagaggagatggaggatgacatcatgcaacctggcggcagcgcaaaagatg

SEQ ID NO: 130416 - DNA, 103 bp, Artificial Sequence
  Synthetic Polynucleotide
taatacgactcactatagggtcctgatgcttctgatttcttagcatgatgaacagaggagacatcatatgaagaaatcaaacctggcggcagcgcaaaagatg

SEQ ID NO: 130417 - DNA, 103 bp, Artificial Sequence
  Synthetic Polynucleotide
taatacgactcactatagggcgtaacagaatcctgatgcttctgatttctaacagaggagaagaaatatgaagcatcagaacctggcggcagcgcaaaagatg

SEQ ID NO: 130418 - DNA, 103 bp, Artificial Sequence
  Synthetic Polynucleotide
taatacgactcactatagggatatcattaacgtaacagaatcctgatgctaacagaggagaagcatcatgattctgttaaacctggcggcagcgcaaaagatg

SEQ ID NO: 130419 - DNA, 103 bp, Artificial Sequence
  Synthetic Polynucleotide
taatacgactcactatagggggcaagcacaatatcattaacgtaacagaaaacagaggagattctgtatggttaatgataacctggcggcagcgcaaaagatg

SEQ ID NO: 130420 - DNA, 103 bp, Artificial Sequence
  Synthetic Polynucleotide
taatacgactcactatagggattcaaggatggcaagcacaatatcattaaaacagaggagattaatgatgttgtgcttgaacctggcggcagcgcaaaagatg

SEQ ID NO: 130421 - DNA, 103 bp, Artificial Sequence
  Synthetic Polynucleotide
taatacgactcactatagggtactttagtaattcaaggatggcaagcacaaacagaggagatgtgctatgcatccttgaaacctggcggcagcgcaaaagatg

SEQ ID NO: 130422 - DNA, 103 bp, Artificial Sequence
  Synthetic Polynucleotide
taatacgactcactatagggtctgtataagccataatttaacagcaagttaacagaggagaaacttgatgttaaattataacctggcggcagcgcaaaagatg

SEQ ID NO: 130423 - DNA, 103 bp, Artificial Sequence
  Synthetic Polynucleotide
taatacgactcactatagggtctctgatgatactttagtaattcaaggataacagaggagaatccttatgttactaaagaacctggcggcagcgcaaaagatg

SEQ ID NO: 130424 - DNA, 103 bp, Artificial Sequence
  Synthetic Polynucleotide
taatacgactcactatagggtatataagactctctgatgatactttagtaaacagaggagatactaaatgatcatcagaaacctggcggcagcgcaaaagatg

SEQ ID NO: 130425 - DNA, 103 bp, Artificial Sequence
  Synthetic Polynucleotide
taatacgactcactatagggtctatatcaatatataagactctctgatgaaacagaggagatcatcaatgagtcttataaacctggcggcagcgcaaaagatg

SEQ ID NO: 130426 - DNA, 103 bp, Artificial Sequence
  Synthetic Polynucleotide
taatacgactcactatagggatgatgaatatctatatcaatatataagacaacagaggagagtcttaatgattgatataaacctggcggcagcgcaaaagatg

SEQ ID NO: 130427 - DNA, 103 bp, Artificial Sequence
  Synthetic Polynucleotide
taatacgactcactatagggcaccatcaccatgatgaatatctatatcaaaacagaggagattgataatgatattcatcaacctggcggcagcgcaaaagatg

SEQ ID NO: 130428 - DNA, 103 bp, Artificial Sequence
  Synthetic Polynucleotide
taatacgactcactataggggcttcttcaacaccatcaccatgatgaataaacagaggagatattcaatgtggtgatggaacctggcggcagcgcaaaagatg

SEQ ID NO: 130429 - DNA, 103 bp, Artificial Sequence
  Synthetic Polynucleotide
taatacgactcactatagggtgtataaaaagcttcttcaacaccatcaccaacagaggagaggtgatatggttgaagaaaacctggcggcagcgcaaaagatg

SEQ ID NO: 130430 - DNA, 103 bp, Artificial Sequence
  Synthetic Polynucleotide
taatacgactcactatagggcacgatctgttgtataaaaagcttcttcaaaacagaggagattgaagatgctttttataaacctggcggcagcgcaaaagatg

SEQ ID NO: 130431 - DNA, 103 bp, Artificial Sequence
  Synthetic Polynucleotide
taatacgactcactatagggaccgtcattacacgatctgttgtataaaaaaacagaggagatttttaatgaacagatcgaacctggcggcagcgcaaaagatg

SEQ ID NO: 130432 - DNA, 103 bp, Artificial Sequence
  Synthetic Polynucleotide
taatacgactcactatagggatggaatgataccgtcattacacgatctgtaacagaggagaacagatatggtaatgacgaacctggcggcagcgcaaaagatg

SEQ ID NO: 130433 - DNA, 103 bp, Artificial Sequence
  Synthetic Polynucleotide
taatacgactcactatagggtttccatttttctgtataagccataatttaaacagaggagataaattatggcttatacaaacctggcggcagcgcaaaagatg

SEQ ID NO: 130434 - DNA, 103 bp, Artificial Sequence
  Synthetic Polynucleotide
taatacgactcactatagggccccatatttatggaatgataccgtcattaaacagaggagataatgaatgtatcattccaacctggcggcagcgcaaaagatg

SEQ ID NO: 130435 - DNA, 103 bp, Artificial Sequence
  Synthetic Polynucleotide
taatacgactcactatagggggaaagtattccccatatttatggaatgataacagaggagaatcattatgtaaatatggaacctggcggcagcgcaaaagatg

SEQ ID NO: 130436 - DNA, 103 bp, Artificial Sequence
  Synthetic Polynucleotide
taatacgactcactatagggtcctgtgccaggaaagtattccccatatttaacagaggagaaaatatatggaatactttaacctggcggcagcgcaaaagatg

SEQ ID NO: 130437 - DNA, 103 bp, Artificial Sequence
  Synthetic Polynucleotide
taatacgactcactatagggccctcaagtctcctgtgccaggaaagtattaacagaggagaaatactatgctggcacagaacctggcggcagcgcaaaagatg

SEQ ID NO: 130438 - DNA, 103 bp, Artificial Sequence
  Synthetic Polynucleotide
taatacgactcactataggggcaccaatatccctcaagtctcctgtgccaaacagaggagatggcacatgagacttgagaacctggcggcagcgcaaaagatg

SEQ ID NO: 130439 - DNA, 103 bp, Artificial Sequence
  Synthetic Polynucleotide
taatacgactcactataggggccttttccagcaccaatatccctcaagtcaacagaggagagacttgatggatattggtaacctggcggcagcgcaaaagatg

SEQ ID NO: 130440 - DNA, 103 bp, Artificial Sequence
  Synthetic Polynucleotide
taatacgactcactatagggcatagtatttgccttttccagcaccaatataacagaggagaatattgatgctggaaaagaacctggcggcagcgcaaaagatg

SEQ ID NO: 130441 - DNA, 103 bp, Artificial Sequence
  Synthetic Polynucleotide
taatacgactcactatagggaaattgacagcatagtatttgccttttccaaacagaggagatggaaaatgcaaatactaaacctggcggcagcgcaaaagatg

SEQ ID NO: 130442 - DNA, 103 bp, Artificial Sequence
  Synthetic Polynucleotide
taatacgactcactatagggtctcattggaaaattgacagcatagtatttaacagaggagaaaatacatggctgtcaataacctggcggcagcgcaaaagatg

SEQ ID NO: 130443 - DNA, 103 bp, Artificial Sequence
  Synthetic Polynucleotide
taatacgactcactatagggctataccatctctcattggaaaattgacagaacagaggagactgtcaatgttccaatgaaacctggcggcagcgcaaaagatg

SEQ ID NO: 130444 - DNA, 103 bp, Artificial Sequence
  Synthetic Polynucleotide
taatacgactcactatagggggcctatatatttccatttttctgtataagaacagaggagacttataatgaaaaatggaaacctggcggcagcgcaaaagatg

SEQ ID NO: 130445 - DNA, 103 bp, Artificial Sequence
  Synthetic Polynucleotide
taatacgactcactataggggactcatcatctataccatctctcattggaaacagaggagatccaatatgagatggtataacctggcggcagcgcaaaagatg

SEQ ID NO: 130446 - DNA, 103 bp, Artificial Sequence
  Synthetic Polynucleotide
taatacgactcactatagggctgcccatatgactcatcatctataccatcaacagaggagagatggtatggatgatgagaacctggcggcagcgcaaaagatg

SEQ ID NO: 130447 - DNA, 103 bp, Artificial Sequence
  Synthetic Polynucleotide
taatacgactcactataggggcttaaatatctgcccatatgactcatcataacagaggagaatgatgatgcatatgggcaacctggcggcagcgcaaaagatg

SEQ ID NO: 130448 - DNA, 103 bp, Artificial Sequence
  Synthetic Polynucleotide
taatacgactcactataggggagataataggcttaaatatctgcccatataacagaggagaatatggatggatatttaaaacctggcggcagcgcaaaagatg

SEQ ID NO: 130449 - DNA, 103 bp, Artificial Sequence
  Synthetic Polynucleotide
taatacgactcactatagggcatcacctttgagataataggcttaaatataacagaggagaatatttatgcctattatcaacctggcggcagcgcaaaagatg

SEQ ID NO: 130450 - DNA, 103 bp, Artificial Sequence
  Synthetic Polynucleotide
taatacgactcactataggggatacatctccatcacctttgagataatagaacagaggagactattaatgcaaaggtgaaacctggcggcagcgcaaaagatg

SEQ ID NO: 130451 - DNA, 103 bp, Artificial Sequence
  Synthetic Polynucleotide
taatacgactcactataggggcactaggttgatacatctccatcacctttaacagaggagaaaaggtatgggagatgtaaacctggcggcagcgcaaaagatg

SEQ ID NO: 130452 - DNA, 103 bp, Artificial Sequence
  Synthetic Polynucleotide
taatacgactcactatagggtaataccacagcactaggttgatacatctcaacagaggagagagatgatgcaacctagtaacctggcggcagcgcaaaagatg

SEQ ID NO: 130453 - DNA, 103 bp, Artificial Sequence
  Synthetic Polynucleotide
taatacgactcactatagggcaccacactgtaataccacagcactaggttaacagaggagaaacctaatgctgtggtataacctggcggcagcgcaaaagatg

SEQ ID NO: 130454 - DNA, 103 bp, Artificial Sequence
  Synthetic Polynucleotide
taatacgactcactatagggaatgagtctgcaccacactgtaataccacaaacagaggagatgtggtatgacagtgtggaacctggcggcagcgcaaaagatg

SEQ ID NO: 130455 - DNA, 103 bp, Artificial Sequence
  Synthetic Polynucleotide
taatacgactcactatagggggctttatggggcctatatatttccattttaacagaggagaaaaatgatgatatataggaacctggcggcagcgcaaaagatg

SEQ ID NO: 130456 - DNA, 103 bp, Artificial Sequence
  Synthetic Polynucleotide
taatacgactcactatagggatcaccagataatgagtctgcaccacactgaacagaggagacagtgtatggcagactcaaacctggcggcagcgcaaaagatg

SEQ ID NO: 130457 - DNA, 103 bp, Artificial Sequence
  Synthetic Polynucleotide
taatacgactcactatagggaacccagtctatcaccagataatgagtctgaacagaggagacagactatgtatctggtgaacctggcggcagcgcaaaagatg

SEQ ID NO: 130458 - DNA, 103 bp, Artificial Sequence
  Synthetic Polynucleotide
taatacgactcactatagggagattgaaacaacccagtctatcaccagataacagaggagaatctggatgtagactgggaacctggcggcagcgcaaaagatg

SEQ ID NO: 130459 - DNA, 103 bp, Artificial Sequence
  Synthetic Polynucleotide
taatacgactcactatagggtttgactgttagattgaaacaacccagtctaacagaggagaagactgatgtgtttcaataacctggcggcagcgcaaaagatg

SEQ ID NO: 130460 - DNA, 103 bp, Artificial Sequence
  Synthetic Polynucleotide
taatacgactcactatagggtagcatgacctttgactgttagattgaaacaacagaggagagtttcaatgtaacagtcaaacctggcggcagcgcaaaagatg

SEQ ID NO: 130461 - DNA, 103 bp, Artificial Sequence
  Synthetic Polynucleotide
taatacgactcactatagggtctacacatttagcatgacctttgactgttaacagaggagaaacagtatgaggtcatgcaacctggcggcagcgcaaaagatg

SEQ ID NO: 130462 - DNA, 103 bp, Artificial Sequence
  Synthetic Polynucleotide
taatacgactcactatagggttttacaacttctacacatttagcatgaccaacagaggagaggtcatatgaaatgtgtaaacctggcggcagcgcaaaagatg

SEQ ID NO: 130463 - DNA, 103 bp, Artificial Sequence
  Synthetic Polynucleotide
taatacgactcactatagggagttaaaagtttttacaacttctacacattaacagaggagaaatgtgatgaagttgtaaaacctggcggcagcgcaaaagatg

SEQ ID NO: 130464 - DNA, 103 bp, Artificial Sequence
  Synthetic Polynucleotide
taatacgactcactatagggagtaatggtaagttaaaagtttttacaactaacagaggagaagttgtatgaacttttaaaacctggcggcagcgcaaaagatg

SEQ ID NO: 130465 - DNA, 103 bp, Artificial Sequence
  Synthetic Polynucleotide
taatacgactcactatagggtccaagcatcagtaatggtaagttaaaagtaacagaggagaacttttatgttaccattaaacctggcggcagcgcaaaagatg

SEQ ID NO: 130466 - DNA, 103 bp, Artificial Sequence
  Synthetic Polynucleotide
taatacgactcactatagggcttcggcagtggctttatggggcctatataaacagaggagatatataatgcccataaagaacctggcggcagcgcaaaagatg

SEQ ID NO: 130467 - DNA, 103 bp, Artificial Sequence
  Synthetic Polynucleotide
taatacgactcactatagggagccacctcctccaagcatcagtaatggtaaacagaggagataccatatgtgatgcttgaacctggcggcagcgcaaaagatg

SEQ ID NO: 130468 - DNA, 103 bp, Artificial Sequence
  Synthetic Polynucleotide
taatacgactcactatagggcggattgtgtagccacctcctccaagcatcaacagaggagagatgctatgaggaggtggaacctggcggcagcgcaaaagatg

SEQ ID NO: 130469 - DNA, 103 bp, Artificial Sequence
  Synthetic Polynucleotide
taatacgactcactatagggagcaacattacggattgtgtagccacctccaacagaggagaggaggtatgtacacaatcaacctggcggcagcgcaaaagatg

SEQ ID NO: 130470 - DNA, 103 bp, Artificial Sequence
  Synthetic Polynucleotide
taatacgactcactatagggtccaacatcgagcaacattacggattgtgtaacagaggagaacacaaatggtaatgttgaacctggcggcagcgcaaaagatg

SEQ ID NO: 130471 - DNA, 103 bp, Artificial Sequence
  Synthetic Polynucleotide
taatacgactcactataggggtctcatatgtccaacatcgagcaacattaaacagaggagataatgtatgtcgatgttgaacctggcggcagcgcaaaagatg

SEQ ID NO: 130472 - DNA, 103 bp, Artificial Sequence
  Synthetic Polynucleotide
taatacgactcactatagggggcaactgcagtctcatatgtccaacatcgaacagaggagacgatgtatgacatatgagaacctggcggcagcgcaaaagatg

SEQ ID NO: 130473 - DNA, 103 bp, Artificial Sequence
  Synthetic Polynucleotide
taatacgactcactatagggcacaatcaagggcaactgcagtctcatatgaacagaggagacatatgatgctgcagttgaacctggcggcagcgcaaaagatg

SEQ ID NO: 130474 - DNA, 103 bp, Artificial Sequence
  Synthetic Polynucleotide
taatacgactcactatagggttgggaatctcacaatcaagggcaactgcaaacagaggagatgcagtatgccttgattgaacctggcggcagcgcaaaagatg

SEQ ID NO: 130475 - DNA, 103 bp, Artificial Sequence
  Synthetic Polynucleotide
taatacgactcactatagggtggcaactcattgggaatctcacaatcaagaacagaggagacttgatatggagattcccaacctggcggcagcgcaaaagatg

SEQ ID NO: 130476 - DNA, 103 bp, Artificial Sequence
  Synthetic Polynucleotide
taatacgactcactatagggaatcattatatggcaactcattgggaatctaacagaggagaagattcatgatgagttgcaacctggcggcagcgcaaaagatg

SEQ ID NO: 130477 - DNA, 103 bp, Artificial Sequence
  Synthetic Polynucleotide
taatacgactcactatagggtttgtcatttcttcggcagtggctttatggaacagaggagaccataaatgcactgccgaaacctggcggcagcgcaaaagatg

SEQ ID NO: 130478 - DNA, 103 bp, Artificial Sequence
  Synthetic Polynucleotide
taatacgactcactatagggtactcaaagtaatcattatatggcaactcaaacagaggagatgagttatgatataatgaaacctggcggcagcgcaaaagatg

SEQ ID NO: 130479 - DNA, 103 bp, Artificial Sequence
  Synthetic Polynucleotide
taatacgactcactatagggtggtccaaaatactcaaagtaatcattataaacagaggagatataatatgtactttgagaacctggcggcagcgcaaaagatg

SEQ ID NO: 130480 - DNA, 103 bp, Artificial Sequence
  Synthetic Polynucleotide
taatacgactcactataggggtttgaagtctggtccaaaatactcaaagtaacagaggagaactttgatgattttggacaacctggcggcagcgcaaaagatg

SEQ ID NO: 130481 - DNA, 103 bp, Artificial Sequence
  Synthetic Polynucleotide
taatacgactcactatagggctaatatgcagtttgaagtctggtccaaaaaacagaggagattttggatgagacttcaaaacctggcggcagcgcaaaagatg

SEQ ID NO: 130482 - DNA, 103 bp, Artificial Sequence
  Synthetic Polynucleotide
taatacgactcactataggggtttgaaggactaatatgcagtttgaagtcaacagaggagagacttcatgctgcatattaacctggcggcagcgcaaaagatg

SEQ ID NO: 130483 - DNA, 103 bp, Artificial Sequence
  Synthetic Polynucleotide
taatacgactcactatagggggtttgtcatgtttgaaggactaatatgcaaacagaggagatgcataatggtccttcaaaacctggcggcagcgcaaaagatg

SEQ ID NO: 130484 - DNA, 103 bp, Artificial Sequence
  Synthetic Polynucleotide
taatacgactcactatagggggagtgttctggtttgtcatgtttgaaggaaacagaggagatccttcatgcatgacaaaaacctggcggcagcgcaaaagatg

SEQ ID NO: 130485 - DNA, 103 bp, Artificial Sequence
  Synthetic Polynucleotide
taatacgactcactatagggcatatattctggagtgttctggtttgtcataacagaggagaatgacaatgcagaacactaacctggcggcagcgcaaaagatg

SEQ ID NO: 130486 - DNA, 103 bp, Artificial Sequence
  Synthetic Polynucleotide
taatacgactcactatagggttatcttttccatatattctggagtgttctaacagaggagaagaacaatgcagaatataaacctggcggcagcgcaaaagatg

SEQ ID NO: 130487 - DNA, 103 bp, Artificial Sequence
  Synthetic Polynucleotide
taatacgactcactatagggaaacgctgttttatcttttccatatattctaacagaggagaagaataatgggaaaagataacctggcggcagcgcaaaagatg

SEQ ID NO: 130488 - DNA, 103 bp, Artificial Sequence
  Synthetic Polynucleotide
taatacgactcactatagggaagtccatctggatggctttgggagctcataacagaggagaatgagcatgcaaagccataacctggcggcagcgcaaaagatg

SEQ ID NO: 130489 - DNA, 103 bp, Artificial Sequence
  Synthetic Polynucleotide
taatacgactcactatagggcagaggcagcgccgtggccacatccaccgtaacagaggagaacggtgatggtggccacgaacctggcggcagcgcaaaagatg

SEQ ID NO: 130490 - DNA, 103 bp, Artificial Sequence
  Synthetic Polynucleotide
taatacgactcactatagggggccgagccttctcgtgccacaagtctgtgaacagaggagacacagaatggtggcacgaaacctggcggcagcgcaaaagatg

SEQ ID NO: 130491 - DNA, 103 bp, Artificial Sequence
  Synthetic Polynucleotide
taatacgactcactataggggaagtggagcggccgagccttctcgtgccaaacagaggagatggcacatgaaggctcggaacctggcggcagcgcaaaagatg

SEQ ID NO: 130492 - DNA, 103 bp, Artificial Sequence
  Synthetic Polynucleotide
taatacgactcactataggggtgtagaggggaagtggagcggccgagcctaacagaggagaaggctcatgcgctccactaacctggcggcagcgcaaaagatg

SEQ ID NO: 130493 - DNA, 103 bp, Artificial Sequence
  Synthetic Polynucleotide
taatacgactcactatagggggatggcgatgtgtagaggggaagtggagcaacagaggagagctccaatgcccctctacaacctggcggcagcgcaaaagatg

SEQ ID NO: 130494 - DNA, 103 bp, Artificial Sequence
  Synthetic Polynucleotide
taatacgactcactatagggtgttgggcaaggatggcgatgtgtagagggaacagaggagaccctctatgcatcgccataacctggcggcagcgcaaaagatg

SEQ ID NO: 130495 - DNA, 103 bp, Artificial Sequence
  Synthetic Polynucleotide
taatacgactcactatagggcccagcgtgatgttgggcaaggatggcgataacagaggagaatcgccatgcttgcccaaaacctggcggcagcgcaaaagatg

SEQ ID NO: 130496 - DNA, 103 bp, Artificial Sequence
  Synthetic Polynucleotide
taatacgactcactatagggggcaggcaggcccagcgtgatgttgggcaaaacagaggagattgcccatgatcacgctgaacctggcggcagcgcaaaagatg

SEQ ID NO: 130497 - DNA, 103 bp, Artificial Sequence
  Synthetic Polynucleotide
taatacgactcactatagggaggggccggtggcaggcaggcccagcgtgaaacagaggagatcacgcatggcctgcctgaacctggcggcagcgcaaaagatg

SEQ ID NO: 130498 - DNA, 103 bp, Artificial Sequence
  Synthetic Polynucleotide
taatacgactcactataggggtgcccgcagaggggccggtggcaggcaggaacagaggagacctgccatgcaccggcccaacctggcggcagcgcaaaagatg

SEQ ID NO: 130499 - DNA, 103 bp, Artificial Sequence
  Synthetic Polynucleotide
taatacgactcactatagggctggcccgccgtgcccgcagaggggccggtaacagaggagaaccggcatgtctgcgggcaacctggcggcagcgcaaaagatg

SEQ ID NO: 130500 - DNA, 103 bp, Artificial Sequence
  Synthetic Polynucleotide
taatacgactcactataggggggccacttgcagaggcagcgccgtggccaaacagaggagatggccaatgcgctgcctcaacctggcggcagcgcaaaagatg

SEQ ID NO: 130501 - DNA, 103 bp, Artificial Sequence
  Synthetic Polynucleotide
taatacgactcactatagggcggcgtcctgctggcccgccgtgcccgcagaacagaggagactgcggatgcggcgggccaacctggcggcagcgcaaaagatg

SEQ ID NO: 130502 - DNA, 103 bp, Artificial Sequence
  Synthetic Polynucleotide
taatacgactcactataggggtgagtctctcggcgtcctgctggcccgccaacagaggagaggcgggatggcaggacgcaacctggcggcagcgcaaaagatg

SEQ ID NO: 130503 - DNA, 103 bp, Artificial Sequence
  Synthetic Polynucleotide
taatacgactcactatagggggcgggaagggtgagtctctcggcgtcctgaacagaggagacaggacatggagagactcaacctggcggcagcgcaaaagatg

SEQ ID NO: 130504 - DNA, 103 bp, Artificial Sequence
  Synthetic Polynucleotide
taatacgactcactatagggtctgctggagggcgggaagggtgagtctctaacagaggagaagagacatgcccttcccgaacctggcggcagcgcaaaagatg

SEQ ID NO: 130505 - DNA, 103 bp, Artificial Sequence
  Synthetic Polynucleotide
taatacgactcactatagggagggagagcctctgctggagggcgggaaggaacagaggagaccttccatgcctccagcaaacctggcggcagcgcaaaagatg

SEQ ID NO: 130506 - DNA, 103 bp, Artificial Sequence
  Synthetic Polynucleotide
taatacgactcactataggggccggggaaaagggagagcctctgctggagaacagaggagactccagatgaggctctccaacctggcggcagcgcaaaagatg

SEQ ID NO: 130507 - DNA, 103 bp, Artificial Sequence
  Synthetic Polynucleotide
taatacgactcactatagggtgaggtgggtgccggggaaaagggagagccaacagaggagaggctctatgttttccccgaacctggcggcagcgcaaaagatg

SEQ ID NO: 130508 - DNA, 103 bp, Artificial Sequence
  Synthetic Polynucleotide
taatacgactcactatagggaggtagggagtgaggtgggtgccggggaaaaacagaggagatttcccatgcacccacctaacctggcggcagcgcaaaagatg

SEQ ID NO: 130509 - DNA, 103 bp, Artificial Sequence
  Synthetic Polynucleotide
taatacgactcactatagggcgaggtgctcaggtagggagtgaggtgggtaacagaggagaacccacatgactccctacaacctggcggcagcgcaaaagatg

SEQ ID NO: 130510 - DNA, 103 bp, Artificial Sequence
  Synthetic Polynucleotide
taatacgactcactataggggctccaagggcgaggtgctcaggtagggagaacagaggagactccctatgtgagcacctaacctggcggcagcgcaaaagatg

SEQ ID NO: 130511 - DNA, 103 bp, Artificial Sequence
  Synthetic Polynucleotide
taatacgactcactatagggactgccgagggggccacttgcagaggcagcaacagaggagagctgccatggcaagtggcaacctggcggcagcgcaaaagatg

SEQ ID NO: 130512 - DNA, 103 bp, Artificial Sequence
  Synthetic Polynucleotide
taatacgactcactatagggcctccgtcccgctccaagggcgaggtgctcaacagaggagagagcacatggcccttggaaacctggcggcagcgcaaaagatg

SEQ ID NO: 130513 - DNA, 103 bp, Artificial Sequence
  Synthetic Polynucleotide
taatacgactcactataggggtgcgctgcccctccgtcccgctccaagggaacagaggagacccttgatgcgggacggaaacctggcggcagcgcaaaagatg

SEQ ID NO: 130514 - DNA, 103 bp, Artificial Sequence
  Synthetic Polynucleotide
taatacgactcactataggggaagagggctgtgcgctgcccctccgtcccaacagaggagagggacgatggggcagcgcaacctggcggcagcgcaaaagatg

SEQ ID NO: 130515 - DNA, 103 bp, Artificial Sequence
  Synthetic Polynucleotide
taatacgactcactatagggatgtgctgcagaagagggctgtgcgctgccaacagaggagaggcagcatgcagccctctaacctggcggcagcgcaaaagatg

SEQ ID NO: 130516 - DNA, 103 bp, Artificial Sequence
  Synthetic Polynucleotide
taatacgactcactatagggcagtaagaccatgtgctgcagaagagggctaacagaggagaagccctatgctgcagcacaacctggcggcagcgcaaaagatg

SEQ ID NO: 130517 - DNA, 103 bp, Artificial Sequence
  Synthetic Polynucleotide
taatacgactcactataggggcggctgctccagtaagaccatgtgctgcaaacagaggagatgcagcatgtggtcttacaacctggcggcagcgcaaaagatg

SEQ ID NO: 130518 - DNA, 103 bp, Artificial Sequence
  Synthetic Polynucleotide
taatacgactcactataggggcttgtgccggcggctgctccagtaagaccaacagaggagaggtcttatgggagcagccaacctggcggcagcgcaaaagatg

SEQ ID NO: 130519 - DNA, 103 bp, Artificial Sequence
  Synthetic Polynucleotide
taatacgactcactataggggacgaggggtgcttgtgccggcggctgctcaacagaggagagagcagatgccggcacaaaacctggcggcagcgcaaaagatg

SEQ ID NO: 130520 - DNA, 103 bp, Artificial Sequence
  Synthetic Polynucleotide
taatacgactcactatagggccaggcctgtgacgaggggtgcttgtgccgaacagaggagacggcacatgcacccctcgaacctggcggcagcgcaaaagatg

SEQ ID NO: 130521 - DNA, 103 bp, Artificial Sequence
  Synthetic Polynucleotide
taatacgactcactatagggggcagtgctcccaggcctgtgacgaggggtaacagaggagaacccctatgcacaggcctaacctggcggcagcgcaaaagatg

SEQ ID NO: 130522 - DNA, 103 bp, Artificial Sequence
  Synthetic Polynucleotide
taatacgactcactataggggtccatgggcactgccgagggggccacttgaacagaggagacaagtgatgccctcggcaaacctggcggcagcgcaaaagatg

SEQ ID NO: 130523 - DNA, 103 bp, Artificial Sequence
  Synthetic Polynucleotide
taatacgactcactatagggtgcgtggaggggcagtgctcccaggcctgtaacagaggagaacaggcatgggagcactgaacctggcggcagcgcaaaagatg

SEQ ID NO: 130524 - DNA, 103 bp, Artificial Sequence
  Synthetic Polynucleotide
taatacgactcactatagggccaaggactgtgcgtggaggggcagtgctcaacagaggagagagcacatgccctccacgaacctggcggcagcgcaaaagatg

SEQ ID NO: 130525 - DNA, 103 bp, Artificial Sequence
  Synthetic Polynucleotide
taatacgactcactatagggtctgcaccaaccaaggactgtgcgtggaggaacagaggagacctccaatgacagtccttaacctggcggcagcgcaaaagatg

SEQ ID NO: 130526 - DNA, 103 bp, Artificial Sequence
  Synthetic Polynucleotide
taatacgactcactatagggggacacccggtctgcaccaaccaaggactgaacagaggagacagtccatggttggtgcaaacctggcggcagcgcaaaagatg

SEQ ID NO: 130527 - DNA, 103 bp, Artificial Sequence
  Synthetic Polynucleotide
taatacgactcactatagggggatggagggggacacccggtctgcaccaaaacagaggagattggtgatgaccgggtgtaacctggcggcagcgcaaaagatg

SEQ ID NO: 130528 - DNA, 103 bp, Artificial Sequence
  Synthetic Polynucleotide
taatacgactcactatagggcgcagcttgtggatggagggggacacccggaacagaggagaccgggtatgcccctccataacctggcggcagcgcaaaagatg

SEQ ID NO: 130529 - DNA, 103 bp, Artificial Sequence
  Synthetic Polynucleotide
taatacgactcactataggggcggtgctgccgcagcttgtggatggagggaacagaggagaccctccatgcacaagctgaacctggcggcagcgcaaaagatg

SEQ ID NO: 130530 - DNA, 103 bp, Artificial Sequence
  Synthetic Polynucleotide
taatacgactcactataggggccccagtgggcggtgctgccgcagcttgtaacagaggagaacaagcatgggcagcaccaacctggcggcagcgcaaaagatg

SEQ ID NO: 130531 - DNA, 103 bp, Artificial Sequence
  Synthetic Polynucleotide
taatacgactcactataggggactgggtccgccccagtgggcggtgctgcaacagaggagagcagcaatgcccactgggaacctggcggcagcgcaaaagatg

SEQ ID NO: 130532 - DNA, 103 bp, Artificial Sequence
  Synthetic Polynucleotide
taatacgactcactatagggcagcggggccgactgggtccgccccagtggaacagaggagaccactgatgcggacccagaacctggcggcagcgcaaaagatg

SEQ ID NO: 130533 - DNA, 103 bp, Artificial Sequence
  Synthetic Polynucleotide
taatacgactcactatagggccaggcgcaggtccatgggcactgccgaggaacagaggagacctcggatgtgcccatggaacctggcggcagcgcaaaagatg

SEQ ID NO: 130534 - DNA, 103 bp, Artificial Sequence
  Synthetic Polynucleotide
taatacgactcactatagggcgttctggggcagcggggccgactgggtccaacagaggagaggacccatgcggccccgcaacctggcggcagcgcaaaagatg

SEQ ID NO: 130535 - DNA, 103 bp, Artificial Sequence
  Synthetic Polynucleotide
taatacgactcactatagggagagcctgggcgttctggggcagcggggccaacagaggagaggccccatggccccagaaaacctggcggcagcgcaaaagatg

SEQ ID NO: 130536 - DNA, 103 bp, Artificial Sequence
  Synthetic Polynucleotide
taatacgactcactatagggcaggtgctgcagagcctgggcgttctggggaacagaggagaccccagatggcccaggctaacctggcggcagcgcaaaagatg

SEQ ID NO: 130537 - DNA, 103 bp, Artificial Sequence
  Synthetic Polynucleotide
taatacgactcactataggggctggatgaccaggtgctgcagagcctgggaacagaggagacccaggatgtgcagcaccaacctggcggcagcgcaaaagatg

SEQ ID NO: 130538 - DNA, 103 bp, Artificial Sequence
  Synthetic Polynucleotide
taatacgactcactatagggtgatgctgctgctggatgaccaggtgctgcaacagaggagagcagcaatgggtcatccaaacctggcggcagcgcaaaagatg

SEQ ID NO: 130539 - DNA, 103 bp, Artificial Sequence
  Synthetic Polynucleotide
taatacgactcactatagggcagaaactgctgatgctgctgctggatgacaacagaggagagtcatcatgcagcagcataacctggcggcagcgcaaaagatg

SEQ ID NO: 130540 - DNA, 103 bp, Artificial Sequence
  Synthetic Polynucleotide
taatacgactcactatagggtgtgtttctccagaaactgctgatgctgctaacagaggagaagcagcatgagcagtttcaacctggcggcagcgcaaaagatg

SEQ ID NO: 130541 - DNA, 103 bp, Artificial Sequence
  Synthetic Polynucleotide
taatacgactcactatagggaactgctgcttgtgtttctccagaaactgcaacagaggagagcagttatgggagaaacaaacctggcggcagcgcaaaagatg

SEQ ID NO: 130542 - DNA, 103 bp, Artificial Sequence
  Synthetic Polynucleotide
taatacgactcactatagggctgctgctggaactgctgcttgtgtttctcaacagaggagagagaaaatgaagcagcagaacctggcggcagcgcaaaagatg

SEQ ID NO: 130543 - DNA, 103 bp, Artificial Sequence
  Synthetic Polynucleotide
taatacgactcactatagggtctgcagttgctgctgctggaactgctgctaacagaggagaagcagcatgtccagcagcaacctggcggcagcgcaaaagatg

SEQ ID NO: 130544 - DNA, 103 bp, Artificial Sequence
  Synthetic Polynucleotide
taatacgactcactatagggaactggtggtccaggcgcaggtccatgggcaacagaggagagcccatatgcctgcgcctaacctggcggcagcgcaaaagatg

SEQ ID NO: 130545 - DNA, 103 bp, Artificial Sequence
  Synthetic Polynucleotide
taatacgactcactatagggatcttgttcatctgcagttgctgctgctggaacagaggagaccagcaatggcaactgcaaacctggcggcagcgcaaaagatg

SEQ ID NO: 130546 - DNA, 103 bp, Artificial Sequence
  Synthetic Polynucleotide
taatacgactcactatagggcttggggatgatcttgttcatctgcagttgaacagaggagacaactgatgatgaacaagaacctggcggcagcgcaaaagatg

SEQ ID NO: 130547 - DNA, 103 bp, Artificial Sequence
  Synthetic Polynucleotide
taatacgactcactataggggctcgcttggcttggggatgatcttgttcaaacagaggagatgaacaatgtcatccccaaacctggcggcagcgcaaaagatg

SEQ ID NO: 130548 - DNA, 103 bp, Artificial Sequence
  Synthetic Polynucleotide
taatacgactcactatagggtgccgggctggctcgcttggcttggggatgaacagaggagacatcccatggccaagcgaaacctggcggcagcgcaaaagatg

SEQ ID NO: 130549 - DNA, 103 bp, Artificial Sequence
  Synthetic Polynucleotide
taatacgactcactataggggctctccggctgccgggctggctcgcttggaacagaggagaccaagcatgccagcccggaacctggcggcagcgcaaaagatg

SEQ ID NO: 130550 - DNA, 103 bp, Artificial Sequence
  Synthetic Polynucleotide
taatacgactcactatagggcctccgggtggctctccggctgccgggctgaacagaggagacagcccatgagccggagaaacctggcggcagcgcaaaagatg

SEQ ID NO: 130551 - DNA, 103 bp, Artificial Sequence
  Synthetic Polynucleotide
taatacgactcactatagggtcctccgtctcctccgggtggctctccggcaacagaggagagccggaatgccacccggaaacctggcggcagcgcaaaagatg

SEQ ID NO: 130552 - DNA, 103 bp, Artificial Sequence
  Synthetic Polynucleotide
taatacgactcactatagggacggagctcctcctccgtctcctccgggtgaacagaggagacacccgatggagacggagaacctggcggcagcgcaaaagatg

SEQ ID NO: 130553 - DNA, 103 bp, Artificial Sequence
  Synthetic Polynucleotide
taatacgactcactatagggcctggtgctcacggagctcctcctccgtctaacagaggagaagacggatgaggagctccaacctggcggcagcgcaaaagatg

SEQ ID NO: 130554 - DNA, 103 bp, Artificial Sequence
  Synthetic Polynucleotide
taatacgactcactatagggtccagcagagcctggtgctcacggagctccaacagaggagaggagctatgtgagcaccaaacctggcggcagcgcaaaagatg

SEQ ID NO: 130555 - DNA, 103 bp, Artificial Sequence
  Synthetic Polynucleotide
taatacgactcactatagggaggcagtgagaactggtggtccaggcgcagaacagaggagactgcgcatggaccaccagaacctggcggcagcgcaaaagatg

SEQ ID NO: 130556 - DNA, 103 bp, Artificial Sequence
  Synthetic Polynucleotide
taatacgactcactataggggtagggctcgtccagcagagcctggtgctcaacagaggagagagcacatggctctgctgaacctggcggcagcgcaaaagatg

SEQ ID NO: 130557 - DNA, 103 bp, Artificial Sequence
  Synthetic Polynucleotide
taatacgactcactataggggccggtccaggtagggctcgtccagcagagaacagaggagactctgcatgacgagccctaacctggcggcagcgcaaaagatg

SEQ ID NO: 130558 - DNA, 103 bp, Artificial Sequence
  Synthetic Polynucleotide
taatacgactcactatagggtgccccggcagccggtccaggtagggctcgaacagaggagacgagccatgcctggaccgaacctggcggcagcgcaaaagatg

SEQ ID NO: 130559 - DNA, 103 bp, Artificial Sequence
  Synthetic Polynucleotide
taatacgactcactatagggcgcctccttctgccccggcagccggtccagaacagaggagactggacatgctgccggggaacctggcggcagcgcaaaagatg

SEQ ID NO: 130560 - DNA, 103 bp, Artificial Sequence
  Synthetic Polynucleotide
taatacgactcactatagggcctgtgcgtgcgcctccttctgccccggcaaacagaggagatgccggatgagaaggaggaacctggcggcagcgcaaaagatg

SEQ ID NO: 130561 - DNA, 103 bp, Artificial Sequence
  Synthetic Polynucleotide
taatacgactcactatagggtgcacgccggcctgtgcgtgcgcctccttcaacagaggagagaaggaatggcacgcacaaacctggcggcagcgcaaaagatg

SEQ ID NO: 130562 - DNA, 103 bp, Artificial Sequence
  Synthetic Polynucleotide
taatacgactcactatagggctgcttcacctgcacgccggcctgtgcgtgaacagaggagacacgcaatggccggcgtgaacctggcggcagcgcaaaagatg

SEQ ID NO: 130563 - DNA, 103 bp, Artificial Sequence
  Synthetic Polynucleotide
taatacgactcactatagggcaatgggctcctgcttcacctgcacgccggaacagaggagaccggcgatgaggtgaagcaacctggcggcagcgcaaaagatg

SEQ ID NO: 130564 - DNA, 103 bp, Artificial Sequence
  Synthetic Polynucleotide
taatacgactcactatagggtcatcgctctcaatgggctcctgcttcaccaacagaggagaggtgaaatgggagcccataacctggcggcagcgcaaaagatg

SEQ ID NO: 130565 - DNA, 103 bp, Artificial Sequence
  Synthetic Polynucleotide
taatacgactcactatagggtgcctcttcctcatcgctctcaatgggctcaacagaggagagagcccatggagagcgataacctggcggcagcgcaaaagatg

SEQ ID NO: 130566 - DNA, 103 bp, Artificial Sequence
  Synthetic Polynucleotide
taatacgactcactataggggctctgccacaggcagtgagaactggtggtaacagaggagaaccaccatgtctcactgcaacctggcggcagcgcaaaagatg

SEQ ID NO: 130567 - DNA, 103 bp, Artificial Sequence
  Synthetic Polynucleotide
taatacgactcactataggggtgggggctctgcctcttcctcatcgctctaacagaggagaagagcgatgaggaagaggaacctggcggcagcgcaaaagatg

SEQ ID NO: 130568 - DNA, 103 bp, Artificial Sequence
  Synthetic Polynucleotide
taatacgactcactatagggtccacctcccgtgggggctctgcctcttccaacagaggagaggaagaatgagagcccccaacctggcggcagcgcaaaagatg

SEQ ID NO: 130569 - DNA, 103 bp, Artificial Sequence
  Synthetic Polynucleotide
taatacgactcactatagggctggcccggctccacctcccgtgggggctcaacagaggagagagcccatgcgggaggtgaacctggcggcagcgcaaaagatg

SEQ ID NO: 130570 - DNA, 103 bp, Artificial Sequence
  Synthetic Polynucleotide
taatacgactcactatagggtgggctggcgctggcccggctccacctcccaacagaggagagggaggatgagccgggccaacctggcggcagcgcaaaagatg

SEQ ID NO: 130571 - DNA, 103 bp, Artificial Sequence
  Synthetic Polynucleotide
taatacgactcactatagggtcctgctcactgggctggcgctggcccggcaacagaggagagccgggatggcgccagccaacctggcggcagcgcaaaagatg

SEQ ID NO: 130572 - DNA, 103 bp, Artificial Sequence
  Synthetic Polynucleotide
taatacgactcactataggggaagagcagctcctgctcactgggctggcgaacagaggagacgccagatgagtgagcagaacctggcggcagcgcaaaagatg

SEQ ID NO: 130573 - DNA, 103 bp, Artificial Sequence
  Synthetic Polynucleotide
taatacgactcactatagggcttgctgtctgaagagcagctcctgctcacaacagaggagagtgagcatgagctgctctaacctggcggcagcgcaaaagatg

SEQ ID NO: 130574 - DNA, 103 bp, Artificial Sequence
  Synthetic Polynucleotide
taatacgactcactatagggagcaggagggcttgctgtctgaagagcagcaacagaggagagctgctatgcagacagcaaacctggcggcagcgcaaaagatg

SEQ ID NO: 130575 - DNA, 103 bp, Artificial Sequence
  Synthetic Polynucleotide
taatacgactcactatagggctgctgctccagcaggagggcttgctgtctaacagaggagaagacagatggccctcctgaacctggcggcagcgcaaaagatg

SEQ ID NO: 130576 - DNA, 103 bp, Artificial Sequence
  Synthetic Polynucleotide
taatacgactcactatagggggtggatccgctgctgctccagcaggagggaacagaggagaccctccatgtggagcagcaacctggcggcagcgcaaaagatg

SEQ ID NO: 130577 - DNA, 103 bp, Artificial Sequence
  Synthetic Polynucleotide
taatacgactcactatagggcgcagggccggctctgccacaggcagtgagaacagaggagactcactatgtgtggcagaaacctggcggcagcgcaaaagatg

SEQ ID NO: 130578 - DNA, 103 bp, Artificial Sequence
  Synthetic Polynucleotide
taatacgactcactatagggttcctcagctggtggatccgctgctgctccaacagaggagaggagcaatggcggatccaaacctggcggcagcgcaaaagatg

SEQ ID NO: 130579 - DNA, 103 bp, Artificial Sequence
  Synthetic Polynucleotide
taatacgactcactatagggcgcctggtagttcctcagctggtggatccgaacagaggagacggatcatgcagctgaggaacctggcggcagcgcaaaagatg

SEQ ID NO: 130580 - DNA, 103 bp, Artificial Sequence
  Synthetic Polynucleotide
taatacgactcactatagggcctccatggacgcctggtagttcctcagctaacagaggagaagctgaatgactaccaggaacctggcggcagcgcaaaagatg

SEQ ID NO: 130581 - DNA, 103 bp, Artificial Sequence
  Synthetic Polynucleotide
taatacgactcactatagggatgccggcggcctccatggacgcctggtagaacagaggagactaccaatggtccatggaaacctggcggcagcgcaaaagatg

SEQ ID NO: 130582 - DNA, 103 bp, Artificial Sequence
  Synthetic Polynucleotide
taatacgactcactatagggggacacggggatgccggcggcctccatggaaacagaggagatccatgatggccgccggcaacctggcggcagcgcaaaagatg

SEQ ID NO: 130583 - DNA, 103 bp, Artificial Sequence
  Synthetic Polynucleotide
taatacgactcactatagggggccgccgaaggacacggggatgccggcggaacagaggagaccgccgatgtccccgtgtaacctggcggcagcgcaaaagatg

SEQ ID NO: 130584 - DNA, 103 bp, Artificial Sequence
  Synthetic Polynucleotide
taatacgactcactatagggagaggcctgtggccgccgaaggacacggggaacagaggagaccccgtatgcttcggcggaacctggcggcagcgcaaaagatg

SEQ ID NO: 130585 - DNA, 103 bp, Artificial Sequence
  Synthetic Polynucleotide
taatacgactcactatagggcgcccgggacagaggcctgtggccgccgaaaacagaggagattcggcatgcacaggcctaacctggcggcagcgcaaaagatg

SEQ ID NO: 130586 - DNA, 103 bp, Artificial Sequence
  Synthetic Polynucleotide
taatacgactcactataggggtgaggactgcgcccgggacagaggcctgtaacagaggagaacaggcatgtgtcccgggaacctggcggcagcgcaaaagatg

SEQ ID NO: 130587 - DNA, 103 bp, Artificial Sequence
  Synthetic Polynucleotide
taatacgactcactataggggcagacgcgggtgaggactgcgcccgggacaacagaggagagtcccgatggcagtcctcaacctggcggcagcgcaaaagatg

SEQ ID NO: 130588 - DNA, 103 bp, Artificial Sequence
  Synthetic Polynucleotide
taatacgactcactatagggctgctgctcccgcagggccggctctgccacaacagaggagagtggcaatgccggccctgaacctggcggcagcgcaaaagatg

SEQ ID NO: 130589 - DNA, 103 bp, Artificial Sequence
  Synthetic Polynucleotide
taatacgactcactatagggggggaaggtggcagacgcgggtgaggactgaacagaggagacagtccatgcccgcgtctaacctggcggcagcgcaaaagatg

SEQ ID NO: 130590 - DNA, 103 bp, Artificial Sequence
  Synthetic Polynucleotide
taatacgactcactataggggcacagacacggggaaggtggcagacgcggaacagaggagaccgcgtatgccaccttccaacctggcggcagcgcaaaagatg

SEQ ID NO: 130591 - DNA, 103 bp, Artificial Sequence
  Synthetic Polynucleotide
taatacgactcactataggggggggctcctgcacagacacggggaaggtgaacagaggagacaccttatgcgtgtctgtaacctggcggcagcgcaaaagatg

SEQ ID NO: 130592 - DNA, 103 bp, Artificial Sequence
  Synthetic Polynucleotide
taatacgactcactatagggcggcttggtggggggctcctgcacagacacaacagaggagagtgtctatgcaggagcccaacctggcggcagcgcaaaagatg

SEQ ID NO: 130593 - DNA, 103 bp, Artificial Sequence
  Synthetic Polynucleotide
taatacgactcactatagggtcgtgaacctcggcttggtggggggctcctaacagaggagaaggagcatgccaccaagcaacctggcggcagcgcaaaagatg

SEQ ID NO: 130594 - DNA, 103 bp, Artificial Sequence
  Synthetic Polynucleotide
taatacgactcactatagggacgaggcctgtcgtgaacctcggcttggtgaacagaggagacaccaaatggaggttcacaacctggcggcagcgcaaaagatg

SEQ ID NO: 130595 - DNA, 103 bp, Artificial Sequence
  Synthetic Polynucleotide
taatacgactcactatagggcgtgtcatacacgaggcctgtcgtgaacctaacagaggagaaggttcatgacaggcctcaacctggcggcagcgcaaaagatg

SEQ ID NO: 130596 - DNA, 103 bp, Artificial Sequence
  Synthetic Polynucleotide
taatacgactcactatagggtcagcatcagcgtgtcatacacgaggcctgaacagaggagacaggccatgtgtatgacaaacctggcggcagcgcaaaagatg

SEQ ID NO: 130597 - DNA, 103 bp, Artificial Sequence
  Synthetic Polynucleotide
taatacgactcactatagggcactggtgcttcagcatcagcgtgtcatacaacagaggagagtatgaatggctgatgctaacctggcggcagcgcaaaagatg

SEQ ID NO: 130598 - DNA, 103 bp, Artificial Sequence
  Synthetic Polynucleotide
taatacgactcactatagggcccgcaggtgcactggtgcttcagcatcagaacagaggagactgatgatgaagcaccagaacctggcggcagcgcaaaagatg

SEQ ID NO: 130599 - DNA, 103 bp, Artificial Sequence
  Synthetic Polynucleotide
taatacgactcactatagggctcggccagaaagtccatctggatggctttaacagaggagaaaagccatgcagatggacaacctggcggcagcgcaaaagatg

SEQ ID NO: 130600 - DNA, 103 bp, Artificial Sequence
  Synthetic Polynucleotide
taatacgactcactatagggcctgctgcagctgctgctcccgcagggccgaacagaggagacggcccatggggagcagcaacctggcggcagcgcaaaagatg

SEQ ID NO: 130601 - DNA, 103 bp, Artificial Sequence
  Synthetic Polynucleotide
taatacgactcactatagggtgctgctactcccgcaggtgcactggtgctaacagaggagaagcaccatggcacctgcgaacctggcggcagcgcaaaagatg

SEQ ID NO: 130602 - DNA, 103 bp, Artificial Sequence
  Synthetic Polynucleotide
taatacgactcactatagggtcggggtggctgctgctactcccgcaggtgaacagaggagacacctgatggagtagcagaacctggcggcagcgcaaaagatg

SEQ ID NO: 130603 - DNA, 103 bp, Artificial Sequence
  Synthetic Polynucleotide
taatacgactcactatagggcccggcgtgctcggggtggctgctgctactaacagaggagaagtagcatgagccaccccaacctggcggcagcgcaaaagatg

SEQ ID NO: 130604 - DNA, 103 bp, Artificial Sequence
  Synthetic Polynucleotide
taatacgactcactatagggtctggatcctcccggcgtgctcggggtggcaacagaggagagccaccatgagcacgccgaacctggcggcagcgcaaaagatg

SEQ ID NO: 130605 - DNA, 103 bp, Artificial Sequence
  Synthetic Polynucleotide
taatacgactcactataggggaccagatgctctggatcctcccggcgtgcaacagaggagagcacgcatggaggatccaaacctggcggcagcgcaaaagatg

SEQ ID NO: 130606 - DNA, 103 bp, Artificial Sequence
  Synthetic Polynucleotide
taatacgactcactatagggctgcaggcgggaccagatgctctggatcctaacagaggagaaggatcatgagcatctggaacctggcggcagcgcaaaagatg

SEQ ID NO: 130607 - DNA, 103 bp, Artificial Sequence
  Synthetic Polynucleotide
taatacgactcactatagggggcccgtctcctgcaggcgggaccagatgcaacagaggagagcatctatgcccgcctgcaacctggcggcagcgcaaaagatg

SEQ ID NO: 130608 - DNA, 103 bp, Artificial Sequence
  Synthetic Polynucleotide
taatacgactcactatagggttgccccggaggcccgtctcctgcaggcggaacagaggagaccgcctatgggagacgggaacctggcggcagcgcaaaagatg

SEQ ID NO: 130609 - DNA, 103 bp, Artificial Sequence
  Synthetic Polynucleotide
taatacgactcactataggggcactcgcatttgccccggaggcccgtctcaacagaggagagagacgatgctccggggcaacctggcggcagcgcaaaagatg

SEQ ID NO: 130610 - DNA, 103 bp, Artificial Sequence
  Synthetic Polynucleotide
taatacgactcactataggggtccgcggatgcactcgcatttgccccggaaacagaggagatccgggatgaatgcgagtaacctggcggcagcgcaaaagatg

SEQ ID NO: 130611 - DNA, 103 bp, Artificial Sequence
  Synthetic Polynucleotide
taatacgactcactataggggccaggagctcctgctgcagctgctgctccaacagaggagaggagcaatggctgcagcaaacctggcggcagcgcaaaagatg

SEQ ID NO: 130612 - DNA, 103 bp, Artificial Sequence
  Synthetic Polynucleotide
taatacgactcactataggggtggccttgcgtccgcggatgcactcgcataacagaggagaatgcgaatgcatccgcggaacctggcggcagcgcaaaagatg

SEQ ID NO: 130613 - DNA, 103 bp, Artificial Sequence
  Synthetic Polynucleotide
taatacgactcactatagggctcctccagggtggccttgcgtccgcggataacagaggagaatccgcatgcgcaaggccaacctggcggcagcgcaaaagatg

SEQ ID NO: 130614 - DNA, 103 bp, Artificial Sequence
  Synthetic Polynucleotide
taatacgactcactatagggccgtctgtagctcctccagggtggccttgcaacagaggagagcaaggatgccctggaggaacctggcggcagcgcaaaagatg

SEQ ID NO: 130615 - DNA, 103 bp, Artificial Sequence
  Synthetic Polynucleotide
taatacgactcactatagggtccgagtgcaccgtctgtagctcctccaggaacagaggagacctggaatggctacagacaacctggcggcagcgcaaaagatg

SEQ ID NO: 130616 - DNA, 103 bp, Artificial Sequence
  Synthetic Polynucleotide
taatacgactcactatagggggtgtgggcttccgagtgcaccgtctgtagaacagaggagactacagatggtgcactcgaacctggcggcagcgcaaaagatg

SEQ ID NO: 130617 - DNA, 103 bp, Artificial Sequence
  Synthetic Polynucleotide
taatacgactcactatagggcatacaggagggtgtgggcttccgagtgcaaacagaggagatgcactatgaagcccacaaacctggcggcagcgcaaaagatg

SEQ ID NO: 130618 - DNA, 103 bp, Artificial Sequence
  Synthetic Polynucleotide
taatacgactcactataggggggttcgtgccatacaggagggtgtgggctaacagaggagaagcccaatgcctcctgtaaacctggcggcagcgcaaaagatg

SEQ ID NO: 130619 - DNA, 103 bp, Artificial Sequence
  Synthetic Polynucleotide
taatacgactcactatagggccggttgagggggttcgtgccatacaggagaacagaggagactcctgatgggcacgaacaacctggcggcagcgcaaaagatg

SEQ ID NO: 130620 - DNA, 103 bp, Artificial Sequence
  Synthetic Polynucleotide
taatacgactcactatagggccagtttctgccggttgagggggttcgtgcaacagaggagagcacgaatgccctcaaccaacctggcggcagcgcaaaagatg

SEQ ID NO: 130621 - DNA, 103 bp, Artificial Sequence
  Synthetic Polynucleotide
taatacgactcactatagggttcttactgtccagtttctgccggttgaggaacagaggagacctcaaatggcagaaactaacctggcggcagcgcaaaagatg

SEQ ID NO: 130622 - DNA, 103 bp, Artificial Sequence
  Synthetic Polynucleotide
taatacgactcactatagggctgcttgagcgccaggagctcctgctgcagaacagaggagactgcagatggagctcctgaacctggcggcagcgcaaaagatg

SEQ ID NO: 130623 - DNA, 103 bp, Artificial Sequence
  Synthetic Polynucleotide
taatacgactcactataggggcctagaagtttcttactgtccagtttctgaacagaggagacagaaaatggacagtaagaacctggcggcagcgcaaaagatg

SEQ ID NO: 130624 - DNA, 103 bp, Artificial Sequence
  Synthetic Polynucleotide
taatacgactcactatagggaggcgagcgagcctagaagtttcttactgtaacagaggagaacagtaatgaacttctagaacctggcggcagcgcaaaagatg

SEQ ID NO: 130625 - DNA, 103 bp, Artificial Sequence
  Synthetic Polynucleotide
taatacgactcactatagggacgaacacggaggcgagcgagcctagaagtaacagaggagaacttctatgctcgctcgcaacctggcggcagcgcaaaagatg

SEQ ID NO: 130626 - DNA, 103 bp, Artificial Sequence
  Synthetic Polynucleotide
taatacgactcactatagggagggagccggacgaacacggaggcgagcgaaacagaggagatcgctcatgtccgtgttcaacctggcggcagcgcaaaagatg

SEQ ID NO: 130627 - DNA, 103 bp, Artificial Sequence
  Synthetic Polynucleotide
taatacgactcactatagggcaccaccgcaagggagccggacgaacacggaacagaggagaccgtgtatgtccggctccaacctggcggcagcgcaaaagatg

SEQ ID NO: 130628 - DNA, 103 bp, Artificial Sequence
  Synthetic Polynucleotide
taatacgactcactatagggtccaccccaacaccaccgcaagggagccggaacagaggagaccggctatgttgcggtggaacctggcggcagcgcaaaagatg

SEQ ID NO: 130629 - DNA, 103 bp, Artificial Sequence
  Synthetic Polynucleotide
taatacgactcactatagggggtgtcactgtccaccccaacaccaccgcaaacagaggagatgcggtatggttggggtgaacctggcggcagcgcaaaagatg

SEQ ID NO: 130630 - DNA, 103 bp, Artificial Sequence
  Synthetic Polynucleotide
taatacgactcactatagggcgttccatatggtgtcactgtccaccccaaaacagaggagattggggatgacagtgacaaacctggcggcagcgcaaaagatg

SEQ ID NO: 130631 - DNA, 103 bp, Artificial Sequence
  Synthetic Polynucleotide
taatacgactcactataggggagtgcacctcgttccatatggtgtcactgaacagaggagacagtgaatgcatatggaaaacctggcggcagcgcaaaagatg

SEQ ID NO: 130632 - DNA, 103 bp, Artificial Sequence
  Synthetic Polynucleotide
taatacgactcactatagggtgcccccgccgagtgcacctcgttccatataacagaggagaatatggatggaggtgcacaacctggcggcagcgcaaaagatg

SEQ ID NO: 130633 - DNA, 103 bp, Artificial Sequence
  Synthetic Polynucleotide
taatacgactcactatagggtctgctgcttctgcttgagcgccaggagctaacagaggagaagctccatgcgctcaagcaacctggcggcagcgcaaaagatg

SEQ ID NO: 130634 - DNA, 103 bp, Artificial Sequence
  Synthetic Polynucleotide
taatacgactcactatagggccaggcgggctgcccccgccgagtgcacctaacagaggagaaggtgcatgcggcgggggaacctggcggcagcgcaaaagatg

SEQ ID NO: 130635 - DNA, 103 bp, Artificial Sequence
  Synthetic Polynucleotide
taatacgactcactatagggcagcccacagccaggcgggctgcccccgccaacagaggagaggcgggatgagcccgcctaacctggcggcagcgcaaaagatg

SEQ ID NO: 130636 - DNA, 103 bp, Artificial Sequence
  Synthetic Polynucleotide
taatacgactcactatagggctctaccacgcagcccacagccaggcgggcaacagaggagagcccgcatggctgtgggcaacctggcggcagcgcaaaagatg

SEQ ID NO: 130637 - DNA, 103 bp, Artificial Sequence
  Synthetic Polynucleotide
taatacgactcactatagggtgaagaccagctctaccacgcagcccacagaacagaggagactgtggatggcgtggtagaacctggcggcagcgcaaaagatg

SEQ ID NO: 130638 - DNA, 103 bp, Artificial Sequence
  Synthetic Polynucleotide
taatacgactcactataggggtggccaccttgaagaccagctctaccacgaacagaggagacgtggtatggctggtcttaacctggcggcagcgcaaaagatg

SEQ ID NO: 130639 - DNA, 103 bp, Artificial Sequence
  Synthetic Polynucleotide
taatacgactcactatagggcagctcccctgtggccaccttgaagaccagaacagaggagactggtcatgaaggtggccaacctggcggcagcgcaaaagatg

SEQ ID NO: 130640 - DNA, 103 bp, Artificial Sequence
  Synthetic Polynucleotide
taatacgactcactatagggagccattcttcagctcccctgtggccacctaacagaggagaaggtggatgcaggggagcaacctggcggcagcgcaaaagatg

SEQ ID NO: 130641 - DNA, 103 bp, Artificial Sequence
  Synthetic Polynucleotide
taatacgactcactatagggaccacagcaaagccattcttcagctcccctaacagaggagaaggggaatggaagaatggaacctggcggcagcgcaaaagatg

SEQ ID NO: 130642 - DNA, 103 bp, Artificial Sequence
  Synthetic Polynucleotide
taatacgactcactatagggaggggggcggaccacagcaaagccattcttaacagaggagaaagaatatgtttgctgtgaacctggcggcagcgcaaaagatg

SEQ ID NO: 130643 - DNA, 103 bp, Artificial Sequence
  Synthetic Polynucleotide
taatacgactcactatagggcatggtgtccaggggggcggaccacagcaaaacagaggagattgctgatgtccgcccccaacctggcggcagcgcaaaagatg

SEQ ID NO: 130644 - DNA, 103 bp, Artificial Sequence
  Synthetic Polynucleotide
taatacgactcactatagggtgcctctggatctgctgcttctgcttgagcaacagaggagagctcaaatggaagcagcaaacctggcggcagcgcaaaagatg

SEQ ID NO: 130645 - DNA, 103 bp, Artificial Sequence
  Synthetic Polynucleotide
taatacgactcactatagggctctcctccgcatggtgtccaggggggcggaacagaggagaccgcccatgtggacaccaaacctggcggcagcgcaaaagatg

SEQ ID NO: 130646 - DNA, 103 bp, Artificial Sequence
  Synthetic Polynucleotide
taatacgactcactatagggcatgggcgtgctctcctccgcatggtgtccaacagaggagaggacacatggcggaggagaacctggcggcagcgcaaaagatg

SEQ ID NO: 130647 - DNA, 103 bp, Artificial Sequence
  Synthetic Polynucleotide
taatacgactcactatagggagcaaaagcccatgggcgtgctctcctccgaacagaggagacggaggatggcacgcccaaacctggcggcagcgcaaaagatg

SEQ ID NO: 130648 - DNA, 103 bp, Artificial Sequence
  Synthetic Polynucleotide
taatacgactcactataggggagttgaagtagcaaaagcccatgggcgtgaacagaggagacacgccatggggcttttgaacctggcggcagcgcaaaagatg

SEQ ID NO: 130649 - DNA, 103 bp, Artificial Sequence
  Synthetic Polynucleotide
taatacgactcactatagggcacggccacggagttgaagtagcaaaagccaacagaggagaggctttatgtacttcaacaacctggcggcagcgcaaaagatg

SEQ ID NO: 130650 - DNA, 103 bp, Artificial Sequence
  Synthetic Polynucleotide
taatacgactcactataggggcttggctgccacggccacggagttgaagtaacagaggagaacttcaatgccgtggccgaacctggcggcagcgcaaaagatg

SEQ ID NO: 130651 - DNA, 103 bp, Artificial Sequence
  Synthetic Polynucleotide
taatacgactcactatagggtgctgcagaagcttggctgccacggccacgaacagaggagacgtggcatgggcagccaaaacctggcggcagcgcaaaagatg

SEQ ID NO: 130652 - DNA, 103 bp, Artificial Sequence
  Synthetic Polynucleotide
taatacgactcactataggggctcaacctctgctgcagaagcttggctgcaacagaggagagcagccatgcttctgcagaacctggcggcagcgcaaaagatg

SEQ ID NO: 130653 - DNA, 103 bp, Artificial Sequence
  Synthetic Polynucleotide
taatacgactcactatagggtcttgctcacgctcaacctctgctgcagaaaacagaggagattctgcatgagaggttgaaacctggcggcagcgcaaaagatg

SEQ ID NO: 130654 - DNA, 103 bp, Artificial Sequence
  Synthetic Polynucleotide
taatacgactcactatagggacgatgaggatcttgctcacgctcaacctcaacagaggagagaggttatgcgtgagcaaaacctggcggcagcgcaaaagatg

SEQ ID NO: 130655 - DNA, 103 bp, Artificial Sequence
  Synthetic Polynucleotide
taatacgactcactataggggatgaggatctgcctctggatctgctgcttaacagaggagaaagcagatgatccagaggaacctggcggcagcgcaaaagatg

SEQ ID NO: 130656 - DNA, 103 bp, Artificial Sequence
  Synthetic Polynucleotide
taatacgactcactataggggtcccagtccacgatgaggatcttgctcacaacagaggagagtgagcatgatcctcatcaacctggcggcagcgcaaaagatg

SEQ ID NO: 130657 - DNA, 103 bp, Artificial Sequence
  Synthetic Polynucleotide
taatacgactcactatagggcatggtgcacgtcccagtccacgatgaggaaacagaggagatcctcaatgtggactgggaacctggcggcagcgcaaaagatg

SEQ ID NO: 130658 - DNA, 103 bp, Artificial Sequence
  Synthetic Polynucleotide
taatacgactcactataggggtcccgtttccatggtgcacgtcccagtccaacagaggagaggactgatgcgtgcaccaaacctggcggcagcgcaaaagatg

SEQ ID NO: 130659 - DNA, 103 bp, Artificial Sequence
  Synthetic Polynucleotide
taatacgactcactatagggagcctgctgggtcccgtttccatggtgcacaacagaggagagtgcacatgggaaacgggaacctggcggcagcgcaaaagatg

SEQ ID NO: 130660 - DNA, 103 bp, Artificial Sequence
  Synthetic Polynucleotide
taatacgactcactatagggcgctgtagaaagcctgctgggtcccgtttcaacagaggagagaaacgatgcccagcaggaacctggcggcagcgcaaaagatg

SEQ ID NO: 130661 - DNA, 103 bp, Artificial Sequence
  Synthetic Polynucleotide
taatacgactcactatagggacgctggggtcgctgtagaaagcctgctggaacagaggagaccagcaatgtttctacagaacctggcggcagcgcaaaagatg

SEQ ID NO: 130662 - DNA, 103 bp, Artificial Sequence
  Synthetic Polynucleotide
taatacgactcactatagggcatgtacaggacgctggggtcgctgtagaaaacagaggagattctacatggaccccagcaacctggcggcagcgcaaaagatg

SEQ ID NO: 130663 - DNA, 103 bp, Artificial Sequence
  Synthetic Polynucleotide
taatacgactcactatagggggtggagggacatgtacaggacgctggggtaacagaggagaaccccaatgtcctgtacaaacctggcggcagcgcaaaagatg

SEQ ID NO: 130664 - DNA, 103 bp, Artificial Sequence
  Synthetic Polynucleotide
taatacgactcactatagggtcgtcgtagcggtggagggacatgtacaggaacagaggagacctgtaatggtccctccaaacctggcggcagcgcaaaagatg

SEQ ID NO: 130665 - DNA, 103 bp, Artificial Sequence
  Synthetic Polynucleotide
taatacgactcactataggggaagttcccatcgtcgtagcggtggagggaaacagaggagatccctcatgcgctacgacaacctggcggcagcgcaaaagatg

SEQ ID NO: 130666 - DNA, 103 bp, Artificial Sequence
  Synthetic Polynucleotide
taatacgactcactatagggggaactcagcgatgaggatctgcctctggaaacagaggagatccagaatgagatcctcaaacctggcggcagcgcaaaagatg

SEQ ID NO: 130667 - DNA, 103 bp, Artificial Sequence
  Synthetic Polynucleotide
taatacgactcactatagggtgcctgggaagaagttcccatcgtcgtagcaacagaggagagctacgatgatgggaactaacctggcggcagcgcaaaagatg

SEQ ID NO: 130668 - DNA, 103 bp, Artificial Sequence
  Synthetic Polynucleotide
taatacgactcactatagggggagccccgctgcctgggaagaagttcccaaacagaggagatgggaaatgcttcccaggaacctggcggcagcgcaaaagatg

SEQ ID NO: 130669 - DNA, 103 bp, Artificial Sequence
  Synthetic Polynucleotide
taatacgactcactatagggcacctcatcaggagccccgctgcctgggaaaacagaggagattcccaatgagcggggctaacctggcggcagcgcaaaagatg

SEQ ID NO: 130670 - DNA, 103 bp, Artificial Sequence
  Synthetic Polynucleotide
taatacgactcactataggggccctgtgcccacctcatcaggagccccgcaacagaggagagcggggatgctgatgaggaacctggcggcagcgcaaaagatg

SEQ ID NO: 130671 - DNA, 103 bp, Artificial Sequence
  Synthetic Polynucleotide
taatacgactcactatagggcccacgccgggccctgtgcccacctcatcaaacagaggagatgatgaatggggcacaggaacctggcggcagcgcaaaagatg

SEQ ID NO: 130672 - DNA, 103 bp, Artificial Sequence
  Synthetic Polynucleotide
taatacgactcactataggggacgttgaaacccacgccgggccctgtgccaacagaggagaggcacaatgcccggcgtgaacctggcggcagcgcaaaagatg

SEQ ID NO: 130673 - DNA, 103 bp, Artificial Sequence
  Synthetic Polynucleotide
taatacgactcactatagggaagccatgttgacgttgaaacccacgccggaacagaggagaccggcgatggtttcaacgaacctggcggcagcgcaaaagatg

SEQ ID NO: 130674 - DNA, 103 bp, Artificial Sequence
  Synthetic Polynucleotide
taatacgactcactatagggccgccggtgaaagccatgttgacgttgaaaaacagaggagatttcaaatgcaacatggcaacctggcggcagcgcaaaagatg

SEQ ID NO: 130675 - DNA, 103 bp, Artificial Sequence
  Synthetic Polynucleotide
taatacgactcactatagggggggtccaggccgccggtgaaagccatgttaacagaggagaaacatgatgttcaccggcaacctggcggcagcgcaaaagatg

SEQ ID NO: 130676 - DNA, 103 bp, Artificial Sequence
  Synthetic Polynucleotide
taatacgactcactatagggctcccatgggggggtccaggccgccggtgaaacagaggagatcaccgatggcctggaccaacctggcggcagcgcaaaagatg

SEQ ID NO: 130677 - DNA, 103 bp, Artificial Sequence
  Synthetic Polynucleotide
taatacgactcactatagggtgctgcctctggaactcagcgatgaggatcaacagaggagagatcctatgcgctgagttaacctggcggcagcgcaaaagatg

SEQ ID NO: 130678 - DNA, 103 bp, Artificial Sequence
  Synthetic Polynucleotide
taatacgactcactatagggtactcagcgtctcccatgggggggtccaggaacagaggagacctggaatgccccatgggaacctggcggcagcgcaaaagatg

SEQ ID NO: 130679 - DNA, 103 bp, Artificial Sequence
  Synthetic Polynucleotide
taatacgactcactatagggggccgccaagtactcagcgtctcccatgggaacagaggagacccatgatggacgctgagaacctggcggcagcgcaaaagatg

SEQ ID NO: 130680 - DNA, 103 bp, Artificial Sequence
  Synthetic Polynucleotide
taatacgactcactatagggccgttctgaaggccgccaagtactcagcgtaacagaggagaacgctgatgacttggcggaacctggcggcagcgcaaaagatg

SEQ ID NO: 130681 - DNA, 103 bp, Artificial Sequence
  Synthetic Polynucleotide
taatacgactcactatagggggcatgaccaccgttctgaaggccgccaagaacagaggagacttggcatgcttcagaacaacctggcggcagcgcaaaagatg

SEQ ID NO: 130682 - DNA, 103 bp, Artificial Sequence
  Synthetic Polynucleotide
taatacgactcactataggggctggcgatcggcatgaccaccgttctgaaaacagaggagattcagaatggtggtcatgaacctggcggcagcgcaaaagatg

SEQ ID NO: 130683 - DNA, 103 bp, Artificial Sequence
  Synthetic Polynucleotide
taatacgactcactataggggggcaaactcgctggcgatcggcatgaccaaacagaggagatggtcaatgcgatcgccaaacctggcggcagcgcaaaagatg

SEQ ID NO: 130684 - DNA, 103 bp, Artificial Sequence
  Synthetic Polynucleotide
taatacgactcactatagggaccacatccggggcaaactcgctggcgatcaacagaggagagatcgcatgcgagtttgcaacctggcggcagcgcaaaagatg

SEQ ID NO: 130685 - DNA, 103 bp, Artificial Sequence
  Synthetic Polynucleotide
taatacgactcactatagggtgacaccagcaccacatccggggcaaactcaacagaggagagagtttatgccggatgtgaacctggcggcagcgcaaaagatg

SEQ ID NO: 130686 - DNA, 103 bp, Artificial Sequence
  Synthetic Polynucleotide
taatacgactcactatagggcgaagcctgatgacaccagcaccacatccgaacagaggagacggatgatgtgctggtgtaacctggcggcagcgcaaaagatg

SEQ ID NO: 130687 - DNA, 103 bp, Artificial Sequence
  Synthetic Polynucleotide
taatacgactcactatagggtccacggcatcgaagcctgatgacaccagcaacagaggagagctggtatgatcaggcttaacctggcggcagcgcaaaagatg

SEQ ID NO: 130688 - DNA, 103 bp, Artificial Sequence
  Synthetic Polynucleotide
taatacgactcactataggggagctgctcgtgctgcctctggaactcagcaacagaggagagctgagatgcagaggcagaacctggcggcagcgcaaaagatg

SEQ ID NO: 130689 - DNA, 103 bp, Artificial Sequence
  Synthetic Polynucleotide
taatacgactcactatagggggggtggccctccacggcatcgaagcctgaaacagaggagatcaggcatggatgccgtgaacctggcggcagcgcaaaagatg

SEQ ID NO: 130690 - DNA, 103 bp, Artificial Sequence
  Synthetic Polynucleotide
taatacgactcactatagggcaagaggggtggggtggccctccacggcataacagaggagaatgccgatgagggccaccaacctggcggcagcgcaaaagatg

SEQ ID NO: 130691 - DNA, 103 bp, Artificial Sequence
  Synthetic Polynucleotide
taatacgactcactatagggttgtagcccccaagaggggtggggtggcccaacagaggagagggccaatgcacccctctaacctggcggcagcgcaaaagatg

SEQ ID NO: 130692 - DNA, 103 bp, Artificial Sequence
  Synthetic Polynucleotide
taatacgactcactatagggggcggagaggttgtagcccccaagaggggtaacagaggagaacccctatggggggctacaacctggcggcagcgcaaaagatg

SEQ ID NO: 130693 - DNA, 103 bp, Artificial Sequence
  Synthetic Polynucleotide
taatacgactcactatagggcgaagcatctggcggagaggttgtagccccaacagaggagaggggctatgacctctccgaacctggcggcagcgcaaaagatg

SEQ ID NO: 130694 - DNA, 103 bp, Artificial Sequence
  Synthetic Polynucleotide
taatacgactcactataggggtcaggtacccgaagcatctggcggagaggaacagaggagacctctcatgcagatgcttaacctggcggcagcgcaaaagatg

SEQ ID NO: 130695 - DNA, 103 bp, Artificial Sequence
  Synthetic Polynucleotide
taatacgactcactatagggcagctgcttcgtcaggtacccgaagcatctaacagaggagaagatgcatggggtacctgaacctggcggcagcgcaaaagatg

SEQ ID NO: 130696 - DNA, 103 bp, Artificial Sequence
  Synthetic Polynucleotide
taatacgactcactatagggccaggcccatcagctgcttcgtcaggtaccaacagaggagaggtaccatgcgaagcagcaacctggcggcagcgcaaaagatg

SEQ ID NO: 130697 - DNA, 103 bp, Artificial Sequence
  Synthetic Polynucleotide
taatacgactcactatagggcggccgccagccaggcccatcagctgcttcaacagaggagagaagcaatggatgggcctaacctggcggcagcgcaaaagatg

SEQ ID NO: 130698 - DNA, 103 bp, Artificial Sequence
  Synthetic Polynucleotide
taatacgactcactatagggcaggacaatccggccgccagccaggcccataacagaggagaatgggcatggctggcggcaacctggcggcagcgcaaaagatg

SEQ ID NO: 130699 - DNA, 103 bp, Artificial Sequence
  Synthetic Polynucleotide
taatacgactcactataggggctgccgggagagctgctcgtgctgcctctaacagaggagaagaggcatgacgagcagcaacctggcggcagcgcaaaagatg

SEQ ID NO: 130700 - DNA, 103 bp, Artificial Sequence
  Synthetic Polynucleotide
taatacgactcactatagggcctcgagggccaggacaatccggccgccagaacagaggagactggcgatgggattgtccaacctggcggcagcgcaaaagatg

SEQ ID NO: 130701 - DNA, 103 bp, Artificial Sequence
  Synthetic Polynucleotide
taatacgactcactatagggtcgtggcctccctcgagggccaggacaatcaacagaggagagattgtatgggccctcgaaacctggcggcagcgcaaaagatg

SEQ ID NO: 130702 - DNA, 103 bp, Artificial Sequence
  Synthetic Polynucleotide
taatacgactcactatagggggcggtcaggtcgtggcctccctcgagggcaacagaggagagccctcatgggaggccacaacctggcggcagcgcaaaagatg

SEQ ID NO: 130703 - DNA, 103 bp, Artificial Sequence
  Synthetic Polynucleotide
taatacgactcactatagggcgtcgcaaatggcggtcaggtcgtggcctcaacagaggagagaggccatgacctgaccgaacctggcggcagcgcaaaagatg

SEQ ID NO: 130704 - DNA, 103 bp, Artificial Sequence
  Synthetic Polynucleotide
taatacgactcactataggggcttccgaggcgtcgcaaatggcggtcaggaacagaggagacctgacatgcatttgcgaaacctggcggcagcgcaaaagatg

SEQ ID NO: 130705 - DNA, 103 bp, Artificial Sequence
  Synthetic Polynucleotide
taatacgactcactatagggagaaacacatgcttccgaggcgtcgcaaataacagaggagaatttgcatggcctcggaaaacctggcggcagcgcaaaagatg

SEQ ID NO: 130706 - DNA, 103 bp, Artificial Sequence
  Synthetic Polynucleotide
taatacgactcactatagggccagcaaggcagaaacacatgcttccgaggaacagaggagacctcggatgcatgtgtttaacctggcggcagcgcaaaagatg

SEQ ID NO: 130707 - DNA, 103 bp, Artificial Sequence
  Synthetic Polynucleotide
taatacgactcactatagggagctcgtttcccagcaaggcagaaacacataacagaggagaatgtgtatgtgccttgctaacctggcggcagcgcaaaagatg

SEQ ID NO: 130708 - DNA, 103 bp, Artificial Sequence
  Synthetic Polynucleotide
taatacgactcactataggggagaggatcaagctcgtttcccagcaaggcaacagaggagagccttgatgggaaacgagaacctggcggcagcgcaaaagatg

SEQ ID NO: 130709 - DNA, 103 bp, Artificial Sequence
  Synthetic Polynucleotide
taatacgactcactatagggccttttctgggagaggatcaagctcgtttcaacagaggagagaaacgatgttgatcctcaacctggcggcagcgcaaaagatg

SEQ ID NO: 130710 - DNA, 103 bp, Artificial Sequence
  Synthetic Polynucleotide
taatacgactcactatagggactggctggtctcggccagaaagtccatctaacagaggagaagatggatgttctggccgaacctggcggcagcgcaaaagatg

SEQ ID NO: 130711 - DNA, 103 bp, Artificial Sequence
  Synthetic Polynucleotide
taatacgactcactatagggtgcgcctcgtgctgccgggagagctgctcgaacagaggagacgagcaatgctcccggcaaacctggcggcagcgcaaaagatg

SEQ ID NO: 130712 - DNA, 103 bp, Artificial Sequence
  Synthetic Polynucleotide
taatacgactcactatagggtgctgtaaaaccttttctgggagaggatcaaacagaggagatgatccatgcccagaaaaaacctggcggcagcgcaaaagatg

SEQ ID NO: 130713 - DNA, 103 bp, Artificial Sequence
  Synthetic Polynucleotide
taatacgactcactatagggattgggtctttgctgtaaaaccttttctggaacagaggagaccagaaatggttttacagaacctggcggcagcgcaaaagatg

SEQ ID NO: 130714 - DNA, 103 bp, Artificial Sequence
  Synthetic Polynucleotide
taatacgactcactatagggcagcgtttgcattgggtctttgctgtaaaaaacagaggagattttacatgaaagacccaaacctggcggcagcgcaaaagatg

SEQ ID NO: 130715 - DNA, 103 bp, Artificial Sequence
  Synthetic Polynucleotide
taatacgactcactatagggatggaacggacagcgtttgcattgggtcttaacagaggagaaagaccatgtgcaaacgcaacctggcggcagcgcaaaagatg

SEQ ID NO: 130716 - DNA, 103 bp, Artificial Sequence
  Synthetic Polynucleotide
taatacgactcactataggggactttctccatggaacggacagcgtttgcaacagaggagagcaaacatggtccgttccaacctggcggcagcgcaaaagatg

SEQ ID NO: 130717 - DNA, 103 bp, Artificial Sequence
  Synthetic Polynucleotide
taatacgactcactatagggggatctccatgactttctccatggaacggaaacagaggagatccgttatgtggagaaagaacctggcggcagcgcaaaagatg

SEQ ID NO: 130718 - DNA, 103 bp, Artificial Sequence
  Synthetic Polynucleotide
taatacgactcactatagggtacttgctgtggatctccatgactttctccaacagaggagaggagaaatgcatggagataacctggcggcagcgcaaaagatg

SEQ ID NO: 130719 - DNA, 103 bp, Artificial Sequence
  Synthetic Polynucleotide
taatacgactcactataggggcagcgccagtacttgctgtggatctccataacagaggagaatggagatgcacagcaagaacctggcggcagcgcaaaagatg

SEQ ID NO: 130720 - DNA, 103 bp, Artificial Sequence
  Synthetic Polynucleotide
taatacgactcactatagggtgcgctgcaggcagcgccagtacttgctgtaacagaggagaacagcaatgactggcgctaacctggcggcagcgcaaaagatg

SEQ ID NO: 130721 - DNA, 103 bp, Artificial Sequence
  Synthetic Polynucleotide
taatacgactcactataggggtggaggttgtgcgctgcaggcagcgccagaacagaggagactggcgatgcctgcagcgaacctggcggcagcgcaaaagatg

SEQ ID NO: 130722 - DNA, 103 bp, Artificial Sequence
  Synthetic Polynucleotide
taatacgactcactatagggctcgtggagctgcgcctcgtgctgccgggaaacagaggagatcccggatgcacgaggcgaacctggcggcagcgcaaaagatg

SEQ ID NO: 130723 - DNA, 103 bp, Artificial Sequence
  Synthetic Polynucleotide
taatacgactcactatagggacgccccgctgtggaggttgtgcgctgcagaacagaggagactgcagatgacaacctccaacctggcggcagcgcaaaagatg

SEQ ID NO: 130724 - DNA, 103 bp, Artificial Sequence
  Synthetic Polynucleotide
taatacgactcactatagggcgatcagagaacgccccgctgtggaggttgaacagaggagacaacctatgcagcggggcaacctggcggcagcgcaaaagatg

SEQ ID NO: 130725 - DNA, 103 bp, Artificial Sequence
  Synthetic Polynucleotide
taatacgactcactataggggtctgagcctcgatcagagaacgccccgctaacagaggagaagcgggatgttctctgataacctggcggcagcgcaaaagatg

SEQ ID NO: 130726 - DNA, 103 bp, Artificial Sequence
  Synthetic Polynucleotide
taatacgactcactataggggttctcgcaagtctgagcctcgatcagagaaacagaggagatctctgatggaggctcagaacctggcggcagcgcaaaagatg

SEQ ID NO: 130727 - DNA, 103 bp, Artificial Sequence
  Synthetic Polynucleotide
taatacgactcactatagggcggcttcttcgttctcgcaagtctgagcctaacagaggagaaggctcatgcttgcgagaaacctggcggcagcgcaaaagatg

SEQ ID NO: 130728 - DNA, 103 bp, Artificial Sequence
  Synthetic Polynucleotide
taatacgactcactataggggtgaccgtctcggcttcttcgttctcgcaaaacagaggagattgcgaatgcgaagaagcaacctggcggcagcgcaaaagatg

SEQ ID NO: 130729 - DNA, 103 bp, Artificial Sequence
  Synthetic Polynucleotide
taatacgactcactatagggggccatggcggtgaccgtctcggcttcttcaacagaggagagaagaaatggagacggtcaacctggcggcagcgcaaaagatg

SEQ ID NO: 130730 - DNA, 103 bp, Artificial Sequence
  Synthetic Polynucleotide
taatacgactcactatagggcggacagcgaggccatggcggtgaccgtctaacagaggagaagacggatgccgccatggaacctggcggcagcgcaaaagatg

SEQ ID NO: 130731 - DNA, 103 bp, Artificial Sequence
  Synthetic Polynucleotide
taatacgactcactatagggttcacgcccacggacagcgaggccatggcgaacagaggagacgccatatgctcgctgtcaacctggcggcagcgcaaaagatg

SEQ ID NO: 130732 - DNA, 103 bp, Artificial Sequence
  Synthetic Polynucleotide
taatacgactcactatagggttcggcgggcttcacgcccacggacagcgaaacagaggagatcgctgatggtgggcgtgaacctggcggcagcgcaaaagatg

SEQ ID NO: 130733 - DNA, 103 bp, Artificial Sequence
  Synthetic Polynucleotide
taatacgactcactataggggcttgatgtgctcgtggagctgcgcctcgtaacagaggagaacgaggatgagctccacgaacctggcggcagcgcaaaagatg

SEQ ID NO: 130734 - DNA, 103 bp, Artificial Sequence
  Synthetic Polynucleotide
taatacgactcactatagggctggtctcttttcggcgggcttcacgcccaaacagaggagatgggcgatgagcccgccgaacctggcggcagcgcaaaagatg

SEQ ID NO: 130735 - DNA, 103 bp, Artificial Sequence
  Synthetic Polynucleotide
taatacgactcactatagggggctcctcatctggtctcttttcggcgggcaacagaggagagcccgcatgaaagagaccaacctggcggcagcgcaaaagatg

SEQ ID NO: 130736 - DNA, 103 bp, Artificial Sequence
  Synthetic Polynucleotide
taatacgactcactatagggctcttccatgggctcctcatctggtctcttaacagaggagaaagagaatggatgaggagaacctggcggcagcgcaaaagatg

SEQ ID NO: 130737 - DNA, 103 bp, Artificial Sequence
  Synthetic Polynucleotide
taatacgactcactatagggggggcggctcctcttccatgggctcctcataacagaggagaatgaggatgccatggaagaacctggcggcagcgcaaaagatg

SEQ ID NO: 130738 - DNA, 103 bp, Artificial Sequence
  Synthetic Polynucleotide
taatacgactcactatagggtcctgttgttgcttgatgtgctcgtggagcaacagaggagagctccaatggcacatcaaaacctggcggcagcgcaaaagatg

SEQ ID NO: 130739 - DNA, 103 bp, Artificial Sequence
  Synthetic Polynucleotide
taatacgactcactatagggggccagcatctcctgttgttgcttgatgtgaacagaggagacacatcatgcaacaacagaacctggcggcagcgcaaaagatg

SEQ ID NO: 130740 - DNA, 103 bp, Artificial Sequence
  Synthetic Polynucleotide
taatacgactcactatagggggtgcttcatggccagcatctcctgttgttaacagaggagaaacaacatgagatgctggaacctggcggcagcgcaaaagatg

SEQ ID NO: 130741 - DNA, 103 bp, Artificial Sequence
  Synthetic Polynucleotide
taatacgactcactatagggagctcctgctggtgcttcatggccagcatcaacagaggagagatgctatgcatgaagcaaacctggcggcagcgcaaaagatg

SEQ ID NO: 130742 - DNA, 103 bp, Artificial Sequence
  Synthetic Polynucleotide
taatacgactcactataggggtgttccagcagctcctgctggtgcttcataacagaggagaatgaagatgcagcaggagaacctggcggcagcgcaaaagatg

SEQ ID NO: 130743 - DNA, 103 bp, Artificial Sequence
  Synthetic Polynucleotide
taatacgactcactataggggcttccgctggtgttccagcagctcctgctaacagaggagaagcaggatgtgctggaacaacctggcggcagcgcaaaagatg

SEQ ID NO: 130744 - DNA, 103 bp, Artificial Sequence
  Synthetic Polynucleotide
taatacgactcactatagggtgcctctccagcttccgctggtgttccagcaacagaggagagctggaatgccagcggaaaacctggcggcagcgcaaaagatg

SEQ ID NO: 130745 - DNA, 103 bp, Artificial Sequence
  Synthetic Polynucleotide
taatacgactcactatagggcagcagctccactggctggtctcggccagaaacagaggagatctggcatggaccagccaaacctggcggcagcgcaaaagatg

SEQ ID NO: 130746 - DNA, 103 bp, Artificial Sequence
  Synthetic Polynucleotide
taatacgactcactatagggctcctggcggtgcctctccagcttccgctgaacagaggagacagcggatgctggagaggaacctggcggcagcgcaaaagatg

SEQ ID NO: 130747 - DNA, 103 bp, Artificial Sequence
  Synthetic Polynucleotide
taatacgactcactatagggccagctcctgctcctggcggtgcctctccaaacagaggagatggagaatgaccgccaggaacctggcggcagcgcaaaagatg

SEQ ID NO: 130748 - DNA, 103 bp, Artificial Sequence
  Synthetic Polynucleotide
taatacgactcactatagggtgctgcttctccagctcctgctcctggcggaacagaggagaccgccaatggcaggagctaacctggcggcagcgcaaaagatg

SEQ ID NO: 130749 - DNA, 103 bp, Artificial Sequence
  Synthetic Polynucleotide
taatacgactcactatagggctgctcccggtgctgcttctccagctcctgaacagaggagacaggagatggagaagcagaacctggcggcagcgcaaaagatg

SEQ ID NO: 130750 - DNA, 103 bp, Artificial Sequence
  Synthetic Polynucleotide
taatacgactcactataggggctgcagcttctgctcccggtgctgcttctaacagaggagaagaagcatgaccgggagcaacctggcggcagcgcaaaagatg

SEQ ID NO: 130751 - DNA, 103 bp, Artificial Sequence
  Synthetic Polynucleotide
taatacgactcactatagggttcttgagctgctgcagcttctgctcccggaacagaggagaccgggaatggaagctgcaaacctggcggcagcgcaaaagatg

SEQ ID NO: 130752 - DNA, 103 bp, Artificial Sequence
  Synthetic Polynucleotide
taatacgactcactatagggcttctccttgttcttgagctgctgcagcttaacagaggagaaagctgatgcagctcaagaacctggcggcagcgcaaaagatg

SEQ ID NO: 130753 - DNA, 103 bp, Artificial Sequence
  Synthetic Polynucleotide
taatacgactcactatagggtctctttgcccttctccttgttcttgagctaacagaggagaagctcaatgacaaggagaaacctggcggcagcgcaaaagatg

SEQ ID NO: 130754 - DNA, 103 bp, Artificial Sequence
  Synthetic Polynucleotide
taatacgactcactataggggccacggcactctctttgcccttctccttgaacagaggagacaaggaatggggcaaagaaacctggcggcagcgcaaaagatg

SEQ ID NO: 130755 - DNA, 103 bp, Artificial Sequence
  Synthetic Polynucleotide
taatacgactcactatagggttctgtgctggccacggcactctctttgccaacagaggagaggcaaaatgagtgccgtgaacctggcggcagcgcaaaagatg

SEQ ID NO: 130756 - DNA, 103 bp, Artificial Sequence
  Synthetic Polynucleotide
taatacgactcactataggggggcaggattcagcagctccactggctggtaacagaggagaaccagcatgtggagctgcaacctggcggcagcgcaaaagatg

SEQ ID NO: 130757 - DNA, 103 bp, Artificial Sequence
  Synthetic Polynucleotide
taatacgactcactatagggtcatcttcacttctgtgctggccacggcacaacagaggagagtgccgatgccagcacagaacctggcggcagcgcaaaagatg

SEQ ID NO: 130758 - DNA, 103 bp, Artificial Sequence
  Synthetic Polynucleotide
taatacgactcactatagggtcttgtaacttcatcttcacttctgtgctgaacagaggagacagcacatgagtgaagataacctggcggcagcgcaaaagatg

SEQ ID NO: 130759 - DNA, 103 bp, Artificial Sequence
  Synthetic Polynucleotide
taatacgactcactataggggaggacaaattcttgtaacttcatcttcacaacagaggagagtgaagatgaagttacaaaacctggcggcagcgcaaaagatg

SEQ ID NO: 130760 - DNA, 103 bp, Artificial Sequence
  Synthetic Polynucleotide
taatacgactcactatagggtctttttattgaggacaaattcttgtaactaacagaggagaagttacatgaatttgtccaacctggcggcagcgcaaaagatg

SEQ ID NO: 130761 - DNA, 103 bp, Artificial Sequence
  Synthetic Polynucleotide
taatacgactcactataggggccagcgccttctttttattgaggacaaataacagaggagaatttgtatgcaataaaaaaacctggcggcagcgcaaaagatg

SEQ ID NO: 130762 - DNA, 103 bp, Artificial Sequence
  Synthetic Polynucleotide
taatacgactcactatagggattccggtgggccagcgccttctttttattaacagaggagaaataaaatgaaggcgctgaacctggcggcagcgcaaaagatg

SEQ ID NO: 130763 - DNA, 103 bp, Artificial Sequence
  Synthetic Polynucleotide
taatacgactcactatagggagtggttcagattccggtgggccagcgcctaacagaggagaaggcgcatgcccaccggaaacctggcggcagcgcaaaagatg

SEQ ID NO: 130764 - DNA, 103 bp, Artificial Sequence
  Synthetic Polynucleotide
taatacgactcactatagggctggaaatgcagtggttcagattccggtggaacagaggagaccaccgatgtctgaaccaaacctggcggcagcgcaaaagatg

SEQ ID NO: 130765 - DNA, 103 bp, Artificial Sequence
  Synthetic Polynucleotide
taatacgactcactataggggcgagggtcgctggaaatgcagtggttcagaacagaggagactgaacatgtgcatttccaacctggcggcagcgcaaaagatg

SEQ ID NO: 130766 - DNA, 103 bp, Artificial Sequence
  Synthetic Polynucleotide
taatacgactcactatagggcgtaccagtagcgagggtcgctggaaatgcaacagaggagagcatttatggcgaccctcaacctggcggcagcgcaaaagatg

SEQ ID NO: 130767 - DNA, 103 bp, Artificial Sequence
  Synthetic Polynucleotide
taatacgactcactatagggtggttcacgcgggcaggattcagcagctccaacagaggagaggagctatggaatcctgcaacctggcggcagcgcaaaagatg

SEQ ID NO: 130768 - DNA, 103 bp, Artificial Sequence
  Synthetic Polynucleotide
taatacgactcactatagggtgcgttttcccgtaccagtagcgagggtcgaacagaggagacgacccatgctactggtaaacctggcggcagcgcaaaagatg

SEQ ID NO: 130769 - DNA, 103 bp, Artificial Sequence
  Synthetic Polynucleotide
taatacgactcactatagggggaactgtgctgcgttttcccgtaccagtaaacagaggagatactggatggggaaaacgaacctggcggcagcgcaaaagatg

SEQ ID NO: 130770 - DNA, 103 bp, Artificial Sequence
  Synthetic Polynucleotide
taatacgactcactatagggtctggtcaagggaactgtgctgcgttttccaacagaggagaggaaaaatgagcacagttaacctggcggcagcgcaaaagatg

SEQ ID NO: 130771 - DNA, 103 bp, Artificial Sequence
  Synthetic Polynucleotide
taatacgactcactatagggggtggagaactctggtcaagggaactgtgcaacagaggagagcacagatgccttgaccaaacctggcggcagcgcaaaagatg

SEQ ID NO: 130772 - DNA, 103 bp, Artificial Sequence
  Synthetic Polynucleotide
taatacgactcactatagggtccgctctggggtggagaactctggtcaagaacagaggagacttgacatgagttctccaaacctggcggcagcgcaaaagatg

SEQ ID NO: 130773 - DNA, 103 bp, Artificial Sequence
  Synthetic Polynucleotide
taatacgactcactatagggaggtcgacactccgctctggggtggagaacaacagaggagagttctcatgcccagagcgaacctggcggcagcgcaaaagatg

SEQ ID NO: 130774 - DNA, 103 bp, Artificial Sequence
  Synthetic Polynucleotide
taatacgactcactatagggtggttataggaggtcgacactccgctctggaacagaggagaccagagatgagtgtcgacaacctggcggcagcgcaaaagatg

SEQ ID NO: 130775 - DNA, 103 bp, Artificial Sequence
  Synthetic Polynucleotide
taatacgactcactatagggcaggaccgggtggttataggaggtcgacacaacagaggagagtgtcgatgtcctataacaacctggcggcagcgcaaaagatg

SEQ ID NO: 130776 - DNA, 103 bp, Artificial Sequence
  Synthetic Polynucleotide
taatacgactcactatagggcgtacattcccaggaccgggtggttataggaacagaggagacctataatgacccggtccaacctggcggcagcgcaaaagatg

SEQ ID NO: 130777 - DNA, 103 bp, Artificial Sequence
  Synthetic Polynucleotide
taatacgactcactatagggtctttggcgtcgtacattcccaggaccgggaacagaggagacccggtatggggaatgtaaacctggcggcagcgcaaaagatg

SEQ ID NO: 130778 - DNA, 103 bp, Artificial Sequence
  Synthetic Polynucleotide
taatacgactcactataggggctgggcatgtggttcacgcgggcaggattaacagaggagaaatcctatgcgcgtgaacaacctggcggcagcgcaaaagatg

SEQ ID NO: 130779 - DNA, 103 bp, Artificial Sequence
  Synthetic Polynucleotide
taatacgactcactatagggagggaagtcatctttggcgtcgtacattccaacagaggagaggaatgatggacgccaaaaacctggcggcagcgcaaaagatg

SEQ ID NO: 130780 - DNA, 103 bp, Artificial Sequence
  Synthetic Polynucleotide
taatacgactcactatagggttttcctaagagggaagtcatctttggcgtaacagaggagaacgccaatgatgacttccaacctggcggcagcgcaaaagatg

SEQ ID NO: 130781 - DNA, 103 bp, Artificial Sequence
  Synthetic Polynucleotide
taatacgactcactatagggtcagaagctgttttcctaagagggaagtcaaacagaggagatgacttatgtcttaggaaaacctggcggcagcgcaaaagatg

SEQ ID NO: 130782 - DNA, 103 bp, Artificial Sequence
  Synthetic Polynucleotide
taatacgactcactatagggcagattcggttcagaagctgttttcctaagaacagaggagacttaggatgacagcttctaacctggcggcagcgcaaaagatg

SEQ ID NO: 130783 - DNA, 103 bp, Artificial Sequence
  Synthetic Polynucleotide
taatacgactcactatagggaccgtaatttcagattcggttcagaagctgaacagaggagacagcttatgaaccgaatcaacctggcggcagcgcaaaagatg

SEQ ID NO: 130784 - DNA, 103 bp, Artificial Sequence
  Synthetic Polynucleotide
taatacgactcactatagggtttagcctggaccgtaatttcagattcggtaacagaggagaaccgaaatggaaattacgaacctggcggcagcgcaaaagatg

SEQ ID NO: 130785 - DNA, 103 bp, Artificial Sequence
  Synthetic Polynucleotide
taatacgactcactatagggcactttctgctttagcctggaccgtaatttaacagaggagaaaattaatgtccaggctaaacctggcggcagcgcaaaagatg

SEQ ID NO: 130786 - DNA, 103 bp, Artificial Sequence
  Synthetic Polynucleotide
taatacgactcactataggggtctttcggccactttctgctttagcctggaacagaggagaccaggcatgagcagaaagaacctggcggcagcgcaaaagatg

SEQ ID NO: 130787 - DNA, 103 bp, Artificial Sequence
  Synthetic Polynucleotide
taatacgactcactataggggggctgctccgtctttcggccactttctgcaacagaggagagcagaaatgggccgaaagaacctggcggcagcgcaaaagatg

SEQ ID NO: 130788 - DNA, 103 bp, Artificial Sequence
  Synthetic Polynucleotide
taatacgactcactataggggcgtaacagggggctgctccgtctttcggcaacagaggagagccgaaatgcggagcagcaacctggcggcagcgcaaaagatg

SEQ ID NO: 130789 - DNA, 103 bp, Artificial Sequence
  Synthetic Polynucleotide
taatacgactcactatagggcatccaccgtgctgggcatgtggttcacgcaacagaggagagcgtgaatgacatgcccaaacctggcggcagcgcaaaagatg

SEQ ID NO: 130790 - DNA, 103 bp, Artificial Sequence
  Synthetic Polynucleotide
taatacgactcactatagggcgtctttcctgcgtaacagggggctgctccaacagaggagaggagcaatgccctgttacaacctggcggcagcgcaaaagatg

SEQ ID NO: 130791 - DNA, 103 bp, Artificial Sequence
  Synthetic Polynucleotide
taatacgactcactatagggaccactggcccgtctttcctgcgtaacaggaacagaggagacctgttatgcaggaaagaaacctggcggcagcgcaaaagatg

SEQ ID NO: 130792 - DNA, 103 bp, Artificial Sequence
  Synthetic Polynucleotide
taatacgactcactatagggtagagcagtgaccactggcccgtctttcctaacagaggagaaggaaaatggggccagtgaacctggcggcagcgcaaaagatg

SEQ ID NO: 130793 - DNA, 103 bp, Artificial Sequence
  Synthetic Polynucleotide
taatacgactcactataggggacgcttttttagagcagtgaccactggccaacagaggagaggccagatgtcactgctcaacctggcggcagcgcaaaagatg

SEQ ID NO: 130794 - DNA, 103 bp, Artificial Sequence
  Synthetic Polynucleotide
taatacgactcactatagggacatccaacggacgcttttttagagcagtgaacagaggagacactgcatgaaaaaagcgaacctggcggcagcgcaaaagatg

SEQ ID NO: 130795 - DNA, 103 bp, Artificial Sequence
  Synthetic Polynucleotide
taatacgactcactatagggggagtctgtgacatccaacggacgctttttaacagaggagaaaaaagatgccgttggataacctggcggcagcgcaaaagatg

SEQ ID NO: 130796 - DNA, 103 bp, Artificial Sequence
  Synthetic Polynucleotide
taatacgactcactatagggtgctgcacgcggagtctgtgacatccaacgaacagaggagacgttggatgtcacagactaacctggcggcagcgcaaaagatg

SEQ ID NO: 130797 - DNA, 103 bp, Artificial Sequence
  Synthetic Polynucleotide
taatacgactcactatagggcctggggcgctgctgcacgcggagtctgtgaacagaggagacacagaatgcgcgtgcagaacctggcggcagcgcaaaagatg

SEQ ID NO: 130798 - DNA, 103 bp, Artificial Sequence
  Synthetic Polynucleotide
taatacgactcactataggggggtccggagcctggggcgctgctgcacgcaacagaggagagcgtgcatgagcgccccaaacctggcggcagcgcaaaagatg

SEQ ID NO: 130799 - DNA, 103 bp, Artificial Sequence
  Synthetic Polynucleotide
taatacgactcactatagggtgggtgagctgggtccggagcctggggcgcaacagaggagagcgcccatggctccggacaacctggcggcagcgcaaaagatg

SEQ ID NO: 130800 - DNA, 103 bp, Artificial Sequence
  Synthetic Polynucleotide
taatacgactcactataggggccgtggccacatccaccgtgctgggcatgaacagaggagacatgccatgcacggtggaaacctggcggcagcgcaaaagatg

SEQ ID NO: 130801 - DNA, 103 bp, Artificial Sequence
  Synthetic Polynucleotide
taatacgactcactataggggagctgttgttgggtgagctgggtccggagaacagaggagactccggatgcagctcaccaacctggcggcagcgcaaaagatg

SEQ ID NO: 130802 - DNA, 103 bp, Artificial Sequence
  Synthetic Polynucleotide
taatacgactcactataggggacgctcccggagctgttgttgggtgagctaacagaggagaagctcaatgaacaacagcaacctggcggcagcgcaaaagatg

SEQ ID NO: 130803 - DNA, 103 bp, Artificial Sequence
  Synthetic Polynucleotide
taatacgactcactatagggtctccgcgctgacgctcccggagctgttgtaacagaggagaacaacaatgccgggagcgaacctggcggcagcgcaaaagatg

SEQ ID NO: 130804 - DNA, 103 bp, Artificial Sequence
  Synthetic Polynucleotide
taatacgactcactataggggcgataccgttctccgcgctgacgctcccgaacagaggagacgggagatgcagcgcggaaacctggcggcagcgcaaaagatg

SEQ ID NO: 130805 - DNA, 103 bp, Artificial Sequence
  Synthetic Polynucleotide
taatacgactcactataggggacggcgggcgcgataccgttctccgcgctaacagaggagaagcgcgatgaacggtatcaacctggcggcagcgcaaaagatg

SEQ ID NO: 130806 - DNA, 103 bp, Artificial Sequence
  Synthetic Polynucleotide
taatacgactcactatagggggatgctggggacggcgggcgcgataccgtaacagaggagaacggtaatgcgcccgccgaacctggcggcagcgcaaaagatg

SEQ ID NO: 130807 - DNA, 103 bp, Artificial Sequence
  Synthetic Polynucleotide
taatacgactcactataggggtctccgccgggatgctggggacggcgggcaacagaggagagcccgcatgccccagcataacctggcggcagcgcaaaagatg

SEQ ID NO: 130808 - DNA, 103 bp, Artificial Sequence
  Synthetic Polynucleotide
taatacgactcactatagggcgccaaactcgtctccgccgggatgctgggaacagaggagacccagcatgccggcggagaacctggcggcagcgcaaaagatg

SEQ ID NO: 130809 - DNA, 103 bp, Artificial Sequence
  Synthetic Polynucleotide
taatacgactcactatagggcaagtctgtgcgccaaactcgtctccgccgaacagaggagacggcggatgcgagtttggaacctggcggcagcgcaaaagatg

SEQ ID NO: 130810 - DNA, 103 bp, Artificial Sequence
  Synthetic Polynucleotide
taatacgactcactatagggtctcgtgccacaagtctgtgcgccaaactcaacagaggagagagtttatggcacagactaacctggcggcagcgcaaaagatg

SEQ ID NO: 130811 - DNA, 103 bp, Artificial Sequence
  Synthetic Polynucleotide
taatacgactcactatagggcccatctgccgactcgttgggagagttcataacagaggagaatgaacatgcccaacgagaacctggcggcagcgcaaaagatg

SEQ ID NO: 130812 - DNA, 103 bp, Artificial Sequence
  Synthetic Polynucleotide
taatacgactcactatagggtggcagcaccggcttcacctccactgtcacaacagaggagagtgacaatggaggtgaagaacctggcggcagcgcaaaagatg

SEQ ID NO: 130813 - DNA, 103 bp, Artificial Sequence
  Synthetic Polynucleotide
taatacgactcactatagggggggactgagccagtaaagccattctcagcaacagaggagagctgagatgggctttactaacctggcggcagcgcaaaagatg

SEQ ID NO: 130814 - DNA, 103 bp, Artificial Sequence
  Synthetic Polynucleotide
taatacgactcactatagggtggggatgttggggactgagccagtaaagcaacagaggagagctttaatggctcagtccaacctggcggcagcgcaaaagatg

SEQ ID NO: 130815 - DNA, 103 bp, Artificial Sequence
  Synthetic Polynucleotide
taatacgactcactatagggagcatctcagtggggatgttggggactgagaacagaggagactcagtatgcaacatcccaacctggcggcagcgcaaaagatg

SEQ ID NO: 130816 - DNA, 103 bp, Artificial Sequence
  Synthetic Polynucleotide
taatacgactcactataggggtgctgagggagcatctcagtggggatgttaacagaggagaaacatcatgactgagatgaacctggcggcagcgcaaaagatg

SEQ ID NO: 130817 - DNA, 103 bp, Artificial Sequence
  Synthetic Polynucleotide
taatacgactcactatagggggagggctcggtgctgagggagcatctcagaacagaggagactgagaatgtccctcagcaacctggcggcagcgcaaaagatg

SEQ ID NO: 130818 - DNA, 103 bp, Artificial Sequence
  Synthetic Polynucleotide
taatacgactcactatagggctgtccagagggagggctcggtgctgagggaacagaggagaccctcaatgccgagccctaacctggcggcagcgcaaaagatg

SEQ ID NO: 130819 - DNA, 103 bp, Artificial Sequence
  Synthetic Polynucleotide
taatacgactcactataggggttgggggagctgtccagagggagggctcgaacagaggagacgagccatgcctctggacaacctggcggcagcgcaaaagatg

SEQ ID NO: 130820 - DNA, 103 bp, Artificial Sequence
  Synthetic Polynucleotide
taatacgactcactatagggggctgaactggttgggggagctgtccagagaacagaggagactctggatggctcccccaaacctggcggcagcgcaaaagatg

SEQ ID NO: 130821 - DNA, 103 bp, Artificial Sequence
  Synthetic Polynucleotide
taatacgactcactataggggacgtgtagaggctgaactggttgggggagaacagaggagactccccatgccagttcagaacctggcggcagcgcaaaagatg

SEQ ID NO: 130822 - DNA, 103 bp, Artificial Sequence
  Synthetic Polynucleotide
taatacgactcactatagggcagagaaggagacgtgtagaggctgaactgaacagaggagacagttcatgctctacacgaacctggcggcagcgcaaaagatg

SEQ ID NO: 130823 - DNA, 103 bp, Artificial Sequence
  Synthetic Polynucleotide
taatacgactcactataggggcatggctcttggcagcaccggcttcacctaacagaggagaaggtgaatgcggtgctgcaacctggcggcagcgcaaaagatg

SEQ ID NO: 130824 - DNA, 103 bp, Artificial Sequence
  Synthetic Polynucleotide
taatacgactcactatagggagatgttgggcagagaaggagacgtgtagaaacagaggagatctacaatgctccttctcaacctggcggcagcgcaaaagatg

SEQ ID NO: 130825 - DNA, 103 bp, Artificial Sequence
  Synthetic Polynucleotide
taatacgactcactatagggagccctagggagatgttgggcagagaaggaaacagaggagatccttcatggcccaacataacctggcggcagcgcaaaagatg

SEQ ID NO: 130826 - DNA, 103 bp, Artificial Sequence
  Synthetic Polynucleotide
taatacgactcactatagggcgtggcctgcagccctagggagatgttgggaacagaggagacccaacatgtccctagggaacctggcggcagcgcaaaagatg

SEQ ID NO: 130827 - DNA, 103 bp, Artificial Sequence
  Synthetic Polynucleotide
taatacgactcactatagggtgacagtgaccgtggcctgcagccctagggaacagaggagaccctagatgtgcaggccaaacctggcggcagcgcaaaagatg

SEQ ID NO: 130828 - DNA, 103 bp, Artificial Sequence
  Synthetic Polynucleotide
taatacgactcactatagggtgtgagttggtgacagtgaccgtggcctgcaacagaggagagcaggcatgggtcactgtaacctggcggcagcgcaaaagatg

SEQ ID NO: 130829 - DNA, 103 bp, Artificial Sequence
  Synthetic Polynucleotide
taatacgactcactatagggggcagtgaggtgtgagttggtgacagtgacaacagaggagagtcactatgaccaactcaaacctggcggcagcgcaaaagatg

SEQ ID NO: 130830 - DNA, 103 bp, Artificial Sequence
  Synthetic Polynucleotide
taatacgactcactataggggcttcggggaggcagtgaggtgtgagttggaacagaggagaccaactatgacctcactgaacctggcggcagcgcaaaagatg

SEQ ID NO: 130831 - DNA, 103 bp, Artificial Sequence
  Synthetic Polynucleotide
taatacgactcactatagggtgtgtcgacagcttcggggaggcagtgaggaacagaggagacctcacatgctccccgaaaacctggcggcagcgcaaaagatg

SEQ ID NO: 130832 - DNA, 103 bp, Artificial Sequence
  Synthetic Polynucleotide
taatacgactcactatagggggcctcctgctgtgtcgacagcttcggggaaacagaggagatccccgatgctgtcgacaaacctggcggcagcgcaaaagatg

SEQ ID NO: 130833 - DNA, 103 bp, Artificial Sequence
  Synthetic Polynucleotide
taatacgactcactatagggcctgcctctcggcctcctgctgtgtcgacaaacagaggagatgtcgaatgagcaggaggaacctggcggcagcgcaaaagatg

SEQ ID NO: 130834 - DNA, 103 bp, Artificial Sequence
  Synthetic Polynucleotide
taatacgactcactatagggatggaactgggcatggctcttggcagcaccaacagaggagaggtgctatgaagagccataacctggcggcagcgcaaaagatg

SEQ ID NO: 130835 - DNA, 103 bp, Artificial Sequence
  Synthetic Polynucleotide
taatacgactcactataggggactggagggcctgcctctcggcctcctgcaacagaggagagcaggaatgcgagaggcaaacctggcggcagcgcaaaagatg

SEQ ID NO: 130836 - DNA, 103 bp, Artificial Sequence
  Synthetic Polynucleotide
taatacgactcactatagggctgccgcagggactggagggcctgcctctcaacagaggagagagaggatggccctccagaacctggcggcagcgcaaaagatg

SEQ ID NO: 130837 - DNA, 103 bp, Artificial Sequence
  Synthetic Polynucleotide
taatacgactcactataggggcgtgccaccctgccgcagggactggagggaacagaggagaccctccatgccctgcggcaacctggcggcagcgcaaaagatg

SEQ ID NO: 130838 - DNA, 103 bp, Artificial Sequence
  Synthetic Polynucleotide
taatacgactcactatagggttgccggtcagcgtgccaccctgccgcaggaacagaggagacctgcgatggggtggcacaacctggcggcagcgcaaaagatg

SEQ ID NO: 130839 - DNA, 103 bp, Artificial Sequence
  Synthetic Polynucleotide
taatacgactcactataggggctcatgaacttgccggtcagcgtgccaccaacagaggagaggtggcatgctgaccggcaacctggcggcagcgcaaaagatg

SEQ ID NO: 130840 - DNA, 103 bp, Artificial Sequence
  Synthetic Polynucleotide
taatacgactcactatagggtagaggatgtgctcatgaacttgccggtcaaacagaggagatgaccgatgagttcatgaaacctggcggcagcgcaaaagatg

SEQ ID NO: 130841 - DNA, 103 bp, Artificial Sequence
  Synthetic Polynucleotide
taatacgactcactatagggcagccaggaatagaggatgtgctcatgaacaacagaggagagttcatatgcacatcctcaacctggcggcagcgcaaaagatg

SEQ ID NO: 130842 - DNA, 103 bp, Artificial Sequence
  Synthetic Polynucleotide
taatacgactcactataggggcccagcaggcagccaggaatagaggatgtaacagaggagaacatccatgattcctggcaacctggcggcagcgcaaaagatg

SEQ ID NO: 130843 - DNA, 103 bp, Artificial Sequence
  Synthetic Polynucleotide
taatacgactcactatagggccagtgccacgcccagcaggcagccaggaaaacagaggagattcctgatggcctgctggaacctggcggcagcgcaaaagatg

SEQ ID NO: 130844 - DNA, 103 bp, Artificial Sequence
  Synthetic Polynucleotide
taatacgactcactatagggccgtcgccctccagtgccacgcccagcaggaacagaggagacctgctatgcgtggcactaacctggcggcagcgcaaaagatg

SEQ ID NO: 130845 - DNA, 103 bp, Artificial Sequence
  Synthetic Polynucleotide
taatacgactcactatagggcccaccccccatggaactgggcatggctctaacagaggagaagagccatgcccagttccaacctggcggcagcgcaaaagatg

SEQ ID NO: 130846 - DNA, 103 bp, Artificial Sequence
  Synthetic Polynucleotide
taatacgactcactataggggtgggggctcccgtcgccctccagtgccacaacagaggagagtggcaatggagggcgacaacctggcggcagcgcaaaagatg

SEQ ID NO: 130847 - DNA, 103 bp, Artificial Sequence
  Synthetic Polynucleotide
taatacgactcactatagggaggcatgcccgtgggggctcccgtcgccctaacagaggagaagggcgatgggagcccccaacctggcggcagcgcaaaagatg

SEQ ID NO: 130848 - DNA, 103 bp, Artificial Sequence
  Synthetic Polynucleotide
taatacgactcactatagggtgcagcagggaggcatgcccgtgggggctcaacagaggagagagcccatgcgggcatgcaacctggcggcagcgcaaaagatg

SEQ ID NO: 130849 - DNA, 103 bp, Artificial Sequence
  Synthetic Polynucleotide
taatacgactcactatagggcagcacatgctgcagcagggaggcatgcccaacagaggagagggcatatgtccctgctgaacctggcggcagcgcaaaagatg

SEQ ID NO: 130850 - DNA, 103 bp, Artificial Sequence
  Synthetic Polynucleotide
taatacgactcactataggggctccagcaacagcacatgctgcagcagggaacagaggagaccctgcatgagcatgtgcaacctggcggcagcgcaaaagatg

SEQ ID NO: 130851 - DNA, 103 bp, Artificial Sequence
  Synthetic Polynucleotide
taatacgactcactatagggtgccgggcctgctccagcaacagcacatgcaacagaggagagcatgtatggttgctggaaacctggcggcagcgcaaaagatg

SEQ ID NO: 130852 - DNA, 103 bp, Artificial Sequence
  Synthetic Polynucleotide
taatacgactcactatagggggtgctctgctgccgggcctgctccagcaaaacagaggagattgctgatgcaggcccggaacctggcggcagcgcaaaagatg

SEQ ID NO: 130853 - DNA, 103 bp, Artificial Sequence
  Synthetic Polynucleotide
taatacgactcactatagggcagcaatgagggtgctctgctgccgggcctaacagaggagaaggcccatgagcagagcaaacctggcggcagcgcaaaagatg

SEQ ID NO: 130854 - DNA, 103 bp, Artificial Sequence
  Synthetic Polynucleotide
taatacgactcactatagggtggagtggcacagcaatgagggtgctctgcaacagaggagagcagagatgcctcattgcaacctggcggcagcgcaaaagatg

SEQ ID NO: 130855 - DNA, 103 bp, Artificial Sequence
  Synthetic Polynucleotide
taatacgactcactatagggggactgcccgtggagtggcacagcaatgagaacagaggagactcattatggtgccactcaacctggcggcagcgcaaaagatg

SEQ ID NO: 130856 - DNA, 103 bp, Artificial Sequence
  Synthetic Polynucleotide
taatacgactcactatagggtgcctccacccccaccccccatggaactggaacagaggagaccagttatgtggggggtgaacctggcggcagcgcaaaagatg

SEQ ID NO: 130857 - DNA, 103 bp, Artificial Sequence
  Synthetic Polynucleotide
taatacgactcactatagggtcactagtggggactgcccgtggagtggcaaacagaggagatgccacatgacgggcagtaacctggcggcagcgcaaaagatg

SEQ ID NO: 130858 - DNA, 103 bp, Artificial Sequence
  Synthetic Polynucleotide
taatacgactcactatagggcgttcacccgtcactagtggggactgcccgaacagaggagacgggcaatgcccactagtaacctggcggcagcgcaaaagatg

SEQ ID NO: 130859 - DNA, 103 bp, Artificial Sequence
  Synthetic Polynucleotide
taatacgactcactatagggggtggccacacgttcacccgtcactagtggaacagaggagaccactaatgacgggtgaaaacctggcggcagcgcaaaagatg

SEQ ID NO: 130860 - DNA, 103 bp, Artificial Sequence
  Synthetic Polynucleotide
taatacgactcactatagggtccgcatgctggtggccacacgttcacccgaacagaggagacgggtgatggtgtggccaaacctggcggcagcgcaaaagatg

SEQ ID NO: 130861 - DNA, 103 bp, Artificial Sequence
  Synthetic Polynucleotide
taatacgactcactatagggttgcctaccgtccgcatgctggtggccacaaacagaggagatgtggcatgcagcatgcgaacctggcggcagcgcaaaagatg

SEQ ID NO: 130862 - DNA, 103 bp, Artificial Sequence
  Synthetic Polynucleotide
taatacgactcactatagggccgcgggagcttgcctaccgtccgcatgctaacagaggagaagcatgatgacggtaggcaacctggcggcagcgcaaaagatg

SEQ ID NO: 130863 - DNA, 103 bp, Artificial Sequence
  Synthetic Polynucleotide
taatacgactcactatagggggggccgatgccgcgggagcttgcctaccgaacagaggagacggtagatgagctcccgcaacctggcggcagcgcaaaagatg

SEQ ID NO: 130864 - DNA, 103 bp, Artificial Sequence
  Synthetic Polynucleotide
taatacgactcactataggggtgcggctcaggggccgatgccgcgggagcaacagaggagagctcccatggcatcggccaacctggcggcagcgcaaaagatg

SEQ ID NO: 130865 - DNA, 103 bp, Artificial Sequence
  Synthetic Polynucleotide
taatacgactcactatagggtgaggactgagtgcggctcaggggccgatgaacagaggagacatcggatgctgagccgcaacctggcggcagcgcaaaagatg

SEQ ID NO: 130866 - DNA, 103 bp, Artificial Sequence
  Synthetic Polynucleotide
taatacgactcactataggggcggcagcggtgaggactgagtgcggctcaaacagaggagatgagccatgctcagtcctaacctggcggcagcgcaaaagatg

SEQ ID NO: 130867 - DNA, 103 bp, Artificial Sequence
  Synthetic Polynucleotide
taatacgactcactataggggggctggggctgcctccacccccaccccccaacagaggagaggggggatggggtggaggaacctggcggcagcgcaaaagatg

SEQ ID NO: 130868 - DNA, 103 bp, Artificial Sequence
  Synthetic Polynucleotide
taatacgactcactatagggtggggactctgcggcagcggtgaggactgaaacagaggagatcagtcatgaccgctgccaacctggcggcagcgcaaaagatg

SEQ ID NO: 130869 - DNA, 103 bp, Artificial Sequence
  Synthetic Polynucleotide
taatacgactcactatagggctgcagggcctggggactctgcggcagcggaacagaggagaccgctgatgcagagtcccaacctggcggcagcgcaaaagatg

SEQ ID NO: 130870 - DNA, 103 bp, Artificial Sequence
  Synthetic Polynucleotide
taatacgactcactatagggtgaccagctgctgcagggcctggggactctaacagaggagaagagtcatgaggccctgcaacctggcggcagcgcaaaagatg

SEQ ID NO: 130871 - DNA, 103 bp, Artificial Sequence
  Synthetic Polynucleotide
taatacgactcactatagggtgttgttgcatgaccagctgctgcagggccaacagaggagaggccctatggcagctggtaacctggcggcagcgcaaaagatg

SEQ ID NO: 130872 - DNA, 103 bp, Artificial Sequence
  Synthetic Polynucleotide
taatacgactcactatagggctgctggtgctgttgttgcatgaccagctgaacagaggagacagctgatgatgcaacaaaacctggcggcagcgcaaaagatg

SEQ ID NO: 130873 - DNA, 103 bp, Artificial Sequence
  Synthetic Polynucleotide
taatacgactcactatagggtctccaggaactgctggtgctgttgttgcaaacagaggagatgcaacatgagcaccagcaacctggcggcagcgcaaaagatg

SEQ ID NO: 130874 - DNA, 103 bp, Artificial Sequence
  Synthetic Polynucleotide
taatacgactcactatagggtgcttctgcttctccaggaactgctggtgcaacagaggagagcaccaatggttcctggaaacctggcggcagcgcaaaagatg

SEQ ID NO: 130875 - DNA, 103 bp, Artificial Sequence
  Synthetic Polynucleotide
taatacgactcactatagggtagctgctgctgcttctgcttctccaggaaaacagaggagattcctgatgaagcagaagaacctggcggcagcgcaaaagatg

SEQ ID NO: 130876 - DNA, 103 bp, Artificial Sequence
  Synthetic Polynucleotide
taatacgactcactatagggtgcccagctgtagctgctgctgcttctgctaacagaggagaagcagaatgagcagcagcaacctggcggcagcgcaaaagatg

SEQ ID NO: 130877 - DNA, 103 bp, Artificial Sequence
  Synthetic Polynucleotide
taatacgactcactataggggtgaggatcttgcccagctgtagctgctgcaacagaggagagcagcaatgacagctgggaacctggcggcagcgcaaaagatg

SEQ ID NO: 130878 - DNA, 103 bp, Artificial Sequence
  Synthetic Polynucleotide
taatacgactcactatagggtagctccacagggctggggctgcctccaccaacagaggagaggtggaatgagccccagcaacctggcggcagcgcaaaagatg

SEQ ID NO: 130879 - DNA, 103 bp, Artificial Sequence
  Synthetic Polynucleotide
taatacgactcactatagggccctgtcttggtgaggatcttgcccagctgaacagaggagacagctgatgaagatcctcaacctggcggcagcgcaaaagatg

SEQ ID NO: 130880 - DNA, 103 bp, Artificial Sequence
  Synthetic Polynucleotide
taatacgactcactatagggtgggcagctcccctgtcttggtgaggatctaacagaggagaagatccatgccaagacagaacctggcggcagcgcaaaagatg

SEQ ID NO: 130881 - DNA, 103 bp, Artificial Sequence
  Synthetic Polynucleotide
taatacgactcactataggggtgggctgcctgggcagctcccctgtcttgaacagaggagacaagacatgggagctgccaacctggcggcagcgcaaaagatg

SEQ ID NO: 130882 - DNA, 103 bp, Artificial Sequence
  Synthetic Polynucleotide
taatacgactcactatagggagggtgggtggtgggctgcctgggcagctcaacagaggagagagctgatgaggcagcccaacctggcggcagcgcaaaagatg

SEQ ID NO: 130883 - DNA, 103 bp, Artificial Sequence
  Synthetic Polynucleotide
taatacgactcactatagggctgtctcctcagggtgggtggtgggctgccaacagaggagaggcagcatgccacccaccaacctggcggcagcgcaaaagatg

SEQ ID NO: 130884 - DNA, 103 bp, Artificial Sequence
  Synthetic Polynucleotide
taatacgactcactatagggagctcctcctctgtctcctcagggtgggtgaacagaggagacacccaatgtgaggagacaacctggcggcagcgcaaaagatg

SEQ ID NO: 130885 - DNA, 103 bp, Artificial Sequence
  Synthetic Polynucleotide
taatacgactcactatagggctgctccgtcagctcctcctctgtctcctcaacagaggagagaggagatggaggaggagaacctggcggcagcgcaaaagatg

SEQ ID NO: 130886 - DNA, 103 bp, Artificial Sequence
  Synthetic Polynucleotide
taatacgactcactatagggagacctcctgctgctccgtcagctcctcctaacagaggagaaggaggatgtgacggagcaacctggcggcagcgcaaaagatg

SEQ ID NO: 130887 - DNA, 103 bp, Artificial Sequence
  Synthetic Polynucleotide
taatacgactcactatagggtcccccagcaagacctcctgctgctccgtcaacagaggagagacggaatggcaggaggtaacctggcggcagcgcaaaagatg

SEQ ID NO: 130888 - DNA, 103 bp, Artificial Sequence
  Synthetic Polynucleotide
taatacgactcactatagggcagggctccctcccccagcaagacctcctgaacagaggagacaggagatgttgctggggaacctggcggcagcgcaaaagatg

SEQ ID NO: 130889 - DNA, 103 bp, Artificial Sequence
  Synthetic Polynucleotide
taatacgactcactataggggagccccccgtagctccacagggctggggcaacagaggagagccccaatgctgtggagcaacctggcggcagcgcaaaagatg

SEQ ID NO: 130890 - DNA, 103 bp, Artificial Sequence
  Synthetic Polynucleotide
taatacgactcactatagggggggcatggtcagggctccctcccccagcaaacagaggagatgctggatgagggagcccaacctggcggcagcgcaaaagatg

SEQ ID NO: 130891 - DNA, 103 bp, Artificial Sequence
  Synthetic Polynucleotide
taatacgactcactataggggagccctcccggggcatggtcagggctcccaacagaggagagggagcatggaccatgccaacctggcggcagcgcaaaagatg

SEQ ID NO: 130892 - DNA, 103 bp, Artificial Sequence
  Synthetic Polynucleotide
taatacgactcactatagggactctctgtggagccctcccggggcatggtaacagaggagaaccatgatgcgggagggcaacctggcggcagcgcaaaagatg

SEQ ID NO: 130893 - DNA, 103 bp, Artificial Sequence
  Synthetic Polynucleotide
taatacgactcactataggggtgtgctctcactctctgtggagccctcccaacagaggagagggaggatgccacagagaaacctggcggcagcgcaaaagatg

SEQ ID NO: 130894 - DNA, 103 bp, Artificial Sequence
  Synthetic Polynucleotide
taatacgactcactatagggaggtcttcctgtgtgctctcactctctgtgaacagaggagacacagaatgtgagagcacaacctggcggcagcgcaaaagatg

SEQ ID NO: 130895 - DNA, 103 bp, Artificial Sequence
  Synthetic Polynucleotide
taatacgactcactatagggctcctcctccaggtcttcctgtgtgctctcaacagaggagagagagcatgcaggaagacaacctggcggcagcgcaaaagatg

SEQ ID NO: 130896 - DNA, 103 bp, Artificial Sequence
  Synthetic Polynucleotide
taatacgactcactatagggcttcctcgtcctcctcctccaggtcttcctaacagaggagaaggaagatgtggaggaggaacctggcggcagcgcaaaagatg

SEQ ID NO: 130897 - DNA, 103 bp, Artificial Sequence
  Synthetic Polynucleotide
taatacgactcactatagggtccccatcgtcttcctcgtcctcctcctccaacagaggagaggaggaatgggacgaggaaacctggcggcagcgcaaaagatg

SEQ ID NO: 130898 - DNA, 103 bp, Artificial Sequence
  Synthetic Polynucleotide
taatacgactcactatagggctcctcctcctccccatcgtcttcctcgtcaacagaggagagacgagatggacgatgggaacctggcggcagcgcaaaagatg

SEQ ID NO: 130899 - DNA, 103 bp, Artificial Sequence
  Synthetic Polynucleotide
taatacgactcactatagggggatgcaatcctcctcctcctccccatcgtaacagaggagaacgatgatgaggaggaggaacctggcggcagcgcaaaagatg

SEQ ID NO: 130900 - DNA, 103 bp, Artificial Sequence
  Synthetic Polynucleotide
taatacgactcactataggggagcccaccagagccccccgtagctccacaaacagaggagatgtggaatgacggggggcaacctggcggcagcgcaaaagatg

SEQ ID NO: 130901 - DNA, 103 bp, Artificial Sequence
  Synthetic Polynucleotide
taatacgactcactatagggtccttaacctggatgcaatcctcctcctccaacagaggagaggaggaatgggattgcataacctggcggcagcgcaaaagatg

SEQ ID NO: 130902 - DNA, 103 bp, Artificial Sequence
  Synthetic Polynucleotide
taatacgactcactataggggccctcctcgtccttaacctggatgcaatcaacagaggagagattgcatgcaggttaagaacctggcggcagcgcaaaagatg

SEQ ID NO: 130903 - DNA, 103 bp, Artificial Sequence
  Synthetic Polynucleotide
taatacgactcactatagggcaccactctcgccctcctcgtccttaacctaacagaggagaaggttaatgacgaggaggaacctggcggcagcgcaaaagatg

SEQ ID NO: 130904 - DNA, 103 bp, Artificial Sequence
  Synthetic Polynucleotide
taatacgactcactatagggccctcctcagcaccactctcgccctcctcgaacagaggagacgaggaatgcgagagtggaacctggcggcagcgcaaaagatg

SEQ ID NO: 130905 - DNA, 103 bp, Artificial Sequence
  Synthetic Polynucleotide
taatacgactcactatagggcaagtcgggcccctcctcagcaccactctcaacagaggagagagagtatggctgaggagaacctggcggcagcgcaaaagatg

SEQ ID NO: 130906 - DNA, 103 bp, Artificial Sequence
  Synthetic Polynucleotide
taatacgactcactatagggcaggctcctccaagtcgggcccctcctcagaacagaggagactgaggatgggcccgactaacctggcggcagcgcaaaagatg

SEQ ID NO: 130907 - DNA, 103 bp, Artificial Sequence
  Synthetic Polynucleotide
taatacgactcactatagggtatccagcaccaggctcctccaagtcgggcaacagaggagagcccgaatgggaggagccaacctggcggcagcgcaaaagatg

SEQ ID NO: 130908 - DNA, 103 bp, Artificial Sequence
  Synthetic Polynucleotide
taatacgactcactatagggcagttttttgtatccagcaccaggctcctcaacagaggagagaggagatgggtgctggaaacctggcggcagcgcaaaagatg

SEQ ID NO: 130909 - DNA, 103 bp, Artificial Sequence
  Synthetic Polynucleotide
taatacgactcactatagggcatctgagaacagttttttgtatccagcacaacagaggagagtgctgatgacaaaaaacaacctggcggcagcgcaaaagatg

SEQ ID NO: 130910 - DNA, 103 bp, Artificial Sequence
  Synthetic Polynucleotide
taatacgactcactatagggagcggctgggcatctgagaacagttttttgaacagaggagacaaaaaatggttctcagaaacctggcggcagcgcaaaagatg

SEQ ID NO: 130911 - DNA, 103 bp, Artificial Sequence
  Synthetic Polynucleotide
taatacgactcactatagggggggtccacagagcccaccagagccccccgaacagaggagacgggggatgctggtgggcaacctggcggcagcgcaaaagatg

SEQ ID NO: 130912 - DNA, 103 bp, Artificial Sequence
  Synthetic Polynucleotide
taatacgactcactatagggcaaaggctgcagcggctgggcatctgagaaaacagaggagattctcaatggcccagccgaacctggcggcagcgcaaaagatg

SEQ ID NO: 130913 - DNA, 103 bp, Artificial Sequence
  Synthetic Polynucleotide
taatacgactcactatagggggtacacctgcaaaggctgcagcggctgggaacagaggagacccagcatgtgcagccttaacctggcggcagcgcaaaagatg

SEQ ID NO: 130914 - DNA, 103 bp, Artificial Sequence
  Synthetic Polynucleotide
taatacgactcactatagggaggggcgcctggtacacctgcaaaggctgcaacagaggagagcagccatggcaggtgtaaacctggcggcagcgcaaaagatg

SEQ ID NO: 130915 - DNA, 103 bp, Artificial Sequence
  Synthetic Polynucleotide
taatacgactcactatagggggccaggctgaggggcgcctggtacacctgaacagaggagacaggtgatgcaggcgcccaacctggcggcagcgcaaaagatg

SEQ ID NO: 130916 - DNA, 103 bp, Artificial Sequence
  Synthetic Polynucleotide
taatacgactcactatagggggggcacagtggccaggctgaggggcgcctaacagaggagaaggcgcatgtcagcctggaacctggcggcagcgcaaaagatg

SEQ ID NO: 130917 - DNA, 103 bp, Artificial Sequence
  Synthetic Polynucleotide
taatacgactcactatagggagggcctggtggggcacagtggccaggctgaacagaggagacagcctatgcactgtgccaacctggcggcagcgcaaaagatg

SEQ ID NO: 130918 - DNA, 103 bp, Artificial Sequence
  Synthetic Polynucleotide
taatacgactcactatagggggtacggcccagggcctggtggggcacagtaacagaggagaactgtgatgcaccaggccaacctggcggcagcgcaaaagatg

SEQ ID NO: 130919 - DNA, 103 bp, Artificial Sequence
  Synthetic Polynucleotide
taatacgactcactataggggggaggactgggtacggcccagggcctggtaacagaggagaaccaggatgtgggccgtaaacctggcggcagcgcaaaagatg

SEQ ID NO: 130920 - DNA, 103 bp, Artificial Sequence
  Synthetic Polynucleotide
taatacgactcactatagggggggcagcaggggaggactgggtacggcccaacagaggagagggccgatgccagtcctcaacctggcggcagcgcaaaagatg

SEQ ID NO: 130921 - DNA, 103 bp, Artificial Sequence
  Synthetic Polynucleotide
taatacgactcactatagggcatgcccccaggggcagcaggggaggactgaacagaggagacagtccatgcctgctgccaacctggcggcagcgcaaaagatg

SEQ ID NO: 130922 - DNA, 103 bp, Artificial Sequence
  Synthetic Polynucleotide
taatacgactcactataggggacctgacatcccatctgccgactcgttggaacagaggagaccaacgatgcggcagatgaacctggcggcagcgcaaaagatg

SEQ ID NO: 130923 - DNA, 103 bp, Artificial Sequence
  Synthetic Polynucleotide
taatacgactcactatagggcccgcagtgtggggtccacagagcccaccaaacagaggagatggtggatgctgtggaccaacctggcggcagcgcaaaagatg

SEQ ID NO: 130924 - DNA, 103 bp, Artificial Sequence
  Synthetic Polynucleotide
taatacgactcactataggggggggctcttcatgcccccaggggcagcagaacagaggagactgctgatgctgggggcaaacctggcggcagcgcaaaagatg

SEQ ID NO: 130925 - DNA, 103 bp, Artificial Sequence
  Synthetic Polynucleotide
taatacgactcactatagggggctggtctggggggctcttcatgcccccaaacagaggagatgggggatggaagagcccaacctggcggcagcgcaaaagatg

SEQ ID NO: 130926 - DNA, 103 bp, Artificial Sequence
  Synthetic Polynucleotide
taatacgactcactataggggtgcttgacgggctggtctggggggctcttaacagaggagaaagagcatgccagaccagaacctggcggcagcgcaaaagatg

SEQ ID NO: 130927 - DNA, 103 bp, Artificial Sequence
  Synthetic Polynucleotide
taatacgactcactatagggtggtgaagaggtgcttgacgggctggtctgaacagaggagacagaccatgccgtcaagcaacctggcggcagcgcaaaagatg

SEQ ID NO: 130928 - DNA, 103 bp, Artificial Sequence
  Synthetic Polynucleotide
taatacgactcactatagggaccacacctgtggtgaagaggtgcttgacgaacagaggagacgtcaaatgcctcttcacaacctggcggcagcgcaaaagatg

SEQ ID NO: 130929 - DNA, 103 bp, Artificial Sequence
  Synthetic Polynucleotide
taatacgactcactatagggcgtgtcgtagaccacacctgtggtgaagagaacagaggagactcttcatgacaggtgtgaacctggcggcagcgcaaaagatg

SEQ ID NO: 130930 - DNA, 103 bp, Artificial Sequence
  Synthetic Polynucleotide
taatacgactcactatagggttagcatgaacgtgtcgtagaccacacctgaacagaggagacaggtgatgtctacgacaaacctggcggcagcgcaaaagatg

SEQ ID NO: 130931 - DNA, 103 bp, Artificial Sequence
  Synthetic Polynucleotide
taatacgactcactatagggcactggtgctttagcatgaacgtgtcgtagaacagaggagactacgaatggttcatgctaacctggcggcagcgcaaaagatg

SEQ ID NO: 130932 - DNA, 103 bp, Artificial Sequence
  Synthetic Polynucleotide
taatacgactcactatagggcccgcacatgcactggtgctttagcatgaaaacagaggagattcatgatgaagcaccagaacctggcggcagcgcaaaagatg

SEQ ID NO: 130933 - DNA, 103 bp, Artificial Sequence
  Synthetic Polynucleotide
taatacgactcactatagggcgtgtgtgttcccgcacatgcactggtgctaacagaggagaagcaccatggcatgtgcgaacctggcggcagcgcaaaagatg

SEQ ID NO: 130934 - DNA, 103 bp, Artificial Sequence
  Synthetic Polynucleotide
taatacgactcactatagggagttgctgctcccgcagtgtggggtccacaaacagaggagatgtggaatgcacactgcgaacctggcggcagcgcaaaagatg

SEQ ID NO: 130935 - DNA, 103 bp, Artificial Sequence
  Synthetic Polynucleotide
taatacgactcactatagggtcagggtgcacgtgtgtgttcccgcacatgaacagaggagacatgtgatggaacacacaaacctggcggcagcgcaaaagatg

SEQ ID NO: 130936 - DNA, 103 bp, Artificial Sequence
  Synthetic Polynucleotide
taatacgactcactataggggccagcatgctcagggtgcacgtgtgtgttaacagaggagaaacacaatggtgcaccctaacctggcggcagcgcaaaagatg

SEQ ID NO: 130937 - DNA, 103 bp, Artificial Sequence
  Synthetic Polynucleotide
taatacgactcactatagggtctggatccggccagcatgctcagggtgcaaacagaggagatgcaccatgagcatgctgaacctggcggcagcgcaaaagatg

SEQ ID NO: 130938 - DNA, 103 bp, Artificial Sequence
  Synthetic Polynucleotide
taatacgactcactataggggaccagatgctctggatccggccagcatgcaacagaggagagcatgcatgccggatccaaacctggcggcagcgcaaaagatg

SEQ ID NO: 130939 - DNA, 103 bp, Artificial Sequence
  Synthetic Polynucleotide
taatacgactcactatagggctgcagccgggaccagatgctctggatccgaacagaggagacggatcatgagcatctggaacctggcggcagcgcaaaagatg

SEQ ID NO: 130940 - DNA, 103 bp, Artificial Sequence
  Synthetic Polynucleotide
taatacgactcactatagggggcctgtctcctgcagccgggaccagatgcaacagaggagagcatctatgcccggctgcaacctggcggcagcgcaaaagatg

SEQ ID NO: 130941 - DNA, 103 bp, Artificial Sequence
  Synthetic Polynucleotide
taatacgactcactatagggttgctaagcaggcctgtctcctgcagccggaacagaggagaccggctatgggagacaggaacctggcggcagcgcaaaagatg

SEQ ID NO: 130942 - DNA, 103 bp, Artificial Sequence
  Synthetic Polynucleotide
taatacgactcactatagggccgctcgcacttgctaagcaggcctgtctcaacagaggagagagacaatgctgcttagcaacctggcggcagcgcaaaagatg

SEQ ID NO: 130943 - DNA, 103 bp, Artificial Sequence
  Synthetic Polynucleotide
taatacgactcactataggggacctcggatccgctcgcacttgctaagcaaacagaggagatgcttaatgagtgcgagcaacctggcggcagcgcaaaagatg

SEQ ID NO: 130944 - DNA, 103 bp, Artificial Sequence
  Synthetic Polynucleotide
taatacgactcactataggggtggctttgcgacctcggatccgctcgcacaacagaggagagtgcgaatggatccgaggaacctggcggcagcgcaaaagatg

SEQ ID NO: 130945 - DNA, 103 bp, Artificial Sequence
  Synthetic Polynucleotide
taatacgactcactatagggctcctgctgcagttgctgctcccgcagtgtaacagaggagaacactgatggagcagcaaaacctggcggcagcgcaaaagatg

SEQ ID NO: 130946 - DNA, 103 bp, Artificial Sequence
  Synthetic Polynucleotide
taatacgactcactatagggctcatctagcgtggctttgcgacctcggataacagaggagaatccgaatgcgcaaagccaacctggcggcagcgcaaaagatg

SEQ ID NO: 130947 - DNA, 103 bp, Artificial Sequence
  Synthetic Polynucleotide
taatacgactcactatagggctgtctggatctcatctagcgtggctttgcaacagaggagagcaaagatgcgctagatgaacctggcggcagcgcaaaagatg

SEQ ID NO: 130948 - DNA, 103 bp, Artificial Sequence
  Synthetic Polynucleotide
taatacgactcactatagggtcagagtgcactgtctggatctcatctagcaacagaggagagctagaatggatccagacaacctggcggcagcgcaaaagatg

SEQ ID NO: 130949 - DNA, 103 bp, Artificial Sequence
  Synthetic Polynucleotide
taatacgactcactatagggggtgtggtattcagagtgcactgtctggataacagaggagaatccagatggtgcactctaacctggcggcagcgcaaaagatg

SEQ ID NO: 130950 - DNA, 103 bp, Artificial Sequence
  Synthetic Polynucleotide
taatacgactcactatagggcatagagcagggtgtggtattcagagtgcaaacagaggagatgcactatgaataccacaaacctggcggcagcgcaaaagatg

SEQ ID NO: 130951 - DNA, 103 bp, Artificial Sequence
  Synthetic Polynucleotide
taatacgactcactatagggggactggtcccatagagcagggtgtggtataacagaggagaataccaatgcctgctctaaacctggcggcagcgcaaaagatg

SEQ ID NO: 130952 - DNA, 103 bp, Artificial Sequence
  Synthetic Polynucleotide
taatacgactcactatagggccggttgaggggactggtcccatagagcagaacagaggagactgctcatggggaccagtaacctggcggcagcgcaaaagatg

SEQ ID NO: 130953 - DNA, 103 bp, Artificial Sequence
  Synthetic Polynucleotide
taatacgactcactatagggctagcttctgccggttgaggggactggtccaacagaggagaggaccaatgccctcaaccaacctggcggcagcgcaaaagatg

SEQ ID NO: 130954 - DNA, 103 bp, Artificial Sequence
  Synthetic Polynucleotide
taatacgactcactatagggttcttgctgtctagcttctgccggttgaggaacagaggagacctcaaatggcagaagctaacctggcggcagcgcaaaagatg

SEQ ID NO: 130955 - DNA, 103 bp, Artificial Sequence
  Synthetic Polynucleotide
taatacgactcactataggggccgagcaacttcttgctgtctagcttctgaacagaggagacagaagatggacagcaagaacctggcggcagcgcaaaagatg

SEQ ID NO: 130956 - DNA, 103 bp, Artificial Sequence
  Synthetic Polynucleotide
taatacgactcactataggggcgccaggagctcctgctgcagttgctgctaacagaggagaagcagcatgtgcagcaggaacctggcggcagcgcaaaagatg

SEQ ID NO: 130957 - DNA, 103 bp, Artificial Sequence
  Synthetic Polynucleotide
taatacgactcactatagggggctgatggggccgagcaacttcttgctgtaacagaggagaacagcaatgagttgctcgaacctggcggcagcgcaaaagatg

SEQ ID NO: 130958 - DNA, 103 bp, Artificial Sequence
  Synthetic Polynucleotide
taatacgactcactatagggtacatcttctggctgatggggccgagcaacaacagaggagagttgctatgccccatcagaacctggcggcagcgcaaaagatg

SEQ ID NO: 130959 - DNA, 103 bp, Artificial Sequence
  Synthetic Polynucleotide
taatacgactcactatagggcagcacagcatacatcttctggctgatgggaacagaggagacccatcatgcagaagatgaacctggcggcagcgcaaaagatg

SEQ ID NO: 130960 - DNA, 103 bp, Artificial Sequence
  Synthetic Polynucleotide
taatacgactcactatagggccccacaaggcagcacagcatacatcttctaacagaggagaagaagaatgatgctgtgcaacctggcggcagcgcaaaagatg

SEQ ID NO: 130961 - DNA, 103 bp, Artificial Sequence
  Synthetic Polynucleotide
taatacgactcactatagggaccccgatgcccccacaaggcagcacagcaaacagaggagatgctgtatggccttgtggaacctggcggcagcgcaaaagatg

SEQ ID NO: 130962 - DNA, 103 bp, Artificial Sequence
  Synthetic Polynucleotide
taatacgactcactataggggtcactgtccaccccgatgcccccacaaggaacagaggagaccttgtatgggcatcgggaacctggcggcagcgcaaaagatg

SEQ ID NO: 130963 - DNA, 103 bp, Artificial Sequence
  Synthetic Polynucleotide
taatacgactcactatagggtccacacggtgtcactgtccaccccgatgcaacagaggagagcatcgatgtggacagtgaacctggcggcagcgcaaaagatg

SEQ ID NO: 130964 - DNA, 103 bp, Artificial Sequence
  Synthetic Polynucleotide
taatacgactcactatagggtgcatctcattccacacggtgtcactgtccaacagaggagaggacagatgcaccgtgtgaacctggcggcagcgcaaaagatg

SEQ ID NO: 130965 - DNA, 103 bp, Artificial Sequence
  Synthetic Polynucleotide
taatacgactcactatagggactggaggagtgcatctcattccacacggtaacagaggagaaccgtgatgaatgagatgaacctggcggcagcgcaaaagatg

SEQ ID NO: 130966 - DNA, 103 bp, Artificial Sequence
  Synthetic Polynucleotide
taatacgactcactatagggtgcgcacagcactggaggagtgcatctcataacagaggagaatgagaatgactcctccaaacctggcggcagcgcaaaagatg

SEQ ID NO: 130967 - DNA, 103 bp, Artificial Sequence
  Synthetic Polynucleotide
taatacgactcactatagggtgctgcttgagcgccaggagctcctgctgcaacagaggagagcagcaatggctcctggcaacctggcggcagcgcaaaagatg

SEQ ID NO: 130968 - DNA, 103 bp, Artificial Sequence
  Synthetic Polynucleotide
taatacgactcactatagggcccactgccatgcgcacagcactggaggagaacagaggagactcctcatgtgctgtgcgaacctggcggcagcgcaaaagatg

SEQ ID NO: 130969 - DNA, 103 bp, Artificial Sequence
  Synthetic Polynucleotide
taatacgactcactatagggcagcaggcagcccactgccatgcgcacagcaacagaggagagctgtgatgatggcagtgaacctggcggcagcgcaaaagatg

SEQ ID NO: 130970 - DNA, 103 bp, Artificial Sequence
  Synthetic Polynucleotide
taatacgactcactatagggaggccagctccagcaggcagcccactgccaaacagaggagatggcagatggctgcctgcaacctggcggcagcgcaaaagatg

SEQ ID NO: 130971 - DNA, 103 bp, Artificial Sequence
  Synthetic Polynucleotide
taatacgactcactataggggccaccttgaaggccagctccagcaggcagaacagaggagactgcctatgggagctggcaacctggcggcagcgcaaaagatg

SEQ ID NO: 130972 - DNA, 103 bp, Artificial Sequence
  Synthetic Polynucleotide
taatacgactcactatagggctctcctgcagccaccttgaaggccagctcaacagaggagagagctgatgttcaaggtgaacctggcggcagcgcaaaagatg

SEQ ID NO: 130973 - DNA, 103 bp, Artificial Sequence
  Synthetic Polynucleotide
taatacgactcactatagggcattcttgagctctcctgcagccaccttgaaacagaggagatcaaggatgctgcaggagaacctggcggcagcgcaaaagatg

SEQ ID NO: 130974 - DNA, 103 bp, Artificial Sequence
  Synthetic Polynucleotide
taatacgactcactatagggatggcaaatccattcttgagctctcctgcaaacagaggagatgcaggatggctcaagaaaacctggcggcagcgcaaaagatg

SEQ ID NO: 130975 - DNA, 103 bp, Artificial Sequence
  Synthetic Polynucleotide
taatacgactcactataggggggccggatgatggcaaatccattcttgagaacagaggagactcaagatgggatttgccaacctggcggcagcgcaaaagatg

SEQ ID NO: 130976 - DNA, 103 bp, Artificial Sequence
  Synthetic Polynucleotide
taatacgactcactatagggggtgtcctgggggccggatgatggcaaatcaacagaggagagatttgatgtcatccggcaacctggcggcagcgcaaaagatg

SEQ ID NO: 130977 - DNA, 103 bp, Artificial Sequence
  Synthetic Polynucleotide
taatacgactcactatagggtcctcggcgtggtgtcctgggggccggatgaacagaggagacatccgatgcccaggacaaacctggcggcagcgcaaaagatg

SEQ ID NO: 130978 - DNA, 103 bp, Artificial Sequence
  Synthetic Polynucleotide
taatacgactcactatagggcagctgctgctgctgcttgagcgccaggagaacagaggagactcctgatgctcaagcagaacctggcggcagcgcaaaagatg

SEQ ID NO: 130979 - DNA, 103 bp, Artificial Sequence
  Synthetic Polynucleotide
taatacgactcactatagggggctgtggattcctcggcgtggtgtcctggaacagaggagaccaggaatgcacgccgagaacctggcggcagcgcaaaagatg

SEQ ID NO: 130980 - DNA, 103 bp, Artificial Sequence
  Synthetic Polynucleotide
taatacgactcactatagggagaatcccatggctgtggattcctcggcgtaacagaggagaacgccgatgaatccacagaacctggcggcagcgcaaaagatg

SEQ ID NO: 130981 - DNA, 103 bp, Artificial Sequence
  Synthetic Polynucleotide
taatacgactcactatagggttgaagaagcagaatcccatggctgtggataacagaggagaatccacatgcatgggattaacctggcggcagcgcaaaagatg

SEQ ID NO: 130982 - DNA, 103 bp, Artificial Sequence
  Synthetic Polynucleotide
taatacgactcactatagggggctacagagttgaagaagcagaatcccataacagaggagaatgggaatgtgcttcttcaacctggcggcagcgcaaaagatg

SEQ ID NO: 130983 - DNA, 103 bp, Artificial Sequence
  Synthetic Polynucleotide
taatacgactcactatagggttgcggtgatggctacagagttgaagaagcaacagaggagagcttctatgactctgtagaacctggcggcagcgcaaaagatg

SEQ ID NO: 130984 - DNA, 103 bp, Artificial Sequence
  Synthetic Polynucleotide
taatacgactcactatagggtgtaggagttttgcggtgatggctacagagaacagaggagactctgtatgcatcaccgcaacctggcggcagcgcaaaagatg

SEQ ID NO: 130985 - DNA, 103 bp, Artificial Sequence
  Synthetic Polynucleotide
taatacgactcactatagggcaacttctgctgtaggagttttgcggtgataacagaggagaatcaccatgaaactcctaaacctggcggcagcgcaaaagatg

SEQ ID NO: 130986 - DNA, 103 bp, Artificial Sequence
  Synthetic Polynucleotide
taatacgactcactatagggtgcccacgttcaacttctgctgtaggagttaacagaggagaaactccatgagcagaagtaacctggcggcagcgcaaaagatg

SEQ ID NO: 130987 - DNA, 103 bp, Artificial Sequence
  Synthetic Polynucleotide
taatacgactcactatagggatgaggaccttgcccacgttcaacttctgcaacagaggagagcagaaatggaacgtgggaacctggcggcagcgcaaaagatg

SEQ ID NO: 130988 - DNA, 103 bp, Artificial Sequence
  Synthetic Polynucleotide
taatacgactcactatagggccagtccacgatgaggaccttgcccacgttaacagaggagaaacgtgatgaaggtcctcaacctggcggcagcgcaaaagatg

SEQ ID NO: 130989 - DNA, 103 bp, Artificial Sequence
  Synthetic Polynucleotide
taatacgactcactataggggctgcttctgcagctgctgctgctgcttgaaacagaggagatcaagcatgagcagcagcaacctggcggcagcgcaaaagatg

SEQ ID NO: 130990 - DNA, 103 bp, Artificial Sequence
  Synthetic Polynucleotide
taatacgactcactatagggggtgaatgtcccagtccacgatgaggacctaacagaggagaaggtccatgtcgtggactaacctggcggcagcgcaaaagatg

SEQ ID NO: 130991 - DNA, 103 bp, Artificial Sequence
  Synthetic Polynucleotide
taatacgactcactatagggccattgccatggtgaatgtcccagtccacgaacagaggagacgtggaatgggacattcaaacctggcggcagcgcaaaagatg

SEQ ID NO: 130992 - DNA, 103 bp, Artificial Sequence
  Synthetic Polynucleotide
taatacgactcactatagggctgctgggtgccattgccatggtgaatgtcaacagaggagagacattatgcatggcaataacctggcggcagcgcaaaagatg

SEQ ID NO: 130993 - DNA, 103 bp, Artificial Sequence
  Synthetic Polynucleotide
taatacgactcactatagggtgtagaacgcctgctgggtgccattgccataacagaggagaatggcaatggcacccagcaacctggcggcagcgcaaaagatg

SEQ ID NO: 130994 - DNA, 103 bp, Artificial Sequence
  Synthetic Polynucleotide
taatacgactcactataggggaggggtcattgtagaacgcctgctgggtgaacagaggagacacccaatgggcgttctaaacctggcggcagcgcaaaagatg

SEQ ID NO: 130995 - DNA, 103 bp, Artificial Sequence
  Synthetic Polynucleotide
taatacgactcactataggggtagagcacagaggggtcattgtagaacgcaacagaggagagcgttcatgaatgaccccaacctggcggcagcgcaaaagatg

SEQ ID NO: 130996 - DNA, 103 bp, Artificial Sequence
  Synthetic Polynucleotide
taatacgactcactataggggcagagagatgtagagcacagaggggtcataacagaggagaatgaccatgctgtgctctaacctggcggcagcgcaaaagatg

SEQ ID NO: 130997 - DNA, 103 bp, Artificial Sequence
  Synthetic Polynucleotide
taatacgactcactatagggtcatagcgatgcagagagatgtagagcacaaacagaggagatgtgctatgcatctctctaacctggcggcagcgcaaaagatg

SEQ ID NO: 130998 - DNA, 103 bp, Artificial Sequence
  Synthetic Polynucleotide
taatacgactcactataggggttcccgttgtcatagcgatgcagagagataacagaggagaatctctatgcatcgctataacctggcggcagcgcaaaagatg

SEQ ID NO: 130999 - DNA, 103 bp, Artificial Sequence
  Synthetic Polynucleotide
taatacgactcactatagggctggaaagaagttcccgttgtcatagcgataacagaggagaatcgctatgacaacgggaaacctggcggcagcgcaaaagatg

SEQ ID NO: 131000 - DNA, 103 bp, Artificial Sequence
  Synthetic Polynucleotide
taatacgactcactataggggcgaacaggagctgcttctgcagctgctgcaacagaggagagcagcaatggcagaagcaaacctggcggcagcgcaaaagatg

SEQ ID NO: 131001 - DNA, 103 bp, Artificial Sequence
  Synthetic Polynucleotide
taatacgactcactataggggccccagagcctggaaagaagttcccgttgaacagaggagacaacggatgcttctttccaacctggcggcagcgcaaaagatg

SEQ ID NO: 131002 - DNA, 103 bp, Artificial Sequence
  Synthetic Polynucleotide
taatacgactcactatagggctcttcaggagccccagagcctggaaagaaaacagaggagattctttatgggctctgggaacctggcggcagcgcaaaagatg

SEQ ID NO: 131003 - DNA, 103 bp, Artificial Sequence
  Synthetic Polynucleotide
taatacgactcactatagggctccaccaacctcttcaggagccccagagcaacagaggagagctctgatgctcctgaagaacctggcggcagcgcaaaagatg

SEQ ID NO: 131004 - DNA, 103 bp, Artificial Sequence
  Synthetic Polynucleotide
taatacgactcactatagggacgcctggtcctccaccaacctcttcaggaaacagaggagatcctgaatgggttggtggaacctggcggcagcgcaaaagatg

SEQ ID NO: 131005 - DNA, 103 bp, Artificial Sequence
  Synthetic Polynucleotide
taatacgactcactatagggattgtaccccacgcctggtcctccaccaacaacagaggagagttggtatgggaccaggcaacctggcggcagcgcaaaagatg

SEQ ID NO: 131006 - DNA, 103 bp, Artificial Sequence
  Synthetic Polynucleotide
taatacgactcactatagggccacgttcacattgtaccccacgcctggtcaacagaggagagaccagatgtggggtacaaacctggcggcagcgcaaaagatg

SEQ ID NO: 131007 - DNA, 103 bp, Artificial Sequence
  Synthetic Polynucleotide
taatacgactcactatagggcctgtccatgccacgttcacattgtaccccaacagaggagaggggtaatgtgtgaacgtaacctggcggcagcgcaaaagatg

SEQ ID NO: 131008 - DNA, 103 bp, Artificial Sequence
  Synthetic Polynucleotide
taatacgactcactataggggtccacacctcctgtccatgccacgttcacaacagaggagagtgaacatggcatggacaaacctggcggcagcgcaaaagatg

SEQ ID NO: 131009 - DNA, 103 bp, Artificial Sequence
  Synthetic Polynucleotide
taatacgactcactatagggcaatgggggggtccacacctcctgtccatgaacagaggagacatggaatggaggtgtggaacctggcggcagcgcaaaagatg

SEQ ID NO: 131010 - DNA, 103 bp, Artificial Sequence
  Synthetic Polynucleotide
taatacgactcactatagggtccacgtctccaatgggggggtccacacctaacagaggagaaggtgtatgcccccccataacctggcggcagcgcaaaagatg

SEQ ID NO: 131011 - DNA, 103 bp, Artificial Sequence
  Synthetic Polynucleotide
taatacgactcactatagggctggaactcagcgaacaggagctgcttctgaacagaggagacagaagatgctcctgttcaacctggcggcagcgcaaaagatg

SEQ ID NO: 131012 - DNA, 103 bp, Artificial Sequence
  Synthetic Polynucleotide
taatacgactcactatagggtgtaaggtactccacgtctccaatggggggaacagaggagaccccccatgggagacgtgaacctggcggcagcgcaaaagatg

SEQ ID NO: 131013 - DNA, 103 bp, Artificial Sequence
  Synthetic Polynucleotide
taatacgactcactatagggtcctgaaggctgtaaggtactccacgtctcaacagaggagagagacgatgagtaccttaaacctggcggcagcgcaaaagatg

SEQ ID NO: 131014 - DNA, 103 bp, Artificial Sequence
  Synthetic Polynucleotide
taatacgactcactatagggatcaccactgtcctgaaggctgtaaggtacaacagaggagagtacctatgagccttcagaacctggcggcagcgcaaaagatg

SEQ ID NO: 131015 - DNA, 103 bp, Artificial Sequence
  Synthetic Polynucleotide
taatacgactcactatagggggcaatgggcatcaccactgtcctgaaggcaacagaggagagccttcatgacagtggtgaacctggcggcagcgcaaaagatg

SEQ ID NO: 131016 - DNA, 103 bp, Artificial Sequence
  Synthetic Polynucleotide
taatacgactcactatagggagaactcgtgggcaatgggcatcaccactgaacagaggagacagtggatgtgcccattgaacctggcggcagcgcaaaagatg

SEQ ID NO: 131017 - DNA, 103 bp, Artificial Sequence
  Synthetic Polynucleotide
taatacgactcactatagggacatcaggtgagaactcgtgggcaatgggcaacagaggagagcccatatgccacgagttaacctggcggcagcgcaaaagatg

SEQ ID NO: 131018 - DNA, 103 bp, Artificial Sequence
  Synthetic Polynucleotide
taatacgactcactataggggactaggaccacatcaggtgagaactcgtgaacagaggagacacgagatgtcacctgataacctggcggcagcgcaaaagatg

SEQ ID NO: 131019 - DNA, 103 bp, Artificial Sequence
  Synthetic Polynucleotide
taatacgactcactatagggacccggcggagactaggaccacatcaggtgaacagaggagacacctgatgtggtcctagaacctggcggcagcgcaaaagatg

SEQ ID NO: 131020 - DNA, 103 bp, Artificial Sequence
  Synthetic Polynucleotide
taatacgactcactatagggacagcatcaaacccggcggagactaggaccaacagaggagaggtcctatgctccgccggaacctggcggcagcgcaaaagatg

SEQ ID NO: 131021 - DNA, 103 bp, Artificial Sequence
  Synthetic Polynucleotide
taatacgactcactatagggatgtccttcaacagcatcaaacccggcggaaacagaggagatccgccatgtttgatgctaacctggcggcagcgcaaaagatg

SEQ ID NO: 131022 - DNA, 103 bp, Artificial Sequence
  Synthetic Polynucleotide
taatacgactcactatagggcatgctgtttctggaactcagcgaacaggaaacagaggagatcctgtatgctgagttccaacctggcggcagcgcaaaagatg

SEQ ID NO: 131023 - DNA, 103 bp, Artificial Sequence
  Synthetic Polynucleotide
taatacgactcactataggggaggagacagatgtccttcaacagcatcaaaacagaggagattgatgatgttgaaggacaacctggcggcagcgcaaaagatg

SEQ ID NO: 131024 - DNA, 103 bp, Artificial Sequence
  Synthetic Polynucleotide
taatacgactcactatagggtagccacccagaggagacagatgtccttcaaacagaggagatgaaggatgtctgtctccaacctggcggcagcgcaaaagatg

SEQ ID NO: 131025 - DNA, 103 bp, Artificial Sequence
  Synthetic Polynucleotide
taatacgactcactatagggggtgacagagtagccacccagaggagacagaacagaggagactgtctatgctgggtggcaacctggcggcagcgcaaaagatg

SEQ ID NO: 131026 - DNA, 103 bp, Artificial Sequence
  Synthetic Polynucleotide
taatacgactcactatagggaacatctggcggtgacagagtagccacccaaacagaggagatgggtgatgactctgtcaaacctggcggcagcgcaaaagatg

SEQ ID NO: 131027 - DNA, 103 bp, Artificial Sequence
  Synthetic Polynucleotide
taatacgactcactatagggaagtggccaaaacatctggcggtgacagagaacagaggagactctgtatgcgccagatgaacctggcggcagcgcaaaagatg

SEQ ID NO: 131028 - DNA, 103 bp, Artificial Sequence
  Synthetic Polynucleotide
taatacgactcactatagggctgcctggtcaagtggccaaaacatctggcaacagaggagagccagaatgtttggccacaacctggcggcagcgcaaaagatg

SEQ ID NO: 131029 - DNA, 103 bp, Artificial Sequence
  Synthetic Polynucleotide
taatacgactcactataggggggtcatcagctgcctggtcaagtggccaaaacagaggagattggccatgtgaccaggcaacctggcggcagcgcaaaagatg

SEQ ID NO: 131030 - DNA, 103 bp, Artificial Sequence
  Synthetic Polynucleotide
taatacgactcactatagggccccctgccagggtcatcagctgcctggtcaacagaggagagaccagatggctgatgacaacctggcggcagcgcaaaagatg

SEQ ID NO: 131031 - DNA, 103 bp, Artificial Sequence
  Synthetic Polynucleotide
taatacgactcactatagggcaccacccggccccctgccagggtcatcagaacagaggagactgatgatgctggcagggaacctggcggcagcgcaaaagatg

SEQ ID NO: 131032 - DNA, 103 bp, Artificial Sequence
  Synthetic Polynucleotide
taatacgactcactatagggccagggccagcaccacccggccccctgccaaacagaggagatggcagatggccgggtggaacctggcggcagcgcaaaagatg

SEQ ID NO: 131033 - DNA, 103 bp, Artificial Sequence
  Synthetic Polynucleotide
taatacgactcactataggggatggttcccgacctgacatcccatctgccaacagaggagaggcagaatggatgtcaggaacctggcggcagcgcaaaagatg

SEQ ID NO: 131034 - DNA, 103 bp, Artificial Sequence
  Synthetic Polynucleotide
taatacgactcactataggggtcaggtggtcatgctgtttctggaactcaaacagaggagatgagttatggaaacagcaaacctggcggcagcgcaaaagatg

SEQ ID NO: 131035 - DNA, 103 bp, Artificial Sequence
  Synthetic Polynucleotide
taatacgactcactatagggtggcctccctccagggccagcaccacccggaacagaggagaccgggtatggctggccctaacctggcggcagcgcaaaagatg

SEQ ID NO: 131036 - DNA, 103 bp, Artificial Sequence
  Synthetic Polynucleotide
taatacgactcactatagggggtcaagtcatggcctccctccagggccagaacagaggagactggccatggagggaggcaacctggcggcagcgcaaaagatg

SEQ ID NO: 131037 - DNA, 103 bp, Artificial Sequence
  Synthetic Polynucleotide
taatacgactcactatagggcacagatggcggtcaagtcatggcctccctaacagaggagaagggagatgatgacttgaaacctggcggcagcgcaaaagatg

SEQ ID NO: 131038 - DNA, 103 bp, Artificial Sequence
  Synthetic Polynucleotide
taatacgactcactatagggtcagaggcatcacagatggcggtcaagtcaaacagaggagatgacttatgcgccatctgaacctggcggcagcgcaaaagatg

SEQ ID NO: 131039 - DNA, 103 bp, Artificial Sequence
  Synthetic Polynucleotide
taatacgactcactataggggacacaagcctcagaggcatcacagatggcaacagaggagagccatcatggatgcctctaacctggcggcagcgcaaaagatg

SEQ ID NO: 131040 - DNA, 103 bp, Artificial Sequence
  Synthetic Polynucleotide
taatacgactcactataggggcagagccgagacacaagcctcagaggcataacagaggagaatgcctatgaggcttgtgaacctggcggcagcgcaaaagatg

SEQ ID NO: 131041 - DNA, 103 bp, Artificial Sequence
  Synthetic Polynucleotide
taatacgactcactatagggtctacactgagcagagccgagacacaagccaacagaggagaggcttgatgctcggctctaacctggcggcagcgcaaaagatg

SEQ ID NO: 131042 - DNA, 103 bp, Artificial Sequence
  Synthetic Polynucleotide
taatacgactcactataggggggctgcagctctacactgagcagagccgaaacagaggagatcggctatgctcagtgtaaacctggcggcagcgcaaaagatg

SEQ ID NO: 131043 - DNA, 103 bp, Artificial Sequence
  Synthetic Polynucleotide
taatacgactcactatagggcctcatccaagggctgcagctctacactgaaacagaggagatcagtgatgagctgcagcaacctggcggcagcgcaaaagatg

SEQ ID NO: 131044 - DNA, 103 bp, Artificial Sequence
  Synthetic Polynucleotide
taatacgactcactatagggtgcaagactgcctcatccaagggctgcagcaacagaggagagctgcaatgcttggatgaaacctggcggcagcgcaaaagatg

SEQ ID NO: 131045 - DNA, 103 bp, Artificial Sequence
  Synthetic Polynucleotide
taatacgactcactatagggatgctgccttgtcaggtggtcatgctgtttaacagaggagaaaacagatggaccacctgaacctggcggcagcgcaaaagatg

SEQ ID NO: 131046 - DNA, 103 bp, Artificial Sequence
  Synthetic Polynucleotide
taatacgactcactataggggggcttttgctgcaagactgcctcatccaaaacagaggagattggatatggcagtcttgaacctggcggcagcgcaaaagatg

SEQ ID NO: 131047 - DNA, 103 bp, Artificial Sequence
  Synthetic Polynucleotide
taatacgactcactatagggcgttgatgttgggcttttgctgcaagactgaacagaggagacagtctatgagcaaaagcaacctggcggcagcgcaaaagatg

SEQ ID NO: 131048 - DNA, 103 bp, Artificial Sequence
  Synthetic Polynucleotide
taatacgactcactataggggtggccactgcgttgatgttgggcttttgcaacagaggagagcaaaaatgcaacatcaaaacctggcggcagcgcaaaagatg

SEQ ID NO: 131049 - DNA, 103 bp, Artificial Sequence
  Synthetic Polynucleotide
taatacgactcactatagggtttctctagcgtggccactgcgttgatgttaacagaggagaaacatcatggcagtggccaacctggcggcagcgcaaaagatg

SEQ ID NO: 131050 - DNA, 103 bp, Artificial Sequence
  Synthetic Polynucleotide
taatacgactcactatagggtctcgatgactttctctagcgtggccactgaacagaggagacagtggatgcgctagagaaacctggcggcagcgcaaaagatg

SEQ ID NO: 131051 - DNA, 103 bp, Artificial Sequence
  Synthetic Polynucleotide
taatacgactcactatagggttgctctggatctcgatgactttctctagcaacagaggagagctagaatgagtcatcgaaacctggcggcagcgcaaaagatg

SEQ ID NO: 131052 - DNA, 103 bp, Artificial Sequence
  Synthetic Polynucleotide
taatacgactcactataggggctccagtgtttgctctggatctcgatgacaacagaggagagtcatcatgatccagagcaacctggcggcagcgcaaaagatg

SEQ ID NO: 131053 - DNA, 103 bp, Artificial Sequence
  Synthetic Polynucleotide
taatacgactcactatagggtctgcacacagctccagtgtttgctctggaaacagaggagatccagaatgaacactggaaacctggcggcagcgcaaaagatg

SEQ ID NO: 131054 - DNA, 103 bp, Artificial Sequence
  Synthetic Polynucleotide
taatacgactcactataggggcggcgaacttctgcacacagctccagtgtaacagaggagaacactgatgctgtgtgcaaacctggcggcagcgcaaaagatg

SEQ ID NO: 131055 - DNA, 103 bp, Artificial Sequence
  Synthetic Polynucleotide
taatacgactcactataggggcccagaccagcggcgaacttctgcacacaaacagaggagatgtgtgatgaagttcgccaacctggcggcagcgcaaaagatg

SEQ ID NO: 131056 - DNA, 103 bp, Artificial Sequence
  Synthetic Polynucleotide
taatacgactcactataggggctggacctcatgctgccttgtcaggtggtaacagaggagaaccaccatgcaaggcagcaacctggcggcagcgcaaaagatg

SEQ ID NO: 131057 - DNA, 103 bp, Artificial Sequence
  Synthetic Polynucleotide
taatacgactcactataggggcagggaccggcccagaccagcggcgaactaacagaggagaagttcgatgctggtctggaacctggcggcagcgcaaaagatg

SEQ ID NO: 131058 - DNA, 103 bp, Artificial Sequence
  Synthetic Polynucleotide
taatacgactcactatagggtgggcctctcgcagggaccggcccagaccaaacagaggagatggtctatgccggtccctaacctggcggcagcgcaaaagatg

SEQ ID NO: 131059 - DNA, 103 bp, Artificial Sequence
  Synthetic Polynucleotide
taatacgactcactatagggctcacctgcttgggcctctcgcagggaccgaacagaggagacggtccatgcgagaggccaacctggcggcagcgcaaaagatg

SEQ ID NO: 131060 - DNA, 103 bp, Artificial Sequence
  Synthetic Polynucleotide
taatacgactcactatagggcctcctcggtctcacctgcttgggcctctcaacagaggagagagaggatgaagcaggtgaacctggcggcagcgcaaaagatg

SEQ ID NO: 131061 - DNA, 103 bp, Artificial Sequence
  Synthetic Polynucleotide
taatacgactcactatagggacagtctcggcctcctcggtctcacctgctaacagaggagaagcaggatggaccgaggaaacctggcggcagcgcaaaagatg

SEQ ID NO: 131062 - DNA, 103 bp, Artificial Sequence
  Synthetic Polynucleotide
taatacgactcactatagggcatggcgctcacagtctcggcctcctcggtaacagaggagaaccgagatggccgagactaacctggcggcagcgcaaaagatg

SEQ ID NO: 131063 - DNA, 103 bp, Artificial Sequence
  Synthetic Polynucleotide
taatacgactcactatagggacagcaaggccatggcgctcacagtctcggaacagaggagaccgagaatgtgagcgccaaacctggcggcagcgcaaaagatg

SEQ ID NO: 131064 - DNA, 103 bp, Artificial Sequence
  Synthetic Polynucleotide
taatacgactcactataggggcccccaccgacagcaaggccatggcgctcaacagaggagagagcgcatgggccttgctaacctggcggcagcgcaaaagatg

SEQ ID NO: 131065 - DNA, 103 bp, Artificial Sequence
  Synthetic Polynucleotide
taatacgactcactatagggggcctgctcggcccccaccgacagcaaggcaacagaggagagccttgatgtcggtggggaacctggcggcagcgcaaaagatg

SEQ ID NO: 131066 - DNA, 103 bp, Artificial Sequence
  Synthetic Polynucleotide
taatacgactcactatagggccgcagcctgggcctgctcggcccccaccgaacagaggagacggtggatgccgagcaggaacctggcggcagcgcaaaagatg

SEQ ID NO: 131067 - DNA, 103 bp, Artificial Sequence
  Synthetic Polynucleotide
taatacgactcactatagggtgcttctgcagctggacctcatgctgccttaacagaggagaaaggcaatgtgaggtccaaacctggcggcagcgcaaaagatg

SEQ ID NO: 131068 - DNA, 103 bp, Artificial Sequence
  Synthetic Polynucleotide
taatacgactcactatagggtcccgggctgccgcagcctgggcctgctcgaacagaggagacgagcaatgccaggctgcaacctggcggcagcgcaaaagatg

SEQ ID NO: 131069 - DNA, 103 bp, Artificial Sequence
  Synthetic Polynucleotide
taatacgactcactatagggggggctgtgttcccgggctgccgcagcctgaacagaggagacaggctatggcagcccggaacctggcggcagcgcaaaagatg

SEQ ID NO: 131070 - DNA, 103 bp, Artificial Sequence
  Synthetic Polynucleotide
taatacgactcactatagggctgccggcctggggctgtgttcccgggctgaacagaggagacagcccatgaacacagccaacctggcggcagcgcaaaagatg

SEQ ID NO: 131071 - DNA, 103 bp, Artificial Sequence
  Synthetic Polynucleotide
taatacgactcactatagggatgggctcctctgccggcctggggctgtgtaacagaggagaacacagatgcaggccggcaacctggcggcagcgcaaaagatg

SEQ ID NO: 131072 - DNA, 103 bp, Artificial Sequence
  Synthetic Polynucleotide
taatacgactcactatagggctcctgctccatgggctcctctgccggcctaacagaggagaaggccgatggaggagcccaacctggcggcagcgcaaaagatg

SEQ ID NO: 131073 - DNA, 103 bp, Artificial Sequence
  Synthetic Polynucleotide
taatacgactcactatagggacagggcaggctcctgctccatgggctcctaacagaggagaaggagcatgtggagcaggaacctggcggcagcgcaaaagatg

SEQ ID NO: 131074 - DNA, 103 bp, Artificial Sequence
  Synthetic Polynucleotide
taatacgactcactatagggctgcttgaggtgcttctgcagctggacctcaacagaggagagaggtcatgctgcagaagaacctggcggcagcgcaaaagatg

SEQ ID NO: 131075 - DNA, 103 bp, Artificial Sequence
  Synthetic Polynucleotide
taatacgactcactatagggtctcctgctgctgcttgaggtgcttctgcaaacagaggagatgcagaatgacctcaagcaacctggcggcagcgcaaaagatg

SEQ ID NO: 131076 - DNA, 103 bp, Artificial Sequence
  Synthetic Polynucleotide
taatacgactcactataggggctgccagcatctcctgctgctgcttgaggaacagaggagacctcaaatggcagcaggaaacctggcggcagcgcaaaagatg

SEQ ID NO: 131077 - DNA, 103 bp, Artificial Sequence
  Synthetic Polynucleotide
taatacgactcactatagggctgctgcttggctgccagcatctcctgctgaacagaggagacagcagatgatgctggcaaacctggcggcagcgcaaaagatg

SEQ ID NO: 131078 - DNA, 103 bp, Artificial Sequence
  Synthetic Polynucleotide
taatacgactcactataggggcatctcctgctgctgcttggctgccagcaaacagaggagatgctggatgccaagcagcaacctggcggcagcgcaaaagatg

SEQ ID NO: 131079 - DNA, 103 bp, Artificial Sequence
  Synthetic Polynucleotide
taatacgactcactatagggttggctgccagcatctcctgctgctgcttgaacagaggagacaagcaatggcaggagataacctggcggcagcgcaaaagatg

SEQ ID NO: 131080 - DNA, 103 bp, Artificial Sequence
  Synthetic Polynucleotide
taatacgactcactataggggatttccaaggatggttcccgacctgacataacagaggagaatgtcaatgcgggaaccaaacctggcggcagcgcaaaagatg

SEQ ID NO: 131081 - DNA, 103 bp, Artificial Sequence
  Synthetic Polynucleotide
taatacgactcactatagggctgctgccgcttggctgccagcatctcctgaacagaggagacaggagatgctggcagccaacctggcggcagcgcaaaagatg

SEQ ID NO: 131082 - DNA, 103 bp, Artificial Sequence
  Synthetic Polynucleotide
taatacgactcactataggggctccagctcctgctgccgcttggctgccaaacagaggagatggcagatgagcggcagcaacctggcggcagcgcaaaagatg

SEQ ID NO: 131083 - DNA, 103 bp, Artificial Sequence
  Synthetic Polynucleotide
taatacgactcactatagggtgccgctgctgctccagctcctgctgccgcaacagaggagagcggcaatgggagctggaaacctggcggcagcgcaaaagatg

SEQ ID NO: 131084 - DNA, 103 bp, Artificial Sequence
  Synthetic Polynucleotide
taatacgactcactatagggctgctcccgctgccgctgctgctccagctcaacagaggagagagctgatgcagcagcggaacctggcggcagcgcaaaagatg

SEQ ID NO: 131085 - DNA, 103 bp, Artificial Sequence
  Synthetic Polynucleotide
taatacgactcactatagggcctgccgctgctgctcccgctgccgctgctaacagaggagaagcagcatgagcgggagcaacctggcggcagcgcaaaagatg

SEQ ID NO: 131086 - DNA, 103 bp, Artificial Sequence
  Synthetic Polynucleotide
taatacgactcactatagggtccagctcttcctgccgctgctgctcccgcaacagaggagagcgggaatggcagcggcaaacctggcggcagcgcaaaagatg

SEQ ID NO: 131087 - DNA, 103 bp, Artificial Sequence
  Synthetic Polynucleotide
taatacgactcactatagggccgctgcttctccagctcttcctgccgctgaacagaggagacagcggatggaagagctgaacctggcggcagcgcaaaagatg

SEQ ID NO: 131088 - DNA, 103 bp, Artificial Sequence
  Synthetic Polynucleotide
taatacgactcactataggggctgctccagccgctgcttctccagctcttaacagaggagaaagagcatgagaagcagcaacctggcggcagcgcaaaagatg

SEQ ID NO: 131089 - DNA, 103 bp, Artificial Sequence
  Synthetic Polynucleotide
taatacgactcactatagggatgagcagctgctgctccagccgctgcttcaacagaggagagaagcaatggctggagcaaacctggcggcagcgcaaaagatg

SEQ ID NO: 131090 - DNA, 103 bp, Artificial Sequence
  Synthetic Polynucleotide
taatacgactcactataggggttccgcaggatgagcagctgctgctccagaacagaggagactggagatgcagctgctcaacctggcggcagcgcaaaagatg

SEQ ID NO: 131091 - DNA, 103 bp, Artificial Sequence
  Synthetic Polynucleotide
taatacgactcactatagggtccgcggcaggatttccaaggatggttcccaacagaggagagggaacatgccttggaaaaacctggcggcagcgcaaaagatg

SEQ ID NO: 131092 - DNA, 103 bp, Artificial Sequence
  Synthetic Polynucleotide
taatacgactcactatagggtcttctccttgttccgcaggatgagcagctaacagaggagaagctgcatgtcctgcggaaacctggcggcagcgcaaaagatg

SEQ ID NO: 131093 - DNA, 103 bp, Artificial Sequence
  Synthetic Polynucleotide
taatacgactcactatagggctctctttgctcttctccttgttccgcaggaacagaggagacctgcgatgcaaggagaaaacctggcggcagcgcaaaagatg

SEQ ID NO: 131094 - DNA, 103 bp, Artificial Sequence
  Synthetic Polynucleotide
taatacgactcactatagggggcaatggcactctctttgctcttctccttaacagaggagaaaggagatgagcaaagagaacctggcggcagcgcaaaagatg

SEQ ID NO: 131095 - DNA, 103 bp, Artificial Sequence
  Synthetic Polynucleotide
taatacgactcactatagggcctcagtgctggcaatggcactctctttgcaacagaggagagcaaagatggtgccattgaacctggcggcagcgcaaaagatg

SEQ ID NO: 131096 - DNA, 103 bp, Artificial Sequence
  Synthetic Polynucleotide
taatacgactcactatagggctcagctttacctcagtgctggcaatggcaaacagaggagatgccatatgcagcactgaaacctggcggcagcgcaaaagatg

SEQ ID NO: 131097 - DNA, 103 bp, Artificial Sequence
  Synthetic Polynucleotide
taatacgactcactatagggttcctggagcctcagctttacctcagtgctaacagaggagaagcactatggtaaagctgaacctggcggcagcgcaaaagatg

SEQ ID NO: 131098 - DNA, 103 bp, Artificial Sequence
  Synthetic Polynucleotide
taatacgactcactatagggacaagaggaattcctggagcctcagctttaaacagaggagataaagcatgggctccaggaacctggcggcagcgcaaaagatg

SEQ ID NO: 131099 - DNA, 103 bp, Artificial Sequence
  Synthetic Polynucleotide
taatacgactcactatagggtttgacttcgacaagaggaattcctggagcaacagaggagagctccaatgattcctcttaacctggcggcagcgcaaaagatg

SEQ ID NO: 131100 - DNA, 103 bp, Artificial Sequence
  Synthetic Polynucleotide
taatacgactcactatagggtgtgggctcctttgacttcgacaagaggaaaacagaggagattcctcatgtcgaagtcaaacctggcggcagcgcaaaagatg

SEQ ID NO: 131101 - DNA, 103 bp, Artificial Sequence
  Synthetic Polynucleotide
taatacgactcactatagggggccgcctggtgtgggctcctttgacttcgaacagaggagacgaagtatgaggagcccaaacctggcggcagcgcaaaagatg

SEQ ID NO: 131102 - DNA, 103 bp, Artificial Sequence
  Synthetic Polynucleotide
taatacgactcactatagggtgcagagaagtccgcggcaggatttccaagaacagaggagacttggaatgcctgccgcgaacctggcggcagcgcaaaagatg

SEQ ID NO: 131103 - DNA, 103 bp, Artificial Sequence
  Synthetic Polynucleotide
taatacgactcactataggggaatggttgaggccgcctggtgtgggctccaacagaggagaggagccatgaccaggcggaacctggcggcagcgcaaaagatg

SEQ ID NO: 131104 - DNA, 103 bp, Artificial Sequence
  Synthetic Polynucleotide
taatacgactcactatagggctgtgggagggaatggttgaggccgcctggaacagaggagaccaggcatgctcaaccataacctggcggcagcgcaaaagatg

SEQ ID NO: 131105 - DNA, 103 bp, Artificial Sequence
  Synthetic Polynucleotide
taatacgactcactatagggatttggggtgctgtgggagggaatggttgaaacagaggagatcaaccatgccctcccacaacctggcggcagcgcaaaagatg

SEQ ID NO: 131106 - DNA, 103 bp, Artificial Sequence
  Synthetic Polynucleotide
taatacgactcactataggggctccccagcatttggggtgctgtgggaggaacagaggagacctcccatggcaccccaaaacctggcggcagcgcaaaagatg

SEQ ID NO: 131107 - DNA, 103 bp, Artificial Sequence
  Synthetic Polynucleotide
taatacgactcactatagggagcatggtgggctccccagcatttggggtgaacagaggagacaccccatgtgctggggaaacctggcggcagcgcaaaagatg

SEQ ID NO: 131108 - DNA, 103 bp, Artificial Sequence
  Synthetic Polynucleotide
taatacgactcactatagggggtccaaagaagcatggtgggctccccagcaacagaggagagctgggatgcccaccatgaacctggcggcagcgcaaaagatg

SEQ ID NO: 131109 - DNA, 103 bp, Artificial Sequence
  Synthetic Polynucleotide
taatacgactcactatagggggggaactctggtccaaagaagcatggtggaacagaggagaccaccaatgttctttggaaacctggcggcagcgcaaaagatg

SEQ ID NO: 131110 - DNA, 103 bp, Artificial Sequence
  Synthetic Polynucleotide
taatacgactcactataggggctctggggaggggaactctggtccaaagaaacagaggagatctttgatgcagagttccaacctggcggcagcgcaaaagatg

SEQ ID NO: 131111 - DNA, 103 bp, Artificial Sequence
  Synthetic Polynucleotide
taatacgactcactatagggcaggggggccgctctggggaggggaactctaacagaggagaagagttatgctccccagaaacctggcggcagcgcaaaagatg

SEQ ID NO: 131112 - DNA, 103 bp, Artificial Sequence
  Synthetic Polynucleotide
taatacgactcactatagggggaggcgtcccaggggggccgctctggggaaacagaggagatccccaatgcggccccccaacctggcggcagcgcaaaagatg

SEQ ID NO: 131113 - DNA, 103 bp, Artificial Sequence
  Synthetic Polynucleotide
taatacgactcactatagggagggatgctgtgcagagaagtccgcggcagaacagaggagactgccgatgacttctctgaacctggcggcagcgcaaaagatg

SEQ ID NO: 131114 - DNA, 103 bp, Artificial Sequence
  Synthetic Polynucleotide
taatacgactcactatagggtttgtaggagggaggcgtcccaggggggccaacagaggagaggccccatggggacgcctaacctggcggcagcgcaaaagatg

SEQ ID NO: 131115 - DNA, 103 bp, Artificial Sequence
  Synthetic Polynucleotide
taatacgactcactataggggcaaaggcagtttgtaggagggaggcgtccaacagaggagaggacgcatgcctcctacaaacctggcggcagcgcaaaagatg

SEQ ID NO: 131116 - DNA, 103 bp, Artificial Sequence
  Synthetic Polynucleotide
taatacgactcactatagggtagggcccaggcaaaggcagtttgtaggagaacagaggagactcctaatgactgcctttaacctggcggcagcgcaaaagatg

SEQ ID NO: 131117 - DNA, 103 bp, Artificial Sequence
  Synthetic Polynucleotide
taatacgactcactatagggtcgactgtcgtagggcccaggcaaaggcagaacagaggagactgcctatgcctgggcccaacctggcggcagcgcaaaagatg

SEQ ID NO: 131118 - DNA, 103 bp, Artificial Sequence
  Synthetic Polynucleotide
taatacgactcactatagggggaagtcgtctcgactgtcgtagggcccagaacagaggagactgggcatgacgacagtcaacctggcggcagcgcaaaagatg

SEQ ID NO: 131119 - DNA, 103 bp, Artificial Sequence
  Synthetic Polynucleotide
taatacgactcactatagggttgcggagggggaagtcgtctcgactgtcgaacagaggagacgacagatgagacgacttaacctggcggcagcgcaaaagatg

SEQ ID NO: 131120 - DNA, 103 bp, Artificial Sequence
  Synthetic Polynucleotide
taatacgactcactatagggagaggctgttttgcggagggggaagtcgtcaacagaggagagacgacatgcccctccgcaacctggcggcagcgcaaaagatg

SEQ ID NO: 131121 - DNA, 103 bp, Artificial Sequence
  Synthetic Polynucleotide
taatacgactcactatagggagttgggttcagaggctgttttgcggagggaacagaggagaccctccatgaaacagcctaacctggcggcagcgcaaaagatg

SEQ ID NO: 131122 - DNA, 103 bp, Artificial Sequence
  Synthetic Polynucleotide
taatacgactcactatagggcgcactttcaagttgggttcagaggctgttaacagaggagaaacagcatgtgaacccaaaacctggcggcagcgcaaaagatg

SEQ ID NO: 131123 - DNA, 103 bp, Artificial Sequence
  Synthetic Polynucleotide
taatacgactcactatagggtagccttgaacgcactttcaagttgggttcaacagaggagagaacccatgttgaaagtgaacctggcggcagcgcaaaagatg

SEQ ID NO: 131124 - DNA, 103 bp, Artificial Sequence
  Synthetic Polynucleotide
taatacgactcactatagggccactgtcacagggatgctgtgcagagaagaacagaggagacttctcatgacagcatccaacctggcggcagcgcaaaagatg

SEQ ID NO: 131125 - DNA, 103 bp, Artificial Sequence
  Synthetic Polynucleotide
taatacgactcactatagggccttctgttttagccttgaacgcactttcaaacagaggagatgaaagatggttcaaggcaacctggcggcagcgcaaaagatg

SEQ ID NO: 131126 - DNA, 103 bp, Artificial Sequence
  Synthetic Polynucleotide
taatacgactcactatagggcgctcagccaccttctgttttagccttgaaaacagaggagattcaagatgaaaacagaaaacctggcggcagcgcaaaagatg

SEQ ID NO: 131127 - DNA, 103 bp, Artificial Sequence
  Synthetic Polynucleotide
taatacgactcactatagggactgcttctccgctcagccaccttctgtttaacagaggagaaaacagatggtggctgagaacctggcggcagcgcaaaagatg

SEQ ID NO: 131128 - DNA, 103 bp, Artificial Sequence
  Synthetic Polynucleotide
taatacgactcactataggggcaggaggggactgcttctccgctcagccaaacagaggagatggctgatgggagaagcaaacctggcggcagcgcaaaagatg

SEQ ID NO: 131129 - DNA, 103 bp, Artificial Sequence
  Synthetic Polynucleotide
taatacgactcactatagggtccttgcgacgcaggaggggactgcttctcaacagaggagagagaagatgtcccctcctaacctggcggcagcgcaaaagatg

SEQ ID NO: 131130 - DNA, 103 bp, Artificial Sequence
  Synthetic Polynucleotide
taatacgactcactatagggaacagtcccatccttgcgacgcaggaggggaacagaggagacccctcatgcgtcgcaagaacctggcggcagcgcaaaagatg

SEQ ID NO: 131131 - DNA, 103 bp, Artificial Sequence
  Synthetic Polynucleotide
taatacgactcactatagggaggtgctaataacagtcccatccttgcgacaacagaggagagtcgcaatgatgggactgaacctggcggcagcgcaaaagatg

SEQ ID NO: 131132 - DNA, 103 bp, Artificial Sequence
  Synthetic Polynucleotide
taatacgactcactatagggctcttcttaaaggtgctaataacagtcccaaacagaggagatgggacatgtattagcacaacctggcggcagcgcaaaagatg

SEQ ID NO: 131133 - DNA, 103 bp, Artificial Sequence
  Synthetic Polynucleotide
taatacgactcactatagggctcaacagctctcttcttaaaggtgctaataacagaggagaattagcatgtttaagaagaacctggcggcagcgcaaaagatg

SEQ ID NO: 131134 - DNA, 103 bp, Artificial Sequence
  Synthetic Polynucleotide
taatacgactcactatagggcacctgtgatctcaacagctctcttcttaaaacagaggagattaagaatggagctgttgaacctggcggcagcgcaaaagatg

SEQ ID NO: 131135 - DNA, 103 bp, Artificial Sequence
  Synthetic Polynucleotide
taatacgactcactatagggggcttcacctccactgtcacagggatgctgaacagaggagacagcatatgtgtgacagtaacctggcggcagcgcaaaagatg

SEQ ID NO: 131136 - DNA, 103 bp, Artificial Sequence
  Synthetic Polynucleotide
taatacgactcactatagggccaggcccggcacctgtgatctcaacagctaacagaggagaagctgtatggatcacaggaacctggcggcagcgcaaaagatg

SEQ ID NO: 131137 - DNA, 103 bp, Artificial Sequence
  Synthetic Polynucleotide
taatacgactcactatagggggacgacgccccaggcccggcacctgtgataacagaggagaatcacaatggccgggcctaacctggcggcagcgcaaaagatg

SEQ ID NO: 131138 - DNA, 103 bp, Artificial Sequence
  Synthetic Polynucleotide
taatacgactcactatagggtgttacacacggacgacgccccaggcccggaacagaggagaccgggcatggggcgtcgtaacctggcggcagcgcaaaagatg

SEQ ID NO: 131139 - DNA, 103 bp, Artificial Sequence
  Synthetic Polynucleotide
taatacgactcactatagggccgggtgcgctgttacacacggacgacgccaacagaggagaggcgtcatgcgtgtgtaaaacctggcggcagcgcaaaagatg

SEQ ID NO: 131140 - DNA, 103 bp, Artificial Sequence
  Synthetic Polynucleotide
taatacgactcactatagggggggccggagccgggtgcgctgttacacacaacagaggagagtgtgtatgagcgcacccaacctggcggcagcgcaaaagatg

SEQ ID NO: 131141 - DNA, 103 bp, Artificial Sequence
  Synthetic Polynucleotide
taatacgactcactatagggtgggagagctggggccggagccgggtgcgcaacagaggagagcgcacatggctccggccaacctggcggcagcgcaaaagatg

SEQ ID NO: 131142 - DNA, 103 bp, Artificial Sequence
  Synthetic Polynucleotide
taatacgactcactatagggtgggagctgttgggagagctggggccggagaacagaggagactccggatgcagctctccaacctggcggcagcgcaaaagatg

SEQ ID NO: 131143 - DNA, 103 bp, Artificial Sequence
  Synthetic Polynucleotide
taatacgactcactataggggatggtgctgtgggagctgttgggagagctaacagaggagaagctctatgaacagctccaacctggcggcagcgcaaaagatg

SEQ ID NO: 131144 - DNA, 103 bp, Artificial Sequence
  Synthetic Polynucleotide
taatacgactcactatagggcattctcagcgatggtgctgtgggagctgtaacagaggagaacagctatgacagcaccaaacctggcggcagcgcaaaagatg

SEQ ID NO: 131145 - DNA, 103 bp, Artificial Sequence
  Synthetic Polynucleotide
taatacgactcactatagggccagtaaagccattctcagcgatggtgctgaacagaggagacagcacatgcgctgagaaaacctggcggcagcgcaaaagatg

SEQ ID NO: 131146 - DNA, 103 bp, Artificial Sequence
  Synthetic Polynucleotide
taatacgactcactatagggtgtggtggaatcctggccggttgaggtcataacagaggagaatgaccatgaccggccagaacctggcggcagcgcaaaagatg

SEQ ID NO: 131147 - DNA, 103 bp, Artificial Sequence
  Synthetic Polynucleotide
taatacgactcactatagggaacggctccctttttaatatttcgcttcgaaacagaggagatcgaagatgaatattaaaaacctggcggcagcgcaaaagatg

SEQ ID NO: 131148 - DNA, 103 bp, Artificial Sequence
  Synthetic Polynucleotide
taatacgactcactatagggcaggaccagctgaggctggaactcgagggcaacagaggagagccctcatgttccagcctaacctggcggcagcgcaaaagatg

SEQ ID NO: 131149 - DNA, 103 bp, Artificial Sequence
  Synthetic Polynucleotide
taatacgactcactatagggcagcagccaccaggaccagctgaggctggaaacagaggagatccagcatgagctggtccaacctggcggcagcgcaaaagatg

SEQ ID NO: 131150 - DNA, 103 bp, Artificial Sequence
  Synthetic Polynucleotide
taatacgactcactataggggcatcaaatccagcagccaccaggaccagcaacagaggagagctggtatgggtggctgcaacctggcggcagcgcaaaagatg

SEQ ID NO: 131151 - DNA, 103 bp, Artificial Sequence
  Synthetic Polynucleotide
taatacgactcactatagggcccttgcagggcatcaaatccagcagccacaacagaggagagtggctatgggatttgataacctggcggcagcgcaaaagatg

SEQ ID NO: 131152 - DNA, 103 bp, Artificial Sequence
  Synthetic Polynucleotide
taatacgactcactatagggccttggggtccccttgcagggcatcaaatcaacagaggagagatttgatgccctgcaagaacctggcggcagcgcaaaagatg

SEQ ID NO: 131153 - DNA, 103 bp, Artificial Sequence
  Synthetic Polynucleotide
taatacgactcactataggggccatctcacccttggggtccccttgcaggaacagaggagacctgcaatgggaccccaaaacctggcggcagcgcaaaagatg

SEQ ID NO: 131154 - DNA, 103 bp, Artificial Sequence
  Synthetic Polynucleotide
taatacgactcactatagggcggagtggcggccatctcacccttggggtcaacagaggagagaccccatgggtgagatgaacctggcggcagcgcaaaagatg

SEQ ID NO: 131155 - DNA, 103 bp, Artificial Sequence
  Synthetic Polynucleotide
taatacgactcactatagggcgaaccctgccggagtggcggccatctcacaacagaggagagtgagaatgccgccactcaacctggcggcagcgcaaaagatg

SEQ ID NO: 131156 - DNA, 103 bp, Artificial Sequence
  Synthetic Polynucleotide
taatacgactcactataggggttagctgggcgaaccctgccggagtggcgaacagaggagacgccacatgggcagggttaacctggcggcagcgcaaaagatg

SEQ ID NO: 131157 - DNA, 103 bp, Artificial Sequence
  Synthetic Polynucleotide
taatacgactcactataggggagcaggtgggttagctgggcgaaccctgcaacagaggagagcagggatggcccagctaaacctggcggcagcgcaaaagatg

SEQ ID NO: 131158 - DNA, 103 bp, Artificial Sequence
  Synthetic Polynucleotide
taatacgactcactatagggtagagcggggaacggctccctttttaatataacagaggagaatattaatgagggagccgaacctggcggcagcgcaaaagatg

SEQ ID NO: 131159 - DNA, 103 bp, Artificial Sequence
  Synthetic Polynucleotide
taatacgactcactatagggccagacccatgagcaggtgggttagctgggaacagaggagacccagcatgcccacctgcaacctggcggcagcgcaaaagatg

SEQ ID NO: 131160 - DNA, 103 bp, Artificial Sequence
  Synthetic Polynucleotide
taatacgactcactatagggttgcctcctgccagacccatgagcaggtggaacagaggagaccacctatgcatgggtctaacctggcggcagcgcaaaagatg

SEQ ID NO: 131161 - DNA, 103 bp, Artificial Sequence
  Synthetic Polynucleotide
taatacgactcactatagggcaggatcagcttgcctcctgccagacccataacagaggagaatgggtatggcaggaggcaacctggcggcagcgcaaaagatg

SEQ ID NO: 131162 - DNA, 103 bp, Artificial Sequence
  Synthetic Polynucleotide
taatacgactcactatagggcctccagagacaggatcagcttgcctcctgaacagaggagacaggagatgagctgatccaacctggcggcagcgcaaaagatg

SEQ ID NO: 131163 - DNA, 103 bp, Artificial Sequence
  Synthetic Polynucleotide
taatacgactcactatagggttgtagccaccctccagagacaggatcagcaacagaggagagctgatatggtctctggaaacctggcggcagcgcaaaagatg

SEQ ID NO: 131164 - DNA, 103 bp, Artificial Sequence
  Synthetic Polynucleotide
taatacgactcactatagggggcgcggaggttgtagccaccctccagagaaacagaggagatctctgatgggtggctacaacctggcggcagcgcaaaagatg

SEQ ID NO: 131165 - DNA, 103 bp, Artificial Sequence
  Synthetic Polynucleotide
taatacgactcactatagggcttcagccagggcgcggaggttgtagccacaacagaggagagtggctatgacctccgcgaacctggcggcagcgcaaaagatg

SEQ ID NO: 131166 - DNA, 103 bp, Artificial Sequence
  Synthetic Polynucleotide
taatacgactcactataggggcactgacgccttcagccagggcgcggaggaacagaggagacctccgatgcctggctgaaacctggcggcagcgcaaaagatg

SEQ ID NO: 131167 - DNA, 103 bp, Artificial Sequence
  Synthetic Polynucleotide
taatacgactcactataggggtggagcgaagcactgacgccttcagccagaacagaggagactggctatgggcgtcagtaacctggcggcagcgcaaaagatg

SEQ ID NO: 131168 - DNA, 103 bp, Artificial Sequence
  Synthetic Polynucleotide
taatacgactcactatagggccagaagggtgtggagcgaagcactgacgcaacagaggagagcgtcaatgcttcgctccaacctggcggcagcgcaaaagatg

SEQ ID NO: 131169 - DNA, 103 bp, Artificial Sequence
  Synthetic Polynucleotide
taatacgactcactatagggagattggggatagagcggggaacggctcccaacagaggagagggagcatgtccccgctcaacctggcggcagcgcaaaagatg

SEQ ID NO: 131170 - DNA, 103 bp, Artificial Sequence
  Synthetic Polynucleotide
taatacgactcactatagggcaagggtctcccagaagggtgtggagcgaaaacagaggagattcgctatgcacccttctaacctggcggcagcgcaaaagatg

SEQ ID NO: 131171 - DNA, 103 bp, Artificial Sequence
  Synthetic Polynucleotide
taatacgactcactatagggcagcatggggcaagggtctcccagaagggtaacagaggagaacccttatgggagaccctaacctggcggcagcgcaaaagatg

SEQ ID NO: 131172 - DNA, 103 bp, Artificial Sequence
  Synthetic Polynucleotide
taatacgactcactatagggcaggtgactccagcatggggcaagggtctcaacagaggagagagaccatggccccatgcaacctggcggcagcgcaaaagatg

SEQ ID NO: 131173 - DNA, 103 bp, Artificial Sequence
  Synthetic Polynucleotide
taatacgactcactatagggcagggggcaccaggtgactccagcatggggaacagaggagaccccatatgggagtcaccaacctggcggcagcgcaaaagatg

SEQ ID NO: 131174 - DNA, 103 bp, Artificial Sequence
  Synthetic Polynucleotide
taatacgactcactatagggggcactccggcagggggcaccaggtgactcaacagaggagagagtcaatgggtgcccccaacctggcggcagcgcaaaagatg

SEQ ID NO: 131175 - DNA, 103 bp, Artificial Sequence
  Synthetic Polynucleotide
taatacgactcactatagggctgaagcctgggcactccggcagggggcacaacagaggagagtgcccatggccggagtgaacctggcggcagcgcaaaagatg

SEQ ID NO: 131176 - DNA, 103 bp, Artificial Sequence
  Synthetic Polynucleotide
taatacgactcactataggggcacaggaaactgaagcctgggcactccggaacagaggagaccggagatgccaggcttcaacctggcggcagcgcaaaagatg

SEQ ID NO: 131177 - DNA, 103 bp, Artificial Sequence
  Synthetic Polynucleotide
taatacgactcactatagggggcttccagagcacaggaaactgaagcctgaacagaggagacaggctatggtttcctgtaacctggcggcagcgcaaaagatg

SEQ ID NO: 131178 - DNA, 103 bp, Artificial Sequence
  Synthetic Polynucleotide
taatacgactcactatagggagggctcaagggcttccagagcacaggaaaaacagaggagatttcctatgctctggaagaacctggcggcagcgcaaaagatg

SEQ ID NO: 131179 - DNA, 103 bp, Artificial Sequence
  Synthetic Polynucleotide
taatacgactcactatagggacctcccagaagggctcaagggcttccagaaacagaggagatctggaatgccttgagccaacctggcggcagcgcaaaagatg

SEQ ID NO: 131180 - DNA, 103 bp, Artificial Sequence
  Synthetic Polynucleotide
taatacgactcactatagggtacctccgctagattggggatagagcggggaacagaggagaccccgcatgatccccaataacctggcggcagcgcaaaagatg

SEQ ID NO: 131181 - DNA, 103 bp, Artificial Sequence
  Synthetic Polynucleotide
taatacgactcactatagggtctcacaagaacctcccagaagggctcaagaacagaggagacttgagatgttctgggagaacctggcggcagcgcaaaagatg

SEQ ID NO: 131182 - DNA, 103 bp, Artificial Sequence
  Synthetic Polynucleotide
taatacgactcactatagggtctcagttgatctcacaagaacctcccagaaacagaggagatctgggatgttcttgtgaaacctggcggcagcgcaaaagatg

SEQ ID NO: 131183 - DNA, 103 bp, Artificial Sequence
  Synthetic Polynucleotide
taatacgactcactatagggctctccacggtctcagttgatctcacaagaaacagaggagatcttgtatgatcaactgaaacctggcggcagcgcaaaagatg

SEQ ID NO: 131184 - DNA, 103 bp, Artificial Sequence
  Synthetic Polynucleotide
taatacgactcactatagggcatgttgtccctctccacggtctcagttgaaacagaggagatcaactatgaccgtggagaacctggcggcagcgcaaaagatg

SEQ ID NO: 131185 - DNA, 103 bp, Artificial Sequence
  Synthetic Polynucleotide
taatacgactcactatagggtgtcctcctccatgttgtccctctccacggaacagaggagaccgtggatggggacaacaaacctggcggcagcgcaaaagatg

SEQ ID NO: 131186 - DNA, 103 bp, Artificial Sequence
  Synthetic Polynucleotide
taatacgactcactatagggtcctctacattgtcctcctccatgttgtccaacagaggagaggacaaatgggaggaggaaacctggcggcagcgcaaaagatg

SEQ ID NO: 131187 - DNA, 103 bp, Artificial Sequence
  Synthetic Polynucleotide
taatacgactcactatagggctcctcgctctcctctacattgtcctcctcaacagaggagagaggagatgaatgtagagaacctggcggcagcgcaaaagatg

SEQ ID NO: 131188 - DNA, 103 bp, Artificial Sequence
  Synthetic Polynucleotide
taatacgactcactatagggagggtccttcctcctcgctctcctctacataacagaggagaatgtagatgagagcgaggaacctggcggcagcgcaaaagatg

SEQ ID NO: 131189 - DNA, 103 bp, Artificial Sequence
  Synthetic Polynucleotide
taatacgactcactataggggggggctcccagggtccttcctcctcgctcaacagaggagagagcgaatgggaaggaccaacctggcggcagcgcaaaagatg

SEQ ID NO: 131190 - DNA, 103 bp, Artificial Sequence
  Synthetic Polynucleotide
taatacgactcactatagggtgggagcacagggggctcccagggtccttcaacagaggagagaaggaatgtgggagcccaacctggcggcagcgcaaaagatg

SEQ ID NO: 131191 - DNA, 103 bp, Artificial Sequence
  Synthetic Polynucleotide
taatacgactcactatagggctttcttctttacctccgctagattggggaaacagaggagatccccaatgtagcggaggaacctggcggcagcgcaaaagatg

SEQ ID NO: 131192 - DNA, 103 bp, Artificial Sequence
  Synthetic Polynucleotide
taatacgactcactatagggatgtcaggattgggagcacagggggctcccaacagaggagagggagcatgctgtgctccaacctggcggcagcgcaaaagatg

SEQ ID NO: 131193 - DNA, 103 bp, Artificial Sequence
  Synthetic Polynucleotide
taatacgactcactatagggagcactggccatgtcaggattgggagcacaaacagaggagatgtgctatgaatcctgacaacctggcggcagcgcaaaagatg

SEQ ID NO: 131194 - DNA, 103 bp, Artificial Sequence
  Synthetic Polynucleotide
taatacgactcactataggggcgagactgtagcactggccatgtcaggataacagaggagaatcctgatgtggccagtgaacctggcggcagcgcaaaagatg

SEQ ID NO: 131195 - DNA, 103 bp, Artificial Sequence
  Synthetic Polynucleotide
taatacgactcactatagggccagccctgtgcgagactgtagcactggccaacagaggagaggccagatgtacagtctcaacctggcggcagcgcaaaagatg

SEQ ID NO: 131196 - DNA, 103 bp, Artificial Sequence
  Synthetic Polynucleotide
taatacgactcactatagggtggtcatagaccagccctgtgcgagactgtaacagaggagaacagtcatgcacagggctaacctggcggcagcgcaaaagatg

SEQ ID NO: 131197 - DNA, 103 bp, Artificial Sequence
  Synthetic Polynucleotide
taatacgactcactatagggcatcatattttggtcatagaccagccctgtaacagaggagaacagggatggtctatgacaacctggcggcagcgcaaaagatg

SEQ ID NO: 131198 - DNA, 103 bp, Artificial Sequence
  Synthetic Polynucleotide
taatacgactcactatagggtgcagtgattcatcatattttggtcatagaaacagaggagatctatgatgaaaatatgaaacctggcggcagcgcaaaagatg

SEQ ID NO: 131199 - DNA, 103 bp, Artificial Sequence
  Synthetic Polynucleotide
taatacgactcactatagggtcccacaagttgcagtgattcatcatatttaacagaggagaaaatatatggaatcactgaacctggcggcagcgcaaaagatg

SEQ ID NO: 131200 - DNA, 103 bp, Artificial Sequence
  Synthetic Polynucleotide
taatacgactcactataggggtggtggctgtcccacaagttgcagtgattaacagaggagaaatcacatgaacttgtggaacctggcggcagcgcaaaagatg

SEQ ID NO: 131201 - DNA, 103 bp, Artificial Sequence
  Synthetic Polynucleotide
taatacgactcactataggggtacctcagggtggtggctgtcccacaagtaacagaggagaacttgtatgacagccaccaacctggcggcagcgcaaaagatg

SEQ ID NO: 131202 - DNA, 103 bp, Artificial Sequence
  Synthetic Polynucleotide
taatacgactcactatagggttcattttgcctttcttctttacctccgctaacagaggagaagcggaatgaaagaagaaaacctggcggcagcgcaaaagatg

SEQ ID NO: 131203 - DNA, 103 bp, Artificial Sequence
  Synthetic Polynucleotide
taatacgactcactatagggatgcgctggggtacctcagggtggtggctgaacagaggagacagccaatgccctgaggtaacctggcggcagcgcaaaagatg

SEQ ID NO: 131204 - DNA, 103 bp, Artificial Sequence
  Synthetic Polynucleotide
taatacgactcactataggggatccgcaagatgcgctggggtacctcaggaacagaggagacctgagatgccccagcgcaacctggcggcagcgcaaaagatg

SEQ ID NO: 131205 - DNA, 103 bp, Artificial Sequence
  Synthetic Polynucleotide
taatacgactcactataggggacggcacatgatccgcaagatgcgctgggaacagaggagacccagcatgtcttgcggaaacctggcggcagcgcaaaagatg

SEQ ID NO: 131206 - DNA, 103 bp, Artificial Sequence
  Synthetic Polynucleotide
taatacgactcactatagggagctcctccagacggcacatgatccgcaagaacagaggagacttgcgatgcatgtgccgaacctggcggcagcgcaaaagatg

SEQ ID NO: 131207 - DNA, 103 bp, Artificial Sequence
  Synthetic Polynucleotide
taatacgactcactatagggggcaaggcccagctcctccagacggcacataacagaggagaatgtgcatgctggaggagaacctggcggcagcgcaaaagatg

SEQ ID NO: 131208 - DNA, 103 bp, Artificial Sequence
  Synthetic Polynucleotide
taatacgactcactatagggggcagcgcccggcaaggcccagctcctccaaacagaggagatggaggatgtgggccttgaacctggcggcagcgcaaaagatg

SEQ ID NO: 131209 - DNA, 103 bp, Artificial Sequence
  Synthetic Polynucleotide
taatacgactcactataggggtcagggtgaggcagcgcccggcaaggcccaacagaggagagggcctatgcgggcgctgaacctggcggcagcgcaaaagatg

SEQ ID NO: 131210 - DNA, 103 bp, Artificial Sequence
  Synthetic Polynucleotide
taatacgactcactatagggagggcgcggtgtcagggtgaggcagcgcccaacagaggagagggcgcatgctcaccctgaacctggcggcagcgcaaaagatg

SEQ ID NO: 131211 - DNA, 103 bp, Artificial Sequence
  Synthetic Polynucleotide
taatacgactcactatagggcctctgtggcagggcgcggtgtcagggtgaaacagaggagatcacccatgcaccgcgccaacctggcggcagcgcaaaagatg

SEQ ID NO: 131212 - DNA, 103 bp, Artificial Sequence
  Synthetic Polynucleotide
taatacgactcactatagggagcagctcagcctctgtggcagggcgcggtaacagaggagaaccgcgatgtgccacagaaacctggcggcagcgcaaaagatg

SEQ ID NO: 131213 - DNA, 103 bp, Artificial Sequence
  Synthetic Polynucleotide
taatacgactcactataggggccgagcttcttcattttgcctttcttcttaacagaggagaaagaagatgggcaaaatgaacctggcggcagcgcaaaagatg

SEQ ID NO: 131214 - DNA, 103 bp, Artificial Sequence
  Synthetic Polynucleotide
taatacgactcactataggggtgacaggtgagcagctcagcctctgtggcaacagaggagagccacaatggctgagctgaacctggcggcagcgcaaaagatg

SEQ ID NO: 131215 - DNA, 103 bp, Artificial Sequence
  Synthetic Polynucleotide
taatacgactcactatagggactcagcactgtgacaggtgagcagctcagaacagaggagactgagcatgtcacctgtcaacctggcggcagcgcaaaagatg

SEQ ID NO: 131216 - DNA, 103 bp, Artificial Sequence
  Synthetic Polynucleotide
taatacgactcactatagggtgacccacgtactcagcactgtgacaggtgaacagaggagacacctgatgcagtgctgaaacctggcggcagcgcaaaagatg

SEQ ID NO: 131217 - DNA, 103 bp, Artificial Sequence
  Synthetic Polynucleotide
taatacgactcactatagggggcccggagatgacccacgtactcagcactaacagaggagaagtgctatgtacgtgggtaacctggcggcagcgcaaaagatg

SEQ ID NO: 131218 - DNA, 103 bp, Artificial Sequence
  Synthetic Polynucleotide
taatacgactcactatagggttttctctgtggcccggagatgacccacgtaacagaggagaacgtggatgatctccgggaacctggcggcagcgcaaaagatg

SEQ ID NO: 131219 - DNA, 103 bp, Artificial Sequence
  Synthetic Polynucleotide
taatacgactcactatagggcgggttttcattttctctgtggcccggagaaacagaggagatctccgatgcacagagaaaacctggcggcagcgcaaaagatg

SEQ ID NO: 131220 - DNA, 103 bp, Artificial Sequence
  Synthetic Polynucleotide
taatacgactcactataggggtgcagctcccgggttttcattttctctgtaacagaggagaacagagatgatgaaaaccaacctggcggcagcgcaaaagatg

SEQ ID NO: 131221 - DNA, 103 bp, Artificial Sequence
  Synthetic Polynucleotide
taatacgactcactatagggaactctcacggtgcagctcccgggttttcaaacagaggagatgaaaaatggggagctgcaacctggcggcagcgcaaaagatg

SEQ ID NO: 131222 - DNA, 103 bp, Artificial Sequence
  Synthetic Polynucleotide
taatacgactcactatagggtcaaagttggaactctcacggtgcagctccaacagaggagaggagctatgccgtgagagaacctggcggcagcgcaaaagatg

SEQ ID NO: 131223 - DNA, 103 bp, Artificial Sequence
  Synthetic Polynucleotide
taatacgactcactatagggatagatggagtcaaagttggaactctcacgaacagaggagacgtgagatgtccaactttaacctggcggcagcgcaaaagatg

SEQ ID NO: 131224 - DNA, 103 bp, Artificial Sequence
  Synthetic Polynucleotide
taatacgactcactatagggccattgcttggccgagcttcttcattttgcaacagaggagagcaaaaatgagaagctcgaacctggcggcagcgcaaaagatg

SEQ ID NO: 131225 - DNA, 103 bp, Artificial Sequence
  Synthetic Polynucleotide
taatacgactcactatagggtggggcagatatagatggagtcaaagttggaacagaggagaccaactatgactccatctaacctggcggcagcgcaaaagatg

SEQ ID NO: 131226 - DNA, 103 bp, Artificial Sequence
  Synthetic Polynucleotide
taatacgactcactataggggcgaaggtactggggcagatatagatggagaacagaggagactccatatgtatctgcccaacctggcggcagcgcaaaagatg

SEQ ID NO: 131227 - DNA, 103 bp, Artificial Sequence
  Synthetic Polynucleotide
taatacgactcactatagggctgtgcacaggcgaaggtactggggcagataacagaggagaatctgcatgagtaccttcaacctggcggcagcgcaaaagatg

SEQ ID NO: 131228 - DNA, 103 bp, Artificial Sequence
  Synthetic Polynucleotide
taatacgactcactatagggcagtggcaagctgtgcacaggcgaaggtacaacagaggagagtacctatgcctgtgcacaacctggcggcagcgcaaaagatg

SEQ ID NO: 131229 - DNA, 103 bp, Artificial Sequence
  Synthetic Polynucleotide
taatacgactcactatagggcaggcagcgccagtggcaagctgtgcacagaacagaggagactgtgcatggcttgccacaacctggcggcagcgcaaaagatg

SEQ ID NO: 131230 - DNA, 103 bp, Artificial Sequence
  Synthetic Polynucleotide
taatacgactcactatagggcaccaggcggcaggcagcgccagtggcaagaacagaggagacttgccatgggcgctgccaacctggcggcagcgcaaaagatg

SEQ ID NO: 131231 - DNA, 103 bp, Artificial Sequence
  Synthetic Polynucleotide
taatacgactcactataggggcacagcctccaccaggcggcaggcagcgcaacagaggagagcgctgatggccgcctggaacctggcggcagcgcaaaagatg

SEQ ID NO: 131232 - DNA, 103 bp, Artificial Sequence
  Synthetic Polynucleotide
taatacgactcactatagggtctcctgagagcacagcctccaccaggcggaacagaggagaccgcctatgggaggctgtaacctggcggcagcgcaaaagatg

SEQ ID NO: 131233 - DNA, 103 bp, Artificial Sequence
  Synthetic Polynucleotide
taatacgactcactatagggattcagaacctctcctgagagcacagcctcaacagaggagagaggctatgctctcaggaaacctggcggcagcgcaaaagatg

SEQ ID NO: 131234 - DNA, 103 bp, Artificial Sequence
  Synthetic Polynucleotide
taatacgactcactatagggcagcagcaccattcagaacctctcctgagaaacagaggagatctcagatgaggttctgaaacctggcggcagcgcaaaagatg

SEQ ID NO: 131235 - DNA, 103 bp, Artificial Sequence
  Synthetic Polynucleotide
taatacgactcactatagggaggtcttcttccattgcttggccgagcttcaacagaggagagaagctatgccaagcaataacctggcggcagcgcaaaagatg

SEQ ID NO: 131236 - DNA, 103 bp, Artificial Sequence
  Synthetic Polynucleotide
taatacgactcactatagggggacgcaccacagcagcaccattcagaaccaacagaggagaggttctatgtggtgctgcaacctggcggcagcgcaaaagatg

SEQ ID NO: 131237 - DNA, 103 bp, Artificial Sequence
  Synthetic Polynucleotide
taatacgactcactataggggtgtcctgggggacgcaccacagcagcaccaacagaggagaggtgctatggtggtgcgtaacctggcggcagcgcaaaagatg

SEQ ID NO: 131238 - DNA, 103 bp, Artificial Sequence
  Synthetic Polynucleotide
taatacgactcactataggggctctgcgtggtgtcctgggggacgcaccaaacagaggagatggtgcatgccccaggacaacctggcggcagcgcaaaagatg

SEQ ID NO: 131239 - DNA, 103 bp, Artificial Sequence
  Synthetic Polynucleotide
taatacgactcactataggggctgcatcctgctctgcgtggtgtcctgggaacagaggagacccaggatgccacgcagaaacctggcggcagcgcaaaagatg

SEQ ID NO: 131240 - DNA, 103 bp, Artificial Sequence
  Synthetic Polynucleotide
taatacgactcactatagggaaaaccgcaagctgcatcctgctctgcgtgaacagaggagacacgcaatgcaggatgcaaacctggcggcagcgcaaaagatg

SEQ ID NO: 131241 - DNA, 103 bp, Artificial Sequence
  Synthetic Polynucleotide
taatacgactcactatagggtgaaaaagcaaaaaccgcaagctgcatcctaacagaggagaaggatgatgcttgcggttaacctggcggcagcgcaaaagatg

SEQ ID NO: 131242 - DNA, 103 bp, Artificial Sequence
  Synthetic Polynucleotide
taatacgactcactataggggccacagagttgaaaaagcaaaaaccgcaaaacagaggagattgcggatgttgctttttaacctggcggcagcgcaaaagatg

SEQ ID NO: 131243 - DNA, 103 bp, Artificial Sequence
  Synthetic Polynucleotide
taatacgactcactatagggagcagccacagccacagagttgaaaaagcaaacagaggagatgctttatgaactctgtgaacctggcggcagcgcaaaagatg

SEQ ID NO: 131244 - DNA, 103 bp, Artificial Sequence
  Synthetic Polynucleotide
taatacgactcactataggggggcatggcgagcagccacagccacagagtaacagaggagaactctgatgctgtggctgaacctggcggcagcgcaaaagatg

SEQ ID NO: 131245 - DNA, 103 bp, Artificial Sequence
  Synthetic Polynucleotide
taatacgactcactatagggctgatagtctgggcatggcgagcagccacaaacagaggagatgtggcatgtcgccatgcaacctggcggcagcgcaaaagatg

SEQ ID NO: 131246 - DNA, 103 bp, Artificial Sequence
  Synthetic Polynucleotide
taatacgactcactatagggtcccacgattaggtcttcttccattgcttgaacagaggagacaagcaatggaagaagacaacctggcggcagcgcaaaagatg

SEQ ID NO: 131247 - DNA, 103 bp, Artificial Sequence
  Synthetic Polynucleotide
taatacgactcactatagggggcatgcccactgatagtctgggcatggcgaacagaggagacgccatatgcagactatcaacctggcggcagcgcaaaagatg

SEQ ID NO: 131248 - DNA, 103 bp, Artificial Sequence
  Synthetic Polynucleotide
taatacgactcactatagggggatccgtagggcatgcccactgatagtctaacagaggagaagactaatggtgggcatgaacctggcggcagcgcaaaagatg

SEQ ID NO: 131249 - DNA, 103 bp, Artificial Sequence
  Synthetic Polynucleotide
taatacgactcactatagggtccacaatcaggatccgtagggcatgcccaaacagaggagatgggcaatgcctacggataacctggcggcagcgcaaaagatg

SEQ ID NO: 131250 - DNA, 103 bp, Artificial Sequence
  Synthetic Polynucleotide
taatacgactcactataggggacatcccaatccacaatcaggatccgtagaacagaggagactacggatgctgattgtgaacctggcggcagcgcaaaagatg

SEQ ID NO: 131251 - DNA, 103 bp, Artificial Sequence
  Synthetic Polynucleotide
taatacgactcactatagggtaccgtggtggacatcccaatccacaatcaaacagaggagatgattgatgattgggatgaacctggcggcagcgcaaaagatg

SEQ ID NO: 131252 - DNA, 103 bp, Artificial Sequence
  Synthetic Polynucleotide
taatacgactcactatagggtgagttccattaccgtggtggacatcccaaaacagaggagattgggaatgccaccacggaacctggcggcagcgcaaaagatg

SEQ ID NO: 131253 - DNA, 103 bp, Artificial Sequence
  Synthetic Polynucleotide
taatacgactcactatagggaaacatgtgctgagttccattaccgtggtgaacagaggagacaccacatgaatggaactaacctggcggcagcgcaaaagatg

SEQ ID NO: 131254 - DNA, 103 bp, Artificial Sequence
  Synthetic Polynucleotide
taatacgactcactatagggggtcatcctcaaacatgtgctgagttccataacagaggagaatggaaatgagcacatgtaacctggcggcagcgcaaaagatg

SEQ ID NO: 131255 - DNA, 103 bp, Artificial Sequence
  Synthetic Polynucleotide
taatacgactcactatagggagcacactggggtcatcctcaaacatgtgcaacagaggagagcacatatgtgaggatgaaacctggcggcagcgcaaaagatg

SEQ ID NO: 131256 - DNA, 103 bp, Artificial Sequence
  Synthetic Polynucleotide
taatacgactcactatagggggacacatatagcacactggggtcatcctcaacagaggagagaggatatgcccagtgtgaacctggcggcagcgcaaaagatg

SEQ ID NO: 131257 - DNA, 103 bp, Artificial Sequence
  Synthetic Polynucleotide
taatacgactcactataggggctgcctggttgtggtggaatcctggccggaacagaggagaccggccatgattccaccaaacctggcggcagcgcaaaagatg

SEQ ID NO: 131258 - DNA, 103 bp, Artificial Sequence
  Synthetic Polynucleotide
taatacgactcactatagggtcccttgcagtcccacgattaggtcttcttaacagaggagaaagaagatgtaatcgtggaacctggcggcagcgcaaaagatg

SEQ ID NO: 131259 - DNA, 103 bp, Artificial Sequence
  Synthetic Polynucleotide
taatacgactcactatagggagcggtgcagggacacatatagcacactggaacagaggagaccagtgatgtatatgtgtaacctggcggcagcgcaaaagatg

SEQ ID NO: 131260 - DNA, 103 bp, Artificial Sequence
  Synthetic Polynucleotide
taatacgactcactatagggccatgatcatagcggtgcagggacacatataacagaggagaatatgtatgcctgcaccgaacctggcggcagcgcaaaagatg

SEQ ID NO: 131261 - DNA, 103 bp, Artificial Sequence
  Synthetic Polynucleotide
taatacgactcactataggggaagaaggtgccatgatcatagcggtgcagaacagaggagactgcacatgtatgatcataacctggcggcagcgcaaaagatg

SEQ ID NO: 131262 - DNA, 103 bp, Artificial Sequence
  Synthetic Polynucleotide
taatacgactcactatagggcccccatggggaagaaggtgccatgatcataacagaggagaatgatcatggcaccttctaacctggcggcagcgcaaaagatg

SEQ ID NO: 131263 - DNA, 103 bp, Artificial Sequence
  Synthetic Polynucleotide
taatacgactcactataggggcaccctcatcccccatggggaagaaggtgaacagaggagacaccttatgccccatgggaacctggcggcagcgcaaaagatg

SEQ ID NO: 131264 - DNA, 103 bp, Artificial Sequence
  Synthetic Polynucleotide
taatacgactcactatagggctggctgctggcaccctcatcccccatgggaacagaggagacccatgatggatgagggtaacctggcggcagcgcaaaagatg

SEQ ID NO: 131265 - DNA, 103 bp, Artificial Sequence
  Synthetic Polynucleotide
taatacgactcactatagggcccggccgatctggctgctggcaccctcataacagaggagaatgaggatgccagcagccaacctggcggcagcgcaaaagatg

SEQ ID NO: 131266 - DNA, 103 bp, Artificial Sequence
  Synthetic Polynucleotide
taatacgactcactataggggtgcccgcagcccggccgatctggctgctgaacagaggagacagcagatggatcggccgaacctggcggcagcgcaaaagatg

SEQ ID NO: 131267 - DNA, 103 bp, Artificial Sequence
  Synthetic Polynucleotide
taatacgactcactatagggggtgaagcctgtgcccgcagcccggccgataacagaggagaatcggcatggctgcgggcaacctggcggcagcgcaaaagatg

SEQ ID NO: 131268 - DNA, 103 bp, Artificial Sequence
  Synthetic Polynucleotide
taatacgactcactatagggccacgttgacggtgaagcctgtgcccgcagaacagaggagactgcggatgcaggcttcaaacctggcggcagcgcaaaagatg

SEQ ID NO: 131269 - DNA, 103 bp, Artificial Sequence
  Synthetic Polynucleotide
taatacgactcactatagggttcagatccatcccttgcagtcccacgattaacagaggagaaatcgtatgactgcaaggaacctggcggcagcgcaaaagatg

SEQ ID NO: 131270 - DNA, 103 bp, Artificial Sequence
  Synthetic Polynucleotide
taatacgactcactatagggccgttccatgccacgttgacggtgaagcctaacagaggagaaggcttatgcgtcaacgtaacctggcggcagcgcaaaagatg

SEQ ID NO: 131271 - DNA, 103 bp, Artificial Sequence
  Synthetic Polynucleotide
taatacgactcactatagggcatgcggggcccgttccatgccacgttgacaacagaggagagtcaacatggcatggaacaacctggcggcagcgcaaaagatg

SEQ ID NO: 131272 - DNA, 103 bp, Artificial Sequence
  Synthetic Polynucleotide
taatacgactcactatagggcagcatcacccatgcggggcccgttccatgaacagaggagacatggaatgggccccgcaaacctggcggcagcgcaaaagatg

SEQ ID NO: 131273 - DNA, 103 bp, Artificial Sequence
  Synthetic Polynucleotide
taatacgactcactataggggctaggtagtcagcatcacccatgcggggcaacagaggagagccccgatggggtgatgcaacctggcggcagcgcaaaagatg

SEQ ID NO: 131274 - DNA, 103 bp, Artificial Sequence
  Synthetic Polynucleotide
taatacgactcactatagggatgccaggcagctaggtagtcagcatcaccaacagaggagaggtgatatggactacctaaacctggcggcagcgcaaaagatg

SEQ ID NO: 131275 - DNA, 103 bp, Artificial Sequence
  Synthetic Polynucleotide
taatacgactcactataggggcaccaggcgatgccaggcagctaggtagtaacagaggagaactaccatgctgcctggcaacctggcggcagcgcaaaagatg

SEQ ID NO: 131276 - DNA, 103 bp, Artificial Sequence
  Synthetic Polynucleotide
taatacgactcactataggggcaatgggaagcaccaggcgatgccaggcaaacagaggagatgcctgatgtcgcctggtaacctggcggcagcgcaaaagatg

SEQ ID NO: 131277 - DNA, 103 bp, Artificial Sequence
  Synthetic Polynucleotide
taatacgactcactatagggaaactcgtaggcaatgggaagcaccaggcgaacagaggagacgcctgatgcttcccattaacctggcggcagcgcaaaagatg

SEQ ID NO: 131278 - DNA, 103 bp, Artificial Sequence
  Synthetic Polynucleotide
taatacgactcactataggggttctgggttaaactcgtaggcaatgggaaaacagaggagattcccaatgcctacgagtaacctggcggcagcgcaaaagatg

SEQ ID NO: 131279 - DNA, 103 bp, Artificial Sequence
  Synthetic Polynucleotide
taatacgactcactatagggaccagcaccagttctgggttaaactcgtagaacagaggagactacgaatgtaacccagaaacctggcggcagcgcaaaagatg

SEQ ID NO: 131280 - DNA, 103 bp, Artificial Sequence
  Synthetic Polynucleotide
taatacgactcactatagggagcctcaaggttcagatccatcccttgcagaacagaggagactgcaaatgatggatctgaacctggcggcagcgcaaaagatg

SEQ ID NO: 131281 - DNA, 103 bp, Artificial Sequence
  Synthetic Polynucleotide
taatacgactcactataggggccagctgagaccagcaccagttctgggttaacagaggagaaacccaatgctggtgctgaacctggcggcagcgcaaaagatg

SEQ ID NO: 131282 - DNA, 103 bp, Artificial Sequence
  Synthetic Polynucleotide
taatacgactcactatagggcagcatcaaagccagctgagaccagcaccaaacagaggagatggtgcatgtctcagctgaacctggcggcagcgcaaaagatg

SEQ ID NO: 131283 - DNA, 103 bp, Artificial Sequence
  Synthetic Polynucleotide
taatacgactcactatagggtccccccgtgcagcatcaaagccagctgagaacagaggagactcagcatgctttgatgcaacctggcggcagcgcaaaagatg

SEQ ID NO: 131284 - DNA, 103 bp, Artificial Sequence
  Synthetic Polynucleotide
taatacgactcactatagggccccagcggatccccccgtgcagcatcaaaaacagaggagatttgatatggcacgggggaacctggcggcagcgcaaaagatg

SEQ ID NO: 131285 - DNA, 103 bp, Artificial Sequence
  Synthetic Polynucleotide
taatacgactcactatagggcctggcagccccccagcggatccccccgtgaacagaggagacacgggatgatccgctggaacctggcggcagcgcaaaagatg

SEQ ID NO: 131286 - DNA, 103 bp, Artificial Sequence
  Synthetic Polynucleotide
taatacgactcactatagggtcaggtgacacctggcagccccccagcggaaacagaggagatccgctatggggctgccaaacctggcggcagcgcaaaagatg

SEQ ID NO: 131287 - DNA, 103 bp, Artificial Sequence
  Synthetic Polynucleotide
taatacgactcactatagggggcataaccctcaggtgacacctggcagccaacagaggagaggctgcatggtgtcacctaacctggcggcagcgcaaaagatg

SEQ ID NO: 131288 - DNA, 103 bp, Artificial Sequence
  Synthetic Polynucleotide
taatacgactcactataggggggtgaggtgggcataaccctcaggtgacaaacagaggagatgtcacatgagggttatgaacctggcggcagcgcaaaagatg

SEQ ID NO: 131289 - DNA, 103 bp, Artificial Sequence
  Synthetic Polynucleotide
taatacgactcactatagggatcagcaggtgggtgaggtgggcataacccaacagaggagagggttaatgccacctcacaacctggcggcagcgcaaaagatg

SEQ ID NO: 131290 - DNA, 103 bp, Artificial Sequence
  Synthetic Polynucleotide
taatacgactcactatagggggcaaggcccatcagcaggtgggtgaggtgaacagaggagacacctcatgcacctgctgaacctggcggcagcgcaaaagatg

SEQ ID NO: 131291 - DNA, 103 bp, Artificial Sequence
  Synthetic Polynucleotide
taatacgactcactatagggccagtgcttcagcctcaaggttcagatccaaacagaggagatggatcatgaccttgaggaacctggcggcagcgcaaaagatg

SEQ ID NO: 131292 - DNA, 103 bp, Artificial Sequence
  Synthetic Polynucleotide
taatacgactcactatagggtgcggccactggcaaggcccatcagcaggtaacagaggagaacctgcatgtgggccttgaacctggcggcagcgcaaaagatg

SEQ ID NO: 131293 - DNA, 103 bp, Artificial Sequence
  Synthetic Polynucleotide
taatacgactcactatagggataaggataatgcggccactggcaaggcccaacagaggagagggcctatgcagtggccgaacctggcggcagcgcaaaagatg

SEQ ID NO: 131294 - DNA, 103 bp, Artificial Sequence
  Synthetic Polynucleotide
taatacgactcactatagggaccctctaggataaggataatgcggccactaacagaggagaagtggcatgattatccttaacctggcggcagcgcaaaagatg

SEQ ID NO: 131295 - DNA, 103 bp, Artificial Sequence
  Synthetic Polynucleotide
taatacgactcactatagggggttatagccaccctctaggataaggataaaacagaggagattatccatgtcctagaggaacctggcggcagcgcaaaagatg

SEQ ID NO: 131296 - DNA, 103 bp, Artificial Sequence
  Synthetic Polynucleotide
taatacgactcactatagggatggatgtcaggttatagccaccctctaggaacagaggagacctagaatgtggctataaaacctggcggcagcgcaaaagatg

SEQ ID NO: 131297 - DNA, 103 bp, Artificial Sequence
  Synthetic Polynucleotide
taatacgactcactatagggggactctgagatggatgtcaggttatagccaacagaggagaggctatatgctgacatccaacctggcggcagcgcaaaagatg

SEQ ID NO: 131298 - DNA, 103 bp, Artificial Sequence
  Synthetic Polynucleotide
taatacgactcactatagggaggcagccatggactctgagatggatgtcaaacagaggagatgacatatgtctcagagtaacctggcggcagcgcaaaagatg

SEQ ID NO: 131299 - DNA, 103 bp, Artificial Sequence
  Synthetic Polynucleotide
taatacgactcactataggggagcgagtgcaggcagccatggactctgagaacagaggagactcagaatgcatggctgcaacctggcggcagcgcaaaagatg

SEQ ID NO: 131300 - DNA, 103 bp, Artificial Sequence
  Synthetic Polynucleotide
taatacgactcactatagggtccaaggagggagcgagtgcaggcagccataacagaggagaatggctatgtgcactcgcaacctggcggcagcgcaaaagatg

SEQ ID NO: 131301 - DNA, 103 bp, Artificial Sequence
  Synthetic Polynucleotide
taatacgactcactataggggtggtgggtctccaaggagggagcgagtgcaacagaggagagcactcatgccctccttgaacctggcggcagcgcaaaagatg

SEQ ID NO: 131302 - DNA, 103 bp, Artificial Sequence
  Synthetic Polynucleotide
taatacgactcactatagggccagtgccagccagtgcttcagcctcaaggaacagaggagaccttgaatgtgaagcactaacctggcggcagcgcaaaagatg

SEQ ID NO: 131303 - DNA, 103 bp, Artificial Sequence
  Synthetic Polynucleotide
taatacgactcactataggggtcagcaggggtggtgggtctccaaggaggaacagaggagacctcctatgagacccaccaacctggcggcagcgcaaaagatg

SEQ ID NO: 131304 - DNA, 103 bp, Artificial Sequence
  Synthetic Polynucleotide
taatacgactcactatagggccgtggcagggtcagcaggggtggtgggtcaacagaggagagacccaatgcccctgctgaacctggcggcagcgcaaaagatg

SEQ ID NO: 131305 - DNA, 103 bp, Artificial Sequence
  Synthetic Polynucleotide
taatacgactcactatagggatagtgggggccgtggcagggtcagcagggaacagaggagaccctgcatgccctgccacaacctggcggcagcgcaaaagatg

SEQ ID NO: 131306 - DNA, 103 bp, Artificial Sequence
  Synthetic Polynucleotide
taatacgactcactatagggagggcccctgatagtgggggccgtggcaggaacagaggagacctgccatggcccccactaacctggcggcagcgcaaaagatg

SEQ ID NO: 131307 - DNA, 103 bp, Artificial Sequence
  Synthetic Polynucleotide
taatacgactcactataggggattgaggccagggcccctgatagtgggggaacagaggagacccccaatgtcaggggccaacctggcggcagcgcaaaagatg

SEQ ID NO: 131308 - DNA, 103 bp, Artificial Sequence
  Synthetic Polynucleotide
taatacgactcactatagggtggtctcagtgattgaggccagggcccctgaacagaggagacaggggatgtggcctcaaaacctggcggcagcgcaaaagatg

SEQ ID NO: 131309 - DNA, 103 bp, Artificial Sequence
  Synthetic Polynucleotide
taatacgactcactatagggtggacttggatggtctcagtgattgaggccaacagaggagaggcctcatgcactgagacaacctggcggcagcgcaaaagatg

SEQ ID NO: 131310 - DNA, 103 bp, Artificial Sequence
  Synthetic Polynucleotide
taatacgactcactataggggtatctgcgatggacttggatggtctcagtaacagaggagaactgagatgatccaagtcaacctggcggcagcgcaaaagatg

SEQ ID NO: 131311 - DNA, 103 bp, Artificial Sequence
  Synthetic Polynucleotide
taatacgactcactatagggagctgcgccagtatctgcgatggacttggaaacagaggagatccaagatgatcgcagataacctggcggcagcgcaaaagatg

SEQ ID NO: 131312 - DNA, 103 bp, Artificial Sequence
  Synthetic Polynucleotide
taatacgactcactatagggatgacccgtaagctgcgccagtatctgcgaaacagaggagatcgcagatgctggcgcagaacctggcggcagcgcaaaagatg

SEQ ID NO: 131313 - DNA, 103 bp, Artificial Sequence
  Synthetic Polynucleotide
taatacgactcactatagggcaacaccaagccagtgccagccagtgcttcaacagaggagagaagcaatggctggcactaacctggcggcagcgcaaaagatg

SEQ ID NO: 131314 - DNA, 103 bp, Artificial Sequence
  Synthetic Polynucleotide
taatacgactcactatagggttctaccttcatgacccgtaagctgcgccaaacagaggagatggcgcatgttacgggtcaacctggcggcagcgcaaaagatg

SEQ ID NO: 131315 - DNA, 103 bp, Artificial Sequence
  Synthetic Polynucleotide
taatacgactcactatagggcttctctgtcttctaccttcatgacccgtaaacagaggagatacgggatgtgaaggtagaacctggcggcagcgcaaaagatg

SEQ ID NO: 131316 - DNA, 103 bp, Artificial Sequence
  Synthetic Polynucleotide
taatacgactcactatagggctggagggtccttctctgtcttctaccttcaacagaggagagaaggtatgagacagagaaacctggcggcagcgcaaaagatg

SEQ ID NO: 131317 - DNA, 103 bp, Artificial Sequence
  Synthetic Polynucleotide
taatacgactcactatagggcaacttagaactggagggtccttctctgtcaacagaggagagacagaatgggaccctccaacctggcggcagcgcaaaagatg

SEQ ID NO: 131318 - DNA, 103 bp, Artificial Sequence
  Synthetic Polynucleotide
taatacgactcactatagggtcttggtgaccaacttagaactggagggtcaacagaggagagaccctatggttctaagtaacctggcggcagcgcaaaagatg

SEQ ID NO: 131319 - DNA, 103 bp, Artificial Sequence
  Synthetic Polynucleotide
taatacgactcactatagggtggggtgccttcttggtgaccaacttagaaaacagaggagattctaaatgggtcaccaaaacctggcggcagcgcaaaagatg

SEQ ID NO: 131320 - DNA, 103 bp, Artificial Sequence
  Synthetic Polynucleotide
taatacgactcactatagggtttggctggttggggtgccttcttggtgacaacagaggagagtcaccatgaaggcacccaacctggcggcagcgcaaaagatg

SEQ ID NO: 131321 - DNA, 103 bp, Artificial Sequence
  Synthetic Polynucleotide
taatacgactcactatagggctaacctaggtttggctggttggggtgcctaacagaggagaaggcacatgaaccagccaaacctggcggcagcgcaaaagatg

SEQ ID NO: 131322 - DNA, 103 bp, Artificial Sequence
  Synthetic Polynucleotide
taatacgactcactatagggatccgctcagctaacctaggtttggctggtaacagaggagaaccagcatgacctaggttaacctggcggcagcgcaaaagatg

SEQ ID NO: 131323 - DNA, 103 bp, Artificial Sequence
  Synthetic Polynucleotide
taatacgactcactatagggtcgtgtggtcatccgctcagctaacctaggaacagaggagacctaggatggctgagcggaacctggcggcagcgcaaaagatg

SEQ ID NO: 131324 - DNA, 103 bp, Artificial Sequence
  Synthetic Polynucleotide
taatacgactcactatagggactgctcatccaacaccaagccagtgccagaacagaggagactggcaatggcttggtgtaacctggcggcagcgcaaaagatg

SEQ ID NO: 131325 - DNA, 103 bp, Artificial Sequence
  Synthetic Polynucleotide
taatacgactcactatagggccttcttttctcgtgtggtcatccgctcagaacagaggagactgagcatgtgaccacacaacctggcggcagcgcaaaagatg

SEQ ID NO: 131326 - DNA, 103 bp, Artificial Sequence
  Synthetic Polynucleotide
taatacgactcactataggggcttccagaaccttcttttctcgtgtggtcaacagaggagagaccacatgagaaaagaaaacctggcggcagcgcaaaagatg

SEQ ID NO: 131327 - DNA, 103 bp, Artificial Sequence
  Synthetic Polynucleotide
taatacgactcactatagggccccatgcctgcttccagaaccttcttttcaacagaggagagaaaagatggttctggaaaacctggcggcagcgcaaaagatg

SEQ ID NO: 131328 - DNA, 103 bp, Artificial Sequence
  Synthetic Polynucleotide
taatacgactcactatagggaggtgactttccccatgcctgcttccagaaaacagaggagattctggatgcaggcatggaacctggcggcagcgcaaaagatg

SEQ ID NO: 131329 - DNA, 103 bp, Artificial Sequence
  Synthetic Polynucleotide
taatacgactcactatagggaatgatgccgaggtgactttccccatgcctaacagaggagaaggcatatggaaagtcacaacctggcggcagcgcaaaagatg

SEQ ID NO: 131330 - DNA, 103 bp, Artificial Sequence
  Synthetic Polynucleotide
taatacgactcactatagggctcttccccaaatgatgccgaggtgactttaacagaggagaaaagtcatgtcggcatcaaacctggcggcagcgcaaaagatg

SEQ ID NO: 131331 - DNA, 103 bp, Artificial Sequence
  Synthetic Polynucleotide
taatacgactcactatagggctggagtggactcttccccaaatgatgccgaacagaggagacggcatatgttggggaagaacctggcggcagcgcaaaagatg

SEQ ID NO: 131332 - DNA, 103 bp, Artificial Sequence
  Synthetic Polynucleotide
taatacgactcactatagggttagtctggcctggagtggactcttccccaaacagaggagatggggaatggtccactccaacctggcggcagcgcaaaagatg

SEQ ID NO: 131333 - DNA, 103 bp, Artificial Sequence
  Synthetic Polynucleotide
taatacgactcactatagggtgtctctgagttagtctggcctggagtggaaacagaggagatccactatgggccagactaacctggcggcagcgcaaaagatg

SEQ ID NO: 131334 - DNA, 103 bp, Artificial Sequence
  Synthetic Polynucleotide
taatacgactcactatagggccaccacagctgtctctgagttagtctggcaacagaggagagccagaatgactcagagaaacctggcggcagcgcaaaagatg

SEQ ID NO: 131335 - DNA, 103 bp, Artificial Sequence
  Synthetic Polynucleotide
taatacgactcactatagggaattcatttaactgctcatccaacaccaagaacagaggagacttggtatgggatgagcaaacctggcggcagcgcaaaagatg

SEQ ID NO: 131336 - DNA, 103 bp, Artificial Sequence
  Synthetic Polynucleotide
taatacgactcactatagggtgagtgagggccaccacagctgtctctgagaacagaggagactcagaatgagctgtggtaacctggcggcagcgcaaaagatg

SEQ ID NO: 131337 - DNA, 103 bp, Artificial Sequence
  Synthetic Polynucleotide
taatacgactcactataggggggctggtcctgagtgagggccaccacagcaacagaggagagctgtgatggccctcactaacctggcggcagcgcaaaagatg

SEQ ID NO: 131338 - DNA, 103 bp, Artificial Sequence
  Synthetic Polynucleotide
taatacgactcactatagggctgcctctgagggctggtcctgagtgagggaacagaggagaccctcaatgaggaccagcaacctggcggcagcgcaaaagatg

SEQ ID NO: 131339 - DNA, 103 bp, Artificial Sequence
  Synthetic Polynucleotide
taatacgactcactatagggccccctgtggctgcctctgagggctggtccaacagaggagaggaccaatgctcagaggcaacctggcggcagcgcaaaagatg

SEQ ID NO: 131340 - DNA, 103 bp, Artificial Sequence
  Synthetic Polynucleotide
taatacgactcactatagggcagagtggctccccctgtggctgcctctgaaacagaggagatcagagatggccacagggaacctggcggcagcgcaaaagatg

SEQ ID NO: 131341 - DNA, 103 bp, Artificial Sequence
  Synthetic Polynucleotide
taatacgactcactatagggtggtctgggccagagtggctccccctgtggaacagaggagaccacagatggagccactcaacctggcggcagcgcaaaagatg

SEQ ID NO: 131342 - DNA, 103 bp, Artificial Sequence
  Synthetic Polynucleotide
taatacgactcactataggggcctcagaaatggtctgggccagagtggctaacagaggagaagccacatgggcccagacaacctggcggcagcgcaaaagatg

SEQ ID NO: 131343 - DNA, 103 bp, Artificial Sequence
  Synthetic Polynucleotide
taatacgactcactatagggcccaatggctgcctcagaaatggtctgggcaacagaggagagcccagatgatttctgagaacctggcggcagcgcaaaagatg

SEQ ID NO: 131344 - DNA, 103 bp, Artificial Sequence
  Synthetic Polynucleotide
taatacgactcactataggggcatggctcccccaatggctgcctcagaaaaacagaggagatttctgatgcagccattgaacctggcggcagcgcaaaagatg

SEQ ID NO: 131345 - DNA, 103 bp, Artificial Sequence
  Synthetic Polynucleotide
taatacgactcactataggggtctggcccagcatggctcccccaatggctaacagaggagaagccatatggggagccataacctggcggcagcgcaaaagatg

SEQ ID NO: 131346 - DNA, 103 bp, Artificial Sequence
  Synthetic Polynucleotide
taatacgactcactataggggaggcaatggaattcatttaactgctcatcaacagaggagagatgagatgttaaatgaaaacctggcggcagcgcaaaagatg

SEQ ID NO: 131347 - DNA, 103 bp, Artificial Sequence
  Synthetic Polynucleotide
taatacgactcactatagggctctgaggtggtctggcccagcatggctccaacagaggagaggagccatgctgggccagaacctggcggcagcgcaaaagatg

SEQ ID NO: 131348 - DNA, 103 bp, Artificial Sequence
  Synthetic Polynucleotide
taatacgactcactatagggcgacagcctcctctgaggtggtctggcccaaacagaggagatgggccatgccacctcagaacctggcggcagcgcaaaagatg

SEQ ID NO: 131349 - DNA, 103 bp, Artificial Sequence
  Synthetic Polynucleotide
taatacgactcactataggggtggctcccccgacagcctcctctgaggtgaacagaggagacacctcatgggaggctgtaacctggcggcagcgcaaaagatg

SEQ ID NO: 131350 - DNA, 103 bp, Artificial Sequence
  Synthetic Polynucleotide
taatacgactcactatagggctggtccggagtggctcccccgacagcctcaacagaggagagaggctatggggggagccaacctggcggcagcgcaaaagatg

SEQ ID NO: 131351 - DNA, 103 bp, Artificial Sequence
  Synthetic Polynucleotide
taatacgactcactatagggctgaggtggtctggtccggagtggctccccaacagaggagaggggagatgctccggaccaacctggcggcagcgcaaaagatg

SEQ ID NO: 131352 - DNA, 103 bp, Artificial Sequence
  Synthetic Polynucleotide
taatacgactcactatagggacagtctcctctgaggtggtctggtccggaaacagaggagatccggaatggaccacctcaacctggcggcagcgcaaaagatg

SEQ ID NO: 131353 - DNA, 103 bp, Artificial Sequence
  Synthetic Polynucleotide
taatacgactcactatagggggctcctcccacagtctcctctgaggtggtaacagaggagaaccaccatggaggagactaacctggcggcagcgcaaaagatg

SEQ ID NO: 131354 - DNA, 103 bp, Artificial Sequence
  Synthetic Polynucleotide
taatacgactcactatagggggtccagaatggctcctcccacagtctcctaacagaggagaaggagaatgtgggaggagaacctggcggcagcgcaaaagatg

SEQ ID NO: 131355 - DNA, 103 bp, Artificial Sequence
  Synthetic Polynucleotide
taatacgactcactataggggaggtggtctggtccagaatggctcctcccaacagaggagagggaggatgcattctggaaacctggcggcagcgcaaaagatg

SEQ ID NO: 131356 - DNA, 103 bp, Artificial Sequence
  Synthetic Polynucleotide
taatacgactcactatagggagcatcctctgaggtggtctggtccagaataacagaggagaattctgatgcagaccaccaacctggcggcagcgcaaaagatg

SEQ ID NO: 131357 - DNA, 103 bp, Artificial Sequence
  Synthetic Polynucleotide
taatacgactcactatagggtgtcatcccagaggcaatggaattcatttaaacagaggagataaatgatgtccattgccaacctggcggcagcgcaaaagatg

SEQ ID NO: 131358 - DNA, 103 bp, Artificial Sequence
  Synthetic Polynucleotide
taatacgactcactatagggctcccccaacagcatcctctgaggtggtctaacagaggagaagaccaatgcagaggatgaacctggcggcagcgcaaaagatg

SEQ ID NO: 131359 - DNA, 103 bp, Artificial Sequence
  Synthetic Polynucleotide
taatacgactcactatagggcccagcgtggctcccccaacagcatcctctaacagaggagaagaggaatgtgttgggggaacctggcggcagcgcaaaagatg

SEQ ID NO: 131360 - DNA, 103 bp, Artificial Sequence
  Synthetic Polynucleotide
taatacgactcactatagggggtagtctggcccagcgtggctcccccaacaacagaggagagttgggatggccacgctgaacctggcggcagcgcaaaagatg

SEQ ID NO: 131361 - DNA, 103 bp, Artificial Sequence
  Synthetic Polynucleotide
taatacgactcactatagggcctcctctgaggtagtctggcccagcgtggaacagaggagaccacgcatggccagactaaacctggcggcagcgcaaaagatg

SEQ ID NO: 131362 - DNA, 103 bp, Artificial Sequence
  Synthetic Polynucleotide
taatacgactcactatagggcctcctacagcctcctctgaggtagtctggaacagaggagaccagacatgctcagaggaaacctggcggcagcgcaaaagatg

SEQ ID NO: 131363 - DNA, 103 bp, Artificial Sequence
  Synthetic Polynucleotide
taatacgactcactatagggcagtgtagctcctcctacagcctcctctgaaacagaggagatcagagatggctgtaggaaacctggcggcagcgcaaaagatg

SEQ ID NO: 131364 - DNA, 103 bp, Artificial Sequence
  Synthetic Polynucleotide
taatacgactcactatagggtggtctgggccagtgtagctcctcctacagaacagaggagactgtagatggagctacacaacctggcggcagcgcaaaagatg

SEQ ID NO: 131365 - DNA, 103 bp, Artificial Sequence
  Synthetic Polynucleotide
taatacgactcactataggggcctccgaggtggtctgggccagtgtagctaacagaggagaagctacatgggcccagacaacctggcggcagcgcaaaagatg

SEQ ID NO: 131366 - DNA, 103 bp, Artificial Sequence
  Synthetic Polynucleotide
taatacgactcactatagggctccatggctgcctccgaggtggtctgggcaacagaggagagcccagatgacctcggagaacctggcggcagcgcaaaagatg

SEQ ID NO: 131367 - DNA, 103 bp, Artificial Sequence
  Synthetic Polynucleotide
taatacgactcactataggggtgtggctccctccatggctgcctccgaggaacagaggagacctcggatgcagccatggaacctggcggcagcgcaaaagatg

SEQ ID NO: 131368 - DNA, 103 bp, Artificial Sequence
  Synthetic Polynucleotide
taatacgactcactatagggctacttcttcgctgcctggttgtggtggaaaacagaggagattccacatgaaccaggcaaacctggcggcagcgcaaaagatg

SEQ ID NO: 131369 - DNA, 103 bp, Artificial Sequence
  Synthetic Polynucleotide
taatacgactcactatagggtccgggaagctgtcatcccagaggcaatggaacagaggagaccattgatgctgggatgaaacctggcggcagcgcaaaagatg

SEQ ID NO: 131370 - DNA, 103 bp, Artificial Sequence
  Synthetic Polynucleotide
taatacgactcactataggggtctggtccagtgtggctccctccatggctaacagaggagaagccatatggggagccacaacctggcggcagcgcaaaagatg

SEQ ID NO: 131371 - DNA, 103 bp, Artificial Sequence
  Synthetic Polynucleotide
taatacgactcactatagggctctgacgtagtctggtccagtgtggctccaacagaggagaggagccatgctggaccagaacctggcggcagcgcaaaagatg

SEQ ID NO: 131372 - DNA, 103 bp, Artificial Sequence
  Synthetic Polynucleotide
taatacgactcactatagggctggagcctcctctgacgtagtctggtccaaacagaggagatggaccatgctacgtcagaacctggcggcagcgcaaaagatg

SEQ ID NO: 131373 - DNA, 103 bp, Artificial Sequence
  Synthetic Polynucleotide
taatacgactcactatagggtcggtgccccctggagcctcctctgacgtaaacagaggagatacgtcatgggaggctccaacctggcggcagcgcaaaagatg

SEQ ID NO: 131374 - DNA, 103 bp, Artificial Sequence
  Synthetic Polynucleotide
taatacgactcactatagggttggatcagctcggtgccccctggagcctcaacagaggagagaggctatggggggcaccaacctggcggcagcgcaaaagatg

SEQ ID NO: 131375 - DNA, 103 bp, Artificial Sequence
  Synthetic Polynucleotide
taatacgactcactatagggctagaggagtttggatcagctcggtgccccaacagaggagaggggcaatgagctgatccaacctggcggcagcgcaaaagatg

SEQ ID NO: 131376 - DNA, 103 bp, Artificial Sequence
  Synthetic Polynucleotide
taatacgactcactataggggtgctcgaggctagaggagtttggatcagcaacagaggagagctgatatgaactcctctaacctggcggcagcgcaaaagatg

SEQ ID NO: 131377 - DNA, 103 bp, Artificial Sequence
  Synthetic Polynucleotide
taatacgactcactatagggctggtggtctgtgctcgaggctagaggagtaacagaggagaactcctatggcctcgagcaacctggcggcagcgcaaaagatg

SEQ ID NO: 131378 - DNA, 103 bp, Artificial Sequence
  Synthetic Polynucleotide
taatacgactcactatagggttgggggggtctggtggtctgtgctcgaggaacagaggagacctcgaatgcagaccaccaacctggcggcagcgcaaaagatg

SEQ ID NO: 131379 - DNA, 103 bp, Artificial Sequence
  Synthetic Polynucleotide
taatacgactcactatagggacaggtgaggttgggggggtctggtggtctaacagaggagaagaccaatggacccccccaacctggcggcagcgcaaaagatg

SEQ ID NO: 131380 - DNA, 103 bp, Artificial Sequence
  Synthetic Polynucleotide
taatacgactcactatagggctcagggccttccgggaagctgtcatcccaaacagaggagatgggatatgagcttcccgaacctggcggcagcgcaaaagatg

SEQ ID NO: 131381 - DNA, 103 bp, Artificial Sequence
  Synthetic Polynucleotide
taatacgactcactatagggagttccctgcacaggtgaggttgggggggtaacagaggagaacccccatgacctcacctaacctggcggcagcgcaaaagatg

SEQ ID NO: 131382 - DNA, 103 bp, Artificial Sequence
  Synthetic Polynucleotide
taatacgactcactatagggtctggggtgtagttccctgcacaggtgaggaacagaggagacctcacatgtgcagggaaaacctggcggcagcgcaaaagatg

SEQ ID NO: 131383 - DNA, 103 bp, Artificial Sequence
  Synthetic Polynucleotide
taatacgactcactatagggctgggagatatctggggtgtagttccctgcaacagaggagagcagggatgtacaccccaaacctggcggcagcgcaaaagatg

SEQ ID NO: 131384 - DNA, 103 bp, Artificial Sequence
  Synthetic Polynucleotide
taatacgactcactatagggaatcagtgtactgggagatatctggggtgtaacagaggagaacacccatgatatctcccaacctggcggcagcgcaaaagatg

SEQ ID NO: 131385 - DNA, 103 bp, Artificial Sequence
  Synthetic Polynucleotide
taatacgactcactatagggtgagactcccaatcagtgtactgggagataaacagaggagatatctcatggtacactgaaacctggcggcagcgcaaaagatg

SEQ ID NO: 131386 - DNA, 103 bp, Artificial Sequence
  Synthetic Polynucleotide
taatacgactcactatagggtccaaggtcctgagactcccaatcagtgtaaacagaggagatacactatgtgggagtctaacctggcggcagcgcaaaagatg

SEQ ID NO: 131387 - DNA, 103 bp, Artificial Sequence
  Synthetic Polynucleotide
taatacgactcactataggggctgcctagctccaaggtcctgagactcccaacagaggagagggagtatgaggaccttgaacctggcggcagcgcaaaagatg

SEQ ID NO: 131388 - DNA, 103 bp, Artificial Sequence
  Synthetic Polynucleotide
taatacgactcactatagggcctgagattcgctgcctagctccaaggtccaacagaggagaggacctatgagctaggcaaacctggcggcagcgcaaaagatg

SEQ ID NO: 131389 - DNA, 103 bp, Artificial Sequence
  Synthetic Polynucleotide
taatacgactcactatagggtctgaggccccctgagattcgctgcctagcaacagaggagagctaggatgcgaatctcaaacctggcggcagcgcaaaagatg

SEQ ID NO: 131390 - DNA, 103 bp, Artificial Sequence
  Synthetic Polynucleotide
taatacgactcactatagggggcctgagattctgaggccccctgagattcaacagaggagagaatctatgggggcctcaaacctggcggcagcgcaaaagatg

SEQ ID NO: 131391 - DNA, 103 bp, Artificial Sequence
  Synthetic Polynucleotide
taatacgactcactatagggcatggagccgctcagggccttccgggaagcaacagaggagagcttccatgaaggccctgaacctggcggcagcgcaaaagatg

SEQ ID NO: 131392 - DNA, 103 bp, Artificial Sequence
  Synthetic Polynucleotide
taatacgactcactatagggcctctcctggggcctgagattctgaggcccaacagaggagagggcctatgaatctcaggaacctggcggcagcgcaaaagatg

SEQ ID NO: 131393 - DNA, 103 bp, Artificial Sequence
  Synthetic Polynucleotide
taatacgactcactatagggagtaggttctcctctcctggggcctgagataacagaggagaatctcaatgcccaggagaaacctggcggcagcgcaaaagatg

SEQ ID NO: 131394 - DNA, 103 bp, Artificial Sequence
  Synthetic Polynucleotide
taatacgactcactatagggtgcctctcctagtaggttctcctctcctggaacagaggagaccaggaatggagaacctaaacctggcggcagcgcaaaagatg

SEQ ID NO: 131395 - DNA, 103 bp, Artificial Sequence
  Synthetic Polynucleotide
taatacgactcactataggggacctccagctgcctctcctagtaggttctaacagaggagaagaaccatgtaggagaggaacctggcggcagcgcaaaagatg

SEQ ID NO: 131396 - DNA, 103 bp, Artificial Sequence
  Synthetic Polynucleotide
taatacgactcactataggggccatgtcctgacctccagctgcctctcctaacagaggagaaggagaatgagctggaggaacctggcggcagcgcaaaagatg

SEQ ID NO: 131397 - DNA, 103 bp, Artificial Sequence
  Synthetic Polynucleotide
taatacgactcactatagggcatcgaatcagccatgtcctgacctccagcaacagaggagagctggaatgcaggacatgaacctggcggcagcgcaaaagatg

SEQ ID NO: 131398 - DNA, 103 bp, Artificial Sequence
  Synthetic Polynucleotide
taatacgactcactatagggcctgcatcagcatcgaatcagccatgtcctaacagaggagaaggacaatgctgattcgaaacctggcggcagcgcaaaagatg

SEQ ID NO: 131399 - DNA, 103 bp, Artificial Sequence
  Synthetic Polynucleotide
taatacgactcactatagggcccctagatccctgcatcagcatcgaatcaaacagaggagatgattcatggctgatgcaaacctggcggcagcgcaaaagatg

SEQ ID NO: 131400 - DNA, 103 bp, Artificial Sequence
  Synthetic Polynucleotide
taatacgactcactatagggatcagtgaggcccctagatccctgcatcagaacagaggagactgatgatgggatctaggaacctggcggcagcgcaaaagatg

SEQ ID NO: 131401 - DNA, 103 bp, Artificial Sequence
  Synthetic Polynucleotide
taatacgactcactatagggatatggcctgatcagtgaggcccctagatcaacagaggagagatctaatggcctcactgaacctggcggcagcgcaaaagatg

SEQ ID NO: 131402 - DNA, 103 bp, Artificial Sequence
  Synthetic Polynucleotide
taatacgactcactatagggtccttgatggcatggagccgctcagggcctaacagaggagaaggcccatggcggctccaaacctggcggcagcgcaaaagatg

SEQ ID NO: 131403 - DNA, 103 bp, Artificial Sequence
  Synthetic Polynucleotide
taatacgactcactatagggacagcataaaatatggcctgatcagtgaggaacagaggagacctcacatgtcaggccataacctggcggcagcgcaaaagatg

SEQ ID NO: 131404 - DNA, 103 bp, Artificial Sequence
  Synthetic Polynucleotide
taatacgactcactatagggcagtggtgtcacagcataaaatatggcctgaacagaggagacaggccatgttttatgctaacctggcggcagcgcaaaagatg

SEQ ID NO: 131405 - DNA, 103 bp, Artificial Sequence
  Synthetic Polynucleotide
taatacgactcactataggggacaccagggcagtggtgtcacagcataaaaacagaggagatttatgatgtgacaccacaacctggcggcagcgcaaaagatg

SEQ ID NO: 131406 - DNA, 103 bp, Artificial Sequence
  Synthetic Polynucleotide
taatacgactcactatagggaccaaatggggacaccagggcagtggtgtcaacagaggagagacaccatggccctggtgaacctggcggcagcgcaaaagatg

SEQ ID NO: 131407 - DNA, 103 bp, Artificial Sequence
  Synthetic Polynucleotide
taatacgactcactataggggcatactgccaccaaatggggacaccagggaacagaggagaccctggatgccccatttgaacctggcggcagcgcaaaagatg

SEQ ID NO: 131408 - DNA, 103 bp, Artificial Sequence
  Synthetic Polynucleotide
taatacgactcactatagggcaggtatggggcatactgccaccaaatgggaacagaggagacccattatgtggcagtataacctggcggcagcgcaaaagatg

SEQ ID NO: 131409 - DNA, 103 bp, Artificial Sequence
  Synthetic Polynucleotide
taatacgactcactatagggaggcctgctgcaggtatggggcatactgccaacagaggagaggcagtatgccccataccaacctggcggcagcgcaaaagatg

SEQ ID NO: 131410 - DNA, 103 bp, Artificial Sequence
  Synthetic Polynucleotide
taatacgactcactatagggggtcacgtctaggcctgctgcaggtatgggaacagaggagacccataatggcagcaggcaacctggcggcagcgcaaaagatg

SEQ ID NO: 131411 - DNA, 103 bp, Artificial Sequence
  Synthetic Polynucleotide
taatacgactcactatagggcacaaggttgggtcacgtctaggcctgctgaacagaggagacagcagatgtagacgtgaaacctggcggcagcgcaaaagatg

SEQ ID NO: 131412 - DNA, 103 bp, Artificial Sequence
  Synthetic Polynucleotide
taatacgactcactatagggccacagtccccacaaggttgggtcacgtctaacagaggagaagacgtatgccaaccttgaacctggcggcagcgcaaaagatg

SEQ ID NO: 131413 - DNA, 103 bp, Artificial Sequence
  Synthetic Polynucleotide
taatacgactcactataggggatcagttgctccttgatggcatggagccgaacagaggagacggctcatggccatcaagaacctggcggcagcgcaaaagatg

SEQ ID NO: 131414 - DNA, 103 bp, Artificial Sequence
  Synthetic Polynucleotide
taatacgactcactatagggttggattgttccacagtccccacaaggttgaacagaggagacaacctatgggggactgtaacctggcggcagcgcaaaagatg

SEQ ID NO: 131415 - DNA, 103 bp, Artificial Sequence
  Synthetic Polynucleotide
taatacgactcactatagggcccaattctcttggattgttccacagtcccaacagaggagagggactatggaacaatccaacctggcggcagcgcaaaagatg

SEQ ID NO: 131416 - DNA, 103 bp, Artificial Sequence
  Synthetic Polynucleotide
taatacgactcactataggggagagacacacccaattctcttggattgttaacagaggagaaacaatatgagagaattgaacctggcggcagcgcaaaagatg

SEQ ID NO: 131417 - DNA, 103 bp, Artificial Sequence
  Synthetic Polynucleotide
taatacgactcactatagggctgatagcaagagagacacacccaattctcaacagaggagagagaatatggtgtgtctcaacctggcggcagcgcaaaagatg

SEQ ID NO: 131418 - DNA, 103 bp, Artificial Sequence
  Synthetic Polynucleotide
taatacgactcactatagggcacagtagacctgatagcaagagagacacaaacagaggagatgtgtcatgcttgctatcaacctggcggcagcgcaaaagatg

SEQ ID NO: 131419 - DNA, 103 bp, Artificial Sequence
  Synthetic Polynucleotide
taatacgactcactatagggatgtaacgaccacagtagacctgatagcaaaacagaggagattgctaatgggtctactgaacctggcggcagcgcaaaagatg

SEQ ID NO: 131420 - DNA, 103 bp, Artificial Sequence
  Synthetic Polynucleotide
taatacgactcactataggggtggccattgatgtaacgaccacagtagacaacagaggagagtctacatgggtcgttacaacctggcggcagcgcaaaagatg

SEQ ID NO: 131421 - DNA, 103 bp, Artificial Sequence
  Synthetic Polynucleotide
taatacgactcactataggggttggagcatgtggccattgatgtaacgacaacagaggagagtcgttatgtcaatggccaacctggcggcagcgcaaaagatg

SEQ ID NO: 131422 - DNA, 103 bp, Artificial Sequence
  Synthetic Polynucleotide
taatacgactcactatagggtttccatggtgttggagcatgtggccattgaacagaggagacaatggatgcatgctccaaacctggcggcagcgcaaaagatg

SEQ ID NO: 131423 - DNA, 103 bp, Artificial Sequence
  Synthetic Polynucleotide
taatacgactcactataggggtgtccagaatttccatggtgttggagcataacagaggagaatgctcatgcaccatggaaacctggcggcagcgcaaaagatg

SEQ ID NO: 131424 - DNA, 103 bp, Artificial Sequence
  Synthetic Polynucleotide
taatacgactcactatagggggccctcctggatcagttgctccttgatggaacagaggagaccatcaatgagcaactgaaacctggcggcagcgcaaaagatg

SEQ ID NO: 131425 - DNA, 103 bp, Artificial Sequence
  Synthetic Polynucleotide
taatacgactcactatagggggaccagcgggtgtccagaatttccatggtaacagaggagaaccatgatgattctggacaacctggcggcagcgcaaaagatg

SEQ ID NO: 131426 - DNA, 103 bp, Artificial Sequence
  Synthetic Polynucleotide
taatacgactcactatagggatgtagctgaggaccagcgggtgtccagaaaacagaggagattctggatgcccgctggtaacctggcggcagcgcaaaagatg

SEQ ID NO: 131427 - DNA, 103 bp, Artificial Sequence
  Synthetic Polynucleotide
taatacgactcactatagggtgacaggtcgatgtagctgaggaccagcggaacagaggagaccgctgatgctcagctacaacctggcggcagcgcaaaagatg

SEQ ID NO: 131428 - DNA, 103 bp, Artificial Sequence
  Synthetic Polynucleotide
taatacgactcactatagggaacaccaggctgacaggtcgatgtagctgaaacagaggagatcagctatgtcgacctgtaacctggcggcagcgcaaaagatg

SEQ ID NO: 131429 - DNA, 103 bp, Artificial Sequence
  Synthetic Polynucleotide
taatacgactcactatagggtgacagtagtaacaccaggctgacaggtcgaacagaggagacgacctatgagcctggtgaacctggcggcagcgcaaaagatg

SEQ ID NO: 131430 - DNA, 103 bp, Artificial Sequence
  Synthetic Polynucleotide
taatacgactcactataggggacataggcctgacagtagtaacaccaggcaacagaggagagcctggatgtactactgtaacctggcggcagcgcaaaagatg

SEQ ID NO: 131431 - DNA, 103 bp, Artificial Sequence
  Synthetic Polynucleotide
taatacgactcactatagggcctggtggtggacataggcctgacagtagtaacagaggagaactactatgaggcctatgaacctggcggcagcgcaaaagatg

SEQ ID NO: 131432 - DNA, 103 bp, Artificial Sequence
  Synthetic Polynucleotide
taatacgactcactatagggtctaggagagcctggtggtggacataggccaacagaggagaggcctaatgccaccaccaaacctggcggcagcgcaaaagatg

SEQ ID NO: 131433 - DNA, 103 bp, Artificial Sequence
  Synthetic Polynucleotide
taatacgactcactataggggttcttcacatctaggagagcctggtggtgaacagaggagacaccacatggctctcctaaacctggcggcagcgcaaaagatg

SEQ ID NO: 131434 - DNA, 103 bp, Artificial Sequence
  Synthetic Polynucleotide
taatacgactcactatagggggtgggcgatgttcttcacatctaggagagaacagaggagactctccatgatgtgaagaaacctggcggcagcgcaaaagatg

SEQ ID NO: 131435 - DNA, 103 bp, Artificial Sequence
  Synthetic Polynucleotide
taatacgactcactatagggcgatctaggaggccctcctggatcagttgcaacagaggagagcaactatgccaggagggaacctggcggcagcgcaaaagatg

SEQ ID NO: 131436 - DNA, 103 bp, Artificial Sequence
  Synthetic Polynucleotide
taatacgactcactatagggaacttgttctggtgggcgatgttcttcacaaacagaggagatgtgaaatgcatcgcccaaacctggcggcagcgcaaaagatg

SEQ ID NO: 131437 - DNA, 103 bp, Artificial Sequence
  Synthetic Polynucleotide
taatacgactcactatagggatcctccccaaacttgttctggtgggcgataacagaggagaatcgccatgcagaacaagaacctggcggcagcgcaaaagatg

SEQ ID NO: 131438 - DNA, 103 bp, Artificial Sequence
  Synthetic Polynucleotide
taatacgactcactatagggggtggggcatatcctccccaaacttgttctaacagaggagaagaacaatgttggggaggaacctggcggcagcgcaaaagatg

SEQ ID NO: 131439 - DNA, 103 bp, Artificial Sequence
  Synthetic Polynucleotide
taatacgactcactatagggggacacgcagcgatctaggaggccctcctgaacagaggagacaggagatgctcctagataacctggcggcagcgcaaaagatg

SEQ ID NO: 131440 - DNA, 103 bp, Artificial Sequence
  Synthetic Polynucleotide
taatacgactcactataggggggcctgaaaggacacgcagcgatctaggaaacagaggagatcctagatggctgcgtgtaacctggcggcagcgcaaaagatg

SEQ ID NO: 131441 - DNA, 103 bp, Artificial Sequence
  Synthetic Polynucleotide
taatacgactcactatagggtcagcaaaccgggcctgaaaggacacgcagaacagaggagactgcgtatgctttcaggcaacctggcggcagcgcaaaagatg

SEQ ID NO: 131442 - DNA, 103 bp, Artificial Sequence
  Synthetic Polynucleotide
taatacgactcactatagggggggttctgcctacttcttcgctgcctggtaacagaggagaaccaggatgcgaagaagtaacctggcggcagcgcaaaagatg

SEQ ID NO: 131443 - DNA, 103 bp, Artificial Sequence
  Synthetic Polynucleotide
taatacgactcactatagggctcttccttttcagcaaaccgggcctgaaaaacagaggagatttcagatgcggtttgctaacctggcggcagcgcaaaagatg

SEQ ID NO: 131444 - DNA, 103 bp, Artificial Sequence
  Synthetic Polynucleotide
taatacgactcactatagggccaacatcagctcttccttttcagcaaaccaacagaggagaggtttgatgaaaaggaagaacctggcggcagcgcaaaagatg

SEQ ID NO: 131445 - DNA, 103 bp, Artificial Sequence
  Synthetic Polynucleotide
taatacgactcactatagggaggctgtgaaccaacatcagctcttcctttaacagaggagaaaaggaatggctgatgttaacctggcggcagcgcaaaagatg

SEQ ID NO: 131446 - DNA, 103 bp, Artificial Sequence
  Synthetic Polynucleotide
taatacgactcactatagggaatatattctaggctgtgaaccaacatcagaacagaggagactgatgatggttcacagcaacctggcggcagcgcaaaagatg

SEQ ID NO: 131447 - DNA, 103 bp, Artificial Sequence
  Synthetic Polynucleotide
taatacgactcactatagggccatcagatcaatatattctaggctgtgaaaacagaggagattcacaatgtagaatataaacctggcggcagcgcaaaagatg

SEQ ID NO: 131448 - DNA, 103 bp, Artificial Sequence
  Synthetic Polynucleotide
taatacgactcactatagggtgggttgtttccatcagatcaatatattctaacagaggagaagaataatgtgatctgataacctggcggcagcgcaaaagatg

SEQ ID NO: 131449 - DNA, 103 bp, Artificial Sequence
  Synthetic Polynucleotide
taatacgactcactatagggattcatgtactgggttgtttccatcagatcaacagaggagagatctgatggaaacaaccaacctggcggcagcgcaaaagatg

SEQ ID NO: 131450 - DNA, 103 bp, Artificial Sequence
  Synthetic Polynucleotide
taatacgactcactataggggttctccctcattcatgtactgggttgtttaacagaggagaaaacaaatgagtacatgaaacctggcggcagcgcaaaagatg

SEQ ID NO: 131451 - DNA, 103 bp, Artificial Sequence
  Synthetic Polynucleotide
taatacgactcactatagggaggacacggagttctccctcattcatgtacaacagaggagagtacatatgtgagggagaaacctggcggcagcgcaaaagatg

SEQ ID NO: 131452 - DNA, 103 bp, Artificial Sequence
  Synthetic Polynucleotide
taatacgactcactatagggggtgtctgctaggacacggagttctccctcaacagaggagagagggaatgctccgtgtcaacctggcggcagcgcaaaagatg

SEQ ID NO: 131453 - DNA, 103 bp, Artificial Sequence
  Synthetic Polynucleotide
taatacgactcactatagggggggcgactgggggttctgcctacttcttcaacagaggagagaagaaatgggcagaaccaacctggcggcagcgcaaaagatg

SEQ ID NO: 131454 - DNA, 103 bp, Artificial Sequence
  Synthetic Polynucleotide
taatacgactcactatagggctgagtcgtaggtgtctgctaggacacggaaacagaggagatccgtgatgtagcagacaaacctggcggcagcgcaaaagatg

SEQ ID NO: 131455 - DNA, 103 bp, Artificial Sequence
  Synthetic Polynucleotide
taatacgactcactatagggtgcagataaactgagtcgtaggtgtctgctaacagaggagaagcagaatgctacgactcaacctggcggcagcgcaaaagatg

SEQ ID NO: 131456 - DNA, 103 bp, Artificial Sequence
  Synthetic Polynucleotide
taatacgactcactatagggtgagttcggatgcagataaactgagtcgtaaacagaggagatacgacatggtttatctgaacctggcggcagcgcaaaagatg

SEQ ID NO: 131457 - DNA, 103 bp, Artificial Sequence
  Synthetic Polynucleotide
taatacgactcactatagggcacaggagtatgagttcggatgcagataaaaacagaggagatttatcatgatccgaactaacctggcggcagcgcaaaagatg

SEQ ID NO: 131458 - DNA, 103 bp, Artificial Sequence
  Synthetic Polynucleotide
taatacgactcactataggggccaggcaggcacaggagtatgagttcggaaacagaggagatccgaaatgatactcctgaacctggcggcagcgcaaaagatg

SEQ ID NO: 131459 - DNA, 103 bp, Artificial Sequence
  Synthetic Polynucleotide
taatacgactcactatagggagagcctgaggccaggcaggcacaggagtaaacagaggagatactccatggcctgcctgaacctggcggcagcgcaaaagatg

SEQ ID NO: 131460 - DNA, 103 bp, Artificial Sequence
  Synthetic Polynucleotide
taatacgactcactataggggcctgaggacagagcctgaggccaggcaggaacagaggagacctgccatgcctcaggctaacctggcggcagcgcaaaagatg

SEQ ID NO: 131461 - DNA, 103 bp, Artificial Sequence
  Synthetic Polynucleotide
taatacgactcactataggggcatccaccagcctgaggacagagcctgagaacagaggagactcaggatgtgtcctcagaacctggcggcagcgcaaaagatg

SEQ ID NO: 131462 - DNA, 103 bp, Artificial Sequence
  Synthetic Polynucleotide
taatacgactcactatagggccccaggaccgcatccaccagcctgaggacaacagaggagagtcctcatgctggtggataacctggcggcagcgcaaaagatg

SEQ ID NO: 131463 - DNA, 103 bp, Artificial Sequence
  Synthetic Polynucleotide
taatacgactcactatagggggatctcagcccccaggaccgcatccaccaaacagaggagatggtggatgcggtcctggaacctggcggcagcgcaaaagatg

SEQ ID NO: 131464 - DNA, 103 bp, Artificial Sequence
  Synthetic Polynucleotide
taatacgactcactataggggagtcctgagggggcgactgggggttctgcaacagaggagagcagaaatgccagtcgccaacctggcggcagcgcaaaagatg

SEQ ID NO: 131465 - DNA, 103 bp, Artificial Sequence
  Synthetic Polynucleotide
taatacgactcactatagggatgccattccggatctcagcccccaggaccaacagaggagaggtcctatgggctgagataacctggcggcagcgcaaaagatg

SEQ ID NO: 131466 - DNA, 103 bp, Artificial Sequence
  Synthetic Polynucleotide
taatacgactcactatagggaatgatggccatgccattccggatctcagcaacagaggagagctgagatgcggaatggcaacctggcggcagcgcaaaagatg

SEQ ID NO: 131467 - DNA, 103 bp, Artificial Sequence
  Synthetic Polynucleotide
taatacgactcactatagggcaggaggcctaatgatggccatgccattccaacagaggagaggaatgatgtggccatcaaacctggcggcagcgcaaaagatg

SEQ ID NO: 131468 - DNA, 103 bp, Artificial Sequence
  Synthetic Polynucleotide
taatacgactcactataggggcgtgatgtccaggaggcctaatgatggccaacagaggagaggccatatgtaggcctccaacctggcggcagcgcaaaagatg

SEQ ID NO: 131469 - DNA, 103 bp, Artificial Sequence
  Synthetic Polynucleotide
taatacgactcactatagggactgtgctgggcgtgatgtccaggaggcctaacagaggagaaggcctatgggacatcacaacctggcggcagcgcaaaagatg

SEQ ID NO: 131470 - DNA, 103 bp, Artificial Sequence
  Synthetic Polynucleotide
taatacgactcactatagggcatccataagactgtgctgggcgtgatgtcaacagaggagagacatcatgcccagcacaaacctggcggcagcgcaaaagatg

SEQ ID NO: 131471 - DNA, 103 bp, Artificial Sequence
  Synthetic Polynucleotide
taatacgactcactatagggatgcaatagccatccataagactgtgctggaacagaggagaccagcaatgtcttatggaaacctggcggcagcgcaaaagatg

SEQ ID NO: 131472 - DNA, 103 bp, Artificial Sequence
  Synthetic Polynucleotide
taatacgactcactataggggtggttgaacatgcaatagccatccataagaacagaggagacttatgatgggctattgcaacctggcggcagcgcaaaagatg

SEQ ID NO: 131473 - DNA, 103 bp, Artificial Sequence
  Synthetic Polynucleotide
taatacgactcactatagggccacagccacgtggttgaacatgcaatagcaacagaggagagctattatgtgttcaaccaacctggcggcagcgcaaaagatg

SEQ ID NO: 131474 - DNA, 103 bp, Artificial Sequence
  Synthetic Polynucleotide
taatacgactcactatagggtagcgggctgccacagccacgtggttgaacaacagaggagagttcaaatgcgtggctgtaacctggcggcagcgcaaaagatg

SEQ ID NO: 131475 - DNA, 103 bp, Artificial Sequence
  Synthetic Polynucleotide
taatacgactcactatagggagtgacactggagtcctgagggggcgactgaacagaggagacagtcgatgcctcaggacaacctggcggcagcgcaaaagatg

SEQ ID NO: 131476 - DNA, 103 bp, Artificial Sequence
  Synthetic Polynucleotide
taatacgactcactatagggctgttgagcatagcgggctgccacagccacaacagaggagagtggctatggcagcccgcaacctggcggcagcgcaaaagatg

SEQ ID NO: 131477 - DNA, 103 bp, Artificial Sequence
  Synthetic Polynucleotide
taatacgactcactatagggtgcggtgtttctgttgagcatagcgggctgaacagaggagacagcccatgatgctcaacaacctggcggcagcgcaaaagatg

SEQ ID NO: 131478 - DNA, 103 bp, Artificial Sequence
  Synthetic Polynucleotide
taatacgactcactatagggaccctccggatgcggtgtttctgttgagcaaacagaggagatgctcaatggaaacaccgaacctggcggcagcgcaaaagatg

SEQ ID NO: 131479 - DNA, 103 bp, Artificial Sequence
  Synthetic Polynucleotide
taatacgactcactatagggtacgataaggaccctccggatgcggtgtttaacagaggagaaaacacatgatccggaggaacctggcggcagcgcaaaagatg

SEQ ID NO: 131480 - DNA, 103 bp, Artificial Sequence
  Synthetic Polynucleotide
taatacgactcactatagggcatcccaatctacgataaggaccctccggaaacagaggagatccggaatgtccttatcgaacctggcggcagcgcaaaagatg

SEQ ID NO: 131481 - DNA, 103 bp, Artificial Sequence
  Synthetic Polynucleotide
taatacgactcactatagggccgtggtgcacatcccaatctacgataaggaacagaggagaccttatatgagattgggaaacctggcggcagcgcaaaagatg

SEQ ID NO: 131482 - DNA, 103 bp, Artificial Sequence
  Synthetic Polynucleotide
taatacgactcactatagggtgttccttgaccgtggtgcacatcccaatcaacagaggagagattggatggtgcaccacaacctggcggcagcgcaaaagatg

SEQ ID NO: 131483 - DNA, 103 bp, Artificial Sequence
  Synthetic Polynucleotide
taatacgactcactatagggaggtgaactgtgttccttgaccgtggtgcaaacagaggagatgcaccatggtcaaggaaaacctggcggcagcgcaaaagatg

SEQ ID NO: 131484 - DNA, 103 bp, Artificial Sequence
  Synthetic Polynucleotide
taatacgactcactatagggtcctggtcgaaggtgaactgtgttccttgaaacagaggagatcaaggatgacagttcacaacctggcggcagcgcaaaagatg

SEQ ID NO: 131485 - DNA, 103 bp, Artificial Sequence
  Synthetic Polynucleotide
taatacgactcactataggggacactggggtcctggtcgaaggtgaactgaacagaggagacagttcatgttcgaccagaacctggcggcagcgcaaaagatg

SEQ ID NO: 131486 - DNA, 103 bp, Artificial Sequence
  Synthetic Polynucleotide
taatacgactcactatagggttcgcttcgaagtgacactggagtcctgagaacagaggagactcaggatgccagtgtcaaacctggcggcagcgcaaaagatg

SEQ ID NO: 131487 - DNA, 103 bp, Artificial Sequence
  Synthetic Polynucleotide
taatacgactcactatagggagaaatagaggacactggggtcctggtcgaaacagaggagatcgaccatgaccccagtgaacctggcggcagcgcaaaagatg

SEQ ID NO: 131488 - DNA, 103 bp, Artificial Sequence
  Synthetic Polynucleotide
taatacgactcactatagggcggtggatggagaaatagaggacactggggaacagaggagaccccagatgcctctatttaacctggcggcagcgcaaaagatg

SEQ ID NO: 131489 - DNA, 103 bp, Artificial Sequence
  Synthetic Polynucleotide
taatacgactcactatagggctgctcgtagcggtggatggagaaatagagaacagaggagactctatatgtccatccacaacctggcggcagcgcaaaagatg

SEQ ID NO: 131490 - DNA, 103 bp, Artificial Sequence
  Synthetic Polynucleotide
taatacgactcactatagggagaacctaccctgctcgtagcggtggatggaacagaggagaccatccatggctacgagcaacctggcggcagcgcaaaagatg

SEQ ID NO: 131491 - DNA, 103 bp, Artificial Sequence
  Synthetic Polynucleotide
taatacgactcactatagggaggtggggccagaacctaccctgctcgtagaacagaggagactacgaatggggtaggttaacctggcggcagcgcaaaagatg

SEQ ID NO: 131492 - DNA, 103 bp, Artificial Sequence
  Synthetic Polynucleotide
taatacgactcactatagggagaggccttcaggtggggccagaacctaccaacagaggagaggtaggatgtggccccacaacctggcggcagcgcaaaagatg

SEQ ID NO: 131493 - DNA, 103 bp, Artificial Sequence
  Synthetic Polynucleotide
taatacgactcactatagggtggaccagttagaggccttcaggtggggccaacagaggagaggccccatgtgaaggcctaacctggcggcagcgcaaaagatg

SEQ ID NO: 131494 - DNA, 103 bp, Artificial Sequence
  Synthetic Polynucleotide
taatacgactcactatagggaaacctgtggtggaccagttagaggccttcaacagaggagagaaggcatgtaactggtcaacctggcggcagcgcaaaagatg

SEQ ID NO: 131495 - DNA, 103 bp, Artificial Sequence
  Synthetic Polynucleotide
taatacgactcactataggggccttggccgaaacctgtggtggaccagttaacagaggagaaactggatgaccacaggtaacctggcggcagcgcaaaagatg

SEQ ID NO: 131496 - DNA, 103 bp, Artificial Sequence
  Synthetic Polynucleotide
taatacgactcactatagggtatatccttggccttggccgaaacctgtggaacagaggagaccacagatgtcggccaagaacctggcggcagcgcaaaagatg

SEQ ID NO: 131497 - DNA, 103 bp, Artificial Sequence
  Synthetic Polynucleotide
taatacgactcactatagggtttttaatatttcgcttcgaagtgacactgaacagaggagacagtgtatgttcgaagcgaacctggcggcagcgcaaaagatg

SEQ ID NO: 131498 - DNA, 103 bp, Artificial Sequence
  Synthetic Polynucleotide
taatacgactcactatagggacattgatggtatatccttggccttggccgaacagaggagacggccaatgccaaggataaacctggcggcagcgcaaaagatg

SEQ ID NO: 131499 - DNA, 103 bp, Artificial Sequence
  Synthetic Polynucleotide
taatacgactcactataggggttccaaggcacattgatggtatatccttgaacagaggagacaaggaatgaccatcaataacctggcggcagcgcaaaagatg

SEQ ID NO: 131500 - DNA, 103 bp, Artificial Sequence
  Synthetic Polynucleotide
taatacgactcactatagggtccccacctggttccaaggcacattgatggaacagaggagaccatcaatgtgccttggaaacctggcggcagcgcaaaagatg

SEQ ID NO: 131501 - DNA, 103 bp, Artificial Sequence
  Synthetic Polynucleotide
taatacgactcactataggggcatcccgcatccccacctggttccaaggcaacagaggagagccttgatgccaggtgggaacctggcggcagcgcaaaagatg

SEQ ID NO: 131502 - DNA, 103 bp, Artificial Sequence
  Synthetic Polynucleotide
taatacgactcactatagggaatgtagtcagcatcccgcatccccacctgaacagaggagacaggtgatgatgcgggataacctggcggcagcgcaaaagatg

SEQ ID NO: 131503 - DNA, 103 bp, Artificial Sequence
  Synthetic Polynucleotide
taatacgactcactatagggggaaagcagcaatgtagtcagcatcccgcaaacagaggagatgcgggatgctgactacaaacctggcggcagcgcaaaagatg

SEQ ID NO: 131504 - DNA, 103 bp, Artificial Sequence
  Synthetic Polynucleotide
taatacgactcactatagggaggacgtgcaggaaagcagcaatgtagtcaaacagaggagatgactaatgtgctgctttaacctggcggcagcgcaaaagatg

SEQ ID NO: 131505 - DNA, 103 bp, Artificial Sequence
  Synthetic Polynucleotide
taatacgactcactataggggactggcagcaggacgtgcaggaaagcagcaacagaggagagctgctatgctgcacgtcaacctggcggcagcgcaaaagatg

SEQ ID NO: 131506 - DNA, 103 bp, Artificial Sequence
  Synthetic Polynucleotide
taatacgactcactatagggactcgagggcgactggcagcaggacgtgcaaacagaggagatgcacgatgtgctgccagaacctggcggcagcgcaaaagatg

SEQ ID NO: 131507 - DNA, 103 bp, Artificial Sequence
  Synthetic Polynucleotide
taatacgactcactatagggtgaggctggaactcgagggcgactggcagcaacagaggagagctgccatgcgccctcgaaacctggcggcagcgcaaaagatg

SEQ ID NO: 131508 - DNA, 103 bp, Artificial Sequence
  Synthetic Polynucleotide
taatacgactcactatagggtcttttgcgttccttgagcttgtctgacataacagaggagaatgtcaatgaagctcaagaacctggcggcagcgcaaaagatg

SEQ ID NO: 131509 - DNA, 103 bp, Artificial Sequence
  Synthetic Polynucleotide
taatacgactcactatagggggccatgggcactgtcttgcccagctcgttaacagaggagaaacgagatgggcaagacaaacctggcggcagcgcaaaagatg

SEQ ID NO: 131510 - DNA, 103 bp, Artificial Sequence
  Synthetic Polynucleotide
taatacgactcactataggggcttcgccaaggccatgggcactgtcttgcaacagaggagagcaagaatgtgcccatggaacctggcggcagcgcaaaagatg

SEQ ID NO: 131511 - DNA, 103 bp, Artificial Sequence
  Synthetic Polynucleotide
taatacgactcactatagggccggaactctgcttcgccaaggccatgggcaacagaggagagcccatatgcttggcgaaaacctggcggcagcgcaaaagatg

SEQ ID NO: 131512 - DNA, 103 bp, Artificial Sequence
  Synthetic Polynucleotide
taatacgactcactatagggctccagcttcccggaactctgcttcgccaaaacagaggagattggcgatgcagagttccaacctggcggcagcgcaaaagatg

SEQ ID NO: 131513 - DNA, 103 bp, Artificial Sequence
  Synthetic Polynucleotide
taatacgactcactatagggtctccgccttctccagcttcccggaactctaacagaggagaagagttatgggaagctggaacctggcggcagcgcaaaagatg

SEQ ID NO: 131514 - DNA, 103 bp, Artificial Sequence
  Synthetic Polynucleotide
taatacgactcactatagggatctcgaggatctccgccttctccagcttcaacagaggagagaagctatggaaggcggaaacctggcggcagcgcaaaagatg

SEQ ID NO: 131515 - DNA, 103 bp, Artificial Sequence
  Synthetic Polynucleotide
taatacgactcactatagggctgaacggtcatctcgaggatctccgccttaacagaggagaaaggcgatgatcctcgagaacctggcggcagcgcaaaagatg

SEQ ID NO: 131516 - DNA, 103 bp, Artificial Sequence
  Synthetic Polynucleotide
taatacgactcactatagggctctcaggtactgaacggtcatctcgaggaaacagaggagatcctcgatgtgaccgttcaacctggcggcagcgcaaaagatg

SEQ ID NO: 131517 - DNA, 103 bp, Artificial Sequence
  Synthetic Polynucleotide
taatacgactcactataggggagtgcagtgctctcaggtactgaacggtcaacagaggagagaccgtatggtacctgagaacctggcggcagcgcaaaagatg

SEQ ID NO: 131518 - DNA, 103 bp, Artificial Sequence
  Synthetic Polynucleotide
taatacgactcactatagggaaaatcagcggagtgcagtgctctcaggtaaacagaggagatacctgatggcactgcacaacctggcggcagcgcaaaagatg

SEQ ID NO: 131519 - DNA, 103 bp, Artificial Sequence
  Synthetic Polynucleotide
taatacgactcactatagggaaacgggggttcttttgcgttccttgagctaacagaggagaagctcaatgaacgcaaaaaacctggcggcagcgcaaaagatg

SEQ ID NO: 131520 - DNA, 103 bp, Artificial Sequence
  Synthetic Polynucleotide
taatacgactcactatagggttccccggggaaaatcagcggagtgcagtgaacagaggagacactgcatgccgctgattaacctggcggcagcgcaaaagatg

SEQ ID NO: 131521 - DNA, 103 bp, Artificial Sequence
  Synthetic Polynucleotide
taatacgactcactatagggtctttttcccttccccggggaaaatcagcgaacagaggagacgctgaatgtccccggggaacctggcggcagcgcaaaagatg

SEQ ID NO: 131522 - DNA, 103 bp, Artificial Sequence
  Synthetic Polynucleotide
taatacgactcactatagggcgctagaagttctttttcccttccccggggaacagaggagaccccggatgagggaaaaaaacctggcggcagcgcaaaagatg

SEQ ID NO: 131523 - DNA, 103 bp, Artificial Sequence
  Synthetic Polynucleotide
taatacgactcactatagggtggcaaactccgctagaagttctttttcccaacagaggagagggaaaatgaacttctagaacctggcggcagcgcaaaagatg

SEQ ID NO: 131524 - DNA, 103 bp, Artificial Sequence
  Synthetic Polynucleotide
taatacgactcactatagggtggaagtagttggcaaactccgctagaagtaacagaggagaacttctatgggagtttgcaacctggcggcagcgcaaaagatg

SEQ ID NO: 131525 - DNA, 103 bp, Artificial Sequence
  Synthetic Polynucleotide
taatacgactcactataggggtagccatagtggaagtagttggcaaactcaacagaggagagagtttatgaactacttcaacctggcggcagcgcaaaagatg

SEQ ID NO: 131526 - DNA, 103 bp, Artificial Sequence
  Synthetic Polynucleotide
taatacgactcactatagggtgcactcgtggtagccatagtggaagtagtaacagaggagaactactatgactatggctaacctggcggcagcgcaaaagatg

SEQ ID NO: 131527 - DNA, 103 bp, Artificial Sequence
  Synthetic Polynucleotide
taatacgactcactatagggaggttcttcatgcactcgtggtagccatagaacagaggagactatggatgccacgagtgaacctggcggcagcgcaaaagatg

SEQ ID NO: 131528 - DNA, 103 bp, Artificial Sequence
  Synthetic Polynucleotide
taatacgactcactataggggtaatgcaccaggttcttcatgcactcgtgaacagaggagacacgagatgatgaagaacaacctggcggcagcgcaaaagatg

SEQ ID NO: 131529 - DNA, 103 bp, Artificial Sequence
  Synthetic Polynucleotide
taatacgactcactatagggccgtggtgaggtaatgcaccaggttcttcaaacagaggagatgaagaatgtggtgcattaacctggcggcagcgcaaaagatg

SEQ ID NO: 131530 - DNA, 103 bp, Artificial Sequence
  Synthetic Polynucleotide
taatacgactcactatagggactttatgagaaacgggggttcttttgcgtaacagaggagaacgcaaatgaacccccgtaacctggcggcagcgcaaaagatg

SEQ ID NO: 131531 - DNA, 103 bp, Artificial Sequence
  Synthetic Polynucleotide
taatacgactcactatagggatccgctccaccgtggtgaggtaatgcaccaacagaggagaggtgcaatgcctcaccacaacctggcggcagcgcaaaagatg

SEQ ID NO: 131532 - DNA, 103 bp, Artificial Sequence
  Synthetic Polynucleotide
taatacgactcactatagggcttggtctccatccgctccaccgtggtgagaacagaggagactcaccatggtggagcggaacctggcggcagcgcaaaagatg

SEQ ID NO: 131533 - DNA, 103 bp, Artificial Sequence
  Synthetic Polynucleotide
taatacgactcactatagggacttcgtgtccttggtctccatccgctccaaacagaggagatggagcatgtggagaccaaacctggcggcagcgcaaaagatg

SEQ ID NO: 131534 - DNA, 103 bp, Artificial Sequence
  Synthetic Polynucleotide
taatacgactcactatagggatgcgcgcgtacttcgtgtccttggtctccaacagaggagaggagacatgggacacgaaaacctggcggcagcgcaaaagatg

SEQ ID NO: 131535 - DNA, 103 bp, Artificial Sequence
  Synthetic Polynucleotide
taatacgactcactataggggaaggcgaggatgcgcgcgtacttcgtgtcaacagaggagagacacgatgtacgcgcgcaacctggcggcagcgcaaaagatg

SEQ ID NO: 131536 - DNA, 103 bp, Artificial Sequence
  Synthetic Polynucleotide
taatacgactcactatagggtggactgcaagaaggcgaggatgcgcgcgtaacagaggagaacgcgcatgtcctcgcctaacctggcggcagcgcaaaagatg

SEQ ID NO: 131537 - DNA, 103 bp, Artificial Sequence
  Synthetic Polynucleotide
taatacgactcactatagggaggcgggccttggactgcaagaaggcgaggaacagaggagacctcgcatgcttgcagtcaacctggcggcagcgcaaaagatg

SEQ ID NO: 131538 - DNA, 103 bp, Artificial Sequence
  Synthetic Polynucleotide
taatacgactcactatagggctccgcgcccaggcgggccttggactgcaaaacagaggagattgcagatgaaggcccgcaacctggcggcagcgcaaaagatg

SEQ ID NO: 131539 - DNA, 103 bp, Artificial Sequence
  Synthetic Polynucleotide
taatacgactcactataggggaaaggcgggctccgcgcccaggcgggcctaacagaggagaaggcccatgtgggcgcggaacctggcggcagcgcaaaagatg

SEQ ID NO: 131540 - DNA, 103 bp, Artificial Sequence
  Synthetic Polynucleotide
taatacgactcactatagggcccagcggcggaaaggcgggctccgcgcccaacagaggagagggcgcatggcccgccttaacctggcggcagcgcaaaagatg

SEQ ID NO: 131541 - DNA, 103 bp, Artificial Sequence
  Synthetic Polynucleotide
taatacgactcactatagggcttttctatcactttatgagaaacgggggtaacagaggagaacccccatgtctcataaaaacctggcggcagcgcaaaagatg

SEQ ID NO: 131542 - DNA, 103 bp, Artificial Sequence
  Synthetic Polynucleotide
taatacgactcactatagggcgggagcgaacccagcggcggaaaggcgggaacagaggagacccgccatgccgccgctgaacctggcggcagcgcaaaagatg

SEQ ID NO: 131543 - DNA, 103 bp, Artificial Sequence
  Synthetic Polynucleotide
taatacgactcactatagggaatccggctccgggagcgaacccagcggcgaacagaggagacgccgcatggttcgctccaacctggcggcagcgcaaaagatg

SEQ ID NO: 131544 - DNA, 103 bp, Artificial Sequence
  Synthetic Polynucleotide
taatacgactcactatagggtgataggagaaatccggctccgggagcgaaaacagaggagattcgctatgggagccggaaacctggcggcagcgcaaaagatg

SEQ ID NO: 131545 - DNA, 103 bp, Artificial Sequence
  Synthetic Polynucleotide
taatacgactcactatagggagggtgcagctgataggagaaatccggctcaacagaggagagagccgatgttctcctataacctggcggcagcgcaaaagatg

SEQ ID NO: 131546 - DNA, 103 bp, Artificial Sequence
  Synthetic Polynucleotide
taatacgactcactatagggcgggccccgcagggtgcagctgataggagaaacagaggagatctcctatgagctgcaccaacctggcggcagcgcaaaagatg

SEQ ID NO: 131547 - DNA, 103 bp, Artificial Sequence
  Synthetic Polynucleotide
taatacgactcactatagggccagcgaattcgggccccgcagggtgcagcaacagaggagagctgcaatgtgcggggccaacctggcggcagcgcaaaagatg

SEQ ID NO: 131548 - DNA, 103 bp, Artificial Sequence
  Synthetic Polynucleotide
taatacgactcactatagggcgggctgtgaccagcgaattcgggccccgcaacagaggagagcggggatggaattcgctaacctggcggcagcgcaaaagatg

SEQ ID NO: 131549 - DNA, 103 bp, Artificial Sequence
  Synthetic Polynucleotide
taatacgactcactatagggcggcctcgcccgggctgtgaccagcgaattaacagaggagaaattcgatggtcacagccaacctggcggcagcgcaaaagatg

SEQ ID NO: 131550 - DNA, 103 bp, Artificial Sequence
  Synthetic Polynucleotide
taatacgactcactataggggggaacacagcggcctcgcccgggctgtgaaacagaggagatcacagatggggcgaggcaacctggcggcagcgcaaaagatg

SEQ ID NO: 131551 - DNA, 103 bp, Artificial Sequence
  Synthetic Polynucleotide
taatacgactcactatagggagagccctgcgggaacacagcggcctcgccaacagaggagaggcgagatggctgtgttcaacctggcggcagcgcaaaagatg

SEQ ID NO: 131552 - DNA, 103 bp, Artificial Sequence
  Synthetic Polynucleotide
taatacgactcactatagggccctcctccgcttttctatcactttatgagaacagaggagactcataatgtgatagaaaaacctggcggcagcgcaaaagatg

SEQ ID NO: 131553 - DNA, 103 bp, Artificial Sequence
  Synthetic Polynucleotide
taatacgactcactataggggcccggcaccagagccctgcgggaacacagaacagaggagactgtgtatgcgcagggctaacctggcggcagcgcaaaagatg

SEQ ID NO: 131554 - DNA, 103 bp, Artificial Sequence
  Synthetic Polynucleotide
taatacgactcactatagggcaggggaaaggcccggcaccagagccctgcaacagaggagagcagggatgtggtgccggaacctggcggcagcgcaaaagatg

SEQ ID NO: 131555 - DNA, 103 bp, Artificial Sequence
  Synthetic Polynucleotide
taatacgactcactataggggccaggcggccaggggaaaggcccggcaccaacagaggagaggtgccatgcctttccccaacctggcggcagcgcaaaagatg

SEQ ID NO: 131556 - DNA, 103 bp, Artificial Sequence
  Synthetic Polynucleotide
taatacgactcactatagggtgcgggccgcgccaggcggccaggggaaagaacagaggagactttccatgggccgcctgaacctggcggcagcgcaaaagatg

SEQ ID NO: 131557 - DNA, 103 bp, Artificial Sequence
  Synthetic Polynucleotide
taatacgactcactatagggagcgcggggctgcgggccgcgccaggcggcaacagaggagagccgccatgcgcggcccgaacctggcggcagcgcaaaagatg

SEQ ID NO: 131558 - DNA, 103 bp, Artificial Sequence
  Synthetic Polynucleotide
taatacgactcactatagggcaggtagggcagcgcggggctgcgggccgcaacagaggagagcggccatgagccccgcgaacctggcggcagcgcaaaagatg

SEQ ID NO: 131559 - DNA, 103 bp, Artificial Sequence
  Synthetic Polynucleotide
taatacgactcactataggggcgcgctgggcaggtagggcagcgcggggcaacagaggagagccccgatgtgccctaccaacctggcggcagcgcaaaagatg

SEQ ID NO: 131560 - DNA, 103 bp, Artificial Sequence
  Synthetic Polynucleotide
taatacgactcactatagggagcggcactggcgcgctgggcaggtagggcaacagaggagagccctaatggcccagcgcaacctggcggcagcgcaaaagatg

SEQ ID NO: 131561 - DNA, 103 bp, Artificial Sequence
  Synthetic Polynucleotide
taatacgactcactatagggtgggctagcgagcggcactggcgcgctgggaacagaggagacccagcatgccagtgccgaacctggcggcagcgcaaaagatg

SEQ ID NO: 131562 - DNA, 103 bp, Artificial Sequence
  Synthetic Polynucleotide
taatacgactcactataggggctgctgcgctgggctagcgagcggcactgaacagaggagacagtgcatgtcgctagccaacctggcggcagcgcaaaagatg

SEQ ID NO: 131563 - DNA, 103 bp, Artificial Sequence
  Synthetic Polynucleotide
taatacgactcactatagggttgatcctgtccctcctccgcttttctatcaacagaggagagatagaatggcggaggagaacctggcggcagcgcaaaagatg

SEQ ID NO: 131564 - DNA, 103 bp, Artificial Sequence
  Synthetic Polynucleotide
taatacgactcactatagggaaggggctgtgctgctgcgctgggctagcgaacagaggagacgctagatgagcgcagcaaacctggcggcagcgcaaaagatg

SEQ ID NO: 131565 - DNA, 103 bp, Artificial Sequence
  Synthetic Polynucleotide
taatacgactcactatagggcggtgtcaggaaggggctgtgctgctgcgcaacagaggagagcgcagatgcacagccccaacctggcggcagcgcaaaagatg

SEQ ID NO: 131566 - DNA, 103 bp, Artificial Sequence
  Synthetic Polynucleotide
taatacgactcactatagggggccctgcaccggtgtcaggaaggggctgtaacagaggagaacagccatgtcctgacacaacctggcggcagcgcaaaagatg

SEQ ID NO: 131567 - DNA, 103 bp, Artificial Sequence
  Synthetic Polynucleotide
taatacgactcactatagggtgccggtccaggccctgcaccggtgtcaggaacagaggagacctgacatgggtgcagggaacctggcggcagcgcaaaagatg

SEQ ID NO: 131568 - DNA, 103 bp, Artificial Sequence
  Synthetic Polynucleotide
taatacgactcactataggggttgaggtaatgccggtccaggccctgcacaacagaggagagtgcagatgctggaccggaacctggcggcagcgcaaaagatg

SEQ ID NO: 131569 - DNA, 103 bp, Artificial Sequence
  Synthetic Polynucleotide
taatacgactcactatagggggccgatcaggttgaggtaatgccggtccaaacagaggagatggaccatgattacctcaaacctggcggcagcgcaaaagatg

SEQ ID NO: 131570 - DNA, 103 bp, Artificial Sequence
  Synthetic Polynucleotide
taatacgactcactataggggggtgcgcgtggccgatcaggttgaggtaaaacagaggagattacctatgcctgatcggaacctggcggcagcgcaaaagatg

SEQ ID NO: 131571 - DNA, 103 bp, Artificial Sequence
  Synthetic Polynucleotide
taatacgactcactatagggaagggcgttggggtgcgcgtggccgatcagaacagaggagactgatcatgcacgcgcacaacctggcggcagcgcaaaagatg

SEQ ID NO: 131572 - DNA, 103 bp, Artificial Sequence
  Synthetic Polynucleotide
taatacgactcactatagggtgtgcaggttaagggcgttggggtgcgcgtaacagaggagaacgcgcatgccaacgcccaacctggcggcagcgcaaaagatg

SEQ ID NO: 131573 - DNA, 103 bp, Artificial Sequence
  Synthetic Polynucleotide
taatacgactcactatagggtgctggggcgtgtgcaggttaagggcgttgaacagaggagacaacgcatgtaacctgcaaacctggcggcagcgcaaaagatg

SEQ ID NO: 131574 - DNA, 103 bp, Artificial Sequence
  Synthetic Polynucleotide
taatacgactcactatagggcaagcagcggttgatcctgtccctcctccgaacagaggagacggaggatggacaggatcaacctggcggcagcgcaaaagatg

SEQ ID NO: 131575 - DNA, 103 bp, Artificial Sequence
  Synthetic Polynucleotide
taatacgactcactatagggcaccggggggtgctggggcgtgtgcaggttaacagaggagaaacctgatgacgccccagaacctggcggcagcgcaaaagatg

SEQ ID NO: 131576 - DNA, 103 bp, Artificial Sequence
  Synthetic Polynucleotide
taatacgactcactatagggccagctcgttcaagcagcggttgatcctgtaacagaggagaacaggaatgaccgctgctaacctggcggcagcgcaaaagatg

SEQ ID NO: 131577 - DNA, 103 bp, Artificial Sequence
  Synthetic Polynucleotide
taatacgactcactatagggactgtcttgcccagctcgttcaagcagcggaacagaggagaccgctgatggaacgagctaacctggcggcagcgcaaaagatg

SEQ ID NO: 131578 - DNA, 103 bp, Artificial Sequence
  Synthetic Polynucleotide
taatacgactcactatagggggaatttttctccattatatcagctggcataacagaggagaatgccaatggatataatgaacctggcggcagcgcaaaagatg

SEQ ID NO: 131579 - DNA, 103 bp, Artificial Sequence
  Synthetic Polynucleotide
taatacgactcactatagggaggctttgatgactttctgtgctcagatgcaacagaggagagcatctatgcacagaaagaacctggcggcagcgcaaaagatg

SEQ ID NO: 131580 - DNA, 103 bp, Artificial Sequence
  Synthetic Polynucleotide
taatacgactcactatagggtctccataataggctttgatgactttctgtaacagaggagaacagaaatgcatcaaagcaacctggcggcagcgcaaaagatg

SEQ ID NO: 131581 - DNA, 103 bp, Artificial Sequence
  Synthetic Polynucleotide
taatacgactcactatagggcttcgtcttttctccataataggctttgataacagaggagaatcaaaatgtattatggaaacctggcggcagcgcaaaagatg

SEQ ID NO: 131582 - DNA, 103 bp, Artificial Sequence
  Synthetic Polynucleotide
taatacgactcactatagggtattcttgctcttcgtcttttctccataataacagaggagaattatgatgaaaagacgaaacctggcggcagcgcaaaagatg

SEQ ID NO: 131583 - DNA, 103 bp, Artificial Sequence
  Synthetic Polynucleotide
taatacgactcactataggggactttcatttattcttgctcttcgtctttaacagaggagaaaagacatggagcaagaaaacctggcggcagcgcaaaagatg

SEQ ID NO: 131584 - DNA, 103 bp, Artificial Sequence
  Synthetic Polynucleotide
taatacgactcactatagggagctggctcagactttcatttattcttgctaacagaggagaagcaagatgaaatgaaagaacctggcggcagcgcaaaagatg

SEQ ID NO: 131585 - DNA, 103 bp, Artificial Sequence
  Synthetic Polynucleotide
taatacgactcactatagggcagtgttttcagctggctcagactttcattaacagaggagaaatgaaatgctgagccagaacctggcggcagcgcaaaagatg

SEQ ID NO: 131586 - DNA, 103 bp, Artificial Sequence
  Synthetic Polynucleotide
taatacgactcactatagggcatccaaaatcagtgttttcagctggctcaaacagaggagatgagccatgtgaaaacacaacctggcggcagcgcaaaagatg

SEQ ID NO: 131587 - DNA, 103 bp, Artificial Sequence
  Synthetic Polynucleotide
taatacgactcactatagggttcttcagagcatccaaaatcagtgttttcaacagaggagagaaaacatggattttggaaacctggcggcagcgcaaaagatg

SEQ ID NO: 131588 - DNA, 103 bp, Artificial Sequence
  Synthetic Polynucleotide
taatacgactcactatagggcgagctatctttcttcagagcatccaaaataacagaggagaattttgatggctctgaagaacctggcggcagcgcaaaagatg

SEQ ID NO: 131589 - DNA, 103 bp, Artificial Sequence
  Synthetic Polynucleotide
taatacgactcactatagggccggggacgaggaatttttctccattatataacagaggagaatataaatgagaaaaattaacctggcggcagcgcaaaagatg

SEQ ID NO: 131590 - DNA, 103 bp, Artificial Sequence
  Synthetic Polynucleotide
taatacgactcactatagggtggaatgccgcgagctatctttcttcagagaacagaggagactctgaatgaagatagctaacctggcggcagcgcaaaagatg

SEQ ID NO: 131591 - DNA, 103 bp, Artificial Sequence
  Synthetic Polynucleotide
taatacgactcactatagggttctccagcttggaatgccgcgagctatctaacagaggagaagatagatggcggcattcaacctggcggcagcgcaaaagatg

SEQ ID NO: 131592 - DNA, 103 bp, Artificial Sequence
  Synthetic Polynucleotide
taatacgactcactatagggaatgtccgccttctccagcttggaatgccgaacagaggagacggcatatgaagctggagaacctggcggcagcgcaaaagatg

SEQ ID NO: 131593 - DNA, 103 bp, Artificial Sequence
  Synthetic Polynucleotide
taatacgactcactatagggtcatttccagaatgtccgccttctccagctaacagaggagaagctggatgaggcggacaaacctggcggcagcgcaaaagatg

SEQ ID NO: 131594 - DNA, 103 bp, Artificial Sequence
  Synthetic Polynucleotide
taatacgactcactatagggtgcttcactgtcatttccagaatgtccgccaacagaggagaggcggaatgtctggaaataacctggcggcagcgcaaaagatg

SEQ ID NO: 131595 - DNA, 103 bp, Artificial Sequence
  Synthetic Polynucleotide
taatacgactcactataggggttccggaggtgcttcactgtcatttccagaacagaggagactggaaatgacagtgaagaacctggcggcagcgcaaaagatg

SEQ ID NO: 131596 - DNA, 103 bp, Artificial Sequence
  Synthetic Polynucleotide
taatacgactcactatagggcccgctgcaggttccggaggtgcttcactgaacagaggagacagtgaatgacctccggaaacctggcggcagcgcaaaagatg

SEQ ID NO: 131597 - DNA, 103 bp, Artificial Sequence
  Synthetic Polynucleotide
taatacgactcactataggggtcatctgcgcccgctgcaggttccggaggaacagaggagacctccgatgcctgcagcgaacctggcggcagcgcaaaagatg

SEQ ID NO: 131598 - DNA, 103 bp, Artificial Sequence
  Synthetic Polynucleotide
taatacgactcactatagggcagcgcagccgtcatctgcgcccgctgcagaacagaggagactgcagatggcgcagatgaacctggcggcagcgcaaaagatg

SEQ ID NO: 131599 - DNA, 103 bp, Artificial Sequence
  Synthetic Polynucleotide
taatacgactcactatagggggtctgtgctcagcgcagccgtcatctgcgaacagaggagacgcagaatgcggctgcgcaacctggcggcagcgcaaaagatg

SEQ ID NO: 131600 - DNA, 103 bp, Artificial Sequence
  Synthetic Polynucleotide
taatacgactcactataggggtagcagccaccggggacgaggaatttttcaacagaggagagaaaaaatgctcgtccccaacctggcggcagcgcaaaagatg

SEQ ID NO: 131601 - DNA, 103 bp, Artificial Sequence
  Synthetic Polynucleotide
taatacgactcactatagggagcacacttgggtctgtgctcagcgcagccaacagaggagaggctgcatggagcacagaaacctggcggcagcgcaaaagatg

SEQ ID NO: 131602 - DNA, 103 bp, Artificial Sequence
  Synthetic Polynucleotide
taatacgactcactataggggtacttccccagcacacttgggtctgtgctaacagaggagaagcacaatgccaagtgtgaacctggcggcagcgcaaaagatg

SEQ ID NO: 131603 - DNA, 103 bp, Artificial Sequence
  Synthetic Polynucleotide
taatacgactcactatagggagccggctcggtacttccccagcacacttgaacagaggagacaagtgatgtggggaagtaacctggcggcagcgcaaaagatg

SEQ ID NO: 131604 - DNA, 103 bp, Artificial Sequence
  Synthetic Polynucleotide
taatacgactcactatagggcactcgctgaagccggctcggtacttccccaacagaggagaggggaaatgccgagccggaacctggcggcagcgcaaaagatg

SEQ ID NO: 131605 - DNA, 103 bp, Artificial Sequence
  Synthetic Polynucleotide
taatacgactcactatagggctcgttcatgcactcgctgaagccggctcgaacagaggagacgagccatgttcagcgagaacctggcggcagcgcaaaagatg

SEQ ID NO: 131606 - DNA, 103 bp, Artificial Sequence
  Synthetic Polynucleotide
taatacgactcactatagggagcgggtcacctcgttcatgcactcgctgaaacagaggagatcagcgatggcatgaacgaacctggcggcagcgcaaaagatg

SEQ ID NO: 131607 - DNA, 103 bp, Artificial Sequence
  Synthetic Polynucleotide
taatacgactcactataggggtggacaggaagcgggtcacctcgttcatgaacagaggagacatgaaatgggtgacccgaacctggcggcagcgcaaaagatg

SEQ ID NO: 131608 - DNA, 103 bp, Artificial Sequence
  Synthetic Polynucleotide
taatacgactcactataggggccctcgcacgtggacaggaagcgggtcacaacagaggagagtgaccatgttcctgtccaacctggcggcagcgcaaaagatg

SEQ ID NO: 131609 - DNA, 103 bp, Artificial Sequence
  Synthetic Polynucleotide
taatacgactcactatagggcggtattaacgccctcgcacgtggacaggaaacagaggagatcctgtatgcgtgcgaggaacctggcggcagcgcaaaagatg

SEQ ID NO: 131610 - DNA, 103 bp, Artificial Sequence
  Synthetic Polynucleotide
taatacgactcactataggggtgcgcacctcggtattaacgccctcgcacaacagaggagagtgcgaatgcgttaatacaacctggcggcagcgcaaaagatg

SEQ ID NO: 131611 - DNA, 103 bp, Artificial Sequence
  Synthetic Polynucleotide
taatacgactcactatagggactggctggggtagcagccaccggggacgaaacagaggagatcgtccatggtggctgctaacctggcggcagcgcaaaagatg

SEQ ID NO: 131612 - DNA, 103 bp, Artificial Sequence
  Synthetic Polynucleotide
taatacgactcactataggggagcagccgagtgcgcacctcggtattaacaacagaggagagttaatatggaggtgcgcaacctggcggcagcgcaaaagatg

SEQ ID NO: 131613 - DNA, 103 bp, Artificial Sequence
  Synthetic Polynucleotide
taatacgactcactatagggccaggtggccgagcagccgagtgcgcacctaacagaggagaaggtgcatgctcggctgcaacctggcggcagcgcaaaagatg

SEQ ID NO: 131614 - DNA, 103 bp, Artificial Sequence
  Synthetic Polynucleotide
taatacgactcactatagggatgcagttggccaggtggccgagcagccgaaacagaggagatcggctatgcggccacctaacctggcggcagcgcaaaagatg

SEQ ID NO: 131615 - DNA, 103 bp, Artificial Sequence
  Synthetic Polynucleotide
taatacgactcactataggggatctgggtcatgcagttggccaggtggccaacagaggagaggccacatggccaactgcaacctggcggcagcgcaaaagatg

SEQ ID NO: 131616 - DNA, 103 bp, Artificial Sequence
  Synthetic Polynucleotide
taatacgactcactatagggtcatggcattgatctgggtcatgcagttggaacagaggagaccaactatgtgacccagaaacctggcggcagcgcaaaagatg

SEQ ID NO: 131617 - DNA, 103 bp, Artificial Sequence
  Synthetic Polynucleotide
taatacgactcactatagggccggggtaggtcatggcattgatctgggtcaacagaggagagacccaatgcaatgccataacctggcggcagcgcaaaagatg

SEQ ID NO: 131618 - DNA, 103 bp, Artificial Sequence
  Synthetic Polynucleotide
taatacgactcactataggggtgcggctgcccggggtaggtcatggcattaacagaggagaaatgccatgacctaccccaacctggcggcagcgcaaaagatg

SEQ ID NO: 131619 - DNA, 103 bp, Artificial Sequence
  Synthetic Polynucleotide
taatacgactcactataggggcaaggcggggtgcggctgcccggggtaggaacagaggagacctaccatgggcagccgcaacctggcggcagcgcaaaagatg

SEQ ID NO: 131620 - DNA, 103 bp, Artificial Sequence
  Synthetic Polynucleotide
taatacgactcactatagggggcggcgcctgcaaggcggggtgcggctgcaacagaggagagcagccatgccccgccttaacctggcggcagcgcaaaagatg

SEQ ID NO: 131621 - DNA, 103 bp, Artificial Sequence
  Synthetic Polynucleotide
taatacgactcactatagggtgggggcggtggcggcgcctgcaaggcgggaacagaggagacccgccatgcaggcgccgaacctggcggcagcgcaaaagatg

SEQ ID NO: 131622 - DNA, 103 bp, Artificial Sequence
  Synthetic Polynucleotide
taatacgactcactatagggtcgtgttgacactggctggggtagcagccaaacagaggagatggctgatgccccagccaaacctggcggcagcgcaaaagatg

SEQ ID NO: 131623 - DNA, 103 bp, Artificial Sequence
  Synthetic Polynucleotide
taatacgactcactatagggcgggtcccggtgggggcggtggcggcgcctaacagaggagaaggcgcatgcaccgccccaacctggcggcagcgcaaaagatg

SEQ ID NO: 131624 - DNA, 103 bp, Artificial Sequence
  Synthetic Polynucleotide
taatacgactcactatagggtgggggccgccgggtcccggtgggggcggtaacagaggagaaccgccatgaccgggaccaacctggcggcagcgcaaaagatg

SEQ ID NO: 131625 - DNA, 103 bp, Artificial Sequence
  Synthetic Polynucleotide
taatacgactcactatagggcggcgcgtgctgggggccgccgggtcccggaacagaggagaccgggaatgggcggccccaacctggcggcagcgcaaaagatg

SEQ ID NO: 131626 - DNA, 103 bp, Artificial Sequence
  Synthetic Polynucleotide
taatacgactcactataggggcggcgcgaacggcgcgtgctgggggccgcaacagaggagagcggccatgagcacgcgcaacctggcggcagcgcaaaagatg

SEQ ID NO: 131627 - DNA, 103 bp, Artificial Sequence
  Synthetic Polynucleotide
taatacgactcactatagggagtggcggcggcggcgcgaacggcgcgtgcaacagaggagagcacgcatggttcgcgccaacctggcggcagcgcaaaagatg

SEQ ID NO: 131628 - DNA, 103 bp, Artificial Sequence
  Synthetic Polynucleotide
taatacgactcactataggggatgggcacgagtggcggcggcggcgcgaaaacagaggagattcgcgatgccgccgccaaacctggcggcagcgcaaaagatg

SEQ ID NO: 131629 - DNA, 103 bp, Artificial Sequence
  Synthetic Polynucleotide
taatacgactcactatagggcgcccccggggatgggcacgagtggcggcgaacagaggagacgccgcatgtcgtgcccaaacctggcggcagcgcaaaagatg

SEQ ID NO: 131630 - DNA, 103 bp, Artificial Sequence
  Synthetic Polynucleotide
taatacgactcactataggggggggcgccgcgcccccggggatgggcacgaacagaggagacgtgccatgccccgggggaacctggcggcagcgcaaaagatg

SEQ ID NO: 131631 - DNA, 103 bp, Artificial Sequence
  Synthetic Polynucleotide
taatacgactcactataggggccgccgggagggggcgccgcgcccccgggaacagaggagacccgggatggcggcgcccaacctggcggcagcgcaaaagatg

SEQ ID NO: 131632 - DNA, 103 bp, Artificial Sequence
  Synthetic Polynucleotide
taatacgactcactatagggtgcagggggcgccgccgggagggggcgccgaacagaggagacggcgcatgctcccggcgaacctggcggcagcgcaaaagatg

SEQ ID NO: 131633 - DNA, 103 bp, Artificial Sequence
  Synthetic Polynucleotide
taatacgactcactatagggttatccggtgtcgtgttgacactggctgggaacagaggagacccagcatgtgtcaacacaacctggcggcagcgcaaaagatg

SEQ ID NO: 131634 - DNA, 103 bp, Artificial Sequence
  Synthetic Polynucleotide
taatacgactcactatagggctgcccagcttgcagggggcgccgccgggaaacagaggagatcccggatgcgccccctgaacctggcggcagcgcaaaagatg

SEQ ID NO: 131635 - DNA, 103 bp, Artificial Sequence
  Synthetic Polynucleotide
taatacgactcactatagggtccagcctggctgcccagcttgcagggggcaacagaggagagcccccatgaagctgggcaacctggcggcagcgcaaaagatg

SEQ ID NO: 131636 - DNA, 103 bp, Artificial Sequence
  Synthetic Polynucleotide
taatacgactcactatagggtagccgcctctccagcctggctgcccagctaacagaggagaagctggatggccaggctgaacctggcggcagcgcaaaagatg

SEQ ID NO: 131637 - DNA, 103 bp, Artificial Sequence
  Synthetic Polynucleotide
taatacgactcactatagggccaaacaccttagccgcctctccagcctggaacagaggagaccaggcatgagaggcggcaacctggcggcagcgcaaaagatg

SEQ ID NO: 131638 - DNA, 103 bp, Artificial Sequence
  Synthetic Polynucleotide
taatacgactcactatagggctggaagcctccaaacaccttagccgcctcaacagaggagagaggcgatgaaggtgtttaacctggcggcagcgcaaaagatg

SEQ ID NO: 131639 - DNA, 103 bp, Artificial Sequence
  Synthetic Polynucleotide
taatacgactcactatagggccggtaccacctggaagcctccaaacacctaacagaggagaaggtgtatggaggcttccaacctggcggcagcgcaaaagatg

SEQ ID NO: 131640 - DNA, 103 bp, Artificial Sequence
  Synthetic Polynucleotide
taatacgactcactatagggccatcgggagccggtaccacctggaagcctaacagaggagaaggcttatgggtggtaccaacctggcggcagcgcaaaagatg

SEQ ID NO: 131641 - DNA, 103 bp, Artificial Sequence
  Synthetic Polynucleotide
taatacgactcactatagggagcaaactggccatcgggagccggtaccacaacagaggagagtggtaatggctcccgataacctggcggcagcgcaaaagatg

SEQ ID NO: 131642 - DNA, 103 bp, Artificial Sequence
  Synthetic Polynucleotide
taatacgactcactataggggaatgaggaaagcaaactggccatcgggagaacagaggagactcccgatggccagtttgaacctggcggcagcgcaaaagatg

SEQ ID NO: 131643 - DNA, 103 bp, Artificial Sequence
  Synthetic Polynucleotide
taatacgactcactataggggccccgttgggaatgaggaaagcaaactggaacagaggagaccagttatgtttcctcataacctggcggcagcgcaaaagatg

SEQ ID NO: 131644 - DNA, 103 bp, Artificial Sequence
  Synthetic Polynucleotide
taatacgactcactatagggtgtctttggtttatccggtgtcgtgttgacaacagaggagagtcaacatgacaccggataacctggcggcagcgcaaaagatg

SEQ ID NO: 131645 - DNA, 103 bp, Artificial Sequence
  Synthetic Polynucleotide
taatacgactcactataggggtgcgcgaaggccccgttgggaatgaggaaaacagaggagattcctcatgcccaacgggaacctggcggcagcgcaaaagatg

SEQ ID NO: 131646 - DNA, 103 bp, Artificial Sequence
  Synthetic Polynucleotide
taatacgactcactatagggcagggccgctgtgcgcgaaggccccgttggaacagaggagaccaacgatgccttcgcgcaacctggcggcagcgcaaaagatg

SEQ ID NO: 131647 - DNA, 103 bp, Artificial Sequence
  Synthetic Polynucleotide
taatacgactcactatagggacggggatgacagggccgctgtgcgcgaagaacagaggagacttcgcatgcagcggcccaacctggcggcagcgcaaaagatg

SEQ ID NO: 131648 - DNA, 103 bp, Artificial Sequence
  Synthetic Polynucleotide
taatacgactcactataggggctggtgtagacggggatgacagggccgctaacagaggagaagcggcatggtcatccccaacctggcggcagcgcaaaagatg

SEQ ID NO: 131649 - DNA, 103 bp, Artificial Sequence
  Synthetic Polynucleotide
taatacgactcactatagggtgccgctgttgctggtgtagacggggatgaaacagaggagatcatccatgtctacaccaaacctggcggcagcgcaaaagatg

SEQ ID NO: 131650 - DNA, 103 bp, Artificial Sequence
  Synthetic Polynucleotide
taatacgactcactatagggcccacggaggtgccgctgttgctggtgtagaacagaggagactacacatgcaacagcggaacctggcggcagcgcaaaagatg

SEQ ID NO: 131651 - DNA, 103 bp, Artificial Sequence
  Synthetic Polynucleotide
taatacgactcactatagggtgcgttggggcccacggaggtgccgctgttaacagaggagaaacagcatgacctccgtgaacctggcggcagcgcaaaagatg

SEQ ID NO: 131652 - DNA, 103 bp, Artificial Sequence
  Synthetic Polynucleotide
taatacgactcactatagggaaggtgacactgcgttggggcccacggaggaacagaggagacctccgatggccccaacgaacctggcggcagcgcaaaagatg

SEQ ID NO: 131653 - DNA, 103 bp, Artificial Sequence
  Synthetic Polynucleotide
taatacgactcactataggggggccgctggaaggtgacactgcgttggggaacagaggagaccccaaatgagtgtcaccaacctggcggcagcgcaaaagatg

SEQ ID NO: 131654 - DNA, 103 bp, Artificial Sequence
  Synthetic Polynucleotide
taatacgactcactatagggcgtaagcgaggggccgctggaaggtgacacaacagaggagagtgtcaatgtccagcggcaacctggcggcagcgcaaaagatg

SEQ ID NO: 131655 - DNA, 103 bp, Artificial Sequence
  Synthetic Polynucleotide
taatacgactcactataggggctcagatgctgtctttggtttatccggtgaacagaggagacaccggatgaaccaaagaaacctggcggcagcgcaaaagatg

SEQ ID NO: 131656 - DNA, 103 bp, Artificial Sequence
  Synthetic Polynucleotide
taatacgactcactatagggtggagtccgccgtaagcgaggggccgctggaacagaggagaccagcgatgcctcgcttaaacctggcggcagcgcaaaagatg

SEQ ID NO: 131657 - DNA, 103 bp, Artificial Sequence
  Synthetic Polynucleotide
taatacgactcactatagggggcctccacatggagtccgccgtaagcgagaacagaggagactcgctatgggcggactcaacctggcggcagcgcaaaagatg

SEQ ID NO: 131658 - DNA, 103 bp, Artificial Sequence
  Synthetic Polynucleotide
taatacgactcactataggggttccgccacggcctccacatggagtccgcaacagaggagagcggacatgatgtggaggaacctggcggcagcgcaaaagatg

SEQ ID NO: 131659 - DNA, 103 bp, Artificial Sequence
  Synthetic Polynucleotide
taatacgactcactataggggactttctgtgctcagatgctgtctttggtaacagaggagaaccaaaatgagcatctgaaacctggcggcagcgcaaaagatg

SEQ ID NO: 131660 - DNA, 103 bp, Artificial Sequence
  Synthetic Polynucleotide
taatacgactcactatagggcgcgtcccctgcccggcgaggcagccccataacagaggagaatggggatgcctcgccggaacctggcggcagcgcaaaagatg

SEQ ID NO: 131661 - DNA, 103 bp, Artificial Sequence
  Synthetic Polynucleotide
taatacgactcactataggggatgagccccttaagctggctcaggctctgaacagaggagacagagcatgagccagcttaacctggcggcagcgcaaaagatg

SEQ ID NO: 131662 - DNA, 103 bp, Artificial Sequence
  Synthetic Polynucleotide
taatacgactcactataggggcagcggcaggatgagccccttaagctggcaacagaggagagccagcatgaggggctcaaacctggcggcagcgcaaaagatg

SEQ ID NO: 131663 - DNA, 103 bp, Artificial Sequence
  Synthetic Polynucleotide
taatacgactcactatagggtcccggcccagcagcggcaggatgagccccaacagaggagaggggctatgcctgccgctaacctggcggcagcgcaaaagatg

SEQ ID NO: 131664 - DNA, 103 bp, Artificial Sequence
  Synthetic Polynucleotide
taatacgactcactataggggttggagttctcccggcccagcagcggcagaacagaggagactgccgatgctgggccggaacctggcggcagcgcaaaagatg

SEQ ID NO: 131665 - DNA, 103 bp, Artificial Sequence
  Synthetic Polynucleotide
taatacgactcactataggggcttcgagcagttggagttctcccggcccaaacagaggagatgggccatgagaactccaaacctggcggcagcgcaaaagatg

SEQ ID NO: 131666 - DNA, 103 bp, Artificial Sequence
  Synthetic Polynucleotide
taatacgactcactataggggccttctctagcttcgagcagttggagttcaacagaggagagaactcatgctgctcgaaaacctggcggcagcgcaaaagatg

SEQ ID NO: 131667 - DNA, 103 bp, Artificial Sequence
  Synthetic Polynucleotide
taatacgactcactatagggcaggacgtctgccttctctagcttcgagcaaacagaggagatgctcgatgctagagaagaacctggcggcagcgcaaaagatg

SEQ ID NO: 131668 - DNA, 103 bp, Artificial Sequence
  Synthetic Polynucleotide
taatacgactcactatagggcggtcatttccaggacgtctgccttctctaaacagaggagatagagaatgcagacgtccaacctggcggcagcgcaaaagatg

SEQ ID NO: 131669 - DNA, 103 bp, Artificial Sequence
  Synthetic Polynucleotide
taatacgactcactatagggaggaagcgcacggtcatttccaggacgtctaacagaggagaagacgtatgggaaatgacaacctggcggcagcgcaaaagatg

SEQ ID NO: 131670 - DNA, 103 bp, Artificial Sequence
  Synthetic Polynucleotide
taatacgactcactatagggcagctcctgcaggaagcgcacggtcatttcaacagaggagagaaatgatggtgcgcttcaacctggcggcagcgcaaaagatg

SEQ ID NO: 131671 - DNA, 103 bp, Artificial Sequence
  Synthetic Polynucleotide
taatacgactcactataggggcagctccgccgcgtcccctgcccggcgagaacagaggagactcgccatgcaggggacgaacctggcggcagcgcaaaagatg

SEQ ID NO: 131672 - DNA, 103 bp, Artificial Sequence
  Synthetic Polynucleotide
taatacgactcactatagggaggacgcaggcagctcctgcaggaagcgcaaacagaggagatgcgctatgtgcaggagcaacctggcggcagcgcaaaagatg

SEQ ID NO: 131673 - DNA, 103 bp, Artificial Sequence
  Synthetic Polynucleotide
taatacgactcactataggggtgggccatgaggacgcaggcagctcctgcaacagaggagagcaggaatggcctgcgtcaacctggcggcagcgcaaaagatg

SEQ ID NO: 131674 - DNA, 103 bp, Artificial Sequence
  Synthetic Polynucleotide
taatacgactcactataggggggcgctgccgtgggccatgaggacgcaggaacagaggagacctgcgatgtcatggcccaacctggcggcagcgcaaaagatg

SEQ ID NO: 131675 - DNA, 103 bp, Artificial Sequence
  Synthetic Polynucleotide
taatacgactcactatagggcgcaaggcaggggcgctgccgtgggccatgaacagaggagacatggcatgcggcagcgcaacctggcggcagcgcaaaagatg

SEQ ID NO: 131676 - DNA, 103 bp, Artificial Sequence
  Synthetic Polynucleotide
taatacgactcactatagggcggtagctgtcgcaaggcaggggcgctgccaacagaggagaggcagcatgcctgccttgaacctggcggcagcgcaaaagatg

SEQ ID NO: 131677 - DNA, 103 bp, Artificial Sequence
  Synthetic Polynucleotide
taatacgactcactataggggtagccctcgcggtagctgtcgcaaggcagaacagaggagactgcctatggacagctacaacctggcggcagcgcaaaagatg

SEQ ID NO: 131678 - DNA, 103 bp, Artificial Sequence
  Synthetic Polynucleotide
taatacgactcactatagggcacaggcgctgtagccctcgcggtagctgtaacagaggagaacagctatggcgagggctaacctggcggcagcgcaaaagatg

SEQ ID NO: 131679 - DNA, 103 bp, Artificial Sequence
  Synthetic Polynucleotide
taatacgactcactatagggaggcgcgccacacaggcgctgtagccctcgaacagaggagacgagggatgcagcgcctgaacctggcggcagcgcaaaagatg

SEQ ID NO: 131680 - DNA, 103 bp, Artificial Sequence
  Synthetic Polynucleotide
taatacgactcactatagggcacgcgggccaggcgcgccacacaggcgctaacagaggagaagcgccatggtggcgcgcaacctggcggcagcgcaaaagatg

SEQ ID NO: 131681 - DNA, 103 bp, Artificial Sequence
  Synthetic Polynucleotide
taatacgactcactatagggaggcgggcagcacgcgggccaggcgcgccaaacagaggagatggcgcatgtggcccgcgaacctggcggcagcgcaaaagatg

SEQ ID NO: 131682 - DNA, 103 bp, Artificial Sequence
  Synthetic Polynucleotide
taatacgactcactatagggaggctcttgcgcagctccgccgcgtcccctaacagaggagaaggggaatgggcggagctaacctggcggcagcgcaaaagatg

SEQ ID NO: 131683 - DNA, 103 bp, Artificial Sequence
  Synthetic Polynucleotide
taatacgactcactatagggaggacacggcaggcgggcagcacgcgggccaacagaggagaggcccgatggctgcccgcaacctggcggcagcgcaaaagatg

SEQ ID NO: 131684 - DNA, 103 bp, Artificial Sequence
  Synthetic Polynucleotide
taatacgactcactatagggggcgggctccaggacacggcaggcgggcagaacagaggagactgcccatgtgccgtgtcaacctggcggcagcgcaaaagatg

SEQ ID NO: 131685 - DNA, 103 bp, Artificial Sequence
  Synthetic Polynucleotide
taatacgactcactataggggcgcgctcacggcgggctccaggacacggcaacagaggagagccgtgatgtggagcccgaacctggcggcagcgcaaaagatg

SEQ ID NO: 131686 - DNA, 103 bp, Artificial Sequence
  Synthetic Polynucleotide
taatacgactcactatagggtccagcaggcgcgcgctcacggcgggctccaacagaggagaggagccatgcgtgagcgcaacctggcggcagcgcaaaagatg

SEQ ID NO: 131687 - DNA, 103 bp, Artificial Sequence
  Synthetic Polynucleotide
taatacgactcactatagggccacaggtgctccagcaggcgcgcgctcacaacagaggagagtgagcatgcgcctgctgaacctggcggcagcgcaaaagatg

SEQ ID NO: 131688 - DNA, 103 bp, Artificial Sequence
  Synthetic Polynucleotide
taatacgactcactatagggccgctctccgccacaggtgctccagcaggcaacagaggagagcctgcatgagcacctgtaacctggcggcagcgcaaaagatg

SEQ ID NO: 131689 - DNA, 103 bp, Artificial Sequence
  Synthetic Polynucleotide
taatacgactcactataggggtggcgctggccgctctccgccacaggtgcaacagaggagagcacctatggcggagagcaacctggcggcagcgcaaaagatg

SEQ ID NO: 131690 - DNA, 103 bp, Artificial Sequence
  Synthetic Polynucleotide
taatacgactcactataggggccgtccagggtggcgctggccgctctccgaacagaggagacggagaatggccagcgccaacctggcggcagcgcaaaagatg

SEQ ID NO: 131691 - DNA, 103 bp, Artificial Sequence
  Synthetic Polynucleotide
taatacgactcactatagggcagcgcgcccgccgtccagggtggcgctggaacagaggagaccagcgatgccctggacgaacctggcggcagcgcaaaagatg

SEQ ID NO: 131692 - DNA, 103 bp, Artificial Sequence
  Synthetic Polynucleotide
taatacgactcactatagggctggaatccccagcgcgcccgccgtccaggaacagaggagacctggaatgcgggcgcgcaacctggcggcagcgcaaaagatg

SEQ ID NO: 131693 - DNA, 103 bp, Artificial Sequence
  Synthetic Polynucleotide
taatacgactcactatagggcagcggcttcaggctcttgcgcagctccgcaacagaggagagcggagatgcgcaagagcaacctggcggcagcgcaaaagatg

SEQ ID NO: 131694 - DNA, 103 bp, Artificial Sequence
  Synthetic Polynucleotide
taatacgactcactatagggagacgggccactggaatccccagcgcgcccaacagaggagagggcgcatgggggattccaacctggcggcagcgcaaaagatg

SEQ ID NO: 131695 - DNA, 103 bp, Artificial Sequence
  Synthetic Polynucleotide
taatacgactcactataggggggcgggggcagacgggccactggaatcccaacagaggagagggattatggtggcccgtaacctggcggcagcgcaaaagatg

SEQ ID NO: 131696 - DNA, 103 bp, Artificial Sequence
  Synthetic Polynucleotide
taatacgactcactataggggcgggcgctggggcgggggcagacgggccaaacagaggagatggcccatgtgcccccgcaacctggcggcagcgcaaaagatg

SEQ ID NO: 131697 - DNA, 103 bp, Artificial Sequence
  Synthetic Polynucleotide
taatacgactcactatagggtggggcagacgcgggcgctggggcgggggcaacagaggagagcccccatgccagcgcccaacctggcggcagcgcaaaagatg

SEQ ID NO: 131698 - DNA, 103 bp, Artificial Sequence
  Synthetic Polynucleotide
taatacgactcactatagggatgcgggctctggggcagacgcgggcgctgaacagaggagacagcgcatgcgtctgcccaacctggcggcagcgcaaaagatg

SEQ ID NO: 131699 - DNA, 103 bp, Artificial Sequence
  Synthetic Polynucleotide
taatacgactcactatagggaccggagcggatgcgggctctggggcagacaacagaggagagtctgcatgagagcccgcaacctggcggcagcgcaaaagatg

SEQ ID NO: 131700 - DNA, 103 bp, Artificial Sequence
  Synthetic Polynucleotide
taatacgactcactatagggcggcgagggcaccggagcggatgcgggctcaacagaggagagagcccatgtccgctccgaacctggcggcagcgcaaaagatg

SEQ ID NO: 131701 - DNA, 103 bp, Artificial Sequence
  Synthetic Polynucleotide
taatacgactcactataggggaggcgagggcggcgagggcaccggagcggaacagaggagaccgctcatgtgccctcgcaacctggcggcagcgcaaaagatg

SEQ ID NO: 131702 - DNA, 103 bp, Artificial Sequence
  Synthetic Polynucleotide
taatacgactcactataggggggccgcagggaggcgagggcggcgagggcaacagaggagagccctcatggccctcgccaacctggcggcagcgcaaaagatg

SEQ ID NO: 131703 - DNA, 103 bp, Artificial Sequence
  Synthetic Polynucleotide
taatacgactcactatagggccagaggccagggccgcagggaggcgagggaacagaggagaccctcgatgccctgcggcaacctggcggcagcgcaaaagatg

SEQ ID NO: 131704 - DNA, 103 bp, Artificial Sequence
  Synthetic Polynucleotide
taatacgactcactataggggcttctccagcagcggcttcaggctcttgcaacagaggagagcaagaatgtgaagccgcaacctggcggcagcgcaaaagatg

SEQ ID NO: 131705 - DNA, 103 bp, Artificial Sequence
  Synthetic Polynucleotide
taatacgactcactatagggaccacggccgccagaggccagggccgcaggaacagaggagacctgcgatgctggcctctaacctggcggcagcgcaaaagatg

SEQ ID NO: 131706 - DNA, 103 bp, Artificial Sequence
  Synthetic Polynucleotide
taatacgactcactataggggcgcgccggcgcttctccagcagcggcttcaacagaggagagaagccatggctggagaaaacctggcggcagcgcaaaagatg

SEQ ID NO: 131707 - DNA, 103 bp, Artificial Sequence
  Synthetic Polynucleotide
taatacgactcactataggggttgatgcgcgcgcgccggcgcttctccagaacagaggagactggagatgcgccggcgcaacctggcggcagcgcaaaagatg

SEQ ID NO: 131708 - DNA, 103 bp, Artificial Sequence
  Synthetic Polynucleotide
taatacgactcactatagggtcaggctctggttgatgcgcgcgcgccggcaacagaggagagccggcatgcgcgcatcaaacctggcggcagcgcaaaagatg

SEQ ID NO: 131709 - DNA, 103 bp, Artificial Sequence
  Synthetic Polynucleotide
taatacgactcactatagggttaagctggctcaggctctggttgatgcgcaacagaggagagcgcatatgccagagcctaacctggcggcagcgcaaaagatg

SEQ ID NO: 131710 - DNA, 103 bp, Artificial Sequence
  Synthetic Polynucleotide
taatacgactcactatagggattgatgcgtgcccggcgctttttctccataacagaggagaatggagatgaagcgccggaacctggcggcagcgcaaaagatg

SEQ ID NO: 131711 - DNA, 103 bp, Artificial Sequence
  Synthetic Polynucleotide
taatacgactcactatagggctccaggatgtcggccttctccaatttgcgaacagaggagacgcaaaatggagaaggccaacctggcggcagcgcaaaagatg

SEQ ID NO: 131712 - DNA, 103 bp, Artificial Sequence
  Synthetic Polynucleotide
taatacgactcactatagggtcacgctcaactccaggatgtcggccttctaacagaggagaagaaggatgacatcctggaacctggcggcagcgcaaaagatg

SEQ ID NO: 131713 - DNA, 103 bp, Artificial Sequence
  Synthetic Polynucleotide
taatacgactcactatagggctcatgtacttcacgctcaactccaggatgaacagaggagacatcctatggttgagcgtaacctggcggcagcgcaaaagatg

SEQ ID NO: 131714 - DNA, 103 bp, Artificial Sequence
  Synthetic Polynucleotide
taatacgactcactatagggctgaaggcttctcatgtacttcacgctcaaaacagaggagattgagcatgaagtacatgaacctggcggcagcgcaaaagatg

SEQ ID NO: 131715 - DNA, 103 bp, Artificial Sequence
  Synthetic Polynucleotide
taatacgactcactataggggcaaggagttctgaaggcttctcatgtactaacagaggagaagtacaatggaagccttcaacctggcggcagcgcaaaagatg

SEQ ID NO: 131716 - DNA, 103 bp, Artificial Sequence
  Synthetic Polynucleotide
taatacgactcactatagggcagagcccttgcaaggagttctgaaggcttaacagaggagaaagcctatggaactccttaacctggcggcagcgcaaaagatg

SEQ ID NO: 131717 - DNA, 103 bp, Artificial Sequence
  Synthetic Polynucleotide
taatacgactcactataggggggcacaggccagagcccttgcaaggagttaacagaggagaaactccatgcaagggctcaacctggcggcagcgcaaaagatg

SEQ ID NO: 131718 - DNA, 103 bp, Artificial Sequence
  Synthetic Polynucleotide
taatacgactcactatagggcggctcccctgggcacaggccagagcccttaacagaggagaaagggcatgggcctgtgcaacctggcggcagcgcaaaagatg

SEQ ID NO: 131719 - DNA, 103 bp, Artificial Sequence
  Synthetic Polynucleotide
taatacgactcactataggggacggttgctcggctcccctgggcacaggcaacagaggagagcctgtatgcaggggagcaacctggcggcagcgcaaaagatg

SEQ ID NO: 131720 - DNA, 103 bp, Artificial Sequence
  Synthetic Polynucleotide
taatacgactcactataggggcggaagcccgacggttgctcggctcccctaacagaggagaaggggaatggagcaaccgaacctggcggcagcgcaaaagatg

SEQ ID NO: 131721 - DNA, 103 bp, Artificial Sequence
  Synthetic Polynucleotide
taatacgactcactatagggccagtgacacattgatgcgtgcccggcgctaacagaggagaagcgccatgcacgcatcaaacctggcggcagcgcaaaagatg

SEQ ID NO: 131722 - DNA, 103 bp, Artificial Sequence
  Synthetic Polynucleotide
taatacgactcactataggggcaggcagctgcggaagcccgacggttgctaacagaggagaagcaacatgcgggcttccaacctggcggcagcgcaaaagatg

SEQ ID NO: 131723 - DNA, 103 bp, Artificial Sequence
  Synthetic Polynucleotide
taatacgactcactatagggctcacgccgggcaggcagctgcggaagcccaacagaggagagggcttatgcagctgcctaacctggcggcagcgcaaaagatg

SEQ ID NO: 131724 - DNA, 103 bp, Artificial Sequence
  Synthetic Polynucleotide
taatacgactcactatagggaaggagctggctcacgccgggcaggcagctaacagaggagaagctgcatgcccggcgtgaacctggcggcagcgcaaaagatg

SEQ ID NO: 131725 - DNA, 103 bp, Artificial Sequence
  Synthetic Polynucleotide
taatacgactcactatagggctccgcgccgaaggagctggctcacgccggaacagaggagaccggcgatggccagctccaacctggcggcagcgcaaaagatg

SEQ ID NO: 131726 - DNA, 103 bp, Artificial Sequence
  Synthetic Polynucleotide
taatacgactcactatagggccgacctcatctccgcgccgaaggagctggaacagaggagaccagctatgtcggcgcggaacctggcggcagcgcaaaagatg

SEQ ID NO: 131727 - DNA, 103 bp, Artificial Sequence
  Synthetic Polynucleotide
taatacgactcactatagggcaggccgctgccgacctcatctccgcgccgaacagaggagacggcgcatggatgaggtcaacctggcggcagcgcaaaagatg

SEQ ID NO: 131728 - DNA, 103 bp, Artificial Sequence
  Synthetic Polynucleotide
taatacgactcactataggggggggcagcgcaggccgctgccgacctcataacagaggagaatgaggatggcagcggccaacctggcggcagcgcaaaagatg

SEQ ID NO: 131729 - DNA, 103 bp, Artificial Sequence
  Synthetic Polynucleotide
taatacgactcactatagggtcgggcaccagggggcagcgcaggccgctgaacagaggagacagcggatggcgctgcccaacctggcggcagcgcaaaagatg

SEQ ID NO: 131730 - DNA, 103 bp, Artificial Sequence
  Synthetic Polynucleotide
taatacgactcactatagggggcggcgctctcgggcaccagggggcagcgaacagaggagacgctgcatgctggtgcccaacctggcggcagcgcaaaagatg

SEQ ID NO: 131731 - DNA, 103 bp, Artificial Sequence
  Synthetic Polynucleotide
taatacgactcactatagggtggtgctgccggcggcgctctcgggcaccaaacagaggagatggtgcatgagagcgccgaacctggcggcagcgcaaaagatg

SEQ ID NO: 131732 - DNA, 103 bp, Artificial Sequence
  Synthetic Polynucleotide
taatacgactcactatagggttgagctgctccagtgacacattgatgcgtaacagaggagaacgcatatgtgtgtcactaacctggcggcagcgcaaaagatg

SEQ ID NO: 131733 - DNA, 103 bp, Artificial Sequence
  Synthetic Polynucleotide
taatacgactcactataggggcgctgtccatggtgctgccggcggcgctcaacagaggagagagcgcatgcggcagcacaacctggcggcagcgcaaaagatg

SEQ ID NO: 131734 - DNA, 103 bp, Artificial Sequence
  Synthetic Polynucleotide
taatacgactcactataggggcccaacccggcgctgtccatggtgctgccaacagaggagaggcagcatgatggacagcaacctggcggcagcgcaaaagatg

SEQ ID NO: 131735 - DNA, 103 bp, Artificial Sequence
  Synthetic Polynucleotide
taatacgactcactataggggcgcctcctggcccaacccggcgctgtccaaacagaggagatggacaatgccgggttggaacctggcggcagcgcaaaagatg

SEQ ID NO: 131736 - DNA, 103 bp, Artificial Sequence
  Synthetic Polynucleotide
taatacgactcactatagggaacagcgcgggcgcctcctggcccaacccgaacagaggagacgggttatgccaggaggcaacctggcggcagcgcaaaagatg

SEQ ID NO: 131737 - DNA, 103 bp, Artificial Sequence
  Synthetic Polynucleotide
taatacgactcactataggggcaagggcggaacagcgcgggcgcctcctgaacagaggagacaggagatgcccgcgctgaacctggcggcagcgcaaaagatg

SEQ ID NO: 131738 - DNA, 103 bp, Artificial Sequence
  Synthetic Polynucleotide
taatacgactcactatagggcggcaggggtgcaagggcggaacagcgcggaacagaggagaccgcgcatgtccgcccttaacctggcggcagcgcaaaagatg

SEQ ID NO: 131739 - DNA, 103 bp, Artificial Sequence
  Synthetic Polynucleotide
taatacgactcactatagggggagcccagacggcaggggtgcaagggcggaacagaggagaccgcccatgcacccctgcaacctggcggcagcgcaaaagatg

SEQ ID NO: 131740 - DNA, 103 bp, Artificial Sequence
  Synthetic Polynucleotide
taatacgactcactatagggggccggagcaggagcccagacggcaggggtaacagaggagaacccctatggtctgggctaacctggcggcagcgcaaaagatg

SEQ ID NO: 131741 - DNA, 103 bp, Artificial Sequence
  Synthetic Polynucleotide
taatacgactcactatagggggccgccggcggccggagcaggagcccagaaacagaggagatctgggatgctgctccggaacctggcggcagcgcaaaagatg

SEQ ID NO: 131742 - DNA, 103 bp, Artificial Sequence
  Synthetic Polynucleotide
taatacgactcactatagggggggaccgcgggccgccggcggccggagcaaacagaggagatgctccatgcgccggcggaacctggcggcagcgcaaaagatg

SEQ ID NO: 131743 - DNA, 103 bp, Artificial Sequence
  Synthetic Polynucleotide
taatacgactcactatagggcagcagcgacttgagctgctccagtgacacaacagaggagagtgtcaatggagcagctcaacctggcggcagcgcaaaagatg

SEQ ID NO: 131744 - DNA, 103 bp, Artificial Sequence
  Synthetic Polynucleotide
taatacgactcactatagggcaggggtggtggggaccgcgggccgccggcaacagaggagagccggcatgccgcggtccaacctggcggcagcgcaaaagatg

SEQ ID NO: 131745 - DNA, 103 bp, Artificial Sequence
  Synthetic Polynucleotide
taatacgactcactatagggggaggaggagcaggggtggtggggaccgcgaacagaggagacgcggtatgcaccaccccaacctggcggcagcgcaaaagatg

SEQ ID NO: 131746 - DNA, 103 bp, Artificial Sequence
  Synthetic Polynucleotide
taatacgactcactatagggagactttcggggaggaggagcaggggtggtaacagaggagaaccaccatggctcctcctaacctggcggcagcgcaaaagatg

SEQ ID NO: 131747 - DNA, 103 bp, Artificial Sequence
  Synthetic Polynucleotide
taatacgactcactatagggcgagccagggagactttcggggaggaggagaacagaggagactcctcatgcccgaaagtaacctggcggcagcgcaaaagatg

SEQ ID NO: 131748 - DNA, 103 bp, Artificial Sequence
  Synthetic Polynucleotide
taatacgactcactatagggcgctggcggacgagccagggagactttcggaacagaggagaccgaaaatgtccctggctaacctggcggcagcgcaaaagatg

SEQ ID NO: 131749 - DNA, 103 bp, Artificial Sequence
  Synthetic Polynucleotide
taatacgactcactatagggggcggggggacgctggcggacgagccagggaacagaggagaccctggatggtccgccagaacctggcggcagcgcaaaagatg

SEQ ID NO: 131750 - DNA, 103 bp, Artificial Sequence
  Synthetic Polynucleotide
taatacgactcactatagggcgctggctgcggcggggggacgctggcggaaacagaggagatccgccatggtccccccgaacctggcggcagcgcaaaagatg

SEQ ID NO: 131751 - DNA, 103 bp, Artificial Sequence
  Synthetic Polynucleotide
taatacgactcactatagggagcgactcgacgctggctgcggcggggggaaacagaggagatcccccatgcgcagccagaacctggcggcagcgcaaaagatg

SEQ ID NO: 131752 - DNA, 103 bp, Artificial Sequence
  Synthetic Polynucleotide
taatacgactcactatagggctctcggcgcagcgactcgacgctggctgcaacagaggagagcagccatggtcgagtcgaacctggcggcagcgcaaaagatg

SEQ ID NO: 131753 - DNA, 103 bp, Artificial Sequence
  Synthetic Polynucleotide
taatacgactcactatagggcagcccgggactctcggcgcagcgactcgaaacagaggagatcgagtatgtgcgccgagaacctggcggcagcgcaaaagatg

SEQ ID NO: 131754 - DNA, 103 bp, Artificial Sequence
  Synthetic Polynucleotide
taatacgactcactatagggagtgtttctccagcagcgacttgagctgctaacagaggagaagcagcatgagtcgctgcaacctggcggcagcgcaaaagatg

SEQ ID NO: 131755 - DNA, 103 bp, Artificial Sequence
  Synthetic Polynucleotide
taatacgactcactatagggcgcgcaggcccagcccgggactctcggcgcaacagaggagagcgccgatggtcccgggcaacctggcggcagcgcaaaagatg

SEQ ID NO: 131756 - DNA, 103 bp, Artificial Sequence
  Synthetic Polynucleotide
taatacgactcactatagggggccgccacacgcgcaggcccagcccgggaaacagaggagatcccggatggggcctgcgaacctggcggcagcgcaaaagatg

SEQ ID NO: 131757 - DNA, 103 bp, Artificial Sequence
  Synthetic Polynucleotide
taatacgactcactataggggcttccccagggccgccacacgcgcaggccaacagaggagaggcctgatggtgtggcggaacctggcggcagcgcaaaagatg

SEQ ID NO: 131758 - DNA, 103 bp, Artificial Sequence
  Synthetic Polynucleotide
taatacgactcactatagggcatccccggggcttccccagggccgccacaaacagaggagatgtggcatgcctggggaaaacctggcggcagcgcaaaagatg

SEQ ID NO: 131759 - DNA, 103 bp, Artificial Sequence
  Synthetic Polynucleotide
taatacgactcactatagggcagttcaggtcatccccggggcttccccagaacagaggagactggggatgccccggggaaacctggcggcagcgcaaaagatg

SEQ ID NO: 131760 - DNA, 103 bp, Artificial Sequence
  Synthetic Polynucleotide
taatacgactcactatagggtggtgcgagtagtgtttctccagcagcgacaacagaggagagtcgctatgggagaaacaaacctggcggcagcgcaaaagatg

SEQ ID NO: 131761 - DNA, 103 bp, Artificial Sequence
  Synthetic Polynucleotide
taatacgactcactatagggcttccggatctggtgcgagtagtgtttctcaacagaggagagagaaaatgtactcgcacaacctggcggcagcgcaaaagatg

SEQ ID NO: 131762 - DNA, 103 bp, Artificial Sequence
  Synthetic Polynucleotide
taatacgactcactatagggccaatttgcgcttccggatctggtgcgagtaacagaggagaactcgcatgagatccggaaacctggcggcagcgcaaaagatg

SEQ ID NO: 131763 - DNA, 103 bp, Artificial Sequence
  Synthetic Polynucleotide
taatacgactcactatagggtcggccttctccaatttgcgcttccggatcaacagaggagagatccgatggcgcaaattaacctggcggcagcgcaaaagatg

SEQ ID NO: 131764 - DNA, 103 bp, Artificial Sequence
  Synthetic Polynucleotide
taatacgactcactataggggctcggtttccccggcgtgtctgcggccataacagaggagaatggccatggacacgccgaacctggcggcagcgcaaaagatg

SEQ ID NO: 131765 - DNA, 103 bp, Artificial Sequence
  Synthetic Polynucleotide
taatacgactcactatagggcggcttggaggacttgcggtgctcggccgcaacagaggagagcggccatgcaccgcaagaacctggcggcagcgcaaaagatg

SEQ ID NO: 131766 - DNA, 103 bp, Artificial Sequence
  Synthetic Polynucleotide
taatacgactcactatagggtctccatgaccggcttggaggacttgcggtaacagaggagaaccgcaatgcctccaagcaacctggcggcagcgcaaaagatg

SEQ ID NO: 131767 - DNA, 103 bp, Artificial Sequence
  Synthetic Polynucleotide
taatacgactcactatagggcggcgccgcttctccatgaccggcttggagaacagaggagactccaaatgggtcatggaaacctggcggcagcgcaaaagatg

SEQ ID NO: 131768 - DNA, 103 bp, Artificial Sequence
  Synthetic Polynucleotide
taatacgactcactatagggaatacgcgctcggcgccgcttctccatgacaacagaggagagtcatgatgaagcggcgcaacctggcggcagcgcaaaagatg

SEQ ID NO: 131769 - DNA, 103 bp, Artificial Sequence
  Synthetic Polynucleotide
taatacgactcactatagggggctctcgttaatacgcgctcggcgccgctaacagaggagaagcggcatggagcgcgtaaacctggcggcagcgcaaaagatg

SEQ ID NO: 131770 - DNA, 103 bp, Artificial Sequence
  Synthetic Polynucleotide
taatacgactcactatagggagctgagcgaggctctcgttaatacgcgctaacagaggagaagcgcgatgtaacgagagaacctggcggcagcgcaaaagatg

SEQ ID NO: 131771 - DNA, 103 bp, Artificial Sequence
  Synthetic Polynucleotide
taatacgactcactataggggagggttttgagctgagcgaggctctcgttaacagaggagaaacgagatgctcgctcagaacctggcggcagcgcaaaagatg

SEQ ID NO: 131772 - DNA, 103 bp, Artificial Sequence
  Synthetic Polynucleotide
taatacgactcactatagggcgtccaggatgagggttttgagctgagcgaaacagaggagatcgctcatgtcaaaacccaacctggcggcagcgcaaaagatg

SEQ ID NO: 131773 - DNA, 103 bp, Artificial Sequence
  Synthetic Polynucleotide
taatacgactcactatagggtttctgagggcgtccaggatgagggttttgaacagaggagacaaaacatgcatcctggaaacctggcggcagcgcaaaagatg

SEQ ID NO: 131774 - DNA, 103 bp, Artificial Sequence
  Synthetic Polynucleotide
taatacgactcactatagggggagctctcttttctgagggcgtccaggataacagaggagaatcctgatggccctcagaaacctggcggcagcgcaaaagatg

SEQ ID NO: 131775 - DNA, 103 bp, Artificial Sequence
  Synthetic Polynucleotide
taatacgactcactatagggtcggcgaggcgctcggtttccccggcgtgtaacagaggagaacacgcatgggaaaccgaaacctggcggcagcgcaaaagatg

SEQ ID NO: 131776 - DNA, 103 bp, Artificial Sequence
  Synthetic Polynucleotide
taatacgactcactatagggtcgagtggcgggagctctcttttctgagggaacagaggagaccctcaatgaagagagctaacctggcggcagcgcaaaagatg

SEQ ID NO: 131777 - DNA, 103 bp, Artificial Sequence
  Synthetic Polynucleotide
taatacgactcactatagggttctccagcttcgagtggcgggagctctctaacagaggagaagagagatgccgccactcaacctggcggcagcgcaaaagatg

SEQ ID NO: 131778 - DNA, 103 bp, Artificial Sequence
  Synthetic Polynucleotide
taatacgactcactataggggatgtccgccttctccagcttcgagtggcgaacagaggagacgccacatgaagctggagaacctggcggcagcgcaaaagatg

SEQ ID NO: 131779 - DNA, 103 bp, Artificial Sequence
  Synthetic Polynucleotide
taatacgactcactatagggtcatctccaggatgtccgccttctccagctaacagaggagaagctggatgaggcggacaaacctggcggcagcgcaaaagatg

SEQ ID NO: 131780 - DNA, 103 bp, Artificial Sequence
  Synthetic Polynucleotide
taatacgactcactatagggtgtctcacggtcatctccaggatgtccgccaacagaggagaggcggaatgcctggagataacctggcggcagcgcaaaagatg

SEQ ID NO: 131781 - DNA, 103 bp, Artificial Sequence
  Synthetic Polynucleotide
taatacgactcactataggggctccgcaggtgtctcacggtcatctccagaacagaggagactggagatgaccgtgagaaacctggcggcagcgcaaaagatg

SEQ ID NO: 131782 - DNA, 103 bp, Artificial Sequence
  Synthetic Polynucleotide
taatacgactcactatagggcgcgacgcaggctccgcaggtgtctcacggaacagaggagaccgtgaatgacctgcggaaacctggcggcagcgcaaaagatg

SEQ ID NO: 131783 - DNA, 103 bp, Artificial Sequence
  Synthetic Polynucleotide
taatacgactcactataggggtcacctgcacgcgacgcaggctccgcaggaacagaggagacctgcgatgcctgcgtcgaacctggcggcagcgcaaaagatg

SEQ ID NO: 131784 - DNA, 103 bp, Artificial Sequence
  Synthetic Polynucleotide
taatacgactcactataggggagcgcggccgtcacctgcacgcgacgcagaacagaggagactgcgtatggtgcaggtgaacctggcggcagcgcaaaagatg

SEQ ID NO: 131785 - DNA, 103 bp, Artificial Sequence
  Synthetic Polynucleotide
taatacgactcactatagggggtcggcgctgagcgcggccgtcacctgcaaacagaggagatgcaggatgcggccgcgcaacctggcggcagcgcaaaagatg

SEQ ID NO: 131786 - DNA, 103 bp, Artificial Sequence
  Synthetic Polynucleotide
taatacgactcactataggggctcctgccatcggcgaggcgctcggtttcaacagaggagagaaaccatgcgcctcgccaacctggcggcagcgcaaaagatg

SEQ ID NO: 131787 - DNA, 103 bp, Artificial Sequence
  Synthetic Polynucleotide
taatacgactcactatagggagaacggcggggtcggcgctgagcgcggccaacagaggagaggccgcatgcagcgccgaaacctggcggcagcgcaaaagatg

SEQ ID NO: 131788 - DNA, 103 bp, Artificial Sequence
  Synthetic Polynucleotide
taatacgactcactataggggtacttgcccagaacggcggggtcggcgctaacagaggagaagcgccatgcccgccgttaacctggcggcagcgcaaaagatg

SEQ ID NO: 131789 - DNA, 103 bp, Artificial Sequence
  Synthetic Polynucleotide
taatacgactcactatagggagccggcgcggtacttgcccagaacggcggaacagaggagaccgccgatgtgggcaagtaacctggcggcagcgcaaaagatg

SEQ ID NO: 131790 - DNA, 103 bp, Artificial Sequence
  Synthetic Polynucleotide
taatacgactcactatagggcactcgtggaagccggcgcggtacttgcccaacagaggagagggcaaatgccgcgccggaacctggcggcagcgcaaaagatg

SEQ ID NO: 131791 - DNA, 103 bp, Artificial Sequence
  Synthetic Polynucleotide
taatacgactcactatagggctccgccagacactcgtggaagccggcgcgaacagaggagacgcgccatgttccacgagaacctggcggcagcgcaaaagatg

SEQ ID NO: 131792 - DNA, 103 bp, Artificial Sequence
  Synthetic Polynucleotide
taatacgactcactatagggagcggttcacctccgccagacactcgtggaaacagaggagatccacgatggtctggcggaacctggcggcagcgcaaaagatg

SEQ ID NO: 131793 - DNA, 103 bp, Artificial Sequence
  Synthetic Polynucleotide
taatacgactcactatagggccggccaggaagcggttcacctccgccagaaacagaggagatctggcatgggtgaaccgaacctggcggcagcgcaaaagatg

SEQ ID NO: 131794 - DNA, 103 bp, Artificial Sequence
  Synthetic Polynucleotide
taatacgactcactataggggccctcgcagccggccaggaagcggttcacaacagaggagagtgaacatgttcctggccaacctggcggcagcgcaaaagatg

SEQ ID NO: 131795 - DNA, 103 bp, Artificial Sequence
  Synthetic Polynucleotide
taatacgactcactatagggcggccgggacgccctcgcagccggccaggaaacagaggagatcctggatggctgcgaggaacctggcggcagcgcaaaagatg

SEQ ID NO: 131796 - DNA, 103 bp, Artificial Sequence
  Synthetic Polynucleotide
taatacgactcactataggggagcgcacgtcggccgggacgccctcgcagaacagaggagactgcgaatgcgtcccggcaacctggcggcagcgcaaaagatg

SEQ ID NO: 131797 - DNA, 103 bp, Artificial Sequence
  Synthetic Polynucleotide
taatacgactcactataggggctggccggcgctcctgccatcggcgaggcaacagaggagagcctcgatgatggcaggaaacctggcggcagcgcaaaagatg

SEQ ID NO: 131798 - DNA, 103 bp, Artificial Sequence
  Synthetic Polynucleotide
taatacgactcactatagggcagcaggcgggagcgcacgtcggccgggacaacagaggagagtcccgatggacgtgcgcaacctggcggcagcgcaaaagatg

SEQ ID NO: 131799 - DNA, 103 bp, Artificial Sequence
  Synthetic Polynucleotide
taatacgactcactatagggccaggtggcccagcaggcgggagcgcacgtaacagaggagaacgtgcatgcccgcctgcaacctggcggcagcgcaaaagatg

SEQ ID NO: 131800 - DNA, 103 bp, Artificial Sequence
  Synthetic Polynucleotide
taatacgactcactatagggaggcaggctgccaggtggcccagcaggcggaacagaggagaccgcctatggggccacctaacctggcggcagcgcaaaagatg

SEQ ID NO: 131801 - DNA, 103 bp, Artificial Sequence
  Synthetic Polynucleotide
taatacgactcactatagggcagctggcgcaggcaggctgccaggtggccaacagaggagaggccacatggcagcctgcaacctggcggcagcgcaaaagatg

SEQ ID NO: 131802 - DNA, 103 bp, Artificial Sequence
  Synthetic Polynucleotide
taatacgactcactataggggggagggtcccagctggcgcaggcaggctgaacagaggagacagcctatgtgcgccagcaacctggcggcagcgcaaaagatg

SEQ ID NO: 131803 - DNA, 103 bp, Artificial Sequence
  Synthetic Polynucleotide
taatacgactcactataggggccgggcggcgggagggtcccagctggcgcaacagaggagagcgccaatggggaccctcaacctggcggcagcgcaaaagatg

SEQ ID NO: 131804 - DNA, 103 bp, Artificial Sequence
  Synthetic Polynucleotide
taatacgactcactatagggggacagcgaggccgggcggcgggagggtccaacagaggagaggacccatgcgccgcccgaacctggcggcagcgcaaaagatg

SEQ ID NO: 131805 - DNA, 103 bp, Artificial Sequence
  Synthetic Polynucleotide
taatacgactcactataggggggcagccggggacagcgaggccgggcggcaacagaggagagccgccatgcctcgctgtaacctggcggcagcgcaaaagatg

SEQ ID NO: 131806 - DNA, 103 bp, Artificial Sequence
  Synthetic Polynucleotide
taatacgactcactataggggcctctgcgggggcagccggggacagcgagaacagaggagactcgctatgcccggctgcaacctggcggcagcgcaaaagatg

SEQ ID NO: 131807 - DNA, 103 bp, Artificial Sequence
  Synthetic Polynucleotide
taatacgactcactataggggggcgctggggcctctgcgggggcagccggaacagaggagaccggctatgcccgcagagaacctggcggcagcgcaaaagatg

SEQ ID NO: 131808 - DNA, 103 bp, Artificial Sequence
  Synthetic Polynucleotide
taatacgactcactatagggtccggctggcgctggccggcgctcctgccaaacagaggagatggcagatgcgccggccaaacctggcggcagcgcaaaagatg

SEQ ID NO: 131809 - DNA, 103 bp, Artificial Sequence
  Synthetic Polynucleotide
taatacgactcactatagggcgtagacctcgggcgctggggcctctgcggaacagaggagaccgcagatgccccagcgcaacctggcggcagcgcaaaagatg

SEQ ID NO: 131810 - DNA, 103 bp, Artificial Sequence
  Synthetic Polynucleotide
taatacgactcactataggggggcggcccgcgtagacctcgggcgctgggaacagaggagacccagcatgcgaggtctaaacctggcggcagcgcaaaagatg

SEQ ID NO: 131811 - DNA, 103 bp, Artificial Sequence
  Synthetic Polynucleotide
taatacgactcactatagggtggcagcagcgggcggcccgcgtagacctcaacagaggagagaggtcatggcgggccgcaacctggcggcagcgcaaaagatg

SEQ ID NO: 131812 - DNA, 103 bp, Artificial Sequence
  Synthetic Polynucleotide
taatacgactcactatagggcgccgagcgatggcagcagcgggcggcccgaacagaggagacgggccatgcgctgctgcaacctggcggcagcgcaaaagatg

SEQ ID NO: 131813 - DNA, 103 bp, Artificial Sequence
  Synthetic Polynucleotide
taatacgactcactataggggggaaggggccgccgagcgatggcagcagcaacagaggagagctgctatgatcgctcggaacctggcggcagcgcaaaagatg

SEQ ID NO: 131814 - DNA, 103 bp, Artificial Sequence
  Synthetic Polynucleotide
taatacgactcactatagggcgcgagcagagggaaggggccgccgagcgaaacagaggagatcgctcatgggccccttcaacctggcggcagcgcaaaagatg

SEQ ID NO: 131815 - DNA, 103 bp, Artificial Sequence
  Synthetic Polynucleotide
taatacgactcactataggggcagcggcggcgcgagcagagggaaggggcaacagaggagagcccctatgctctgctcgaacctggcggcagcgcaaaagatg

SEQ ID NO: 131816 - DNA, 103 bp, Artificial Sequence
  Synthetic Polynucleotide
taatacgactcactatagggagacccggcagcagcggcggcgcgagcagaaacagaggagatctgctatggccgccgctaacctggcggcagcgcaaaagatg

SEQ ID NO: 131817 - DNA, 103 bp, Artificial Sequence
  Synthetic Polynucleotide
taatacgactcactatagggcgcccgggtcagacccggcagcagcggcggaacagaggagaccgccgatgctgccgggtaacctggcggcagcgcaaaagatg

SEQ ID NO: 131818 - DNA, 103 bp, Artificial Sequence
  Synthetic Polynucleotide
taatacgactcactatagggcggcgggcagcgcccgggtcagacccggcaaacagaggagatgccggatgtgacccgggaacctggcggcagcgcaaaagatg

SEQ ID NO: 131819 - DNA, 103 bp, Artificial Sequence
  Synthetic Polynucleotide
taatacgactcactatagggttgtctggggtccggctggcgctggccggcaacagaggagagccggcatgcgccagccgaacctggcggcagcgcaaaagatg

SEQ ID NO: 131820 - DNA, 103 bp, Artificial Sequence
  Synthetic Polynucleotide
taatacgactcactataggggccctgggggcggcgggcagcgcccgggtcaacagaggagagacccgatggctgcccgcaacctggcggcagcgcaaaagatg

SEQ ID NO: 131821 - DNA, 103 bp, Artificial Sequence
  Synthetic Polynucleotide
taatacgactcactatagggctgcggccccgccctgggggcggcgggcagaacagaggagactgcccatggcccccaggaacctggcggcagcgcaaaagatg

SEQ ID NO: 131822 - DNA, 103 bp, Artificial Sequence
  Synthetic Polynucleotide
taatacgactcactatagggcacccgggccctgcggccccgccctgggggaacagaggagacccccaatgcggggccgcaacctggcggcagcgcaaaagatg

SEQ ID NO: 131823 - DNA, 103 bp, Artificial Sequence
  Synthetic Polynucleotide
taatacgactcactatagggctccagggcccacccgggccctgcggccccaacagaggagaggggccatggggcccgggaacctggcggcagcgcaaaagatg

SEQ ID NO: 131824 - DNA, 103 bp, Artificial Sequence
  Synthetic Polynucleotide
taatacgactcactatagggcagccacggcctccagggcccacccgggccaacagaggagaggcccgatggggccctggaacctggcggcagcgcaaaagatg

SEQ ID NO: 131825 - DNA, 103 bp, Artificial Sequence
  Synthetic Polynucleotide
taatacgactcactataggggctccggggcttgtctggggtccggctggcaacagaggagagccagcatgaccccagacaacctggcggcagcgcaaaagatg

SEQ ID NO: 131826 - DNA, 103 bp, Artificial Sequence
  Synthetic Polynucleotide
taatacgactcactataggggctcggccgcgctccggggcttgtctggggaacagaggagaccccagatgagccccggaaacctggcggcagcgcaaaagatg

SEQ ID NO: 131827 - DNA, 103 bp, Artificial Sequence
  Synthetic Polynucleotide
taatacgactcactataggggacttgcggtgctcggccgcgctccggggcaacagaggagagccccgatgcgcggccgaaacctggcggcagcgcaaaagatg

SEQ ID NO: 131828 - DNA, 103 bp, Artificial Sequence
  Synthetic Polynucleotide
taatacgactcactatagggcagctccacggccacagtgctgggggccataacagaggagaatggccatgagcactgtgaacctggcggcagcgcaaaagatg

SEQ ID NO: 131829 - DNA, 103 bp, Artificial Sequence
  Synthetic Polynucleotide
taatacgactcactatagggcttcagctgctcgatgctgctgttgatgcgaacagaggagacgcatcatgagcagcatcaacctggcggcagcgcaaaagatg

SEQ ID NO: 131830 - DNA, 103 bp, Artificial Sequence
  Synthetic Polynucleotide
taatacgactcactatagggccagcagcagcttcagctgctcgatgctgcaacagaggagagcagcaatgagcagctgaaacctggcggcagcgcaaaagatg

SEQ ID NO: 131831 - DNA, 103 bp, Artificial Sequence
  Synthetic Polynucleotide
taatacgactcactatagggaactcctgctccagcagcagcttcagctgcaacagaggagagcagctatggctgctgctaacctggcggcagcgcaaaagatg

SEQ ID NO: 131832 - DNA, 103 bp, Artificial Sequence
  Synthetic Polynucleotide
taatacgactcactataggggtgccgcgcgaactcctgctccagcagcagaacagaggagactgctgatggagcaggagaacctggcggcagcgcaaaagatg

SEQ ID NO: 131833 - DNA, 103 bp, Artificial Sequence
  Synthetic Polynucleotide
taatacgactcactatagggagttgggctggtgccgcgcgaactcctgctaacagaggagaagcaggatgtcgcgcggcaacctggcggcagcgcaaaagatg

SEQ ID NO: 131834 - DNA, 103 bp, Artificial Sequence
  Synthetic Polynucleotide
taatacgactcactatagggtccagcttggagttgggctggtgccgcgcgaacagaggagacgcgcgatgccagcccaaaacctggcggcagcgcaaaagatg

SEQ ID NO: 131835 - DNA, 103 bp, Artificial Sequence
  Synthetic Polynucleotide
taatacgactcactataggggtcggccttctccagcttggagttgggctgaacagaggagacagcccatgtccaagctgaacctggcggcagcgcaaaagatg

SEQ ID NO: 131836 - DNA, 103 bp, Artificial Sequence
  Synthetic Polynucleotide
taatacgactcactatagggtctccaggatgtcggccttctccagcttggaacagaggagaccaagcatgagaaggccgaacctggcggcagcgcaaaagatg

SEQ ID NO: 131837 - DNA, 103 bp, Artificial Sequence
  Synthetic Polynucleotide
taatacgactcactatagggctgacagccatctccaggatgtcggccttcaacagaggagagaaggcatgcatcctggaaacctggcggcagcgcaaaagatg

SEQ ID NO: 131838 - DNA, 103 bp, Artificial Sequence
  Synthetic Polynucleotide
taatacgactcactatagggcttcaggtagctgacagccatctccaggataacagaggagaatcctgatgatggctgtcaacctggcggcagcgcaaaagatg

SEQ ID NO: 131839 - DNA, 103 bp, Artificial Sequence
  Synthetic Polynucleotide
taatacgactcactatagggtggggctgagcagctccacggccacagtgcaacagaggagagcactgatgccgtggagcaacctggcggcagcgcaaaagatg

SEQ ID NO: 131840 - DNA, 103 bp, Artificial Sequence
  Synthetic Polynucleotide
taatacgactcactatagggctttgctgtgcttcaggtagctgacagccaaacagaggagatggctgatggctacctgaaacctggcggcagcgcaaaagatg

SEQ ID NO: 131841 - DNA, 103 bp, Artificial Sequence
  Synthetic Polynucleotide
taatacgactcactataggggcgacgaaggctttgctgtgcttcaggtagaacagaggagactacctatggcacagcaaaacctggcggcagcgcaaaagatg

SEQ ID NO: 131842 - DNA, 103 bp, Artificial Sequence
  Synthetic Polynucleotide
taatacgactcactataggggccggcggcggcgacgaaggctttgctgtgaacagaggagacacagcatggccttcgtcaacctggcggcagcgcaaaagatg

SEQ ID NO: 131843 - DNA, 103 bp, Artificial Sequence
  Synthetic Polynucleotide
taatacgactcactatagggggctcttggggccggcggcggcgacgaaggaacagaggagaccttcgatgccgccgccgaacctggcggcagcgcaaaagatg

SEQ ID NO: 131844 - DNA, 103 bp, Artificial Sequence
  Synthetic Polynucleotide
taatacgactcactatagggtcctggtgcaggctcttggggccggcggcgaacagaggagacgccgcatgccccaagagaacctggcggcagcgcaaaagatg

SEQ ID NO: 131845 - DNA, 103 bp, Artificial Sequence
  Synthetic Polynucleotide
taatacgactcactatagggttcgctgtagtcctggtgcaggctcttgggaacagaggagacccaagatgctgcaccagaacctggcggcagcgcaaaagatg

SEQ ID NO: 131846 - DNA, 103 bp, Artificial Sequence
  Synthetic Polynucleotide
taatacgactcactatagggacgagtagccttcgctgtagtcctggtgcaaacagaggagatgcaccatgactacagcgaacctggcggcagcgcaaaagatg

SEQ ID NO: 131847 - DNA, 103 bp, Artificial Sequence
  Synthetic Polynucleotide
taatacgactcactatagggtgcaggcaccacgagtagccttcgctgtagaacagaggagactacagatgaggctactcaacctggcggcagcgcaaaagatg

SEQ ID NO: 131848 - DNA, 103 bp, Artificial Sequence
  Synthetic Polynucleotide
taatacgactcactatagggcacggcctcctgcaggcaccacgagtagccaacagaggagaggctacatgtggtgcctgaacctggcggcagcgcaaaagatg

SEQ ID NO: 131849 - DNA, 103 bp, Artificial Sequence
  Synthetic Polynucleotide
taatacgactcactatagggtcaggaactgcacggcctcctgcaggcaccaacagaggagaggtgccatgaggaggccgaacctggcggcagcgcaaaagatg

SEQ ID NO: 131850 - DNA, 103 bp, Artificial Sequence
  Synthetic Polynucleotide
taatacgactcactatagggtttttctctttggggctgagcagctccacgaacagaggagacgtggaatggctcagcccaacctggcggcagcgcaaaagatg

SEQ ID NO: 131851 - DNA, 103 bp, Artificial Sequence
  Synthetic Polynucleotide
taatacgactcactataggggcgtggagcgtcaggaactgcacggcctccaacagaggagaggaggcatggcagttcctaacctggcggcagcgcaaaagatg

SEQ ID NO: 131852 - DNA, 103 bp, Artificial Sequence
  Synthetic Polynucleotide
taatacgactcactataggggtcgctggcggcgtggagcgtcaggaactgaacagaggagacagttcatgacgctccacaacctggcggcagcgcaaaagatg

SEQ ID NO: 131853 - DNA, 103 bp, Artificial Sequence
  Synthetic Polynucleotide
taatacgactcactatagggtcatctgcgtgtcgctggcggcgtggagcgaacagaggagacgctccatgccgccagcgaacctggcggcagcgcaaaagatg

SEQ ID NO: 131854 - DNA, 103 bp, Artificial Sequence
  Synthetic Polynucleotide
taatacgactcactatagggtacagcagcttcatctgcgtgtcgctggcgaacagaggagacgccagatgcacgcagataacctggcggcagcgcaaaagatg

SEQ ID NO: 131855 - DNA, 103 bp, Artificial Sequence
  Synthetic Polynucleotide
taatacgactcactatagggctggaagtggtacagcagcttcatctgcgtaacagaggagaacgcagatgaagctgctgaacctggcggcagcgcaaaagatg

SEQ ID NO: 131856 - DNA, 103 bp, Artificial Sequence
  Synthetic Polynucleotide
taatacgactcactatagggccgggggccgctggaagtggtacagcagctaacagaggagaagctgcatgaccacttccaacctggcggcagcgcaaaagatg

SEQ ID NO: 131857 - DNA, 103 bp, Artificial Sequence
  Synthetic Polynucleotide
taatacgactcactataggggcgggcgcggccgggggccgctggaagtggaacagaggagaccacttatggcggcccccaacctggcggcagcgcaaaagatg

SEQ ID NO: 131858 - DNA, 103 bp, Artificial Sequence
  Synthetic Polynucleotide
taatacgactcactatagggggcgggcgcggcgggcgcggccgggggccgaacagaggagacggcccatggccgcgcccaacctggcggcagcgcaaaagatg

SEQ ID NO: 131859 - DNA, 103 bp, Artificial Sequence
  Synthetic Polynucleotide
taatacgactcactatagggtgggctccttggcgggcgcggcgggcgcggaacagaggagaccgcgcatgccgcgcccgaacctggcggcagcgcaaaagatg

SEQ ID NO: 131860 - DNA, 103 bp, Artificial Sequence
  Synthetic Polynucleotide
taatacgactcactatagggcccggcgccttgggctccttggcgggcgcgaacagaggagacgcgccatgcaaggagccaacctggcggcagcgcaaaagatg

SEQ ID NO: 131861 - DNA, 103 bp, Artificial Sequence
  Synthetic Polynucleotide
taatacgactcactatagggccgcagtcggtttttctctttggggctgagaacagaggagactcagcatgaaagagaaaaacctggcggcagcgcaaaagatg

SEQ ID NO: 131862 - DNA, 103 bp, Artificial Sequence
  Synthetic Polynucleotide
taatacgactcactataggggggcgcggcgcccggcgccttgggctccttaacagaggagaaaggagatgaaggcgccgaacctggcggcagcgcaaaagatg

SEQ ID NO: 131863 - DNA, 103 bp, Artificial Sequence
  Synthetic Polynucleotide
taatacgactcactataggggcgcgggcgggggcgcggcgcccggcgcctaacagaggagaaggcgcatggcgccgcgcaacctggcggcagcgcaaaagatg

SEQ ID NO: 131864 - DNA, 103 bp, Artificial Sequence
  Synthetic Polynucleotide
taatacgactcactatagggttggcggagagcgcgggcgggggcgcggcgaacagaggagacgccgcatgcccgcccgcaacctggcggcagcgcaaaagatg

SEQ ID NO: 131865 - DNA, 103 bp, Artificial Sequence
  Synthetic Polynucleotide
taatacgactcactatagggggcggtggccttggcggagagcgcgggcggaacagaggagaccgcccatgctctccgccaacctggcggcagcgcaaaagatg

SEQ ID NO: 131866 - DNA, 103 bp, Artificial Sequence
  Synthetic Polynucleotide
taatacgactcactatagggcggcggcggcggcggtggccttggcggagaaacagaggagatctccgatgaggccaccgaacctggcggcagcgcaaaagatg

SEQ ID NO: 131867 - DNA, 103 bp, Artificial Sequence
  Synthetic Polynucleotide
taatacgactcactatagggtggtgcgcggcggcggcggcggcggtggccaacagaggagaggccacatgcgccgccgcaacctggcggcagcgcaaaagatg

SEQ ID NO: 131868 - DNA, 103 bp, Artificial Sequence
  Synthetic Polynucleotide
taatacgactcactataggggcaggcgggctggtgcgcggcggcggcggcaacagaggagagccgccatggccgcgcacaacctggcggcagcgcaaaagatg

SEQ ID NO: 131869 - DNA, 103 bp, Artificial Sequence
  Synthetic Polynucleotide
taatacgactcactataggggccagaggccgcaggcgggctggtgcgcggaacagaggagaccgcgcatgagcccgcctaacctggcggcagcgcaaaagatg

SEQ ID NO: 131870 - DNA, 103 bp, Artificial Sequence
  Synthetic Polynucleotide
taatacgactcactatagggcaccagggccgccagaggccgcaggcgggcaacagaggagagcccgcatgcggcctctgaacctggcggcagcgcaaaagatg

SEQ ID NO: 131871 - DNA, 103 bp, Artificial Sequence
  Synthetic Polynucleotide
taatacgactcactatagggccaccggcttccgcagtcggtttttctcttaacagaggagaaagagaatgaccgactgcaacctggcggcagcgcaaaagatg

SEQ ID NO: 131872 - DNA, 103 bp, Artificial Sequence
  Synthetic Polynucleotide
taatacgactcactatagggatcttctccaccaccggcttccgcagtcggaacagaggagaccgactatggaagccggtaacctggcggcagcgcaaaagatg

SEQ ID NO: 131873 - DNA, 103 bp, Artificial Sequence
  Synthetic Polynucleotide
taatacgactcactataggggtcgcggcgcatcttctccaccaccggcttaacagaggagaaagccgatggtggagaagaacctggcggcagcgcaaaagatg

SEQ ID NO: 131874 - DNA, 103 bp, Artificial Sequence
  Synthetic Polynucleotide
taatacgactcactatagggtgttgatgcggtcgcggcgcatcttctccaaacagaggagatggagaatgtgcgccgcgaacctggcggcagcgcaaaagatg

SEQ ID NO: 131875 - DNA, 103 bp, Artificial Sequence
  Synthetic Polynucleotide
taatacgactcactatagggtcgatgctgctgttgatgcggtcgcggcgcaacagaggagagcgccgatgccgcatcaaaacctggcggcagcgcaaaagatg

SEQ ID NO: 131876 - DNA, 103 bp, Artificial Sequence
  Synthetic Polynucleotide
taatacgactcactataggggtcccggccaggcgccgcgggtggcgccataacagaggagaatggcgatgcccgcggcgaacctggcggcagcgcaaaagatg

SEQ ID NO: 131877 - DNA, 103 bp, Artificial Sequence
  Synthetic Polynucleotide
taatacgactcactatagggccgcgcgcgccgcttcttctccaccaggggaacagaggagacccctgatggagaagaagaacctggcggcagcgcaaaagatg

SEQ ID NO: 131878 - DNA, 103 bp, Artificial Sequence
  Synthetic Polynucleotide
taatacgactcactatagggtctcgttgatccgcgcgcgccgcttcttctaacagaggagaagaagaatgggcgcgcgcaacctggcggcagcgcaaaagatg

SEQ ID NO: 131879 - DNA, 103 bp, Artificial Sequence
  Synthetic Polynucleotide
taatacgactcactatagggtcctgcaggctctcgttgatccgcgcgcgcaacagaggagagcgcgcatggatcaacgaaacctggcggcagcgcaaaagatg

SEQ ID NO: 131880 - DNA, 103 bp, Artificial Sequence
  Synthetic Polynucleotide
taatacgactcactatagggcagccgcagctcctgcaggctctcgttgataacagaggagaatcaacatgagcctgcagaacctggcggcagcgcaaaagatg

SEQ ID NO: 131881 - DNA, 103 bp, Artificial Sequence
  Synthetic Polynucleotide
taatacgactcactatagggccgccagcagcagccgcagctcctgcaggcaacagaggagagcctgcatgagctgcggcaacctggcggcagcgcaaaagatg

SEQ ID NO: 131882 - DNA, 103 bp, Artificial Sequence
  Synthetic Polynucleotide
taatacgactcactatagggacctcggcgcccgccagcagcagccgcagcaacagaggagagctgcgatggctgctggcaacctggcggcagcgcaaaagatg

SEQ ID NO: 131883 - DNA, 103 bp, Artificial Sequence
  Synthetic Polynucleotide
taatacgactcactatagggcttggcctgcacctcggcgcccgccagcagaacagaggagactgctgatgggcgccgagaacctggcggcagcgcaaaagatg

SEQ ID NO: 131884 - DNA, 103 bp, Artificial Sequence
  Synthetic Polynucleotide
taatacgactcactatagggcgttctccagcttggcctgcacctcggcgcaacagaggagagcgccgatgtgcaggccaaacctggcggcagcgcaaaagatg

SEQ ID NO: 131885 - DNA, 103 bp, Artificial Sequence
  Synthetic Polynucleotide
taatacgactcactatagggagcacttcggcgttctccagcttggcctgcaacagaggagagcaggcatggctggagaaaacctggcggcagcgcaaaagatg

SEQ ID NO: 131886 - DNA, 103 bp, Artificial Sequence
  Synthetic Polynucleotide
taatacgactcactatagggcgtcagctccagcacttcggcgttctccagaacagaggagactggagatggccgaagtgaacctggcggcagcgcaaaagatg

SEQ ID NO: 131887 - DNA, 103 bp, Artificial Sequence
  Synthetic Polynucleotide
taatacgactcactatagggggcccacacggtcccggccaggcgccgcggaacagaggagaccgcggatgctggccgggaacctggcggcagcgcaaaagatg

SEQ ID NO: 131888 - DNA, 103 bp, Artificial Sequence
  Synthetic Polynucleotide
taatacgactcactatagggcccgccgcaccgtcagctccagcacttcggaacagaggagaccgaagatgtggagctgaaacctggcggcagcgcaaaagatg

SEQ ID NO: 131889 - DNA, 103 bp, Artificial Sequence
  Synthetic Polynucleotide
taatacgactcactatagggacaccctggacccgccgcaccgtcagctccaacagaggagaggagctatgggtgcggcgaacctggcggcagcgcaaaagatg

SEQ ID NO: 131890 - DNA, 103 bp, Artificial Sequence
  Synthetic Polynucleotide
taatacgactcactataggggccccgcagcacaccctggacccgccgcacaacagaggagagtgcggatggtccagggtaacctggcggcagcgcaaaagatg

SEQ ID NO: 131891 - DNA, 103 bp, Artificial Sequence
  Synthetic Polynucleotide
taatacgactcactatagggcgcgcgcccggccccgcagcacaccctggaaacagaggagatccaggatgtgctgcgggaacctggcggcagcgcaaaagatg

SEQ ID NO: 131892 - DNA, 103 bp, Artificial Sequence
  Synthetic Polynucleotide
taatacgactcactatagggtgctcgcgctcgcgcgcccggccccgcagcaacagaggagagctgcgatgccgggcgcgaacctggcggcagcgcaaaagatg

SEQ ID NO: 131893 - DNA, 103 bp, Artificial Sequence
  Synthetic Polynucleotide
taatacgactcactatagggcgcctgcagctgctcgcgctcgcgcgcccgaacagaggagacgggcgatggagcgcgagaacctggcggcagcgcaaaagatg

SEQ ID NO: 131894 - DNA, 103 bp, Artificial Sequence
  Synthetic Polynucleotide
taatacgactcactatagggcgctcgcttccgcctgcagctgctcgcgctaacagaggagaagcgcgatgagctgcaggaacctggcggcagcgcaaaagatg

SEQ ID NO: 131895 - DNA, 103 bp, Artificial Sequence
  Synthetic Polynucleotide
taatacgactcactataggggcgaagcgctcgctcgcttccgcctgcagcaacagaggagagctgcaatgggaagcgagaacctggcggcagcgcaaaagatg

SEQ ID NO: 131896 - DNA, 103 bp, Artificial Sequence
  Synthetic Polynucleotide
taatacgactcactataggggtagccggcagcgaagcgctcgctcgcttcaacagaggagagaagcgatggagcgcttcaacctggcggcagcgcaaaagatg

SEQ ID NO: 131897 - DNA, 103 bp, Artificial Sequence
  Synthetic Polynucleotide
taatacgactcactatagggtgcactggatgtagccggcagcgaagcgctaacagaggagaagcgctatgctgccggctaacctggcggcagcgcaaaagatg

SEQ ID NO: 131898 - DNA, 103 bp, Artificial Sequence
  Synthetic Polynucleotide
taatacgactcactatagggtcatcctcacggcccacacggtcccggccaaacagaggagatggccgatgccgtgtgggaacctggcggcagcgcaaaagatg

SEQ ID NO: 131899 - DNA, 103 bp, Artificial Sequence
  Synthetic Polynucleotide
taatacgactcactatagggacctcgtgcatgcactggatgtagccggcaaacagaggagatgccggatgcatccagtgaacctggcggcagcgcaaaagatg

SEQ ID NO: 131900 - DNA, 103 bp, Artificial Sequence
  Synthetic Polynucleotide
taatacgactcactataggggaacgtgtgcacctcgtgcatgcactggataacagaggagaatccagatgatgcacgagaacctggcggcagcgcaaaagatg

SEQ ID NO: 131901 - DNA, 103 bp, Artificial Sequence
  Synthetic Polynucleotide
taatacgactcactatagggacgtggacacgaacgtgtgcacctcgtgcaaacagaggagatgcacgatgtgcacacgtaacctggcggcagcgcaaaagatg

SEQ ID NO: 131902 - DNA, 103 bp, Artificial Sequence
  Synthetic Polynucleotide
taatacgactcactatagggatggcctggcacgtggacacgaacgtgtgcaacagaggagagcacacatgcgtgtccacaacctggcggcagcgcaaaagatg

SEQ ID NO: 131903 - DNA, 103 bp, Artificial Sequence
  Synthetic Polynucleotide
taatacgactcactatagggggtagcgtcgatggcctggcacgtggacacaacagaggagagtgtccatgtgccaggccaacctggcggcagcgcaaaagatg

SEQ ID NO: 131904 - DNA, 103 bp, Artificial Sequence
  Synthetic Polynucleotide
taatacgactcactatagggcggcagcgacggtagcgtcgatggcctggcaacagaggagagccaggatgtcgacgctaaacctggcggcagcgcaaaagatg

SEQ ID NO: 131905 - DNA, 103 bp, Artificial Sequence
  Synthetic Polynucleotide
taatacgactcactatagggttcaggagctcggcagcgacggtagcgtcgaacagaggagacgacgcatgcgtcgctgcaacctggcggcagcgcaaaagatg

SEQ ID NO: 131906 - DNA, 103 bp, Artificial Sequence
  Synthetic Polynucleotide
taatacgactcactataggggagcagatggttcaggagctcggcagcgacaacagaggagagtcgctatggagctcctgaacctggcggcagcgcaaaagatg

SEQ ID NO: 131907 - DNA, 103 bp, Artificial Sequence
  Synthetic Polynucleotide
taatacgactcactataggggcatggactcgagcagatggttcaggagctaacagaggagaagctccatgaccatctgcaacctggcggcagcgcaaaagatg

SEQ ID NO: 131908 - DNA, 103 bp, Artificial Sequence
  Synthetic Polynucleotide
taatacgactcactatagggtcacgcagcggcatggactcgagcagatggaacagaggagaccatctatgcgagtccataacctggcggcagcgcaaaagatg

SEQ ID NO: 131909 - DNA, 103 bp, Artificial Sequence
  Synthetic Polynucleotide
taatacgactcactatagggccagccgtcctcatcctcacggcccacacgaacagaggagacgtgtgatgcgtgaggataacctggcggcagcgcaaaagatg

SEQ ID NO: 131910 - DNA, 103 bp, Artificial Sequence
  Synthetic Polynucleotide
taatacgactcactataggggctgctgccctcacgcagcggcatggactcaacagaggagagagtccatgccgctgcgtaacctggcggcagcgcaaaagatg

SEQ ID NO: 131911 - DNA, 103 bp, Artificial Sequence
  Synthetic Polynucleotide
taatacgactcactataggggatcctggaagctgctgccctcacgcagcgaacagaggagacgctgcatgagggcagcaaacctggcggcagcgcaaaagatg

SEQ ID NO: 131912 - DNA, 103 bp, Artificial Sequence
  Synthetic Polynucleotide
taatacgactcactatagggtcccccagcagatcctggaagctgctgcccaacagaggagagggcagatgcttccaggaaacctggcggcagcgcaaaagatg

SEQ ID NO: 131913 - DNA, 103 bp, Artificial Sequence
  Synthetic Polynucleotide
taatacgactcactatagggcgccagggcgtcccccagcagatcctggaaaacagaggagattccagatgctgctggggaacctggcggcagcgcaaaagatg

SEQ ID NO: 131914 - DNA, 103 bp, Artificial Sequence
  Synthetic Polynucleotide
taatacgactcactatagggtaggtggccccgccagggcgtcccccagcaaacagaggagatgctggatgacgccctggaacctggcggcagcgcaaaagatg

SEQ ID NO: 131915 - DNA, 103 bp, Artificial Sequence
  Synthetic Polynucleotide
taatacgactcactatagggccaggggctctaggtggccccgccagggcgaacagaggagacgccctatgggggccaccaacctggcggcagcgcaaaagatg

SEQ ID NO: 131916 - DNA, 103 bp, Artificial Sequence
  Synthetic Polynucleotide
taatacgactcactataggggccactccgtccaggggctctaggtggcccaacagaggagagggccaatgagagcccctaacctggcggcagcgcaaaagatg

SEQ ID NO: 131917 - DNA, 103 bp, Artificial Sequence
  Synthetic Polynucleotide
taatacgactcactatagggccgcaggccagccactccgtccaggggctcaacagaggagagagcccatggacggagtgaacctggcggcagcgcaaaagatg

SEQ ID NO: 131918 - DNA, 103 bp, Artificial Sequence
  Synthetic Polynucleotide
taatacgactcactatagggggagcgccccccgcaggccagccactccgtaacagaggagaacggagatgctggcctgcaacctggcggcagcgcaaaagatg

SEQ ID NO: 131919 - DNA, 103 bp, Artificial Sequence
  Synthetic Polynucleotide
taatacgactcactatagggtggggatcccggagcgccccccgcaggccaaacagaggagatggcctatggggggcgctaacctggcggcagcgcaaaagatg

SEQ ID NO: 131920 - DNA, 103 bp, Artificial Sequence
  Synthetic Polynucleotide
taatacgactcactatagggctcgcgtctcccagccgtcctcatcctcacaacagaggagagtgaggatgaggacggctaacctggcggcagcgcaaaagatg

SEQ ID NO: 131921 - DNA, 103 bp, Artificial Sequence
  Synthetic Polynucleotide
taatacgactcactatagggggctgggtattggggatcccggagcgccccaacagaggagaggggcgatgcgggatcccaacctggcggcagcgcaaaagatg

SEQ ID NO: 131922 - DNA, 103 bp, Artificial Sequence
  Synthetic Polynucleotide
taatacgactcactatagggggacccggggggctgggtattggggatcccaacagaggagagggatcatgaatacccagaacctggcggcagcgcaaaagatg

SEQ ID NO: 131923 - DNA, 103 bp, Artificial Sequence
  Synthetic Polynucleotide
taatacgactcactataggggtcgtccccaggacccggggggctgggtataacagaggagaatacccatgcccccgggtaacctggcggcagcgcaaaagatg

SEQ ID NO: 131924 - DNA, 103 bp, Artificial Sequence
  Synthetic Polynucleotide
taatacgactcactatagggcggagcacaggtcgtccccaggacccggggaacagaggagaccccggatgctggggacgaacctggcggcagcgcaaaagatg

SEQ ID NO: 131925 - DNA, 103 bp, Artificial Sequence
  Synthetic Polynucleotide
taatacgactcactatagggtcctccaggtcggagcacaggtcgtccccaaacagaggagatggggaatgcctgtgctcaacctggcggcagcgcaaaagatg

SEQ ID NO: 131926 - DNA, 103 bp, Artificial Sequence
  Synthetic Polynucleotide
taatacgactcactatagggctcaggggcctcctccaggtcggagcacagaacagaggagactgtgcatggacctggagaacctggcggcagcgcaaaagatg

SEQ ID NO: 131927 - DNA, 103 bp, Artificial Sequence
  Synthetic Polynucleotide
taatacgactcactatagggtcagttcagcctcaggggcctcctccaggtaacagaggagaacctggatgaggcccctgaacctggcggcagcgcaaaagatg

SEQ ID NO: 131928 - DNA, 103 bp, Artificial Sequence
  Synthetic Polynucleotide
taatacgactcactatagggggagcctgactcagttcagcctcaggggccaacagaggagaggccccatgggctgaactaacctggcggcagcgcaaaagatg

SEQ ID NO: 131929 - DNA, 103 bp, Artificial Sequence
  Synthetic Polynucleotide
taatacgactcactatagggcccctcagcaggagcctgactcagttcagcaacagaggagagctgaaatgagtcaggctaacctggcggcagcgcaaaagatg

SEQ ID NO: 131930 - DNA, 103 bp, Artificial Sequence
  Synthetic Polynucleotide
taatacgactcactatagggccaagtcgggcccctcagcaggagcctgacaacagaggagagtcaggatgctgctgaggaacctggcggcagcgcaaaagatg

SEQ ID NO: 131931 - DNA, 103 bp, Artificial Sequence
  Synthetic Polynucleotide
taatacgactcactatagggttgcggtcccctcgcgtctcccagccgtccaacagaggagaggacggatgggagacgcgaacctggcggcagcgcaaaagatg

SEQ ID NO: 131932 - DNA, 103 bp, Artificial Sequence
  Synthetic Polynucleotide
taatacgactcactataggggctgcgggcaccaagtcgggcccctcagcaaacagaggagatgctgaatggcccgacttaacctggcggcagcgcaaaagatg

SEQ ID NO: 131933 - DNA, 103 bp, Artificial Sequence
  Synthetic Polynucleotide
taatacgactcactataggggctgcccagggctgcgggcaccaagtcgggaacagaggagacccgacatggtgcccgcaaacctggcggcagcgcaaaagatg

SEQ ID NO: 131934 - DNA, 103 bp, Artificial Sequence
  Synthetic Polynucleotide
taatacgactcactatagggctgtggtcaggctgcccagggctgcgggcaaacagaggagatgcccgatgccctgggcaaacctggcggcagcgcaaaagatg

SEQ ID NO: 131935 - DNA, 103 bp, Artificial Sequence
  Synthetic Polynucleotide
taatacgactcactataggggcaatttgggctgtggtcaggctgcccaggaacagaggagacctgggatgcctgaccacaacctggcggcagcgcaaaagatg

SEQ ID NO: 131936 - DNA, 103 bp, Artificial Sequence
  Synthetic Polynucleotide
taatacgactcactataggggacactccgggcaatttgggctgtggtcagaacagaggagactgaccatggcccaaattaacctggcggcagcgcaaaagatg

SEQ ID NO: 131937 - DNA, 103 bp, Artificial Sequence
  Synthetic Polynucleotide
taatacgactcactatagggaaggcctccagacactccgggcaatttgggaacagaggagacccaaaatgcccggagtgaacctggcggcagcgcaaaagatg

SEQ ID NO: 131938 - DNA, 103 bp, Artificial Sequence
  Synthetic Polynucleotide
taatacgactcactatagggcttccgggccttgcggtcccctcgcgtctcaacagaggagagagacgatgggggaccgcaacctggcggcagcgcaaaagatg

SEQ ID NO: 131939 - DNA, 103 bp, Artificial Sequence
  Synthetic Polynucleotide
taatacgactcactatagggccaccaggggcttccgggccttgcggtcccaacagaggagagggaccatgaggcccggaaacctggcggcagcgcaaaagatg

SEQ ID NO: 131940 - DNA, 103 bp, Artificial Sequence
  Synthetic Polynucleotide
taatacgactcactatagggcgcttcttctccaccaggggcttccgggccaacagaggagaggcccgatggcccctggtaacctggcggcagcgcaaaagatg

SEQ ID NO: 131941 - DNA, 103 bp, Artificial Sequence
  Synthetic Polynucleotide
taatacgactcactatagggcctattctcagctcgatcccgggtgaccataacagaggagaatggtcatgcgggatcgaaacctggcggcagcgcaaaagatg

SEQ ID NO: 131942 - DNA, 103 bp, Artificial Sequence
  Synthetic Polynucleotide
taatacgactcactatagggcagcagcagcagcctcagctcttccaggctaacagaggagaagcctgatggagctgaggaacctggcggcagcgcaaaagatg

SEQ ID NO: 131943 - DNA, 103 bp, Artificial Sequence
  Synthetic Polynucleotide
taatacgactcactataggggggtccgctccagcagcagcagcctcagctaacagaggagaagctgaatgtgctgctgcaacctggcggcagcgcaaaagatg

SEQ ID NO: 131944 - DNA, 103 bp, Artificial Sequence
  Synthetic Polynucleotide
taatacgactcactatagggttctggtcccgggtccgctccagcagcagcaacagaggagagctgctatgggagcggacaacctggcggcagcgcaaaagatg

SEQ ID NO: 131945 - DNA, 103 bp, Artificial Sequence
  Synthetic Polynucleotide
taatacgactcactataggggttccggaggttctggtcccgggtccgctcaacagaggagagagcggatgcgggaccagaacctggcggcagcgcaaaagatg

SEQ ID NO: 131946 - DNA, 103 bp, Artificial Sequence
  Synthetic Polynucleotide
taatacgactcactatagggccagcttcgggttccggaggttctggtcccaacagaggagagggaccatgacctccggaaacctggcggcagcgcaaaagatg

SEQ ID NO: 131947 - DNA, 103 bp, Artificial Sequence
  Synthetic Polynucleotide
taatacgactcactatagggtccgctttctccagcttcgggttccggaggaacagaggagacctccgatgcccgaagctaacctggcggcagcgcaaaagatg

SEQ ID NO: 131948 - DNA, 103 bp, Artificial Sequence
  Synthetic Polynucleotide
taatacgactcactatagggctccaatatctccgctttctccagcttcggaacagaggagaccgaagatggagaaagcgaacctggcggcagcgcaaaagatg

SEQ ID NO: 131949 - DNA, 103 bp, Artificial Sequence
  Synthetic Polynucleotide
taatacgactcactatagggccacggcgaactccaatatctccgctttctaacagaggagaagaaagatgagatattggaacctggcggcagcgcaaaagatg

SEQ ID NO: 131950 - DNA, 103 bp, Artificial Sequence
  Synthetic Polynucleotide
taatacgactcactatagggctcaagtagcccacggcgaactccaatatcaacagaggagagatattatggttcgccgtaacctggcggcagcgcaaaagatg

SEQ ID NO: 131951 - DNA, 103 bp, Artificial Sequence
  Synthetic Polynucleotide
taatacgactcactataggggcttcgctccctcaagtagcccacggcgaaaacagaggagattcgccatgggctacttgaacctggcggcagcgcaaaagatg

SEQ ID NO: 131952 - DNA, 103 bp, Artificial Sequence
  Synthetic Polynucleotide
taatacgactcactatagggtggggccgtccctattctcagctcgatcccaacagaggagagggatcatgctgagaataaacctggcggcagcgcaaaagatg

SEQ ID NO: 131953 - DNA, 103 bp, Artificial Sequence
  Synthetic Polynucleotide
taatacgactcactataggggctccacccggcttcgctccctcaagtagcaacagaggagagctactatggggagcgaaaacctggcggcagcgcaaaagatg

SEQ ID NO: 131954 - DNA, 103 bp, Artificial Sequence
  Synthetic Polynucleotide
taatacgactcactatagggacccccgggggctccacccggcttcgctccaacagaggagaggagcgatgccgggtggaaacctggcggcagcgcaaaagatg

SEQ ID NO: 131955 - DNA, 103 bp, Artificial Sequence
  Synthetic Polynucleotide
taatacgactcactatagggggaccggggaacccccgggggctccacccgaacagaggagacgggtgatgcccccggggaacctggcggcagcgcaaaagatg

SEQ ID NO: 131956 - DNA, 103 bp, Artificial Sequence
  Synthetic Polynucleotide
taatacgactcactatagggcctggactggggaccggggaacccccggggaacagaggagaccccggatgttccccggtaacctggcggcagcgcaaaagatg

SEQ ID NO: 131957 - DNA, 103 bp, Artificial Sequence
  Synthetic Polynucleotide
taatacgactcactataggggcctcggcgtcctggactggggaccggggaaacagaggagatccccgatgcccagtccaaacctggcggcagcgcaaaagatg

SEQ ID NO: 131958 - DNA, 103 bp, Artificial Sequence
  Synthetic Polynucleotide
taatacgactcactataggggctggcgagcgcctcggcgtcctggactggaacagaggagaccagtcatggacgccgagaacctggcggcagcgcaaaagatg

SEQ ID NO: 131959 - DNA, 103 bp, Artificial Sequence
  Synthetic Polynucleotide
taatacgactcactatagggacaagtagcagctggcgagcgcctcggcgtaacagaggagaacgccgatgcgctcgccaaacctggcggcagcgcaaaagatg

SEQ ID NO: 131960 - DNA, 103 bp, Artificial Sequence
  Synthetic Polynucleotide
taatacgactcactatagggcggaaaccggacaagtagcagctggcgagcaacagaggagagctcgcatgctgctacttaacctggcggcagcgcaaaagatg

SEQ ID NO: 131961 - DNA, 103 bp, Artificial Sequence
  Synthetic Polynucleotide
taatacgactcactatagggcaggcactcgcggaaaccggacaagtagcaaacagaggagatgctacatgtccggtttcaacctggcggcagcgcaaaagatg

SEQ ID NO: 131962 - DNA, 103 bp, Artificial Sequence
  Synthetic Polynucleotide
taatacgactcactatagggccaagcgaagcaggcactcgcggaaaccggaacagaggagaccggttatggcgagtgccaacctggcggcagcgcaaaagatg

SEQ ID NO: 131963 - DNA, 103 bp, Artificial Sequence
  Synthetic Polynucleotide
taatacgactcactatagggttgagcatcttggggccgtccctattctcaaacagaggagatgagaaatgggacggcccaacctggcggcagcgcaaaagatg

SEQ ID NO: 131964 - DNA, 103 bp, Artificial Sequence
  Synthetic Polynucleotide
taatacgactcactataggggcgaaggccgccaagcgaagcaggcactcgaacagaggagacgagtgatggcttcgcttaacctggcggcagcgcaaaagatg

SEQ ID NO: 131965 - DNA, 103 bp, Artificial Sequence
  Synthetic Polynucleotide
taatacgactcactatagggggcgtcgtgcgcgaaggccgccaagcgaagaacagaggagacttcgcatggcggccttcaacctggcggcagcgcaaaagatg

SEQ ID NO: 131966 - DNA, 103 bp, Artificial Sequence
  Synthetic Polynucleotide
taatacgactcactatagggcggccgggctggcgtcgtgcgcgaaggccgaacagaggagacggcctatgcgcacgacgaacctggcggcagcgcaaaagatg

SEQ ID NO: 131967 - DNA, 103 bp, Artificial Sequence
  Synthetic Polynucleotide
taatacgactcactatagggtgggcgcgggcggccgggctggcgtcgtgcaacagaggagagcacgaatgcagcccggcaacctggcggcagcgcaaaagatg

SEQ ID NO: 131968 - DNA, 103 bp, Artificial Sequence
  Synthetic Polynucleotide
taatacgactcactatagggggagaagagctgggcgcgggcggccgggctaacagaggagaagcccgatggcccgcgccaacctggcggcagcgcaaaagatg

SEQ ID NO: 131969 - DNA, 103 bp, Artificial Sequence
  Synthetic Polynucleotide
taatacgactcactatagggcgtgcagcgcggagaagagctgggcgcgggaacagaggagacccgcgatgagctcttctaacctggcggcagcgcaaaagatg

SEQ ID NO: 131970 - DNA, 103 bp, Artificial Sequence
  Synthetic Polynucleotide
taatacgactcactatagggcgcagatagccgtgcagcgcggagaagagcaacagaggagagctcttatgcgcgctgcaaacctggcggcagcgcaaaagatg

SEQ ID NO: 131971 - DNA, 103 bp, Artificial Sequence
  Synthetic Polynucleotide
taatacgactcactatagggcggtttggggcgcagatagccgtgcagcgcaacagaggagagcgctgatgggctatctgaacctggcggcagcgcaaaagatg

SEQ ID NO: 131972 - DNA, 103 bp, Artificial Sequence
  Synthetic Polynucleotide
taatacgactcactatagggtgggccggggcggtttggggcgcagatagcaacagaggagagctatcatggccccaaacaacctggcggcagcgcaaaagatg

SEQ ID NO: 131973 - DNA, 103 bp, Artificial Sequence
  Synthetic Polynucleotide
taatacgactcactatagggtctaccggcttgggccggggcggtttggggaacagaggagaccccaaatggccccggccaacctggcggcagcgcaaaagatg

SEQ ID NO: 131974 - DNA, 103 bp, Artificial Sequence
  Synthetic Polynucleotide
taatacgactcactatagggcacaagcggcttgagcatcttggggccgtcaacagaggagagacggcatgaagatgctcaacctggcggcagcgcaaaagatg

SEQ ID NO: 131975 - DNA, 103 bp, Artificial Sequence
  Synthetic Polynucleotide
taatacgactcactatagggaggcctcggatctaccggcttgggccggggaacagaggagaccccggatgaagccggtaaacctggcggcagcgcaaaagatg

SEQ ID NO: 131976 - DNA, 103 bp, Artificial Sequence
  Synthetic Polynucleotide
taatacgactcactataggggcggcgctggaggcctcggatctaccggctaacagaggagaagccggatgatccgaggcaacctggcggcagcgcaaaagatg

SEQ ID NO: 131977 - DNA, 103 bp, Artificial Sequence
  Synthetic Polynucleotide
taatacgactcactatagggagggatgggcgcggcgctggaggcctcggaaacagaggagatccgagatgtccagcgccaacctggcggcagcgcaaaagatg

SEQ ID NO: 131978 - DNA, 103 bp, Artificial Sequence
  Synthetic Polynucleotide
taatacgactcactatagggggcggggtccagggatgggcgcggcgctggaacagaggagaccagcgatgcgcccatccaacctggcggcagcgcaaaagatg

SEQ ID NO: 131979 - DNA, 103 bp, Artificial Sequence
  Synthetic Polynucleotide
taatacgactcactataggggggccggtgcggcggggtccagggatgggcaacagaggagagcccatatgtggaccccgaacctggcggcagcgcaaaagatg

SEQ ID NO: 131980 - DNA, 103 bp, Artificial Sequence
  Synthetic Polynucleotide
taatacgactcactataggggcagggccaagggccggtgcggcggggtccaacagaggagaggacccatgcgcaccggcaacctggcggcagcgcaaaagatg

SEQ ID NO: 131981 - DNA, 103 bp, Artificial Sequence
  Synthetic Polynucleotide
taatacgactcactatagggctggtgcagcgcagggccaagggccggtgcaacagaggagagcaccgatgcttggccctaacctggcggcagcgcaaaagatg

SEQ ID NO: 131982 - DNA, 103 bp, Artificial Sequence
  Synthetic Polynucleotide
taatacgactcactatagggctggggggcgctggtgcagcgcagggccaaaacagaggagattggccatgcgctgcaccaacctggcggcagcgcaaaagatg

SEQ ID NO: 131983 - DNA, 103 bp, Artificial Sequence
  Synthetic Polynucleotide
taatacgactcactatagggccctggtgcactggggggcgctggtgcagcaacagaggagagctgcaatggcgccccccaacctggcggcagcgcaaaagatg

SEQ ID NO: 131984 - DNA, 103 bp, Artificial Sequence
  Synthetic Polynucleotide
taatacgactcactataggggctagggtggccctggtgcactggggggcgaacagaggagacgccccatggtgcaccagaacctggcggcagcgcaaaagatg

SEQ ID NO: 131985 - DNA, 103 bp, Artificial Sequence
  Synthetic Polynucleotide
taatacgactcactataggggccgcttctccacaagcggcttgagcatctaacagaggagaagatgcatgagccgcttgaacctggcggcagcgcaaaagatg

SEQ ID NO: 131986 - DNA, 103 bp, Artificial Sequence
  Synthetic Polynucleotide
taatacgactcactatagggcgcagcgcgggctagggtggccctggtgcaaacagaggagatgcaccatggccaccctaaacctggcggcagcgcaaaagatg

SEQ ID NO: 131987 - DNA, 103 bp, Artificial Sequence
  Synthetic Polynucleotide
taatacgactcactatagggggggaccatgcgcagcgcgggctagggtggaacagaggagaccacccatgcccgcgctgaacctggcggcagcgcaaaagatg

SEQ ID NO: 131988 - DNA, 103 bp, Artificial Sequence
  Synthetic Polynucleotide
taatacgactcactataggggcagagggatggggaccatgcgcagcgcggaacagaggagaccgcgcatggcatggtccaacctggcggcagcgcaaaagatg

SEQ ID NO: 131989 - DNA, 103 bp, Artificial Sequence
  Synthetic Polynucleotide
taatacgactcactatagggcgcgcggggagcagagggatggggaccatgaacagaggagacatggtatgcatccctctaacctggcggcagcgcaaaagatg

SEQ ID NO: 131990 - DNA, 103 bp, Artificial Sequence
  Synthetic Polynucleotide
taatacgactcactataggggaatccccggcgcgcggggagcagagggataacagaggagaatccctatgctccccgcgaacctggcggcagcgcaaaagatg

SEQ ID NO: 131991 - DNA, 103 bp, Artificial Sequence
  Synthetic Polynucleotide
taatacgactcactatagggcggcgcgccagaatccccggcgcgcggggaaacagaggagatccccgatggccggggataacctggcggcagcgcaaaagatg

SEQ ID NO: 131992 - DNA, 103 bp, Artificial Sequence
  Synthetic Polynucleotide
taatacgactcactatagggtgaggggcgccggcgcgccagaatccccggaacagaggagaccggggatgctggcgcgcaacctggcggcagcgcaaaagatg

SEQ ID NO: 131993 - DNA, 103 bp, Artificial Sequence
  Synthetic Polynucleotide
taatacgactcactatagggagcagtccggtgaggggcgccggcgcgccaaacagaggagatggcgcatgggcgcccctaacctggcggcagcgcaaaagatg

SEQ ID NO: 131994 - DNA, 103 bp, Artificial Sequence
  Synthetic Polynucleotide
taatacgactcactatagggtggcggcggcagcagtccggtgaggggcgcaacagaggagagcgcccatgaccggactgaacctggcggcagcgcaaaagatg

SEQ ID NO: 131995 - DNA, 103 bp, Artificial Sequence
  Synthetic Polynucleotide
taatacgactcactataggggaggcggcggtggcggcggcagcagtccggaacagaggagaccggacatgtgccgccgcaacctggcggcagcgcaaaagatg

SEQ ID NO: 131996 - DNA, 103 bp, Artificial Sequence
  Synthetic Polynucleotide
taatacgactcactatagggcggtcccggcgccgcttctccacaagcggcaacagaggagagccgctatgggagaagcgaacctggcggcagcgcaaaagatg

SEQ ID NO: 131997 - DNA, 103 bp, Artificial Sequence
  Synthetic Polynucleotide
taatacgactcactatagggtcttgtctgtgaggcggcggtggcggcggcaacagaggagagccgccatgaccgccgccaacctggcggcagcgcaaaagatg

SEQ ID NO: 131998 - DNA, 103 bp, Artificial Sequence
  Synthetic Polynucleotide
taatacgactcactataggggggcgccccgtcttgtctgtgaggcggcggaacagaggagaccgccgatgcacagacaaaacctggcggcagcgcaaaagatg

SEQ ID NO: 131999 - DNA, 103 bp, Artificial Sequence
  Synthetic Polynucleotide
taatacgactcactataggggcggggccttgggcgccccgtcttgtctgtaacagaggagaacagacatgacggggcgcaacctggcggcagcgcaaaagatg

SEQ ID NO: 132000 - DNA, 103 bp, Artificial Sequence
  Synthetic Polynucleotide
taatacgactcactatagggggcgggggcagcggggccttgggcgccccgaacagaggagacggggcatgcaaggccccaacctggcggcagcgcaaaagatg

SEQ ID NO: 132001 - DNA, 103 bp, Artificial Sequence
  Synthetic Polynucleotide
taatacgactcactataggggaaagcgggcggcgggggcagcggggccttaacagaggagaaaggccatgctgcccccgaacctggcggcagcgcaaaagatg

SEQ ID NO: 132002 - DNA, 103 bp, Artificial Sequence
  Synthetic Polynucleotide
taatacgactcactatagggaaggtctccagaaagcgggcggcgggggcaaacagaggagatgccccatgcgcccgcttaacctggcggcagcgcaaaagatg

SEQ ID NO: 132003 - DNA, 103 bp, Artificial Sequence
  Synthetic Polynucleotide
taatacgactcactataggggcggttgatgcggtcccggcgccgcttctcaacagaggagagagaagatgcgccgggacaacctggcggcagcgcaaaagatg

SEQ ID NO: 132004 - DNA, 103 bp, Artificial Sequence
  Synthetic Polynucleotide
taatacgactcactatagggcttccaggctgcggttgatgcggtcccggcaacagaggagagccgggatggcatcaaccaacctggcggcagcgcaaaagatg

SEQ ID NO: 132005 - DNA, 103 bp, Artificial Sequence
  Synthetic Polynucleotide
taatacgactcactatagggagcctcagctcttccaggctgcggttgatgaacagaggagacatcaaatgcagcctggaaacctggcggcagcgcaaaagatg

SEQ ID NO: 132006 - DNA, 103 bp, Artificial Sequence
  Synthetic Polynucleotide
taatacgactcactatagggctgagcgccttcctgaaggctgggagacataacagaggagaatgtctatgagccttcagaacctggcggcagcgcaaaagatg

SEQ ID NO: 132007 - DNA, 103 bp, Artificial Sequence
  Synthetic Polynucleotide
taatacgactcactatagggtttcattaatggaacacagtctttcttctgaacagaggagacagaagatggactgtgttaacctggcggcagcgcaaaagatg

SEQ ID NO: 132008 - DNA, 103 bp, Artificial Sequence
  Synthetic Polynucleotide
taatacgactcactataggggcctgtggggtttcattaatggaacacagtaacagaggagaactgtgatgcattaatgaaacctggcggcagcgcaaaagatg

SEQ ID NO: 132009 - DNA, 103 bp, Artificial Sequence
  Synthetic Polynucleotide
taatacgactcactatagggtctgcccagggcctgtggggtttcattaataacagaggagaattaatatgaccccacagaacctggcggcagcgcaaaagatg

SEQ ID NO: 132010 - DNA, 103 bp, Artificial Sequence
  Synthetic Polynucleotide
taatacgactcactataggggctgcaggtgtctgcccagggcctgtggggaacagaggagaccccacatgccctgggcaaacctggcggcagcgcaaaagatg

SEQ ID NO: 132011 - DNA, 103 bp, Artificial Sequence
  Synthetic Polynucleotide
taatacgactcactatagggtccctgatgagctgcaggtgtctgcccaggaacagaggagacctgggatgacacctgcaaacctggcggcagcgcaaaagatg

SEQ ID NO: 132012 - DNA, 103 bp, Artificial Sequence
  Synthetic Polynucleotide
taatacgactcactatagggttaccatctttccctgatgagctgcaggtgaacagaggagacacctgatgctcatcaggaacctggcggcagcgcaaaagatg

SEQ ID NO: 132013 - DNA, 103 bp, Artificial Sequence
  Synthetic Polynucleotide
taatacgactcactatagggtagacataagttaccatctttccctgatgaaacagaggagatcatcaatgaaagatggtaacctggcggcagcgcaaaagatg

SEQ ID NO: 132014 - DNA, 103 bp, Artificial Sequence
  Synthetic Polynucleotide
taatacgactcactatagggttgggacatgtagacataagttaccatcttaacagaggagaaagatgatgacttatgtcaacctggcggcagcgcaaaagatg

SEQ ID NO: 132015 - DNA, 103 bp, Artificial Sequence
  Synthetic Polynucleotide
taatacgactcactatagggctgggaggatttgggacatgtagacataagaacagaggagacttatgatgacatgtcccaacctggcggcagcgcaaaagatg

SEQ ID NO: 132016 - DNA, 103 bp, Artificial Sequence
  Synthetic Polynucleotide
taatacgactcactatagggtgaaatcccactgggaggatttgggacatgaacagaggagacatgtcatgaatcctcccaacctggcggcagcgcaaaagatg

SEQ ID NO: 132017 - DNA, 103 bp, Artificial Sequence
  Synthetic Polynucleotide
taatacgactcactatagggtttccccgagctgagcgccttcctgaaggcaacagaggagagccttcatgaaggcgctcaacctggcggcagcgcaaaagatg

SEQ ID NO: 132018 - DNA, 103 bp, Artificial Sequence
  Synthetic Polynucleotide
taatacgactcactatagggcgctagggaatgaaatcccactgggaggataacagaggagaatcctcatggtgggatttaacctggcggcagcgcaaaagatg

SEQ ID NO: 132019 - DNA, 103 bp, Artificial Sequence
  Synthetic Polynucleotide
taatacgactcactatagggtgatccaccacgctagggaatgaaatcccaaacagaggagatgggatatgattccctagaacctggcggcagcgcaaaagatg

SEQ ID NO: 132020 - DNA, 103 bp, Artificial Sequence
  Synthetic Polynucleotide
taatacgactcactatagggtggcattgggtgatccaccacgctagggaaaacagaggagattccctatggtggtggataacctggcggcagcgcaaaagatg

SEQ ID NO: 132021 - DNA, 103 bp, Artificial Sequence
  Synthetic Polynucleotide
taatacgactcactatagggctctttcttctggcattgggtgatccaccaaacagaggagatggtggatgacccaatgcaacctggcggcagcgcaaaagatg

SEQ ID NO: 132022 - DNA, 103 bp, Artificial Sequence
  Synthetic Polynucleotide
taatacgactcactatagggtatttcgaagctctttcttctggcattgggaacagaggagacccaatatgagaagaaagaacctggcggcagcgcaaaagatg

SEQ ID NO: 132023 - DNA, 103 bp, Artificial Sequence
  Synthetic Polynucleotide
taatacgactcactataggggtaattttcatatttcgaagctctttcttcaacagaggagagaagaaatggcttcgaaaaacctggcggcagcgcaaaagatg

SEQ ID NO: 132024 - DNA, 103 bp, Artificial Sequence
  Synthetic Polynucleotide
taatacgactcactatagggaggctgaaaagtaattttcatatttcgaagaacagaggagacttcgaatgatgaaaattaacctggcggcagcgcaaaagatg

SEQ ID NO: 132025 - DNA, 103 bp, Artificial Sequence
  Synthetic Polynucleotide
taatacgactcactatagggagtctttctgaggctgaaaagtaattttcaaacagaggagatgaaaaatgcttttcagcaacctggcggcagcgcaaaagatg

SEQ ID NO: 132026 - DNA, 103 bp, Artificial Sequence
  Synthetic Polynucleotide
taatacgactcactatagggtttcaaagacagtctttctgaggctgaaaaaacagaggagattttcaatgtcagaaagaaacctggcggcagcgcaaaagatg

SEQ ID NO: 132027 - DNA, 103 bp, Artificial Sequence
  Synthetic Polynucleotide
taatacgactcactatagggtcaactctcttttcaaagacagtctttctgaacagaggagacagaaaatgtgtctttgaaacctggcggcagcgcaaaagatg

SEQ ID NO: 132028 - DNA, 103 bp, Artificial Sequence
  Synthetic Polynucleotide
taatacgactcactataggggagggtttgttttccccgagctgagcgcctaacagaggagaaggcgcatggctcggggaaacctggcggcagcgcaaaagatg

SEQ ID NO: 132029 - DNA, 103 bp, Artificial Sequence
  Synthetic Polynucleotide
taatacgactcactatagggctataccaactcaactctcttttcaaagacaacagaggagagtctttatgaagagagttaacctggcggcagcgcaaaagatg

SEQ ID NO: 132030 - DNA, 103 bp, Artificial Sequence
  Synthetic Polynucleotide
taatacgactcactatagggtcttcggcctctataccaactcaactctctaacagaggagaagagagatgagttggtataacctggcggcagcgcaaaagatg

SEQ ID NO: 132031 - DNA, 103 bp, Artificial Sequence
  Synthetic Polynucleotide
taatacgactcactatagggcagttcttggtcttcggcctctataccaacaacagaggagagttggtatggaggccgaaaacctggcggcagcgcaaaagatg

SEQ ID NO: 132032 - DNA, 103 bp, Artificial Sequence
  Synthetic Polynucleotide
taatacgactcactatagggtgagtaaaagcagttcttggtcttcggcctaacagaggagaaggccgatgaccaagaacaacctggcggcagcgcaaaagatg

SEQ ID NO: 132033 - DNA, 103 bp, Artificial Sequence
  Synthetic Polynucleotide
taatacgactcactatagggaatctggttttgagtaaaagcagttcttggaacagaggagaccaagaatggcttttactaacctggcggcagcgcaaaagatg

SEQ ID NO: 132034 - DNA, 103 bp, Artificial Sequence
  Synthetic Polynucleotide
taatacgactcactatagggctaacacttcaatctggttttgagtaaaagaacagaggagacttttaatgaaaaccagaaacctggcggcagcgcaaaagatg

SEQ ID NO: 132035 - DNA, 103 bp, Artificial Sequence
  Synthetic Polynucleotide
taatacgactcactatagggaagacattttctaacacttcaatctggtttaacagaggagaaaaccaatgtgaagtgttaacctggcggcagcgcaaaagatg

SEQ ID NO: 132036 - DNA, 103 bp, Artificial Sequence
  Synthetic Polynucleotide
taatacgactcactataggggtttactctaaagacattttctaacacttcaacagaggagagaagtgatggaaaatgtcaacctggcggcagcgcaaaagatg

SEQ ID NO: 132037 - DNA, 103 bp, Artificial Sequence
  Synthetic Polynucleotide
taatacgactcactatagggcaggatagcagtttactctaaagacattttaacagaggagaaaaatgatgttagagtaaaacctggcggcagcgcaaaagatg

SEQ ID NO: 132038 - DNA, 103 bp, Artificial Sequence
  Synthetic Polynucleotide
taatacgactcactatagggatatcgataccaggatagcagtttactctaaacagaggagatagagtatgctgctatccaacctggcggcagcgcaaaagatg

SEQ ID NO: 132039 - DNA, 103 bp, Artificial Sequence
  Synthetic Polynucleotide
taatacgactcactatagggggagcaagttgagggtttgttttccccgagaacagaggagactcgggatgaacaaacccaacctggcggcagcgcaaaagatg

SEQ ID NO: 132040 - DNA, 103 bp, Artificial Sequence
  Synthetic Polynucleotide
taatacgactcactataggggtcttctctaatatcgataccaggatagcaaacagaggagatgctatatgggtatcgataacctggcggcagcgcaaaagatg

SEQ ID NO: 132041 - DNA, 103 bp, Artificial Sequence
  Synthetic Polynucleotide
taatacgactcactatagggtttgagctaagtcttctctaatatcgatacaacagaggagagtatcgatgttagagaagaacctggcggcagcgcaaaagatg

SEQ ID NO: 132042 - DNA, 103 bp, Artificial Sequence
  Synthetic Polynucleotide
taatacgactcactatagggagattcaatttttgagctaagtcttctctaaacagaggagatagagaatgcttagctcaaacctggcggcagcgcaaaagatg

SEQ ID NO: 132043 - DNA, 103 bp, Artificial Sequence
  Synthetic Polynucleotide
taatacgactcactataggggtcttcctctagattcaatttttgagctaaaacagaggagattagctatgaaattgaataacctggcggcagcgcaaaagatg

SEQ ID NO: 132044 - DNA, 103 bp, Artificial Sequence
  Synthetic Polynucleotide
taatacgactcactatagggtctggattctgtcttcctctagattcaattaacagaggagaaattgaatgtagaggaagaacctggcggcagcgcaaaagatg

SEQ ID NO: 132045 - DNA, 103 bp, Artificial Sequence
  Synthetic Polynucleotide
taatacgactcactatagggtgaaaccaaatctggattctgtcttcctctaacagaggagaagaggaatgcagaatccaaacctggcggcagcgcaaaagatg

SEQ ID NO: 132046 - DNA, 103 bp, Artificial Sequence
  Synthetic Polynucleotide
taatacgactcactatagggacgccgattttgaaaccaaatctggattctaacagaggagaagaatcatgatttggtttaacctggcggcagcgcaaaagatg

SEQ ID NO: 132047 - DNA, 103 bp, Artificial Sequence
  Synthetic Polynucleotide
taatacgactcactatagggtcagttttgcacgccgattttgaaaccaaaaacagaggagatttggtatgaaaatcggcaacctggcggcagcgcaaaagatg

SEQ ID NO: 132048 - DNA, 103 bp, Artificial Sequence
  Synthetic Polynucleotide
taatacgactcactatagggtgggaccttttcagttttgcacgccgatttaacagaggagaaaatcgatgtgcaaaactaacctggcggcagcgcaaaagatg

SEQ ID NO: 132049 - DNA, 103 bp, Artificial Sequence
  Synthetic Polynucleotide
taatacgactcactatagggtgattctctatgggaccttttcagttttgcaacagaggagagcaaaaatgaaaaggtccaacctggcggcagcgcaaaagatg

SEQ ID NO: 132050 - DNA, 103 bp, Artificial Sequence
  Synthetic Polynucleotide
taatacgactcactatagggcaattgaaaaggagcaagttgagggtttgtaacagaggagaacaaacatgcaacttgctaacctggcggcagcgcaaaagatg

SEQ ID NO: 132051 - DNA, 103 bp, Artificial Sequence
  Synthetic Polynucleotide
taatacgactcactatagggttagaaactgtgattctctatgggacctttaacagaggagaaaaggtatgatagagaataacctggcggcagcgcaaaagatg

SEQ ID NO: 132052 - DNA, 103 bp, Artificial Sequence
  Synthetic Polynucleotide
taatacgactcactatagggtttttcgccattagaaactgtgattctctaaacagaggagatagagaatgacagtttctaacctggcggcagcgcaaaagatg

SEQ ID NO: 132053 - DNA, 103 bp, Artificial Sequence
  Synthetic Polynucleotide
taatacgactcactataggggttgaaattttttttcgccattagaaactgaacagaggagacagtttatgatggcgaaaaacctggcggcagcgcaaaagatg

SEQ ID NO: 132054 - DNA, 103 bp, Artificial Sequence
  Synthetic Polynucleotide
taatacgactcactataggggcagatttgtgttgaaattttttttcgccaaacagaggagatggcgaatgaaaatttcaaacctggcggcagcgcaaaagatg

SEQ ID NO: 132055 - DNA, 103 bp, Artificial Sequence
  Synthetic Polynucleotide
taatacgactcactatagggaagattctctcaattgaaaaggagcaagttaacagaggagaaacttgatgcttttcaataacctggcggcagcgcaaaagatg

SEQ ID NO: 132056 - DNA, 103 bp, Artificial Sequence
  Synthetic Polynucleotide
taatacgactcactataggggtccagtcctaagattctctcaattgaaaaaacagaggagattttcaatggagagaatcaacctggcggcagcgcaaaagatg

SEQ ID NO: 132057 - DNA, 103 bp, Artificial Sequence
  Synthetic Polynucleotide
taatacgactcactatagggctttcttctggtccagtcctaagattctctaacagaggagaagagaaatgtaggactggaacctggcggcagcgcaaaagatg

SEQ ID NO: 132058 - DNA, 103 bp, Artificial Sequence
  Synthetic Polynucleotide
taatacgactcactatagggggaacacagtctttcttctggtccagtcctaacagaggagaaggactatgccagaagaaaacctggcggcagcgcaaaagatg

SEQ ID NO: 132059 - DNA, 103 bp, Artificial Sequence
  Synthetic Polynucleotide
taatacgactcactatagggggagctgtactcggggtgagctcgcttcataacagaggagaatgaagatggctcaccccaacctggcggcagcgcaaaagatg

SEQ ID NO: 132060 - DNA, 103 bp, Artificial Sequence
  Synthetic Polynucleotide
taatacgactcactatagggggacatggaacctagagccgaactcaagttaacagaggagaaacttgatgtcggctctaaacctggcggcagcgcaaaagatg

SEQ ID NO: 132061 - DNA, 103 bp, Artificial Sequence
  Synthetic Polynucleotide
taatacgactcactatagggatgtagttggggacatggaacctagagccgaacagaggagacggctcatggttccatgtaacctggcggcagcgcaaaagatg

SEQ ID NO: 132062 - DNA, 103 bp, Artificial Sequence
  Synthetic Polynucleotide
taatacgactcactatagggatctgggaagatgtagttggggacatggaaaacagaggagattccatatgcccaactacaacctggcggcagcgcaaaagatg

SEQ ID NO: 132063 - DNA, 103 bp, Artificial Sequence
  Synthetic Polynucleotide
taatacgactcactatagggtctggccaaaatctgggaagatgtagttggaacagaggagaccaactatgtcttcccagaacctggcggcagcgcaaaagatg

SEQ ID NO: 132064 - DNA, 103 bp, Artificial Sequence
  Synthetic Polynucleotide
taatacgactcactatagggtccgtctttttctggccaaaatctgggaagaacagaggagacttcccatgttttggccaaacctggcggcagcgcaaaagatg

SEQ ID NO: 132065 - DNA, 103 bp, Artificial Sequence
  Synthetic Polynucleotide
taatacgactcactatagggattattcctctccgtctttttctggccaaaaacagaggagatttggcatgaaaaagacgaacctggcggcagcgcaaaagatg

SEQ ID NO: 132066 - DNA, 103 bp, Artificial Sequence
  Synthetic Polynucleotide
taatacgactcactataggggcgcttctcaattattcctctccgtcttttaacagaggagaaaaagaatgagaggaataaacctggcggcagcgcaaaagatg

SEQ ID NO: 132067 - DNA, 103 bp, Artificial Sequence
  Synthetic Polynucleotide
taatacgactcactatagggggtctcgtcggcgcttctcaattattcctcaacagaggagagaggaaatgttgagaagcaacctggcggcagcgcaaaagatg

SEQ ID NO: 132068 - DNA, 103 bp, Artificial Sequence
  Synthetic Polynucleotide
taatacgactcactatagggttattgatccggtctcgtcggcgcttctcaaacagaggagatgagaaatgccgacgagaaacctggcggcagcgcaaaagatg

SEQ ID NO: 132069 - DNA, 103 bp, Artificial Sequence
  Synthetic Polynucleotide
taatacgactcactatagggagacaaactgttattgatccggtctcgtcgaacagaggagacgacgaatgcggatcaataacctggcggcagcgcaaaagatg

SEQ ID NO: 132070 - DNA, 103 bp, Artificial Sequence
  Synthetic Polynucleotide
taatacgactcactatagggcgctgtccgaggagctgtactcggggtgagaacagaggagactcaccatgagtacagctaacctggcggcagcgcaaaagatg

SEQ ID NO: 132071 - DNA, 103 bp, Artificial Sequence
  Synthetic Polynucleotide
taatacgactcactatagggttctcagctcagacaaactgttattgatccaacagaggagaggatcaatgacagtttgtaacctggcggcagcgcaaaagatg

SEQ ID NO: 132072 - DNA, 103 bp, Artificial Sequence
  Synthetic Polynucleotide
taatacgactcactatagggggtaccagccttctcagctcagacaaactgaacagaggagacagtttatgtgagctgagaacctggcggcagcgcaaaagatg

SEQ ID NO: 132073 - DNA, 103 bp, Artificial Sequence
  Synthetic Polynucleotide
taatacgactcactatagggaaaagcactgggtaccagccttctcagctcaacagaggagagagctgatgaggctggtaaacctggcggcagcgcaaaagatg

SEQ ID NO: 132074 - DNA, 103 bp, Artificial Sequence
  Synthetic Polynucleotide
taatacgactcactatagggcctgcttctcaaaagcactgggtaccagccaacagaggagaggctggatgccagtgcttaacctggcggcagcgcaaaagatg

SEQ ID NO: 132075 - DNA, 103 bp, Artificial Sequence
  Synthetic Polynucleotide
taatacgactcactatagggtgctccattacctgcttctcaaaagcactgaacagaggagacagtgcatgtgagaagcaaacctggcggcagcgcaaaagatg

SEQ ID NO: 132076 - DNA, 103 bp, Artificial Sequence
  Synthetic Polynucleotide
taatacgactcactatagggagcagatccttgctccattacctgcttctcaacagaggagagagaagatggtaatggagaacctggcggcagcgcaaaagatg

SEQ ID NO: 132077 - DNA, 103 bp, Artificial Sequence
  Synthetic Polynucleotide
taatacgactcactatagggtttctagcttagcagatccttgctccattaaacagaggagataatggatgaaggatctgaacctggcggcagcgcaaaagatg

SEQ ID NO: 132078 - DNA, 103 bp, Artificial Sequence
  Synthetic Polynucleotide
taatacgactcactatagggatctcggctttttctagcttagcagatcctaacagaggagaaggatcatgtaagctagaaacctggcggcagcgcaaaagatg

SEQ ID NO: 132079 - DNA, 103 bp, Artificial Sequence
  Synthetic Polynucleotide
taatacgactcactatagggcatctgcaggatctcggctttttctagcttaacagaggagaaagctaatgaaagccgagaacctggcggcagcgcaaaagatg

SEQ ID NO: 132080 - DNA, 103 bp, Artificial Sequence
  Synthetic Polynucleotide
taatacgactcactataggggatccacggtcatctgcaggatctcggcttaacagaggagaaagccgatgtcctgcagaaacctggcggcagcgcaaaagatg

SEQ ID NO: 132081 - DNA, 103 bp, Artificial Sequence
  Synthetic Polynucleotide
taatacgactcactatagggtcgtccagctcgctgtccgaggagctgtacaacagaggagagtacagatgctcggacagaacctggcggcagcgcaaaagatg

SEQ ID NO: 132082 - DNA, 103 bp, Artificial Sequence
  Synthetic Polynucleotide
taatacgactcactatagggattttcaggtgatccacggtcatctgcaggaacagaggagacctgcaatggaccgtggaaacctggcggcagcgcaaaagatg

SEQ ID NO: 132083 - DNA, 103 bp, Artificial Sequence
  Synthetic Polynucleotide
taatacgactcactatagggcgtatgcagcattttcaggtgatccacggtaacagaggagaaccgtgatgcacctgaaaaacctggcggcagcgcaaaagatg

SEQ ID NO: 132084 - DNA, 103 bp, Artificial Sequence
  Synthetic Polynucleotide
taatacgactcactatagggtccctcctgccgtatgcagcattttcaggtaacagaggagaacctgaatgtgctgcataaacctggcggcagcgcaaaagatg

SEQ ID NO: 132085 - DNA, 103 bp, Artificial Sequence
  Synthetic Polynucleotide
taatacgactcactatagggaagtaacctttccctcctgccgtatgcagcaacagaggagagctgcaatgggcaggaggaacctggcggcagcgcaaaagatg

SEQ ID NO: 132086 - DNA, 103 bp, Artificial Sequence
  Synthetic Polynucleotide
taatacgactcactataggggtgcgcgtcaaagtaacctttccctcctgcaacagaggagagcaggaatgaaaggttacaacctggcggcagcgcaaaagatg

SEQ ID NO: 132087 - DNA, 103 bp, Artificial Sequence
  Synthetic Polynucleotide
taatacgactcactatagggtagcaagggcgtgcgcgtcaaagtaaccttaacagaggagaaaggttatgttgacgcgcaacctggcggcagcgcaaaagatg

SEQ ID NO: 132088 - DNA, 103 bp, Artificial Sequence
  Synthetic Polynucleotide
taatacgactcactatagggcgatagtccatagcaagggcgtgcgcgtcaaacagaggagatgacgcatgcgcccttgcaacctggcggcagcgcaaaagatg

SEQ ID NO: 132089 - DNA, 103 bp, Artificial Sequence
  Synthetic Polynucleotide
taatacgactcactatagggtcccaaactccgatagtccatagcaagggcaacagaggagagcccttatgatggactataacctggcggcagcgcaaaagatg

SEQ ID NO: 132090 - DNA, 103 bp, Artificial Sequence
  Synthetic Polynucleotide
taatacgactcactatagggattcccgaaatcccaaactccgatagtccaaacagaggagatggactatgggagtttggaacctggcggcagcgcaaaagatg

SEQ ID NO: 132091 - DNA, 103 bp, Artificial Sequence
  Synthetic Polynucleotide
taatacgactcactatagggtctgccaggcattcccgaaatcccaaactcaacagaggagagagtttatgatttcgggaaacctggcggcagcgcaaaagatg

SEQ ID NO: 132092 - DNA, 103 bp, Artificial Sequence
  Synthetic Polynucleotide
taatacgactcactatagggctcgatggtctcgtccagctcgctgtccgaaacagaggagatcggacatggagctggacaacctggcggcagcgcaaaagatg

SEQ ID NO: 132093 - DNA, 103 bp, Artificial Sequence
  Synthetic Polynucleotide
taatacgactcactatagggacgcgcaacttctgccaggcattcccgaaaaacagaggagatttcggatgtgcctggcaaacctggcggcagcgcaaaagatg

SEQ ID NO: 132094 - DNA, 103 bp, Artificial Sequence
  Synthetic Polynucleotide
taatacgactcactatagggtgctcagataacgcgcaacttctgccaggcaacagaggagagcctggatgaagttgcgcaacctggcggcagcgcaaaagatg

SEQ ID NO: 132095 - DNA, 103 bp, Artificial Sequence
  Synthetic Polynucleotide
taatacgactcactatagggccttcaatgatgctcagataacgcgcaactaacagaggagaagttgcatgttatctgagaacctggcggcagcgcaaaagatg

SEQ ID NO: 132096 - DNA, 103 bp, Artificial Sequence
  Synthetic Polynucleotide
taatacgactcactatagggggcatctagtccttcaatgatgctcagataaacagaggagatatctgatgatcattgaaaacctggcggcagcgcaaaagatg

SEQ ID NO: 132097 - DNA, 103 bp, Artificial Sequence
  Synthetic Polynucleotide
taatacgactcactataggggcgggtcagaggcatctagtccttcaatgaaacagaggagatcattgatggactagatgaacctggcggcagcgcaaaagatg

SEQ ID NO: 132098 - DNA, 103 bp, Artificial Sequence
  Synthetic Polynucleotide
taatacgactcactatagggcgaactcgaagcgggtcagaggcatctagtaacagaggagaactagaatgctctgacccaacctggcggcagcgcaaaagatg

SEQ ID NO: 132099 - DNA, 103 bp, Artificial Sequence
  Synthetic Polynucleotide
taatacgactcactatagggcgaaaccagtcgaactcgaagcgggtcagaaacagaggagatctgacatgcttcgagttaacctggcggcagcgcaaaagatg

SEQ ID NO: 132100 - DNA, 103 bp, Artificial Sequence
  Synthetic Polynucleotide
taatacgactcactatagggtgttgagatgcgaaaccagtcgaactcgaaaacagaggagattcgagatggactggtttaacctggcggcagcgcaaaagatg

SEQ ID NO: 132101 - DNA, 103 bp, Artificial Sequence
  Synthetic Polynucleotide
taatacgactcactataggggaagcgtagttgttgagatgcgaaaccagtaacagaggagaactggtatggcatctcaaaacctggcggcagcgcaaaagatg

SEQ ID NO: 132102 - DNA, 103 bp, Artificial Sequence
  Synthetic Polynucleotide
taatacgactcactatagggttcccgctgggaagcgtagttgttgagatgaacagaggagacatctcatgaactacgctaacctggcggcagcgcaaaagatg

SEQ ID NO: 132103 - DNA, 103 bp, Artificial Sequence
  Synthetic Polynucleotide
taatacgactcactatagggccttctccacctcgatggtctcgtccagctaacagaggagaagctggatgagaccatcgaacctggcggcagcgcaaaagatg

SEQ ID NO: 132104 - DNA, 103 bp, Artificial Sequence
  Synthetic Polynucleotide
taatacgactcactatagggcgctcgcggcttcccgctgggaagcgtagtaacagaggagaactacgatgcccagcgggaacctggcggcagcgcaaaagatg

SEQ ID NO: 132105 - DNA, 103 bp, Artificial Sequence
  Synthetic Polynucleotide
taatacgactcactataggggcgtgggcgccgctcgcggcttcccgctggaacagaggagaccagcgatgagccgcgagaacctggcggcagcgcaaaagatg

SEQ ID NO: 132106 - DNA, 103 bp, Artificial Sequence
  Synthetic Polynucleotide
taatacgactcactatagggtccgaggcccgcgtgggcgccgctcgcggcaacagaggagagccgcgatgggcgcccacaacctggcggcagcgcaaaagatg

SEQ ID NO: 132107 - DNA, 103 bp, Artificial Sequence
  Synthetic Polynucleotide
taatacgactcactatagggagggaatgtgtccgaggcccgcgtgggcgcaacagaggagagcgcccatgcgggcctcgaacctggcggcagcgcaaaagatg

SEQ ID NO: 132108 - DNA, 103 bp, Artificial Sequence
  Synthetic Polynucleotide
taatacgactcactatagggacggtcccccagggaatgtgtccgaggcccaacagaggagagggcctatgacacattccaacctggcggcagcgcaaaagatg

SEQ ID NO: 132109 - DNA, 103 bp, Artificial Sequence
  Synthetic Polynucleotide
taatacgactcactatagggatgtccgaagacggtcccccagggaatgtgaacagaggagacacattatgtgggggaccaacctggcggcagcgcaaaagatg

SEQ ID NO: 132110 - DNA, 103 bp, Artificial Sequence
  Synthetic Polynucleotide
taatacgactcactatagggtgtgcgggtgatgtccgaagacggtcccccaacagaggagagggggaatgtcttcggacaacctggcggcagcgcaaaagatg

SEQ ID NO: 132111 - DNA, 103 bp, Artificial Sequence
  Synthetic Polynucleotide
taatacgactcactataggggggtgcgcgatgtgcgggtgatgtccgaagaacagaggagacttcggatgtcacccgcaaacctggcggcagcgcaaaagatg

SEQ ID NO: 132112 - DNA, 103 bp, Artificial Sequence
  Synthetic Polynucleotide
taatacgactcactatagggcagcaacagcgggtgcgcgatgtgcgggtgaacagaggagacacccgatgatcgcgcacaacctggcggcagcgcaaaagatg

SEQ ID NO: 132113 - DNA, 103 bp, Artificial Sequence
  Synthetic Polynucleotide
taatacgactcactatagggcgttctggggcagcaacagcgggtgcgcgaaacagaggagatcgcgcatgcgctgttgcaacctggcggcagcgcaaaagatg

SEQ ID NO: 132114 - DNA, 103 bp, Artificial Sequence
  Synthetic Polynucleotide
taatacgactcactatagggtccgcactctccttctccacctcgatggtcaacagaggagagaccatatgggtggagaaaacctggcggcagcgcaaaagatg

SEQ ID NO: 132115 - DNA, 103 bp, Artificial Sequence
  Synthetic Polynucleotide
taatacgactcactatagggttcccgtggccgttctggggcagcaacagcaacagaggagagctgttatggccccagaaaacctggcggcagcgcaaaagatg

SEQ ID NO: 132116 - DNA, 103 bp, Artificial Sequence
  Synthetic Polynucleotide
taatacgactcactatagggggtgcccgcgttcccgtggccgttctggggaacagaggagaccccagatgggccacgggaacctggcggcagcgcaaaagatg

SEQ ID NO: 132117 - DNA, 103 bp, Artificial Sequence
  Synthetic Polynucleotide
taatacgactcactataggggtgaggccgtggtgcccgcgttcccgtggcaacagaggagagccacgatgacgcgggcaaacctggcggcagcgcaaaagatg

SEQ ID NO: 132118 - DNA, 103 bp, Artificial Sequence
  Synthetic Polynucleotide
taatacgactcactatagggggttccgtgggtgaggccgtggtgcccgcgaacagaggagacgcgggatgcacggcctcaacctggcggcagcgcaaaagatg

SEQ ID NO: 132119 - DNA, 103 bp, Artificial Sequence
  Synthetic Polynucleotide
taatacgactcactatagggctggtggtgcggttccgtgggtgaggccgtaacagaggagaacggccatgcccacggaaaacctggcggcagcgcaaaagatg

SEQ ID NO: 132120 - DNA, 103 bp, Artificial Sequence
  Synthetic Polynucleotide
taatacgactcactatagggccagcctgccctggtggtgcggttccgtggaacagaggagaccacggatgcgcaccaccaacctggcggcagcgcaaaagatg

SEQ ID NO: 132121 - DNA, 103 bp, Artificial Sequence
  Synthetic Polynucleotide
taatacgactcactatagggtgtgccgagcccagcctgccctggtggtgcaacagaggagagcaccaatggggcaggctaacctggcggcagcgcaaaagatg

SEQ ID NO: 132122 - DNA, 103 bp, Artificial Sequence
  Synthetic Polynucleotide
taatacgactcactatagggcgcctccggatgtgccgagcccagcctgccaacagaggagaggcaggatgggctcggcaaacctggcggcagcgcaaaagatg

SEQ ID NO: 132123 - DNA, 103 bp, Artificial Sequence
  Synthetic Polynucleotide
taatacgactcactataggggcaaagcaggcgcctccggatgtgccgagcaacagaggagagctcggatgatccggaggaacctggcggcagcgcaaaagatg

SEQ ID NO: 132124 - DNA, 103 bp, Artificial Sequence
  Synthetic Polynucleotide
taatacgactcactataggggggggcgctcgcaaagcaggcgcctccggaaacagaggagatccggaatggcctgctttaacctggcggcagcgcaaaagatg

SEQ ID NO: 132125 - DNA, 103 bp, Artificial Sequence
  Synthetic Polynucleotide
taatacgactcactatagggtccattctcgtccgcactctccttctccacaacagaggagagtggagatggagagtgcgaacctggcggcagcgcaaaagatg

SEQ ID NO: 132126 - DNA, 103 bp, Artificial Sequence
  Synthetic Polynucleotide
taatacgactcactataggggctgccgctagggggcgctcgcaaagcaggaacagaggagacctgctatgcgagcgcccaacctggcggcagcgcaaaagatg

SEQ ID NO: 132127 - DNA, 103 bp, Artificial Sequence
  Synthetic Polynucleotide
taatacgactcactatagggccggtccgaggctgccgctagggggcgctcaacagaggagagagcgcatgctagcggcaaacctggcggcagcgcaaaagatg

SEQ ID NO: 132128 - DNA, 103 bp, Artificial Sequence
  Synthetic Polynucleotide
taatacgactcactatagggacagggagcaccggtccgaggctgccgctaaacagaggagatagcggatgcctcggaccaacctggcggcagcgcaaaagatg

SEQ ID NO: 132129 - DNA, 103 bp, Artificial Sequence
  Synthetic Polynucleotide
taatacgactcactatagggggaggtgaccacagggagcaccggtccgagaacagaggagactcggaatggtgctccctaacctggcggcagcgcaaaagatg

SEQ ID NO: 132130 - DNA, 103 bp, Artificial Sequence
  Synthetic Polynucleotide
taatacgactcactataggggtttggaggcggaggtgaccacagggagcaaacagaggagatgctccatgtggtcacctaacctggcggcagcgcaaaagatg

SEQ ID NO: 132131 - DNA, 103 bp, Artificial Sequence
  Synthetic Polynucleotide
taatacgactcactatagggggcggcgacagtttggaggcggaggtgaccaacagaggagaggtcacatgcgcctccaaaacctggcggcagcgcaaaagatg

SEQ ID NO: 132132 - DNA, 103 bp, Artificial Sequence
  Synthetic Polynucleotide
taatacgactcactatagggggagagcagaggcggcgacagtttggaggcaacagaggagagcctccatgctgtcgccgaacctggcggcagcgcaaaagatg

SEQ ID NO: 132133 - DNA, 103 bp, Artificial Sequence
  Synthetic Polynucleotide
taatacgactcactatagggaggccactgaggagagcagaggcggcgacaaacagaggagatgtcgcatgctctgctctaacctggcggcagcgcaaaagatg

SEQ ID NO: 132134 - DNA, 103 bp, Artificial Sequence
  Synthetic Polynucleotide
taatacgactcactataggggccgacagggaggccactgaggagagcagaaacagaggagatctgctatgctcagtggcaacctggcggcagcgcaaaagatg

SEQ ID NO: 132135 - DNA, 103 bp, Artificial Sequence
  Synthetic Polynucleotide
taatacgactcactataggggaaggggaaggccgacagggaggccactgaaacagaggagatcagtgatgtccctgtcgaacctggcggcagcgcaaaagatg

SEQ ID NO: 132136 - DNA, 103 bp, Artificial Sequence
  Synthetic Polynucleotide
taatacgactcactatagggaactcaagtttccattctcgtccgcactctaacagaggagaagagtgatgacgagaatgaacctggcggcagcgcaaaagatg

SEQ ID NO: 132137 - DNA, 103 bp, Artificial Sequence
  Synthetic Polynucleotide
taatacgactcactatagggagccgaaagagaaggggaaggccgacagggaacagaggagaccctgtatgccttcccctaacctggcggcagcgcaaaagatg

SEQ ID NO: 132138 - DNA, 103 bp, Artificial Sequence
  Synthetic Polynucleotide
taatacgactcactatagggaagtggaaggagccgaaagagaaggggaagaacagaggagacttcccatgctctttcggaacctggcggcagcgcaaaagatg

SEQ ID NO: 132139 - DNA, 103 bp, Artificial Sequence
  Synthetic Polynucleotide
taatacgactcactataggggggagacagtaagtggaaggagccgaaagaaacagaggagatctttcatgtccttccacaacctggcggcagcgcaaaagatg

SEQ ID NO: 132140 - DNA, 103 bp, Artificial Sequence
  Synthetic Polynucleotide
taatacgactcactatagggtcagtgcattgggagacagtaagtggaaggaacagaggagaccttccatgtactgtctcaacctggcggcagcgcaaaagatg

SEQ ID NO: 132141 - DNA, 103 bp, Artificial Sequence
  Synthetic Polynucleotide
taatacgactcactataggggctgaagggctcagtgcattgggagacagtaacagaggagaactgtcatgcaatgcactaacctggcggcagcgcaaaagatg

SEQ ID NO: 132142 - DNA, 103 bp, Artificial Sequence
  Synthetic Polynucleotide
taatacgactcactatagggctgcgtgggtgctgaagggctcagtgcattaacagaggagaaatgcaatgagcccttcaaacctggcggcagcgcaaaagatg

SEQ ID NO: 132143 - DNA, 103 bp, Artificial Sequence
  Synthetic Polynucleotide
taatacgactcactatagggggtttgcagcctgcgtgggtgctgaagggcaacagaggagagcccttatgcacccacgcaacctggcggcagcgcaaaagatg

SEQ ID NO: 132144 - DNA, 103 bp, Artificial Sequence
  Synthetic Polynucleotide
taatacgactcactatagggggcttgccaaggtttgcagcctgcgtgggtaacagaggagaacccacatgggctgcaaaaacctggcggcagcgcaaaagatg

SEQ ID NO: 132145 - DNA, 103 bp, Artificial Sequence
  Synthetic Polynucleotide
taatacgactcactatagggaggtctatagggcttgccaaggtttgcagcaacagaggagagctgcaatgcttggcaagaacctggcggcagcgcaaaagatg

SEQ ID NO: 132146 - DNA, 103 bp, Artificial Sequence
  Synthetic Polynucleotide
taatacgactcactatagggccgtcccccaaggtctatagggcttgccaaaacagaggagattggcaatgcctatagacaacctggcggcagcgcaaaagatg

SEQ ID NO: 132147 - DNA, 103 bp, Artificial Sequence
  Synthetic Polynucleotide
taatacgactcactatagggcctagagccgaactcaagtttccattctcgaacagaggagacgagaaatgaaacttgagaacctggcggcagcgcaaaagatg

SEQ ID NO: 132148 - DNA, 103 bp, Artificial Sequence
  Synthetic Polynucleotide
taatacgactcactataggggctccgatctccgtcccccaaggtctatagaacagaggagactatagatgttgggggacaacctggcggcagcgcaaaagatg

SEQ ID NO: 132149 - DNA, 103 bp, Artificial Sequence
  Synthetic Polynucleotide
taatacgactcactatagggggaggtcgtctcctcgcaggggcgcttcataacagaggagaatgaagatgccctgcgagaacctggcggcagcgcaaaagatg

SEQ ID NO: 132150 - DNA, 103 bp, Artificial Sequence
  Synthetic Polynucleotide
taatacgactcactatagggtggagaattcaatctaatcacagagctagtaacagaggagaactagcatggtgattagaaacctggcggcagcgcaaaagatg

SEQ ID NO: 132151 - DNA, 103 bp, Artificial Sequence
  Synthetic Polynucleotide
taatacgactcactatagggatgttgttgttggagaattcaatctaatcaaacagaggagatgattaatgtgaattctcaacctggcggcagcgcaaaagatg

SEQ ID NO: 132152 - DNA, 103 bp, Artificial Sequence
  Synthetic Polynucleotide
taatacgactcactatagggataatctgagatgttgttgttggagaattcaacagaggagagaattcatgaacaacaacaacctggcggcagcgcaaaagatg

SEQ ID NO: 132153 - DNA, 103 bp, Artificial Sequence
  Synthetic Polynucleotide
taatacgactcactatagggctttcttgccataatctgagatgttgttgtaacagaggagaacaacaatgtctcagattaacctggcggcagcgcaaaagatg

SEQ ID NO: 132154 - DNA, 103 bp, Artificial Sequence
  Synthetic Polynucleotide
taatacgactcactatagggctctccttttctttcttgccataatctgagaacagaggagactcagaatgtggcaagaaaacctggcggcagcgcaaaagatg

SEQ ID NO: 132155 - DNA, 103 bp, Artificial Sequence
  Synthetic Polynucleotide
taatacgactcactatagggtctataatccctctccttttctttcttgccaacagaggagaggcaagatggaaaaggagaacctggcggcagcgcaaaagatg

SEQ ID NO: 132156 - DNA, 103 bp, Artificial Sequence
  Synthetic Polynucleotide
taatacgactcactatagggacgccttttctctataatccctctccttttaacagaggagaaaaaggatggggattataaacctggcggcagcgcaaaagatg

SEQ ID NO: 132157 - DNA, 103 bp, Artificial Sequence
  Synthetic Polynucleotide
taatacgactcactatagggtccgatcccgacgccttttctctataatccaacagaggagaggattaatgagaaaaggcaacctggcggcagcgcaaaagatg

SEQ ID NO: 132158 - DNA, 103 bp, Artificial Sequence
  Synthetic Polynucleotide
taatacgactcactatagggctgttatttatccgatcccgacgccttttcaacagaggagagaaaagatgtcgggatcgaacctggcggcagcgcaaaagatg

SEQ ID NO: 132159 - DNA, 103 bp, Artificial Sequence
  Synthetic Polynucleotide
taatacgactcactatagggctcagataaactgttatttatccgatcccgaacagaggagacgggatatgataaataacaacctggcggcagcgcaaaagatg

SEQ ID NO: 132160 - DNA, 103 bp, Artificial Sequence
  Synthetic Polynucleotide
taatacgactcactatagggtgtcgctctcggaggtcgtctcctcgcaggaacagaggagacctgcgatgagacgacctaacctggcggcagcgcaaaagatg

SEQ ID NO: 132161 - DNA, 103 bp, Artificial Sequence
  Synthetic Polynucleotide
taatacgactcactataggggtcttctcaactcagataaactgttatttaaacagaggagataaataatggtttatctgaacctggcggcagcgcaaaagatg

SEQ ID NO: 132162 - DNA, 103 bp, Artificial Sequence
  Synthetic Polynucleotide
taatacgactcactataggggttggcacaagtcttctcaactcagataaaaacagaggagatttatcatggttgagaagaacctggcggcagcgcaaaagatg

SEQ ID NO: 132163 - DNA, 103 bp, Artificial Sequence
  Synthetic Polynucleotide
taatacgactcactatagggttcaaaagcagttggcacaagtcttctcaaaacagaggagattgagaatgcttgtgccaaacctggcggcagcgcaaaagatg

SEQ ID NO: 132164 - DNA, 103 bp, Artificial Sequence
  Synthetic Polynucleotide
taatacgactcactatagggatccttgtttttcaaaagcagttggcacaaaacagaggagattgtgcatgctgcttttgaacctggcggcagcgcaaaagatg

SEQ ID NO: 132165 - DNA, 103 bp, Artificial Sequence
  Synthetic Polynucleotide
taatacgactcactatagggaactttgcagatccttgtttttcaaaagcaaacagaggagatgctttatgaaaacaaggaacctggcggcagcgcaaaagatg

SEQ ID NO: 132166 - DNA, 103 bp, Artificial Sequence
  Synthetic Polynucleotide
taatacgactcactatagggagctttttctaactttgcagatccttgtttaacagaggagaaaacaaatgtctgcaaagaacctggcggcagcgcaaaagatg

SEQ ID NO: 132167 - DNA, 103 bp, Artificial Sequence
  Synthetic Polynucleotide
taatacgactcactataggggcaatatttcagctttttctaactttgcagaacagaggagactgcaaatgtagaaaaagaacctggcggcagcgcaaaagatg

SEQ ID NO: 132168 - DNA, 103 bp, Artificial Sequence
  Synthetic Polynucleotide
taatacgactcactatagggactgtcatttgcaatatttcagctttttctaacagaggagaagaaaaatgtgaaatattaacctggcggcagcgcaaaagatg

SEQ ID NO: 132169 - DNA, 103 bp, Artificial Sequence
  Synthetic Polynucleotide
taatacgactcactatagggcaaatgatccactgtcatttgcaatatttcaacagaggagagaaataatgcaaatgacaaacctggcggcagcgcaaaagatg

SEQ ID NO: 132170 - DNA, 103 bp, Artificial Sequence
  Synthetic Polynucleotide
taatacgactcactataggggaagcatcttcaaatgatccactgtcatttaacagaggagaaaatgaatgtggatcattaacctggcggcagcgcaaaagatg

SEQ ID NO: 132171 - DNA, 103 bp, Artificial Sequence
  Synthetic Polynucleotide
taatacgactcactataggggtctcgtccatgtcgctctcggaggtcgtcaacagaggagagacgacatgcgagagcgaaacctggcggcagcgcaaaagatg

SEQ ID NO: 132172 - DNA, 103 bp, Artificial Sequence
  Synthetic Polynucleotide
taatacgactcactatagggcctgttgcctgaagcatcttcaaatgatccaacagaggagaggatcaatggaagatgctaacctggcggcagcgcaaaagatg

SEQ ID NO: 132173 - DNA, 103 bp, Artificial Sequence
  Synthetic Polynucleotide
taatacgactcactataggggcctttaccccctgttgcctgaagcatcttaacagaggagaaagatgatgcaggcaacaaacctggcggcagcgcaaaagatg

SEQ ID NO: 132174 - DNA, 103 bp, Artificial Sequence
  Synthetic Polynucleotide
taatacgactcactatagggcgtcaaagtagcctttaccccctgttgcctaacagaggagaaggcaaatgggggtaaagaacctggcggcagcgcaaaagatg

SEQ ID NO: 132175 - DNA, 103 bp, Artificial Sequence
  Synthetic Polynucleotide
taatacgactcactatagggagagcgtgtgcgtcaaagtagcctttacccaacagaggagagggtaaatgctactttgaaacctggcggcagcgcaaaagatg

SEQ ID NO: 132176 - DNA, 103 bp, Artificial Sequence
  Synthetic Polynucleotide
taatacgactcactataggggtccatggcaagagcgtgtgcgtcaaagtaaacagaggagatactttatggcacacgctaacctggcggcagcgcaaaagatg

SEQ ID NO: 132177 - DNA, 103 bp, Artificial Sequence
  Synthetic Polynucleotide
taatacgactcactatagggtgctcatgaagtccatggcaagagcgtgtgaacagaggagacacacgatgttgccatggaacctggcggcagcgcaaaagatg

SEQ ID NO: 132178 - DNA, 103 bp, Artificial Sequence
  Synthetic Polynucleotide
taatacgactcactatagggcggaatcctatgctcatgaagtccatggcaaacagaggagatgccatatgcttcatgagaacctggcggcagcgcaaaagatg

SEQ ID NO: 132179 - DNA, 103 bp, Artificial Sequence
  Synthetic Polynucleotide
taatacgactcactatagggtaggcactctcggaatcctatgctcatgaaaacagaggagattcatgatgataggattcaacctggcggcagcgcaaaagatg

SEQ ID NO: 132180 - DNA, 103 bp, Artificial Sequence
  Synthetic Polynucleotide
taatacgactcactatagggcaacttctgttaggcactctcggaatcctaaacagaggagataggatatggagagtgccaacctggcggcagcgcaaaagatg

SEQ ID NO: 132181 - DNA, 103 bp, Artificial Sequence
  Synthetic Polynucleotide
taatacgactcactatagggaggtaccgcgcaacttctgttaggcactctaacagaggagaagagtgatgaacagaagtaacctggcggcagcgcaaaagatg

SEQ ID NO: 132182 - DNA, 103 bp, Artificial Sequence
  Synthetic Polynucleotide
taatacgactcactatagggcacgtcgatggtctcgtccatgtcgctctcaacagaggagagagagcatgatggacgagaacctggcggcagcgcaaaagatg

SEQ ID NO: 132183 - DNA, 103 bp, Artificial Sequence
  Synthetic Polynucleotide
taatacgactcactatagggcacggagctcaggtaccgcgcaacttctgtaacagaggagaacagaaatggcgcggtacaacctggcggcagcgcaaaagatg

SEQ ID NO: 132184 - DNA, 103 bp, Artificial Sequence
  Synthetic Polynucleotide
taatacgactcactatagggccaggccttccacggagctcaggtaccgcgaacagaggagacgcggtatgtgagctccgaacctggcggcagcgcaaaagatg

SEQ ID NO: 132185 - DNA, 103 bp, Artificial Sequence
  Synthetic Polynucleotide
taatacgactcactatagggtccgaggagtccaggccttccacggagctcaacagaggagagagctcatgggaaggcctaacctggcggcagcgcaaaagatg

SEQ ID NO: 132186 - DNA, 103 bp, Artificial Sequence
  Synthetic Polynucleotide
taatacgactcactatagggccgcagcggatccgaggagtccaggccttcaacagaggagagaaggcatggactcctcgaacctggcggcagcgcaaaagatg

SEQ ID NO: 132187 - DNA, 103 bp, Artificial Sequence
  Synthetic Polynucleotide
taatacgactcactatagggcaagccgcacccgcagcggatccgaggagtaacagaggagaactcctatgatccgctgcaacctggcggcagcgcaaaagatg

SEQ ID NO: 132188 - DNA, 103 bp, Artificial Sequence
  Synthetic Polynucleotide
taatacgactcactatagggagatgagacacaagccgcacccgcagcggaaacagaggagatccgctatgggtgcggctaacctggcggcagcgcaaaagatg

SEQ ID NO: 132189 - DNA, 103 bp, Artificial Sequence
  Synthetic Polynucleotide
taatacgactcactataggggcaagtgctgagatgagacacaagccgcacaacagaggagagtgcggatggtgtctcataacctggcggcagcgcaaaagatg

SEQ ID NO: 132190 - DNA, 103 bp, Artificial Sequence
  Synthetic Polynucleotide
taatacgactcactataggggctgggtggcgcaagtgctgagatgagacaaacagaggagatgtctcatgtcagcacttaacctggcggcagcgcaaaagatg

SEQ ID NO: 132191 - DNA, 103 bp, Artificial Sequence
  Synthetic Polynucleotide
taatacgactcactataggggccgcctcccgctgggtggcgcaagtgctgaacagaggagacagcacatgcgccacccaaacctggcggcagcgcaaaagatg

SEQ ID NO: 132192 - DNA, 103 bp, Artificial Sequence
  Synthetic Polynucleotide
taatacgactcactatagggtgtcatggccgccgcctcccgctgggtggcaacagaggagagccaccatgcgggaggcgaacctggcggcagcgcaaaagatg

SEQ ID NO: 132193 - DNA, 103 bp, Artificial Sequence
  Synthetic Polynucleotide
taatacgactcactatagggtctcgctccccacgtcgatggtctcgtccaaacagaggagatggacgatgccatcgacgaacctggcggcagcgcaaaagatg

SEQ ID NO: 132194 - DNA, 103 bp, Artificial Sequence
  Synthetic Polynucleotide
taatacgactcactatagggccatggaggatgtcatggccgccgcctcccaacagaggagagggaggatgcggccatgaaacctggcggcagcgcaaaagatg

SEQ ID NO: 132195 - DNA, 103 bp, Artificial Sequence
  Synthetic Polynucleotide
taatacgactcactatagggtggtggtgggccatggaggatgtcatggccaacagaggagaggccatatgatcctccataacctggcggcagcgcaaaagatg

SEQ ID NO: 132196 - DNA, 103 bp, Artificial Sequence
  Synthetic Polynucleotide
taatacgactcactataggggagcggatgatggtggtgggccatggaggaaacagaggagatcctccatggcccaccacaacctggcggcagcgcaaaagatg

SEQ ID NO: 132197 - DNA, 103 bp, Artificial Sequence
  Synthetic Polynucleotide
taatacgactcactataggggatgcgggtggagcggatgatggtggtgggaacagaggagacccaccatgatcatccgcaacctggcggcagcgcaaaagatg

SEQ ID NO: 132198 - DNA, 103 bp, Artificial Sequence
  Synthetic Polynucleotide
taatacgactcactataggggcggcccagtgatgcgggtggagcggatgaaacagaggagatcatccatgccacccgcaaacctggcggcagcgcaaaagatg

SEQ ID NO: 132199 - DNA, 103 bp, Artificial Sequence
  Synthetic Polynucleotide
taatacgactcactataggggtggaaggcggcggcccagtgatgcgggtgaacagaggagacacccgatgcactgggccaacctggcggcagcgcaaaagatg

SEQ ID NO: 132200 - DNA, 103 bp, Artificial Sequence
  Synthetic Polynucleotide
taatacgactcactatagggcgggcaggtggtggaaggcggcggcccagtaacagaggagaactgggatgccgccttccaacctggcggcagcgcaaaagatg

SEQ ID NO: 132201 - DNA, 103 bp, Artificial Sequence
  Synthetic Polynucleotide
taatacgactcactatagggagcagggctgcgggcaggtggtggaaggcgaacagaggagacgccttatgccacctgccaacctggcggcagcgcaaaagatg

SEQ ID NO: 132202 - DNA, 103 bp, Artificial Sequence
  Synthetic Polynucleotide
taatacgactcactataggggttgggctggagcagggctgcgggcaggtgaacagaggagacacctgatggcagccctgaacctggcggcagcgcaaaagatg

SEQ ID NO: 132203 - DNA, 103 bp, Artificial Sequence
  Synthetic Polynucleotide
taatacgactcactatagggcatggaggccgttgggctggagcagggctgaacagaggagacagcccatgtccagcccaaacctggcggcagcgcaaaagatg

SEQ ID NO: 132204 - DNA, 103 bp, Artificial Sequence
  Synthetic Polynucleotide
taatacgactcactataggggagtaattgttctcgctccccacgtcgatgaacagaggagacatcgaatgggggagcgaaacctggcggcagcgcaaaagatg

SEQ ID NO: 132205 - DNA, 103 bp, Artificial Sequence
  Synthetic Polynucleotide
taatacgactcactataggggactctgaggcatggaggccgttgggctggaacagaggagaccagccatgcggcctccaaacctggcggcagcgcaaaagatg

SEQ ID NO: 132206 - DNA, 103 bp, Artificial Sequence
  Synthetic Polynucleotide
taatacgactcactatagggacaaggggttgactctgaggcatggaggccaacagaggagaggcctcatggcctcagagaacctggcggcagcgcaaaagatg

SEQ ID NO: 132207 - DNA, 103 bp, Artificial Sequence
  Synthetic Polynucleotide
taatacgactcactatagggtggagaggcgacaaggggttgactctgaggaacagaggagacctcagatgcaaccccttaacctggcggcagcgcaaaagatg

SEQ ID NO: 132208 - DNA, 103 bp, Artificial Sequence
  Synthetic Polynucleotide
taatacgactcactatagggtctgaagttgtggagaggcgacaaggggttaacagaggagaaaccccatgtcgcctctcaacctggcggcagcgcaaaagatg

SEQ ID NO: 132209 - DNA, 103 bp, Artificial Sequence
  Synthetic Polynucleotide
taatacgactcactatagggaggaggcacttctgaagttgtggagaggcgaacagaggagacgcctcatgacaacttcaaacctggcggcagcgcaaaagatg

SEQ ID NO: 132210 - DNA, 103 bp, Artificial Sequence
  Synthetic Polynucleotide
taatacgactcactatagggagccgtgggcaggaggcacttctgaagttgaacagaggagacaacttatgaagtgcctcaacctggcggcagcgcaaaagatg

SEQ ID NO: 132211 - DNA, 103 bp, Artificial Sequence
  Synthetic Polynucleotide
taatacgactcactatagggaggagagcagagccgtgggcaggaggcactaacagaggagaagtgccatgtgcccacggaacctggcggcagcgcaaaagatg

SEQ ID NO: 132212 - DNA, 103 bp, Artificial Sequence
  Synthetic Polynucleotide
taatacgactcactatagggcgtggccgtgaggagagcagagccgtgggcaacagaggagagcccacatgtctgctctcaacctggcggcagcgcaaaagatg

SEQ ID NO: 132213 - DNA, 103 bp, Artificial Sequence
  Synthetic Polynucleotide
taatacgactcactatagggcatgggcaaacgtggccgtgaggagagcagaacagaggagactgctcatgtcacggccaaacctggcggcagcgcaaaagatg

SEQ ID NO: 132214 - DNA, 103 bp, Artificial Sequence
  Synthetic Polynucleotide
taatacgactcactataggggctgaatccgcatgggcaaacgtggccgtgaacagaggagacacggcatggtttgcccaaacctggcggcagcgcaaaagatg

SEQ ID NO: 132215 - DNA, 103 bp, Artificial Sequence
  Synthetic Polynucleotide
taatacgactcactatagggactttgccccgagtaattgttctcgctcccaacagaggagagggagcatgaacaattacaacctggcggcagcgcaaaagatg

SEQ ID NO: 132216 - DNA, 103 bp, Artificial Sequence
  Synthetic Polynucleotide
taatacgactcactatagggcattcggagggctgaatccgcatgggcaaaaacagaggagatttgccatggcggattcaaacctggcggcagcgcaaaagatg

SEQ ID NO: 132217 - DNA, 103 bp, Artificial Sequence
  Synthetic Polynucleotide
taatacgactcactatagggccgtggatggcattcggagggctgaatccgaacagaggagacggattatgccctccgaaaacctggcggcagcgcaaaagatg

SEQ ID NO: 132218 - DNA, 103 bp, Artificial Sequence
  Synthetic Polynucleotide
taatacgactcactataggggcgacgctgcccgtggatggcattcggaggaacagaggagacctccgatggccatccacaacctggcggcagcgcaaaagatg

SEQ ID NO: 132219 - DNA, 103 bp, Artificial Sequence
  Synthetic Polynucleotide
taatacgactcactatagggcacgcagggggcgacgctgcccgtggatggaacagaggagaccatccatgggcagcgtcaacctggcggcagcgcaaaagatg

SEQ ID NO: 132220 - DNA, 103 bp, Artificial Sequence
  Synthetic Polynucleotide
taatacgactcactatagggagagaggtggcacgcagggggcgacgctgcaacagaggagagcagcgatgccccctgcgaacctggcggcagcgcaaaagatg

SEQ ID NO: 132221 - DNA, 103 bp, Artificial Sequence
  Synthetic Polynucleotide
taatacgactcactatagggagagaggtggagagaggtggcacgcaggggaacagaggagacccctgatggccacctctaacctggcggcagcgcaaaagatg

SEQ ID NO: 132222 - DNA, 103 bp, Artificial Sequence
  Synthetic Polynucleotide
taatacgactcactataggggagggacaagagagaggtggagagaggtggaacagaggagaccacctatgtccacctctaacctggcggcagcgcaaaagatg

SEQ ID NO: 132223 - DNA, 103 bp, Artificial Sequence
  Synthetic Polynucleotide
taatacgactcactatagggcggtggcagagagggacaagagagaggtggaacagaggagaccacctatgtcttgtcccaacctggcggcagcgcaaaagatg

SEQ ID NO: 132224 - DNA, 103 bp, Artificial Sequence
  Synthetic Polynucleotide
taatacgactcactataggggcggcgtggacggtggcagagagggacaagaacagaggagacttgtcatgctctgccacaacctggcggcagcgcaaaagatg

SEQ ID NO: 132225 - DNA, 103 bp, Artificial Sequence
  Synthetic Polynucleotide
taatacgactcactatagggtgctgcggctgcggcgtggacggtggcagaaacagaggagatctgccatggtccacgccaacctggcggcagcgcaaaagatg

SEQ ID NO: 132226 - DNA, 103 bp, Artificial Sequence
  Synthetic Polynucleotide
taatacgactcactatagggcagagctagtactttgccccgagtaattgtaacagaggagaacaattatgcggggcaaaaacctggcggcagcgcaaaagatg

SEQ ID NO: 132227 - DNA, 103 bp, Artificial Sequence
  Synthetic Polynucleotide
taatacgactcactatagggccgcggtggctgctgcggctgcggcgtggaaacagaggagatccacgatgcagccgcagaacctggcggcagcgcaaaagatg

SEQ ID NO: 132228 - DNA, 103 bp, Artificial Sequence
  Synthetic Polynucleotide
taatacgactcactatagggctgtgtgcagccgcggtggctgctgcggctaacagaggagaagccgcatgagccaccgcaacctggcggcagcgcaaaagatg

SEQ ID NO: 132229 - DNA, 103 bp, Artificial Sequence
  Synthetic Polynucleotide
taatacgactcactatagggcagagggaagctgtgtgcagccgcggtggcaacagaggagagccaccatggctgcacacaacctggcggcagcgcaaaagatg

SEQ ID NO: 132230 - DNA, 103 bp, Artificial Sequence
  Synthetic Polynucleotide
taatacgactcactatagggccgcgaaggacagagggaagctgtgtgcagaacagaggagactgcacatggcttccctcaacctggcggcagcgcaaaagatg

SEQ ID NO: 132231 - DNA, 103 bp, Artificial Sequence
  Synthetic Polynucleotide
taatacgactcactataggggggaatgcccccgcgaaggacagagggaagaacagaggagacttcccatggtccttcgcaacctggcggcagcgcaaaagatg

SEQ ID NO: 132232 - DNA, 103 bp, Artificial Sequence
  Synthetic Polynucleotide
taatacgactcactataggggggaagcatggggaatgcccccgcgaaggaaacagaggagatccttcatgggggcattcaacctggcggcagcgcaaaagatg

SEQ ID NO: 132233 - DNA, 103 bp, Artificial Sequence
  Synthetic Polynucleotide
taatacgactcactatagggctgcgtttgggggaagcatggggaatgcccaacagaggagagggcatatgccatgcttcaacctggcggcagcgcaaaagatg

SEQ ID NO: 132234 - DNA, 103 bp, Artificial Sequence
  Synthetic Polynucleotide
taatacgactcactatagggactgctgctgctgcgtttgggggaagcatgaacagaggagacatgctatgcccaaacgcaacctggcggcagcgcaaaagatg

SEQ ID NO: 132235 - DNA, 103 bp, Artificial Sequence
  Synthetic Polynucleotide
taatacgactcactatagggggccgcggccactgctgctgctgcgtttggaacagaggagaccaaacatggcagcagcaaacctggcggcagcgcaaaagatg

SEQ ID NO: 132236 - DNA, 103 bp, Artificial Sequence
  Synthetic Polynucleotide
taatacgactcactatagggtgatggctgtggccgcggccactgctgctgaacagaggagacagcagatgtggccgcggaacctggcggcagcgcaaaagatg

SEQ ID NO: 132237 - DNA, 103 bp, Artificial Sequence
  Synthetic Polynucleotide
taatacgactcactatagggaatctaatcacagagctagtactttgccccaacagaggagaggggcaatgtactagctcaacctggcggcagcgcaaaagatg

SEQ ID NO: 132238 - DNA, 103 bp, Artificial Sequence
  Synthetic Polynucleotide
taatacgactcactatagggaagggcgggctgatggctgtggccgcggccaacagaggagaggccgcatgcacagccataacctggcggcagcgcaaaagatg

SEQ ID NO: 132239 - DNA, 103 bp, Artificial Sequence
  Synthetic Polynucleotide
taatacgactcactatagggtgatactgacaagggcgggctgatggctgtaacagaggagaacagccatgagcccgcccaacctggcggcagcgcaaaagatg

SEQ ID NO: 132240 - DNA, 103 bp, Artificial Sequence
  Synthetic Polynucleotide
taatacgactcactatagggtggacgtggctgatactgacaagggcgggcaacagaggagagcccgcatgtgtcagtataacctggcggcagcgcaaaagatg

SEQ ID NO: 132241 - DNA, 103 bp, Artificial Sequence
  Synthetic Polynucleotide
taatacgactcactatagggtgctgaggactggacgtggctgatactgacaacagaggagagtcagtatgagccacgtcaacctggcggcagcgcaaaagatg

SEQ ID NO: 132242 - DNA, 103 bp, Artificial Sequence
  Synthetic Polynucleotide
taatacgactcactatagggactgctggtctgctgaggactggacgtggcaacagaggagagccacgatgagtcctcagaacctggcggcagcgcaaaagatg

SEQ ID NO: 132243 - DNA, 103 bp, Artificial Sequence
  Synthetic Polynucleotide
taatacgactcactatagggtgtttgttccactgctggtctgctgaggacaacagaggagagtcctcatgagaccagcaaacctggcggcagcgcaaaagatg

SEQ ID NO: 132244 - DNA, 103 bp, Artificial Sequence
  Synthetic Polynucleotide
taatacgactcactatagggtaaggtttattgtttgttccactgctggtcaacagaggagagaccagatgtggaacaaaaacctggcggcagcgcaaaagatg

SEQ ID NO: 132245 - DNA, 103 bp, Artificial Sequence
  Synthetic Polynucleotide
taatacgactcactatagggccagggtcggtaaggtttattgtttgttccaacagaggagaggaacaatgaataaacctaacctggcggcagcgcaaaagatg

SEQ ID NO: 132246 - DNA, 103 bp, Artificial Sequence
  Synthetic Polynucleotide
taatacgactcactatagggcttctgtcccccagggtcggtaaggtttataacagaggagaataaacatgaccgaccctaacctggcggcagcgcaaaagatg

SEQ ID NO: 132247 - DNA, 103 bp, Artificial Sequence
  Synthetic Polynucleotide
taatacgactcactatagggaaagctccaacttctgtcccccagggtcggaacagaggagaccgaccatgggggacagaaacctggcggcagcgcaaaagatg

SEQ ID NO: 132248 - DNA, 103 bp, Artificial Sequence
  Synthetic Polynucleotide
taatacgactcactatagggggagccgctcggctccttgggtcgcttcataacagaggagaatgaagatgcccaaggagaacctggcggcagcgcaaaagatg

SEQ ID NO: 132249 - DNA, 103 bp, Artificial Sequence
  Synthetic Polynucleotide
taatacgactcactatagggctgcgaagagctgggggtggacagcggcctaacagaggagaaggccgatgtccacccccaacctggcggcagcgcaaaagatg

SEQ ID NO: 132250 - DNA, 103 bp, Artificial Sequence
  Synthetic Polynucleotide
taatacgactcactatagggtggcttgcatctgcgaagagctgggggtggaacagaggagaccacccatggctcttcgcaacctggcggcagcgcaaaagatg

SEQ ID NO: 132251 - DNA, 103 bp, Artificial Sequence
  Synthetic Polynucleotide
taatacgactcactatagggtgtttcttcctggcttgcatctgcgaagagaacagaggagactcttcatggatgcaagcaacctggcggcagcgcaaaagatg

SEQ ID NO: 132252 - DNA, 103 bp, Artificial Sequence
  Synthetic Polynucleotide
taatacgactcactataggggatccctctgtgtttcttcctggcttgcataacagaggagaatgcaaatgaggaagaaaaacctggcggcagcgcaaaagatg

SEQ ID NO: 132253 - DNA, 103 bp, Artificial Sequence
  Synthetic Polynucleotide
taatacgactcactataggggtttctctatgatccctctgtgtttcttccaacagaggagaggaagaatgacagagggaaacctggcggcagcgcaaaagatg

SEQ ID NO: 132254 - DNA, 103 bp, Artificial Sequence
  Synthetic Polynucleotide
taatacgactcactatagggtctcgacgccgtttctctatgatccctctgaacagaggagacagaggatgcatagagaaaacctggcggcagcgcaaaagatg

SEQ ID NO: 132255 - DNA, 103 bp, Artificial Sequence
  Synthetic Polynucleotide
taatacgactcactataggggttgatgcggtctcgacgccgtttctctataacagaggagaatagagatgcggcgtcgaaacctggcggcagcgcaaaagatg

SEQ ID NO: 132256 - DNA, 103 bp, Artificial Sequence
  Synthetic Polynucleotide
taatacgactcactatagggaaaggctactgttgatgcggtctcgacgccaacagaggagaggcgtcatgaccgcatcaaacctggcggcagcgcaaaagatg

SEQ ID NO: 132257 - DNA, 103 bp, Artificial Sequence
  Synthetic Polynucleotide
taatacgactcactatagggcgcaattcagaaaggctactgttgatgcggaacagaggagaccgcatatgcagtagcctaacctggcggcagcgcaaaagatg

SEQ ID NO: 132258 - DNA, 103 bp, Artificial Sequence
  Synthetic Polynucleotide
taatacgactcactataggggaccaagcgtcgcaattcagaaaggctactaacagaggagaagtagcatgtctgaattgaacctggcggcagcgcaaaagatg

SEQ ID NO: 132259 - DNA, 103 bp, Artificial Sequence
  Synthetic Polynucleotide
taatacgactcactatagggactccccgtcggagccgctcggctccttggaacagaggagaccaaggatgcgagcggctaacctggcggcagcgcaaaagatg

SEQ ID NO: 132260 - DNA, 103 bp, Artificial Sequence
  Synthetic Polynucleotide
taatacgactcactatagggaggcagtggggaccaagcgtcgcaattcagaacagaggagactgaatatggacgcttggaacctggcggcagcgcaaaagatg

SEQ ID NO: 132261 - DNA, 103 bp, Artificial Sequence
  Synthetic Polynucleotide
taatacgactcactatagggtgtttctcaaaggcagtggggaccaagcgtaacagaggagaacgcttatgccccactgcaacctggcggcagcgcaaaagatg

SEQ ID NO: 132262 - DNA, 103 bp, Artificial Sequence
  Synthetic Polynucleotide
taatacgactcactatagggggaagagccctgtttctcaaaggcagtgggaacagaggagacccactatgtttgagaaaaacctggcggcagcgcaaaagatg

SEQ ID NO: 132263 - DNA, 103 bp, Artificial Sequence
  Synthetic Polynucleotide
taatacgactcactatagggtctccagcttggaagagccctgtttctcaaaacagaggagattgagaatgagggctcttaacctggcggcagcgcaaaagatg

SEQ ID NO: 132264 - DNA, 103 bp, Artificial Sequence
  Synthetic Polynucleotide
taatacgactcactatagggacctcggctttctccagcttggaagagcccaacagaggagagggctcatgcaagctggaaacctggcggcagcgcaaaagatg

SEQ ID NO: 132265 - DNA, 103 bp, Artificial Sequence
  Synthetic Polynucleotide
taatacgactcactatagggcatctgcaagacctcggctttctccagcttaacagaggagaaagctgatgaaagccgagaacctggcggcagcgcaaaagatg

SEQ ID NO: 132266 - DNA, 103 bp, Artificial Sequence
  Synthetic Polynucleotide
taatacgactcactataggggatccaccgtcatctgcaagacctcggcttaacagaggagaaagccgatgtcttgcagaaacctggcggcagcgcaaaagatg

SEQ ID NO: 132267 - DNA, 103 bp, Artificial Sequence
  Synthetic Polynucleotide
taatacgactcactatagggattttcaagtgatccaccgtcatctgcaagaacagaggagacttgcaatggacggtggaaacctggcggcagcgcaaaagatg

SEQ ID NO: 132268 - DNA, 103 bp, Artificial Sequence
  Synthetic Polynucleotide
taatacgactcactatagggggcatggagcattttcaagtgatccaccgtaacagaggagaacggtgatgcacttgaaaaacctggcggcagcgcaaaagatg

SEQ ID NO: 132269 - DNA, 103 bp, Artificial Sequence
  Synthetic Polynucleotide
taatacgactcactatagggtcccaccagtggcatggagcattttcaagtaacagaggagaacttgaatgtgctccatgaacctggcggcagcgcaaaagatg

SEQ ID NO: 132270 - DNA, 103 bp, Artificial Sequence
  Synthetic Polynucleotide
taatacgactcactatagggggtccgtcggactccccgtcggagccgctcaacagaggagagagcggatgcgacggggaaacctggcggcagcgcaaaagatg

SEQ ID NO: 132271 - DNA, 103 bp, Artificial Sequence
  Synthetic Polynucleotide
taatacgactcactatagggaagaatcctgtcccaccagtggcatggagcaacagaggagagctccaatgcactggtggaacctggcggcagcgcaaaagatg

SEQ ID NO: 132272 - DNA, 103 bp, Artificial Sequence
  Synthetic Polynucleotide
taatacgactcactatagggtcgggcatcaaagaatcctgtcccaccagtaacagaggagaactggtatgacaggattcaacctggcggcagcgcaaaagatg

SEQ ID NO: 132273 - DNA, 103 bp, Artificial Sequence
  Synthetic Polynucleotide
taatacgactcactatagggctgccagggctcgggcatcaaagaatcctgaacagaggagacaggatatgttgatgcccaacctggcggcagcgcaaaagatg

SEQ ID NO: 132274 - DNA, 103 bp, Artificial Sequence
  Synthetic Polynucleotide
taatacgactcactatagggcggaagtcaactgccagggctcgggcatcaaacagaggagatgatgcatgagccctggcaacctggcggcagcgcaaaagatg

SEQ ID NO: 132275 - DNA, 103 bp, Artificial Sequence
  Synthetic Polynucleotide
taatacgactcactatagggaccaatgctccggaagtcaactgccagggcaacagaggagagccctgatggttgacttcaacctggcggcagcgcaaaagatg

SEQ ID NO: 132276 - DNA, 103 bp, Artificial Sequence
  Synthetic Polynucleotide
taatacgactcactatagggactcccgaaaaccaatgctccggaagtcaaaacagaggagattgactatgggagcattgaacctggcggcagcgcaaaagatg

SEQ ID NO: 132277 - DNA, 103 bp, Artificial Sequence
  Synthetic Polynucleotide
taatacgactcactatagggtcagtgaggcactcccgaaaaccaatgctcaacagaggagagagcatatgttttcgggaaacctggcggcagcgcaaaagatg

SEQ ID NO: 132278 - DNA, 103 bp, Artificial Sequence
  Synthetic Polynucleotide
taatacgactcactatagggcctgatgacctcagtgaggcactcccgaaaaacagaggagatttcggatgtgcctcactaacctggcggcagcgcaaaagatg

SEQ ID NO: 132279 - DNA, 103 bp, Artificial Sequence
  Synthetic Polynucleotide
taatacgactcactatagggcccccaggtacctgatgacctcagtgaggcaacagaggagagcctcaatgaggtcatcaaacctggcggcagcgcaaaagatg

SEQ ID NO: 132280 - DNA, 103 bp, Artificial Sequence
  Synthetic Polynucleotide
taatacgactcactatagggccttcaaggacccccaggtacctgatgaccaacagaggagaggtcatatggtacctgggaacctggcggcagcgcaaaagatg

SEQ ID NO: 132281 - DNA, 103 bp, Artificial Sequence
  Synthetic Polynucleotide
taatacgactcactatagggcacgtcgatgggtccgtcggactccccgtcaacagaggagagacgggatgtccgacggaaacctggcggcagcgcaaaagatg

SEQ ID NO: 132282 - DNA, 103 bp, Artificial Sequence
  Synthetic Polynucleotide
taatacgactcactataggggctgctgggcccttcaaggacccccaggtaaacagaggagatacctgatggtccttgaaaacctggcggcagcgcaaaagatg

SEQ ID NO: 132283 - DNA, 103 bp, Artificial Sequence
  Synthetic Polynucleotide
taatacgactcactatagggggtctgcacggctgctgggcccttcaaggaaacagaggagatccttgatgggcccagcaaacctggcggcagcgcaaaagatg

SEQ ID NO: 132284 - DNA, 103 bp, Artificial Sequence
  Synthetic Polynucleotide
taatacgactcactatagggatccggacggggtctgcacggctgctgggcaacagaggagagcccagatgccgtgcagaaacctggcggcagcgcaaaagatg

SEQ ID NO: 132285 - DNA, 103 bp, Artificial Sequence
  Synthetic Polynucleotide
taatacgactcactataggggagaaggcgaatccggacggggtctgcacgaacagaggagacgtgcaatgcccgtccggaacctggcggcagcgcaaaagatg

SEQ ID NO: 132286 - DNA, 103 bp, Artificial Sequence
  Synthetic Polynucleotide
taatacgactcactatagggtgaggtgggagagaaggcgaatccggacggaacagaggagaccgtccatgttcgccttcaacctggcggcagcgcaaaagatg

SEQ ID NO: 132287 - DNA, 103 bp, Artificial Sequence
  Synthetic Polynucleotide
taatacgactcactataggggcgtagctgttgaggtgggagagaaggcgaaacagaggagatcgcctatgctcccacctaacctggcggcagcgcaaaagatg

SEQ ID NO: 132288 - DNA, 103 bp, Artificial Sequence
  Synthetic Polynucleotide
taatacgactcactatagggcatctcggctgcgtagctgttgaggtgggaaacagaggagatcccacatgaacagctacaacctggcggcagcgcaaaagatg

SEQ ID NO: 132289 - DNA, 103 bp, Artificial Sequence
  Synthetic Polynucleotide
taatacgactcactataggggcgaaggctccatctcggctgcgtagctgtaacagaggagaacagctatgcagccgagaaacctggcggcagcgcaaaagatg

SEQ ID NO: 132290 - DNA, 103 bp, Artificial Sequence
  Synthetic Polynucleotide
taatacgactcactataggggtgggcgtgggcgaaggctccatctcggctaacagaggagaagccgaatgggagccttcaacctggcggcagcgcaaaagatg

SEQ ID NO: 132291 - DNA, 103 bp, Artificial Sequence
  Synthetic Polynucleotide
taatacgactcactatagggcaaagggccagtgggcgtgggcgaaggctcaacagaggagagagcctatgcccacgcccaacctggcggcagcgcaaaagatg

SEQ ID NO: 132292 - DNA, 103 bp, Artificial Sequence
  Synthetic Polynucleotide
taatacgactcactatagggcctcttggcccacgtcgatgggtccgtcggaacagaggagaccgacgatgccatcgacgaacctggcggcagcgcaaaagatg

SEQ ID NO: 132293 - DNA, 103 bp, Artificial Sequence
  Synthetic Polynucleotide
taatacgactcactatagggcagggaaggccaaagggccagtgggcgtggaacagaggagaccacgcatgctggcccttaacctggcggcagcgcaaaagatg

SEQ ID NO: 132294 - DNA, 103 bp, Artificial Sequence
  Synthetic Polynucleotide
taatacgactcactatagggcagggccaggcagggaaggccaaagggccaaacagaggagatggcccatgggccttcccaacctggcggcagcgcaaaagatg

SEQ ID NO: 132295 - DNA, 103 bp, Artificial Sequence
  Synthetic Polynucleotide
taatacgactcactataggggaagaaagaccagggccaggcagggaaggcaacagaggagagccttcatggcctggcccaacctggcggcagcgcaaaagatg

SEQ ID NO: 132296 - DNA, 103 bp, Artificial Sequence
  Synthetic Polynucleotide
taatacgactcactataggggacagctatggaagaaagaccagggccaggaacagaggagacctggcatgggtctttctaacctggcggcagcgcaaaagatg

SEQ ID NO: 132297 - DNA, 103 bp, Artificial Sequence
  Synthetic Polynucleotide
taatacgactcactatagggggcagccctggacagctatggaagaaagacaacagaggagagtctttatgccatagctgaacctggcggcagcgcaaaagatg

SEQ ID NO: 132298 - DNA, 103 bp, Artificial Sequence
  Synthetic Polynucleotide
taatacgactcactataggggctcagggctggcagccctggacagctatgaacagaggagacatagcatgccagggctgaacctggcggcagcgcaaaagatg

SEQ ID NO: 132299 - DNA, 103 bp, Artificial Sequence
  Synthetic Polynucleotide
taatacgactcactatagggcgagctggttgctcagggctggcagccctgaacagaggagacagggcatgcagccctgaaacctggcggcagcgcaaaagatg

SEQ ID NO: 132300 - DNA, 103 bp, Artificial Sequence
  Synthetic Polynucleotide
taatacgactcactatagggcccaggatggcgagctggttgctcagggctaacagaggagaagccctatgcaaccagctaacctggcggcagcgcaaaagatg

SEQ ID NO: 132301 - DNA, 103 bp, Artificial Sequence
  Synthetic Polynucleotide
taatacgactcactataggggggcactcttcccaggatggcgagctggttaacagaggagaaaccagatggccatcctgaacctggcggcagcgcaaaagatg

SEQ ID NO: 132302 - DNA, 103 bp, Artificial Sequence
  Synthetic Polynucleotide
taatacgactcactatagggggacagggctgggcactcttcccaggatggaacagaggagaccatccatggaagagtgcaacctggcggcagcgcaaaagatg

SEQ ID NO: 132303 - DNA, 103 bp, Artificial Sequence
  Synthetic Polynucleotide
taatacgactcactatagggctcagctggccctcttggcccacgtcgatgaacagaggagacatcgaatggggccaagaaacctggcggcagcgcaaaagatg

SEQ ID NO: 132304 - DNA, 103 bp, Artificial Sequence
  Synthetic Polynucleotide
taatacgactcactatagggacaccggggaggacagggctgggcactcttaacagaggagaaagagtatgcagccctgtaacctggcggcagcgcaaaagatg

SEQ ID NO: 132305 - DNA, 103 bp, Artificial Sequence
  Synthetic Polynucleotide
taatacgactcactatagggaggagaggagacaccggggaggacagggctaacagaggagaagccctatgctccccggtaacctggcggcagcgcaaaagatg

SEQ ID NO: 132306 - DNA, 103 bp, Artificial Sequence
  Synthetic Polynucleotide
taatacgactcactatagggtggggtaagcaggagaggagacaccggggaaacagaggagatccccgatgtctcctctcaacctggcggcagcgcaaaagatg

SEQ ID NO: 132307 - DNA, 103 bp, Artificial Sequence
  Synthetic Polynucleotide
taatacgactcactatagggagggctgggatggggtaagcaggagaggagaacagaggagactcctcatgtgcttacccaacctggcggcagcgcaaaagatg

SEQ ID NO: 132308 - DNA, 103 bp, Artificial Sequence
  Synthetic Polynucleotide
taatacgactcactatagggagcggttcggagggctgggatggggtaagcaacagaggagagcttacatgatcccagccaacctggcggcagcgcaaaagatg

SEQ ID NO: 132309 - DNA, 103 bp, Artificial Sequence
  Synthetic Polynucleotide
taatacgactcactatagggtgcgaaggggagcggttcggagggctgggaaacagaggagatcccagatgtccgaaccgaacctggcggcagcgcaaaagatg

SEQ ID NO: 132310 - DNA, 103 bp, Artificial Sequence
  Synthetic Polynucleotide
taatacgactcactatagggcctgtggctctgcgaaggggagcggttcggaacagaggagaccgaacatgtccccttcgaacctggcggcagcgcaaaagatg

SEQ ID NO: 132311 - DNA, 103 bp, Artificial Sequence
  Synthetic Polynucleotide
taatacgactcactatagggcaggatgatgcctgtggctctgcgaaggggaacagaggagaccccttatgagagccacaaacctggcggcagcgcaaaagatg

SEQ ID NO: 132312 - DNA, 103 bp, Artificial Sequence
  Synthetic Polynucleotide
taatacgactcactatagggtccgggctggcaggatgatgcctgtggctcaacagaggagagagccaatggcatcatccaacctggcggcagcgcaaaagatg

SEQ ID NO: 132313 - DNA, 103 bp, Artificial Sequence
  Synthetic Polynucleotide
taatacgactcactatagggagcacattcctccgggctggcaggatgatgaacagaggagacatcatatggccagcccgaacctggcggcagcgcaaaagatg

SEQ ID NO: 132314 - DNA, 103 bp, Artificial Sequence
  Synthetic Polynucleotide
taatacgactcactatagggggccatctggctcagctggccctcttggccaacagaggagaggccaaatgggccagctgaacctggcggcagcgcaaaagatg

SEQ ID NO: 132315 - DNA, 103 bp, Artificial Sequence
  Synthetic Polynucleotide
taatacgactcactatagggtcgactgggcagcacattcctccgggctggaacagaggagaccagccatgaggaatgtgaacctggcggcagcgcaaaagatg

SEQ ID NO: 132316 - DNA, 103 bp, Artificial Sequence
  Synthetic Polynucleotide
taatacgactcactatagggaagatgcccctcgactgggcagcacattccaacagaggagaggaatgatgtgcccagtcaacctggcggcagcgcaaaagatg

SEQ ID NO: 132317 - DNA, 103 bp, Artificial Sequence
  Synthetic Polynucleotide
taatacgactcactatagggctccgggtggaagatgcccctcgactgggcaacagaggagagcccagatgaggggcatcaacctggcggcagcgcaaaagatg

SEQ ID NO: 132318 - DNA, 103 bp, Artificial Sequence
  Synthetic Polynucleotide
taatacgactcactatagggggggcgggccctccgggtggaagatgccccaacagaggagaggggcaatgtccacccggaacctggcggcagcgcaaaagatg

SEQ ID NO: 132319 - DNA, 103 bp, Artificial Sequence
  Synthetic Polynucleotide
taatacgactcactataggggcctctctagggggcgggccctccgggtggaacagaggagaccacccatggggcccgccaacctggcggcagcgcaaaagatg

SEQ ID NO: 132320 - DNA, 103 bp, Artificial Sequence
  Synthetic Polynucleotide
taatacgactcactatagggggggtcgctggcctctctagggggcgggccaacagaggagaggcccgatgcctagagagaacctggcggcagcgcaaaagatg

SEQ ID NO: 132321 - DNA, 103 bp, Artificial Sequence
  Synthetic Polynucleotide
taatacgactcactataggggacaggcacaggggtcgctggcctctctagaacagaggagactagagatgccagcgaccaacctggcggcagcgcaaaagatg

SEQ ID NO: 132322 - DNA, 103 bp, Artificial Sequence
  Synthetic Polynucleotide
taatacgactcactatagggtgctgggggcgacaggcacaggggtcgctgaacagaggagacagcgaatgctgtgcctgaacctggcggcagcgcaaaagatg

SEQ ID NO: 132323 - DNA, 103 bp, Artificial Sequence
  Synthetic Polynucleotide
taatacgactcactataggggcagccctgctgctgggggcgacaggcacaaacagaggagatgtgccatgcgcccccagaacctggcggcagcgcaaaagatg

SEQ ID NO: 132324 - DNA, 103 bp, Artificial Sequence
  Synthetic Polynucleotide
taatacgactcactataggggctgctcctggcagccctgctgctgggggcaacagaggagagcccccatgagcagggctaacctggcggcagcgcaaaagatg

SEQ ID NO: 132325 - DNA, 103 bp, Artificial Sequence
  Synthetic Polynucleotide
taatacgactcactatagggacagcggcctggccatctggctcagctggcaacagaggagagccagcatggccagatggaacctggcggcagcgcaaaagatg

SEQ ID NO: 132326 - DNA, 103 bp, Artificial Sequence
  Synthetic Polynucleotide
taatacgactcactataggggagcgatgtggctgctcctggcagccctgcaacagaggagagcagggatgccaggagcaaacctggcggcagcgcaaaagatg

SEQ ID NO: 132327 - DNA, 103 bp, Artificial Sequence
  Synthetic Polynucleotide
taatacgactcactatagggtgcaggaggggagcgatgtggctgctcctgaacagaggagacaggagatgccacatcgcaacctggcggcagcgcaaaagatg

SEQ ID NO: 132328 - DNA, 103 bp, Artificial Sequence
  Synthetic Polynucleotide
taatacgactcactatagggggaggaagactgcaggaggggagcgatgtgaacagaggagacacatcatgcccctcctgaacctggcggcagcgcaaaagatg

SEQ ID NO: 132329 - DNA, 103 bp, Artificial Sequence
  Synthetic Polynucleotide
taatacgactcactatagggggggtgttggggaggaagactgcaggagggaacagaggagaccctccatgagtcttcctaacctggcggcagcgcaaaagatg

SEQ ID NO: 132330 - DNA, 103 bp, Artificial Sequence
  Synthetic Polynucleotide
taatacgactcactataggggtaggaccagggggtgttggggaggaagacaacagaggagagtcttcatgcccaacaccaacctggcggcagcgcaaaagatg

SEQ ID NO: 132331 - DNA, 103 bp, Artificial Sequence
  Synthetic Polynucleotide
taatacgactcactatagggagccgaccctgtaggaccagggggtgttggaacagaggagaccaacaatgcctggtcctaacctggcggcagcgcaaaagatg

SEQ ID NO: 132332 - DNA, 103 bp, Artificial Sequence
  Synthetic Polynucleotide
taatacgactcactatagggccacgtaagcagccgaccctgtaggaccagaacagaggagactggtcatgcagggtcggaacctggcggcagcgcaaaagatg

SEQ ID NO: 132333 - DNA, 103 bp, Artificial Sequence
  Synthetic Polynucleotide
taatacgactcactataggggtgggaacagccacgtaagcagccgaccctaacagaggagaagggtcatgtgcttacgtaacctggcggcagcgcaaaagatg

SEQ ID NO: 132334 - DNA, 103 bp, Artificial Sequence
  Synthetic Polynucleotide
taatacgactcactatagggtgagttgggggtgggaacagccacgtaagcaacagaggagagcttacatggctgttcccaacctggcggcagcgcaaaagatg

SEQ ID NO: 132335 - DNA, 103 bp, Artificial Sequence
  Synthetic Polynucleotide
taatacgactcactatagggctggggaggatgagttgggggtgggaacagaacagaggagactgttcatgcccccaactaacctggcggcagcgcaaaagatg

SEQ ID NO: 132336 - DNA, 103 bp, Artificial Sequence
  Synthetic Polynucleotide
taatacgactcactatagggctgggggtggacagcggcctggccatctggaacagaggagaccagatatgcaggccgctaacctggcggcagcgcaaaagatg

SEQ ID NO: 132337 - DNA, 103 bp, Artificial Sequence
  Synthetic Polynucleotide
taatacgactcactatagggccagctggccctggggaggatgagttggggaacagaggagaccccaaatgatcctccccaacctggcggcagcgcaaaagatg

SEQ ID NO: 132338 - DNA, 103 bp, Artificial Sequence
  Synthetic Polynucleotide
taatacgactcactatagggcgctggcctcccagctggccctggggaggaaacagaggagatcctccatggggccagctaacctggcggcagcgcaaaagatg

SEQ ID NO: 132339 - DNA, 103 bp, Artificial Sequence
  Synthetic Polynucleotide
taatacgactcactataggggcatggctcccgctggcctcccagctggccaacagaggagaggccagatgggaggccagaacctggcggcagcgcaaaagatg

SEQ ID NO: 132340 - DNA, 103 bp, Artificial Sequence
  Synthetic Polynucleotide
taatacgactcactataggggagtggtagagcatggctcccgctggcctcaacagaggagagaggccatggggagccataacctggcggcagcgcaaaagatg

SEQ ID NO: 132341 - DNA, 103 bp, Artificial Sequence
  Synthetic Polynucleotide
taatacgactcactatagggagagacccaggagtggtagagcatggctccaacagaggagaggagccatgctctaccacaacctggcggcagcgcaaaagatg

SEQ ID NO: 132342 - DNA, 103 bp, Artificial Sequence
  Synthetic Polynucleotide
taatacgactcactatagggcagtgatttcagagacccaggagtggtagaaacagaggagatctaccatgcctgggtctaacctggcggcagcgcaaaagatg

SEQ ID NO: 132343 - DNA, 103 bp, Artificial Sequence
  Synthetic Polynucleotide
taatacgactcactataggggccccgatttcagtgatttcagagacccagaacagaggagactgggtatgtgaaatcacaacctggcggcagcgcaaaagatg

SEQ ID NO: 132344 - DNA, 103 bp, Artificial Sequence
  Synthetic Polynucleotide
taatacgactcactatagggcgccgccggcccggggtgcgggtactgcataacagaggagaatgcagatgccgcaccccaacctggcggcagcgcaaaagatg

SEQ ID NO: 132345 - DNA, 103 bp, Artificial Sequence
  Synthetic Polynucleotide
taatacgactcactataggggcggcccaggatgtcctcgatgtaaaagggaacagaggagaccctttatgatcgaggacaacctggcggcagcgcaaaagatg

SEQ ID NO: 132346 - DNA, 103 bp, Artificial Sequence
  Synthetic Polynucleotide
taatacgactcactatagggcggcgggcccgcggcccaggatgtcctcgaaacagaggagatcgaggatgtcctgggccaacctggcggcagcgcaaaagatg

SEQ ID NO: 132347 - DNA, 103 bp, Artificial Sequence
  Synthetic Polynucleotide
taatacgactcactatagggggcgtgggcgcggcgggcccgcggcccaggaacagaggagacctgggatgcgggcccgcaacctggcggcagcgcaaaagatg

SEQ ID NO: 132348 - DNA, 103 bp, Artificial Sequence
  Synthetic Polynucleotide
taatacgactcactatagggcgtgggggcgggcgtgggcgcggcgggcccaacagaggagagggcccatggcgcccacgaacctggcggcagcgcaaaagatg

SEQ ID NO: 132349 - DNA, 103 bp, Artificial Sequence
  Synthetic Polynucleotide
taatacgactcactataggggggacggcagcgtgggggcgggcgtgggcgaacagaggagacgcccaatgccgcccccaaacctggcggcagcgcaaaagatg

SEQ ID NO: 132350 - DNA, 103 bp, Artificial Sequence
  Synthetic Polynucleotide
taatacgactcactataggggaggagttgggggacggcagcgtgggggcgaacagaggagacgccccatggctgccgtcaacctggcggcagcgcaaaagatg

SEQ ID NO: 132351 - DNA, 103 bp, Artificial Sequence
  Synthetic Polynucleotide
taatacgactcactataggggctggtgaaggaggagttgggggacggcagaacagaggagactgccgatgcccaactccaacctggcggcagcgcaaaagatg

SEQ ID NO: 132352 - DNA, 103 bp, Artificial Sequence
  Synthetic Polynucleotide
taatacgactcactataggggggacacgaggctggtgaaggaggagttggaacagaggagaccaactatgccttcaccaaacctggcggcagcgcaaaagatg

SEQ ID NO: 132353 - DNA, 103 bp, Artificial Sequence
  Synthetic Polynucleotide
taatacgactcactataggggtccggtagggggacacgaggctggtgaagaacagaggagacttcacatgcctcgtgtcaacctggcggcagcgcaaaagatg

SEQ ID NO: 132354 - DNA, 103 bp, Artificial Sequence
  Synthetic Polynucleotide
taatacgactcactataggggtacaccggggtccggtagggggacacgagaacagaggagactcgtgatgccctaccggaacctggcggcagcgcaaaagatg

SEQ ID NO: 132355 - DNA, 103 bp, Artificial Sequence
  Synthetic Polynucleotide
taatacgactcactatagggccacggcgcccgccgccggcccggggtgcgaacagaggagacgcaccatgggccggcggaacctggcggcagcgcaaaagatg

SEQ ID NO: 132356 - DNA, 103 bp, Artificial Sequence
  Synthetic Polynucleotide
taatacgactcactataggggcgtgggctcgtacaccggggtccggtaggaacagaggagacctaccatgccccggtgtaacctggcggcagcgcaaaagatg

SEQ ID NO: 132357 - DNA, 103 bp, Artificial Sequence
  Synthetic Polynucleotide
taatacgactcactatagggggatggatcggcgtgggctcgtacaccgggaacagaggagacccggtatgcgagcccacaacctggcggcagcgcaaaagatg

SEQ ID NO: 132358 - DNA, 103 bp, Artificial Sequence
  Synthetic Polynucleotide
taatacgactcactatagggcgagaaggctggatggatcggcgtgggctcaacagaggagagagcccatgccgatccataacctggcggcagcgcaaaagatg

SEQ ID NO: 132359 - DNA, 103 bp, Artificial Sequence
  Synthetic Polynucleotide
taatacgactcactatagggcggagtggtgcgagaaggctggatggatcgaacagaggagacgatccatgcagccttctaacctggcggcagcgcaaaagatg

SEQ ID NO: 132360 - DNA, 103 bp, Artificial Sequence
  Synthetic Polynucleotide
taatacgactcactatagggagcgcggcggcggagtggtgcgagaaggctaacagaggagaagccttatggcaccactcaacctggcggcagcgcaaaagatg

SEQ ID NO: 132361 - DNA, 103 bp, Artificial Sequence
  Synthetic Polynucleotide
taatacgactcactatagggggcagcggccagcgcggcggcggagtggtgaacagaggagacaccacatggccgccgcgaacctggcggcagcgcaaaagatg

SEQ ID NO: 132362 - DNA, 103 bp, Artificial Sequence
  Synthetic Polynucleotide
taatacgactcactatagggcgggtccgtaggcagcggccagcgcggcggaacagaggagaccgccgatgtggccgctgaacctggcggcagcgcaaaagatg

SEQ ID NO: 132363 - DNA, 103 bp, Artificial Sequence
  Synthetic Polynucleotide
taatacgactcactatagggccgaagccgccgggtccgtaggcagcggccaacagaggagaggccgcatgctacggaccaacctggcggcagcgcaaaagatg

SEQ ID NO: 132364 - DNA, 103 bp, Artificial Sequence
  Synthetic Polynucleotide
taatacgactcactatagggcagagggcccccgaagccgccgggtccgtaaacagaggagatacggaatgggcggcttcaacctggcggcagcgcaaaagatg

SEQ ID NO: 132365 - DNA, 103 bp, Artificial Sequence
  Synthetic Polynucleotide
taatacgactcactatagggggaaggggtacagagggcccccgaagccgcaacagaggagagcggctatgggggccctcaacctggcggcagcgcaaaagatg

SEQ ID NO: 132366 - DNA, 103 bp, Artificial Sequence
  Synthetic Polynucleotide
taatacgactcactatagggagcggcacccccacggcgcccgccgccggcaacagaggagagccggcatggggcgccgtaacctggcggcagcgcaaaagatg

SEQ ID NO: 132367 - DNA, 103 bp, Artificial Sequence
  Synthetic Polynucleotide
taatacgactcactatagggaccgtccgcgggaaggggtacagagggcccaacagaggagagggcccatggtaccccttaacctggcggcagcgcaaaagatg

SEQ ID NO: 132368 - DNA, 103 bp, Artificial Sequence
  Synthetic Polynucleotide
taatacgactcactataggggtagtcgttcaccgtccgcgggaaggggtaaacagaggagataccccatgccgcggacgaacctggcggcagcgcaaaagatg

SEQ ID NO: 132369 - DNA, 103 bp, Artificial Sequence
  Synthetic Polynucleotide
taatacgactcactataggggggcgtgcgtgtagtcgttcaccgtccgcgaacagaggagacgcggaatgtgaacgactaacctggcggcagcgcaaaagatg

SEQ ID NO: 132370 - DNA, 103 bp, Artificial Sequence
  Synthetic Polynucleotide
taatacgactcactatagggtggcggagcagggcgtgcgtgtagtcgttcaacagaggagagaacgaatgcacgcacgcaacctggcggcagcgcaaaagatg

SEQ ID NO: 132371 - DNA, 103 bp, Artificial Sequence
  Synthetic Polynucleotide
taatacgactcactatagggcagggggtcgtggcggagcagggcgtgcgtaacagaggagaacgcacatgctgctccgcaacctggcggcagcgcaaaagatg

SEQ ID NO: 132372 - DNA, 103 bp, Artificial Sequence
  Synthetic Polynucleotide
taatacgactcactataggggaggtttgcccagggggtcgtggcggagcaaacagaggagatgctccatgacgacccccaacctggcggcagcgcaaaagatg

SEQ ID NO: 132373 - DNA, 103 bp, Artificial Sequence
  Synthetic Polynucleotide
taatacgactcactatagggctccagagtagaggtttgcccagggggtcgaacagaggagacgacccatggggcaaaccaacctggcggcagcgcaaaagatg

SEQ ID NO: 132374 - DNA, 103 bp, Artificial Sequence
  Synthetic Polynucleotide
taatacgactcactatagggcaagaaggggctccagagtagaggtttgccaacagaggagaggcaaaatgctactctggaacctggcggcagcgcaaaagatg

SEQ ID NO: 132375 - DNA, 103 bp, Artificial Sequence
  Synthetic Polynucleotide
taatacgactcactataggggaggcctctgcaagaaggggctccagagtaaacagaggagatactctatggccccttctaacctggcggcagcgcaaaagatg

SEQ ID NO: 132376 - DNA, 103 bp, Artificial Sequence
  Synthetic Polynucleotide
taatacgactcactatagggcttttatgcagaggcctctgcaagaaggggaacagaggagaccccttatggcagaggccaacctggcggcagcgcaaaagatg

SEQ ID NO: 132377 - DNA, 103 bp, Artificial Sequence
  Synthetic Polynucleotide
taatacgactcactataggggggcgcgtacagcggcacccccacggcgccaacagaggagaggcgccatgggggtgccgaacctggcggcagcgcaaaagatg

SEQ ID NO: 132378 - DNA, 103 bp, Artificial Sequence
  Synthetic Polynucleotide
taatacgactcactataggggccgcctttccttttatgcagaggcctctgaacagaggagacagaggatgctgcataaaaacctggcggcagcgcaaaagatg

SEQ ID NO: 132379 - DNA, 103 bp, Artificial Sequence
  Synthetic Polynucleotide
taatacgactcactatagggatctcacctggccgcctttccttttatgcaaacagaggagatgcataatgggaaaggcgaacctggcggcagcgcaaaagatg

SEQ ID NO: 132380 - DNA, 103 bp, Artificial Sequence
  Synthetic Polynucleotide
taatacgactcactatagggtcgttggagaatctcacctggccgcctttcaacagaggagagaaaggatgccaggtgagaacctggcggcagcgcaaaagatg

SEQ ID NO: 132381 - DNA, 103 bp, Artificial Sequence
  Synthetic Polynucleotide
taatacgactcactataggggatggtctggtcgttggagaatctcacctgaacagaggagacaggtgatgttctccaacaacctggcggcagcgcaaaagatg

SEQ ID NO: 132382 - DNA, 103 bp, Artificial Sequence
  Synthetic Polynucleotide
taatacgactcactatagggtctccagctcgatggtctggtcgttggagaaacagaggagatctccaatgaccagaccaaacctggcggcagcgcaaaagatg

SEQ ID NO: 132383 - DNA, 103 bp, Artificial Sequence
  Synthetic Polynucleotide
taatacgactcactatagggtcgaatttcttctccagctcgatggtctggaacagaggagaccagacatgcgagctggaaacctggcggcagcgcaaaagatg

SEQ ID NO: 132384 - DNA, 103 bp, Artificial Sequence
  Synthetic Polynucleotide
taatacgactcactatagggtttctgcgtctcgaatttcttctccagctcaacagaggagagagctgatgaagaaattcaacctggcggcagcgcaaaagatg

SEQ ID NO: 132385 - DNA, 103 bp, Artificial Sequence
  Synthetic Polynucleotide
taatacgactcactataggggagagagatatttctgcgtctcgaatttctaacagaggagaagaaatatgagacgcagaaacctggcggcagcgcaaaagatg

SEQ ID NO: 132386 - DNA, 103 bp, Artificial Sequence
  Synthetic Polynucleotide
taatacgactcactatagggctctcgggcggagagagatatttctgcgtcaacagaggagagacgcaatgatatctctcaacctggcggcagcgcaaaagatg

SEQ ID NO: 132387 - DNA, 103 bp, Artificial Sequence
  Synthetic Polynucleotide
taatacgactcactatagggcagacgcttcctctcgggcggagagagataaacagaggagatatctcatgccgcccgagaacctggcggcagcgcaaaagatg

SEQ ID NO: 132388 - DNA, 103 bp, Artificial Sequence
  Synthetic Polynucleotide
taatacgactcactataggggcagcggcgtgggcgcgtacagcggcacccaacagaggagagggtgcatgtgtacgcgcaacctggcggcagcgcaaaagatg

SEQ ID NO: 132389 - DNA, 103 bp, Artificial Sequence
  Synthetic Polynucleotide
taatacgactcactataggggcatcttggccagacgcttcctctcgggcgaacagaggagacgcccgatgggaagcgtcaacctggcggcagcgcaaaagatg

SEQ ID NO: 132390 - DNA, 103 bp, Artificial Sequence
  Synthetic Polynucleotide
taatacgactcactatagggctgagctgcagcatcttggccagacgcttcaacagaggagagaagcgatgggccaagataacctggcggcagcgcaaaagatg

SEQ ID NO: 132391 - DNA, 103 bp, Artificial Sequence
  Synthetic Polynucleotide
taatacgactcactatagggctgtctctcgctgagctgcagcatcttggcaacagaggagagccaagatgctgcagctcaacctggcggcagcgcaaaagatg

SEQ ID NO: 132392 - DNA, 103 bp, Artificial Sequence
  Synthetic Polynucleotide
taatacgactcactatagggaggttttgacctgtctctcgctgagctgcaaacagaggagatgcagcatggcgagagacaacctggcggcagcgcaaaagatg

SEQ ID NO: 132393 - DNA, 103 bp, Artificial Sequence
  Synthetic Polynucleotide
taatacgactcactatagggttctgaaaccaggttttgacctgtctctcgaacagaggagacgagagatgggtcaaaacaacctggcggcagcgcaaaagatg

SEQ ID NO: 132394 - DNA, 103 bp, Artificial Sequence
  Synthetic Polynucleotide
taatacgactcactatagggagcgcgtcgattctgaaaccaggttttgacaacagaggagagtcaaaatgtggtttcagaacctggcggcagcgcaaaagatg

SEQ ID NO: 132395 - DNA, 103 bp, Artificial Sequence
  Synthetic Polynucleotide
taatacgactcactatagggtcctccatttagcgcgtcgattctgaaaccaacagaggagaggtttcatgatcgacgcgaacctggcggcagcgcaaaagatg

SEQ ID NO: 132396 - DNA, 103 bp, Artificial Sequence
  Synthetic Polynucleotide
taatacgactcactatagggtgttttagtctcctccatttagcgcgtcgaaacagaggagatcgacgatgtaaatggagaacctggcggcagcgcaaaagatg

SEQ ID NO: 132397 - DNA, 103 bp, Artificial Sequence
  Synthetic Polynucleotide
taatacgactcactatagggagggttctcctgttttagtctcctccatttaacagaggagaaaatggatgagactaaaaaacctggcggcagcgcaaaagatg

SEQ ID NO: 132398 - DNA, 103 bp, Artificial Sequence
  Synthetic Polynucleotide
taatacgactcactatagggtattgctttgagggttctcctgttttagtcaacagaggagagactaaatgaggagaaccaacctggcggcagcgcaaaagatg

SEQ ID NO: 132399 - DNA, 103 bp, Artificial Sequence
  Synthetic Polynucleotide
taatacgactcactataggggcgggttgcagcagcggcgtgggcgcgtacaacagaggagagtacgcatgcacgccgctaacctggcggcagcgcaaaagatg

SEQ ID NO: 132400 - DNA, 103 bp, Artificial Sequence
  Synthetic Polynucleotide
taatacgactcactatagggtcttcttttttattgctttgagggttctccaacagaggagaggagaaatgtcaaagcaaaacctggcggcagcgcaaaagatg

SEQ ID NO: 132401 - DNA, 103 bp, Artificial Sequence
  Synthetic Polynucleotide
taatacgactcactatagggactttccagttcttcttttttattgctttgaacagaggagacaaagcatgaaaaaagaaaacctggcggcagcgcaaaagatg

SEQ ID NO: 132402 - DNA, 103 bp, Artificial Sequence
  Synthetic Polynucleotide
taatacgactcactatagggaactgtccaaactttccagttcttctttttaacagaggagaaaaaagatgaactggaaaaacctggcggcagcgcaaaagatg

SEQ ID NO: 132403 - DNA, 103 bp, Artificial Sequence
  Synthetic Polynucleotide
taatacgactcactatagggtgatcacaggaactgtccaaactttccagtaacagaggagaactggaatgtttggacagaacctggcggcagcgcaaaagatg

SEQ ID NO: 132404 - DNA, 103 bp, Artificial Sequence
  Synthetic Polynucleotide
taatacgactcactatagggatcttgcctctgatcacaggaactgtccaaaacagaggagattggacatgtcctgtgataacctggcggcagcgcaaaagatg

SEQ ID NO: 132405 - DNA, 103 bp, Artificial Sequence
  Synthetic Polynucleotide
taatacgactcactatagggcactgggcaaatcttgcctctgatcacaggaacagaggagacctgtgatgagaggcaagaacctggcggcagcgcaaaagatg

SEQ ID NO: 132406 - DNA, 103 bp, Artificial Sequence
  Synthetic Polynucleotide
taatacgactcactatagggttattctgttcactgggcaaatcttgcctcaacagaggagagaggcaatgtttgcccagaacctggcggcagcgcaaaagatg

SEQ ID NO: 132407 - DNA, 103 bp, Artificial Sequence
  Synthetic Polynucleotide
taatacgactcactatagggagaagcacctttattctgttcactgggcaaaacagaggagattgcccatggaacagaataacctggcggcagcgcaaaagatg

SEQ ID NO: 132408 - DNA, 103 bp, Artificial Sequence
  Synthetic Polynucleotide
taatacgactcactatagggagctatccaaagaagcacctttattctgttaacagaggagaaacagaatgaaggtgcttaacctggcggcagcgcaaaagatg

SEQ ID NO: 132409 - DNA, 103 bp, Artificial Sequence
  Synthetic Polynucleotide
taatacgactcactataggggaacattgagagctatccaaagaagcacctaacagaggagaaggtgcatgtttggatagaacctggcggcagcgcaaaagatg

SEQ ID NO: 132410 - DNA, 103 bp, Artificial Sequence
  Synthetic Polynucleotide
taatacgactcactatagggcgtcgggtgtgcgggttgcagcagcggcgtaacagaggagaacgccgatgctgcaacccaacctggcggcagcgcaaaagatg

SEQ ID NO: 132411 - DNA, 103 bp, Artificial Sequence
  Synthetic Polynucleotide
taatacgactcactatagggaggggagggcgaacattgagagctatccaaaacagaggagattggatatgtctcaatgtaacctggcggcagcgcaaaagatg

SEQ ID NO: 132412 - DNA, 103 bp, Artificial Sequence
  Synthetic Polynucleotide
taatacgactcactatagggcctgggaggcaggggagggcgaacattgagaacagaggagactcaatatgcgccctcccaacctggcggcagcgcaaaagatg

SEQ ID NO: 132413 - DNA, 103 bp, Artificial Sequence
  Synthetic Polynucleotide
taatacgactcactatagggtcaaggtcttcctgggaggcaggggagggcaacagaggagagccctcatgtgcctcccaaacctggcggcagcgcaaaagatg

SEQ ID NO: 132414 - DNA, 103 bp, Artificial Sequence
  Synthetic Polynucleotide
taatacgactcactatagggaatctctgattcaaggtcttcctgggaggcaacagaggagagcctccatggaagaccttaacctggcggcagcgcaaaagatg

SEQ ID NO: 132415 - DNA, 103 bp, Artificial Sequence
  Synthetic Polynucleotide
taatacgactcactatagggaatcctctgaaatctctgattcaaggtcttaacagaggagaaagaccatgaatcagagaaacctggcggcagcgcaaaagatg

SEQ ID NO: 132416 - DNA, 103 bp, Artificial Sequence
  Synthetic Polynucleotide
taatacgactcactatagggtcctgatcagaatcctctgaaatctctgataacagaggagaatcagaatgttcagaggaaacctggcggcagcgcaaaagatg

SEQ ID NO: 132417 - DNA, 103 bp, Artificial Sequence
  Synthetic Polynucleotide
taatacgactcactatagggaatgtccacttcctgatcagaatcctctgaaacagaggagatcagagatgtctgatcagaacctggcggcagcgcaaaagatg

SEQ ID NO: 132418 - DNA, 103 bp, Artificial Sequence
  Synthetic Polynucleotide
taatacgactcactatagggtatcgccctcaatgtccacttcctgatcagaacagaggagactgatcatgaagtggacaaacctggcggcagcgcaaaagatg

SEQ ID NO: 132419 - DNA, 103 bp, Artificial Sequence
  Synthetic Polynucleotide
taatacgactcactatagggaaatagcttttatcgccctcaatgtccactaacagaggagaagtggaatgtgagggcgaaacctggcggcagcgcaaaagatg

SEQ ID NO: 132420 - DNA, 103 bp, Artificial Sequence
  Synthetic Polynucleotide
taatacgactcactatagggtccagcattaaaatagcttttatcgccctcaacagaggagagagggcatgaaaagctataacctggcggcagcgcaaaagatg

SEQ ID NO: 132421 - DNA, 103 bp, Artificial Sequence
  Synthetic Polynucleotide
taatacgactcactatagggtgtaaaagggcgtcgggtgtgcgggttgcaaacagaggagatgcaacatgcacacccgaaacctggcggcagcgcaaaagatg

SEQ ID NO: 132422 - DNA, 103 bp, Artificial Sequence
  Synthetic Polynucleotide
taatacgactcactatagggatgtcctcgatgtaaaagggcgtcgggtgtaacagaggagaacacccatggcccttttaaacctggcggcagcgcaaaagatg

SEQ ID NO: 132423 - DNA, 103 bp, Artificial Sequence
  Synthetic Polynucleotide
taatacgactcactatagggccaccggagtgccaagggcccagacaccataacagaggagaatggtgatggggcccttgaacctggcggcagcgcaaaagatg

SEQ ID NO: 132424 - DNA, 103 bp, Artificial Sequence
  Synthetic Polynucleotide
taatacgactcactatagggcctctgctggttcagctgcagcaggagctgaacagaggagacagctcatgctgcagctgaacctggcggcagcgcaaaagatg

SEQ ID NO: 132425 - DNA, 103 bp, Artificial Sequence
  Synthetic Polynucleotide
taatacgactcactataggggccccactccttcttccgagtggagtgccgaacagaggagacggcacatgactcggaagaacctggcggcagcgcaaaagatg

SEQ ID NO: 132426 - DNA, 103 bp, Artificial Sequence
  Synthetic Polynucleotide
taatacgactcactataggggctccttcttgccccactccttcttccgagaacagaggagactcggaatgaggagtgggaacctggcggcagcgcaaaagatg

SEQ ID NO: 132427 - DNA, 103 bp, Artificial Sequence
  Synthetic Polynucleotide
taatacgactcactatagggccagccacaggctccttcttgccccactccaacagaggagaggagtgatgcaagaaggaaacctggcggcagcgcaaaagatg

SEQ ID NO: 132428 - DNA, 103 bp, Artificial Sequence
  Synthetic Polynucleotide
taatacgactcactatagggaaagggggagccagccacaggctccttcttaacagaggagaaagaagatgcctgtggctaacctggcggcagcgcaaaagatg

SEQ ID NO: 132429 - DNA, 103 bp, Artificial Sequence
  Synthetic Polynucleotide
taatacgactcactatagggctctccgctcaaagggggagccagccacagaacagaggagactgtggatggctccccctaacctggcggcagcgcaaaagatg

SEQ ID NO: 132430 - DNA, 103 bp, Artificial Sequence
  Synthetic Polynucleotide
taatacgactcactatagggggccctgcttctctccgctcaaagggggagaacagaggagactccccatgtgagcggagaacctggcggcagcgcaaaagatg

SEQ ID NO: 132431 - DNA, 103 bp, Artificial Sequence
  Synthetic Polynucleotide
taatacgactcactataggggggacccttgggccctgcttctctccgctcaacagaggagagagcggatggaagcagggaacctggcggcagcgcaaaagatg

SEQ ID NO: 132432 - DNA, 103 bp, Artificial Sequence
  Synthetic Polynucleotide
taatacgactcactatagggctcccgggcagggacccttgggccctgcttaacagaggagaaagcagatgccaagggtcaacctggcggcagcgcaaaagatg

SEQ ID NO: 132433 - DNA, 103 bp, Artificial Sequence
  Synthetic Polynucleotide
taatacgactcactatagggtcaccctcctctcccgggcagggacccttgaacagaggagacaagggatgctgcccgggaacctggcggcagcgcaaaagatg

SEQ ID NO: 132434 - DNA, 103 bp, Artificial Sequence
  Synthetic Polynucleotide
taatacgactcactatagggcccgaccccctcaccctcctctcccgggcaaacagaggagatgcccgatggaggagggtaacctggcggcagcgcaaaagatg

SEQ ID NO: 132435 - DNA, 103 bp, Artificial Sequence
  Synthetic Polynucleotide
taatacgactcactatagggagcccttggtcctctgctggttcagctgcaaacagaggagatgcagcatgaccagcagaaacctggcggcagcgcaaaagatg

SEQ ID NO: 132436 - DNA, 103 bp, Artificial Sequence
  Synthetic Polynucleotide
taatacgactcactataggggaaccctgtccccgaccccctcaccctcctaacagaggagaaggaggatgagggggtcgaacctggcggcagcgcaaaagatg

SEQ ID NO: 132437 - DNA, 103 bp, Artificial Sequence
  Synthetic Polynucleotide
taatacgactcactatagggatgccattgggaaccctgtccccgacccccaacagaggagagggggtatgggacagggtaacctggcggcagcgcaaaagatg

SEQ ID NO: 132438 - DNA, 103 bp, Artificial Sequence
  Synthetic Polynucleotide
taatacgactcactatagggactagccaggatgccattgggaaccctgtcaacagaggagagacaggatgcccaatggcaacctggcggcagcgcaaaagatg

SEQ ID NO: 132439 - DNA, 103 bp, Artificial Sequence
  Synthetic Polynucleotide
taatacgactcactatagggggccagccccactagccaggatgccattggaacagaggagaccaatgatgtcctggctaaacctggcggcagcgcaaaagatg

SEQ ID NO: 132440 - DNA, 103 bp, Artificial Sequence
  Synthetic Polynucleotide
taatacgactcactatagggggcccgctagggccagccccactagccaggaacagaggagacctggcatgtggggctggaacctggcggcagcgcaaaagatg

SEQ ID NO: 132441 - DNA, 103 bp, Artificial Sequence
  Synthetic Polynucleotide
taatacgactcactatagggctccccatagggcccgctagggccagccccaacagaggagaggggctatgcctagcgggaacctggcggcagcgcaaaagatg

SEQ ID NO: 132442 - DNA, 103 bp, Artificial Sequence
  Synthetic Polynucleotide
taatacgactcactatagggggtaggggggctccccatagggcccgctagaacagaggagactagcgatgcctatggggaacctggcggcagcgcaaaagatg

SEQ ID NO: 132443 - DNA, 103 bp, Artificial Sequence
  Synthetic Polynucleotide
taatacgactcactatagggtccttgcaggggtaggggggctccccatagaacagaggagactatggatggcccccctaaacctggcggcagcgcaaaagatg

SEQ ID NO: 132444 - DNA, 103 bp, Artificial Sequence
  Synthetic Polynucleotide
taatacgactcactatagggctcctcctcctccttgcaggggtaggggggaacagaggagaccccccatgccctgcaagaacctggcggcagcgcaaaagatg

SEQ ID NO: 132445 - DNA, 103 bp, Artificial Sequence
  Synthetic Polynucleotide
taatacgactcactatagggccttgccgttctcctcctcctccttgcaggaacagaggagacctgcaatgaggaggaggaacctggcggcagcgcaaaagatg

SEQ ID NO: 132446 - DNA, 103 bp, Artificial Sequence
  Synthetic Polynucleotide
taatacgactcactatagggtcacacaggaagcccttggtcctctgctggaacagaggagaccagcaatggaccaagggaacctggcggcagcgcaaaagatg

SEQ ID NO: 132447 - DNA, 103 bp, Artificial Sequence
  Synthetic Polynucleotide
taatacgactcactatagggtcacttgcatccttgccgttctcctcctccaacagaggagaggaggaatggaacggcaaaacctggcggcagcgcaaaagatg

SEQ ID NO: 132448 - DNA, 103 bp, Artificial Sequence
  Synthetic Polynucleotide
taatacgactcactatagggcgcactgtcttcacttgcatccttgccgttaacagaggagaaacggcatggatgcaagtaacctggcggcagcgcaaaagatg

SEQ ID NO: 132449 - DNA, 103 bp, Artificial Sequence
  Synthetic Polynucleotide
taatacgactcactatagggtcccgctctgcgcactgtcttcacttgcataacagaggagaatgcaaatgaagacagtgaacctggcggcagcgcaaaagatg

SEQ ID NO: 132450 - DNA, 103 bp, Artificial Sequence
  Synthetic Polynucleotide
taatacgactcactatagggcccccctcgctcccgctctgcgcactgtctaacagaggagaagacagatggcagagcggaacctggcggcagcgcaaaagatg

SEQ ID NO: 132451 - DNA, 103 bp, Artificial Sequence
  Synthetic Polynucleotide
taatacgactcactatagggatggccgctgcccccctcgctcccgctctgaacagaggagacagagcatgagcgaggggaacctggcggcagcgcaaaagatg

SEQ ID NO: 132452 - DNA, 103 bp, Artificial Sequence
  Synthetic Polynucleotide
taatacgactcactataggggggcgctggcatggccgctgcccccctcgcaacagaggagagcgaggatggcagcggccaacctggcggcagcgcaaaagatg

SEQ ID NO: 132453 - DNA, 103 bp, Artificial Sequence
  Synthetic Polynucleotide
taatacgactcactatagggtacatgtagtgggcgctggcatggccgctgaacagaggagacagcggatgtgccagcgcaacctggcggcagcgcaaaagatg

SEQ ID NO: 132454 - DNA, 103 bp, Artificial Sequence
  Synthetic Polynucleotide
taatacgactcactatagggctcctgccggtacatgtagtgggcgctggcaacagaggagagccagcatgcactacatgaacctggcggcagcgcaaaagatg

SEQ ID NO: 132455 - DNA, 103 bp, Artificial Sequence
  Synthetic Polynucleotide
taatacgactcactatagggtctcgtagccctcctgccggtacatgtagtaacagaggagaactacaatgaccggcaggaacctggcggcagcgcaaaagatg

SEQ ID NO: 132456 - DNA, 103 bp, Artificial Sequence
  Synthetic Polynucleotide
taatacgactcactatagggtaggacaccgtctcgtagccctcctgccggaacagaggagaccggcaatggggctacgaaacctggcggcagcgcaaaagatg

SEQ ID NO: 132457 - DNA, 103 bp, Artificial Sequence
  Synthetic Polynucleotide
taatacgactcactataggggatgatgacgtcacacaggaagcccttggtaacagaggagaaccaagatgttcctgtgtaacctggcggcagcgcaaaagatg

SEQ ID NO: 132458 - DNA, 103 bp, Artificial Sequence
  Synthetic Polynucleotide
taatacgactcactataggggttgtccccgtaggacaccgtctcgtagccaacagaggagaggctacatgacggtgtccaacctggcggcagcgcaaaagatg

SEQ ID NO: 132459 - DNA, 103 bp, Artificial Sequence
  Synthetic Polynucleotide
taatacgactcactatagggacacatacaagttgtccccgtaggacaccgaacagaggagacggtgtatgacggggacaaacctggcggcagcgcaaaagatg

SEQ ID NO: 132460 - DNA, 103 bp, Artificial Sequence
  Synthetic Polynucleotide
taatacgactcactatagggcagggaatgcacacatacaagttgtccccgaacagaggagacggggaatgcttgtatgtaacctggcggcagcgcaaaagatg

SEQ ID NO: 132461 - DNA, 103 bp, Artificial Sequence
  Synthetic Polynucleotide
taatacgactcactataggggcccttggcgcagggaatgcacacatacaaaacagaggagattgtatatgtgcattcccaacctggcggcagcgcaaaagatg

SEQ ID NO: 132462 - DNA, 103 bp, Artificial Sequence
  Synthetic Polynucleotide
taatacgactcactatagggagctggggaagcccttggcgcagggaatgcaacagaggagagcattcatggcgccaaggaacctggcggcagcgcaaaagatg

SEQ ID NO: 132463 - DNA, 103 bp, Artificial Sequence
  Synthetic Polynucleotide
taatacgactcactatagggagctgctcagagctggggaagcccttggcgaacagaggagacgccaaatgcttccccagaacctggcggcagcgcaaaagatg

SEQ ID NO: 132464 - DNA, 103 bp, Artificial Sequence
  Synthetic Polynucleotide
taatacgactcactataggggtgcgcattgagctgctcagagctggggaaaacagaggagattccccatgtctgagcagaacctggcggcagcgcaaaagatg

SEQ ID NO: 132465 - DNA, 103 bp, Artificial Sequence
  Synthetic Polynucleotide
taatacgactcactataggggagtctccacgtgcgcattgagctgctcagaacagaggagactgagcatgtcaatgcgcaacctggcggcagcgcaaaagatg

SEQ ID NO: 132466 - DNA, 103 bp, Artificial Sequence
  Synthetic Polynucleotide
taatacgactcactatagggtcctccgtgtgagtctccacgtgcgcattgaacagaggagacaatgcatgcgtggagacaacctggcggcagcgcaaaagatg

SEQ ID NO: 132467 - DNA, 103 bp, Artificial Sequence
  Synthetic Polynucleotide
taatacgactcactataggggaacagctcttcctccgtgtgagtctccacaacagaggagagtggagatgcacacggagaacctggcggcagcgcaaaagatg

SEQ ID NO: 132468 - DNA, 103 bp, Artificial Sequence
  Synthetic Polynucleotide
taatacgactcactatagggtctccaccatgatgatgacgtcacacaggaaacagaggagatcctgtatgacgtcatcaaacctggcggcagcgcaaaagatg

SEQ ID NO: 132469 - DNA, 103 bp, Artificial Sequence
  Synthetic Polynucleotide
taatacgactcactatagggcttccttgatgaacagctcttcctccgtgtaacagaggagaacacggatgaagagctgtaacctggcggcagcgcaaaagatg

SEQ ID NO: 132470 - DNA, 103 bp, Artificial Sequence
  Synthetic Polynucleotide
taatacgactcactatagggtaggccccctcttccttgatgaacagctctaacagaggagaagagctatgcatcaaggaaacctggcggcagcgcaaaagatg

SEQ ID NO: 132471 - DNA, 103 bp, Artificial Sequence
  Synthetic Polynucleotide
taatacgactcactataggggcctgtctcgtaggccccctcttccttgataacagaggagaatcaagatggagggggccaacctggcggcagcgcaaaagatg

SEQ ID NO: 132472 - DNA, 103 bp, Artificial Sequence
  Synthetic Polynucleotide
taatacgactcactatagggcacccccactgcctgtctcgtaggccccctaacagaggagaagggggatgacgagacagaacctggcggcagcgcaaaagatg

SEQ ID NO: 132473 - DNA, 103 bp, Artificial Sequence
  Synthetic Polynucleotide
taatacgactcactatagggtcctcctcggcacccccactgcctgtctcgaacagaggagacgagacatgcagtgggggaacctggcggcagcgcaaaagatg

SEQ ID NO: 132474 - DNA, 103 bp, Artificial Sequence
  Synthetic Polynucleotide
taatacgactcactataggggtcctcggcctcctcctcggcacccccactaacagaggagaagtgggatggccgaggagaacctggcggcagcgcaaaagatg

SEQ ID NO: 132475 - DNA, 103 bp, Artificial Sequence
  Synthetic Polynucleotide
taatacgactcactataggggtgctgacaggtcctcggcctcctcctcggaacagaggagaccgaggatgaggccgaggaacctggcggcagcgcaaaagatg

SEQ ID NO: 132476 - DNA, 103 bp, Artificial Sequence
  Synthetic Polynucleotide
taatacgactcactataggggccgcactgggtgctgacaggtcctcggccaacagaggagaggccgaatgcctgtcagcaacctggcggcagcgcaaaagatg

SEQ ID NO: 132477 - DNA, 103 bp, Artificial Sequence
  Synthetic Polynucleotide
taatacgactcactatagggagccgtgtaggccgcactgggtgctgacagaacagaggagactgtcaatgcccagtgcgaacctggcggcagcgcaaaagatg

SEQ ID NO: 132478 - DNA, 103 bp, Artificial Sequence
  Synthetic Polynucleotide
taatacgactcactataggggccggggctcagccgtgtaggccgcactggaacagaggagaccagtgatgcctacacggaacctggcggcagcgcaaaagatg

SEQ ID NO: 132479 - DNA, 103 bp, Artificial Sequence
  Synthetic Polynucleotide
taatacgactcactatagggaagatggagttctccaccatgatgatgacgaacagaggagacgtcatatgcatggtggaaacctggcggcagcgcaaaagatg

SEQ ID NO: 132480 - DNA, 103 bp, Artificial Sequence
  Synthetic Polynucleotide
taatacgactcactatagggcacttgaagggccggggctcagccgtgtagaacagaggagactacacatgtgagccccgaacctggcggcagcgcaaaagatg

SEQ ID NO: 132481 - DNA, 103 bp, Artificial Sequence
  Synthetic Polynucleotide
taatacgactcactataggggcagaccgaacacttgaagggccggggctcaacagaggagagagcccatgcccttcaagaacctggcggcagcgcaaaagatg

SEQ ID NO: 132482 - DNA, 103 bp, Artificial Sequence
  Synthetic Polynucleotide
taatacgactcactatagggaggtcttctcgcagaccgaacacttgaaggaacagaggagaccttcaatggttcggtctaacctggcggcagcgcaaaagatg

SEQ ID NO: 132483 - DNA, 103 bp, Artificial Sequence
  Synthetic Polynucleotide
taatacgactcactataggggggtccttgtaggtcttctcgcagaccgaaaacagaggagattcggtatgcgagaagacaacctggcggcagcgcaaaagatg

SEQ ID NO: 132484 - DNA, 103 bp, Artificial Sequence
  Synthetic Polynucleotide
taatacgactcactatagggcagcgtggctgggtccttgtaggtcttctcaacagaggagagagaagatgtacaaggacaacctggcggcagcgcaaaagatg

SEQ ID NO: 132485 - DNA, 103 bp, Artificial Sequence
  Synthetic Polynucleotide
taatacgactcactatagggcgtgctgccgcagcgtggctgggtccttgtaacagaggagaacaaggatgcagccacgcaacctggcggcagcgcaaaagatg

SEQ ID NO: 132486 - DNA, 103 bp, Artificial Sequence
  Synthetic Polynucleotide
taatacgactcactatagggtgcgtcttctcgtgctgccgcagcgtggctaacagaggagaagccacatggcggcagcaaacctggcggcagcgcaaaagatg

SEQ ID NO: 132487 - DNA, 103 bp, Artificial Sequence
  Synthetic Polynucleotide
taatacgactcactatagggtgtcagccagtgcgtcttctcgtgctgccgaacagaggagacggcagatggagaagacgaacctggcggcagcgcaaaagatg

SEQ ID NO: 132488 - DNA, 103 bp, Artificial Sequence
  Synthetic Polynucleotide
taatacgactcactatagggggaagggccgtgtcagccagtgcgtcttctaacagaggagaagaagaatgactggctgaaacctggcggcagcgcaaaagatg

SEQ ID NO: 132489 - DNA, 103 bp, Artificial Sequence
  Synthetic Polynucleotide
taatacgactcactatagggatgttgcaggggaagggccgtgtcagccagaacagaggagactggctatgacggcccttaacctggcggcagcgcaaaagatg

SEQ ID NO: 132490 - DNA, 103 bp, Artificial Sequence
  Synthetic Polynucleotide
taatacgactcactataggggtgggcccggaagatggagttctccaccataacagaggagaatggtgatgaactccatcaacctggcggcagcgcaaaagatg

SEQ ID NO: 132491 - DNA, 103 bp, Artificial Sequence
  Synthetic Polynucleotide
taatacgactcactatagggtttgccacagatgttgcaggggaagggccgaacagaggagacggcccatgccctgcaacaacctggcggcagcgcaaaagatg

SEQ ID NO: 132492 - DNA, 103 bp, Artificial Sequence
  Synthetic Polynucleotide
taatacgactcactataggggcgtgaacattttgccacagatgttgcaggaacagaggagacctgcaatgtctgtggcaaacctggcggcagcgcaaaagatg

SEQ ID NO: 132493 - DNA, 103 bp, Artificial Sequence
  Synthetic Polynucleotide
taatacgactcactataggggtgccgcgctgcgtgaacattttgccacagaacagaggagactgtggatgaatgttcacaacctggcggcagcgcaaaagatg

SEQ ID NO: 132494 - DNA, 103 bp, Artificial Sequence
  Synthetic Polynucleotide
taatacgactcactatagggacgcgtcatggtgccgcgctgcgtgaacataacagaggagaatgttcatgcagcgcggcaacctggcggcagcgcaaaagatg

SEQ ID NO: 132495 - DNA, 103 bp, Artificial Sequence
  Synthetic Polynucleotide
taatacgactcactatagggtccgcatgtgacgcgtcatggtgccgcgctaacagaggagaagcgcgatgccatgacgcaacctggcggcagcgcaaaagatg

SEQ ID NO: 132496 - DNA, 103 bp, Artificial Sequence
  Synthetic Polynucleotide
taatacgactcactatagggcccaggtggctccgcatgtgacgcgtcatgaacagaggagacatgacatgtcacatgcgaacctggcggcagcgcaaaagatg

SEQ ID NO: 132497 - DNA, 103 bp, Artificial Sequence
  Synthetic Polynucleotide
taatacgactcactataggggggcttcaggcccaggtggctccgcatgtgaacagaggagacacatgatgagccacctgaacctggcggcagcgcaaaagatg

SEQ ID NO: 132498 - DNA, 103 bp, Artificial Sequence
  Synthetic Polynucleotide
taatacgactcactatagggcgcaggcgaagggcttcaggcccaggtggcaacagaggagagccaccatggcctgaagcaacctggcggcagcgcaaaagatg

SEQ ID NO: 132499 - DNA, 103 bp, Artificial Sequence
  Synthetic Polynucleotide
taatacgactcactatagggccacactcatcgcaggcgaagggcttcaggaacagaggagacctgaaatgcttcgcctgaacctggcggcagcgcaaaagatg

SEQ ID NO: 132500 - DNA, 103 bp, Artificial Sequence
  Synthetic Polynucleotide
taatacgactcactataggggaagcgcatgccacactcatcgcaggcgaaaacagaggagattcgccatggatgagtgtaacctggcggcagcgcaaaagatg

SEQ ID NO: 132501 - DNA, 103 bp, Artificial Sequence
  Synthetic Polynucleotide
taatacgactcactatagggggacgttcttgtgggcccggaagatggagtaacagaggagaactccaatgtccgggcccaacctggcggcagcgcaaaagatg

SEQ ID NO: 132502 - DNA, 103 bp, Artificial Sequence
  Synthetic Polynucleotide
taatacgactcactatagggactgacgggtgaagcgcatgccacactcataacagaggagaatgagtatggcatgcgctaacctggcggcagcgcaaaagatg

SEQ ID NO: 132503 - DNA, 103 bp, Artificial Sequence
  Synthetic Polynucleotide
taatacgactcactataggggtgaggcggtactgacgggtgaagcgcatgaacagaggagacatgcgatgcacccgtcaaacctggcggcagcgcaaaagatg

SEQ ID NO: 132504 - DNA, 103 bp, Artificial Sequence
  Synthetic Polynucleotide
taatacgactcactatagggcatgtgctccgtgaggcggtactgacgggtaacagaggagaacccgtatgtaccgcctcaacctggcggcagcgcaaaagatg

SEQ ID NO: 132505 - DNA, 103 bp, Artificial Sequence
  Synthetic Polynucleotide
taatacgactcactatagggagtgcacacgcatgtgctccgtgaggcggtaacagaggagaaccgccatgcggagcacaaacctggcggcagcgcaaaagatg

SEQ ID NO: 132506 - DNA, 103 bp, Artificial Sequence
  Synthetic Polynucleotide
taatacgactcactatagggttctcgcccgagtgcacacgcatgtgctccaacagaggagaggagcaatggcgtgtgcaaacctggcggcagcgcaaaagatg

SEQ ID NO: 132507 - DNA, 103 bp, Artificial Sequence
  Synthetic Polynucleotide
taatacgactcactatagggctcgtaaggtttctcgcccgagtgcacacgaacagaggagacgtgtgatgtcgggcgagaacctggcggcagcgcaaaagatg

SEQ ID NO: 132508 - DNA, 103 bp, Artificial Sequence
  Synthetic Polynucleotide
taatacgactcactatagggacagctggcactcgtaaggtttctcgcccgaacagaggagacgggcgatgaaccttacgaacctggcggcagcgcaaaagatg

SEQ ID NO: 132509 - DNA, 103 bp, Artificial Sequence
  Synthetic Polynucleotide
taatacgactcactatagggttgcccccgcacagctggcactcgtaaggtaacagaggagaaccttaatggtgccagctaacctggcggcagcgcaaaagatg

SEQ ID NO: 132510 - DNA, 103 bp, Artificial Sequence
  Synthetic Polynucleotide
taatacgactcactatagggctgggtgaacttgcccccgcacagctggcaaacagaggagatgccagatgtgcgggggcaacctggcggcagcgcaaaagatg

SEQ ID NO: 132511 - DNA, 103 bp, Artificial Sequence
  Synthetic Polynucleotide
taatacgactcactatagggggttgcgctgctgggtgaacttgcccccgcaacagaggagagcggggatgagttcacccaacctggcggcagcgcaaaagatg

SEQ ID NO: 132512 - DNA, 103 bp, Artificial Sequence
  Synthetic Polynucleotide
taatacgactcactatagggctggcggctaggacgttcttgtgggcccggaacagaggagaccgggcatgcaagaacgtaacctggcggcagcgcaaaagatg

SEQ ID NO: 132513 - DNA, 103 bp, Artificial Sequence
  Synthetic Polynucleotide
taatacgactcactatagggtggctgatgaggttgcgctgctgggtgaacaacagaggagagttcacatggcagcgcaaaacctggcggcagcgcaaaagatg

SEQ ID NO: 132514 - DNA, 103 bp, Artificial Sequence
  Synthetic Polynucleotide
taatacgactcactatagggcatgcgcaggtggctgatgaggttgcgctgaacagaggagacagcgcatgctcatcagcaacctggcggcagcgcaaaagatg

SEQ ID NO: 132515 - DNA, 103 bp, Artificial Sequence
  Synthetic Polynucleotide
taatacgactcactataggggggaggtgtgcatgcgcaggtggctgatgaaacagaggagatcatcaatgacctgcgcaaacctggcggcagcgcaaaagatg

SEQ ID NO: 132516 - DNA, 103 bp, Artificial Sequence
  Synthetic Polynucleotide
taatacgactcactatagggatagatgctgctggcggctaggacgttcttaacagaggagaaagaacatgctagccgccaacctggcggcagcgcaaaagatg

SEQ ID NO: 132517 - DNA, 103 bp, Artificial Sequence
  Synthetic Polynucleotide
taatacgactcactatagggcccacgcgcaccaccggagtgccaagggccaacagaggagaggccctatgcactccggtaacctggcggcagcgcaaaagatg

SEQ ID NO: 132518 - DNA, 103 bp, Artificial Sequence
  Synthetic Polynucleotide
taatacgactcactataggggggacttgaaatagatgctgctggcggctaaacagaggagatagccgatggcagcatctaacctggcggcagcgcaaaagatg

SEQ ID NO: 132519 - DNA, 103 bp, Artificial Sequence
  Synthetic Polynucleotide
taatacgactcactatagggtgcaggaccagggacttgaaatagatgctgaacagaggagacagcatatgtttcaagtcaacctggcggcagcgcaaaagatg

SEQ ID NO: 132520 - DNA, 103 bp, Artificial Sequence
  Synthetic Polynucleotide
taatacgactcactataggggaggttgtcgtgcaggaccagggacttgaaaacagaggagattcaagatgctggtcctgaacctggcggcagcgcaaaagatg

SEQ ID NO: 132521 - DNA, 103 bp, Artificial Sequence
  Synthetic Polynucleotide
taatacgactcactatagggccaggttgatgaggttgtcgtgcaggaccaaacagaggagatggtccatgacgacaaccaacctggcggcagcgcaaaagatg

SEQ ID NO: 132522 - DNA, 103 bp, Artificial Sequence
  Synthetic Polynucleotide
taatacgactcactatagggatgtctgtgtccaggttgatgaggttgtcgaacagaggagacgacaaatgcatcaacctaacctggcggcagcgcaaaagatg

SEQ ID NO: 132523 - DNA, 103 bp, Artificial Sequence
  Synthetic Polynucleotide
taatacgactcactatagggggagctgaccatgtctgtgtccaggttgataacagaggagaatcaacatggacacagacaacctggcggcagcgcaaaagatg

SEQ ID NO: 132524 - DNA, 103 bp, Artificial Sequence
  Synthetic Polynucleotide
taatacgactcactatagggggaacactgtggagctgaccatgtctgtgtaacagaggagaacacagatgtggtcagctaacctggcggcagcgcaaaagatg

SEQ ID NO: 132525 - DNA, 103 bp, Artificial Sequence
  Synthetic Polynucleotide
taatacgactcactatagggaagatctgctggaacactgtggagctgaccaacagaggagaggtcagatgcacagtgttaacctggcggcagcgcaaaagatg

SEQ ID NO: 132526 - DNA, 103 bp, Artificial Sequence
  Synthetic Polynucleotide
taatacgactcactataggggatgaagtccaagatctgctggaacactgtaacagaggagaacagtgatgcagcagatcaacctggcggcagcgcaaaagatg

SEQ ID NO: 132527 - DNA, 103 bp, Artificial Sequence
  Synthetic Polynucleotide
taatacgactcactatagggtgcctgtgtagatgaagtccaagatctgctaacagaggagaagcagaatgtggacttcaaacctggcggcagcgcaaaagatg

SEQ ID NO: 132528 - DNA, 103 bp, Artificial Sequence
  Synthetic Polynucleotide
taatacgactcactatagggccgcgccctgcccacgcgcaccaccggagtaacagaggagaactccgatggtgcgcgtgaacctggcggcagcgcaaaagatg

SEQ ID NO: 132529 - DNA, 103 bp, Artificial Sequence
  Synthetic Polynucleotide
taatacgactcactatagggggcagcagcttgcctgtgtagatgaagtccaacagaggagaggacttatgctacacaggaacctggcggcagcgcaaaagatg

SEQ ID NO: 132530 - DNA, 103 bp, Artificial Sequence
  Synthetic Polynucleotide
taatacgactcactatagggctggtcgctgggcagcagcttgcctgtgtaaacagaggagatacacaatgaagctgctgaacctggcggcagcgcaaaagatg

SEQ ID NO: 132531 - DNA, 103 bp, Artificial Sequence
  Synthetic Polynucleotide
taatacgactcactataggggctcggctggctggtcgctgggcagcagctaacagaggagaagctgcatgccagcgaccaacctggcggcagcgcaaaagatg

SEQ ID NO: 132532 - DNA, 103 bp, Artificial Sequence
  Synthetic Polynucleotide
taatacgactcactatagggctgaagttgggctcggctggctggtcgctgaacagaggagacagcgaatggccagccgaaacctggcggcagcgcaaaagatg

SEQ ID NO: 132533 - DNA, 103 bp, Artificial Sequence
  Synthetic Polynucleotide
taatacgactcactataggggaggagggtgctgaagttgggctcggctggaacagaggagaccagccatgcccaacttcaacctggcggcagcgcaaaagatg

SEQ ID NO: 132534 - DNA, 103 bp, Artificial Sequence
  Synthetic Polynucleotide
taatacgactcactatagggtggcggcagtgaggagggtgctgaagttggaacagaggagaccaactatggcaccctccaacctggcggcagcgcaaaagatg

SEQ ID NO: 132535 - DNA, 103 bp, Artificial Sequence
  Synthetic Polynucleotide
taatacgactcactatagggtggaggtagctggcggcagtgaggagggtgaacagaggagacaccctatgcactgccgcaacctggcggcagcgcaaaagatg

SEQ ID NO: 132536 - DNA, 103 bp, Artificial Sequence
  Synthetic Polynucleotide
taatacgactcactatagggctcgggcagctggaggtagctggcggcagtaacagaggagaactgccatgagctacctcaacctggcggcagcgcaaaagatg

SEQ ID NO: 132537 - DNA, 103 bp, Artificial Sequence
  Synthetic Polynucleotide
taatacgactcactataggggggctgccaactcgggcagctggaggtagcaacagaggagagctaccatgagctgcccgaacctggcggcagcgcaaaagatg

SEQ ID NO: 132538 - DNA, 103 bp, Artificial Sequence
  Synthetic Polynucleotide
taatacgactcactatagggcggcggcagagggctgccaactcgggcagcaacagaggagagctgccatggttggcagcaacctggcggcagcgcaaaagatg

SEQ ID NO: 132539 - DNA, 103 bp, Artificial Sequence
  Synthetic Polynucleotide
taatacgactcactatagggccccatgtccccgcgccctgcccacgcgcaaacagaggagatgcgcgatggcagggcgcaacctggcggcagcgcaaaagatg

SEQ ID NO: 132540 - DNA, 103 bp, Artificial Sequence
  Synthetic Polynucleotide
taatacgactcactatagggcttgagtttgcggcggcagagggctgccaaaacagaggagattggcaatgctctgccgcaacctggcggcagcgcaaaagatg

SEQ ID NO: 132541 - DNA, 103 bp, Artificial Sequence
  Synthetic Polynucleotide
taatacgactcactatagggtgccggctcgcttgagtttgcggcggcagaaacagaggagatctgccatggcaaactcaaacctggcggcagcgcaaaagatg

SEQ ID NO: 132542 - DNA, 103 bp, Artificial Sequence
  Synthetic Polynucleotide
taatacgactcactatagggccaaagggcttgccggctcgcttgagtttgaacagaggagacaaactatggcgagccggaacctggcggcagcgcaaaagatg

SEQ ID NO: 132543 - DNA, 103 bp, Artificial Sequence
  Synthetic Polynucleotide
taatacgactcactatagggcctcccagagccaaagggcttgccggctcgaacagaggagacgagccatgaagccctttaacctggcggcagcgcaaaagatg

SEQ ID NO: 132544 - DNA, 103 bp, Artificial Sequence
  Synthetic Polynucleotide
taatacgactcactatagggtggaccccgccctcccagagccaaagggctaacagaggagaagccctatggctctgggaaacctggcggcagcgcaaaagatg

SEQ ID NO: 132545 - DNA, 103 bp, Artificial Sequence
  Synthetic Polynucleotide
taatacgactcactatagggcccatgccagtggaccccgccctcccagagaacagaggagactctggatgggcggggtcaacctggcggcagcgcaaaagatg

SEQ ID NO: 132546 - DNA, 103 bp, Artificial Sequence
  Synthetic Polynucleotide
taatacgactcactatagggggggggccgccccatgccagtggaccccgcaacagaggagagcggggatgactggcatgaacctggcggcagcgcaaaagatg

SEQ ID NO: 132547 - DNA, 103 bp, Artificial Sequence
  Synthetic Polynucleotide
taatacgactcactataggggctggctgcgggggggccgccccatgccagaacagaggagactggcaatgggcggccccaacctggcggcagcgcaaaagatg

SEQ ID NO: 132548 - DNA, 103 bp, Artificial Sequence
  Synthetic Polynucleotide
taatacgactcactataggggtggacagccgctggctgcgggggggccgcaacagaggagagcggccatgccgcagccaaacctggcggcagcgcaaaagatg

SEQ ID NO: 132549 - DNA, 103 bp, Artificial Sequence
  Synthetic Polynucleotide
taatacgactcactataggggacagaggccgtggacagccgctggctgcgaacagaggagacgcagcatgcggctgtccaacctggcggcagcgcaaaagatg

SEQ ID NO: 132550 - DNA, 103 bp, Artificial Sequence
  Synthetic Polynucleotide
taatacgactcactatagggccatgtcgggccccatgtccccgcgccctgaacagaggagacagggcatggggacatggaacctggcggcagcgcaaaagatg

SEQ ID NO: 132551 - DNA, 103 bp, Artificial Sequence
  Synthetic Polynucleotide
taatacgactcactataggggagcttggatgacagaggccgtggacagccaacagaggagaggctgtatgcggcctctgaacctggcggcagcgcaaaagatg

SEQ ID NO: 132552 - DNA, 103 bp, Artificial Sequence
  Synthetic Polynucleotide
taatacgactcactatagggccctgataccgagcttggatgacagaggccaacagaggagaggcctcatgcatccaagcaacctggcggcagcgcaaaagatg

SEQ ID NO: 132553 - DNA, 103 bp, Artificial Sequence
  Synthetic Polynucleotide
taatacgactcactatagggatccacgagcccctgataccgagcttggataacagaggagaatccaaatgcggtatcagaacctggcggcagcgcaaaagatg

SEQ ID NO: 132554 - DNA, 103 bp, Artificial Sequence
  Synthetic Polynucleotide
taatacgactcactatagggccttgcgcccatccacgagcccctgataccaacagaggagaggtatcatgggctcgtggaacctggcggcagcgcaaaagatg

SEQ ID NO: 132555 - DNA, 103 bp, Artificial Sequence
  Synthetic Polynucleotide
taatacgactcactataggggcgtgggcccccttgcgcccatccacgagcaacagaggagagctcgtatgtgggcgcaaaacctggcggcagcgcaaaagatg

SEQ ID NO: 132556 - DNA, 103 bp, Artificial Sequence
  Synthetic Polynucleotide
taatacgactcactatagggctcctggggggcgtgggcccccttgcgcccaacagaggagagggcgcatgggggcccacaacctggcggcagcgcaaaagatg

SEQ ID NO: 132557 - DNA, 103 bp, Artificial Sequence
  Synthetic Polynucleotide
taatacgactcactatagggcttgggggagctcctggggggcgtgggcccaacagaggagagggcccatgccccccaggaacctggcggcagcgcaaaagatg

SEQ ID NO: 132558 - DNA, 103 bp, Artificial Sequence
  Synthetic Polynucleotide
taatacgactcactataggggagcctttggcttgggggagctcctgggggaacagaggagacccccaatggctcccccaaacctggcggcagcgcaaaagatg

SEQ ID NO: 132559 - DNA, 103 bp, Artificial Sequence
  Synthetic Polynucleotide
taatacgactcactatagggttcatcgtctgagcctttggcttgggggagaacagaggagactccccatggccaaaggcaacctggcggcagcgcaaaagatg

SEQ ID NO: 132560 - DNA, 103 bp, Artificial Sequence
  Synthetic Polynucleotide
taatacgactcactatagggcaagaaagagttcatcgtctgagcctttggaacagaggagaccaaagatgcagacgatgaacctggcggcagcgcaaaagatg

SEQ ID NO: 132561 - DNA, 103 bp, Artificial Sequence
  Synthetic Polynucleotide
taatacgactcactatagggctgggcagctccatgtcgggccccatgtccaacagaggagaggacatatggcccgacataacctggcggcagcgcaaaagatg

SEQ ID NO: 132562 - DNA, 103 bp, Artificial Sequence
  Synthetic Polynucleotide
taatacgactcactatagggttagagccaccaagaaagagttcatcgtctaacagaggagaagacgaatgactctttctaacctggcggcagcgcaaaagatg

SEQ ID NO: 132563 - DNA, 103 bp, Artificial Sequence
  Synthetic Polynucleotide
taatacgactcactataggggctatcctggttagagccaccaagaaagagaacagaggagactctttatgggtggctctaacctggcggcagcgcaaaagatg

SEQ ID NO: 132564 - DNA, 103 bp, Artificial Sequence
  Synthetic Polynucleotide
taatacgactcactataggggaccttgcacgctatcctggttagagccacaacagaggagagtggctatgaccaggataaacctggcggcagcgcaaaagatg

SEQ ID NO: 132565 - DNA, 103 bp, Artificial Sequence
  Synthetic Polynucleotide
taatacgactcactataggggcccggcccagaccttgcacgctatcctggaacagaggagaccaggaatgcgtgcaaggaacctggcggcagcgcaaaagatg

SEQ ID NO: 132566 - DNA, 103 bp, Artificial Sequence
  Synthetic Polynucleotide
taatacgactcactatagggtgggcagacagcccggcccagaccttgcacaacagaggagagtgcaaatgctgggccggaacctggcggcagcgcaaaagatg

SEQ ID NO: 132567 - DNA, 103 bp, Artificial Sequence
  Synthetic Polynucleotide
taatacgactcactatagggccccgccagctgggcagacagcccggcccaaacagaggagatgggccatgctgtctgccaacctggcggcagcgcaaaagatg

SEQ ID NO: 132568 - DNA, 103 bp, Artificial Sequence
  Synthetic Polynucleotide
taatacgactcactatagggagacccgcctccccgccagctgggcagacaaacagaggagatgtctgatgagctggcggaacctggcggcagcgcaaaagatg

SEQ ID NO: 132569 - DNA, 103 bp, Artificial Sequence
  Synthetic Polynucleotide
taatacgactcactataggggcagccccccagacccgcctccccgccagcaacagaggagagctggcatggaggcgggtaacctggcggcagcgcaaaagatg

SEQ ID NO: 132570 - DNA, 103 bp, Artificial Sequence
  Synthetic Polynucleotide
taatacgactcactatagggtgctgctgctgcagccccccagacccgcctaacagaggagaaggcggatgtggggggctaacctggcggcagcgcaaaagatg

SEQ ID NO: 132571 - DNA, 103 bp, Artificial Sequence
  Synthetic Polynucleotide
taatacgactcactatagggctcccgttggtgctgctgctgcagccccccaacagaggagaggggggatgcagcagcagaacctggcggcagcgcaaaagatg

SEQ ID NO: 132572 - DNA, 103 bp, Artificial Sequence
  Synthetic Polynucleotide
taatacgactcactatagggcttcgagtggctgggcagctccatgtcgggaacagaggagacccgacatggagctgcccaacctggcggcagcgcaaaagatg

SEQ ID NO: 132573 - DNA, 103 bp, Artificial Sequence
  Synthetic Polynucleotide
taatacgactcactataggggcccccgctgctcccgttggtgctgctgctaacagaggagaagcagcatgaccaacgggaacctggcggcagcgcaaaagatg

SEQ ID NO: 132574 - DNA, 103 bp, Artificial Sequence
  Synthetic Polynucleotide
taatacgactcactatagggcctgctcgcagcccccgctgctcccgttggaacagaggagaccaacgatggcagcggggaacctggcggcagcgcaaaagatg

SEQ ID NO: 132575 - DNA, 103 bp, Artificial Sequence
  Synthetic Polynucleotide
taatacgactcactatagggaagcccagctcctgctcgcagcccccgctgaacagaggagacagcggatgctgcgagcaaacctggcggcagcgcaaaagatg

SEQ ID NO: 132576 - DNA, 103 bp, Artificial Sequence
  Synthetic Polynucleotide
taatacgactcactatagggggacaggtccaagcccagctcctgctcgcaaacagaggagatgcgagatggagctgggcaacctggcggcagcgcaaaagatg

SEQ ID NO: 132577 - DNA, 103 bp, Artificial Sequence
  Synthetic Polynucleotide
taatacgactcactatagggggcttttcttggacaggtccaagcccagctaacagaggagaagctggatgtggacctgtaacctggcggcagcgcaaaagatg

SEQ ID NO: 132578 - DNA, 103 bp, Artificial Sequence
  Synthetic Polynucleotide
taatacgactcactatagggggcaagggtgggcttttcttggacaggtccaacagaggagaggacctatgcaagaaaagaacctggcggcagcgcaaaagatg

SEQ ID NO: 132579 - DNA, 103 bp, Artificial Sequence
  Synthetic Polynucleotide
taatacgactcactatagggggtggcagggggcaagggtgggcttttcttaacagaggagaaagaaaatgccacccttgaacctggcggcagcgcaaaagatg

SEQ ID NO: 132580 - DNA, 103 bp, Artificial Sequence
  Synthetic Polynucleotide
taatacgactcactatagggggggacctggggtggcagggggcaagggtgaacagaggagacaccctatgcccctgccaaacctggcggcagcgcaaaagatg

SEQ ID NO: 132581 - DNA, 103 bp, Artificial Sequence
  Synthetic Polynucleotide
taatacgactcactatagggggagtgaggtggggacctggggtggcagggaacagaggagaccctgcatgcccaggtccaacctggcggcagcgcaaaagatg

SEQ ID NO: 132582 - DNA, 103 bp, Artificial Sequence
  Synthetic Polynucleotide
taatacgactcactatagggtgcgtcatcgggagtgaggtggggacctggaacagaggagaccaggtatgcacctcactaacctggcggcagcgcaaaagatg

SEQ ID NO: 132583 - DNA, 103 bp, Artificial Sequence
  Synthetic Polynucleotide
taatacgactcactataggggcaggagctgcttcgagtggctgggcagctaacagaggagaagctgcatggccactcgaaacctggcggcagcgcaaaagatg

SEQ ID NO: 132584 - DNA, 103 bp, Artificial Sequence
  Synthetic Polynucleotide
taatacgactcactatagggtcagctgggctgcgtcatcgggagtgaggtaacagaggagaacctcaatgccgatgacgaacctggcggcagcgcaaaagatg

SEQ ID NO: 132585 - DNA, 103 bp, Artificial Sequence
  Synthetic Polynucleotide
taatacgactcactatagggtggctgtcgctcagctgggctgcgtcatcgaacagaggagacgatgaatgagcccagctaacctggcggcagcgcaaaagatg

SEQ ID NO: 132586 - DNA, 103 bp, Artificial Sequence
  Synthetic Polynucleotide
taatacgactcactatagggcgagccatgttggctgtcgctcagctgggcaacagaggagagcccagatgagcgacagcaacctggcggcagcgcaaaagatg

SEQ ID NO: 132587 - DNA, 103 bp, Artificial Sequence
  Synthetic Polynucleotide
taatacgactcactatagggccgcagggggcgagccatgttggctgtcgcaacagaggagagcgacaatgaacatggctaacctggcggcagcgcaaaagatg

SEQ ID NO: 132588 - DNA, 103 bp, Artificial Sequence
  Synthetic Polynucleotide
taatacgactcactatagggggagcagaggccgcagggggcgagccatgtaacagaggagaacatggatggccccctgcaacctggcggcagcgcaaaagatg

SEQ ID NO: 132589 - DNA, 103 bp, Artificial Sequence
  Synthetic Polynucleotide
taatacgactcactatagggggcaacgggaggagcagaggccgcagggggaacagaggagaccccctatggcctctgctaacctggcggcagcgcaaaagatg

SEQ ID NO: 132590 - DNA, 103 bp, Artificial Sequence
  Synthetic Polynucleotide
taatacgactcactatagggaggcactgttggcaacgggaggagcagaggaacagaggagacctctgatgctcccgttgaacctggcggcagcgcaaaagatg

SEQ ID NO: 132591 - DNA, 103 bp, Artificial Sequence
  Synthetic Polynucleotide
taatacgactcactatagggtcagaataagaggcactgttggcaacgggaaacagaggagatcccgtatgcaacagtgcaacctggcggcagcgcaaaagatg

SEQ ID NO: 132592 - DNA, 103 bp, Artificial Sequence
  Synthetic Polynucleotide
taatacgactcactataggggccccccagctcagaataagaggcactgttaacagaggagaaacagtatgtcttattctaacctggcggcagcgcaaaagatg

SEQ ID NO: 132593 - DNA, 103 bp, Artificial Sequence
  Synthetic Polynucleotide
taatacgactcactatagggcatcaggggtgccccccagctcagaataagaacagaggagacttattatgagctgggggaacctggcggcagcgcaaaagatg

SEQ ID NO: 132594 - DNA, 103 bp, Artificial Sequence
  Synthetic Polynucleotide
taatacgactcactatagggttcagctgcagcaggagctgcttcgagtggaacagaggagaccactcatggcagctcctaacctggcggcagcgcaaaagatg

SEQ ID NO: 132595 - DNA, 103 bp, Artificial Sequence
  Synthetic Polynucleotide
taatacgactcactatagggtccatgggctcatcaggggtgccccccagcaacagaggagagctgggatgcacccctgaaacctggcggcagcgcaaaagatg

SEQ ID NO: 132596 - DNA, 103 bp, Artificial Sequence
  Synthetic Polynucleotide
taatacgactcactatagggcccctccagatccatgggctcatcaggggtaacagaggagaacccctatggagcccatgaacctggcggcagcgcaaaagatg

SEQ ID NO: 132597 - DNA, 103 bp, Artificial Sequence
  Synthetic Polynucleotide
taatacgactcactatagggtgtcctcggccccctccagatccatgggctaacagaggagaagcccaatgatctggaggaacctggcggcagcgcaaaagatg

SEQ ID NO: 132598 - DNA, 103 bp, Artificial Sequence
  Synthetic Polynucleotide
taatacgactcactatagggctcaggtggttgtcctcggccccctccagaaacagaggagatctggaatgggccgaggaaacctggcggcagcgcaaaagatg

SEQ ID NO: 132599 - DNA, 103 bp, Artificial Sequence
  Synthetic Polynucleotide
taatacgactcactatagggctccagcaggctcaggtggttgtcctcggcaacagaggagagccgagatgaaccacctgaacctggcggcagcgcaaaagatg

SEQ ID NO: 132600 - DNA, 103 bp, Artificial Sequence
  Synthetic Polynucleotide
taatacgactcactatagggcaccaggcgcctccagcaggctcaggtggtaacagaggagaaccaccatggcctgctggaacctggcggcagcgcaaaagatg

SEQ ID NO: 132601 - DNA, 103 bp, Artificial Sequence
  Synthetic Polynucleotide
taatacgactcactatagggcgaggctgcccaccaggcgcctccagcaggaacagaggagacctgctatgggcgcctggaacctggcggcagcgcaaaagatg

SEQ ID NO: 132602 - DNA, 103 bp, Artificial Sequence
  Synthetic Polynucleotide
taatacgactcactataggggaggctcttccgaggctgcccaccaggcgcaacagaggagagcgcctatggggcagcctaacctggcggcagcgcaaaagatg

SEQ ID NO: 132603 - DNA, 103 bp, Artificial Sequence
  Synthetic Polynucleotide
taatacgactcactatagggtggagtgccggaggctcttccgaggctgccaacagaggagaggcagcatgggaagagccaacctggcggcagcgcaaaagatg

SEQ ID NO: 132604 - DNA, 103 bp, Artificial Sequence
  Synthetic Polynucleotide
taatacgactcactatagggttcttccgagtggagtgccggaggctcttcaacagaggagagaagagatgccggcactcaacctggcggcagcgcaaaagatg

SEQ ID NO: 132605 - DNA, 103 bp, Artificial Sequence
  Synthetic Polynucleotide
taatacgactcactataggggttttccaaactccgacattgggagctcataacagaggagaatgagcatgcaatgtcggaacctggcggcagcgcaaaagatg

SEQ ID NO: 132606 - DNA, 103 bp, Artificial Sequence
  Synthetic Polynucleotide
taatacgactcactatagggttcagaacttatcctaccattttctattctaacagaggagaagaataatgaatggtaggaacctggcggcagcgcaaaagatg

SEQ ID NO: 132607 - DNA, 103 bp, Artificial Sequence
  Synthetic Polynucleotide
taatacgactcactatagggccagacatatccacctcttttggcaagcataacagaggagaatgcttatgaaaagaggtaacctggcggcagcgcaaaagatg

SEQ ID NO: 132608 - DNA, 103 bp, Artificial Sequence
  Synthetic Polynucleotide
taatacgactcactataggggagtttcaacccagacatatccacctctttaacagaggagaaaagagatggatatgtctaacctggcggcagcgcaaaagatg

SEQ ID NO: 132609 - DNA, 103 bp, Artificial Sequence
  Synthetic Polynucleotide
taatacgactcactatagggacagttgcttgagtttcaacccagacatataacagaggagaatatgtatgggttgaaacaacctggcggcagcgcaaaagatg

SEQ ID NO: 132610 - DNA, 103 bp, Artificial Sequence
  Synthetic Polynucleotide
taatacgactcactataggggttatatatgacagttgcttgagtttcaacaacagaggagagttgaaatgcaagcaactaacctggcggcagcgcaaaagatg

SEQ ID NO: 132611 - DNA, 103 bp, Artificial Sequence
  Synthetic Polynucleotide
taatacgactcactatagggaattcttggtgttatatatgacagttgcttaacagaggagaaagcaaatgtcatatataaacctggcggcagcgcaaaagatg

SEQ ID NO: 132612 - DNA, 103 bp, Artificial Sequence
  Synthetic Polynucleotide
taatacgactcactatagggtgtggttgagaattcttggtgttatatatgaacagaggagacatataatgcaccaagaaaacctggcggcagcgcaaaagatg

SEQ ID NO: 132613 - DNA, 103 bp, Artificial Sequence
  Synthetic Polynucleotide
taatacgactcactatagggtacaatgcactgtggttgagaattcttggtaacagaggagaaccaagatgtctcaaccaaacctggcggcagcgcaaaagatg

SEQ ID NO: 132614 - DNA, 103 bp, Artificial Sequence
  Synthetic Polynucleotide
taatacgactcactatagggaattcacacatacaatgcactgtggttgagaacagaggagactcaacatgagtgcattgaacctggcggcagcgcaaaagatg

SEQ ID NO: 132615 - DNA, 103 bp, Artificial Sequence
  Synthetic Polynucleotide
taatacgactcactatagggctcacaacgtaattcacacatacaatgcacaacagaggagagtgcatatgatgtgtgaaaacctggcggcagcgcaaaagatg

SEQ ID NO: 132616 - DNA, 103 bp, Artificial Sequence
  Synthetic Polynucleotide
taatacgactcactatagggaataataccactcacaacgtaattcacacaaacagaggagatgtgtgatgtacgttgtgaacctggcggcagcgcaaaagatg

SEQ ID NO: 132617 - DNA, 103 bp, Artificial Sequence
  Synthetic Polynucleotide
taatacgactcactatagggcttttcgacgttcagaacttatcctaccataacagaggagaatggtaatgtaagttctgaacctggcggcagcgcaaaagatg

SEQ ID NO: 132618 - DNA, 103 bp, Artificial Sequence
  Synthetic Polynucleotide
taatacgactcactatagggagtcgtgctgaataataccactcacaacgtaacagaggagaacgttgatggtggtattaaacctggcggcagcgcaaaagatg

SEQ ID NO: 132619 - DNA, 103 bp, Artificial Sequence
  Synthetic Polynucleotide
taatacgactcactataggggagaaaatcaagtcgtgctgaataataccaaacagaggagatggtatatgtcagcacgaaacctggcggcagcgcaaaagatg

SEQ ID NO: 132620 - DNA, 103 bp, Artificial Sequence
  Synthetic Polynucleotide
taatacgactcactatagggttgttgaagggagaaaatcaagtcgtgctgaacagaggagacagcacatgttgattttcaacctggcggcagcgcaaaagatg

SEQ ID NO: 132621 - DNA, 103 bp, Artificial Sequence
  Synthetic Polynucleotide
taatacgactcactatagggcacattctgtttgttgaagggagaaaatcaaacagaggagatgatttatgcccttcaacaacctggcggcagcgcaaaagatg

SEQ ID NO: 132622 - DNA, 103 bp, Artificial Sequence
  Synthetic Polynucleotide
taatacgactcactatagggggtttaaggacacattctgtttgttgaaggaacagaggagaccttcaatgaacagaatgaacctggcggcagcgcaaaagatg

SEQ ID NO: 132623 - DNA, 103 bp, Artificial Sequence
  Synthetic Polynucleotide
taatacgactcactatagggagattcaaccggtttaaggacacattctgtaacagaggagaacagaaatggtccttaaaaacctggcggcagcgcaaaagatg

SEQ ID NO: 132624 - DNA, 103 bp, Artificial Sequence
  Synthetic Polynucleotide
taatacgactcactatagggtcatatctgaagattcaaccggtttaaggaaacagaggagatccttaatgcggttgaataacctggcggcagcgcaaaagatg

SEQ ID NO: 132625 - DNA, 103 bp, Artificial Sequence
  Synthetic Polynucleotide
taatacgactcactatagggtgagtcattttcatatctgaagattcaaccaacagaggagaggttgaatgttcagatataacctggcggcagcgcaaaagatg

SEQ ID NO: 132626 - DNA, 103 bp, Artificial Sequence
  Synthetic Polynucleotide
taatacgactcactatagggggtgaatagctgagtcattttcatatctgaaacagaggagatcagatatgaaaatgactaacctggcggcagcgcaaaagatg

SEQ ID NO: 132627 - DNA, 103 bp, Artificial Sequence
  Synthetic Polynucleotide
taatacgactcactatagggattcaactttggtgaatagctgagtcatttaacagaggagaaaatgaatgagctattcaaacctggcggcagcgcaaaagatg

SEQ ID NO: 132628 - DNA, 103 bp, Artificial Sequence
  Synthetic Polynucleotide
taatacgactcactatagggcgagacttttcttttcgacgttcagaacttaacagaggagaaagttcatgacgtcgaaaaacctggcggcagcgcaaaagatg

SEQ ID NO: 132629 - DNA, 103 bp, Artificial Sequence
  Synthetic Polynucleotide
taatacgactcactataggggtatcttctgattcaactttggtgaatagcaacagaggagagctattatgcaaagttgaaacctggcggcagcgcaaaagatg

SEQ ID NO: 132630 - DNA, 103 bp, Artificial Sequence
  Synthetic Polynucleotide
taatacgactcactataggggaggctacttgtatcttctgattcaactttaacagaggagaaaagttatgtcagaagataacctggcggcagcgcaaaagatg

SEQ ID NO: 132631 - DNA, 103 bp, Artificial Sequence
  Synthetic Polynucleotide
taatacgactcactataggggtttgtcaaagaggctacttgtatcttctgaacagaggagacagaagatgcaagtagccaacctggcggcagcgcaaaagatg

SEQ ID NO: 132632 - DNA, 103 bp, Artificial Sequence
  Synthetic Polynucleotide
taatacgactcactatagggtccttcttaagtttgtcaaagaggctacttaacagaggagaaagtagatgctttgacaaaacctggcggcagcgcaaaagatg

SEQ ID NO: 132633 - DNA, 103 bp, Artificial Sequence
  Synthetic Polynucleotide
taatacgactcactatagggagcatcaggttccttcttaagtttgtcaaaaacagaggagatttgacatgcttaagaagaacctggcggcagcgcaaaagatg

SEQ ID NO: 132634 - DNA, 103 bp, Artificial Sequence
  Synthetic Polynucleotide
taatacgactcactataggggcaaagttaaagcatcaggttccttcttaaaacagaggagattaagaatgaacctgatgaacctggcggcagcgcaaaagatg

SEQ ID NO: 132635 - DNA, 103 bp, Artificial Sequence
  Synthetic Polynucleotide
taatacgactcactataggggctggggccagcaaagttaaagcatcaggtaacagaggagaacctgaatgtttaactttaacctggcggcagcgcaaaagatg

SEQ ID NO: 132636 - DNA, 103 bp, Artificial Sequence
  Synthetic Polynucleotide
taatacgactcactataggggtctccagcggctggggccagcaaagttaaaacagaggagattaactatgctggccccaaacctggcggcagcgcaaaagatg

SEQ ID NO: 132637 - DNA, 103 bp, Artificial Sequence
  Synthetic Polynucleotide
taatacgactcactatagggatatgattgtgtctccagcggctggggccaaacagaggagatggcccatgccgctggagaacctggcggcagcgcaaaagatg

SEQ ID NO: 132638 - DNA, 103 bp, Artificial Sequence
  Synthetic Polynucleotide
taatacgactcactatagggaaatctaaagatatgattgtgtctccagcgaacagaggagacgctggatgcacaatcataacctggcggcagcgcaaaagatg

SEQ ID NO: 132639 - DNA, 103 bp, Artificial Sequence
  Synthetic Polynucleotide
taatacgactcactatagggggctgcatctcgagacttttcttttcgacgaacagaggagacgtcgaatggaaaagtctaacctggcggcagcgcaaaagatg

SEQ ID NO: 132640 - DNA, 103 bp, Artificial Sequence
  Synthetic Polynucleotide
taatacgactcactataggggttgctgccaaaatctaaagatatgattgtaacagaggagaacaatcatgtctttagataacctggcggcagcgcaaaagatg

SEQ ID NO: 132641 - DNA, 103 bp, Artificial Sequence
  Synthetic Polynucleotide
taatacgactcactatagggtttctgtgtcgttgctgccaaaatctaaagaacagaggagactttagatgttggcagcaaacctggcggcagcgcaaaagatg

SEQ ID NO: 132642 - DNA, 103 bp, Artificial Sequence
  Synthetic Polynucleotide
taatacgactcactatagggtggtcatcagtttctgtgtcgttgctgccaaacagaggagatggcagatgcgacacagaaacctggcggcagcgcaaaagatg

SEQ ID NO: 132643 - DNA, 103 bp, Artificial Sequence
  Synthetic Polynucleotide
taatacgactcactatagggctcaagttgctggtcatcagtttctgtgtcaacagaggagagacacaatgactgatgacaacctggcggcagcgcaaaagatg

SEQ ID NO: 132644 - DNA, 103 bp, Artificial Sequence
  Synthetic Polynucleotide
taatacgactcactatagggatggtacttcctcaagttgctggtcatcagaacagaggagactgatgatgagcaacttgaacctggcggcagcgcaaaagatg

SEQ ID NO: 132645 - DNA, 103 bp, Artificial Sequence
  Synthetic Polynucleotide
taatacgactcactatagggtcattatataatggtacttcctcaagttgcaacagaggagagcaactatgggaagtaccaacctggcggcagcgcaaaagatg

SEQ ID NO: 132646 - DNA, 103 bp, Artificial Sequence
  Synthetic Polynucleotide
taatacgactcactataggggagcattacatcattatataatggtacttcaacagaggagagaagtaatgttatataataacctggcggcagcgcaaaagatg

SEQ ID NO: 132647 - DNA, 103 bp, Artificial Sequence
  Synthetic Polynucleotide
taatacgactcactatagggtgggtgaggggagcattacatcattatataaacagaggagatatataatgatgtaatgcaacctggcggcagcgcaaaagatg

SEQ ID NO: 132648 - DNA, 103 bp, Artificial Sequence
  Synthetic Polynucleotide
taatacgactcactatagggaatttttcgttgggtgaggggagcattacaaacagaggagatgtaatatgcccctcaccaacctggcggcagcgcaaaagatg

SEQ ID NO: 132649 - DNA, 103 bp, Artificial Sequence
  Synthetic Polynucleotide
taatacgactcactatagggtatattctgtaatttttcgttgggtgagggaacagaggagaccctcaatgaacgaaaaaaacctggcggcagcgcaaaagatg

SEQ ID NO: 132650 - DNA, 103 bp, Artificial Sequence
  Synthetic Polynucleotide
taatacgactcactataggggccgagatctggctgcatctcgagacttttaacagaggagaaaaagtatggagatgcagaacctggcggcagcgcaaaagatg

SEQ ID NO: 132651 - DNA, 103 bp, Artificial Sequence
  Synthetic Polynucleotide
taatacgactcactatagggttgccaaatttatattctgtaatttttcgtaacagaggagaacgaaaatgtacagaataaacctggcggcagcgcaaaagatg

SEQ ID NO: 132652 - DNA, 103 bp, Artificial Sequence
  Synthetic Polynucleotide
taatacgactcactatagggaatggagacattgccaaatttatattctgtaacagaggagaacagaaatgaaatttggcaacctggcggcagcgcaaaagatg

SEQ ID NO: 132653 - DNA, 103 bp, Artificial Sequence
  Synthetic Polynucleotide
taatacgactcactatagggagcggtgggtaatggagacattgccaaattaacagaggagaaatttgatgatgtctccaaacctggcggcagcgcaaaagatg

SEQ ID NO: 132654 - DNA, 103 bp, Artificial Sequence
  Synthetic Polynucleotide
taatacgactcactatagggttggcgtttcagcggtgggtaatggagacaaacagaggagatgtctcatgtacccaccgaacctggcggcagcgcaaaagatg

SEQ ID NO: 132655 - DNA, 103 bp, Artificial Sequence
  Synthetic Polynucleotide
taatacgactcactatagggcgaagtggctttggcgtttcagcggtgggtaacagaggagaacccacatgtgaaacgccaacctggcggcagcgcaaaagatg

SEQ ID NO: 132656 - DNA, 103 bp, Artificial Sequence
  Synthetic Polynucleotide
taatacgactcactatagggagcactacttcgaagtggctttggcgtttcaacagaggagagaaacgatgaagccacttaacctggcggcagcgcaaaagatg

SEQ ID NO: 132657 - DNA, 103 bp, Artificial Sequence
  Synthetic Polynucleotide
taatacgactcactataggggtgcagggtcagcactacttcgaagtggctaacagaggagaagccacatggaagtagtgaacctggcggcagcgcaaaagatg

SEQ ID NO: 132658 - DNA, 103 bp, Artificial Sequence
  Synthetic Polynucleotide
taatacgactcactatagggtcttgattgagtgcagggtcagcactacttaacagaggagaaagtagatgtgaccctgcaacctggcggcagcgcaaaagatg

SEQ ID NO: 132659 - DNA, 103 bp, Artificial Sequence
  Synthetic Polynucleotide
taatacgactcactatagggtaatgcaacttcttgattgagtgcagggtcaacagaggagagaccctatgctcaatcaaaacctggcggcagcgcaaaagatg

SEQ ID NO: 132660 - DNA, 103 bp, Artificial Sequence
  Synthetic Polynucleotide
taatacgactcactataggggttctaattttaatgcaacttcttgattgaaacagaggagatcaatcatgaagttgcataacctggcggcagcgcaaaagatg

SEQ ID NO: 132661 - DNA, 103 bp, Artificial Sequence
  Synthetic Polynucleotide
taatacgactcactatagggtctttacttcgccgagatctggctgcatctaacagaggagaagatgcatgcagatctcgaacctggcggcagcgcaaaagatg

SEQ ID NO: 132662 - DNA, 103 bp, Artificial Sequence
  Synthetic Polynucleotide
taatacgactcactatagggtctggatttggttctaattttaatgcaactaacagaggagaagttgcatgaaaattagaaacctggcggcagcgcaaaagatg

SEQ ID NO: 132663 - DNA, 103 bp, Artificial Sequence
  Synthetic Polynucleotide
taatacgactcactatagggttccagtgactctggatttggttctaatttaacagaggagaaaattaatgccaaatccaaacctggcggcagcgcaaaagatg

SEQ ID NO: 132664 - DNA, 103 bp, Artificial Sequence
  Synthetic Polynucleotide
taatacgactcactatagggtaaaagaaagttccagtgactctggatttgaacagaggagacaaatcatgagtcactggaacctggcggcagcgcaaaagatg

SEQ ID NO: 132665 - DNA, 103 bp, Artificial Sequence
  Synthetic Polynucleotide
taatacgactcactatagggtggggcatggtaaaagaaagttccagtgacaacagaggagagtcactatgactttctttaacctggcggcagcgcaaaagatg

SEQ ID NO: 132666 - DNA, 103 bp, Artificial Sequence
  Synthetic Polynucleotide
taatacgactcactatagggatcctgaatctggggcatggtaaaagaaagaacagaggagactttctatgaccatgcccaacctggcggcagcgcaaaagatg

SEQ ID NO: 132667 - DNA, 103 bp, Artificial Sequence
  Synthetic Polynucleotide
taatacgactcactatagggtaggtgtctgatcctgaatctggggcatggaacagaggagaccatgcatgagattcaggaacctggcggcagcgcaaaagatg

SEQ ID NO: 132668 - DNA, 103 bp, Artificial Sequence
  Synthetic Polynucleotide
taatacgactcactatagggtcggaaggactaggtgtctgatcctgaatcaacagaggagagattcaatgtcagacaccaacctggcggcagcgcaaaagatg

SEQ ID NO: 132669 - DNA, 103 bp, Artificial Sequence
  Synthetic Polynucleotide
taatacgactcactatagggagtgcttccatcggaaggactaggtgtctgaacagaggagacagacaatgagtccttccaacctggcggcagcgcaaaagatg

SEQ ID NO: 132670 - DNA, 103 bp, Artificial Sequence
  Synthetic Polynucleotide
taatacgactcactatagggaactttgtctagtgcttccatcggaaggacaacagaggagagtccttatgatggaagcaaacctggcggcagcgcaaaagatg

SEQ ID NO: 132671 - DNA, 103 bp, Artificial Sequence
  Synthetic Polynucleotide
taatacgactcactatagggggctcaggtgaactttgtctagtgcttccaaacagaggagatggaagatgtagacaaagaacctggcggcagcgcaaaagatg

SEQ ID NO: 132672 - DNA, 103 bp, Artificial Sequence
  Synthetic Polynucleotide
taatacgactcactatagggaacttcagattctttacttcgccgagatctaacagaggagaagatctatgcgaagtaaaaacctggcggcagcgcaaaagatg

SEQ ID NO: 132673 - DNA, 103 bp, Artificial Sequence
  Synthetic Polynucleotide
taatacgactcactataggggggactattaggctcaggtgaactttgtctaacagaggagaagacaaatgtcacctgagaacctggcggcagcgcaaaagatg

SEQ ID NO: 132674 - DNA, 103 bp, Artificial Sequence
  Synthetic Polynucleotide
taatacgactcactatagggaatattcactgggactattaggctcaggtgaacagaggagacacctgatgctaatagtcaacctggcggcagcgcaaaagatg

SEQ ID NO: 132675 - DNA, 103 bp, Artificial Sequence
  Synthetic Polynucleotide
taatacgactcactatagggacataaaaacaatattcactgggactattaaacagaggagataatagatgcagtgaataaacctggcggcagcgcaaaagatg

SEQ ID NO: 132676 - DNA, 103 bp, Artificial Sequence
  Synthetic Polynucleotide
taatacgactcactatagggatcactatccacataaaaacaatattcactaacagaggagaagtgaaatgtgtttttataacctggcggcagcgcaaaagatg

SEQ ID NO: 132677 - DNA, 103 bp, Artificial Sequence
  Synthetic Polynucleotide
taatacgactcactatagggcattgaccatatcactatccacataaaaacaacagaggagagtttttatgtggatagtgaacctggcggcagcgcaaaagatg

SEQ ID NO: 132678 - DNA, 103 bp, Artificial Sequence
  Synthetic Polynucleotide
taatacgactcactatagggaacttgaattcattgaccatatcactatccaacagaggagaggatagatgtatggtcaaaacctggcggcagcgcaaaagatg

SEQ ID NO: 132679 - DNA, 103 bp, Artificial Sequence
  Synthetic Polynucleotide
taatacgactcactatagggtaccaattccaacttgaattcattgaccataacagaggagaatggtcatggaattcaagaacctggcggcagcgcaaaagatg

SEQ ID NO: 132680 - DNA, 103 bp, Artificial Sequence
  Synthetic Polynucleotide
taatacgactcactatagggaaagtttttctaccaattccaacttgaattaacagaggagaaattcaatgtggaattggaacctggcggcagcgcaaaagatg

SEQ ID NO: 132681 - DNA, 103 bp, Artificial Sequence
  Synthetic Polynucleotide
taatacgactcactatagggtcttcagcaaaaagtttttctaccaattccaacagaggagaggaattatgagaaaaactaacctggcggcagcgcaaaagatg

SEQ ID NO: 132682 - DNA, 103 bp, Artificial Sequence
  Synthetic Polynucleotide
taatacgactcactatagggtgcttctgtgtcttcagcaaaaagtttttcaacagaggagagaaaaaatgtttgctgaaaacctggcggcagcgcaaaagatg

SEQ ID NO: 132683 - DNA, 103 bp, Artificial Sequence
  Synthetic Polynucleotide
taatacgactcactataggggctcataaaaaacttcagattctttacttcaacagaggagagaagtaatgaatctgaagaacctggcggcagcgcaaaagatg

SEQ ID NO: 132684 - DNA, 103 bp, Artificial Sequence
  Synthetic Polynucleotide
taatacgactcactatagggatgggttctttgcttctgtgtcttcagcaaaacagaggagattgctgatgacacagaagaacctggcggcagcgcaaaagatg

SEQ ID NO: 132685 - DNA, 103 bp, Artificial Sequence
  Synthetic Polynucleotide
taatacgactcactatagggtgagtagaaaatgggttctttgcttctgtgaacagaggagacacagaatgaaagaacccaacctggcggcagcgcaaaagatg

SEQ ID NO: 132686 - DNA, 103 bp, Artificial Sequence
  Synthetic Polynucleotide
taatacgactcactatagggatctgtgtcctgagtagaaaatgggttcttaacagaggagaaagaacatgttttctactaacctggcggcagcgcaaaagatg

SEQ ID NO: 132687 - DNA, 103 bp, Artificial Sequence
  Synthetic Polynucleotide
taatacgactcactatagggccaagtctaaatctgtgtcctgagtagaaaaacagaggagatttctaatgaggacacagaacctggcggcagcgcaaaagatg

SEQ ID NO: 132688 - DNA, 103 bp, Artificial Sequence
  Synthetic Polynucleotide
taatacgactcactataggggctaacatctccaagtctaaatctgtgtccaacagaggagaggacacatgtttagacttaacctggcggcagcgcaaaagatg

SEQ ID NO: 132689 - DNA, 103 bp, Artificial Sequence
  Synthetic Polynucleotide
taatacgactcactataggggatatagggagctaacatctccaagtctaaaacagaggagattagacatggagatgttaaacctggcggcagcgcaaaagatg

SEQ ID NO: 132690 - DNA, 103 bp, Artificial Sequence
  Synthetic Polynucleotide
taatacgactcactatagggcatccattgggatatagggagctaacatctaacagaggagaagatgtatgctccctataaacctggcggcagcgcaaaagatg

SEQ ID NO: 132691 - DNA, 103 bp, Artificial Sequence
  Synthetic Polynucleotide
taatacgactcactatagggtggaagtcatcatccattgggatatagggaaacagaggagatccctaatgcccaatggaaacctggcggcagcgcaaaagatg

SEQ ID NO: 132692 - DNA, 103 bp, Artificial Sequence
  Synthetic Polynucleotide
taatacgactcactatagggggaacgtaactggaagtcatcatccattggaacagaggagaccaatgatggatgacttcaacctggcggcagcgcaaaagatg

SEQ ID NO: 132693 - DNA, 103 bp, Artificial Sequence
  Synthetic Polynucleotide
taatacgactcactatagggactgatcgaaggaacgtaactggaagtcataacagaggagaatgactatgagttacgttaacctggcggcagcgcaaaagatg

SEQ ID NO: 132694 - DNA, 103 bp, Artificial Sequence
  Synthetic Polynucleotide
taatacgactcactatagggtgatgagcaagctcataaaaaacttcagataacagaggagaatctgaatgtttttatgaaacctggcggcagcgcaaaagatg

SEQ ID NO: 132695 - DNA, 103 bp, Artificial Sequence
  Synthetic Polynucleotide
taatacgactcactatagggaatggtgacaactgatcgaaggaacgtaacaacagaggagagttacgatgcttcgatcaaacctggcggcagcgcaaaagatg

SEQ ID NO: 132696 - DNA, 103 bp, Artificial Sequence
  Synthetic Polynucleotide
taatacgactcactatagggactgctttctaatggtgacaactgatcgaaaacagaggagattcgatatgttgtcaccaaacctggcggcagcgcaaaagatg

SEQ ID NO: 132697 - DNA, 103 bp, Artificial Sequence
  Synthetic Polynucleotide
taatacgactcactatagggggcttgcggaactgctttctaatggtgacaaacagaggagatgtcacatgtagaaagcaaacctggcggcagcgcaaaagatg

SEQ ID NO: 132698 - DNA, 103 bp, Artificial Sequence
  Synthetic Polynucleotide
taatacgactcactataggggcgctttcagggcttgcggaactgctttctaacagaggagaagaaagatgttccgcaagaacctggcggcagcgcaaaagatg

SEQ ID NO: 132699 - DNA, 103 bp, Artificial Sequence
  Synthetic Polynucleotide
taatacgactcactatagggttgaggacttgcgctttcagggcttgcggaaacagaggagatccgcaatgcctgaaagcaacctggcggcagcgcaaaagatg

SEQ ID NO: 132700 - DNA, 103 bp, Artificial Sequence
  Synthetic Polynucleotide
taatacgactcactatagggtaactgtgctttgaggacttgcgctttcagaacagaggagactgaaaatgcaagtcctcaacctggcggcagcgcaaaagatg

SEQ ID NO: 132701 - DNA, 103 bp, Artificial Sequence
  Synthetic Polynucleotide
taatacgactcactatagggtggaatactgtaactgtgctttgaggacttaacagaggagaaagtccatgaagcacagtaacctggcggcagcgcaaaagatg

SEQ ID NO: 132702 - DNA, 103 bp, Artificial Sequence
  Synthetic Polynucleotide
taatacgactcactatagggttgagtctgctggaatactgtaactgtgctaacagaggagaagcacaatgacagtattcaacctggcggcagcgcaaaagatg

SEQ ID NO: 132703 - DNA, 103 bp, Artificial Sequence
  Synthetic Polynucleotide
taatacgactcactataggggttcttgtatttgagtctgctggaatactgaacagaggagacagtatatgagcagactcaacctggcggcagcgcaaaagatg

SEQ ID NO: 132704 - DNA, 103 bp, Artificial Sequence
  Synthetic Polynucleotide
taatacgactcactatagggttagcagtaggttcttgtatttgagtctgcaacagaggagagcagacatgaatacaagaaacctggcggcagcgcaaaagatg

SEQ ID NO: 132705 - DNA, 103 bp, Artificial Sequence
  Synthetic Polynucleotide
taatacgactcactatagggaagtggcaactgatgagcaagctcataaaaaacagaggagattttatatgcttgctcataacctggcggcagcgcaaaagatg

SEQ ID NO: 132706 - DNA, 103 bp, Artificial Sequence
  Synthetic Polynucleotide
taatacgactcactatagggagtggtggcattagcagtaggttcttgtataacagaggagaatacaaatgcctactgctaacctggcggcagcgcaaaagatg

SEQ ID NO: 132707 - DNA, 103 bp, Artificial Sequence
  Synthetic Polynucleotide
taatacgactcactatagggtggcagtggtagtggtggcattagcagtagaacagaggagactactgatgatgccaccaaacctggcggcagcgcaaaagatg

SEQ ID NO: 132708 - DNA, 103 bp, Artificial Sequence
  Synthetic Polynucleotide
taatacgactcactatagggtcatcagtggtggcagtggtagtggtggcaaacagaggagatgccacatgtaccactgcaacctggcggcagcgcaaaagatg

SEQ ID NO: 132709 - DNA, 103 bp, Artificial Sequence
  Synthetic Polynucleotide
taatacgactcactatagggtgtttttaattcatcagtggtggcagtggtaacagaggagaaccactatgaccactgataacctggcggcagcgcaaaagatg

SEQ ID NO: 132710 - DNA, 103 bp, Artificial Sequence
  Synthetic Polynucleotide
taatacgactcactatagggcttttgtcactgtttttaattcatcagtggaacagaggagaccactgatgaattaaaaaaacctggcggcagcgcaaaagatg

SEQ ID NO: 132711 - DNA, 103 bp, Artificial Sequence
  Synthetic Polynucleotide
taatacgactcactatagggtccatacggtcttttgtcactgtttttaataacagaggagaattaaaatgagtgacaaaaacctggcggcagcgcaaaagatg

SEQ ID NO: 132712 - DNA, 103 bp, Artificial Sequence
  Synthetic Polynucleotide
taatacgactcactatagggtttaatgtcttccatacggtcttttgtcacaacagaggagagtgacaatggaccgtatgaacctggcggcagcgcaaaagatg

SEQ ID NO: 132713 - DNA, 103 bp, Artificial Sequence
  Synthetic Polynucleotide
taatacgactcactatagggcaatcaatattttaatgtcttccatacggtaacagaggagaaccgtaatgaagacattaaacctggcggcagcgcaaaagatg

SEQ ID NO: 132714 - DNA, 103 bp, Artificial Sequence
  Synthetic Polynucleotide
taatacgactcactataggggatggagatgcaatcaatattttaatgtctaacagaggagaagacatatgaatattgataacctggcggcagcgcaaaagatg

SEQ ID NO: 132715 - DNA, 103 bp, Artificial Sequence
  Synthetic Polynucleotide
taatacgactcactataggggtgggtaggagatggagatgcaatcaatataacagaggagaatattgatggcatctccaaacctggcggcagcgcaaaagatg

SEQ ID NO: 132716 - DNA, 103 bp, Artificial Sequence
  Synthetic Polynucleotide
taatacgactcactatagggagacaaatttgttttccaaactccgacattaacagaggagaaatgtcatggtttggaaaaacctggcggcagcgcaaaagatg

SEQ ID NO: 132717 - DNA, 103 bp, Artificial Sequence
  Synthetic Polynucleotide
taatacgactcactatagggcattatgtggaagtggcaactgatgagcaaaacagaggagattgctcatgagttgccacaacctggcggcagcgcaaaagatg

SEQ ID NO: 132718 - DNA, 103 bp, Artificial Sequence
  Synthetic Polynucleotide
taatacgactcactatagggctttatgtatgtgggtaggagatggagatgaacagaggagacatctcatgctcctacccaacctggcggcagcgcaaaagatg

SEQ ID NO: 132719 - DNA, 103 bp, Artificial Sequence
  Synthetic Polynucleotide
taatacgactcactatagggctagtagtttctttatgtatgtgggtaggaaacagaggagatcctacatgcatacataaaacctggcggcagcgcaaaagatg

SEQ ID NO: 132720 - DNA, 103 bp, Artificial Sequence
  Synthetic Polynucleotide
taatacgactcactatagggtgatgtggcactagtagtttctttatgtataacagaggagaatacatatggaaactactaacctggcggcagcgcaaaagatg

SEQ ID NO: 132721 - DNA, 103 bp, Artificial Sequence
  Synthetic Polynucleotide
taatacgactcactatagggtatatggtgatgatgtggcactagtagtttaacagaggagaaaactaatggtgccacataacctggcggcagcgcaaaagatg

SEQ ID NO: 132722 - DNA, 103 bp, Artificial Sequence
  Synthetic Polynucleotide
taatacgactcactatagggtgagtatctctatatggtgatgatgtggcaaacagaggagatgccacatgatcaccataaacctggcggcagcgcaaaagatg

SEQ ID NO: 132723 - DNA, 103 bp, Artificial Sequence
  Synthetic Polynucleotide
taatacgactcactatagggtgtccgactttgagtatctctatatggtgaaacagaggagatcaccaatgagagatactaacctggcggcagcgcaaaagatg

SEQ ID NO: 132724 - DNA, 103 bp, Artificial Sequence
  Synthetic Polynucleotide
taatacgactcactatagggttggtgaggctgtccgactttgagtatctcaacagaggagagagataatgaaagtcggaaacctggcggcagcgcaaaagatg

SEQ ID NO: 132725 - DNA, 103 bp, Artificial Sequence
  Synthetic Polynucleotide
taatacgactcactatagggcctgctctgtttggtgaggctgtccgacttaacagaggagaaagtcgatgagcctcaccaacctggcggcagcgcaaaagatg

SEQ ID NO: 132726 - DNA, 103 bp, Artificial Sequence
  Synthetic Polynucleotide
taatacgactcactataggggactccttttcctgctctgtttggtgaggcaacagaggagagcctcaatgaacagagcaaacctggcggcagcgcaaaagatg

SEQ ID NO: 132727 - DNA, 103 bp, Artificial Sequence
  Synthetic Polynucleotide
taatacgactcactatagggtctgttctatgactccttttcctgctctgtaacagaggagaacagagatggaaaaggagaacctggcggcagcgcaaaagatg

SEQ ID NO: 132728 - DNA, 103 bp, Artificial Sequence
  Synthetic Polynucleotide
taatacgactcactatagggtgcgaactcacattatgtggaagtggcaacaacagaggagagttgccatgtccacataaaacctggcggcagcgcaaaagatg

SEQ ID NO: 132729 - DNA, 103 bp, Artificial Sequence
  Synthetic Polynucleotide
taatacgactcactataggggatttttctgtctgttctatgactccttttaacagaggagaaaaaggatgcatagaacaaacctggcggcagcgcaaaagatg

SEQ ID NO: 132730 - DNA, 103 bp, Artificial Sequence
  Synthetic Polynucleotide
taatacgactcactatagggtcttggatgagatttttctgtctgttctataacagaggagaatagaaatgacagaaaaaaacctggcggcagcgcaaaagatg

SEQ ID NO: 132731 - DNA, 103 bp, Artificial Sequence
  Synthetic Polynucleotide
taatacgactcactatagggcgttagggcttcttggatgagatttttctgaacagaggagacagaaaatgctcatccaaaacctggcggcagcgcaaaagatg

SEQ ID NO: 132732 - DNA, 103 bp, Artificial Sequence
  Synthetic Polynucleotide
taatacgactcactatagggacagataacacgttagggcttcttggatgaaacagaggagatcatccatgaagccctaaaacctggcggcagcgcaaaagatg

SEQ ID NO: 132733 - DNA, 103 bp, Artificial Sequence
  Synthetic Polynucleotide
taatacgactcactatagggactcaaagcgacagataacacgttagggctaacagaggagaagccctatggtgttatctaacctggcggcagcgcaaaagatg

SEQ ID NO: 132734 - DNA, 103 bp, Artificial Sequence
  Synthetic Polynucleotide
taatacgactcactatagggtagttctttgactcaaagcgacagataacaaacagaggagatgttatatgtcgctttgaaacctggcggcagcgcaaaagatg

SEQ ID NO: 132735 - DNA, 103 bp, Artificial Sequence
  Synthetic Polynucleotide
taatacgactcactatagggtcaggaactgtagttctttgactcaaagcgaacagaggagacgctttatgtcaaagaacaacctggcggcagcgcaaaagatg

SEQ ID NO: 132736 - DNA, 103 bp, Artificial Sequence
  Synthetic Polynucleotide
taatacgactcactatagggtagttcttcctcaggaactgtagttctttgaacagaggagacaaagaatgacagttcctaacctggcggcagcgcaaaagatg

SEQ ID NO: 132737 - DNA, 103 bp, Artificial Sequence
  Synthetic Polynucleotide
taatacgactcactatagggtctttggatttagttcttcctcaggaactgaacagaggagacagttcatgaggaagaacaacctggcggcagcgcaaaagatg

SEQ ID NO: 132738 - DNA, 103 bp, Artificial Sequence
  Synthetic Polynucleotide
taatacgactcactatagggaaagctagtatctttggatttagttcttccaacagaggagaggaagaatgaaatccaaaaacctggcggcagcgcaaaagatg

SEQ ID NO: 132739 - DNA, 103 bp, Artificial Sequence
  Synthetic Polynucleotide
taatacgactcactatagggcttatcaagatgcgaactcacattatgtggaacagaggagaccacatatggtgagttcgaacctggcggcagcgcaaaagatg

SEQ ID NO: 132740 - DNA, 103 bp, Artificial Sequence
  Synthetic Polynucleotide
taatacgactcactatagggagcattctgcaaagctagtatctttggattaacagaggagaaatccaatgatactagctaacctggcggcagcgcaaaagatg

SEQ ID NO: 132741 - DNA, 103 bp, Artificial Sequence
  Synthetic Polynucleotide
taatacgactcactataggggctttctctgagcattctgcaaagctagtaaacagaggagatactagatgtgcagaatgaacctggcggcagcgcaaaagatg

SEQ ID NO: 132742 - DNA, 103 bp, Artificial Sequence
  Synthetic Polynucleotide
taatacgactcactatagggtccatttttcgctttctctgagcattctgcaacagaggagagcagaaatgtcagagaaaaacctggcggcagcgcaaaagatg

SEQ ID NO: 132743 - DNA, 103 bp, Artificial Sequence
  Synthetic Polynucleotide
taatacgactcactatagggaccatcatgttccatttttcgctttctctgaacagaggagacagagaatgcgaaaaatgaacctggcggcagcgcaaaagatg

SEQ ID NO: 132744 - DNA, 103 bp, Artificial Sequence
  Synthetic Polynucleotide
taatacgactcactataggggaaaaagtgaaccatcatgttccatttttcaacagaggagagaaaaaatgaacatgatgaacctggcggcagcgcaaaagatg

SEQ ID NO: 132745 - DNA, 103 bp, Artificial Sequence
  Synthetic Polynucleotide
taatacgactcactatagggcctactgcttgaaaaagtgaaccatcatgtaacagaggagaacatgaatgttcacttttaacctggcggcagcgcaaaagatg

SEQ ID NO: 132746 - DNA, 103 bp, Artificial Sequence
  Synthetic Polynucleotide
taatacgactcactatagggtgttccaattcctactgcttgaaaaagtgaaacagaggagatcacttatgcaagcagtaaacctggcggcagcgcaaaagatg

SEQ ID NO: 132747 - DNA, 103 bp, Artificial Sequence
  Synthetic Polynucleotide
taatacgactcactataggggctgtaataatgttccaattcctactgcttaacagaggagaaagcagatggaattggaaaacctggcggcagcgcaaaagatg

SEQ ID NO: 132748 - DNA, 103 bp, Artificial Sequence
  Synthetic Polynucleotide
taatacgactcactatagggtcgtctggctgctgtaataatgttccaattaacagaggagaaattggatgattattacaaacctggcggcagcgcaaaagatg

SEQ ID NO: 132749 - DNA, 103 bp, Artificial Sequence
  Synthetic Polynucleotide
taatacgactcactatagggagctgcatgatcgtctggctgctgtaataaaacagaggagattattaatgcagccagacaacctggcggcagcgcaaaagatg

SEQ ID NO: 132750 - DNA, 103 bp, Artificial Sequence
  Synthetic Polynucleotide
taatacgactcactatagggtcacagaggccttatcaagatgcgaactcaaacagaggagatgagttatgatcttgataaacctggcggcagcgcaaaagatg

SEQ ID NO: 132751 - DNA, 103 bp, Artificial Sequence
  Synthetic Polynucleotide
taatacgactcactataggggtgatgtagtagctgcatgatcgtctggctaacagaggagaagccagatgatcatgcagaacctggcggcagcgcaaaagatg

SEQ ID NO: 132752 - DNA, 103 bp, Artificial Sequence
  Synthetic Polynucleotide
taatacgactcactatagggttccaagaaagtgatgtagtagctgcatgaaacagaggagatcatgcatgtactacatcaacctggcggcagcgcaaaagatg

SEQ ID NO: 132753 - DNA, 103 bp, Artificial Sequence
  Synthetic Polynucleotide
taatacgactcactatagggttttacacgtttccaagaaagtgatgtagtaacagaggagaactacaatgctttcttggaacctggcggcagcgcaaaagatg

SEQ ID NO: 132754 - DNA, 103 bp, Artificial Sequence
  Synthetic Polynucleotide
taatacgactcactatagggatttgcatccttttacacgtttccaagaaaaacagaggagatttcttatgaacgtgtaaaacctggcggcagcgcaaaagatg

SEQ ID NO: 132755 - DNA, 103 bp, Artificial Sequence
  Synthetic Polynucleotide
taatacgactcactatagggtgttcactagatttgcatccttttacacgtaacagaggagaacgtgtatgaggatgcaaaacctggcggcagcgcaaaagatg

SEQ ID NO: 132756 - DNA, 103 bp, Artificial Sequence
  Synthetic Polynucleotide
taatacgactcactatagggcattccattctgttcactagatttgcatccaacagaggagaggatgcatgtctagtgaaaacctggcggcagcgcaaaagatg

SEQ ID NO: 132757 - DNA, 103 bp, Artificial Sequence
  Synthetic Polynucleotide
taatacgactcactatagggtcttttgctccattccattctgttcactagaacagaggagactagtgatgagaatggaaaacctggcggcagcgcaaaagatg

SEQ ID NO: 132758 - DNA, 103 bp, Artificial Sequence
  Synthetic Polynucleotide
taatacgactcactatagggaaaataattgtcttttgctccattccattcaacagaggagagaatggatgggagcaaaaaacctggcggcagcgcaaaagatg

SEQ ID NO: 132759 - DNA, 103 bp, Artificial Sequence
  Synthetic Polynucleotide
taatacgactcactatagggagagggtattaaaataattgtcttttgctcaacagaggagagagcaaatgacaattattaacctggcggcagcgcaaaagatg

SEQ ID NO: 132760 - DNA, 103 bp, Artificial Sequence
  Synthetic Polynucleotide
taatacgactcactatagggatgctaaatcagagggtattaaaataattgaacagaggagacaattaatgtaataccctaacctggcggcagcgcaaaagatg

SEQ ID NO: 132761 - DNA, 103 bp, Artificial Sequence
  Synthetic Polynucleotide
taatacgactcactataggggtaagcctcatcacagaggccttatcaagaaacagaggagatcttgaatgggcctctgtaacctggcggcagcgcaaaagatg

SEQ ID NO: 132762 - DNA, 103 bp, Artificial Sequence
  Synthetic Polynucleotide
taatacgactcactatagggagcagtctacatgctaaatcagagggtattaacagaggagaaataccatgtgatttagcaacctggcggcagcgcaaaagatg

SEQ ID NO: 132763 - DNA, 103 bp, Artificial Sequence
  Synthetic Polynucleotide
taatacgactcactatagggtgattgccccagcagtctacatgctaaatcaacagaggagagatttaatgtgtagactgaacctggcggcagcgcaaaagatg

SEQ ID NO: 132764 - DNA, 103 bp, Artificial Sequence
  Synthetic Polynucleotide
taatacgactcactatagggtttcatccattgattgccccagcagtctacaacagaggagagtagacatgtggggcaataacctggcggcagcgcaaaagatg

SEQ ID NO: 132765 - DNA, 103 bp, Artificial Sequence
  Synthetic Polynucleotide
taatacgactcactatagggggtaatccactttcatccattgattgccccaacagaggagaggggcaatgaatggatgaaacctggcggcagcgcaaaagatg

SEQ ID NO: 132766 - DNA, 103 bp, Artificial Sequence
  Synthetic Polynucleotide
taatacgactcactatagggggtcagctgtggtaatccactttcatccataacagaggagaatggatatgagtggattaaacctggcggcagcgcaaaagatg

SEQ ID NO: 132767 - DNA, 103 bp, Artificial Sequence
  Synthetic Polynucleotide
taatacgactcactatagggaatcataactggtcagctgtggtaatccacaacagaggagagtggatatgcacagctgaaacctggcggcagcgcaaaagatg

SEQ ID NO: 132768 - DNA, 103 bp, Artificial Sequence
  Synthetic Polynucleotide
taatacgactcactatagggttaacttcacaatcataactggtcagctgtaacagaggagaacagctatgcagttatgaaacctggcggcagcgcaaaagatg

SEQ ID NO: 132769 - DNA, 103 bp, Artificial Sequence
  Synthetic Polynucleotide
taatacgactcactatagggtataggagcattaacttcacaatcataactaacagaggagaagttatatgtgtgaagttaacctggcggcagcgcaaaagatg

SEQ ID NO: 132770 - DNA, 103 bp, Artificial Sequence
  Synthetic Polynucleotide
taatacgactcactatagggtgctgccttgtataggagcattaacttcacaacagaggagagtgaagatgatgctcctaaacctggcggcagcgcaaaagatg

SEQ ID NO: 132771 - DNA, 103 bp, Artificial Sequence
  Synthetic Polynucleotide
taatacgactcactatagggagtaggtttctgctgccttgtataggagcaaacagaggagatgctccatgacaaggcagaacctggcggcagcgcaaaagatg

SEQ ID NO: 132772 - DNA, 103 bp, Artificial Sequence
  Synthetic Polynucleotide
taatacgactcactatagggatagctgatggtaagcctcatcacagaggcaacagaggagagcctctatgatgaggcttaacctggcggcagcgcaaaagatg

SEQ ID NO: 132773 - DNA, 103 bp, Artificial Sequence
  Synthetic Polynucleotide
taatacgactcactatagggttcaccctgcagtaggtttctgctgccttgaacagaggagacaaggcatgagaaacctaaacctggcggcagcgcaaaagatg

SEQ ID NO: 132774 - DNA, 103 bp, Artificial Sequence
  Synthetic Polynucleotide
taatacgactcactatagggtgagtaattcttcaccctgcagtaggtttcaacagaggagagaaaccatgtgcagggtgaacctggcggcagcgcaaaagatg

SEQ ID NO: 132775 - DNA, 103 bp, Artificial Sequence
  Synthetic Polynucleotide
taatacgactcactatagggtccaaagctctgagtaattcttcaccctgcaacagaggagagcagggatgagaattactaacctggcggcagcgcaaaagatg

SEQ ID NO: 132776 - DNA, 103 bp, Artificial Sequence
  Synthetic Polynucleotide
taatacgactcactataggggttaacttgatccaaagctctgagtaattcaacagaggagagaattaatgagagctttgaacctggcggcagcgcaaaagatg

SEQ ID NO: 132777 - DNA, 103 bp, Artificial Sequence
  Synthetic Polynucleotide
taatacgactcactatagggtcacacgcaaatagctgatggtaagcctcaaacagaggagatgaggcatgccatcagctaacctggcggcagcgcaaaagatg

SEQ ID NO: 132778 - DNA, 103 bp, Artificial Sequence
  Synthetic Polynucleotide
taatacgactcactatagggagaagtttcctcacacgcaaatagctgatgaacagaggagacatcagatgtttgcgtgtaacctggcggcagcgcaaaagatg

SEQ ID NO: 132779 - DNA, 103 bp, Artificial Sequence
  Synthetic Polynucleotide
taatacgactcactatagggaccagcatccagaagtttcctcacacgcaaaacagaggagattgcgtatgaggaaacttaacctggcggcagcgcaaaagatg

SEQ ID NO: 132780 - DNA, 103 bp, Artificial Sequence
  Synthetic Polynucleotide
taatacgactcactatagggtatccaaatcaccagcatccagaagtttccaacagaggagaggaaacatgtggatgctgaacctggcggcagcgcaaaagatg

SEQ ID NO: 132781 - DNA, 103 bp, Artificial Sequence
  Synthetic Polynucleotide
taatacgactcactatagggtcttttaaaaagacaaatttgttttccaaaaacagaggagatttggaatgcaaatttgtaacctggcggcagcgcaaaagatg

SEQ ID NO: 132782 - DNA, 103 bp, Artificial Sequence
  Synthetic Polynucleotide
taatacgactcactatagggtcatcttcaatatccaaatcaccagcatccaacagaggagaggatgcatgtgatttggaaacctggcggcagcgcaaaagatg

SEQ ID NO: 132783 - DNA, 103 bp, Artificial Sequence
  Synthetic Polynucleotide
taatacgactcactatagggtgctttcatgtcatcttcaatatccaaatcaacagaggagagatttgatgattgaagataacctggcggcagcgcaaaagatg

SEQ ID NO: 132784 - DNA, 103 bp, Artificial Sequence
  Synthetic Polynucleotide
taatacgactcactatagggaattcatctgtgctttcatgtcatcttcaaaacagaggagattgaagatgacatgaaagaacctggcggcagcgcaaaagatg

SEQ ID NO: 132785 - DNA, 103 bp, Artificial Sequence
  Synthetic Polynucleotide
taatacgactcactatagggaaataaaagcaattcatctgtgctttcatgaacagaggagacatgaaatgacagatgaaaacctggcggcagcgcaaaagatg

SEQ ID NO: 132786 - DNA, 103 bp, Artificial Sequence
  Synthetic Polynucleotide
taatacgactcactatagggcaaggctttcaaataaaagcaattcatctgaacagaggagacagatgatgtgcttttataacctggcggcagcgcaaaagatg

SEQ ID NO: 132787 - DNA, 103 bp, Artificial Sequence
  Synthetic Polynucleotide
taatacgactcactatagggcaaaaccatccaaggctttcaaataaaagcaacagaggagagcttttatgtgaaagcctaacctggcggcagcgcaaaagatg

SEQ ID NO: 132788 - DNA, 103 bp, Artificial Sequence
  Synthetic Polynucleotide
taatacgactcactatagggagaaccataacaaaaccatccaaggctttcaacagaggagagaaagcatgggatggtttaacctggcggcagcgcaaaagatg

SEQ ID NO: 132789 - DNA, 103 bp, Artificial Sequence
  Synthetic Polynucleotide
taatacgactcactatagggatcatctgtgagaaccataacaaaaccatcaacagaggagagatggtatggttatggttaacctggcggcagcgcaaaagatg

SEQ ID NO: 132790 - DNA, 103 bp, Artificial Sequence
  Synthetic Polynucleotide
taatacgactcactatagggtcatgtcaccatcatctgtgagaaccataaaacagaggagattatggatgtcacagatgaacctggcggcagcgcaaaagatg

SEQ ID NO: 132791 - DNA, 103 bp, Artificial Sequence
  Synthetic Polynucleotide
taatacgactcactataggggaaatgtaaatcatgtcaccatcatctgtgaacagaggagacacagaatgtggtgacataacctggcggcagcgcaaaagatg

SEQ ID NO: 132792 - DNA, 103 bp, Artificial Sequence
  Synthetic Polynucleotide
taatacgactcactatagggtcctagaccttcttttaaaaagacaaatttaacagaggagaaaatttatgtttttaaaaaacctggcggcagcgcaaaagatg

SEQ ID NO: 132793 - DNA, 103 bp, Artificial Sequence
  Synthetic Polynucleotide
taatacgactcactatagggcacattatcagaaatgtaaatcatgtcaccaacagaggagaggtgacatgatttacattaacctggcggcagcgcaaaagatg

SEQ ID NO: 132794 - DNA, 103 bp, Artificial Sequence
  Synthetic Polynucleotide
taatacgactcactatagggtgtatttgttcacattatcagaaatgtaaaaacagaggagatttacaatgctgataatgaacctggcggcagcgcaaaagatg

SEQ ID NO: 132795 - DNA, 103 bp, Artificial Sequence
  Synthetic Polynucleotide
taatacgactcactataggggttaatcccatgtatttgttcacattatcaaacagaggagatgataaatggaacaaataaacctggcggcagcgcaaaagatg

SEQ ID NO: 132796 - DNA, 103 bp, Artificial Sequence
  Synthetic Polynucleotide
taatacgactcactatagggttcaaactgagttaatcccatgtatttgttaacagaggagaaacaaaatgatgggattaaacctggcggcagcgcaaaagatg

SEQ ID NO: 132797 - DNA, 103 bp, Artificial Sequence
  Synthetic Polynucleotide
taatacgactcactataggggtccagttagttcaaactgagttaatcccaaacagaggagatgggatatgctcagtttgaacctggcggcagcgcaaaagatg

SEQ ID NO: 132798 - DNA, 103 bp, Artificial Sequence
  Synthetic Polynucleotide
taatacgactcactatagggaacacactgtgtccagttagttcaaactgaaacagaggagatcagttatgactaactggaacctggcggcagcgcaaaagatg

SEQ ID NO: 132799 - DNA, 103 bp, Artificial Sequence
  Synthetic Polynucleotide
taatacgactcactatagggagtaaaatcaaacacactgtgtccagttagaacagaggagactaactatgcacagtgtgaacctggcggcagcgcaaaagatg

SEQ ID NO: 132800 - DNA, 103 bp, Artificial Sequence
  Synthetic Polynucleotide
taatacgactcactatagggcacatggatgagtaaaatcaaacacactgtaacagaggagaacagtgatgttgattttaaacctggcggcagcgcaaaagatg

SEQ ID NO: 132801 - DNA, 103 bp, Artificial Sequence
  Synthetic Polynucleotide
taatacgactcactatagggtcctcatggtcacatggatgagtaaaatcaaacagaggagatgatttatgtcatccatgaacctggcggcagcgcaaaagatg

SEQ ID NO: 132802 - DNA, 103 bp, Artificial Sequence
  Synthetic Polynucleotide
taatacgactcactatagggttctctcatttcctcatggtcacatggatgaacagaggagacatccaatggaccatgagaacctggcggcagcgcaaaagatg

SEQ ID NO: 132803 - DNA, 103 bp, Artificial Sequence
  Synthetic Polynucleotide
taatacgactcactataggggttttgagtttcctagaccttcttttaaaaaacagaggagattttaaatgaaggtctagaacctggcggcagcgcaaaagatg

SEQ ID NO: 132804 - DNA, 103 bp, Artificial Sequence
  Synthetic Polynucleotide
taatacgactcactataggggtgtaagcatttctctcatttcctcatggtaacagaggagaaccatgatgaaatgagagaacctggcggcagcgcaaaagatg

SEQ ID NO: 132805 - DNA, 103 bp, Artificial Sequence
  Synthetic Polynucleotide
taatacgactcactatagggccatttctgtgtgtaagcatttctctcattaacagaggagaaatgagatgaatgcttacaacctggcggcagcgcaaaagatg

SEQ ID NO: 132806 - DNA, 103 bp, Artificial Sequence
  Synthetic Polynucleotide
taatacgactcactatagggtttcacaaggccatttctgtgtgtaagcataacagaggagaatgcttatgcacagaaataacctggcggcagcgcaaaagatg

SEQ ID NO: 132807 - DNA, 103 bp, Artificial Sequence
  Synthetic Polynucleotide
taatacgactcactatagggctttaccctttttcacaaggccatttctgtaacagaggagaacagaaatggccttgtgaaacctggcggcagcgcaaaagatg

SEQ ID NO: 132808 - DNA, 103 bp, Artificial Sequence
  Synthetic Polynucleotide
taatacgactcactataggggtgttttgttctttaccctttttcacaaggaacagaggagaccttgtatgaaagggtaaaacctggcggcagcgcaaaagatg

SEQ ID NO: 132809 - DNA, 103 bp, Artificial Sequence
  Synthetic Polynucleotide
taatacgactcactataggggcttcgctgtgtgttttgttctttacccttaacagaggagaaagggtatggaacaaaacaacctggcggcagcgcaaaagatg

SEQ ID NO: 132810 - DNA, 103 bp, Artificial Sequence
  Synthetic Polynucleotide
taatacgactcactatagggtgagaaaaaagcttcgctgtgtgttttgttaacagaggagaaacaaaatgcacagcgaaaacctggcggcagcgcaaaagatg

SEQ ID NO: 132811 - DNA, 103 bp, Artificial Sequence
  Synthetic Polynucleotide
taatacgactcactatagggcacttcattctgagaaaaaagcttcgctgtaacagaggagaacagcgatgcttttttctaacctggcggcagcgcaaaagatg

SEQ ID NO: 132812 - DNA, 103 bp, Artificial Sequence
  Synthetic Polynucleotide
taatacgactcactatagggagttagggtacacttcattctgagaaaaaaaacagaggagattttttatgagaatgaagaacctggcggcagcgcaaaagatg

SEQ ID NO: 132813 - DNA, 103 bp, Artificial Sequence
  Synthetic Polynucleotide
taatacgactcactatagggttcctcggctagttagggtacacttcattcaacagaggagagaatgaatggtaccctaaaacctggcggcagcgcaaaagatg

SEQ ID NO: 132814 - DNA, 103 bp, Artificial Sequence
  Synthetic Polynucleotide
taatacgactcactatagggaattcttcaggttttgagtttcctagacctaacagaggagaaggtctatgaaactcaaaaacctggcggcagcgcaaaagatg

SEQ ID NO: 132815 - DNA, 103 bp, Artificial Sequence
  Synthetic Polynucleotide
taatacgactcactatagggttcatagttcttcctcggctagttagggtaaacagaggagataccctatgtagccgaggaacctggcggcagcgcaaaagatg

SEQ ID NO: 132816 - DNA, 103 bp, Artificial Sequence
  Synthetic Polynucleotide
taatacgactcactatagggagactttatgttcatagttcttcctcggctaacagaggagaagccgaatgagaactatgaacctggcggcagcgcaaaagatg

SEQ ID NO: 132817 - DNA, 103 bp, Artificial Sequence
  Synthetic Polynucleotide
taatacgactcactatagggtccatgttgcagactttatgttcatagttcaacagaggagagaactaatgacataaagtaacctggcggcagcgcaaaagatg

SEQ ID NO: 132818 - DNA, 103 bp, Artificial Sequence
  Synthetic Polynucleotide
taatacgactcactatagggtgcaataccttccatgttgcagactttatgaacagaggagacataaaatgtgcaacatgaacctggcggcagcgcaaaagatg

SEQ ID NO: 132819 - DNA, 103 bp, Artificial Sequence
  Synthetic Polynucleotide
taatacgactcactataggggcctgtgcagtgcaataccttccatgttgcaacagaggagagcaacaatgaaggtattgaacctggcggcagcgcaaaagatg

SEQ ID NO: 132820 - DNA, 103 bp, Artificial Sequence
  Synthetic Polynucleotide
taatacgactcactatagggcgtgaatgtggcctgtgcagtgcaatacctaacagaggagaaggtatatgactgcacagaacctggcggcagcgcaaaagatg

SEQ ID NO: 132821 - DNA, 103 bp, Artificial Sequence
  Synthetic Polynucleotide
taatacgactcactataggggtatcatatacgtgaatgtggcctgtgcagaacagaggagactgcacatgccacattcaaacctggcggcagcgcaaaagatg

SEQ ID NO: 132822 - DNA, 103 bp, Artificial Sequence
  Synthetic Polynucleotide
taatacgactcactataggggttactgttggtatcatatacgtgaatgtgaacagaggagacacattatggtatatgataacctggcggcagcgcaaaagatg

SEQ ID NO: 132823 - DNA, 103 bp, Artificial Sequence
  Synthetic Polynucleotide
taatacgactcactatagggactgaggttggttactgttggtatcatataaacagaggagatatatgatgccaacagtaaacctggcggcagcgcaaaagatg

SEQ ID NO: 132824 - DNA, 103 bp, Artificial Sequence
  Synthetic Polynucleotide
taatacgactcactatagggttatacccacactgaggttggttactgttgaacagaggagacaacagatgccaacctcaaacctggcggcagcgcaaaagatg

SEQ ID NO: 132825 - DNA, 103 bp, Artificial Sequence
  Synthetic Polynucleotide
taatacgactcactataggggatttcttccaattcttcaggttttgagttaacagaggagaaactcaatgcctgaagaaaacctggcggcagcgcaaaagatg

SEQ ID NO: 132826 - DNA, 103 bp, Artificial Sequence
  Synthetic Polynucleotide
taatacgactcactatagggaggtggtttcttatacccacactgaggttgaacagaggagacaacctatgtgtgggtataacctggcggcagcgcaaaagatg

SEQ ID NO: 132827 - DNA, 103 bp, Artificial Sequence
  Synthetic Polynucleotide
taatacgactcactatagggagcaggtcataggtggtttcttatacccacaacagaggagagtgggtatgagaaaccacaacctggcggcagcgcaaaagatg

SEQ ID NO: 132828 - DNA, 103 bp, Artificial Sequence
  Synthetic Polynucleotide
taatacgactcactatagggatcagcaccaagcaggtcataggtggtttcaacagaggagagaaaccatgtatgacctgaacctggcggcagcgcaaaagatg

SEQ ID NO: 132829 - DNA, 103 bp, Artificial Sequence
  Synthetic Polynucleotide
taatacgactcactataggggggttcacaaatcagcaccaagcaggtcataacagaggagaatgaccatgttggtgctgaacctggcggcagcgcaaaagatg

SEQ ID NO: 132830 - DNA, 103 bp, Artificial Sequence
  Synthetic Polynucleotide
taatacgactcactatagggggtgaggaatgggttcacaaatcagcaccaaacagaggagatggtgcatgtttgtgaacaacctggcggcagcgcaaaagatg

SEQ ID NO: 132831 - DNA, 103 bp, Artificial Sequence
  Synthetic Polynucleotide
taatacgactcactatagggatatttgatgggtgaggaatgggttcacaaaacagaggagattgtgaatgcattcctcaaacctggcggcagcgcaaaagatg

SEQ ID NO: 132832 - DNA, 103 bp, Artificial Sequence
  Synthetic Polynucleotide
taatacgactcactatagggaggaatttcaatatttgatgggtgaggaataacagaggagaattcctatgccatcaaataacctggcggcagcgcaaaagatg

SEQ ID NO: 132833 - DNA, 103 bp, Artificial Sequence
  Synthetic Polynucleotide
taatacgactcactatagggtgctatctaaaggaatttcaatatttgatgaacagaggagacatcaaatgttgaaattcaacctggcggcagcgcaaaagatg

SEQ ID NO: 132834 - DNA, 103 bp, Artificial Sequence
  Synthetic Polynucleotide
taatacgactcactatagggaggaaagtcttgctatctaaaggaatttcaaacagaggagatgaaatatgtttagatagaacctggcggcagcgcaaaagatg

SEQ ID NO: 132835 - DNA, 103 bp, Artificial Sequence
  Synthetic Polynucleotide
taatacgactcactataggggtgtcgactgaggaaagtcttgctatctaaaacagaggagattagatatgaagactttcaacctggcggcagcgcaaaagatg

SEQ ID NO: 132836 - DNA, 103 bp, Artificial Sequence
  Synthetic Polynucleotide
taatacgactcactatagggtttctattctgatttcttccaattcttcagaacagaggagactgaagatgtggaagaaaaacctggcggcagcgcaaaagatg

SEQ ID NO: 132837 - DNA, 103 bp, Artificial Sequence
  Synthetic Polynucleotide
taatacgactcactatagggtatccaggctgtgtcgactgaggaaagtctaacagaggagaagacttatgtcagtcgacaacctggcggcagcgcaaaagatg

SEQ ID NO: 132838 - DNA, 103 bp, Artificial Sequence
  Synthetic Polynucleotide
taatacgactcactataggggaaaatttcatatccaggctgtgtcgactgaacagaggagacagtcgatgcagcctggaaacctggcggcagcgcaaaagatg

SEQ ID NO: 132839 - DNA, 103 bp, Artificial Sequence
  Synthetic Polynucleotide
taatacgactcactatagggatcacaataagaaaatttcatatccaggctaacagaggagaagcctgatgatgaaatttaacctggcggcagcgcaaaagatg

SEQ ID NO: 132840 - DNA, 103 bp, Artificial Sequence
  Synthetic Polynucleotide
taatacgactcactatagggtaattctttcatcacaataagaaaatttcaaacagaggagatgaaatatgcttattgtgaacctggcggcagcgcaaaagatg

SEQ ID NO: 132841 - DNA, 103 bp, Artificial Sequence
  Synthetic Polynucleotide
taatacgactcactatagggatcaattcggtaattctttcatcacaataaaacagaggagattattgatgtgaaagaataacctggcggcagcgcaaaagatg

SEQ ID NO: 132842 - DNA, 103 bp, Artificial Sequence
  Synthetic Polynucleotide
taatacgactcactatagggctcatatcccatcaattcggtaattctttcaacagaggagagaaagaatgaccgaattgaacctggcggcagcgcaaaagatg

SEQ ID NO: 132843 - DNA, 103 bp, Artificial Sequence
  Synthetic Polynucleotide
taatacgactcactataggggttcttctggctcatatcccatcaattcggaacagaggagaccgaatatgtgggatatgaacctggcggcagcgcaaaagatg

SEQ ID NO: 132844 - DNA, 103 bp, Artificial Sequence
  Synthetic Polynucleotide
taatacgactcactatagggcggcctaaaagttcttctggctcatatcccaacagaggagagggataatggccagaagaaacctggcggcagcgcaaaagatg

SEQ ID NO: 132845 - DNA, 103 bp, Artificial Sequence
  Synthetic Polynucleotide
taatacgactcactatagggataaattgagcggcctaaaagttcttctggaacagaggagaccagaaatgcttttaggcaacctggcggcagcgcaaaagatg

SEQ ID NO: 132846 - DNA, 103 bp, Artificial Sequence
  Synthetic Polynucleotide
taatacgactcactataggggataatattcataaattgagcggcctaaaaaacagaggagattttagatggctcaatttaacctggcggcagcgcaaaagatg

SEQ ID NO: 132847 - DNA, 103 bp, Artificial Sequence
  Synthetic Polynucleotide
taatacgactcactatagggatcctaccattttctattctgatttcttccaacagaggagaggaagaatgcagaatagaaacctggcggcagcgcaaaagatg

SEQ ID NO: 132848 - DNA, 103 bp, Artificial Sequence
  Synthetic Polynucleotide
taatacgactcactatagggtccaaagcatgataatattcataaattgagaacagaggagactcaatatgtgaatattaaacctggcggcagcgcaaaagatg

SEQ ID NO: 132849 - DNA, 103 bp, Artificial Sequence
  Synthetic Polynucleotide
taatacgactcactatagggatgatcagagtccaaagcatgataatattcaacagaggagagaatatatgcatgctttgaacctggcggcagcgcaaaagatg

SEQ ID NO: 132850 - DNA, 103 bp, Artificial Sequence
  Synthetic Polynucleotide
taatacgactcactatagggttttggtcagatgatcagagtccaaagcataacagaggagaatgcttatgactctgatcaacctggcggcagcgcaaaagatg

SEQ ID NO: 132851 - DNA, 103 bp, Artificial Sequence
  Synthetic Polynucleotide
taatacgactcactatagggtcatgatgagttttggtcagatgatcagagaacagaggagactctgaatgtctgaccaaaacctggcggcagcgcaaaagatg

SEQ ID NO: 132852 - DNA, 103 bp, Artificial Sequence
  Synthetic Polynucleotide
taatacgactcactatagggagtaaacatatcatgatgagttttggtcagaacagaggagactgaccatgactcatcataacctggcggcagcgcaaaagatg

SEQ ID NO: 132853 - DNA, 103 bp, Artificial Sequence
  Synthetic Polynucleotide
taatacgactcactatagggcttgtcctttagtaaacatatcatgatgagaacagaggagactcatcatgatatgtttaaacctggcggcagcgcaaaagatg

SEQ ID NO: 132854 - DNA, 103 bp, Artificial Sequence
  Synthetic Polynucleotide
taatacgactcactatagggcctgtggtgacttgtcctttagtaaacataaacagaggagatatgttatgtaaaggacaaacctggcggcagcgcaaaagatg

SEQ ID NO: 132855 - DNA, 103 bp, Artificial Sequence
  Synthetic Polynucleotide
taatacgactcactatagggcctgtactgtcctgtggtgacttgtcctttaacagaggagaaaaggaatggtcaccacaaacctggcggcagcgcaaaagatg

SEQ ID NO: 132856 - DNA, 103 bp, Artificial Sequence
  Synthetic Polynucleotide
taatacgactcactatagggtggcaagcatcctgtactgtcctgtggtgaaacagaggagatcaccaatggacagtacaaacctggcggcagcgcaaaagatg

SEQ ID NO: 132857 - DNA, 103 bp, Artificial Sequence
  Synthetic Polynucleotide
taatacgactcactatagggccacctcttttggcaagcatcctgtactgtaacagaggagaacagtaatggatgcttgcaacctggcggcagcgcaaaagatg

SEQ ID NO: 132858 - DNA, 103 bp, Artificial Sequence
  Synthetic Polynucleotide
taatacgactcactatagggctttcggggaactttcccaggaggcggcataacagaggagaatgccgatgcctgggaaaaacctggcggcagcgcaaaagatg

SEQ ID NO: 132859 - DNA, 103 bp, Artificial Sequence
  Synthetic Polynucleotide
taatacgactcactatagggcaggtgctgagtgacatgctcaaagaacttaacagaggagaaagttcatggagcatgtcaacctggcggcagcgcaaaagatg

SEQ ID NO: 132860 - DNA, 103 bp, Artificial Sequence
  Synthetic Polynucleotide
taatacgactcactataggggtctccttcatgtactttgcggtaatgggaaacagaggagatcccatatgcgcaaagtaaacctggcggcagcgcaaaagatg

SEQ ID NO: 132861 - DNA, 103 bp, Artificial Sequence
  Synthetic Polynucleotide
taatacgactcactatagggttggctcagagtctccttcatgtactttgcaacagaggagagcaaagatgatgaaggagaacctggcggcagcgcaaaagatg

SEQ ID NO: 132862 - DNA, 103 bp, Artificial Sequence
  Synthetic Polynucleotide
taatacgactcactatagggcatttgtaccttggctcagagtctccttcaaacagaggagatgaaggatgctctgagccaacctggcggcagcgcaaaagatg

SEQ ID NO: 132863 - DNA, 103 bp, Artificial Sequence
  Synthetic Polynucleotide
taatacgactcactatagggacacacatgacatttgtaccttggctcagaaacagaggagatctgagatgaggtacaaaaacctggcggcagcgcaaaagatg

SEQ ID NO: 132864 - DNA, 103 bp, Artificial Sequence
  Synthetic Polynucleotide
taatacgactcactatagggagcatttgtcacacacatgacatttgtaccaacagaggagaggtacaatggtcatgtgtaacctggcggcagcgcaaaagatg

SEQ ID NO: 132865 - DNA, 103 bp, Artificial Sequence
  Synthetic Polynucleotide
taatacgactcactatagggccccgtgtgaagcatttgtcacacacatgaaacagaggagatcatgtatgtgacaaatgaacctggcggcagcgcaaaagatg

SEQ ID NO: 132866 - DNA, 103 bp, Artificial Sequence
  Synthetic Polynucleotide
taatacgactcactataggggaggttgttgccccgtgtgaagcatttgtcaacagaggagagacaaaatgttcacacggaacctggcggcagcgcaaaagatg

SEQ ID NO: 132867 - DNA, 103 bp, Artificial Sequence
  Synthetic Polynucleotide
taatacgactcactatagggggtgcacggtgaggttgttgccccgtgtgaaacagaggagatcacacatggcaacaaccaacctggcggcagcgcaaaagatg

SEQ ID NO: 132868 - DNA, 103 bp, Artificial Sequence
  Synthetic Polynucleotide
taatacgactcactatagggttcttgcgaaggtgcacggtgaggttgttgaacagaggagacaacaaatgcaccgtgcaaacctggcggcagcgcaaaagatg

SEQ ID NO: 132869 - DNA, 103 bp, Artificial Sequence
  Synthetic Polynucleotide
taatacgactcactataggggaactggtgcttcttgcgaaggtgcacggtaacagaggagaaccgtgatgcttcgcaagaacctggcggcagcgcaaaagatg

SEQ ID NO: 132870 - DNA, 103 bp, Artificial Sequence
  Synthetic Polynucleotide
taatacgactcactatagggggtgctgctgcaggtgctgagtgacatgctaacagaggagaagcatgatgctcagcaccaacctggcggcagcgcaaaagatg

SEQ ID NO: 132871 - DNA, 103 bp, Artificial Sequence
  Synthetic Polynucleotide
taatacgactcactatagggagggccacttgaactggtgcttcttgcgaaaacagaggagattcgcaatgagcaccagtaacctggcggcagcgcaaaagatg

SEQ ID NO: 132872 - DNA, 103 bp, Artificial Sequence
  Synthetic Polynucleotide
taatacgactcactatagggggatgccctgagggccacttgaactggtgcaacagaggagagcaccaatgcaagtggccaacctggcggcagcgcaaaagatg

SEQ ID NO: 132873 - DNA, 103 bp, Artificial Sequence
  Synthetic Polynucleotide
taatacgactcactatagggccgaaaacggggatgccctgagggccacttaacagaggagaaagtggatgtcagggcataacctggcggcagcgcaaaagatg

SEQ ID NO: 132874 - DNA, 103 bp, Artificial Sequence
  Synthetic Polynucleotide
taatacgactcactataggggttccttgtaccgaaaacggggatgccctgaacagaggagacagggcatgcccgttttcaacctggcggcagcgcaaaagatg

SEQ ID NO: 132875 - DNA, 103 bp, Artificial Sequence
  Synthetic Polynucleotide
taatacgactcactatagggccatcttcatgttccttgtaccgaaaacggaacagaggagaccgtttatggtacaaggaaacctggcggcagcgcaaaagatg

SEQ ID NO: 132876 - DNA, 103 bp, Artificial Sequence
  Synthetic Polynucleotide
taatacgactcactatagggccgcatatagccatcttcatgttccttgtaaacagaggagatacaagatgcatgaagataacctggcggcagcgcaaaagatg

SEQ ID NO: 132877 - DNA, 103 bp, Artificial Sequence
  Synthetic Polynucleotide
taatacgactcactatagggccagctgcagccgcatatagccatcttcataacagaggagaatgaagatggctatatgcaacctggcggcagcgcaaaagatg

SEQ ID NO: 132878 - DNA, 103 bp, Artificial Sequence
  Synthetic Polynucleotide
taatacgactcactatagggtcgtagcgaaccagctgcagccgcatatagaacagaggagactatatatggctgcagctaacctggcggcagcgcaaaagatg

SEQ ID NO: 132879 - DNA, 103 bp, Artificial Sequence
  Synthetic Polynucleotide
taatacgactcactatagggctctacactctcgtagcgaaccagctgcagaacagaggagactgcagatggttcgctacaacctggcggcagcgcaaaagatg

SEQ ID NO: 132880 - DNA, 103 bp, Artificial Sequence
  Synthetic Polynucleotide
taatacgactcactataggggctgtgtcagctctacactctcgtagcgaaaacagaggagattcgctatgagagtgtagaacctggcggcagcgcaaaagatg

SEQ ID NO: 132881 - DNA, 103 bp, Artificial Sequence
  Synthetic Polynucleotide
taatacgactcactataggggagccatgcaggtgctgctgcaggtgctgaaacagaggagatcagcaatggcagcagcaaacctggcggcagcgcaaaagatg

SEQ ID NO: 132882 - DNA, 103 bp, Artificial Sequence
  Synthetic Polynucleotide
taatacgactcactatagggcgcagcagttgctgtgtcagctctacactcaacagaggagagagtgtatggctgacacaaacctggcggcagcgcaaaagatg

SEQ ID NO: 132883 - DNA, 103 bp, Artificial Sequence
  Synthetic Polynucleotide
taatacgactcactatagggttgtggttgccgcagcagttgctgtgtcagaacagaggagactgacaatgcaactgctgaacctggcggcagcgcaaaagatg

SEQ ID NO: 132884 - DNA, 103 bp, Artificial Sequence
  Synthetic Polynucleotide
taatacgactcactatagggccgatccctcttgtggttgccgcagcagttaacagaggagaaactgcatgggcaaccacaacctggcggcagcgcaaaagatg

SEQ ID NO: 132885 - DNA, 103 bp, Artificial Sequence
  Synthetic Polynucleotide
taatacgactcactataggggttcccaggcccgatccctcttgtggttgcaacagaggagagcaaccatgagagggatcaacctggcggcagcgcaaaagatg

SEQ ID NO: 132886 - DNA, 103 bp, Artificial Sequence
  Synthetic Polynucleotide
taatacgactcactataggggttcagcgacgttcccaggcccgatccctcaacagaggagagagggaatgggcctgggaaacctggcggcagcgcaaaagatg

SEQ ID NO: 132887 - DNA, 103 bp, Artificial Sequence
  Synthetic Polynucleotide
taatacgactcactatagggggctgctctcgttcagcgacgttcccaggcaacagaggagagcctggatgcgtcgctgaaacctggcggcagcgcaaaagatg

SEQ ID NO: 132888 - DNA, 103 bp, Artificial Sequence
  Synthetic Polynucleotide
taatacgactcactatagggatgccctgcaggctgctctcgttcagcgacaacagaggagagtcgctatgcgagagcagaacctggcggcagcgcaaaagatg

SEQ ID NO: 132889 - DNA, 103 bp, Artificial Sequence
  Synthetic Polynucleotide
taatacgactcactatagggttctagaataatgccctgcaggctgctctcaacagaggagagagagcatgctgcagggcaacctggcggcagcgcaaaagatg

SEQ ID NO: 132890 - DNA, 103 bp, Artificial Sequence
  Synthetic Polynucleotide
taatacgactcactatagggctggcactgtttctagaataatgccctgcaaacagaggagatgcaggatgttattctagaacctggcggcagcgcaaaagatg

SEQ ID NO: 132891 - DNA, 103 bp, Artificial Sequence
  Synthetic Polynucleotide
taatacgactcactatagggcctggctcccctggcactgtttctagaataaacagaggagatattctatgaacagtgccaacctggcggcagcgcaaaagatg

SEQ ID NO: 132892 - DNA, 103 bp, Artificial Sequence
  Synthetic Polynucleotide
taatacgactcactatagggctcctccccagagccatgcaggtgctgctgaacagaggagacagcagatgctgcatggcaacctggcggcagcgcaaaagatg

SEQ ID NO: 132893 - DNA, 103 bp, Artificial Sequence
  Synthetic Polynucleotide
taatacgactcactatagggttccttacgtcctggctcccctggcactgtaacagaggagaacagtgatgggggagccaaacctggcggcagcgcaaaagatg

SEQ ID NO: 132894 - DNA, 103 bp, Artificial Sequence
  Synthetic Polynucleotide
taatacgactcactatagggcctcttcctcttccttacgtcctggctcccaacagaggagagggagcatggacgtaaggaacctggcggcagcgcaaaagatg

SEQ ID NO: 132895 - DNA, 103 bp, Artificial Sequence
  Synthetic Polynucleotide
taatacgactcactatagggcccttgccctcctcttcctcttccttacgtaacagaggagaacgtaaatgagaggaagaaacctggcggcagcgcaaaagatg

SEQ ID NO: 132896 - DNA, 103 bp, Artificial Sequence
  Synthetic Polynucleotide
taatacgactcactatagggcccttcgctacccttgccctcctcttcctcaacagaggagagaggaaatggagggcaagaacctggcggcagcgcaaaagatg

SEQ ID NO: 132897 - DNA, 103 bp, Artificial Sequence
  Synthetic Polynucleotide
taatacgactcactatagggagagggctgtcccttcgctacccttgccctaacagaggagaagggcaatggtagcgaagaacctggcggcagcgcaaaagatg

SEQ ID NO: 132898 - DNA, 103 bp, Artificial Sequence
  Synthetic Polynucleotide
taatacgactcactatagggtgagaggctgagagggctgtcccttcgctaaacagaggagatagcgaatggacagccctaacctggcggcagcgcaaaagatg

SEQ ID NO: 132899 - DNA, 103 bp, Artificial Sequence
  Synthetic Polynucleotide
taatacgactcactatagggggggttgtcctgagaggctgagagggctgtaacagaggagaacagccatgtcagcctctaacctggcggcagcgcaaaagatg

SEQ ID NO: 132900 - DNA, 103 bp, Artificial Sequence
  Synthetic Polynucleotide
taatacgactcactatagggtgacagaactggggttgtcctgagaggctgaacagaggagacagcctatgaggacaaccaacctggcggcagcgcaaaagatg

SEQ ID NO: 132901 - DNA, 103 bp, Artificial Sequence
  Synthetic Polynucleotide
taatacgactcactatagggaccacgtggatgacagaactggggttgtccaacagaggagaggacaaatgcagttctgtaacctggcggcagcgcaaaagatg

SEQ ID NO: 132902 - DNA, 103 bp, Artificial Sequence
  Synthetic Polynucleotide
taatacgactcactatagggggtctgattcaccacgtggatgacagaactaacagaggagaagttctatgatccacgtgaacctggcggcagcgcaaaagatg

SEQ ID NO: 132903 - DNA, 103 bp, Artificial Sequence
  Synthetic Polynucleotide
taatacgactcactatagggcctcttcctcctcctccccagagccatgcaaacagaggagatgcatgatgctggggaggaacctggcggcagcgcaaaagatg

SEQ ID NO: 132904 - DNA, 103 bp, Artificial Sequence
  Synthetic Polynucleotide
taatacgactcactatagggcttgggcattggtctgattcaccacgtggaaacagaggagatccacgatgtgaatcagaaacctggcggcagcgcaaaagatg

SEQ ID NO: 132905 - DNA, 103 bp, Artificial Sequence
  Synthetic Polynucleotide
taatacgactcactatagggtcttgctggccttgggcattggtctgattcaacagaggagagaatcaatgcaatgcccaaacctggcggcagcgcaaaagatg

SEQ ID NO: 132906 - DNA, 103 bp, Artificial Sequence
  Synthetic Polynucleotide
taatacgactcactataggggtagacgatctcttgctggccttgggcattaacagaggagaaatgccatgggccagcaaaacctggcggcagcgcaaaagatg

SEQ ID NO: 132907 - DNA, 103 bp, Artificial Sequence
  Synthetic Polynucleotide
taatacgactcactatagggacagcacatagtagacgatctcttgctggcaacagaggagagccagcatgagatcgtctaacctggcggcagcgcaaaagatg

SEQ ID NO: 132908 - DNA, 103 bp, Artificial Sequence
  Synthetic Polynucleotide
taatacgactcactatagggggggcttcagacagcacatagtagacgatcaacagaggagagatcgtatgctatgtgctaacctggcggcagcgcaaaagatg

SEQ ID NO: 132909 - DNA, 103 bp, Artificial Sequence
  Synthetic Polynucleotide
taatacgactcactatagggaggctcccctggggcttcagacagcacataaacagaggagatatgtgatgtctgaagccaacctggcggcagcgcaaaagatg

SEQ ID NO: 132910 - DNA, 103 bp, Artificial Sequence
  Synthetic Polynucleotide
taatacgactcactataggggggctgggggaggctcccctggggcttcagaacagaggagactgaagatgcaggggagcaacctggcggcagcgcaaaagatg

SEQ ID NO: 132911 - DNA, 103 bp, Artificial Sequence
  Synthetic Polynucleotide
taatacgactcactatagggggtggctcaggggctgggggaggctcccctaacagaggagaaggggaatgtcccccagcaacctggcggcagcgcaaaagatg

SEQ ID NO: 132912 - DNA, 103 bp, Artificial Sequence
  Synthetic Polynucleotide
taatacgactcactataggggccccctgaaggtggctcaggggctgggggaacagaggagacccccaatgcctgagccaaacctggcggcagcgcaaaagatg

SEQ ID NO: 132913 - DNA, 103 bp, Artificial Sequence
  Synthetic Polynucleotide
taatacgactcactatagggtttccatgatgccccctgaaggtggctcagaacagaggagactgagcatgcttcaggggaacctggcggcagcgcaaaagatg

SEQ ID NO: 132914 - DNA, 103 bp, Artificial Sequence
  Synthetic Polynucleotide
taatacgactcactatagggtcctcctcttcctcttcctcctcctccccaaacagaggagatggggaatgggaggaagaaacctggcggcagcgcaaaagatg

SEQ ID NO: 132915 - DNA, 103 bp, Artificial Sequence
  Synthetic Polynucleotide
taatacgactcactatagggccttgaagcttttccatgatgccccctgaaaacagaggagattcaggatgcatcatggaaacctggcggcagcgcaaaagatg

SEQ ID NO: 132916 - DNA, 103 bp, Artificial Sequence
  Synthetic Polynucleotide
taatacgactcactatagggctcagctattccttgaagcttttccatgataacagaggagaatcatgatgaagcttcaaaacctggcggcagcgcaaaagatg

SEQ ID NO: 132917 - DNA, 103 bp, Artificial Sequence
  Synthetic Polynucleotide
taatacgactcactatagggtctctggctcctcagctattccttgaagctaacagaggagaagcttcatggaatagctgaacctggcggcagcgcaaaagatg

SEQ ID NO: 132918 - DNA, 103 bp, Artificial Sequence
  Synthetic Polynucleotide
taatacgactcactatagggaccatctggatctctggctcctcagctattaacagaggagaaatagcatgggagccagaaacctggcggcagcgcaaaagatg

SEQ ID NO: 132919 - DNA, 103 bp, Artificial Sequence
  Synthetic Polynucleotide
taatacgactcactatagggaagtgggtcatcctcctcttcctcttcctcaacagaggagagaggaaatggaagaggagaacctggcggcagcgcaaaagatg

SEQ ID NO: 132920 - DNA, 103 bp, Artificial Sequence
  Synthetic Polynucleotide
taatacgactcactatagggattcttcctcaagtgggtcatcctcctcttaacagaggagaaagaggatgatgacccacaacctggcggcagcgcaaaagatg

SEQ ID NO: 132921 - DNA, 103 bp, Artificial Sequence
  Synthetic Polynucleotide
taatacgactcactatagggaagcaggagaattcttcctcaagtgggtcaaacagaggagatgacccatgtgaggaagaaacctggcggcagcgcaaaagatg

SEQ ID NO: 132922 - DNA, 103 bp, Artificial Sequence
  Synthetic Polynucleotide
taatacgactcactatagggttcctgccacaagcaggagaattcttcctcaacagaggagagaggaaatgttctcctgcaacctggcggcagcgcaaaagatg

SEQ ID NO: 132923 - DNA, 103 bp, Artificial Sequence
  Synthetic Polynucleotide
taatacgactcactatagggacagattctcctttcggggaactttcccagaacagaggagactgggaatgttccccgaaaacctggcggcagcgcaaaagatg

SEQ ID NO: 132924 - DNA, 103 bp, Artificial Sequence
  Synthetic Polynucleotide
taatacgactcactatagggaaaagccacattcctgccacaagcaggagaaacagaggagatctcctatgtgtggcaggaacctggcggcagcgcaaaagatg

SEQ ID NO: 132925 - DNA, 103 bp, Artificial Sequence
  Synthetic Polynucleotide
taatacgactcactatagggtccagagaacaaaagccacattcctgccacaacagaggagagtggcaatgatgtggcttaacctggcggcagcgcaaaagatg

SEQ ID NO: 132926 - DNA, 103 bp, Artificial Sequence
  Synthetic Polynucleotide
taatacgactcactatagggagcagaactgtccagagaacaaaagccacaaacagaggagatgtggcatgtgttctctgaacctggcggcagcgcaaaagatg

SEQ ID NO: 132927 - DNA, 103 bp, Artificial Sequence
  Synthetic Polynucleotide
taatacgactcactatagggggatgaggtcagcagaactgtccagagaacaacagaggagagttctcatgacagttctgaacctggcggcagcgcaaaagatg

SEQ ID NO: 132928 - DNA, 103 bp, Artificial Sequence
  Synthetic Polynucleotide
taatacgactcactatagggtagacatggcggatgaggtcagcagaactgaacagaggagacagttcatgtgacctcataacctggcggcagcgcaaaagatg

SEQ ID NO: 132929 - DNA, 103 bp, Artificial Sequence
  Synthetic Polynucleotide
taatacgactcactataggggcagtggaagtagacatggcggatgaggtcaacagaggagagacctcatgcgccatgtcaacctggcggcagcgcaaaagatg

SEQ ID NO: 132930 - DNA, 103 bp, Artificial Sequence
  Synthetic Polynucleotide
taatacgactcactatagggtggtgtggtagcagtggaagtagacatggcaacagaggagagccatgatgacttccactaacctggcggcagcgcaaaagatg

SEQ ID NO: 132931 - DNA, 103 bp, Artificial Sequence
  Synthetic Polynucleotide
taatacgactcactatagggtgtttcagcttggtgtggtagcagtggaagaacagaggagacttccaatgctaccacacaacctggcggcagcgcaaaagatg

SEQ ID NO: 132932 - DNA, 103 bp, Artificial Sequence
  Synthetic Polynucleotide
taatacgactcactatagggcagcccccactgtttcagcttggtgtggtaaacagaggagataccacatgaagctgaaaaacctggcggcagcgcaaaagatg

SEQ ID NO: 132933 - DNA, 103 bp, Artificial Sequence
  Synthetic Polynucleotide
taatacgactcactataggggcaaggcctgcagcccccactgtttcagctaacagaggagaagctgaatgagtgggggcaacctggcggcagcgcaaaagatg

SEQ ID NO: 132934 - DNA, 103 bp, Artificial Sequence
  Synthetic Polynucleotide
taatacgactcactatagggcactgtagccacagattctcctttcggggaaacagaggagatccccgatgggagaatctaacctggcggcagcgcaaaagatg

SEQ ID NO: 132935 - DNA, 103 bp, Artificial Sequence
  Synthetic Polynucleotide
taatacgactcactataggggcctggctttgcaaggcctgcagcccccacaacagaggagagtggggatggcaggccttaacctggcggcagcgcaaaagatg

SEQ ID NO: 132936 - DNA, 103 bp, Artificial Sequence
  Synthetic Polynucleotide
taatacgactcactataggggccaaggtcagcctggctttgcaaggcctgaacagaggagacaggccatgcaaagccagaacctggcggcagcgcaaaagatg

SEQ ID NO: 132937 - DNA, 103 bp, Artificial Sequence
  Synthetic Polynucleotide
taatacgactcactatagggggatgcaggggccaaggtcagcctggctttaacagaggagaaaagccatgctgaccttgaacctggcggcagcgcaaaagatg

SEQ ID NO: 132938 - DNA, 103 bp, Artificial Sequence
  Synthetic Polynucleotide
taatacgactcactatagggtggaagtccaggatgcaggggccaaggtcaaacagaggagatgacctatgcccctgcataacctggcggcagcgcaaaagatg

SEQ ID NO: 132939 - DNA, 103 bp, Artificial Sequence
  Synthetic Polynucleotide
taatacgactcactataggggttccggctctggaagtccaggatgcagggaacagaggagaccctgcatgctggacttcaacctggcggcagcgcaaaagatg

SEQ ID NO: 132940 - DNA, 103 bp, Artificial Sequence
  Synthetic Polynucleotide
taatacgactcactatagggcagggatgacgttccggctctggaagtccaaacagaggagatggactatgagagccggaaacctggcggcagcgcaaaagatg

SEQ ID NO: 132941 - DNA, 103 bp, Artificial Sequence
  Synthetic Polynucleotide
taatacgactcactatagggtcagggatatcagggatgacgttccggctcaacagaggagagagccgatgcgtcatcccaacctggcggcagcgcaaaagatg

SEQ ID NO: 132942 - DNA, 103 bp, Artificial Sequence
  Synthetic Polynucleotide
taatacgactcactatagggcaggaagtggtcagggatatcagggatgacaacagaggagagtcatcatggatatccctaacctggcggcagcgcaaaagatg

SEQ ID NO: 132943 - DNA, 103 bp, Artificial Sequence
  Synthetic Polynucleotide
taatacgactcactatagggcccacagacacaggaagtggtcagggatataacagaggagaatatccatgaccacttccaacctggcggcagcgcaaaagatg

SEQ ID NO: 132944 - DNA, 103 bp, Artificial Sequence
  Synthetic Polynucleotide
taatacgactcactatagggtcacagtgctcccacagacacaggaagtggaacagaggagaccacttatggtgtctgtgaacctggcggcagcgcaaaagatg

SEQ ID NO: 132945 - DNA, 103 bp, Artificial Sequence
  Synthetic Polynucleotide
taatacgactcactatagggcccccactcacactgtagccacagattctcaacagaggagagagaatatgtggctacagaacctggcggcagcgcaaaagatg

SEQ ID NO: 132946 - DNA, 103 bp, Artificial Sequence
  Synthetic Polynucleotide
taatacgactcactataggggaaggaattctcacagtgctcccacagacaaacagaggagatgtctgatggagcactgtaacctggcggcagcgcaaaagatg

SEQ ID NO: 132947 - DNA, 103 bp, Artificial Sequence
  Synthetic Polynucleotide
taatacgactcactatagggcaggattgtcgaaggaattctcacagtgctaacagaggagaagcactatgagaattcctaacctggcggcagcgcaaaagatg

SEQ ID NO: 132948 - DNA, 103 bp, Artificial Sequence
  Synthetic Polynucleotide
taatacgactcactatagggtaaaaccactcaggattgtcgaaggaattcaacagaggagagaattcatgcgacaatccaacctggcggcagcgcaaaagatg

SEQ ID NO: 132949 - DNA, 103 bp, Artificial Sequence
  Synthetic Polynucleotide
taatacgactcactatagggcacatgccgataaaaccactcaggattgtcaacagaggagagacaatatggagtggtttaacctggcggcagcgcaaaagatg

SEQ ID NO: 132950 - DNA, 103 bp, Artificial Sequence
  Synthetic Polynucleotide
taatacgactcactatagggtgtgtgcttccacatgccgataaaaccactaacagaggagaagtggtatgatcggcatgaacctggcggcagcgcaaaagatg

SEQ ID NO: 132951 - DNA, 103 bp, Artificial Sequence
  Synthetic Polynucleotide
taatacgactcactatagggcagcacagactgtgtgcttccacatgccgaaacagaggagatcggcaatgggaagcacaaacctggcggcagcgcaaaagatg

SEQ ID NO: 132952 - DNA, 103 bp, Artificial Sequence
  Synthetic Polynucleotide
taatacgactcactatagggttcgtattcacagcacagactgtgtgcttcaacagaggagagaagcaatgagtctgtgcaacctggcggcagcgcaaaagatg

SEQ ID NO: 132953 - DNA, 103 bp, Artificial Sequence
  Synthetic Polynucleotide
taatacgactcactatagggtgccgactgcttcgtattcacagcacagacaacagaggagagtctgtatggtgaatacgaacctggcggcagcgcaaaagatg

SEQ ID NO: 132954 - DNA, 103 bp, Artificial Sequence
  Synthetic Polynucleotide
taatacgactcactataggggggttgtccttgccgactgcttcgtattcaaacagaggagatgaataatgagcagtcggaacctggcggcagcgcaaaagatg

SEQ ID NO: 132955 - DNA, 103 bp, Artificial Sequence
  Synthetic Polynucleotide
taatacgactcactatagggcagcaccaccgggttgtccttgccgactgcaacagaggagagcagtcatgaaggacaacaacctggcggcagcgcaaaagatg

SEQ ID NO: 132956 - DNA, 103 bp, Artificial Sequence
  Synthetic Polynucleotide
taatacgactcactatagggaggagcaggacccccactcacactgtagccaacagaggagaggctacatggtgagtgggaacctggcggcagcgcaaaagatg

SEQ ID NO: 132957 - DNA, 103 bp, Artificial Sequence
  Synthetic Polynucleotide
taatacgactcactatagggtccagccacacagcaccaccgggttgtcctaacagaggagaaggacaatgcggtggtgcaacctggcggcagcgcaaaagatg

SEQ ID NO: 132958 - DNA, 103 bp, Artificial Sequence
  Synthetic Polynucleotide
taatacgactcactataggggtacagcctttccagccacacagcaccaccaacagaggagaggtggtatggtgtggctgaacctggcggcagcgcaaaagatg

SEQ ID NO: 132959 - DNA, 103 bp, Artificial Sequence
  Synthetic Polynucleotide
taatacgactcactataggggaaggtgcaggtacagcctttccagccacaaacagaggagatgtggcatgaaaggctgtaacctggcggcagcgcaaaagatg

SEQ ID NO: 132960 - DNA, 103 bp, Artificial Sequence
  Synthetic Polynucleotide
taatacgactcactatagggtgcggtccttgaaggtgcaggtacagccttaacagaggagaaaggctatgcctgcacctaacctggcggcagcgcaaaagatg

SEQ ID NO: 132961 - DNA, 103 bp, Artificial Sequence
  Synthetic Polynucleotide
taatacgactcactatagggcgaagtttactgcggtccttgaaggtgcagaacagaggagactgcacatgcaaggaccgaacctggcggcagcgcaaaagatg

SEQ ID NO: 132962 - DNA, 103 bp, Artificial Sequence
  Synthetic Polynucleotide
taatacgactcactataggggaggtgctctcgaagtttactgcggtccttaacagaggagaaaggacatgagtaaacttaacctggcggcagcgcaaaagatg

SEQ ID NO: 132963 - DNA, 103 bp, Artificial Sequence
  Synthetic Polynucleotide
taatacgactcactatagggtatggctgcggaggtgctctcgaagtttacaacagaggagagtaaacatggagagcaccaacctggcggcagcgcaaaagatg

SEQ ID NO: 132964 - DNA, 103 bp, Artificial Sequence
  Synthetic Polynucleotide
taatacgactcactatagggttctcctgggtatggctgcggaggtgctctaacagaggagaagagcaatgccgcagccaaacctggcggcagcgcaaaagatg

SEQ ID NO: 132965 - DNA, 103 bp, Artificial Sequence
  Synthetic Polynucleotide
taatacgactcactatagggggctaccactttctcctgggtatggctgcgaacagaggagacgcagcatgacccaggagaacctggcggcagcgcaaaagatg

SEQ ID NO: 132966 - DNA, 103 bp, Artificial Sequence
  Synthetic Polynucleotide
taatacgactcactatagggaggtggggcaggctaccactttctcctgggaacagaggagacccaggatgaagtggtagaacctggcggcagcgcaaaagatg

SEQ ID NO: 132967 - DNA, 103 bp, Artificial Sequence
  Synthetic Polynucleotide
taatacgactcactataggggagcacacaaaggagcaggacccccactcaaacagaggagatgagtgatggtcctgctcaacctggcggcagcgcaaaagatg

SEQ ID NO: 132968 - DNA, 103 bp, Artificial Sequence
  Synthetic Polynucleotide
taatacgactcactatagggatgcccccacaggtggggcaggctaccactaacagaggagaagtggtatgctgccccacaacctggcggcagcgcaaaagatg

SEQ ID NO: 132969 - DNA, 103 bp, Artificial Sequence
  Synthetic Polynucleotide
taatacgactcactataggggttggcaaacatgcccccacaggtggggcaaacagaggagatgccccatgtgtgggggcaacctggcggcagcgcaaaagatg

SEQ ID NO: 132970 - DNA, 103 bp, Artificial Sequence
  Synthetic Polynucleotide
taatacgactcactatagggacttggtattgttggcaaacatgcccccacaacagaggagagtggggatgtgtttgccaaacctggcggcagcgcaaaagatg

SEQ ID NO: 132971 - DNA, 103 bp, Artificial Sequence
  Synthetic Polynucleotide
taatacgactcactatagggtgatctaagaacttggtattgttggcaaacaacagaggagagtttgcatgcaataccaaaacctggcggcagcgcaaaagatg

SEQ ID NO: 132972 - DNA, 103 bp, Artificial Sequence
  Synthetic Polynucleotide
taatacgactcactataggggcgacggatgtgatctaagaacttggtattaacagaggagaaataccatgttcttagataacctggcggcagcgcaaaagatg

SEQ ID NO: 132973 - DNA, 103 bp, Artificial Sequence
  Synthetic Polynucleotide
taatacgactcactatagggatgaggtctggcgacggatgtgatctaagaaacagaggagatcttagatgacatccgtcaacctggcggcagcgcaaaagatg

SEQ ID NO: 132974 - DNA, 103 bp, Artificial Sequence
  Synthetic Polynucleotide
taatacgactcactatagggtgctgatccaatgaggtctggcgacggatgaacagaggagacatccgatgccagacctcaacctggcggcagcgcaaaagatg

SEQ ID NO: 132975 - DNA, 103 bp, Artificial Sequence
  Synthetic Polynucleotide
taatacgactcactatagggctggaagtgctgctgatccaatgaggtctgaacagaggagacagaccatgttggatcagaacctggcggcagcgcaaaagatg

SEQ ID NO: 132976 - DNA, 103 bp, Artificial Sequence
  Synthetic Polynucleotide
taatacgactcactatagggagtgagaacactggaagtgctgctgatccaaacagaggagatggatcatgagcacttccaacctggcggcagcgcaaaagatg

SEQ ID NO: 132977 - DNA, 103 bp, Artificial Sequence
  Synthetic Polynucleotide
taatacgactcactatagggctcttggaacagtgagaacactggaagtgcaacagaggagagcacttatggtgttctcaaacctggcggcagcgcaaaagatg

SEQ ID NO: 132978 - DNA, 103 bp, Artificial Sequence
  Synthetic Polynucleotide
taatacgactcactatagggttccatggttgagcacacaaaggagcaggaaacagaggagatcctgcatgtttgtgtgcaacctggcggcagcgcaaaagatg

SEQ ID NO: 132979 - DNA, 103 bp, Artificial Sequence
  Synthetic Polynucleotide
taatacgactcactatagggtgtggcaaatctcttggaacagtgagaacaaacagaggagatgttctatgtgttccaagaacctggcggcagcgcaaaagatg

SEQ ID NO: 132980 - DNA, 103 bp, Artificial Sequence
  Synthetic Polynucleotide
taatacgactcactatagggatagccgctctgtggcaaatctcttggaacaacagaggagagttccaatggatttgccaaacctggcggcagcgcaaaagatg

SEQ ID NO: 132981 - DNA, 103 bp, Artificial Sequence
  Synthetic Polynucleotide
taatacgactcactatagggtggtcccgcaatagccgctctgtggcaaataacagaggagaatttgcatgagagcggctaacctggcggcagcgcaaaagatg

SEQ ID NO: 132982 - DNA, 103 bp, Artificial Sequence
  Synthetic Polynucleotide
taatacgactcactataggggttgcgcatgtggtcccgcaatagccgctcaacagaggagagagcggatgttgcgggacaacctggcggcagcgcaaaagatg

SEQ ID NO: 132983 - DNA, 103 bp, Artificial Sequence
  Synthetic Polynucleotide
taatacgactcactataggggattcacatggttgcgcatgtggtcccgcaaacagaggagatgcgggatgacatgcgcaaacctggcggcagcgcaaaagatg

SEQ ID NO: 132984 - DNA, 103 bp, Artificial Sequence
  Synthetic Polynucleotide
taatacgactcactatagggcacttatagtgattcacatggttgcgcatgaacagaggagacatgcgatgccatgtgaaaacctggcggcagcgcaaaagatg

SEQ ID NO: 132985 - DNA, 103 bp, Artificial Sequence
  Synthetic Polynucleotide
taatacgactcactatagggacacagagggcacttatagtgattcacatgaacagaggagacatgtgatgcactataagaacctggcggcagcgcaaaagatg

SEQ ID NO: 132986 - DNA, 103 bp, Artificial Sequence
  Synthetic Polynucleotide
taatacgactcactatagggaggtcatgtcacacagagggcacttatagtaacagaggagaactataatggccctctgtaacctggcggcagcgcaaaagatg

SEQ ID NO: 132987 - DNA, 103 bp, Artificial Sequence
  Synthetic Polynucleotide
taatacgactcactatagggggcagcgggcaggtcatgtcacacagagggaacagaggagaccctctatgtgacatgacaacctggcggcagcgcaaaagatg

SEQ ID NO: 132988 - DNA, 103 bp, Artificial Sequence
  Synthetic Polynucleotide
taatacgactcactataggggagggaggaaggcagcgggcaggtcatgtcaacagaggagagacatgatgtgcccgctgaacctggcggcagcgcaaaagatg

SEQ ID NO: 132989 - DNA, 103 bp, Artificial Sequence
  Synthetic Polynucleotide
taatacgactcactatagggcaaagaacttttccatggttgagcacacaaaacagaggagattgtgtatgcaaccatggaacctggcggcagcgcaaaagatg

SEQ ID NO: 132990 - DNA, 103 bp, Artificial Sequence
  Synthetic Polynucleotide
taatacgactcactatagggtgtggttgcggagggaggaaggcagcgggcaacagaggagagcccgcatgcttcctcccaacctggcggcagcgcaaaagatg

SEQ ID NO: 132991 - DNA, 103 bp, Artificial Sequence
  Synthetic Polynucleotide
taatacgactcactatagggcgaaagcgcatgtggttgcggagggaggaaaacagaggagattcctcatgccgcaaccaaacctggcggcagcgcaaaagatg

SEQ ID NO: 132992 - DNA, 103 bp, Artificial Sequence
  Synthetic Polynucleotide
taatacgactcactatagggctcactgtgacgaaagcgcatgtggttgcgaacagaggagacgcaacatgatgcgctttaacctggcggcagcgcaaaagatg

SEQ ID NO: 132993 - DNA, 103 bp, Artificial Sequence
  Synthetic Polynucleotide
taatacgactcactatagggagggccggtcctcactgtgacgaaagcgcaaacagaggagatgcgctatggtcacagtgaacctggcggcagcgcaaaagatg

SEQ ID NO: 132994 - DNA, 103 bp, Artificial Sequence
  Synthetic Polynucleotide
taatacgactcactatagggtcacatttaaagggccggtcctcactgtgaaacagaggagatcacagatgggaccggccaacctggcggcagcgcaaaagatg

SEQ ID NO: 132995 - DNA, 103 bp, Artificial Sequence
  Synthetic Polynucleotide
taatacgactcactataggggtcacaacagtcacatttaaagggccggtcaacagaggagagaccggatgtttaaatgtaacctggcggcagcgcaaaagatg

SEQ ID NO: 132996 - DNA, 103 bp, Artificial Sequence
  Synthetic Polynucleotide
taatacgactcactatagggtgcagctgtagtcacaacagtcacatttaaaacagaggagattaaatatgactgttgtgaacctggcggcagcgcaaaagatg

SEQ ID NO: 132997 - DNA, 103 bp, Artificial Sequence
  Synthetic Polynucleotide
taatacgactcactatagggataagattcttgcagctgtagtcacaacagaacagaggagactgttgatgctacagctgaacctggcggcagcgcaaaagatg

SEQ ID NO: 132998 - DNA, 103 bp, Artificial Sequence
  Synthetic Polynucleotide
taatacgactcactatagggctggaggtcaataagattcttgcagctgtaaacagaggagatacagcatgaagaatcttaacctggcggcagcgcaaaagatg

SEQ ID NO: 132999 - DNA, 103 bp, Artificial Sequence
  Synthetic Polynucleotide
taatacgactcactatagggccaggtgcttctggaggtcaataagattctaacagaggagaagaatcatgttgacctccaacctggcggcagcgcaaaagatg

SEQ ID NO: 133000 - DNA, 103 bp, Artificial Sequence
  Synthetic Polynucleotide
taatacgactcactataggggtgacatgctcaaagaacttttccatggttaacagaggagaaaccatatgaaagttcttaacctggcggcagcgcaaaagatg

SEQ ID NO: 133001 - DNA, 103 bp, Artificial Sequence
  Synthetic Polynucleotide
taatacgactcactatagggctgtgggtatccaggtgcttctggaggtcaaacagaggagatgacctatggaagcacctaacctggcggcagcgcaaaagatg

SEQ ID NO: 133002 - DNA, 103 bp, Artificial Sequence
  Synthetic Polynucleotide
taatacgactcactatagggtggctcctcgctgtgggtatccaggtgcttaacagaggagaaagcacatggatacccacaacctggcggcagcgcaaaagatg

SEQ ID NO: 133003 - DNA, 103 bp, Artificial Sequence
  Synthetic Polynucleotide
taatacgactcactatagggacctgtaggctggctcctcgctgtgggtataacagaggagaatacccatggcgaggagcaacctggcggcagcgcaaaagatg

SEQ ID NO: 133004 - DNA, 103 bp, Artificial Sequence
  Synthetic Polynucleotide
taatacgactcactatagggtcaaaatcacacctgtaggctggctcctcgaacagaggagacgaggaatgagcctacagaacctggcggcagcgcaaaagatg

SEQ ID NO: 133005 - DNA, 103 bp, Artificial Sequence
  Synthetic Polynucleotide
taatacgactcactatagggggtgcagttctcaaaatcacacctgtaggcaacagaggagagcctacatgtgtgattttaacctggcggcagcgcaaaagatg

SEQ ID NO: 133006 - DNA, 103 bp, Artificial Sequence
  Synthetic Polynucleotide
taatacgactcactataggggggcactgaaggtgcagttctcaaaatcacaacagaggagagtgattatgagaactgcaaacctggcggcagcgcaaaagatg

SEQ ID NO: 133007 - DNA, 103 bp, Artificial Sequence
  Synthetic Polynucleotide
taatacgactcactatagggcagagggatcgggcactgaaggtgcagttcaacagaggagagaactgatgcttcagtgcaacctggcggcagcgcaaaagatg

SEQ ID NO: 133008 - DNA, 103 bp, Artificial Sequence
  Synthetic Polynucleotide
taatacgactcactatagggcttgatagagcagagggatcgggcactgaaaacagaggagattcagtatgcgatccctcaacctggcggcagcgcaaaagatg

SEQ ID NO: 133009 - DNA, 103 bp, Artificial Sequence
  Synthetic Polynucleotide
taatacgactcactatagggggtaatgggacttgatagagcagagggatcaacagaggagagatcccatggctctatcaaacctggcggcagcgcaaaagatg

SEQ ID NO: 133010 - DNA, 103 bp, Artificial Sequence
  Synthetic Polynucleotide
taatacgactcactatagggtgtactttgcggtaatgggacttgatagagaacagaggagactctatatggtcccattaaacctggcggcagcgcaaaagatg

SEQ ID NO: 133011 - DNA, 103 bp, Artificial Sequence
  Synthetic Polynucleotide
taatacgactcactatagggtctgggatgaatttgtttagttcgaggcataacagaggagaatgcctatgactaaacaaaacctggcggcagcgcaaaagatg

SEQ ID NO: 133012 - DNA, 103 bp, Artificial Sequence
  Synthetic Polynucleotide
taatacgactcactatagggtcctttaacaccagcctgtaagatttctttaacagaggagaaaagaaatgttacaggctaacctggcggcagcgcaaaagatg

SEQ ID NO: 133013 - DNA, 103 bp, Artificial Sequence
  Synthetic Polynucleotide
taatacgactcactatagggggaaggtgaagttaggcctacagatgatgtaacagaggagaacatcaatggtaggcctaaacctggcggcagcgcaaaagatg

SEQ ID NO: 133014 - DNA, 103 bp, Artificial Sequence
  Synthetic Polynucleotide
taatacgactcactataggggagatctactggaaggtgaagttaggcctaaacagaggagataggccatgcttcaccttaacctggcggcagcgcaaaagatg

SEQ ID NO: 133015 - DNA, 103 bp, Artificial Sequence
  Synthetic Polynucleotide
taatacgactcactatagggggagtaacctgagatctactggaaggtgaaaacagaggagattcaccatgcagtagatcaacctggcggcagcgcaaaagatg

SEQ ID NO: 133016 - DNA, 103 bp, Artificial Sequence
  Synthetic Polynucleotide
taatacgactcactatagggctggttttgaggagtaacctgagatctactaacagaggagaagtagaatgcaggttactaacctggcggcagcgcaaaagatg

SEQ ID NO: 133017 - DNA, 103 bp, Artificial Sequence
  Synthetic Polynucleotide
taatacgactcactatagggaatccatttgctggttttgaggagtaacctaacagaggagaaggttaatgctcaaaaccaacctggcggcagcgcaaaagatg

SEQ ID NO: 133018 - DNA, 103 bp, Artificial Sequence
  Synthetic Polynucleotide
taatacgactcactatagggggtgaagcagaatccatttgctggttttgaaacagaggagatcaaaaatggcaaatggaaacctggcggcagcgcaaaagatg

SEQ ID NO: 133019 - DNA, 103 bp, Artificial Sequence
  Synthetic Polynucleotide
taatacgactcactatagggtattgacaaaggtgaagcagaatccatttgaacagaggagacaaatgatgtctgcttcaaacctggcggcagcgcaaaagatg

SEQ ID NO: 133020 - DNA, 103 bp, Artificial Sequence
  Synthetic Polynucleotide
taatacgactcactatagggtagccggacttattgacaaaggtgaagcagaacagaggagactgcttatgctttgtcaaaacctggcggcagcgcaaaagatg

SEQ ID NO: 133021 - DNA, 103 bp, Artificial Sequence
  Synthetic Polynucleotide
taatacgactcactatagggtgtgtagaattagccggacttattgacaaaaacagaggagatttgtcatgaagtccggcaacctggcggcagcgcaaaagatg

SEQ ID NO: 133022 - DNA, 103 bp, Artificial Sequence
  Synthetic Polynucleotide
taatacgactcactatagggggggggcgactgtgtagaattagccggactaacagaggagaagtccgatgaattctacaaacctggcggcagcgcaaaagatg

SEQ ID NO: 133023 - DNA, 103 bp, Artificial Sequence
  Synthetic Polynucleotide
taatacgactcactatagggattccgaagttcctttaacaccagcctgtaaacagaggagatacaggatggtgttaaagaacctggcggcagcgcaaaagatg

SEQ ID NO: 133024 - DNA, 103 bp, Artificial Sequence
  Synthetic Polynucleotide
taatacgactcactatagggagattggcatggggggcgactgtgtagaataacagaggagaattctaatgagtcgccccaacctggcggcagcgcaaaagatg

SEQ ID NO: 133025 - DNA, 103 bp, Artificial Sequence
  Synthetic Polynucleotide
taatacgactcactataggggttgaattatagattggcatggggggcgacaacagaggagagtcgccatgcatgccaataacctggcggcagcgcaaaagatg

SEQ ID NO: 133026 - DNA, 103 bp, Artificial Sequence
  Synthetic Polynucleotide
taatacgactcactatagggggcaacatgagttgaattatagattggcataacagaggagaatgccaatgtataattcaaacctggcggcagcgcaaaagatg

SEQ ID NO: 133027 - DNA, 103 bp, Artificial Sequence
  Synthetic Polynucleotide
taatacgactcactatagggtaacaacagaggcaacatgagttgaattataacagaggagaataattatgctcatgttgaacctggcggcagcgcaaaagatg

SEQ ID NO: 133028 - DNA, 103 bp, Artificial Sequence
  Synthetic Polynucleotide
taatacgactcactatagggacgctttgattaacaacagaggcaacatgaaacagaggagatcatgtatgctctgttgtaacctggcggcagcgcaaaagatg

SEQ ID NO: 133029 - DNA, 103 bp, Artificial Sequence
  Synthetic Polynucleotide
taatacgactcactatagggcatttgctctacgctttgattaacaacagaaacagaggagatctgttatgaatcaaagcaacctggcggcagcgcaaaagatg

SEQ ID NO: 133030 - DNA, 103 bp, Artificial Sequence
  Synthetic Polynucleotide
taatacgactcactataggggaagattgcacatttgctctacgctttgataacagaggagaatcaaaatgtagagcaaaaacctggcggcagcgcaaaagatg

SEQ ID NO: 133031 - DNA, 103 bp, Artificial Sequence
  Synthetic Polynucleotide
taatacgactcactatagggtctttcagaagaagattgcacatttgctctaacagaggagaagagcaatggtgcaatctaacctggcggcagcgcaaaagatg

SEQ ID NO: 133032 - DNA, 103 bp, Artificial Sequence
  Synthetic Polynucleotide
taatacgactcactatagggtggcttctgatctttcagaagaagattgcaaacagaggagatgcaatatgcttctgaaaaacctggcggcagcgcaaaagatg

SEQ ID NO: 133033 - DNA, 103 bp, Artificial Sequence
  Synthetic Polynucleotide
taatacgactcactatagggcttgtttttttggcttctgatctttcagaaaacagaggagattctgaatgatcagaagcaacctggcggcagcgcaaaagatg

SEQ ID NO: 133034 - DNA, 103 bp, Artificial Sequence
  Synthetic Polynucleotide
taatacgactcactatagggcctttaagggattccgaagttcctttaacaaacagaggagatgttaaatgaacttcggaaacctggcggcagcgcaaaagatg

SEQ ID NO: 133035 - DNA, 103 bp, Artificial Sequence
  Synthetic Polynucleotide
taatacgactcactatagggatatattttccttgtttttttggcttctgaaacagaggagatcagaaatgaaaaaaacaaacctggcggcagcgcaaaagatg

SEQ ID NO: 133036 - DNA, 103 bp, Artificial Sequence
  Synthetic Polynucleotide
taatacgactcactatagggatactcacaaatatattttccttgttttttaacagaggagaaaaaaaatgggaaaatataacctggcggcagcgcaaaagatg

SEQ ID NO: 133037 - DNA, 103 bp, Artificial Sequence
  Synthetic Polynucleotide
taatacgactcactatagggctctattgcaatactcacaaatatattttcaacagaggagagaaaatatgtttgtgagtaacctggcggcagcgcaaaagatg

SEQ ID NO: 133038 - DNA, 103 bp, Artificial Sequence
  Synthetic Polynucleotide
taatacgactcactatagggtttgcacatgctctattgcaatactcacaaaacagaggagattgtgaatgttgcaatagaacctggcggcagcgcaaaagatg

SEQ ID NO: 133039 - DNA, 103 bp, Artificial Sequence
  Synthetic Polynucleotide
taatacgactcactatagggcacactaggctttgcacatgctctattgcaaacagaggagatgcaatatggcatgtgcaaacctggcggcagcgcaaaagatg

SEQ ID NO: 133040 - DNA, 103 bp, Artificial Sequence
  Synthetic Polynucleotide
taatacgactcactataggggctttaaaagcacactaggctttgcacatgaacagaggagacatgtgatgagcctagtgaacctggcggcagcgcaaaagatg

SEQ ID NO: 133041 - DNA, 103 bp, Artificial Sequence
  Synthetic Polynucleotide
taatacgactcactataggggagcggatatgctttaaaagcacactaggcaacagaggagagcctagatggcttttaaaaacctggcggcagcgcaaaagatg

SEQ ID NO: 133042 - DNA, 103 bp, Artificial Sequence
  Synthetic Polynucleotide
taatacgactcactatagggtccagtgtgggagcggatatgctttaaaagaacagaggagacttttaatgcatatccgcaacctggcggcagcgcaaaagatg

SEQ ID NO: 133043 - DNA, 103 bp, Artificial Sequence
  Synthetic Polynucleotide
taatacgactcactatagggagggtcgctctccagtgtgggagcggatataacagaggagaatatccatgcccacactgaacctggcggcagcgcaaaagatg

SEQ ID NO: 133044 - DNA, 103 bp, Artificial Sequence
  Synthetic Polynucleotide
taatacgactcactatagggacacagggatagggtcgctctccagtgtggaacagaggagaccacacatgagagcgaccaacctggcggcagcgcaaaagatg

SEQ ID NO: 133045 - DNA, 103 bp, Artificial Sequence
  Synthetic Polynucleotide
taatacgactcactataggggcgtttcacacctttaagggattccgaagtaacagaggagaacttcgatgtcccttaaaaacctggcggcagcgcaaaagatg

SEQ ID NO: 133046 - DNA, 103 bp, Artificial Sequence
  Synthetic Polynucleotide
taatacgactcactatagggtccacaagtcacacagggatagggtcgctcaacagaggagagagcgaatgtatccctgtaacctggcggcagcgcaaaagatg

SEQ ID NO: 133047 - DNA, 103 bp, Artificial Sequence
  Synthetic Polynucleotide
taatacgactcactatagggtaaatgaaaatccacaagtcacacagggataacagaggagaatccctatgtgacttgtgaacctggcggcagcgcaaaagatg

SEQ ID NO: 133048 - DNA, 103 bp, Artificial Sequence
  Synthetic Polynucleotide
taatacgactcactatagggcttttagtcttaaatgaaaatccacaagtcaacagaggagagacttgatgattttcattaacctggcggcagcgcaaaagatg

SEQ ID NO: 133049 - DNA, 103 bp, Artificial Sequence
  Synthetic Polynucleotide
taatacgactcactatagggatacagattacttttagtcttaaatgaaaaaacagaggagattttcaatgaagactaaaaacctggcggcagcgcaaaagatg

SEQ ID NO: 133050 - DNA, 103 bp, Artificial Sequence
  Synthetic Polynucleotide
taatacgactcactatagggtcttgtgcttatacagattacttttagtctaacagaggagaagactaatggtaatctgtaacctggcggcagcgcaaaagatg

SEQ ID NO: 133051 - DNA, 103 bp, Artificial Sequence
  Synthetic Polynucleotide
taatacgactcactataggggcgtgggatttcttgtgcttatacagattaaacagaggagataatctatgtaagcacaaaacctggcggcagcgcaaaagatg

SEQ ID NO: 133052 - DNA, 103 bp, Artificial Sequence
  Synthetic Polynucleotide
taatacgactcactataggggatagtatgtgcgtgggatttcttgtgcttaacagaggagaaagcacatgaaatcccacaacctggcggcagcgcaaaagatg

SEQ ID NO: 133053 - DNA, 103 bp, Artificial Sequence
  Synthetic Polynucleotide
taatacgactcactataggggacccagtttgatagtatgtgcgtgggattaacagaggagaaatcccatgcacatactaaacctggcggcagcgcaaaagatg

SEQ ID NO: 133054 - DNA, 103 bp, Artificial Sequence
  Synthetic Polynucleotide
taatacgactcactatagggtgcaagacaagacccagtttgatagtatgtaacagaggagaacatacatgcaaactgggaacctggcggcagcgcaaaagatg

SEQ ID NO: 133055 - DNA, 103 bp, Artificial Sequence
  Synthetic Polynucleotide
taatacgactcactatagggagcatctggttgcaagacaagacccagtttaacagaggagaaaactgatgcttgtcttgaacctggcggcagcgcaaaagatg

SEQ ID NO: 133056 - DNA, 103 bp, Artificial Sequence
  Synthetic Polynucleotide
taatacgactcactatagggcgatctttttgcgtttcacacctttaagggaacagaggagacccttaatggtgtgaaacaacctggcggcagcgcaaaagatg

SEQ ID NO: 133057 - DNA, 103 bp, Artificial Sequence
  Synthetic Polynucleotide
taatacgactcactatagggacaagccaccagcatctggttgcaagacaaaacagaggagattgtctatgaaccagatgaacctggcggcagcgcaaaagatg

SEQ ID NO: 133058 - DNA, 103 bp, Artificial Sequence
  Synthetic Polynucleotide
taatacgactcactatagggtgggacaagaacaagccaccagcatctggtaacagaggagaaccagaatgtggtggcttaacctggcggcagcgcaaaagatg

SEQ ID NO: 133059 - DNA, 103 bp, Artificial Sequence
  Synthetic Polynucleotide
taatacgactcactataggggggggactcgtgggacaagaacaagccaccaacagaggagaggtggcatgttcttgtccaacctggcggcagcgcaaaagatg

SEQ ID NO: 133060 - DNA, 103 bp, Artificial Sequence
  Synthetic Polynucleotide
taatacgactcactatagggtaagtgctttgggggactcgtgggacaagaaacagaggagatcttgtatgacgagtcccaacctggcggcagcgcaaaagatg

SEQ ID NO: 133061 - DNA, 103 bp, Artificial Sequence
  Synthetic Polynucleotide
taatacgactcactataggggaatgaatactaagtgctttgggggactcgaacagaggagacgagtcatgcaaagcactaacctggcggcagcgcaaaagatg

SEQ ID NO: 133062 - DNA, 103 bp, Artificial Sequence
  Synthetic Polynucleotide
taatacgactcactatagggttctacgtctgaatgaatactaagtgctttaacagaggagaaaagcaatgagtattcataacctggcggcagcgcaaaagatg

SEQ ID NO: 133063 - DNA, 103 bp, Artificial Sequence
  Synthetic Polynucleotide
taatacgactcactatagggccccactgtcttctacgtctgaatgaatacaacagaggagagtattcatgcagacgtagaacctggcggcagcgcaaaagatg

SEQ ID NO: 133064 - DNA, 103 bp, Artificial Sequence
  Synthetic Polynucleotide
taatacgactcactatagggtcctcgctctccccactgtcttctacgtctaacagaggagaagacgtatgagacagtggaacctggcggcagcgcaaaagatg

SEQ ID NO: 133065 - DNA, 103 bp, Artificial Sequence
  Synthetic Polynucleotide
taatacgactcactatagggggcgccttcctcctcgctctccccactgtcaacagaggagagacagtatggagagcgagaacctggcggcagcgcaaaagatg

SEQ ID NO: 133066 - DNA, 103 bp, Artificial Sequence
  Synthetic Polynucleotide
taatacgactcactatagggtctcatcagtggcgccttcctcctcgctctaacagaggagaagagcgatgaggaaggcgaacctggcggcagcgcaaaagatg

SEQ ID NO: 133067 - DNA, 103 bp, Artificial Sequence
  Synthetic Polynucleotide
taatacgactcactatagggttctcagctacgatctttttgcgtttcacaaacagaggagatgtgaaatgcaaaaagataacctggcggcagcgcaaaagatg

SEQ ID NO: 133068 - DNA, 103 bp, Artificial Sequence
  Synthetic Polynucleotide
taatacgactcactatagggtcatgctgtctctcatcagtggcgccttccaacagaggagaggaaggatgcactgatgaaacctggcggcagcgcaaaagatg

SEQ ID NO: 133069 - DNA, 103 bp, Artificial Sequence
  Synthetic Polynucleotide
taatacgactcactatagggggcgcccaggtcatgctgtctctcatcagtaacagaggagaactgatatgagacagcataacctggcggcagcgcaaaagatg

SEQ ID NO: 133070 - DNA, 103 bp, Artificial Sequence
  Synthetic Polynucleotide
taatacgactcactataggggcagctccatggcgcccaggtcatgctgtcaacagaggagagacagcatgacctgggcgaacctggcggcagcgcaaaagatg

SEQ ID NO: 133071 - DNA, 103 bp, Artificial Sequence
  Synthetic Polynucleotide
taatacgactcactatagggtgcacaggctgcagctccatggcgcccaggaacagaggagacctgggatgcatggagctaacctggcggcagcgcaaaagatg

SEQ ID NO: 133072 - DNA, 103 bp, Artificial Sequence
  Synthetic Polynucleotide
taatacgactcactatagggctttattatgtgcacaggctgcagctccataacagaggagaatggagatgcagcctgtgaacctggcggcagcgcaaaagatg

SEQ ID NO: 133073 - DNA, 103 bp, Artificial Sequence
  Synthetic Polynucleotide
taatacgactcactatagggttgacatcctctttattatgtgcacaggctaacagaggagaagcctgatgacataataaaacctggcggcagcgcaaaagatg

SEQ ID NO: 133074 - DNA, 103 bp, Artificial Sequence
  Synthetic Polynucleotide
taatacgactcactataggggtttcagcatttgacatcctctttattatgaacagaggagacataatatggaggatgtcaacctggcggcagcgcaaaagatg

SEQ ID NO: 133075 - DNA, 103 bp, Artificial Sequence
  Synthetic Polynucleotide
taatacgactcactatagggttttagtaaagtttcagcatttgacatcctaacagaggagaaggatgatgaatgctgaaaacctggcggcagcgcaaaagatg

SEQ ID NO: 133076 - DNA, 103 bp, Artificial Sequence
  Synthetic Polynucleotide
taatacgactcactatagggtgaagcttgattttagtaaagtttcagcataacagaggagaatgctgatgctttactaaaacctggcggcagcgcaaaagatg

SEQ ID NO: 133077 - DNA, 103 bp, Artificial Sequence
  Synthetic Polynucleotide
taatacgactcactatagggctgcttggagtgaagcttgattttagtaaaaacagaggagatttactatgatcaagcttaacctggcggcagcgcaaaagatg

SEQ ID NO: 133078 - DNA, 103 bp, Artificial Sequence
  Synthetic Polynucleotide
taatacgactcactatagggtttcaggtgattctcagctacgatctttttaacagaggagaaaaaagatggtagctgagaacctggcggcagcgcaaaagatg

SEQ ID NO: 133079 - DNA, 103 bp, Artificial Sequence
  Synthetic Polynucleotide
taatacgactcactatagggattttctggactgcttggagtgaagcttgaaacagaggagatcaagcatgactccaagcaacctggcggcagcgcaaaagatg

SEQ ID NO: 133080 - DNA, 103 bp, Artificial Sequence
  Synthetic Polynucleotide
taatacgactcactatagggcacctatcacattttctggactgcttggagaacagaggagactccaaatggtccagaaaaacctggcggcagcgcaaaagatg

SEQ ID NO: 133081 - DNA, 103 bp, Artificial Sequence
  Synthetic Polynucleotide
taatacgactcactatagggagcaaaaagtcacctatcacattttctggaaacagaggagatccagaatgtgtgataggaacctggcggcagcgcaaaagatg

SEQ ID NO: 133082 - DNA, 103 bp, Artificial Sequence
  Synthetic Polynucleotide
taatacgactcactatagggtctgtcctgtagcaaaaagtcacctatcacaacagaggagagtgataatggactttttgaacctggcggcagcgcaaaagatg

SEQ ID NO: 133083 - DNA, 103 bp, Artificial Sequence
  Synthetic Polynucleotide
taatacgactcactatagggattctgcagatctgtcctgtagcaaaaagtaacagaggagaacttttatgtacaggacaaacctggcggcagcgcaaaagatg

SEQ ID NO: 133084 - DNA, 103 bp, Artificial Sequence
  Synthetic Polynucleotide
taatacgactcactatagggacagcttgtgattctgcagatctgtcctgtaacagaggagaacaggaatgatctgcagaaacctggcggcagcgcaaaagatg

SEQ ID NO: 133085 - DNA, 103 bp, Artificial Sequence
  Synthetic Polynucleotide
taatacgactcactatagggtaactctgtcacagcttgtgattctgcagaaacagaggagatctgcaatgtcacaagctaacctggcggcagcgcaaaagatg

SEQ ID NO: 133086 - DNA, 103 bp, Artificial Sequence
  Synthetic Polynucleotide
taatacgactcactatagggcaactttcggtaactctgtcacagcttgtgaacagaggagacacaagatgtgacagagtaacctggcggcagcgcaaaagatg

SEQ ID NO: 133087 - DNA, 103 bp, Artificial Sequence
  Synthetic Polynucleotide
taatacgactcactatagggtggtggaccacaactttcggtaactctgtcaacagaggagagacagaatgaccgaaagtaacctggcggcagcgcaaaagatg

SEQ ID NO: 133088 - DNA, 103 bp, Artificial Sequence
  Synthetic Polynucleotide
taatacgactcactatagggcacagtgacatggtggaccacaactttcggaacagaggagaccgaaaatggtggtccacaacctggcggcagcgcaaaagatg

SEQ ID NO: 133089 - DNA, 103 bp, Artificial Sequence
  Synthetic Polynucleotide
taatacgactcactatagggttggtatttttttcaggtgattctcagctaaacagaggagatagctgatgatcacctgaaacctggcggcagcgcaaaagatg

SEQ ID NO: 133090 - DNA, 103 bp, Artificial Sequence
  Synthetic Polynucleotide
taatacgactcactatagggttaagggggacacagtgacatggtggaccaaacagaggagatggtccatgatgtcactgaacctggcggcagcgcaaaagatg

SEQ ID NO: 133091 - DNA, 103 bp, Artificial Sequence
  Synthetic Polynucleotide
taatacgactcactatagggctgtcagttcttaagggggacacagtgacaaacagaggagatgtcacatggtcccccttaacctggcggcagcgcaaaagatg

SEQ ID NO: 133092 - DNA, 103 bp, Artificial Sequence
  Synthetic Polynucleotide
taatacgactcactatagggggcctttggactgtcagttcttaagggggaaacagaggagatcccccatgagaactgacaacctggcggcagcgcaaaagatg

SEQ ID NO: 133093 - DNA, 103 bp, Artificial Sequence
  Synthetic Polynucleotide
taatacgactcactatagggtgggatccatggcctttggactgtcagttcaacagaggagagaactgatggtccaaaggaacctggcggcagcgcaaaagatg

SEQ ID NO: 133094 - DNA, 103 bp, Artificial Sequence
  Synthetic Polynucleotide
taatacgactcactatagggagttcaggcttgggatccatggcctttggaaacagaggagatccaaaatgcatggatccaacctggcggcagcgcaaaagatg

SEQ ID NO: 133095 - DNA, 103 bp, Artificial Sequence
  Synthetic Polynucleotide
taatacgactcactatagggtgcactagaaagttcaggcttgggatccataacagaggagaatggatatgaagcctgaaaacctggcggcagcgcaaaagatg

SEQ ID NO: 133096 - DNA, 103 bp, Artificial Sequence
  Synthetic Polynucleotide
taatacgactcactatagggtctgcttttgtgcactagaaagttcaggctaacagaggagaagcctgatgtttctagtgaacctggcggcagcgcaaaagatg

SEQ ID NO: 133097 - DNA, 103 bp, Artificial Sequence
  Synthetic Polynucleotide
taatacgactcactatagggtgaaggtccttctgcttttgtgcactagaaaacagaggagattctagatgacaaaagcaaacctggcggcagcgcaaaagatg

SEQ ID NO: 133098 - DNA, 103 bp, Artificial Sequence
  Synthetic Polynucleotide
taatacgactcactataggggtttgtcacctgaaggtccttctgcttttgaacagaggagacaaaagatgaaggaccttaacctggcggcagcgcaaaagatg

SEQ ID NO: 133099 - DNA, 103 bp, Artificial Sequence
  Synthetic Polynucleotide
taatacgactcactataggggtggctgtacgtttgtcacctgaaggtcctaacagaggagaaggaccatgaggtgacaaaacctggcggcagcgcaaaagatg

SEQ ID NO: 133100 - DNA, 103 bp, Artificial Sequence
  Synthetic Polynucleotide
taatacgactcactatagggagtggggattttggtatttttttcaggtgaaacagaggagatcacctatgaaaaataccaacctggcggcagcgcaaaagatg

SEQ ID NO: 133101 - DNA, 103 bp, Artificial Sequence
  Synthetic Polynucleotide
taatacgactcactatagggttggctgaaagtggctgtacgtttgtcaccaacagaggagaggtgacatgcgtacagccaacctggcggcagcgcaaaagatg

SEQ ID NO: 133102 - DNA, 103 bp, Artificial Sequence
  Synthetic Polynucleotide
taatacgactcactatagggctgggacatgttggctgaaagtggctgtacaacagaggagagtacagatgctttcagccaacctggcggcagcgcaaaagatg

SEQ ID NO: 133103 - DNA, 103 bp, Artificial Sequence
  Synthetic Polynucleotide
taatacgactcactatagggagactccaccctgggacatgttggctgaaaaacagaggagatttcagatgacatgtcccaacctggcggcagcgcaaaagatg

SEQ ID NO: 133104 - DNA, 103 bp, Artificial Sequence
  Synthetic Polynucleotide
taatacgactcactatagggtccaacctggagactccaccctgggacatgaacagaggagacatgtcatggggtggagtaacctggcggcagcgcaaaagatg

SEQ ID NO: 133105 - DNA, 103 bp, Artificial Sequence
  Synthetic Polynucleotide
taatacgactcactatagggctcattagtctccaacctggagactccaccaacagaggagaggtggaatgtccaggttgaacctggcggcagcgcaaaagatg

SEQ ID NO: 133106 - DNA, 103 bp, Artificial Sequence
  Synthetic Polynucleotide
taatacgactcactatagggggtgggaattctcattagtctccaacctggaacagaggagaccaggtatgagactaatgaacctggcggcagcgcaaaagatg

SEQ ID NO: 133107 - DNA, 103 bp, Artificial Sequence
  Synthetic Polynucleotide
taatacgactcactatagggtcgcctttctggtgggaattctcattagtcaacagaggagagactaaatggaattcccaaacctggcggcagcgcaaaagatg

SEQ ID NO: 133108 - DNA, 103 bp, Artificial Sequence
  Synthetic Polynucleotide
taatacgactcactatagggtggattcatgtcgcctttctggtgggaattaacagaggagaaattccatgcagaaaggcaacctggcggcagcgcaaaagatg

SEQ ID NO: 133109 - DNA, 103 bp, Artificial Sequence
  Synthetic Polynucleotide
taatacgactcactatagggttccttccagtggattcatgtcgcctttctaacagaggagaagaaagatgacatgaatcaacctggcggcagcgcaaaagatg

SEQ ID NO: 133110 - DNA, 103 bp, Artificial Sequence
  Synthetic Polynucleotide
taatacgactcactataggggagtcttgctttccttccagtggattcatgaacagaggagacatgaaatgactggaaggaacctggcggcagcgcaaaagatg

SEQ ID NO: 133111 - DNA, 103 bp, Artificial Sequence
  Synthetic Polynucleotide
taatacgactcactatagggaggatttctcagtggggattttggtattttaacagaggagaaaaataatgaaatccccaaacctggcggcagcgcaaaagatg

SEQ ID NO: 133112 - DNA, 103 bp, Artificial Sequence
  Synthetic Polynucleotide
taatacgactcactatagggtcctacgtgagagtcttgctttccttccagaacagaggagactggaaatgaagcaagacaacctggcggcagcgcaaaagatg

SEQ ID NO: 133113 - DNA, 103 bp, Artificial Sequence
  Synthetic Polynucleotide
taatacgactcactatagggcgtgtaccgttcctacgtgagagtcttgctaacagaggagaagcaagatgctcacgtagaacctggcggcagcgcaaaagatg

SEQ ID NO: 133114 - DNA, 103 bp, Artificial Sequence
  Synthetic Polynucleotide
taatacgactcactatagggtgtagctgggcgtgtaccgttcctacgtgaaacagaggagatcacgtatgaacggtacaaacctggcggcagcgcaaaagatg

SEQ ID NO: 133115 - DNA, 103 bp, Artificial Sequence
  Synthetic Polynucleotide
taatacgactcactatagggctgctgcctttgtagctgggcgtgtaccgtaacagaggagaacggtaatggcccagctaaacctggcggcagcgcaaaagatg

SEQ ID NO: 133116 - DNA, 103 bp, Artificial Sequence
  Synthetic Polynucleotide
taatacgactcactatagggaatcggtagcctgctgcctttgtagctgggaacagaggagacccagcatgaaaggcagcaacctggcggcagcgcaaaagatg

SEQ ID NO: 133117 - DNA, 103 bp, Artificial Sequence
  Synthetic Polynucleotide
taatacgactcactatagggtcttgggagtaatcggtagcctgctgccttaacagaggagaaaggcaatgggctaccgaaacctggcggcagcgcaaaagatg

SEQ ID NO: 133118 - DNA, 103 bp, Artificial Sequence
  Synthetic Polynucleotide
taatacgactcactatagggtccttgctgctcttgggagtaatcggtagcaacagaggagagctaccatgtactcccaaaacctggcggcagcgcaaaagatg

SEQ ID NO: 133119 - DNA, 103 bp, Artificial Sequence
  Synthetic Polynucleotide
taatacgactcactatagggtcaggagctttccttgctgctcttgggagtaacagaggagaactcccatgagcagcaagaacctggcggcagcgcaaaagatg

SEQ ID NO: 133120 - DNA, 103 bp, Artificial Sequence
  Synthetic Polynucleotide
taatacgactcactatagggcttcgaggactcaggagctttccttgctgcaacagaggagagcagcaatgaaagctcctaacctggcggcagcgcaaaagatg

SEQ ID NO: 133121 - DNA, 103 bp, Artificial Sequence
  Synthetic Polynucleotide
taatacgactcactatagggacttcctaaacttcgaggactcaggagcttaacagaggagaaagctcatgagtcctcgaaacctggcggcagcgcaaaagatg

SEQ ID NO: 133122 - DNA, 103 bp, Artificial Sequence
  Synthetic Polynucleotide
taatacgactcactatagggctcttagatttctgggatgaatttgtttagaacagaggagactaaacatgttcatcccaaacctggcggcagcgcaaaagatg

SEQ ID NO: 133123 - DNA, 103 bp, Artificial Sequence
  Synthetic Polynucleotide
taatacgactcactatagggttgcctgaagaggatttctcagtggggattaacagaggagaaatcccatgtgagaaatcaacctggcggcagcgcaaaagatg

SEQ ID NO: 133124 - DNA, 103 bp, Artificial Sequence
  Synthetic Polynucleotide
taatacgactcactatagggcagaatccgtacttcctaaacttcgaggacaacagaggagagtcctcatggtttaggaaaacctggcggcagcgcaaaagatg

SEQ ID NO: 133125 - DNA, 103 bp, Artificial Sequence
  Synthetic Polynucleotide
taatacgactcactataggggaaaagtaaccagaatccgtacttcctaaaaacagaggagatttaggatgtacggattcaacctggcggcagcgcaaaagatg

SEQ ID NO: 133126 - DNA, 103 bp, Artificial Sequence
  Synthetic Polynucleotide
taatacgactcactatagggttcagaacgtgaaaagtaaccagaatccgtaacagaggagaacggatatgggttactttaacctggcggcagcgcaaaagatg

SEQ ID NO: 133127 - DNA, 103 bp, Artificial Sequence
  Synthetic Polynucleotide
taatacgactcactataggggatcggcactttcagaacgtgaaaagtaacaacagaggagagttactatgcacgttctgaacctggcggcagcgcaaaagatg

SEQ ID NO: 133128 - DNA, 103 bp, Artificial Sequence
  Synthetic Polynucleotide
taatacgactcactatagggctcactgtttgatcggcactttcagaacgtaacagaggagaacgttcatgaagtgccgaaacctggcggcagcgcaaaagatg

SEQ ID NO: 133129 - DNA, 103 bp, Artificial Sequence
  Synthetic Polynucleotide
taatacgactcactatagggagttggtggactcactgtttgatcggcactaacagaggagaagtgccatgcaaacagtgaacctggcggcagcgcaaaagatg

SEQ ID NO: 133130 - DNA, 103 bp, Artificial Sequence
  Synthetic Polynucleotide
taatacgactcactatagggtggcaaagggagttggtggactcactgtttaacagaggagaaaacagatggtccaccaaaacctggcggcagcgcaaaagatg

SEQ ID NO: 133131 - DNA, 103 bp, Artificial Sequence
  Synthetic Polynucleotide
taatacgactcactatagggggtaaccttctggcaaagggagttggtggaaacagaggagatccaccatgtccctttgcaacctggcggcagcgcaaaagatg

SEQ ID NO: 133132 - DNA, 103 bp, Artificial Sequence
  Synthetic Polynucleotide
taatacgactcactatagggttctgtgctgggtaaccttctggcaaagggaacagaggagaccctttatgagaaggttaaacctggcggcagcgcaaaagatg

SEQ ID NO: 133133 - DNA, 103 bp, Artificial Sequence
  Synthetic Polynucleotide
taatacgactcactatagggcagagtcttgttctgtgctgggtaaccttcaacagaggagagaaggtatgccagcacagaacctggcggcagcgcaaaagatg

SEQ ID NO: 133134 - DNA, 103 bp, Artificial Sequence
  Synthetic Polynucleotide
taatacgactcactatagggtgtttatgttttgcctgaagaggatttctcaacagaggagagagaaaatgtcttcaggcaacctggcggcagcgcaaaagatg

SEQ ID NO: 133135 - DNA, 103 bp, Artificial Sequence
  Synthetic Polynucleotide
taatacgactcactatagggttactccttccagagtcttgttctgtgctgaacagaggagacagcacatgacaagactcaacctggcggcagcgcaaaagatg

SEQ ID NO: 133136 - DNA, 103 bp, Artificial Sequence
  Synthetic Polynucleotide
taatacgactcactatagggagagggtccgttactccttccagagtcttgaacagaggagacaagacatgggaaggagtaacctggcggcagcgcaaaagatg

SEQ ID NO: 133137 - DNA, 103 bp, Artificial Sequence
  Synthetic Polynucleotide
taatacgactcactatagggcaagagctgcagagggtccgttactccttcaacagaggagagaaggaatgacggaccctaacctggcggcagcgcaaaagatg

SEQ ID NO: 133138 - DNA, 103 bp, Artificial Sequence
  Synthetic Polynucleotide
taatacgactcactataggggacgtggtgacaagagctgcagagggtccgaacagaggagacggaccatgtgcagctctaacctggcggcagcgcaaaagatg

SEQ ID NO: 133139 - DNA, 103 bp, Artificial Sequence
  Synthetic Polynucleotide
taatacgactcactatagggagagggtgttgacgtggtgacaagagctgcaacagaggagagcagctatggtcaccacgaacctggcggcagcgcaaaagatg

SEQ ID NO: 133140 - DNA, 103 bp, Artificial Sequence
  Synthetic Polynucleotide
taatacgactcactatagggtgggcaaagcagagggtgttgacgtggtgaaacagaggagatcaccaatgcaacaccctaacctggcggcagcgcaaaagatg

SEQ ID NO: 133141 - DNA, 103 bp, Artificial Sequence
  Synthetic Polynucleotide
taatacgactcactatagggttttcccctgtgggcaaagcagagggtgttaacagaggagaaacaccatgtgctttgccaacctggcggcagcgcaaaagatg

SEQ ID NO: 133142 - DNA, 103 bp, Artificial Sequence
  Synthetic Polynucleotide
taatacgactcactatagggaagcaatgccttttcccctgtgggcaaagcaacagaggagagctttgatgacaggggaaaacctggcggcagcgcaaaagatg

SEQ ID NO: 133143 - DNA, 103 bp, Artificial Sequence
  Synthetic Polynucleotide
taatacgactcactataggggacctggtaaaagcaatgccttttcccctgaacagaggagacaggggatgaggcattgcaacctggcggcagcgcaaaagatg

SEQ ID NO: 133144 - DNA, 103 bp, Artificial Sequence
  Synthetic Polynucleotide
taatacgactcactataggggggcgcatctgacctggtaaaagcaatgccaacagaggagaggcattatgtttaccaggaacctggcggcagcgcaaaagatg

SEQ ID NO: 133145 - DNA, 103 bp, Artificial Sequence
  Synthetic Polynucleotide
taatacgactcactatagggttctgtattttgtttatgttttgcctgaagaacagaggagacttcagatgaaacataaaaacctggcggcagcgcaaaagatg

SEQ ID NO: 133146 - DNA, 103 bp, Artificial Sequence
  Synthetic Polynucleotide
taatacgactcactatagggggccaaaggtgggcgcatctgacctggtaaaacagaggagattaccaatgcagatgcgcaacctggcggcagcgcaaaagatg

SEQ ID NO: 133147 - DNA, 103 bp, Artificial Sequence
  Synthetic Polynucleotide
taatacgactcactataggggtgtttttgtggccaaaggtgggcgcatctaacagaggagaagatgcatgcacctttggaacctggcggcagcgcaaaagatg

SEQ ID NO: 133148 - DNA, 103 bp, Artificial Sequence
  Synthetic Polynucleotide
taatacgactcactatagggcgctcctcaagtgtttttgtggccaaaggtaacagaggagaacctttatgcacaaaaacaacctggcggcagcgcaaaagatg

SEQ ID NO: 133149 - DNA, 103 bp, Artificial Sequence
  Synthetic Polynucleotide
taatacgactcactatagggcttcgatatccgctcctcaagtgtttttgtaacagaggagaacaaaaatgcttgaggagaacctggcggcagcgcaaaagatg

SEQ ID NO: 133150 - DNA, 103 bp, Artificial Sequence
  Synthetic Polynucleotide
taatacgactcactatagggctgagataagcttcgatatccgctcctcaaaacagaggagattgaggatgggatatcgaaacctggcggcagcgcaaaagatg

SEQ ID NO: 133151 - DNA, 103 bp, Artificial Sequence
  Synthetic Polynucleotide
taatacgactcactataggggcttcattgtctgagataagcttcgatatcaacagaggagagatatcatggcttatctcaacctggcggcagcgcaaaagatg

SEQ ID NO: 133152 - DNA, 103 bp, Artificial Sequence
  Synthetic Polynucleotide
taatacgactcactatagggatctaccaaagcttcattgtctgagataagaacagaggagacttatcatggacaatgaaaacctggcggcagcgcaaaagatg

SEQ ID NO: 133153 - DNA, 103 bp, Artificial Sequence
  Synthetic Polynucleotide
taatacgactcactataggggttgcttgtcatctaccaaagcttcattgtaacagaggagaacaatgatgctttggtagaacctggcggcagcgcaaaagatg

SEQ ID NO: 133154 - DNA, 103 bp, Artificial Sequence
  Synthetic Polynucleotide
taatacgactcactatagggacactatccagttgcttgtcatctaccaaaaacagaggagatttggtatgtgacaagcaaacctggcggcagcgcaaaagatg

SEQ ID NO: 133155 - DNA, 103 bp, Artificial Sequence
  Synthetic Polynucleotide
taatacgactcactatagggccgcggcttcacactatccagttgcttgtcaacagaggagagacaagatgctggatagtaacctggcggcagcgcaaaagatg

SEQ ID NO: 133156 - DNA, 103 bp, Artificial Sequence
  Synthetic Polynucleotide
taatacgactcactatagggaagatgactcttctgtattttgtttatgttaacagaggagaaacataatgaaaatacagaacctggcggcagcgcaaaagatg

SEQ ID NO: 133157 - DNA, 103 bp, Artificial Sequence
  Synthetic Polynucleotide
taatacgactcactataggggtgaggttctccgcggcttcacactatccaaacagaggagatggataatgtgaagccgcaacctggcggcagcgcaaaagatg

SEQ ID NO: 133158 - DNA, 103 bp, Artificial Sequence
  Synthetic Polynucleotide
taatacgactcactatagggcgtcttgacagtgaggttctccgcggcttcaacagaggagagaagccatggagaacctcaacctggcggcagcgcaaaagatg

SEQ ID NO: 133159 - DNA, 103 bp, Artificial Sequence
  Synthetic Polynucleotide
taatacgactcactatagggaatgcttcctcgtcttgacagtgaggttctaacagaggagaagaaccatgctgtcaagaaacctggcggcagcgcaaaagatg

SEQ ID NO: 133160 - DNA, 103 bp, Artificial Sequence
  Synthetic Polynucleotide
taatacgactcactatagggtgggggaatcaatgcttcctcgtcttgacaaacagaggagatgtcaaatggaggaagcaaacctggcggcagcgcaaaagatg

SEQ ID NO: 133161 - DNA, 103 bp, Artificial Sequence
  Synthetic Polynucleotide
taatacgactcactatagggatgtatgatttgggggaatcaatgcttcctaacagaggagaaggaagatgtgattccccaacctggcggcagcgcaaaagatg

SEQ ID NO: 133162 - DNA, 103 bp, Artificial Sequence
  Synthetic Polynucleotide
taatacgactcactatagggatctttaaatatgtatgatttgggggaatcaacagaggagagattccatgaaatcatacaacctggcggcagcgcaaaagatg

SEQ ID NO: 133163 - DNA, 103 bp, Artificial Sequence
  Synthetic Polynucleotide
taatacgactcactatagggactggaaagaatctttaaatatgtatgattaacagaggagaaatcatatgtatttaaagaacctggcggcagcgcaaaagatg

SEQ ID NO: 133164 - DNA, 103 bp, Artificial Sequence
  Synthetic Polynucleotide
taatacgactcactatagggtttaaatcaaactggaaagaatctttaaataacagaggagaatttaaatgttctttccaaacctggcggcagcgcaaaagatg

SEQ ID NO: 133165 - DNA, 103 bp, Artificial Sequence
  Synthetic Polynucleotide
taatacgactcactatagggtcccactggttttaaatcaaactggaaagaaacagaggagatctttcatgtttgatttaaacctggcggcagcgcaaaagatg

SEQ ID NO: 133166 - DNA, 103 bp, Artificial Sequence
  Synthetic Polynucleotide
taatacgactcactatagggttgttctccgtcccactggttttaaatcaaaacagaggagattgattatgaaccagtggaacctggcggcagcgcaaaagatg

SEQ ID NO: 133167 - DNA, 103 bp, Artificial Sequence
  Synthetic Polynucleotide
taatacgactcactatagggagaacggcgaaagatgactcttctgtatttaacagaggagaaaatacatgagagtcatcaacctggcggcagcgcaaaagatg

SEQ ID NO: 133168 - DNA, 103 bp, Artificial Sequence
  Synthetic Polynucleotide
taatacgactcactataggggagcttgaacttgttctccgtcccactggtaacagaggagaaccagtatgacggagaacaacctggcggcagcgcaaaagatg

SEQ ID NO: 133169 - DNA, 103 bp, Artificial Sequence
  Synthetic Polynucleotide
taatacgactcactatagggcggtatatcagagcttgaacttgttctccgaacagaggagacggagaatgagttcaagcaacctggcggcagcgcaaaagatg

SEQ ID NO: 133170 - DNA, 103 bp, Artificial Sequence
  Synthetic Polynucleotide
taatacgactcactatagggaaggtgacttcggtatatcagagcttgaacaacagaggagagttcaaatgctgatatacaacctggcggcagcgcaaaagatg

SEQ ID NO: 133171 - DNA, 103 bp, Artificial Sequence
  Synthetic Polynucleotide
taatacgactcactataggggtaggggtgaaaggtgacttcggtatatcaaacagaggagatgatatatggaagtcaccaacctggcggcagcgcaaaagatg

SEQ ID NO: 133172 - DNA, 103 bp, Artificial Sequence
  Synthetic Polynucleotide
taatacgactcactatagggtgatttttcagtaggggtgaaaggtgacttaacagaggagaaagtcaatgttcacccctaacctggcggcagcgcaaaagatg

SEQ ID NO: 133173 - DNA, 103 bp, Artificial Sequence
  Synthetic Polynucleotide
taatacgactcactatagggacacttgctttgatttttcagtaggggtgaaacagaggagatcacccatgctgaaaaataacctggcggcagcgcaaaagatg

SEQ ID NO: 133174 - DNA, 103 bp, Artificial Sequence
  Synthetic Polynucleotide
taatacgactcactataggggacagaagaaacacttgctttgatttttcaaacagaggagatgaaaaatgaaagcaagtaacctggcggcagcgcaaaagatg

SEQ ID NO: 133175 - DNA, 103 bp, Artificial Sequence
  Synthetic Polynucleotide
taatacgactcactatagggtgaaggtacagacagaagaaacacttgcttaacagaggagaaagcaaatgtttcttctgaacctggcggcagcgcaaaagatg

SEQ ID NO: 133176 - DNA, 103 bp, Artificial Sequence
  Synthetic Polynucleotide
taatacgactcactatagggaacagtcaagtgaaggtacagacagaagaaaacagaggagattcttcatgctgtaccttaacctggcggcagcgcaaaagatg

SEQ ID NO: 133177 - DNA, 103 bp, Artificial Sequence
  Synthetic Polynucleotide
taatacgactcactataggggtgataggtaaacagtcaagtgaaggtacaaacagaggagatgtaccatgacttgactgaacctggcggcagcgcaaaagatg

SEQ ID NO: 133178 - DNA, 103 bp, Artificial Sequence
  Synthetic Polynucleotide
taatacgactcactatagggagcactatgaagaacggcgaaagatgactcaacagaggagagagtcaatgttcgccgttaacctggcggcagcgcaaaagatg

SEQ ID NO: 133179 - DNA, 103 bp, Artificial Sequence
  Synthetic Polynucleotide
taatacgactcactatagggattacttcttgtgataggtaaacagtcaagaacagaggagacttgacatgttacctatcaacctggcggcagcgcaaaagatg

SEQ ID NO: 133180 - DNA, 103 bp, Artificial Sequence
  Synthetic Polynucleotide
taatacgactcactatagggtcggcatggaattacttcttgtgataggtaaacagaggagatacctaatgcaagaagtaaacctggcggcagcgcaaaagatg

SEQ ID NO: 133181 - DNA, 103 bp, Artificial Sequence
  Synthetic Polynucleotide
taatacgactcactatagggtaacctgtggtcggcatggaattacttcttaacagaggagaaagaagatgttccatgccaacctggcggcagcgcaaaagatg

SEQ ID NO: 133182 - DNA, 103 bp, Artificial Sequence
  Synthetic Polynucleotide
taatacgactcactatagggtactgctgaataacctgtggtcggcatggaaacagaggagatccatgatgaccacaggtaacctggcggcagcgcaaaagatg

SEQ ID NO: 133183 - DNA, 103 bp, Artificial Sequence
  Synthetic Polynucleotide
taatacgactcactatagggtatttgcaggtactgctgaataacctgtggaacagaggagaccacagatgattcagcagaacctggcggcagcgcaaaagatg

SEQ ID NO: 133184 - DNA, 103 bp, Artificial Sequence
  Synthetic Polynucleotide
taatacgactcactatagggggaggtattatatttgcaggtactgctgaaaacagaggagattcagcatgacctgcaaaaacctggcggcagcgcaaaagatg

SEQ ID NO: 133185 - DNA, 103 bp, Artificial Sequence
  Synthetic Polynucleotide
taatacgactcactatagggtggatgaggaggaggtattatatttgcaggaacagaggagacctgcaatgataatacctaacctggcggcagcgcaaaagatg

SEQ ID NO: 133186 - DNA, 103 bp, Artificial Sequence
  Synthetic Polynucleotide
taatacgactcactatagggttcctcttagtggatgaggaggaggtattaaacagaggagataatacatgctcctcatcaacctggcggcagcgcaaaagatg

SEQ ID NO: 133187 - DNA, 103 bp, Artificial Sequence
  Synthetic Polynucleotide
taatacgactcactatagggaatgactgacttcctcttagtggatgaggaaacagaggagatcctcaatgactaagaggaacctggcggcagcgcaaaagatg

SEQ ID NO: 133188 - DNA, 103 bp, Artificial Sequence
  Synthetic Polynucleotide
taatacgactcactatagggtttgtcatcaaatgactgacttcctcttagaacagaggagactaagaatgagtcagtcaaacctggcggcagcgcaaaagatg

SEQ ID NO: 133189 - DNA, 103 bp, Artificial Sequence
  Synthetic Polynucleotide
taatacgactcactataggggagactccgaagcactatgaagaacggcgaaacagaggagatcgccgatgttcatagtgaacctggcggcagcgcaaaagatg

SEQ ID NO: 133190 - DNA, 103 bp, Artificial Sequence
  Synthetic Polynucleotide
taatacgactcactatagggaagcgccaattttgtcatcaaatgactgacaacagaggagagtcagtatgttgatgacaaacctggcggcagcgcaaaagatg

SEQ ID NO: 133191 - DNA, 103 bp, Artificial Sequence
  Synthetic Polynucleotide
taatacgactcactatagggtcatcatagaaagcgccaattttgtcatcaaacagaggagatgatgaatgaattggcgcaacctggcggcagcgcaaaagatg

SEQ ID NO: 133192 - DNA, 103 bp, Artificial Sequence
  Synthetic Polynucleotide
taatacgactcactatagggtacaaagacatcatcatagaaagcgccaataacagaggagaattggcatgttctatgataacctggcggcagcgcaaaagatg

SEQ ID NO: 133193 - DNA, 103 bp, Artificial Sequence
  Synthetic Polynucleotide
taatacgactcactatagggtaggtcccgatacaaagacatcatcatagaaacagaggagatctatgatgatgtctttgaacctggcggcagcgcaaaagatg

SEQ ID NO: 133194 - DNA, 103 bp, Artificial Sequence
  Synthetic Polynucleotide
taatacgactcactatagggacaggagcgttaggtcccgatacaaagacaaacagaggagatgtcttatgatcgggaccaacctggcggcagcgcaaaagatg

SEQ ID NO: 133195 - DNA, 103 bp, Artificial Sequence
  Synthetic Polynucleotide
taatacgactcactatagggactctggggcacaggagcgttaggtcccgaaacagaggagatcgggaatgaacgctcctaacctggcggcagcgcaaaagatg

SEQ ID NO: 133196 - DNA, 103 bp, Artificial Sequence
  Synthetic Polynucleotide
taatacgactcactatagggggggatgcccactctggggcacaggagcgtaacagaggagaacgctcatgtgccccagaaacctggcggcagcgcaaaagatg

SEQ ID NO: 133197 - DNA, 103 bp, Artificial Sequence
  Synthetic Polynucleotide
taatacgactcactatagggacaagtgtacggggatgcccactctggggcaacagaggagagccccaatgtgggcatccaacctggcggcagcgcaaaagatg

SEQ ID NO: 133198 - DNA, 103 bp, Artificial Sequence
  Synthetic Polynucleotide
taatacgactcactatagggtgcttgtctcacaagtgtacggggatgcccaacagaggagagggcatatgcgtacacttaacctggcggcagcgcaaaagatg

SEQ ID NO: 133199 - DNA, 103 bp, Artificial Sequence
  Synthetic Polynucleotide
taatacgactcactatagggcttctatggctgcttgtctcacaagtgtacaacagaggagagtacacatgtgagacaagaacctggcggcagcgcaaaagatg

SEQ ID NO: 133200 - DNA, 103 bp, Artificial Sequence
  Synthetic Polynucleotide
taatacgactcactatagggtgtttcttgtgagactccgaagcactatgaaacagaggagatcatagatgttcggagtcaacctggcggcagcgcaaaagatg

SEQ ID NO: 133201 - DNA, 103 bp, Artificial Sequence
  Synthetic Polynucleotide
taatacgactcactataggggctgaagagtcttctatggctgcttgtctcaacagaggagagagacaatgagccatagaaacctggcggcagcgcaaaagatg

SEQ ID NO: 133202 - DNA, 103 bp, Artificial Sequence
  Synthetic Polynucleotide
taatacgactcactatagggactttcatttgctgaagagtcttctatggcaacagaggagagccataatggactcttcaaacctggcggcagcgcaaaagatg

SEQ ID NO: 133203 - DNA, 103 bp, Artificial Sequence
  Synthetic Polynucleotide
taatacgactcactatagggcaagaacatgactttcatttgctgaagagtaacagaggagaactcttatgcaaatgaaaaacctggcggcagcgcaaaagatg

SEQ ID NO: 133204 - DNA, 103 bp, Artificial Sequence
  Synthetic Polynucleotide
taatacgactcactatagggtgtccagtaccaagaacatgactttcatttaacagaggagaaaatgaatgtcatgttctaacctggcggcagcgcaaaagatg

SEQ ID NO: 133205 - DNA, 103 bp, Artificial Sequence
  Synthetic Polynucleotide
taatacgactcactatagggatccagggactgtccagtaccaagaacatgaacagaggagacatgttatgggtactggaaacctggcggcagcgcaaaagatg

SEQ ID NO: 133206 - DNA, 103 bp, Artificial Sequence
  Synthetic Polynucleotide
taatacgactcactatagggggtggctctcatccagggactgtccagtacaacagaggagagtactgatgagtccctggaacctggcggcagcgcaaaagatg

SEQ ID NO: 133207 - DNA, 103 bp, Artificial Sequence
  Synthetic Polynucleotide
taatacgactcactatagggtggcatccttggtggctctcatccagggacaacagaggagagtccctatgtgagagccaaacctggcggcagcgcaaaagatg

SEQ ID NO: 133208 - DNA, 103 bp, Artificial Sequence
  Synthetic Polynucleotide
taatacgactcactatagggaccagcagcatggcatccttggtggctctcaacagaggagagagagcatgcaaggatgcaacctggcggcagcgcaaaagatg

SEQ ID NO: 133209 - DNA, 103 bp, Artificial Sequence
  Synthetic Polynucleotide
taatacgactcactatagggacatggcttcaccagcagcatggcatccttaacagaggagaaaggatatgatgctgctgaacctggcggcagcgcaaaagatg

SEQ ID NO: 133210 - DNA, 103 bp, Artificial Sequence
  Synthetic Polynucleotide
taatacgactcactatagggctcctcactgacatggcttcaccagcagcaaacagaggagatgctgcatgtgaagccataacctggcggcagcgcaaaagatg

SEQ ID NO: 133211 - DNA, 103 bp, Artificial Sequence
  Synthetic Polynucleotide
taatacgactcactatagggaatataattctgtttcttgtgagactccgaaacagaggagatcggagatgcacaagaaaaacctggcggcagcgcaaaagatg

SEQ ID NO: 133212 - DNA, 103 bp, Artificial Sequence
  Synthetic Polynucleotide
taatacgactcactatagggcagtgccttgctcctcactgacatggcttcaacagaggagagaagccatgtcagtgaggaacctggcggcagcgcaaaagatg

SEQ ID NO: 133213 - DNA, 103 bp, Artificial Sequence
  Synthetic Polynucleotide
taatacgactcactatagggggccttgtgccagtgccttgctcctcactgaacagaggagacagtgaatggcaaggcacaacctggcggcagcgcaaaagatg

SEQ ID NO: 133214 - DNA, 103 bp, Artificial Sequence
  Synthetic Polynucleotide
taatacgactcactatagggtctatatgtgggccttgtgccagtgccttgaacagaggagacaaggcatgggcacaaggaacctggcggcagcgcaaaagatg

SEQ ID NO: 133215 - DNA, 103 bp, Artificial Sequence
  Synthetic Polynucleotide
taatacgactcactatagggcttctttttttctatatgtgggccttgtgcaacagaggagagcacaaatgccacatataaacctggcggcagcgcaaaagatg

SEQ ID NO: 133216 - DNA, 103 bp, Artificial Sequence
  Synthetic Polynucleotide
taatacgactcactatagggcttgatgagacttctttttttctatatgtgaacagaggagacacataatgaaaaaaagaaacctggcggcagcgcaaaagatg

SEQ ID NO: 133217 - DNA, 103 bp, Artificial Sequence
  Synthetic Polynucleotide
taatacgactcactataggggtccctcgcccttgatgagacttcttttttaacagaggagaaaaaaaatggtctcatcaaacctggcggcagcgcaaaagatg

SEQ ID NO: 133218 - DNA, 103 bp, Artificial Sequence
  Synthetic Polynucleotide
taatacgactcactatagggctcaaacattgtccctcgcccttgatgagaaacagaggagatctcatatggggcgagggaacctggcggcagcgcaaaagatg

SEQ ID NO: 133219 - DNA, 103 bp, Artificial Sequence
  Synthetic Polynucleotide
taatacgactcactatagggaagtttcacactcaaacattgtccctcgccaacagaggagaggcgagatgcaatgtttgaacctggcggcagcgcaaaagatg

SEQ ID NO: 133220 - DNA, 103 bp, Artificial Sequence
  Synthetic Polynucleotide
taatacgactcactatagggctgtttctacaagtttcacactcaaacattaacagaggagaaatgttatggtgtgaaacaacctggcggcagcgcaaaagatg

SEQ ID NO: 133221 - DNA, 103 bp, Artificial Sequence
  Synthetic Polynucleotide
taatacgactcactatagggtttcctatacctgtttctacaagtttcacaaacagaggagatgtgaaatgtgtagaaacaacctggcggcagcgcaaaagatg

SEQ ID NO: 133222 - DNA, 103 bp, Artificial Sequence
  Synthetic Polynucleotide
taatacgactcactatagggtttttacaggaatataattctgtttcttgtaacagaggagaacaagaatgagaattataaacctggcggcagcgcaaaagatg

SEQ ID NO: 133223 - DNA, 103 bp, Artificial Sequence
  Synthetic Polynucleotide
taatacgactcactatagggaattttccagtttcctatacctgtttctacaacagaggagagtagaaatgggtataggaaacctggcggcagcgcaaaagatg

SEQ ID NO: 133224 - DNA, 103 bp, Artificial Sequence
  Synthetic Polynucleotide
taatacgactcactatagggtgattttcaaaattttccagtttcctatacaacagaggagagtatagatgactggaaaaaacctggcggcagcgcaaaagatg

SEQ ID NO: 133225 - DNA, 103 bp, Artificial Sequence
  Synthetic Polynucleotide
taatacgactcactatagggaaatttcttatgattttcaaaattttccagaacagaggagactggaaatgtttgaaaataacctggcggcagcgcaaaagatg

SEQ ID NO: 133226 - DNA, 103 bp, Artificial Sequence
  Synthetic Polynucleotide
taatacgactcactatagggcagaacagtaaaatttcttatgattttcaaaacagaggagattgaaaatgataagaaataacctggcggcagcgcaaaagatg

SEQ ID NO: 133227 - DNA, 103 bp, Artificial Sequence
  Synthetic Polynucleotide
taatacgactcactatagggccatgtaactcagaacagtaaaatttcttaaacagaggagataagaaatgttactgttcaacctggcggcagcgcaaaagatg

SEQ ID NO: 133228 - DNA, 103 bp, Artificial Sequence
  Synthetic Polynucleotide
taatacgactcactatagggtgtttttggtccatgtaactcagaacagtaaacagaggagatactgtatggagttacataacctggcggcagcgcaaaagatg

SEQ ID NO: 133229 - DNA, 103 bp, Artificial Sequence
  Synthetic Polynucleotide
taatacgactcactatagggtggctacctttgtttttggtccatgtaactaacagaggagaagttacatggaccaaaaaaacctggcggcagcgcaaaagatg

SEQ ID NO: 133230 - DNA, 103 bp, Artificial Sequence
  Synthetic Polynucleotide
taatacgactcactatagggggttctctcatggctacctttgtttttggtaacagaggagaaccaaaatgaaaggtagcaacctggcggcagcgcaaaagatg

SEQ ID NO: 133231 - DNA, 103 bp, Artificial Sequence
  Synthetic Polynucleotide
taatacgactcactataggggctgtgctcaggttctctcatggctaccttaacagaggagaaaggtaatgatgagagaaaacctggcggcagcgcaaaagatg

SEQ ID NO: 133232 - DNA, 103 bp, Artificial Sequence
  Synthetic Polynucleotide
taatacgactcactatagggcgggcacagggctgtgctcaggttctctcaaacagaggagatgagagatgctgagcacaaacctggcggcagcgcaaaagatg

SEQ ID NO: 133233 - DNA, 103 bp, Artificial Sequence
  Synthetic Polynucleotide
taatacgactcactatagggtcaattttgtctcttagatttctgggatgaaacagaggagatcatccatgaaatctaagaacctggcggcagcgcaaaagatg

SEQ ID NO: 133234 - DNA, 103 bp, Artificial Sequence
  Synthetic Polynucleotide
taatacgactcactatagggtgcttcccattttttacaggaatataattcaacagaggagagaattaatgtcctgtaaaaacctggcggcagcgcaaaagatg

SEQ ID NO: 133235 - DNA, 103 bp, Artificial Sequence
  Synthetic Polynucleotide
taatacgactcactatagggtgcagaccgccgggcacagggctgtgctcaaacagaggagatgagcaatgccctgtgccaacctggcggcagcgcaaaagatg

SEQ ID NO: 133236 - DNA, 103 bp, Artificial Sequence
  Synthetic Polynucleotide
taatacgactcactatagggaatctgaggctgcagaccgccgggcacaggaacagaggagacctgtgatgggcggtctgaacctggcggcagcgcaaaagatg

SEQ ID NO: 133237 - DNA, 103 bp, Artificial Sequence
  Synthetic Polynucleotide
taatacgactcactatagggtgtagtgtagaatctgaggctgcagaccgcaacagaggagagcggtcatgagcctcagaaacctggcggcagcgcaaaagatg

SEQ ID NO: 133238 - DNA, 103 bp, Artificial Sequence
  Synthetic Polynucleotide
taatacgactcactatagggccagcgactctgtagtgtagaatctgaggcaacagaggagagcctcaatgtctacactaaacctggcggcagcgcaaaagatg

SEQ ID NO: 133239 - DNA, 103 bp, Artificial Sequence
  Synthetic Polynucleotide
taatacgactcactataggggccggaggacccagcgactctgtagtgtagaacagaggagactacacatgagagtcgctaacctggcggcagcgcaaaagatg

SEQ ID NO: 133240 - DNA, 103 bp, Artificial Sequence
  Synthetic Polynucleotide
taatacgactcactataggggttcccagatgccggaggacccagcgactcaacagaggagagagtcgatgggtcctccgaacctggcggcagcgcaaaagatg

SEQ ID NO: 133241 - DNA, 103 bp, Artificial Sequence
  Synthetic Polynucleotide
taatacgactcactatagggtggggcgtctgttcccagatgccggaggacaacagaggagagtcctcatgcatctgggaaacctggcggcagcgcaaaagatg

SEQ ID NO: 133242 - DNA, 103 bp, Artificial Sequence
  Synthetic Polynucleotide
taatacgactcactatagggttttcttatctggggcgtctgttcccagataacagaggagaatctggatgcagacgcccaacctggcggcagcgcaaaagatg

SEQ ID NO: 133243 - DNA, 103 bp, Artificial Sequence
  Synthetic Polynucleotide
taatacgactcactatagggttttcctcctttttcttatctggggcgtctaacagaggagaagacgcatgagataagaaaacctggcggcagcgcaaaagatg

SEQ ID NO: 133244 - DNA, 103 bp, Artificial Sequence
  Synthetic Polynucleotide
taatacgactcactatagggacacttttcattttcctcctttttcttatcaacagaggagagataagatgaaggaggaaaacctggcggcagcgcaaaagatg

SEQ ID NO: 133245 - DNA, 103 bp, Artificial Sequence
  Synthetic Polynucleotide
taatacgactcactatagggtttggtaaactgcttcccattttttacaggaacagaggagacctgtaatgaatgggaagaacctggcggcagcgcaaaagatg

SEQ ID NO: 133246 - DNA, 103 bp, Artificial Sequence
  Synthetic Polynucleotide
taatacgactcactatagggatcatccccaacacttttcattttcctcctaacagaggagaaggaggatgatgaaaagtaacctggcggcagcgcaaaagatg

SEQ ID NO: 133247 - DNA, 103 bp, Artificial Sequence
  Synthetic Polynucleotide
taatacgactcactataggggaagttcttcatcatccccaacacttttcaaacagaggagatgaaaaatgttggggatgaacctggcggcagcgcaaaagatg

SEQ ID NO: 133248 - DNA, 103 bp, Artificial Sequence
  Synthetic Polynucleotide
taatacgactcactatagggtcattttgctgaagttcttcatcatccccaaacagaggagatggggaatgtgaagaactaacctggcggcagcgcaaaagatg

SEQ ID NO: 133249 - DNA, 103 bp, Artificial Sequence
  Synthetic Polynucleotide
taatacgactcactatagggtgttccactttcattttgctgaagttcttcaacagaggagagaagaaatgcagcaaaataacctggcggcagcgcaaaagatg

SEQ ID NO: 133250 - DNA, 103 bp, Artificial Sequence
  Synthetic Polynucleotide
taatacgactcactatagggtttttggagatgttccactttcattttgctaacagaggagaagcaaaatgaaagtggaaaacctggcggcagcgcaaaagatg

SEQ ID NO: 133251 - DNA, 103 bp, Artificial Sequence
  Synthetic Polynucleotide
taatacgactcactatagggccttcagaactttttggagatgttccacttaacagaggagaaagtggatgatctccaaaaacctggcggcagcgcaaaagatg

SEQ ID NO: 133252 - DNA, 103 bp, Artificial Sequence
  Synthetic Polynucleotide
taatacgactcactatagggaaactgaaggccttcagaactttttggagaaacagaggagatctccaatgagttctgaaaacctggcggcagcgcaaaagatg

SEQ ID NO: 133253 - DNA, 103 bp, Artificial Sequence
  Synthetic Polynucleotide
taatacgactcactataggggagcattctgaaactgaaggccttcagaacaacagaggagagttctgatggccttcagtaacctggcggcagcgcaaaagatg

SEQ ID NO: 133254 - DNA, 103 bp, Artificial Sequence
  Synthetic Polynucleotide
taatacgactcactatagggttacagcccagagcattctgaaactgaaggaacagaggagaccttcaatgtcagaatgcaacctggcggcagcgcaaaagatg

SEQ ID NO: 133255 - DNA, 103 bp, Artificial Sequence
  Synthetic Polynucleotide
taatacgactcactatagggcaaactgggattacagcccagagcattctgaacagaggagacagaatatgctgggctgtaacctggcggcagcgcaaaagatg

SEQ ID NO: 133256 - DNA, 103 bp, Artificial Sequence
  Synthetic Polynucleotide
taatacgactcactatagggctccattttgtttggtaaactgcttcccataacagaggagaatgggaatgagtttaccaaacctggcggcagcgcaaaagatg

SEQ ID NO: 133257 - DNA, 103 bp, Artificial Sequence
  Synthetic Polynucleotide
taatacgactcactatagggtatgtttaggcaaactgggattacagcccaaacagaggagatgggctatgatcccagttaacctggcggcagcgcaaaagatg

SEQ ID NO: 133258 - DNA, 103 bp, Artificial Sequence
  Synthetic Polynucleotide
taatacgactcactatagggatggtaacattatgtttaggcaaactgggaaacagaggagatcccagatggcctaaacaaacctggcggcagcgcaaaagatg

SEQ ID NO: 133259 - DNA, 103 bp, Artificial Sequence
  Synthetic Polynucleotide
taatacgactcactataggggtcacttcttatggtaacattatgtttaggaacagaggagacctaaaatgaatgttaccaacctggcggcagcgcaaaagatg

SEQ ID NO: 133260 - DNA, 103 bp, Artificial Sequence
  Synthetic Polynucleotide
taatacgactcactatagggtatgctgctggtcacttcttatggtaacataacagaggagaatgttaatgtaagaagtgaacctggcggcagcgcaaaagatg

SEQ ID NO: 133261 - DNA, 103 bp, Artificial Sequence
  Synthetic Polynucleotide
taatacgactcactatagggtgtatatttttatgctgctggtcacttcttaacagaggagaaagaagatgccagcagcaaacctggcggcagcgcaaaagatg

SEQ ID NO: 133262 - DNA, 103 bp, Artificial Sequence
  Synthetic Polynucleotide
taatacgactcactataggggttttgcaactgtatatttttatgctgctgaacagaggagacagcagatgaaaaatataaacctggcggcagcgcaaaagatg

SEQ ID NO: 133263 - DNA, 103 bp, Artificial Sequence
  Synthetic Polynucleotide
taatacgactcactataggggaatatgggagttttgcaactgtatattttaacagaggagaaaaataatgagttgcaaaaacctggcggcagcgcaaaagatg

SEQ ID NO: 133264 - DNA, 103 bp, Artificial Sequence
  Synthetic Polynucleotide
taatacgactcactataggggcaacaaggtgaatatgggagttttgcaacaacagaggagagttgcaatgctcccatataacctggcggcagcgcaaaagatg

SEQ ID NO: 133265 - DNA, 103 bp, Artificial Sequence
  Synthetic Polynucleotide
taatacgactcactatagggagggcccctggcaacaaggtgaatatgggaaacagaggagatcccatatgcaccttgttaacctggcggcagcgcaaaagatg

SEQ ID NO: 133266 - DNA, 103 bp, Artificial Sequence
  Synthetic Polynucleotide
taatacgactcactatagggtggtctgctcagggcccctggcaacaaggtaacagaggagaaccttgatgccaggggccaacctggcggcagcgcaaaagatg

SEQ ID NO: 133267 - DNA, 103 bp, Artificial Sequence
  Synthetic Polynucleotide
taatacgactcactatagggccaggtgtttctccattttgtttggtaaacaacagaggagagtttacatgacaaaatggaacctggcggcagcgcaaaagatg

SEQ ID NO: 133268 - DNA, 103 bp, Artificial Sequence
  Synthetic Polynucleotide
taatacgactcactatagggttgggatccatggtctgctcagggcccctgaacagaggagacaggggatgtgagcagacaacctggcggcagcgcaaaagatg

SEQ ID NO: 133269 - DNA, 103 bp, Artificial Sequence
  Synthetic Polynucleotide
taatacgactcactatagggggtcgacagcttgggatccatggtctgctcaacagaggagagagcagatgatggatcccaacctggcggcagcgcaaaagatg

SEQ ID NO: 133270 - DNA, 103 bp, Artificial Sequence
  Synthetic Polynucleotide
taatacgactcactataggggttccatgatggtcgacagcttgggatccaaacagaggagatggatcatgagctgtcgaaacctggcggcagcgcaaaagatg

SEQ ID NO: 133271 - DNA, 103 bp, Artificial Sequence
  Synthetic Polynucleotide
taatacgactcactatagggcttatctgttgttccatgatggtcgacagcaacagaggagagctgtcatgcatcatggaaacctggcggcagcgcaaaagatg

SEQ ID NO: 133272 - DNA, 103 bp, Artificial Sequence
  Synthetic Polynucleotide
taatacgactcactatagggggctgctgaacttatctgttgttccatgataacagaggagaatcatgatgcaacagataaacctggcggcagcgcaaaagatg

SEQ ID NO: 133273 - DNA, 103 bp, Artificial Sequence
  Synthetic Polynucleotide
taatacgactcactatagggtcttgtcctgggctgctgaacttatctgttaacagaggagaaacagaatggttcagcagaacctggcggcagcgcaaaagatg

SEQ ID NO: 133274 - DNA, 103 bp, Artificial Sequence
  Synthetic Polynucleotide
taatacgactcactatagggtgcagttctatcttgtcctgggctgctgaaaacagaggagattcagcatgccaggacaaaacctggcggcagcgcaaaagatg

SEQ ID NO: 133275 - DNA, 103 bp, Artificial Sequence
  Synthetic Polynucleotide
taatacgactcactatagggtccgtgtctctgcagttctatcttgtcctgaacagaggagacaggacatgatagaactgaacctggcggcagcgcaaaagatg

SEQ ID NO: 133276 - DNA, 103 bp, Artificial Sequence
  Synthetic Polynucleotide
taatacgactcactatagggagattccagttccgtgtctctgcagttctaaacagaggagatagaacatgagagacacgaacctggcggcagcgcaaaagatg

SEQ ID NO: 133277 - DNA, 103 bp, Artificial Sequence
  Synthetic Polynucleotide
taatacgactcactatagggtggatgacagagattccagttccgtgtctcaacagaggagagagacaatgaactggaataacctggcggcagcgcaaaagatg

SEQ ID NO: 133278 - DNA, 103 bp, Artificial Sequence
  Synthetic Polynucleotide
taatacgactcactatagggagcaattattccaggtgtttctccattttgaacagaggagacaaaatatggaaacacctaacctggcggcagcgcaaaagatg

SEQ ID NO: 133279 - DNA, 103 bp, Artificial Sequence
  Synthetic Polynucleotide
taatacgactcactataggggttggtgtgctggatgacagagattccagtaacagaggagaactggaatgtctgtcatcaacctggcggcagcgcaaaagatg

SEQ ID NO: 133280 - DNA, 103 bp, Artificial Sequence
  Synthetic Polynucleotide
taatacgactcactatagggtgctcagggagttggtgtgctggatgacagaacagaggagactgtcaatgagcacaccaaacctggcggcagcgcaaaagatg

SEQ ID NO: 133281 - DNA, 103 bp, Artificial Sequence
  Synthetic Polynucleotide
taatacgactcactataggggagttgggcctgctcagggagttggtgtgcaacagaggagagcacacatgctccctgagaacctggcggcagcgcaaaagatg

SEQ ID NO: 133282 - DNA, 103 bp, Artificial Sequence
  Synthetic Polynucleotide
taatacgactcactatagggcttgtcaaatgagttgggcctgctcagggaaacagaggagatccctgatgaggcccaacaacctggcggcagcgcaaaagatg

SEQ ID NO: 133283 - DNA, 103 bp, Artificial Sequence
  Synthetic Polynucleotide
taatacgactcactatagggaaggctcaggcttgtcaaatgagttgggccaacagaggagaggcccaatgcatttgacaaacctggcggcagcgcaaaagatg

SEQ ID NO: 133284 - DNA, 103 bp, Artificial Sequence
  Synthetic Polynucleotide
taatacgactcactataggggctctttcaaaaggctcaggcttgtcaaataacagaggagaatttgaatggcctgagccaacctggcggcagcgcaaaagatg

SEQ ID NO: 133285 - DNA, 103 bp, Artificial Sequence
  Synthetic Polynucleotide
taatacgactcactatagggaactggggaggctctttcaaaaggctcaggaacagaggagacctgagatgtttgaaagaaacctggcggcagcgcaaaagatg

SEQ ID NO: 133286 - DNA, 103 bp, Artificial Sequence
  Synthetic Polynucleotide
taatacgactcactatagggcctggaaagaaactggggaggctctttcaaaacagaggagattgaaaatgcctccccagaacctggcggcagcgcaaaagatg

SEQ ID NO: 133287 - DNA, 103 bp, Artificial Sequence
  Synthetic Polynucleotide
taatacgactcactatagggctattcagctcctggaaagaaactggggagaacagaggagactccccatgttctttccaaacctggcggcagcgcaaaagatg

SEQ ID NO: 133288 - DNA, 103 bp, Artificial Sequence
  Synthetic Polynucleotide
taatacgactcactatagggcttccccgttctattcagctcctggaaagaaacagaggagatctttcatggagctgaataacctggcggcagcgcaaaagatg

SEQ ID NO: 133289 - DNA, 103 bp, Artificial Sequence
  Synthetic Polynucleotide
taatacgactcactatagggttgaggcttcagcaattattccaggtgtttaacagaggagaaaacacatggaataattgaacctggcggcagcgcaaaagatg

SEQ ID NO: 133290 - DNA, 103 bp, Artificial Sequence
  Synthetic Polynucleotide
taatacgactcactataggggagacccggacttccccgttctattcagctaacagaggagaagctgaatggaacggggaaacctggcggcagcgcaaaagatg

SEQ ID NO: 133291 - DNA, 103 bp, Artificial Sequence
  Synthetic Polynucleotide
taatacgactcactatagggatcacttttagagacccggacttccccgttaacagaggagaaacgggatggtccgggtcaacctggcggcagcgcaaaagatg

SEQ ID NO: 133292 - DNA, 103 bp, Artificial Sequence
  Synthetic Polynucleotide
taatacgactcactatagggggagattcctatcacttttagagacccggaaacagaggagatccgggatgctaaaagtgaacctggcggcagcgcaaaagatg

SEQ ID NO: 133293 - DNA, 103 bp, Artificial Sequence
  Synthetic Polynucleotide
taatacgactcactatagggtttcctcttgggagattcctatcacttttaaacagaggagataaaagatgtaggaatctaacctggcggcagcgcaaaagatg

SEQ ID NO: 133294 - DNA, 103 bp, Artificial Sequence
  Synthetic Polynucleotide
taatacgactcactataggggaagggtgactttcctcttgggagattcctaacagaggagaaggaatatgccaagaggaaacctggcggcagcgcaaaagatg

SEQ ID NO: 133295 - DNA, 103 bp, Artificial Sequence
  Synthetic Polynucleotide
taatacgactcactatagggcccgtcccgagaagggtgactttcctcttgaacagaggagacaagagatgagtcaccctaacctggcggcagcgcaaaagatg

SEQ ID NO: 133296 - DNA, 103 bp, Artificial Sequence
  Synthetic Polynucleotide
taatacgactcactataggggaggatgagacccgtcccgagaagggtgacaacagaggagagtcaccatgctcgggacgaacctggcggcagcgcaaaagatg

SEQ ID NO: 133297 - DNA, 103 bp, Artificial Sequence
  Synthetic Polynucleotide
taatacgactcactataggggcaagctggtgaggatgagacccgtcccgaaacagaggagatcgggaatggtctcatccaacctggcggcagcgcaaaagatg

SEQ ID NO: 133298 - DNA, 103 bp, Artificial Sequence
  Synthetic Polynucleotide
taatacgactcactataggggtctgatagtgcaagctggtgaggatgagaaacagaggagatctcatatgcaccagcttaacctggcggcagcgcaaaagatg

SEQ ID NO: 133299 - DNA, 103 bp, Artificial Sequence
  Synthetic Polynucleotide
taatacgactcactatagggctctgagagcgtctgatagtgcaagctggtaacagaggagaaccagcatgcactatcagaacctggcggcagcgcaaaagatg

SEQ ID NO: 133300 - DNA, 103 bp, Artificial Sequence
  Synthetic Polynucleotide
taatacgactcactatagggtcttcagattttgaggcttcagcaattattaacagaggagaaataatatgtgaagcctcaacctggcggcagcgcaaaagatg

SEQ ID NO: 133301 - DNA, 103 bp, Artificial Sequence
  Synthetic Polynucleotide
taatacgactcactatagggtgaagttctcctctgagagcgtctgatagtaacagaggagaactatcatgcgctctcagaacctggcggcagcgcaaaagatg

SEQ ID NO: 133302 - DNA, 103 bp, Artificial Sequence
  Synthetic Polynucleotide
taatacgactcactatagggggagctttcctgaagttctcctctgagagcaacagaggagagctctcatgggagaacttaacctggcggcagcgcaaaagatg

SEQ ID NO: 133303 - DNA, 103 bp, Artificial Sequence
  Synthetic Polynucleotide
taatacgactcactataggggactctttctggagctttcctgaagttctcaacagaggagagagaacatgaggaaagctaacctggcggcagcgcaaaagatg

SEQ ID NO: 133304 - DNA, 103 bp, Artificial Sequence
  Synthetic Polynucleotide
taatacgactcactatagggcgttcacttggactctttctggagctttccaacagaggagaggaaagatgcagaaagagaacctggcggcagcgcaaaagatg

SEQ ID NO: 133305 - DNA, 103 bp, Artificial Sequence
  Synthetic Polynucleotide
taatacgactcactatagggtaacacatgtcgttcacttggactctttctaacagaggagaagaaagatgccaagtgaaaacctggcggcagcgcaaaagatg

SEQ ID NO: 133306 - DNA, 103 bp, Artificial Sequence
  Synthetic Polynucleotide
taatacgactcactatagggagggctgtcctaacacatgtcgttcacttgaacagaggagacaagtgatggacatgtgtaacctggcggcagcgcaaaagatg

SEQ ID NO: 133307 - DNA, 103 bp, Artificial Sequence
  Synthetic Polynucleotide
taatacgactcactatagggacaagtcttgagggctgtcctaacacatgtaacagaggagaacatgtatgaggacagccaacctggcggcagcgcaaaagatg

SEQ ID NO: 133308 - DNA, 103 bp, Artificial Sequence
  Synthetic Polynucleotide
taatacgactcactataggggtgctgccggacaagtcttgagggctgtccaacagaggagaggacagatgtcaagacttaacctggcggcagcgcaaaagatg

SEQ ID NO: 133309 - DNA, 103 bp, Artificial Sequence
  Synthetic Polynucleotide
taatacgactcactatagggcttggatgttgtgctgccggacaagtcttgaacagaggagacaagacatgtccggcagcaacctggcggcagcgcaaaagatg

SEQ ID NO: 133310 - DNA, 103 bp, Artificial Sequence
  Synthetic Polynucleotide
taatacgactcactatagggatctctggaacttggatgttgtgctgccggaacagaggagaccggcaatgcaacatccaaacctggcggcagcgcaaaagatg

SEQ ID NO: 133311 - DNA, 103 bp, Artificial Sequence
  Synthetic Polynucleotide
taatacgactcactatagggggagacagattcttcagattttgaggcttcaacagaggagagaagccatgaaatctgaaaacctggcggcagcgcaaaagatg

SEQ ID NO: 133312 - DNA, 103 bp, Artificial Sequence
  Synthetic Polynucleotide
taatacgactcactatagggtgtgaccaaaatctctggaacttggatgttaacagaggagaaacatcatggttccagagaacctggcggcagcgcaaaagatg

SEQ ID NO: 133313 - DNA, 103 bp, Artificial Sequence
  Synthetic Polynucleotide
taatacgactcactatagggctggttcttctgtgaccaaaatctctggaaaacagaggagattccagatgttttggtcaaacctggcggcagcgcaaaagatg

SEQ ID NO: 133314 - DNA, 103 bp, Artificial Sequence
  Synthetic Polynucleotide
taatacgactcactatagggaggtctcgatctggttcttctgtgaccaaaaacagaggagatttggtatgagaagaaccaacctggcggcagcgcaaaagatg

SEQ ID NO: 133315 - DNA, 103 bp, Artificial Sequence
  Synthetic Polynucleotide
taatacgactcactatagggttgagcttccaggtctcgatctggttcttcaacagaggagagaagaaatggatcgagacaacctggcggcagcgcaaaagatg

SEQ ID NO: 133316 - DNA, 103 bp, Artificial Sequence
  Synthetic Polynucleotide
taatacgactcactataggggatcatggcattgagcttccaggtctcgataacagaggagaatcgagatgtggaagctcaacctggcggcagcgcaaaagatg

SEQ ID NO: 133317 - DNA, 103 bp, Artificial Sequence
  Synthetic Polynucleotide
taatacgactcactataggggacttttcttgatcatggcattgagcttccaacagaggagaggaagcatgatgccatgaaacctggcggcagcgcaaaagatg

SEQ ID NO: 133318 - DNA, 103 bp, Artificial Sequence
  Synthetic Polynucleotide
taatacgactcactataggggaacttctctgacttttcttgatcatggcaaacagaggagatgccatatgcaagaaaagaacctggcggcagcgcaaaagatg

SEQ ID NO: 133319 - DNA, 103 bp, Artificial Sequence
  Synthetic Polynucleotide
taatacgactcactatagggggggccaactgaacttctctgacttttcttaacagaggagaaagaaaatgcagagaagtaacctggcggcagcgcaaaagatg

SEQ ID NO: 133320 - DNA, 103 bp, Artificial Sequence
  Synthetic Polynucleotide
taatacgactcactatagggtcactacgctggggccaactgaacttctctaacagaggagaagagaaatgcagttggccaacctggcggcagcgcaaaagatg

SEQ ID NO: 133321 - DNA, 103 bp, Artificial Sequence
  Synthetic Polynucleotide
taatacgactcactatagggtgacaaggtttcactacgctggggccaactaacagaggagaagttggatgcagcgtagtaacctggcggcagcgcaaaagatg

SEQ ID NO: 133322 - DNA, 103 bp, Artificial Sequence
  Synthetic Polynucleotide
taatacgactcactataggggcttctttggggagacagattcttcagattaacagaggagaaatctgatgaatctgtctaacctggcggcagcgcaaaagatg

SEQ ID NO: 133323 - DNA, 103 bp, Artificial Sequence
  Synthetic Polynucleotide
taatacgactcactatagggttggcaattttgacaaggtttcactacgctaacagaggagaagcgtaatgaaaccttgtaacctggcggcagcgcaaaagatg

SEQ ID NO: 133324 - DNA, 103 bp, Artificial Sequence
  Synthetic Polynucleotide
taatacgactcactatagggagtttctctgttggcaattttgacaaggttaacagaggagaaaccttatgaaaattgccaacctggcggcagcgcaaaagatg

SEQ ID NO: 133325 - DNA, 103 bp, Artificial Sequence
  Synthetic Polynucleotide
taatacgactcactatagggtttgggtggcagtttctctgttggcaatttaacagaggagaaaattgatgacagagaaaaacctggcggcagcgcaaaagatg

SEQ ID NO: 133326 - DNA, 103 bp, Artificial Sequence
  Synthetic Polynucleotide
taatacgactcactataggggccttttctttttgggtggcagtttctctgaacagaggagacagagaatgtgccacccaaacctggcggcagcgcaaaagatg

SEQ ID NO: 133327 - DNA, 103 bp, Artificial Sequence
  Synthetic Polynucleotide
taatacgactcactataggggccagacggagccttttctttttgggtggcaacagaggagagccaccatgaaagaaaagaacctggcggcagcgcaaaagatg

SEQ ID NO: 133328 - DNA, 103 bp, Artificial Sequence
  Synthetic Polynucleotide
taatacgactcactatagggttctatctcagccagacggagccttttcttaacagaggagaaagaaaatgctccgtctgaacctggcggcagcgcaaaagatg

SEQ ID NO: 133329 - DNA, 103 bp, Artificial Sequence
  Synthetic Polynucleotide
taatacgactcactatagggttgaggaatgttctatctcagccagacggaaacagaggagatccgtcatgctgagatagaacctggcggcagcgcaaaagatg

SEQ ID NO: 133330 - DNA, 103 bp, Artificial Sequence
  Synthetic Polynucleotide
taatacgactcactatagggctcgattctgttgaggaatgttctatctcaaacagaggagatgagatatgacattcctcaacctggcggcagcgcaaaagatg

SEQ ID NO: 133331 - DNA, 103 bp, Artificial Sequence
  Synthetic Polynucleotide
taatacgactcactatagggggaatcaaagctcgattctgttgaggaatgaacagaggagacattccatgacagaatcgaacctggcggcagcgcaaaagatg

SEQ ID NO: 133332 - DNA, 103 bp, Artificial Sequence
  Synthetic Polynucleotide
taatacgactcactatagggtggagagagtggaatcaaagctcgattctgaacagaggagacagaatatggctttgattaacctggcggcagcgcaaaagatg

SEQ ID NO: 133333 - DNA, 103 bp, Artificial Sequence
  Synthetic Polynucleotide
taatacgactcactatagggagaaacaagggcttctttggggagacagataacagaggagaatctgtatgcccaaagaaaacctggcggcagcgcaaaagatg

SEQ ID NO: 133334 - DNA, 103 bp, Artificial Sequence
  Synthetic Polynucleotide
taatacgactcactatagggcttagactcctggagagagtggaatcaaagaacagaggagactttgaatgcactctctcaacctggcggcagcgcaaaagatg

SEQ ID NO: 133335 - DNA, 103 bp, Artificial Sequence
  Synthetic Polynucleotide
taatacgactcactataggggctctccctacttagactcctggagagagtaacagaggagaactctcatgaggagtctaaacctggcggcagcgcaaaagatg

SEQ ID NO: 133336 - DNA, 103 bp, Artificial Sequence
  Synthetic Polynucleotide
taatacgactcactataggggagataaactgctctccctacttagactccaacagaggagaggagtcatggtagggagaaacctggcggcagcgcaaaagatg

SEQ ID NO: 133337 - DNA, 103 bp, Artificial Sequence
  Synthetic Polynucleotide
taatacgactcactatagggcttgaagtgtgagataaactgctctccctaaacagaggagatagggaatgcagtttatcaacctggcggcagcgcaaaagatg

SEQ ID NO: 133338 - DNA, 103 bp, Artificial Sequence
  Synthetic Polynucleotide
taatacgactcactatagggggctgagaaacttgaagtgtgagataaactaacagaggagaagtttaatgcacacttcaaacctggcggcagcgcaaaagatg

SEQ ID NO: 133339 - DNA, 103 bp, Artificial Sequence
  Synthetic Polynucleotide
taatacgactcactatagggtgtctaaagaggctgagaaacttgaagtgtaacagaggagaacacttatggtttctcagaacctggcggcagcgcaaaagatg

SEQ ID NO: 133340 - DNA, 103 bp, Artificial Sequence
  Synthetic Polynucleotide
taatacgactcactatagggacgtcctctatgtctaaagaggctgagaaaaacagaggagatttctcatgctctttagaaacctggcggcagcgcaaaagatg

SEQ ID NO: 133341 - DNA, 103 bp, Artificial Sequence
  Synthetic Polynucleotide
taatacgactcactatagggcgttttagaaacgtcctctatgtctaaagaaacagaggagatctttaatgatagaggacaacctggcggcagcgcaaaagatg

SEQ ID NO: 133342 - DNA, 103 bp, Artificial Sequence
  Synthetic Polynucleotide
taatacgactcactataggggggaagcctccgttttagaaacgtcctctaaacagaggagatagaggatgtttctaaaaaacctggcggcagcgcaaaagatg

SEQ ID NO: 133343 - DNA, 103 bp, Artificial Sequence
  Synthetic Polynucleotide
taatacgactcactatagggtcgattttgggggaagcctccgttttagaaaacagaggagattctaaatgggaggcttcaacctggcggcagcgcaaaagatg

SEQ ID NO: 133344 - DNA, 103 bp, Artificial Sequence
  Synthetic Polynucleotide
taatacgactcactatagggttgtgcttcttcaattttgtctcttagattaacagaggagaaatctaatggacaaaattaacctggcggcagcgcaaaagatg

SEQ ID NO: 133345 - DNA, 103 bp, Artificial Sequence
  Synthetic Polynucleotide
taatacgactcactatagggtggttgctgcagaaacaagggcttctttggaacagaggagaccaaagatgcccttgtttaacctggcggcagcgcaaaagatg

SEQ ID NO: 133346 - DNA, 103 bp, Artificial Sequence
  Synthetic Polynucleotide
taatacgactcactatagggatttagaaaatcgattttgggggaagcctcaacagaggagagaggctatgcccaaaatcaacctggcggcagcgcaaaagatg

SEQ ID NO: 133347 - DNA, 103 bp, Artificial Sequence
  Synthetic Polynucleotide
taatacgactcactatagggactcggctttatttagaaaatcgattttggaacagaggagaccaaaaatgattttctaaaacctggcggcagcgcaaaagatg

SEQ ID NO: 133348 - DNA, 103 bp, Artificial Sequence
  Synthetic Polynucleotide
taatacgactcactatagggatcataagaaactcggctttatttagaaaaaacagaggagattttctatgtaaagccgaaacctggcggcagcgcaaaagatg

SEQ ID NO: 133349 - DNA, 103 bp, Artificial Sequence
  Synthetic Polynucleotide
taatacgactcactataggggccagctggaatcataagaaactcggctttaacagaggagaaaagccatgtttcttatgaacctggcggcagcgcaaaagatg

SEQ ID NO: 133350 - DNA, 103 bp, Artificial Sequence
  Synthetic Polynucleotide
taatacgactcactataggggagtattcaagccagctggaatcataagaaaacagaggagattcttaatgttccagctgaacctggcggcagcgcaaaagatg

SEQ ID NO: 133351 - DNA, 103 bp, Artificial Sequence
  Synthetic Polynucleotide
taatacgactcactatagggggaacattcagagtattcaagccagctggaaacagaggagatccagcatgcttgaatacaacctggcggcagcgcaaaagatg

SEQ ID NO: 133352 - DNA, 103 bp, Artificial Sequence
  Synthetic Polynucleotide
taatacgactcactataggggtgacatccaggaacattcagagtattcaaaacagaggagattgaatatgctgaatgttaacctggcggcagcgcaaaagatg

SEQ ID NO: 133353 - DNA, 103 bp, Artificial Sequence
  Synthetic Polynucleotide
taatacgactcactatagggtcatttcccggtgacatccaggaacattcaaacagaggagatgaatgatgctggatgtcaacctggcggcagcgcaaaagatg

SEQ ID NO: 133354 - DNA, 103 bp, Artificial Sequence
  Synthetic Polynucleotide
taatacgactcactataggggcagtacgcctcatttcccggtgacatccaaacagaggagatggatgatgccgggaaataacctggcggcagcgcaaaagatg

SEQ ID NO: 133355 - DNA, 103 bp, Artificial Sequence
  Synthetic Polynucleotide
taatacgactcactatagggctgttctgatgcagtacgcctcatttcccgaacagaggagacgggaaatgaggcgtactaacctggcggcagcgcaaaagatg

SEQ ID NO: 133356 - DNA, 103 bp, Artificial Sequence
  Synthetic Polynucleotide
taatacgactcactataggggcagttcagatggttgctgcagaaacaaggaacagaggagaccttgtatgtgcagcaacaacctggcggcagcgcaaaagatg

SEQ ID NO: 133357 - DNA, 103 bp, Artificial Sequence
  Synthetic Polynucleotide
taatacgactcactatagggtgcaattaatctgttctgatgcagtacgccaacagaggagaggcgtaatgcatcagaacaacctggcggcagcgcaaaagatg

SEQ ID NO: 133358 - DNA, 103 bp, Artificial Sequence
  Synthetic Polynucleotide
taatacgactcactataggggacgtttgcgtgcaattaatctgttctgataacagaggagaatcagaatggattaattgaacctggcggcagcgcaaaagatg

SEQ ID NO: 133359 - DNA, 103 bp, Artificial Sequence
  Synthetic Polynucleotide
taatacgactcactataggggacctccattgacgtttgcgtgcaattaataacagaggagaattaatatgacgcaaacgaacctggcggcagcgcaaaagatg

SEQ ID NO: 133360 - DNA, 103 bp, Artificial Sequence
  Synthetic Polynucleotide
taatacgactcactatagggtgagatcagagacctccattgacgtttgcgaacagaggagacgcaaaatgcaatggaggaacctggcggcagcgcaaaagatg

SEQ ID NO: 133361 - DNA, 103 bp, Artificial Sequence
  Synthetic Polynucleotide
taatacgactcactataggggatttgcttctgagatcagagacctccattaacagaggagaaatggaatgctctgatctaacctggcggcagcgcaaaagatg

SEQ ID NO: 133362 - DNA, 103 bp, Artificial Sequence
  Synthetic Polynucleotide
taatacgactcactatagggacaatcgaatgatttgcttctgagatcagaaacagaggagatctgatatgagaagcaaaaacctggcggcagcgcaaaagatg

SEQ ID NO: 133363 - DNA, 103 bp, Artificial Sequence
  Synthetic Polynucleotide
taatacgactcactatagggtgatgcttccacaatcgaatgatttgcttcaacagaggagagaagcaatgcattcgattaacctggcggcagcgcaaaagatg

SEQ ID NO: 133364 - DNA, 103 bp, Artificial Sequence
  Synthetic Polynucleotide
taatacgactcactatagggtggggtggggtgatgcttccacaatcgaataacagaggagaattcgaatgtggaagcataacctggcggcagcgcaaaagatg

SEQ ID NO: 133365 - DNA, 103 bp, Artificial Sequence
  Synthetic Polynucleotide
taatacgactcactatagggtggtgttgtctggggtggggtgatgcttccaacagaggagaggaagcatgaccccacccaacctggcggcagcgcaaaagatg

SEQ ID NO: 133366 - DNA, 103 bp, Artificial Sequence
  Synthetic Polynucleotide
taatacgactcactatagggattcagtaagtggtgttgtctggggtggggaacagaggagaccccacatgagacaacacaacctggcggcagcgcaaaagatg

SEQ ID NO: 133367 - DNA, 103 bp, Artificial Sequence
  Synthetic Polynucleotide
taatacgactcactatagggctccatctacgcagttcagatggttgctgcaacagaggagagcagcaatgatctgaactaacctggcggcagcgcaaaagatg

SEQ ID NO: 133368 - DNA, 103 bp, Artificial Sequence
  Synthetic Polynucleotide
taatacgactcactatagggggaggctgcaattcagtaagtggtgttgtcaacagaggagagacaacatgacttactgaaacctggcggcagcgcaaaagatg

SEQ ID NO: 133369 - DNA, 103 bp, Artificial Sequence
  Synthetic Polynucleotide
taatacgactcactatagggaggtgaagatggaggctgcaattcagtaagaacagaggagacttactatgttgcagcctaacctggcggcagcgcaaaagatg

SEQ ID NO: 133370 - DNA, 103 bp, Artificial Sequence
  Synthetic Polynucleotide
taatacgactcactatagggccactcgagaaggtgaagatggaggctgcaaacagaggagatgcagcatgcatcttcacaacctggcggcagcgcaaaagatg

SEQ ID NO: 133371 - DNA, 103 bp, Artificial Sequence
  Synthetic Polynucleotide
taatacgactcactatagggccagtcactcccactcgagaaggtgaagataacagaggagaatcttcatgttctcgagtaacctggcggcagcgcaaaagatg

SEQ ID NO: 133372 - DNA, 103 bp, Artificial Sequence
  Synthetic Polynucleotide
taatacgactcactatagggaggcacatgcccagtcactcccactcgagaaacagaggagatctcgaatgggagtgactaacctggcggcagcgcaaaagatg

SEQ ID NO: 133373 - DNA, 103 bp, Artificial Sequence
  Synthetic Polynucleotide
taatacgactcactatagggtttctaagagaggcacatgcccagtcactcaacagaggagagagtgaatgggcatgtgcaacctggcggcagcgcaaaagatg

SEQ ID NO: 133374 - DNA, 103 bp, Artificial Sequence
  Synthetic Polynucleotide
taatacgactcactatagggcctctccttctttctaagagaggcacatgcaacagaggagagcatgtatgtctcttagaaacctggcggcagcgcaaaagatg

SEQ ID NO: 133375 - DNA, 103 bp, Artificial Sequence
  Synthetic Polynucleotide
taatacgactcactatagggtaccagtgggcctctccttctttctaagagaacagaggagactcttaatgagaaggagaaacctggcggcagcgcaaaagatg

SEQ ID NO: 133376 - DNA, 103 bp, Artificial Sequence
  Synthetic Polynucleotide
taatacgactcactatagggatatttgccgtaccagtgggcctctccttcaacagaggagagaaggaatggcccactggaacctggcggcagcgcaaaagatg

SEQ ID NO: 133377 - DNA, 103 bp, Artificial Sequence
  Synthetic Polynucleotide
taatacgactcactatagggatgtttaaagatatttgccgtaccagtgggaacagaggagacccactatgacggcaaataacctggcggcagcgcaaaagatg

SEQ ID NO: 133378 - DNA, 103 bp, Artificial Sequence
  Synthetic Polynucleotide
taatacgactcactataggggccttcggatctccatctacgcagttcagaaacagaggagatctgaaatgcgtagatggaacctggcggcagcgcaaaagatg

SEQ ID NO: 133379 - DNA, 103 bp, Artificial Sequence
  Synthetic Polynucleotide
taatacgactcactatagggatctggggctatgtttaaagatatttgccgaacagaggagacggcaaatgtctttaaacaacctggcggcagcgcaaaagatg

SEQ ID NO: 133380 - DNA, 103 bp, Artificial Sequence
  Synthetic Polynucleotide
taatacgactcactatagggacagatgactatctggggctatgtttaaagaacagaggagactttaaatgtagccccagaacctggcggcagcgcaaaagatg

SEQ ID NO: 133381 - DNA, 103 bp, Artificial Sequence
  Synthetic Polynucleotide
taatacgactcactatagggtgtacaggagacagatgactatctggggctaacagaggagaagccccatgtagtcatctaacctggcggcagcgcaaaagatg

SEQ ID NO: 133382 - DNA, 103 bp, Artificial Sequence
  Synthetic Polynucleotide
taatacgactcactatagggagatgttgggtgtacaggagacagatgactaacagaggagaagtcatatgtctcctgtaaacctggcggcagcgcaaaagatg

SEQ ID NO: 133383 - DNA, 103 bp, Artificial Sequence
  Synthetic Polynucleotide
taatacgactcactatagggtattttggaaagatgttgggtgtacaggagaacagaggagactcctgatgacccaacataacctggcggcagcgcaaaagatg

SEQ ID NO: 133384 - DNA, 103 bp, Artificial Sequence
  Synthetic Polynucleotide
taatacgactcactatagggggaagagcagtattttggaaagatgttgggaacagaggagacccaacatgtttccaaaaaacctggcggcagcgcaaaagatg

SEQ ID NO: 133385 - DNA, 103 bp, Artificial Sequence
  Synthetic Polynucleotide
taatacgactcactatagggattcacactgggaagagcagtattttggaaaacagaggagattccaaatgactgctcttaacctggcggcagcgcaaaagatg

SEQ ID NO: 133386 - DNA, 103 bp, Artificial Sequence
  Synthetic Polynucleotide
taatacgactcactatagggatggcactgcattcacactgggaagagcagaacagaggagactgctcatgccagtgtgaaacctggcggcagcgcaaaagatg

SEQ ID NO: 133387 - DNA, 103 bp, Artificial Sequence
  Synthetic Polynucleotide
taatacgactcactatagggggcccctgatatggcactgcattcacactgaacagaggagacagtgtatgtgcagtgccaacctggcggcagcgcaaaagatg

SEQ ID NO: 133388 - DNA, 103 bp, Artificial Sequence
  Synthetic Polynucleotide
taatacgactcactatagggagtgagctgaggcccctgatatggcactgcaacagaggagagcagtgatgtatcaggggaacctggcggcagcgcaaaagatg

SEQ ID NO: 133389 - DNA, 103 bp, Artificial Sequence
  Synthetic Polynucleotide
taatacgactcactatagggcaggatcagcgccttcggatctccatctacaacagaggagagtagatatggatccgaagaacctggcggcagcgcaaaagatg

SEQ ID NO: 133390 - DNA, 103 bp, Artificial Sequence
  Synthetic Polynucleotide
taatacgactcactatagggaagatgtactagtgagctgaggcccctgataacagaggagaatcaggatgctcagctcaaacctggcggcagcgcaaaagatg

SEQ ID NO: 133391 - DNA, 103 bp, Artificial Sequence
  Synthetic Polynucleotide
taatacgactcactatagggaactcagctaaagatgtactagtgagctgaaacagaggagatcagctatgtagtacatcaacctggcggcagcgcaaaagatg

SEQ ID NO: 133392 - DNA, 103 bp, Artificial Sequence
  Synthetic Polynucleotide
taatacgactcactatagggatttgcagaaaactcagctaaagatgtactaacagaggagaagtacaatgttagctgagaacctggcggcagcgcaaaagatg

SEQ ID NO: 133393 - DNA, 103 bp, Artificial Sequence
  Synthetic Polynucleotide
taatacgactcactatagggagtgcaaagtatttgcagaaaactcagctaaacagaggagatagctgatgtttctgcaaaacctggcggcagcgcaaaagatg

SEQ ID NO: 133394 - DNA, 103 bp, Artificial Sequence
  Synthetic Polynucleotide
taatacgactcactatagggtgagtctgagagtgcaaagtatttgcagaaaacagaggagattctgcatgtactttgcaaacctggcggcagcgcaaaagatg

SEQ ID NO: 133395 - DNA, 103 bp, Artificial Sequence
  Synthetic Polynucleotide
taatacgactcactatagggatccttaacctgagtctgagagtgcaaagtaacagaggagaactttgatgtctcagactaacctggcggcagcgcaaaagatg

SEQ ID NO: 133396 - DNA, 103 bp, Artificial Sequence
  Synthetic Polynucleotide
taatacgactcactatagggctgcctgcagatccttaacctgagtctgagaacagaggagactcagaatgaggttaaggaacctggcggcagcgcaaaagatg

SEQ ID NO: 133397 - DNA, 103 bp, Artificial Sequence
  Synthetic Polynucleotide
taatacgactcactatagggtttgatgtttctgcctgcagatccttaaccaacagaggagaggttaaatgtctgcaggcaacctggcggcagcgcaaaagatg

SEQ ID NO: 133398 - DNA, 103 bp, Artificial Sequence
  Synthetic Polynucleotide
taatacgactcactatagggagagctggagtttgatgtttctgcctgcagaacagaggagactgcagatggaaacatcaaacctggcggcagcgcaaaagatg

SEQ ID NO: 133399 - DNA, 103 bp, Artificial Sequence
  Synthetic Polynucleotide
taatacgactcactatagggaaacgttggtagagctggagtttgatgtttaacagaggagaaaacatatgactccagctaacctggcggcagcgcaaaagatg

SEQ ID NO: 133400 - DNA, 103 bp, Artificial Sequence
  Synthetic Polynucleotide
taatacgactcactatagggctgaatttggcaggatcagcgccttcggataacagaggagaatccgaatgcgctgatccaacctggcggcagcgcaaaagatg

SEQ ID NO: 133401 - DNA, 103 bp, Artificial Sequence
  Synthetic Polynucleotide
taatacgactcactatagggtgaacaggaaaaacgttggtagagctggagaacagaggagactccagatgtaccaacgtaacctggcggcagcgcaaaagatg

SEQ ID NO: 133402 - DNA, 103 bp, Artificial Sequence
  Synthetic Polynucleotide
taatacgactcactatagggacagagctgttgaacaggaaaaacgttggtaacagaggagaaccaacatgtttcctgttaacctggcggcagcgcaaaagatg

SEQ ID NO: 133403 - DNA, 103 bp, Artificial Sequence
  Synthetic Polynucleotide
taatacgactcactatagggaattgatatcacagagctgttgaacaggaaaacagaggagattcctgatgaacagctctaacctggcggcagcgcaaaagatg

SEQ ID NO: 133404 - DNA, 103 bp, Artificial Sequence
  Synthetic Polynucleotide
taatacgactcactatagggtgatttaacaaattgatatcacagagctgtaacagaggagaacagctatgtgatatcaaaacctggcggcagcgcaaaagatg

SEQ ID NO: 133405 - DNA, 103 bp, Artificial Sequence
  Synthetic Polynucleotide
taatacgactcactatagggtgcatggatttgatttaacaaattgatatcaacagaggagagatatcatgttgttaaataacctggcggcagcgcaaaagatg

SEQ ID NO: 133406 - DNA, 103 bp, Artificial Sequence
  Synthetic Polynucleotide
taatacgactcactatagggggctaggcggtgcatggatttgatttaacaaacagaggagatgttaaatgaaatccatgaacctggcggcagcgcaaaagatg

SEQ ID NO: 133407 - DNA, 103 bp, Artificial Sequence
  Synthetic Polynucleotide
taatacgactcactataggggtgctctggtggctaggcggtgcatggattaacagaggagaaatccaatgaccgcctagaacctggcggcagcgcaaaagatg

SEQ ID NO: 133408 - DNA, 103 bp, Artificial Sequence
  Synthetic Polynucleotide
taatacgactcactatagggagatagctgtgtgctctggtggctaggcggaacagaggagaccgcctatgcaccagagcaacctggcggcagcgcaaaagatg

SEQ ID NO: 133409 - DNA, 103 bp, Artificial Sequence
  Synthetic Polynucleotide
taatacgactcactatagggacacttgcagagatagctgtgtgctctggtaacagaggagaaccagaatgcacagctataacctggcggcagcgcaaaagatg

SEQ ID NO: 133410 - DNA, 103 bp, Artificial Sequence
  Synthetic Polynucleotide
taatacgactcactatagggccctgcgtagacacttgcagagatagctgtaacagaggagaacagctatgtctgcaagtaacctggcggcagcgcaaaagatg

SEQ ID NO: 133411 - DNA, 103 bp, Artificial Sequence
  Synthetic Polynucleotide
taatacgactcactatagggatcgaggtcactgaatttggcaggatcagcaacagaggagagctgatatggccaaattcaacctggcggcagcgcaaaagatg

SEQ ID NO: 133412 - DNA, 103 bp, Artificial Sequence
  Synthetic Polynucleotide
taatacgactcactatagggtggcttgctaccctgcgtagacacttgcagaacagaggagactgcaaatgtctacgcagaacctggcggcagcgcaaaagatg

SEQ ID NO: 133413 - DNA, 103 bp, Artificial Sequence
  Synthetic Polynucleotide
taatacgactcactatagggaatttttatctggcttgctaccctgcgtagaacagaggagactacgcatggtagcaagcaacctggcggcagcgcaaaagatg

SEQ ID NO: 133414 - DNA, 103 bp, Artificial Sequence
  Synthetic Polynucleotide
taatacgactcactataggggataaaacagaatttttatctggcttgctaaacagaggagatagcaaatgagataaaaaaacctggcggcagcgcaaaagatg

SEQ ID NO: 133415 - DNA, 103 bp, Artificial Sequence
  Synthetic Polynucleotide
taatacgactcactatagggagaagacccagataaaacagaatttttatcaacagaggagagataaaatgtctgttttaaacctggcggcagcgcaaaagatg

SEQ ID NO: 133416 - DNA, 103 bp, Artificial Sequence
  Synthetic Polynucleotide
taatacgactcactatagggcctcacttttagaagacccagataaaacagaacagaggagactgtttatgctgggtcttaacctggcggcagcgcaaaagatg

SEQ ID NO: 133417 - DNA, 103 bp, Artificial Sequence
  Synthetic Polynucleotide
taatacgactcactataggggcaaagcaatcctcacttttagaagacccaaacagaggagatgggtcatgtaaaagtgaaacctggcggcagcgcaaaagatg

SEQ ID NO: 133418 - DNA, 103 bp, Artificial Sequence
  Synthetic Polynucleotide
taatacgactcactataggggtatttgggagcaaagcaatcctcacttttaacagaggagaaaaagtatggattgctttaacctggcggcagcgcaaaagatg

SEQ ID NO: 133419 - DNA, 103 bp, Artificial Sequence
  Synthetic Polynucleotide
taatacgactcactatagggaatgcaattggtatttgggagcaaagcaataacagaggagaattgctatgctcccaaataacctggcggcagcgcaaaagatg

SEQ ID NO: 133420 - DNA, 103 bp, Artificial Sequence
  Synthetic Polynucleotide
taatacgactcactatagggaaaacctgacaatgcaattggtatttgggaaacagaggagatcccaaatgccaattgcaaacctggcggcagcgcaaaagatg

SEQ ID NO: 133421 - DNA, 103 bp, Artificial Sequence
  Synthetic Polynucleotide
taatacgactcactataggggcctgaagtgaaaacctgacaatgcaattgaacagaggagacaattgatgtgtcaggttaacctggcggcagcgcaaaagatg

SEQ ID NO: 133422 - DNA, 103 bp, Artificial Sequence
  Synthetic Polynucleotide
taatacgactcactatagggcacattgttcatcgaggtcactgaatttggaacagaggagaccaaatatggtgacctcgaacctggcggcagcgcaaaagatg

SEQ ID NO: 133423 - DNA, 103 bp, Artificial Sequence
  Synthetic Polynucleotide
taatacgactcactatagggagcaagatgggcctgaagtgaaaacctgacaacagaggagagtcaggatgtcacttcagaacctggcggcagcgcaaaagatg

SEQ ID NO: 133424 - DNA, 103 bp, Artificial Sequence
  Synthetic Polynucleotide
taatacgactcactatagggggattagaagagcaagatgggcctgaagtgaacagaggagacacttcatgcccatcttgaacctggcggcagcgcaaaagatg

SEQ ID NO: 133425 - DNA, 103 bp, Artificial Sequence
  Synthetic Polynucleotide
taatacgactcactatagggagaatgcacaggattagaagagcaagatggaacagaggagaccatctatgtcttctaataacctggcggcagcgcaaaagatg

SEQ ID NO: 133426 - DNA, 103 bp, Artificial Sequence
  Synthetic Polynucleotide
taatacgactcactataggggatttggcaaagaatgcacaggattagaagaacagaggagacttctaatgctgtgcattaacctggcggcagcgcaaaagatg

SEQ ID NO: 133427 - DNA, 103 bp, Artificial Sequence
  Synthetic Polynucleotide
taatacgactcactataggggaaataacttgatttggcaaagaatgcacaaacagaggagatgtgcaatgtttgccaaaaacctggcggcagcgcaaaagatg

SEQ ID NO: 133428 - DNA, 103 bp, Artificial Sequence
  Synthetic Polynucleotide
taatacgactcactatagggaactggatctgaaataacttgatttggcaaaacagaggagattgccaatgcaagttattaacctggcggcagcgcaaaagatg

SEQ ID NO: 133429 - DNA, 103 bp, Artificial Sequence
  Synthetic Polynucleotide
taatacgactcactataggggatctgttccaactggatctgaaataacttaacagaggagaaagttaatgcagatccagaacctggcggcagcgcaaaagatg

SEQ ID NO: 133430 - DNA, 103 bp, Artificial Sequence
  Synthetic Polynucleotide
taatacgactcactataggggtcacacaatgatctgttccaactggatctaacagaggagaagatccatgtggaacagaaacctggcggcagcgcaaaagatg

SEQ ID NO: 133431 - DNA, 103 bp, Artificial Sequence
  Synthetic Polynucleotide
taatacgactcactatagggtgttgctgatgtcacacaatgatctgttccaacagaggagaggaacaatgcattgtgtgaacctggcggcagcgcaaaagatg

SEQ ID NO: 133432 - DNA, 103 bp, Artificial Sequence
  Synthetic Polynucleotide
taatacgactcactatagggtggttggtaatgttgctgatgtcacacaataacagaggagaattgtgatgcatcagcaaaacctggcggcagcgcaaaagatg

SEQ ID NO: 133433 - DNA, 103 bp, Artificial Sequence
  Synthetic Polynucleotide
taatacgactcactataggggaacttgagtcacattgttcatcgaggtcaaacagaggagatgacctatgtgaacaatgaacctggcggcagcgcaaaagatg

SEQ ID NO: 133434 - DNA, 103 bp, Artificial Sequence
  Synthetic Polynucleotide
taatacgactcactatagggtcaattaatttggttggtaatgttgctgataacagaggagaatcagcatgattaccaacaacctggcggcagcgcaaaagatg

SEQ ID NO: 133435 - DNA, 103 bp, Artificial Sequence
  Synthetic Polynucleotide
taatacgactcactatagggagacatgctgtcaattaatttggttggtaaaacagaggagattaccaatgaaattaattaacctggcggcagcgcaaaagatg

SEQ ID NO: 133436 - DNA, 103 bp, Artificial Sequence
  Synthetic Polynucleotide
taatacgactcactataggggatgcgaattagacatgctgtcaattaattaacagaggagaaattaaatgacagcatgtaacctggcggcagcgcaaaagatg

SEQ ID NO: 133437 - DNA, 103 bp, Artificial Sequence
  Synthetic Polynucleotide
taatacgactcactatagggggtagcagaggatgcgaattagacatgctgaacagaggagacagcatatgtaattcgcaaacctggcggcagcgcaaaagatg

SEQ ID NO: 133438 - DNA, 103 bp, Artificial Sequence
  Synthetic Polynucleotide
taatacgactcactataggggagctctggtggtagcagaggatgcgaattaacagaggagaaattcgatgcctctgctaaacctggcggcagcgcaaaagatg

SEQ ID NO: 133439 - DNA, 103 bp, Artificial Sequence
  Synthetic Polynucleotide
taatacgactcactatagggcaaggggcctgagctctggtggtagcagagaacagaggagactctgcatgcaccagagcaacctggcggcagcgcaaaagatg

SEQ ID NO: 133440 - DNA, 103 bp, Artificial Sequence
  Synthetic Polynucleotide
taatacgactcactatagggacctgacttccaaggggcctgagctctggtaacagaggagaaccagaatgcaggcccctaacctggcggcagcgcaaaagatg

SEQ ID NO: 133441 - DNA, 103 bp, Artificial Sequence
  Synthetic Polynucleotide
taatacgactcactatagggcaccttctgcacctgacttccaaggggcctaacagaggagaaggcccatgggaagtcagaacctggcggcagcgcaaaagatg

SEQ ID NO: 133442 - DNA, 103 bp, Artificial Sequence
  Synthetic Polynucleotide
taatacgactcactatagggatgatgatggcaccttctgcacctgacttcaacagaggagagaagtcatgtgcagaaggaacctggcggcagcgcaaaagatg

SEQ ID NO: 133443 - DNA, 103 bp, Artificial Sequence
  Synthetic Polynucleotide
taatacgactcactatagggggcagcatgaatgatgatggcaccttctgcaacagaggagagcagaaatggccatcatcaacctggcggcagcgcaaaagatg

SEQ ID NO: 133444 - DNA, 103 bp, Artificial Sequence
  Synthetic Polynucleotide
taatacgactcactatagggacttgacaaggaacttgagtcacattgttcaacagaggagagaacaaatggactcaagtaacctggcggcagcgcaaaagatg

SEQ ID NO: 133445 - DNA, 103 bp, Artificial Sequence
  Synthetic Polynucleotide
taatacgactcactatagggcaggcgtatgggcagcatgaatgatgatggaacagaggagaccatcaatgttcatgctgaacctggcggcagcgcaaaagatg

SEQ ID NO: 133446 - DNA, 103 bp, Artificial Sequence
  Synthetic Polynucleotide
taatacgactcactatagggcactactctgcaggcgtatgggcagcatgaaacagaggagatcatgcatgccatacgccaacctggcggcagcgcaaaagatg

SEQ ID NO: 133447 - DNA, 103 bp, Artificial Sequence
  Synthetic Polynucleotide
taatacgactcactatagggtaagcaggaacactactctgcaggcgtatgaacagaggagacatacgatggcagagtagaacctggcggcagcgcaaaagatg

SEQ ID NO: 133448 - DNA, 103 bp, Artificial Sequence
  Synthetic Polynucleotide
taatacgactcactatagggagcaaaacagtaagcaggaacactactctgaacagaggagacagagtatggttcctgctaacctggcggcagcgcaaaagatg

SEQ ID NO: 133449 - DNA, 103 bp, Artificial Sequence
  Synthetic Polynucleotide
taatacgactcactatagggatgtgagtgtagcaaaacagtaagcaggaaaacagaggagattcctgatgactgttttgaacctggcggcagcgcaaaagatg

SEQ ID NO: 133450 - DNA, 103 bp, Artificial Sequence
  Synthetic Polynucleotide
taatacgactcactatagggtgtggcagggatgtgagtgtagcaaaacagaacagaggagactgtttatgtacactcacaacctggcggcagcgcaaaagatg

SEQ ID NO: 133451 - DNA, 103 bp, Artificial Sequence
  Synthetic Polynucleotide
taatacgactcactatagggcactagtatttgtggcagggatgtgagtgtaacagaggagaacactcatgtccctgccaaacctggcggcagcgcaaaagatg

SEQ ID NO: 133452 - DNA, 103 bp, Artificial Sequence
  Synthetic Polynucleotide
taatacgactcactataggggatcttgggtcactagtatttgtggcagggaacagaggagaccctgcatgaaatactagaacctggcggcagcgcaaaagatg

SEQ ID NO: 133453 - DNA, 103 bp, Artificial Sequence
  Synthetic Polynucleotide
taatacgactcactatagggtgattgggcagatcttgggtcactagtattaacagaggagaaatactatggacccaagaaacctggcggcagcgcaaaagatg

SEQ ID NO: 133454 - DNA, 103 bp, Artificial Sequence
  Synthetic Polynucleotide
taatacgactcactataggggcaaattggctgattgggcagatcttgggtaacagaggagaacccaaatgctgcccaataacctggcggcagcgcaaaagatg

SEQ ID NO: 133455 - DNA, 103 bp, Artificial Sequence
  Synthetic Polynucleotide
taatacgactcactatagggtaagttctttttgtgcttcttcaattttgtaacagaggagaacaaaaatgaagaagcacaacctggcggcagcgcaaaagatg

SEQ ID NO: 133456 - DNA, 103 bp, Artificial Sequence
  Synthetic Polynucleotide
taatacgactcactatagggtcctggttttacttgacaaggaacttgagtaacagaggagaactcaaatgccttgtcaaaacctggcggcagcgcaaaagatg

SEQ ID NO: 133457 - DNA, 103 bp, Artificial Sequence
  Synthetic Polynucleotide
taatacgactcactataggggattagtctggcaaattggctgattgggcaaacagaggagatgcccaatgagccaatttaacctggcggcagcgcaaaagatg

SEQ ID NO: 133458 - DNA, 103 bp, Artificial Sequence
  Synthetic Polynucleotide
taatacgactcactatagggactacactatgattagtctggcaaattggcaacagaggagagccaatatgccagactaaaacctggcggcagcgcaaaagatg

SEQ ID NO: 133459 - DNA, 103 bp, Artificial Sequence
  Synthetic Polynucleotide
taatacgactcactatagggactgattggcactacactatgattagtctgaacagaggagacagactatgcatagtgtaaacctggcggcagcgcaaaagatg

SEQ ID NO: 133460 - DNA, 103 bp, Artificial Sequence
  Synthetic Polynucleotide
taatacgactcactatagggtttgttcttcactgattggcactacactataacagaggagaatagtgatgtgccaatcaaacctggcggcagcgcaaaagatg

SEQ ID NO: 133461 - DNA, 103 bp, Artificial Sequence
  Synthetic Polynucleotide
taatacgactcactatagggggcacagaattttgttcttcactgattggcaacagaggagagccaatatgtgaagaacaaacctggcggcagcgcaaaagatg

SEQ ID NO: 133462 - DNA, 103 bp, Artificial Sequence
  Synthetic Polynucleotide
taatacgactcactatagggttgtaatgttggcacagaattttgttcttcaacagaggagagaagaaatgaattctgtgaacctggcggcagcgcaaaagatg

SEQ ID NO: 133463 - DNA, 103 bp, Artificial Sequence
  Synthetic Polynucleotide
taatacgactcactataggggatgacctttttgtaatgttggcacagaataacagaggagaattctgatgcaacattacaacctggcggcagcgcaaaagatg

SEQ ID NO: 133464 - DNA, 103 bp, Artificial Sequence
  Synthetic Polynucleotide
taatacgactcactatagggaaagcattctgatgacctttttgtaatgttaacagaggagaaacattatgaaaaggtcaaacctggcggcagcgcaaaagatg

SEQ ID NO: 133465 - DNA, 103 bp, Artificial Sequence
  Synthetic Polynucleotide
taatacgactcactatagggtgggtttggcaaagcattctgatgacctttaacagaggagaaaaggtatgcagaatgctaacctggcggcagcgcaaaagatg

SEQ ID NO: 133466 - DNA, 103 bp, Artificial Sequence
  Synthetic Polynucleotide
taatacgactcactatagggattccttctctgggtttggcaaagcattctaacagaggagaagaatgatgtgccaaaccaacctggcggcagcgcaaaagatg

SEQ ID NO: 133467 - DNA, 103 bp, Artificial Sequence
  Synthetic Polynucleotide
taatacgactcactatagggctattgtcagtcctggttttacttgacaagaacagaggagacttgtcatgtaaaaccagaacctggcggcagcgcaaaagatg

SEQ ID NO: 133468 - DNA, 103 bp, Artificial Sequence
  Synthetic Polynucleotide
taatacgactcactatagggtcacatagaaattccttctctgggtttggcaacagaggagagccaaaatgagagaaggaaacctggcggcagcgcaaaagatg

SEQ ID NO: 133469 - DNA, 103 bp, Artificial Sequence
  Synthetic Polynucleotide
taatacgactcactatagggaaaaacattttcacatagaaattccttctcaacagaggagagagaagatgtttctatgtaacctggcggcagcgcaaaagatg

SEQ ID NO: 133470 - DNA, 103 bp, Artificial Sequence
  Synthetic Polynucleotide
taatacgactcactatagggtcatctctgaaaaaacattttcacatagaaaacagaggagattctatatgaaaatgtttaacctggcggcagcgcaaaagatg

SEQ ID NO: 133471 - DNA, 103 bp, Artificial Sequence
  Synthetic Polynucleotide
taatacgactcactataggggaattttggctcatctctgaaaaaacatttaacagaggagaaaatgtatgttcagagataacctggcggcagcgcaaaagatg

SEQ ID NO: 133472 - DNA, 103 bp, Artificial Sequence
  Synthetic Polynucleotide
taatacgactcactatagggtgatagagaagaattttggctcatctctgaaacagaggagatcagagatgagccaaaataacctggcggcagcgcaaaagatg

SEQ ID NO: 133473 - DNA, 103 bp, Artificial Sequence
  Synthetic Polynucleotide
taatacgactcactataggggcaaggattctgatagagaagaattttggcaacagaggagagccaaaatgcttctctataacctggcggcagcgcaaaagatg

SEQ ID NO: 133474 - DNA, 103 bp, Artificial Sequence
  Synthetic Polynucleotide
taatacgactcactatagggtgagttatgggcaaggattctgatagagaaaacagaggagattctctatgagaatccttaacctggcggcagcgcaaaagatg

SEQ ID NO: 133475 - DNA, 103 bp, Artificial Sequence
  Synthetic Polynucleotide
taatacgactcactatagggagatattttctgagttatgggcaaggattcaacagaggagagaatccatgcccataactaacctggcggcagcgcaaaagatg

SEQ ID NO: 133476 - DNA, 103 bp, Artificial Sequence
  Synthetic Polynucleotide
taatacgactcactataggggtcgaccaacagatattttctgagttatggaacagaggagaccataaatgagaaaatataacctggcggcagcgcaaaagatg

SEQ ID NO: 133477 - DNA, 103 bp, Artificial Sequence
  Synthetic Polynucleotide
taatacgactcactatagggtgaggggaaagtcgaccaacagatattttcaacagaggagagaaaatatgtgttggtcgaacctggcggcagcgcaaaagatg

SEQ ID NO: 133478 - DNA, 103 bp, Artificial Sequence
  Synthetic Polynucleotide
taatacgactcactataggggatgcattcgctattgtcagtcctggttttaacagaggagaaaaaccatgactgacaataacctggcggcagcgcaaaagatg

SEQ ID NO: 133479 - DNA, 103 bp, Artificial Sequence
  Synthetic Polynucleotide
taatacgactcactatagggagattcttgttgaggggaaagtcgaccaacaacagaggagagttggtatgctttcccctaacctggcggcagcgcaaaagatg

SEQ ID NO: 133480 - DNA, 103 bp, Artificial Sequence
  Synthetic Polynucleotide
taatacgactcactatagggtcgaagctgaagattcttgttgaggggaaaaacagaggagatttcccatgaacaagaataacctggcggcagcgcaaaagatg

SEQ ID NO: 133481 - DNA, 103 bp, Artificial Sequence
  Synthetic Polynucleotide
taatacgactcactatagggatccttttactcgaagctgaagattcttgtaacagaggagaacaagaatgttcagcttcaacctggcggcagcgcaaaagatg

SEQ ID NO: 133482 - DNA, 103 bp, Artificial Sequence
  Synthetic Polynucleotide
taatacgactcactatagggtggggaaagcatccttttactcgaagctgaaacagaggagatcagctatgagtaaaaggaacctggcggcagcgcaaaagatg

SEQ ID NO: 133483 - DNA, 103 bp, Artificial Sequence
  Synthetic Polynucleotide
taatacgactcactatagggaactatttgctggggaaagcatccttttacaacagaggagagtaaaaatgtgctttcccaacctggcggcagcgcaaaagatg

SEQ ID NO: 133484 - DNA, 103 bp, Artificial Sequence
  Synthetic Polynucleotide
taatacgactcactataggggcaatgtctaaactatttgctggggaaagcaacagaggagagctttcatgagcaaatagaacctggcggcagcgcaaaagatg

SEQ ID NO: 133485 - DNA, 103 bp, Artificial Sequence
  Synthetic Polynucleotide
taatacgactcactatagggcttttccatggcaatgtctaaactatttgcaacagaggagagcaaatatgttagacattaacctggcggcagcgcaaaagatg

SEQ ID NO: 133486 - DNA, 103 bp, Artificial Sequence
  Synthetic Polynucleotide
taatacgactcactataggggcttctggtgcttttccatggcaatgtctaaacagaggagatagacaatgccatggaaaaacctggcggcagcgcaaaagatg

SEQ ID NO: 133487 - DNA, 103 bp, Artificial Sequence
  Synthetic Polynucleotide
taatacgactcactatagggtctttggcccgcttctggtgcttttccatgaacagaggagacatggaatggcaccagaaaacctggcggcagcgcaaaagatg

SEQ ID NO: 133488 - DNA, 103 bp, Artificial Sequence
  Synthetic Polynucleotide
taatacgactcactatagggtccattttcatctttggcccgcttctggtgaacagaggagacaccagatgcgggccaaaaacctggcggcagcgcaaaagatg

SEQ ID NO: 133489 - DNA, 103 bp, Artificial Sequence
  Synthetic Polynucleotide
taatacgactcactatagggaatgagaagagatgcattcgctattgtcagaacagaggagactgacaatggcgaatgcaaacctggcggcagcgcaaaagatg

SEQ ID NO: 133490 - DNA, 103 bp, Artificial Sequence
  Synthetic Polynucleotide
taatacgactcactatagggcacaaacagctccattttcatctttggcccaacagaggagagggccaatgatgaaaatgaacctggcggcagcgcaaaagatg

SEQ ID NO: 133491 - DNA, 103 bp, Artificial Sequence
  Synthetic Polynucleotide
taatacgactcactatagggacgtctgttgcacaaacagctccattttcaaacagaggagatgaaaaatgagctgtttgaacctggcggcagcgcaaaagatg

SEQ ID NO: 133492 - DNA, 103 bp, Artificial Sequence
  Synthetic Polynucleotide
taatacgactcactatagggtaaaggtctcacgtctgttgcacaaacagcaacagaggagagctgttatggcaacagacaacctggcggcagcgcaaaagatg

SEQ ID NO: 133493 - DNA, 103 bp, Artificial Sequence
  Synthetic Polynucleotide
taatacgactcactatagggtcaaagcctctaaaggtctcacgtctgttgaacagaggagacaacagatgtgagaccttaacctggcggcagcgcaaaagatg

SEQ ID NO: 133494 - DNA, 103 bp, Artificial Sequence
  Synthetic Polynucleotide
taatacgactcactatagggactctcgaactcaaagcctctaaaggtctcaacagaggagagagaccatgagaggctttaacctggcggcagcgcaaaagatg

SEQ ID NO: 133495 - DNA, 103 bp, Artificial Sequence
  Synthetic Polynucleotide
taatacgactcactatagggagcttcattaactctcgaactcaaagcctcaacagaggagagaggctatgagttcgagaaacctggcggcagcgcaaaagatg

SEQ ID NO: 133496 - DNA, 103 bp, Artificial Sequence
  Synthetic Polynucleotide
taatacgactcactatagggtctgtttactagcttcattaactctcgaacaacagaggagagttcgaatgttaatgaagaacctggcggcagcgcaaaagatg

SEQ ID NO: 133497 - DNA, 103 bp, Artificial Sequence
  Synthetic Polynucleotide
taatacgactcactatagggataggcttcttctgtttactagcttcattaaacagaggagataatgaatgtagtaaacaaacctggcggcagcgcaaaagatg

SEQ ID NO: 133498 - DNA, 103 bp, Artificial Sequence
  Synthetic Polynucleotide
taatacgactcactatagggtctcactaaaataggcttcttctgtttactaacagaggagaagtaaaatgaagaagcctaacctggcggcagcgcaaaagatg

SEQ ID NO: 133499 - DNA, 103 bp, Artificial Sequence
  Synthetic Polynucleotide
taatacgactcactatagggtacaaacctgtctcactaaaataggcttctaacagaggagaagaagcatgttttagtgaaacctggcggcagcgcaaaagatg

SEQ ID NO: 133500 - DNA, 103 bp, Artificial Sequence
  Synthetic Polynucleotide
taatacgactcactataggggtagtgccacaatgagaagagatgcattcgaacagaggagacgaatgatgctcttctcaaacctggcggcagcgcaaaagatg

SEQ ID NO: 133501 - DNA, 103 bp, Artificial Sequence
  Synthetic Polynucleotide
taatacgactcactatagggggctctgtagtacaaacctgtctcactaaaaacagaggagatttagtatgacaggtttgaacctggcggcagcgcaaaagatg

SEQ ID NO: 133502 - DNA, 103 bp, Artificial Sequence
  Synthetic Polynucleotide
taatacgactcactatagggaccgtccaggggctctgtagtacaaacctgaacagaggagacaggttatgactacagagaacctggcggcagcgcaaaagatg

SEQ ID NO: 133503 - DNA, 103 bp, Artificial Sequence
  Synthetic Polynucleotide
taatacgactcactatagggccaacatcacaccgtccaggggctctgtagaacagaggagactacagatgccctggacgaacctggcggcagcgcaaaagatg

SEQ ID NO: 133504 - DNA, 103 bp, Artificial Sequence
  Synthetic Polynucleotide
taatacgactcactatagggacatccttttccaacatcacaccgtccaggaacagaggagacctggaatgtgtgatgttaacctggcggcagcgcaaaagatg

SEQ ID NO: 133505 - DNA, 103 bp, Artificial Sequence
  Synthetic Polynucleotide
taatacgactcactatagggttgagaaaaaacatccttttccaacatcacaacagaggagagtgatgatggaaaaggataacctggcggcagcgcaaaagatg

SEQ ID NO: 133506 - DNA, 103 bp, Artificial Sequence
  Synthetic Polynucleotide
taatacgactcactatagggtaatttcaggttgagaaaaaacatccttttaacagaggagaaaaaggatgttttttctcaacctggcggcagcgcaaaagatg

SEQ ID NO: 133507 - DNA, 103 bp, Artificial Sequence
  Synthetic Polynucleotide
taatacgactcactataggggcctcattactaatttcaggttgagaaaaaaacagaggagatttttcatgacctgaaataacctggcggcagcgcaaaagatg

SEQ ID NO: 133508 - DNA, 103 bp, Artificial Sequence
  Synthetic Polynucleotide
taatacgactcactatagggcaaattaacagcctcattactaatttcaggaacagaggagacctgaaatgagtaatgagaacctggcggcagcgcaaaagatg

SEQ ID NO: 133509 - DNA, 103 bp, Artificial Sequence
  Synthetic Polynucleotide
taatacgactcactatagggaaacatttgtcaaattaacagcctcattacaacagaggagagtaatgatgctgttaattaacctggcggcagcgcaaaagatg

SEQ ID NO: 133510 - DNA, 103 bp, Artificial Sequence
  Synthetic Polynucleotide
taatacgactcactatagggtcagctggtaaaacatttgtcaaattaacaaacagaggagatgttaaatggacaaatgtaacctggcggcagcgcaaaagatg

SEQ ID NO: 133511 - DNA, 103 bp, Artificial Sequence
  Synthetic Polynucleotide
taatacgactcactatagggggagggggacgtagtgccacaatgagaagaaacagaggagatcttctatgtgtggcactaacctggcggcagcgcaaaagatg

SEQ ID NO: 133512 - DNA, 103 bp, Artificial Sequence
  Synthetic Polynucleotide
taatacgactcactatagggtgatgaattatcagctggtaaaacatttgtaacagaggagaacaaatatgttaccagctaacctggcggcagcgcaaaagatg

SEQ ID NO: 133513 - DNA, 103 bp, Artificial Sequence
  Synthetic Polynucleotide
taatacgactcactatagggagcatcctgttgatgaattatcagctggtaaacagaggagataccagatgataattcataacctggcggcagcgcaaaagatg

SEQ ID NO: 133514 - DNA, 103 bp, Artificial Sequence
  Synthetic Polynucleotide
taatacgactcactatagggacaaatttagagcatcctgttgatgaattaaacagaggagataattcatgaacaggatgaacctggcggcagcgcaaaagatg

SEQ ID NO: 133515 - DNA, 103 bp, Artificial Sequence
  Synthetic Polynucleotide
taatacgactcactatagggttctataacgacaaatttagagcatcctgtaacagaggagaacaggaatgtctaaatttaacctggcggcagcgcaaaagatg

SEQ ID NO: 133516 - DNA, 103 bp, Artificial Sequence
  Synthetic Polynucleotide
taatacgactcactatagggcacttataggttctataacgacaaatttagaacagaggagactaaatatgtcgttatagaacctggcggcagcgcaaaagatg

SEQ ID NO: 133517 - DNA, 103 bp, Artificial Sequence
  Synthetic Polynucleotide
taatacgactcactatagggtcctgcaattcacttataggttctataacgaacagaggagacgttatatgacctataagaacctggcggcagcgcaaaagatg

SEQ ID NO: 133518 - DNA, 103 bp, Artificial Sequence
  Synthetic Polynucleotide
taatacgactcactataggggttttcaaattcctgcaattcacttataggaacagaggagacctataatggaattgcagaacctggcggcagcgcaaaagatg

SEQ ID NO: 133519 - DNA, 103 bp, Artificial Sequence
  Synthetic Polynucleotide
taatacgactcactatagggatgacttgatgttttcaaattcctgcaattaacagaggagaaattgcatgaatttgaaaaacctggcggcagcgcaaaagatg

SEQ ID NO: 133520 - DNA, 103 bp, Artificial Sequence
  Synthetic Polynucleotide
taatacgactcactatagggaatgatgtggatgacttgatgttttcaaataacagaggagaatttgaatgcatcaagtcaacctggcggcagcgcaaaagatg

SEQ ID NO: 133521 - DNA, 103 bp, Artificial Sequence
  Synthetic Polynucleotide
taatacgactcactatagggtgtaagagttaatgatgtggatgacttgataacagaggagaatcaagatgtccacatcaaacctggcggcagcgcaaaagatg

SEQ ID NO: 133522 - DNA, 103 bp, Artificial Sequence
  Synthetic Polynucleotide
taatacgactcactatagggtgtttgtataggagggggacgtagtgccacaacagaggagagtggcaatgcgtccccctaacctggcggcagcgcaaaagatg

SEQ ID NO: 133523 - DNA, 103 bp, Artificial Sequence
  Synthetic Polynucleotide
taatacgactcactatagggaacttcgaactgtaagagttaatgatgtggaacagaggagaccacatatgtaactcttaaacctggcggcagcgcaaaagatg

SEQ ID NO: 133524 - DNA, 103 bp, Artificial Sequence
  Synthetic Polynucleotide
taatacgactcactatagggggagcaggtgaacttcgaactgtaagagttaacagaggagaaactctatgagttcgaagaacctggcggcagcgcaaaagatg

SEQ ID NO: 133525 - DNA, 103 bp, Artificial Sequence
  Synthetic Polynucleotide
taatacgactcactatagggattttctgaaggagcaggtgaacttcgaacaacagaggagagttcgaatgtcacctgctaacctggcggcagcgcaaaagatg

SEQ ID NO: 133526 - DNA, 103 bp, Artificial Sequence
  Synthetic Polynucleotide
taatacgactcactatagggaaatatgagtattttctgaaggagcaggtgaacagaggagacacctgatgcttcagaaaaacctggcggcagcgcaaaagatg

SEQ ID NO: 133527 - DNA, 103 bp, Artificial Sequence
  Synthetic Polynucleotide
taatacgactcactatagggttcaaaggagaaatatgagtattttctgaaaacagaggagattcagaatgtactcatataacctggcggcagcgcaaaagatg

SEQ ID NO: 133528 - DNA, 103 bp, Artificial Sequence
  Synthetic Polynucleotide
taatacgactcactataggggtctgtacatttcaaaggagaaatatgagtaacagaggagaactcatatgtctcctttgaacctggcggcagcgcaaaagatg

SEQ ID NO: 133529 - DNA, 103 bp, Artificial Sequence
  Synthetic Polynucleotide
taatacgactcactatagggcttggttattgtctgtacatttcaaaggagaacagaggagactccttatgaatgtacagaacctggcggcagcgcaaaagatg

SEQ ID NO: 133530 - DNA, 103 bp, Artificial Sequence
  Synthetic Polynucleotide
taatacgactcactataggggacttcctttcttggttattgtctgtacataacagaggagaatgtacatgcaataaccaaacctggcggcagcgcaaaagatg

SEQ ID NO: 133531 - DNA, 103 bp, Artificial Sequence
  Synthetic Polynucleotide
taatacgactcactatagggaacccctggagacttcctttcttggttattaacagaggagaaataacatggaaaggaagaacctggcggcagcgcaaaagatg

SEQ ID NO: 133532 - DNA, 103 bp, Artificial Sequence
  Synthetic Polynucleotide
taatacgactcactatagggcttgatttttaacccctggagacttcctttaacagaggagaaaaggaatgctccaggggaacctggcggcagcgcaaaagatg

SEQ ID NO: 133533 - DNA, 103 bp, Artificial Sequence
  Synthetic Polynucleotide
taatacgactcactatagggtcgaatgcagtgtttgtataggagggggacaacagaggagagtccccatgctatacaaaaacctggcggcagcgcaaaagatg

SEQ ID NO: 133534 - DNA, 103 bp, Artificial Sequence
  Synthetic Polynucleotide
taatacgactcactatagggactttgtcaccttgatttttaacccctggaaacagaggagatccaggatgtaaaaatcaaacctggcggcagcgcaaaagatg

SEQ ID NO: 133535 - DNA, 103 bp, Artificial Sequence
  Synthetic Polynucleotide
taatacgactcactatagggttggatgttcactttgtcaccttgatttttaacagaggagaaaaaatatgggtgacaaaaacctggcggcagcgcaaaagatg

SEQ ID NO: 133536 - DNA, 103 bp, Artificial Sequence
  Synthetic Polynucleotide
taatacgactcactataggggactttgctcttggatgttcactttgtcacaacagaggagagtgacaatgtgaacatccaacctggcggcagcgcaaaagatg

SEQ ID NO: 133537 - DNA, 103 bp, Artificial Sequence
  Synthetic Polynucleotide
taatacgactcactatagggactggctgttgactttgctcttggatgttcaacagaggagagaacatatgagagcaaagaacctggcggcagcgcaaaagatg

SEQ ID NO: 133538 - DNA, 103 bp, Artificial Sequence
  Synthetic Polynucleotide
taatacgactcactatagggaagagaagtgactggctgttgactttgctcaacagaggagagagcaaatgcaacagccaaacctggcggcagcgcaaaagatg

SEQ ID NO: 133539 - DNA, 103 bp, Artificial Sequence
  Synthetic Polynucleotide
taatacgactcactatagggtaaacaatgaaagagaagtgactggctgttaacagaggagaaacagcatgtcacttctcaacctggcggcagcgcaaaagatg

SEQ ID NO: 133540 - DNA, 103 bp, Artificial Sequence
  Synthetic Polynucleotide
taatacgactcactatagggtccttgatgttaaacaatgaaagagaagtgaacagaggagacacttcatgttcattgttaacctggcggcagcgcaaaagatg

SEQ ID NO: 133541 - DNA, 103 bp, Artificial Sequence
  Synthetic Polynucleotide
taatacgactcactatagggctgctgggtgtccttgatgttaaacaatgaaacagaggagatcattgatgaacatcaagaacctggcggcagcgcaaaagatg

SEQ ID NO: 133542 - DNA, 103 bp, Artificial Sequence
  Synthetic Polynucleotide
taatacgactcactatagggggaaagccagctgctgggtgtccttgatgtaacagaggagaacatcaatgacacccagcaacctggcggcagcgcaaaagatg

SEQ ID NO: 133543 - DNA, 103 bp, Artificial Sequence
  Synthetic Polynucleotide
taatacgactcactatagggttcaggctagggaaagccagctgctgggtgaacagaggagacacccaatggctggctttaacctggcggcagcgcaaaagatg

SEQ ID NO: 133544 - DNA, 103 bp, Artificial Sequence
  Synthetic Polynucleotide
taatacgactcactatagggcagtaagacatcgaatgcagtgtttgtataaacagaggagatatacaatgactgcattcaacctggcggcagcgcaaaagatg

SEQ ID NO: 133545 - DNA, 103 bp, Artificial Sequence
  Synthetic Polynucleotide
taatacgactcactatagggggttgtagttttcaggctagggaaagccagaacagaggagactggctatgcctagcctgaacctggcggcagcgcaaaagatg

SEQ ID NO: 133546 - DNA, 103 bp, Artificial Sequence
  Synthetic Polynucleotide
taatacgactcactatagggatgtaaagttggttgtagttttcaggctagaacagaggagactagccatgaaactacaaaacctggcggcagcgcaaaagatg

SEQ ID NO: 133547 - DNA, 103 bp, Artificial Sequence
  Synthetic Polynucleotide
taatacgactcactatagggagataacaccatgtaaagttggttgtagttaacagaggagaaactacatgcaactttacaacctggcggcagcgcaaaagatg

SEQ ID NO: 133548 - DNA, 103 bp, Artificial Sequence
  Synthetic Polynucleotide
taatacgactcactatagggctgccttaagagataacaccatgtaaagttaacagaggagaaactttatgtggtgttataacctggcggcagcgcaaaagatg

SEQ ID NO: 133549 - DNA, 103 bp, Artificial Sequence
  Synthetic Polynucleotide
taatacgactcactataggggcaacgacttctgccttaagagataacaccaacagaggagaggtgttatgtcttaaggcaacctggcggcagcgcaaaagatg

SEQ ID NO: 133550 - DNA, 103 bp, Artificial Sequence
  Synthetic Polynucleotide
taatacgactcactatagggtgaggcaaatgcaacgacttctgccttaagaacagaggagacttaagatggaagtcgttaacctggcggcagcgcaaaagatg

SEQ ID NO: 133551 - DNA, 103 bp, Artificial Sequence
  Synthetic Polynucleotide
taatacgactcactatagggctggtccttctgaggcaaatgcaacgacttaacagaggagaaagtcgatgcatttgcctaacctggcggcagcgcaaaagatg

SEQ ID NO: 133552 - DNA, 103 bp, Artificial Sequence
  Synthetic Polynucleotide
taatacgactcactatagggctgaagttttctggtccttctgaggcaaataacagaggagaatttgcatgagaaggaccaacctggcggcagcgcaaaagatg

SEQ ID NO: 133553 - DNA, 103 bp, Artificial Sequence
  Synthetic Polynucleotide
taatacgactcactatagggtcagtataggctgaagttttctggtccttcaacagaggagagaaggaatggaaaacttcaacctggcggcagcgcaaaagatg

SEQ ID NO: 133554 - DNA, 103 bp, Artificial Sequence
  Synthetic Polynucleotide
taatacgactcactatagggtactgtccaatcagtataggctgaagttttaacagaggagaaaaactatggcctatactaacctggcggcagcgcaaaagatg

SEQ ID NO: 133555 - DNA, 103 bp, Artificial Sequence
  Synthetic Polynucleotide
taatacgactcactatagggccattgctttcagtaagacatcgaatgcagaacagaggagactgcatatgatgtcttacaacctggcggcagcgcaaaagatg

SEQ ID NO: 133556 - DNA, 103 bp, Artificial Sequence
  Synthetic Polynucleotide
taatacgactcactatagggtactggcgcttactgtccaatcagtataggaacagaggagacctataatgattggacagaacctggcggcagcgcaaaagatg

SEQ ID NO: 133557 - DNA, 103 bp, Artificial Sequence
  Synthetic Polynucleotide
taatacgactcactatagggggatttggattactggcgcttactgtccaaaacagaggagattggacatgaagcgccagaacctggcggcagcgcaaaagatg

SEQ ID NO: 133558 - DNA, 103 bp, Artificial Sequence
  Synthetic Polynucleotide
taatacgactcactatagggcaaaccgagtggatttggattactggcgctaacagaggagaagcgccatgaatccaaataacctggcggcagcgcaaaagatg

SEQ ID NO: 133559 - DNA, 103 bp, Artificial Sequence
  Synthetic Polynucleotide
taatacgactcactatagggcttttgtgggcaaaccgagtggatttggataacagaggagaatccaaatgcactcggttaacctggcggcagcgcaaaagatg

SEQ ID NO: 133560 - DNA, 103 bp, Artificial Sequence
  Synthetic Polynucleotide
taatacgactcactataggggcaagtgcaacttttgtgggcaaaccgagtaacagaggagaactcggatggcccacaaaaacctggcggcagcgcaaaagatg

SEQ ID NO: 133561 - DNA, 103 bp, Artificial Sequence
  Synthetic Polynucleotide
taatacgactcactatagggattaaggagagcaagtgcaacttttgtgggaacagaggagacccacaatggttgcacttaacctggcggcagcgcaaaagatg

SEQ ID NO: 133562 - DNA, 103 bp, Artificial Sequence
  Synthetic Polynucleotide
taatacgactcactatagggtctgttttgaattaaggagagcaagtgcaaaacagaggagattgcacatgctctccttaaacctggcggcagcgcaaaagatg

SEQ ID NO: 133563 - DNA, 103 bp, Artificial Sequence
  Synthetic Polynucleotide
taatacgactcactatagggtttccagtgttctgttttgaattaaggagaaacagaggagatctcctatgttcaaaacaaacctggcggcagcgcaaaagatg

SEQ ID NO: 133564 - DNA, 103 bp, Artificial Sequence
  Synthetic Polynucleotide
taatacgactcactataggggtatagtgattttccagtgttctgttttgaaacagaggagatcaaaaatgaacactggaaacctggcggcagcgcaaaagatg

SEQ ID NO: 133565 - DNA, 103 bp, Artificial Sequence
  Synthetic Polynucleotide
taatacgactcactatagggttgcttgacagtatagtgattttccagtgtaacagaggagaacactgatgaatcactataacctggcggcagcgcaaaagatg

SEQ ID NO: 133566 - DNA, 103 bp, Artificial Sequence
  Synthetic Polynucleotide
taatacgactcactatagggtctgccccattaagttctttttgtgcttctaacagaggagaagaagcatgaaaagaactaacctggcggcagcgcaaaagatg

SEQ ID NO: 133567 - DNA, 103 bp, Artificial Sequence
  Synthetic Polynucleotide
taatacgactcactatagggagttctggctccattgctttcagtaagacaaacagaggagatgtcttatggaaagcaataacctggcggcagcgcaaaagatg

SEQ ID NO: 133568 - DNA, 103 bp, Artificial Sequence
  Synthetic Polynucleotide
taatacgactcactatagggtgggtagttattgcttgacagtatagtgataacagaggagaatcactatgctgtcaagcaacctggcggcagcgcaaaagatg

SEQ ID NO: 133569 - DNA, 103 bp, Artificial Sequence
  Synthetic Polynucleotide
taatacgactcactatagggtgacttggaatgggtagttattgcttgacaaacagaggagatgtcaaatgataactaccaacctggcggcagcgcaaaagatg

SEQ ID NO: 133570 - DNA, 103 bp, Artificial Sequence
  Synthetic Polynucleotide
taatacgactcactatagggccaataagtctgacttggaatgggtagttaaacagaggagataactaatgattccaagtaacctggcggcagcgcaaaagatg

SEQ ID NO: 133571 - DNA, 103 bp, Artificial Sequence
  Synthetic Polynucleotide
taatacgactcactatagggcttgaatagaccaataagtctgacttggaaaacagaggagattccaaatgagacttattaacctggcggcagcgcaaaagatg

SEQ ID NO: 133572 - DNA, 103 bp, Artificial Sequence
  Synthetic Polynucleotide
taatacgactcactatagggtttccacttgcttgaatagaccaataagtcaacagaggagagacttaatggtctattcaaacctggcggcagcgcaaaagatg

SEQ ID NO: 133573 - DNA, 103 bp, Artificial Sequence
  Synthetic Polynucleotide
taatacgactcactatagggttaagctgcttttccacttgcttgaatagaaacagaggagatctattatggcaagtggaaacctggcggcagcgcaaaagatg

SEQ ID NO: 133574 - DNA, 103 bp, Artificial Sequence
  Synthetic Polynucleotide
taatacgactcactataggggctctcttgcttaagctgcttttccacttgaacagaggagacaagtgatgaagcagcttaacctggcggcagcgcaaaagatg

SEQ ID NO: 133575 - DNA, 103 bp, Artificial Sequence
  Synthetic Polynucleotide
taatacgactcactatagggattacctaatgctctcttgcttaagctgctaacagaggagaagcagcatgagcaagagaaacctggcggcagcgcaaaagatg

SEQ ID NO: 133576 - DNA, 103 bp, Artificial Sequence
  Synthetic Polynucleotide
taatacgactcactatagggtggacttttgattacctaatgctctcttgcaacagaggagagcaagaatgcattaggtaaacctggcggcagcgcaaaagatg

SEQ ID NO: 133577 - DNA, 103 bp, Artificial Sequence
  Synthetic Polynucleotide
taatacgactcactatagggtcaactactgtggacttttgattacctaataacagaggagaattaggatgtcaaaagtcaacctggcggcagcgcaaaagatg

SEQ ID NO: 133578 - DNA, 103 bp, Artificial Sequence
  Synthetic Polynucleotide
taatacgactcactatagggcaaggtgctcagttctggctccattgctttaacagaggagaaaagcaatggagccagaaaacctggcggcagcgcaaaagatg

SEQ ID NO: 133579 - DNA, 103 bp, Artificial Sequence
  Synthetic Polynucleotide
taatacgactcactatagggattgctgaattcaactactgtggacttttgaacagaggagacaaaagatgacagtagttaacctggcggcagcgcaaaagatg

SEQ ID NO: 133580 - DNA, 103 bp, Artificial Sequence
  Synthetic Polynucleotide
taatacgactcactatagggaggcatctttattgctgaattcaactactgaacagaggagacagtagatgaattcagcaaacctggcggcagcgcaaaagatg

SEQ ID NO: 133581 - DNA, 103 bp, Artificial Sequence
  Synthetic Polynucleotide
taatacgactcactatagggttaatttcagaggcatctttattgctgaataacagaggagaattcagatgtaaagatgcaacctggcggcagcgcaaaagatg

SEQ ID NO: 133582 - DNA, 103 bp, Artificial Sequence
  Synthetic Polynucleotide
taatacgactcactatagggttgctcactgttaatttcagaggcatctttaacagaggagaaaagatatgtctgaaattaacctggcggcagcgcaaaagatg

SEQ ID NO: 133583 - DNA, 103 bp, Artificial Sequence
  Synthetic Polynucleotide
taatacgactcactatagggtttctttatcttgctcactgttaatttcagaacagaggagactgaaaatgacagtgagcaacctggcggcagcgcaaaagatg

SEQ ID NO: 133584 - DNA, 103 bp, Artificial Sequence
  Synthetic Polynucleotide
taatacgactcactatagggattaaggaattttctttatcttgctcactgaacagaggagacagtgaatgagataaagaaacctggcggcagcgcaaaagatg

SEQ ID NO: 133585 - DNA, 103 bp, Artificial Sequence
  Synthetic Polynucleotide
taatacgactcactatagggttcacttttgattaaggaattttctttatcaacagaggagagataaaatgaattccttaaacctggcggcagcgcaaaagatg

SEQ ID NO: 133586 - DNA, 103 bp, Artificial Sequence
  Synthetic Polynucleotide
taatacgactcactatagggttcttcttggttcacttttgattaaggaataacagaggagaattcctatgtcaaaagtgaacctggcggcagcgcaaaagatg

SEQ ID NO: 133587 - DNA, 103 bp, Artificial Sequence
  Synthetic Polynucleotide
taatacgactcactatagggaatattttaattcttcttggttcacttttgaacagaggagacaaaagatgaccaagaagaacctggcggcagcgcaaaagatg

SEQ ID NO: 133588 - DNA, 103 bp, Artificial Sequence
  Synthetic Polynucleotide
taatacgactcactatagggtcctccatcaaatattttaattcttcttggaacagaggagaccaagaatgattaaaataaacctggcggcagcgcaaaagatg

SEQ ID NO: 133589 - DNA, 103 bp, Artificial Sequence
  Synthetic Polynucleotide
taatacgactcactatagggccttttgtgacaaggtgctcagttctggctaacagaggagaagccagatgtgagcacctaacctggcggcagcgcaaaagatg

SEQ ID NO: 133590 - DNA, 103 bp, Artificial Sequence
  Synthetic Polynucleotide
taatacgactcactatagggttgacttatatcctccatcaaatattttaaaacagaggagattaaaaatgttgatggagaacctggcggcagcgcaaaagatg

SEQ ID NO: 133591 - DNA, 103 bp, Artificial Sequence
  Synthetic Polynucleotide
taatacgactcactatagggtactcttcatttgacttatatcctccatcaaacagaggagatgatggatgatataagtcaacctggcggcagcgcaaaagatg

SEQ ID NO: 133592 - DNA, 103 bp, Artificial Sequence
  Synthetic Polynucleotide
taatacgactcactataggggacatatacatactcttcatttgacttataaacagaggagatataagatgaatgaagagaacctggcggcagcgcaaaagatg

SEQ ID NO: 133593 - DNA, 103 bp, Artificial Sequence
  Synthetic Polynucleotide
taatacgactcactatagggccctgcctcggacatatacatactcttcataacagaggagaatgaagatgatgtatatgaacctggcggcagcgcaaaagatg

SEQ ID NO: 133594 - DNA, 103 bp, Artificial Sequence
  Synthetic Polynucleotide
taatacgactcactatagggtttcctcttcccctgcctcggacatatacaaacagaggagatgtataatgccgaggcagaacctggcggcagcgcaaaagatg

SEQ ID NO: 133595 - DNA, 103 bp, Artificial Sequence
  Synthetic Polynucleotide
taatacgactcactatagggacaaatgtattttcctcttcccctgcctcgaacagaggagacgaggcatgggaagaggaaacctggcggcagcgcaaaagatg

SEQ ID NO: 133596 - DNA, 103 bp, Artificial Sequence
  Synthetic Polynucleotide
taatacgactcactatagggcacattcttcacaaatgtattttcctcttcaacagaggagagaagagatgaatacatttaacctggcggcagcgcaaaagatg

SEQ ID NO: 133597 - DNA, 103 bp, Artificial Sequence
  Synthetic Polynucleotide
taatacgactcactatagggcaacgtattccacattcttcacaaatgtataacagaggagaatacatatgtgaagaatgaacctggcggcagcgcaaaagatg

SEQ ID NO: 133598 - DNA, 103 bp, Artificial Sequence
  Synthetic Polynucleotide
taatacgactcactatagggaggtttcttacaacgtattccacattcttcaacagaggagagaagaaatgggaatacgtaacctggcggcagcgcaaaagatg

SEQ ID NO: 133599 - DNA, 103 bp, Artificial Sequence
  Synthetic Polynucleotide
taatacgactcactatagggttaacatgctaggtttcttacaacgtattcaacagaggagagaatacatggtaagaaacaacctggcggcagcgcaaaagatg

SEQ ID NO: 133600 - DNA, 103 bp, Artificial Sequence
  Synthetic Polynucleotide
taatacgactcactatagggcaaggtgagcccttttgtgacaaggtgctcaacagaggagagagcacatggtcacaaaaaacctggcggcagcgcaaaagatg

SEQ ID NO: 133601 - DNA, 103 bp, Artificial Sequence
  Synthetic Polynucleotide
taatacgactcactatagggatgtgtttctttaacatgctaggtttcttaaacagaggagataagaaatgtagcatgttaacctggcggcagcgcaaaagatg

SEQ ID NO: 133602 - DNA, 103 bp, Artificial Sequence
  Synthetic Polynucleotide
taatacgactcactatagggatgggttcgtatgtgtttctttaacatgctaacagaggagaagcatgatgaagaaacacaacctggcggcagcgcaaaagatg

SEQ ID NO: 133603 - DNA, 103 bp, Artificial Sequence
  Synthetic Polynucleotide
taatacgactcactatagggggacatctgtatgggttcgtatgtgtttctaacagaggagaagaaacatgtacgaacccaacctggcggcagcgcaaaagatg

SEQ ID NO: 133604 - DNA, 103 bp, Artificial Sequence
  Synthetic Polynucleotide
taatacgactcactatagggtggtaggggcggacatctgtatgggttcgtaacagaggagaacgaacatgtacagatgtaacctggcggcagcgcaaaagatg

SEQ ID NO: 133605 - DNA, 103 bp, Artificial Sequence
  Synthetic Polynucleotide
taatacgactcactataggggtaagtgcagtggtaggggcggacatctgtaacagaggagaacagatatgcgcccctacaacctggcggcagcgcaaaagatg

SEQ ID NO: 133606 - DNA, 103 bp, Artificial Sequence
  Synthetic Polynucleotide
taatacgactcactatagggagaagttacagtaagtgcagtggtaggggcaacagaggagagcccctatgactgcacttaacctggcggcagcgcaaaagatg

SEQ ID NO: 133607 - DNA, 103 bp, Artificial Sequence
  Synthetic Polynucleotide
taatacgactcactataggggtcttaaaggagaagttacagtaagtgcagaacagaggagactgcacatgctgtaacttaacctggcggcagcgcaaaagatg

SEQ ID NO: 133608 - DNA, 103 bp, Artificial Sequence
  Synthetic Polynucleotide
taatacgactcactatagggatttcctttagtcttaaaggagaagttacaaacagaggagatgtaacatgtcctttaagaacctggcggcagcgcaaaagatg

SEQ ID NO: 133609 - DNA, 103 bp, Artificial Sequence
  Synthetic Polynucleotide
taatacgactcactataggggttttgtcagatttcctttagtcttaaaggaacagaggagacctttaatgctaaaggaaaacctggcggcagcgcaaaagatg

SEQ ID NO: 133610 - DNA, 103 bp, Artificial Sequence
  Synthetic Polynucleotide
taatacgactcactataggggacttcatgtgttttgtcagatttcctttaaacagaggagataaaggatgtctgacaaaaacctggcggcagcgcaaaagatg

SEQ ID NO: 133611 - DNA, 103 bp, Artificial Sequence
  Synthetic Polynucleotide
taatacgactcactatagggcttaattgcacaaggtgagcccttttgtgaaacagaggagatcacaaatgggctcacctaacctggcggcagcgcaaaagatg

SEQ ID NO: 133612 - DNA, 103 bp, Artificial Sequence
  Synthetic Polynucleotide
taatacgactcactatagggatgtgccttggacttcatgtgttttgtcagaacagaggagactgacaatgcacatgaagaacctggcggcagcgcaaaagatg

SEQ ID NO: 133613 - DNA, 103 bp, Artificial Sequence
  Synthetic Polynucleotide
taatacgactcactatagggatttcttgctatgtgccttggacttcatgtaacagaggagaacatgaatgccaaggcacaacctggcggcagcgcaaaagatg

SEQ ID NO: 133614 - DNA, 103 bp, Artificial Sequence
  Synthetic Polynucleotide
taatacgactcactatagggaaatccacacatttcttgctatgtgccttgaacagaggagacaaggcatgtagcaagaaaacctggcggcagcgcaaaagatg

SEQ ID NO: 133615 - DNA, 103 bp, Artificial Sequence
  Synthetic Polynucleotide
taatacgactcactatagggtgagacgcctaaatccacacatttcttgctaacagaggagaagcaagatgtgtgtggataacctggcggcagcgcaaaagatg

SEQ ID NO: 133616 - DNA, 103 bp, Artificial Sequence
  Synthetic Polynucleotide
taatacgactcactatagggttaaacctactgagacgcctaaatccacacaacagaggagagtgtggatgtaggcgtctaacctggcggcagcgcaaaagatg

SEQ ID NO: 133617 - DNA, 103 bp, Artificial Sequence
  Synthetic Polynucleotide
taatacgactcactatagggtgttcatctattaaacctactgagacgcctaacagaggagaaggcgtatgagtaggtttaacctggcggcagcgcaaaagatg

SEQ ID NO: 133618 - DNA, 103 bp, Artificial Sequence
  Synthetic Polynucleotide
taatacgactcactatagggttctgtatcctgttcatctattaaacctacaacagaggagagtaggtatgatagatgaaaacctggcggcagcgcaaaagatg

SEQ ID NO: 133619 - DNA, 103 bp, Artificial Sequence
  Synthetic Polynucleotide
taatacgactcactatagggcatctgattcttctgtatcctgttcatctaaacagaggagatagatgatgaggatacagaacctggcggcagcgcaaaagatg

SEQ ID NO: 133620 - DNA, 103 bp, Artificial Sequence
  Synthetic Polynucleotide
taatacgactcactatagggctctgtttttcatctgattcttctgtatccaacagaggagaggatacatgagaatcagaaacctggcggcagcgcaaaagatg

SEQ ID NO: 133621 - DNA, 103 bp, Artificial Sequence
  Synthetic Polynucleotide
taatacgactcactatagggataactgaatctctgtttttcatctgattcaacagaggagagaatcaatggaaaaacagaacctggcggcagcgcaaaagatg

SEQ ID NO: 133622 - DNA, 103 bp, Artificial Sequence
  Synthetic Polynucleotide
taatacgactcactataggggtttttctgtcttaattgcacaaggtgagcaacagaggagagctcacatggtgcaattaaacctggcggcagcgcaaaagatg

SEQ ID NO: 133623 - DNA, 103 bp, Artificial Sequence
  Synthetic Polynucleotide
taatacgactcactatagggcagatcgctcataactgaatctctgtttttaacagaggagaaaaaacatggattcagttaacctggcggcagcgcaaaagatg

SEQ ID NO: 133624 - DNA, 103 bp, Artificial Sequence
  Synthetic Polynucleotide
taatacgactcactatagggagatcatatccagatcgctcataactgaataacagaggagaattcagatgtgagcgatcaacctggcggcagcgcaaaagatg

SEQ ID NO: 133625 - DNA, 103 bp, Artificial Sequence
  Synthetic Polynucleotide
taatacgactcactatagggagattcttcaagatcatatccagatcgctcaacagaggagagagcgaatgggatatgataacctggcggcagcgcaaaagatg

SEQ ID NO: 133626 - DNA, 103 bp, Artificial Sequence
  Synthetic Polynucleotide
taatacgactcactatagggctgggccatcagattcttcaagatcatatcaacagaggagagatatgatgttgaagaataacctggcggcagcgcaaaagatg

SEQ ID NO: 133627 - DNA, 103 bp, Artificial Sequence
  Synthetic Polynucleotide
taatacgactcactatagggtcatcctcatctgggccatcagattcttcaaacagaggagatgaagaatgtgatggcccaacctggcggcagcgcaaaagatg

SEQ ID NO: 133628 - DNA, 103 bp, Artificial Sequence
  Synthetic Polynucleotide
taatacgactcactatagggattttcattgtcatcctcatctgggccatcaacagaggagagatggcatggatgaggataacctggcggcagcgcaaaagatg

SEQ ID NO: 133629 - DNA, 103 bp, Artificial Sequence
  Synthetic Polynucleotide
taatacgactcactatagggcatcgtcttcattttcattgtcatcctcataacagaggagaatgaggatgacaatgaaaaacctggcggcagcgcaaaagatg

SEQ ID NO: 133630 - DNA, 103 bp, Artificial Sequence
  Synthetic Polynucleotide
taatacgactcactatagggctgtcctcatcatcgtcttcattttcattgaacagaggagacaatgaatgtgaagacgaaacctggcggcagcgcaaaagatg

SEQ ID NO: 133631 - DNA, 103 bp, Artificial Sequence
  Synthetic Polynucleotide
taatacgactcactatagggttcagcctggctgtcctcatcatcgtcttcaacagaggagagaagacatggatgaggacaacctggcggcagcgcaaaagatg

SEQ ID NO: 133632 - DNA, 103 bp, Artificial Sequence
  Synthetic Polynucleotide
taatacgactcactatagggacaggactgattcagcctggctgtcctcataacagaggagaatgaggatggccaggctgaacctggcggcagcgcaaaagatg

SEQ ID NO: 133633 - DNA, 103 bp, Artificial Sequence
  Synthetic Polynucleotide
taatacgactcactatagggtttggcctcagtttttctgtcttaattgcaaacagaggagatgcaatatggacagaaaaaacctggcggcagcgcaaaagatg

SEQ ID NO: 133634 - DNA, 103 bp, Artificial Sequence
  Synthetic Polynucleotide
taatacgactcactatagggggtgtggctgacaggactgattcagcctggaacagaggagaccaggcatgatcagtcctaacctggcggcagcgcaaaagatg

SEQ ID NO: 133635 - DNA, 103 bp, Artificial Sequence
  Synthetic Polynucleotide
taatacgactcactatagggtgtgactgagggtgtggctgacaggactgaaacagaggagatcagtcatgtcagccacaaacctggcggcagcgcaaaagatg

SEQ ID NO: 133636 - DNA, 103 bp, Artificial Sequence
  Synthetic Polynucleotide
taatacgactcactataggggcgggctagctgtgactgagggtgtggctgaacagaggagacagccaatgcctcagtcaaacctggcggcagcgcaaaagatg

SEQ ID NO: 133637 - DNA, 103 bp, Artificial Sequence
  Synthetic Polynucleotide
taatacgactcactatagggggaaggtgctgcgggctagctgtgactgagaacagaggagactcagtatgagctagcccaacctggcggcagcgcaaaagatg

SEQ ID NO: 133638 - DNA, 103 bp, Artificial Sequence
  Synthetic Polynucleotide
taatacgactcactatagggacttctagatggaaggtgctgcgggctagcaacagaggagagctagcatgcagcaccttaacctggcggcagcgcaaaagatg

SEQ ID NO: 133639 - DNA, 103 bp, Artificial Sequence
  Synthetic Polynucleotide
taatacgactcactatagggcctgaaggctacttctagatggaaggtgctaacagaggagaagcaccatgcatctagaaaacctggcggcagcgcaaaagatg

SEQ ID NO: 133640 - DNA, 103 bp, Artificial Sequence
  Synthetic Polynucleotide
taatacgactcactatagggctcacagggtcctgaaggctacttctagataacagaggagaatctagatgtagccttcaaacctggcggcagcgcaaaagatg

SEQ ID NO: 133641 - DNA, 103 bp, Artificial Sequence
  Synthetic Polynucleotide
taatacgactcactatagggctcgtcagtactcacagggtcctgaaggctaacagaggagaagccttatggaccctgtgaacctggcggcagcgcaaaagatg

SEQ ID NO: 133642 - DNA, 103 bp, Artificial Sequence
  Synthetic Polynucleotide
taatacgactcactatagggtcctgacatcctcgtcagtactcacagggtaacagaggagaaccctgatggtactgacgaacctggcggcagcgcaaaagatg

SEQ ID NO: 133643 - DNA, 103 bp, Artificial Sequence
  Synthetic Polynucleotide
taatacgactcactatagggcaatcggtgatcctgacatcctcgtcagtaaacagaggagatactgaatgggatgtcagaacctggcggcagcgcaaaagatg

SEQ ID NO: 133644 - DNA, 103 bp, Artificial Sequence
  Synthetic Polynucleotide
taatacgactcactatagggtgcagttttatttggcctcagtttttctgtaacagaggagaacagaaatgctgaggccaaacctggcggcagcgcaaaagatg

SEQ ID NO: 133645 - DNA, 103 bp, Artificial Sequence
  Synthetic Polynucleotide
taatacgactcactatagggcccagaaaagcaatcggtgatcctgacatcaacagaggagagatgtcatgatcaccgataacctggcggcagcgcaaaagatg

SEQ ID NO: 133646 - DNA, 103 bp, Artificial Sequence
  Synthetic Polynucleotide
taatacgactcactatagggccgtgtgtaccccagaaaagcaatcggtgaaacagaggagatcaccgatggcttttctgaacctggcggcagcgcaaaagatg

SEQ ID NO: 133647 - DNA, 103 bp, Artificial Sequence
  Synthetic Polynucleotide
taatacgactcactatagggtccattgggtccgtgtgtaccccagaaaagaacagaggagacttttcatgggtacacacaacctggcggcagcgcaaaagatg

SEQ ID NO: 133648 - DNA, 103 bp, Artificial Sequence
  Synthetic Polynucleotide
taatacgactcactataggggggcagaacgtccattgggtccgtgtgtacaacagaggagagtacacatggacccaatgaacctggcggcagcgcaaaagatg

SEQ ID NO: 133649 - DNA, 103 bp, Artificial Sequence
  Synthetic Polynucleotide
taatacgactcactataggggcagcgccctgggcagaacgtccattgggtaacagaggagaacccaaatgacgttctgcaacctggcggcagcgcaaaagatg

SEQ ID NO: 133650 - DNA, 103 bp, Artificial Sequence
  Synthetic Polynucleotide
taatacgactcactatagggattctggtgagcagcgccctgggcagaacgaacagaggagacgttctatgcagggcgctaacctggcggcagcgcaaaagatg

SEQ ID NO: 133651 - DNA, 103 bp, Artificial Sequence
  Synthetic Polynucleotide
taatacgactcactatagggcaggacagtcattctggtgagcagcgccctaacagaggagaagggcgatgctcaccagaaacctggcggcagcgcaaaagatg

SEQ ID NO: 133652 - DNA, 103 bp, Artificial Sequence
  Synthetic Polynucleotide
taatacgactcactataggggtgctgtgctcaggacagtcattctggtgaaacagaggagatcaccaatgtgactgtccaacctggcggcagcgcaaaagatg

SEQ ID NO: 133653 - DNA, 103 bp, Artificial Sequence
  Synthetic Polynucleotide
taatacgactcactatagggtagtcagactgtgctgtgctcaggacagtcaacagaggagagactgtatggagcacagcaacctggcggcagcgcaaaagatg

SEQ ID NO: 133654 - DNA, 103 bp, Artificial Sequence
  Synthetic Polynucleotide
taatacgactcactatagggcttcctattgtagtcagactgtgctgtgctaacagaggagaagcacaatgcagtctgacaacctggcggcagcgcaaaagatg

SEQ ID NO: 133655 - DNA, 103 bp, Artificial Sequence
  Synthetic Polynucleotide
taatacgactcactataggggaggggaacgtgcagttttatttggcctcaaacagaggagatgaggcatgataaaactgaacctggcggcagcgcaaaagatg

SEQ ID NO: 133656 - DNA, 103 bp, Artificial Sequence
  Synthetic Polynucleotide
taatacgactcactataggggagagagtgtcttcctattgtagtcagactaacagaggagaagtctgatgacaataggaaacctggcggcagcgcaaaagatg

SEQ ID NO: 133657 - DNA, 103 bp, Artificial Sequence
  Synthetic Polynucleotide
taatacgactcactataggggccttccccggagagagtgtcttcctattgaacagaggagacaatagatggacactctcaacctggcggcagcgcaaaagatg

SEQ ID NO: 133658 - DNA, 103 bp, Artificial Sequence
  Synthetic Polynucleotide
taatacgactcactatagggacgctgcctggccttccccggagagagtgtaacagaggagaacactcatgccggggaagaacctggcggcagcgcaaaagatg

SEQ ID NO: 133659 - DNA, 103 bp, Artificial Sequence
  Synthetic Polynucleotide
taatacgactcactatagggctctcgcagcacgctgcctggccttccccgaacagaggagacggggaatgccaggcagcaacctggcggcagcgcaaaagatg

SEQ ID NO: 133660 - DNA, 103 bp, Artificial Sequence
  Synthetic Polynucleotide
taatacgactcactatagggtcgttttcatctctcgcagcacgctgcctgaacagaggagacaggcaatgtgctgcgagaacctggcggcagcgcaaaagatg

SEQ ID NO: 133661 - DNA, 103 bp, Artificial Sequence
  Synthetic Polynucleotide
taatacgactcactatagggcggaattgtgtcgttttcatctctcgcagcaacagaggagagctgcgatggatgaaaacaacctggcggcagcgcaaaagatg

SEQ ID NO: 133662 - DNA, 103 bp, Artificial Sequence
  Synthetic Polynucleotide
taatacgactcactatagggtgtctacagacggaattgtgtcgttttcataacagaggagaatgaaaatgacacaattcaacctggcggcagcgcaaaagatg

SEQ ID NO: 133663 - DNA, 103 bp, Artificial Sequence
  Synthetic Polynucleotide
taatacgactcactataggggacctggaagtgtctacagacggaattgtgaacagaggagacacaatatggtctgtagaaacctggcggcagcgcaaaagatg

SEQ ID NO: 133664 - DNA, 103 bp, Artificial Sequence
  Synthetic Polynucleotide
taatacgactcactatagggatgacacggggacctggaagtgtctacagaaacagaggagatctgtaatgacttccaggaacctggcggcagcgcaaaagatg

SEQ ID NO: 133665 - DNA, 103 bp, Artificial Sequence
  Synthetic Polynucleotide
taatacgactcactatagggcagacatctgatgacacggggacctggaagaacagaggagacttccaatgccccgtgtcaacctggcggcagcgcaaaagatg

SEQ ID NO: 133666 - DNA, 103 bp, Artificial Sequence
  Synthetic Polynucleotide
taatacgactcactatagggtttaatttgggaggggaacgtgcagttttaaacagaggagataaaacatgacgttccccaacctggcggcagcgcaaaagatg

SEQ ID NO: 133667 - DNA, 103 bp, Artificial Sequence
  Synthetic Polynucleotide
taatacgactcactataggggggtagtccacagacatctgatgacacgggaacagaggagacccgtgatgtcagatgtcaacctggcggcagcgcaaaagatg

SEQ ID NO: 133668 - DNA, 103 bp, Artificial Sequence
  Synthetic Polynucleotide
taatacgactcactatagggttctgactcagggtagtccacagacatctgaacagaggagacagatgatggtggactacaacctggcggcagcgcaaaagatg

SEQ ID NO: 133669 - DNA, 103 bp, Artificial Sequence
  Synthetic Polynucleotide
taatacgactcactatagggtcagaatttcttctgactcagggtagtccaaacagaggagatggactatgctgagtcagaacctggcggcagcgcaaaagatg

SEQ ID NO: 133670 - DNA, 103 bp, Artificial Sequence
  Synthetic Polynucleotide
taatacgactcactatagggatagaacttctcagaatttcttctgactcaaacagaggagatgagtcatgagaaattctaacctggcggcagcgcaaaagatg

SEQ ID NO: 133671 - DNA, 103 bp, Artificial Sequence
  Synthetic Polynucleotide
taatacgactcactatagggttttcctgccatagaacttctcagaatttcaacagaggagagaaattatgagaagttctaacctggcggcagcgcaaaagatg

SEQ ID NO: 133672 - DNA, 103 bp, Artificial Sequence
  Synthetic Polynucleotide
taatacgactcactatagggtagcaacagcttttcctgccatagaacttcaacagaggagagaagttatgtggcaggaaaacctggcggcagcgcaaaagatg

SEQ ID NO: 133673 - DNA, 103 bp, Artificial Sequence
  Synthetic Polynucleotide
taatacgactcactatagggctctgtgttatagcaacagcttttcctgccaacagaggagaggcaggatgagctgttgcaacctggcggcagcgcaaaagatg

SEQ ID NO: 133674 - DNA, 103 bp, Artificial Sequence
  Synthetic Polynucleotide
taatacgactcactatagggagatgatgggctctgtgttatagcaacagcaacagaggagagctgttatgataacacagaacctggcggcagcgcaaaagatg

SEQ ID NO: 133675 - DNA, 103 bp, Artificial Sequence
  Synthetic Polynucleotide
taatacgactcactataggggaagtcttacagatgatgggctctgtgttaaacagaggagataacacatggcccatcataacctggcggcagcgcaaaagatg

SEQ ID NO: 133676 - DNA, 103 bp, Artificial Sequence
  Synthetic Polynucleotide
taatacgactcactataggggcagcaggaggaagtcttacagatgatgggaacagaggagacccatcatgtgtaagactaacctggcggcagcgcaaaagatg

SEQ ID NO: 133677 - DNA, 103 bp, Artificial Sequence
  Synthetic Polynucleotide
taatacgactcactatagggttttgaaacttctgccccattaagttctttaacagaggagaaaagaaatgaatggggcaaacctggcggcagcgcaaaagatg

SEQ ID NO: 133678 - DNA, 103 bp, Artificial Sequence
  Synthetic Polynucleotide
taatacgactcactatagggtgaactgttttttaatttgggaggggaacgaacagaggagacgttccatgcccaaattaaacctggcggcagcgcaaaagatg

SEQ ID NO: 133679 - DNA, 103 bp, Artificial Sequence
  Synthetic Polynucleotide
taatacgactcactataggggtgctcagctgcagcaggaggaagtcttacaacagaggagagtaagaatgcctcctgctaacctggcggcagcgcaaaagatg

SEQ ID NO: 133680 - DNA, 103 bp, Artificial Sequence
  Synthetic Polynucleotide
taatacgactcactatagggtctgggggctgtgctcagctgcagcaggagaacagaggagactcctgatgcagctgagcaacctggcggcagcgcaaaagatg

SEQ ID NO: 133681 - DNA, 103 bp, Artificial Sequence
  Synthetic Polynucleotide
taatacgactcactatagggcccgctgctgtctgggggctgtgctcagctaacagaggagaagctgaatgcagcccccaaacctggcggcagcgcaaaagatg

SEQ ID NO: 133682 - DNA, 103 bp, Artificial Sequence
  Synthetic Polynucleotide
taatacgactcactatagggagaaggcatccccgctgctgtctgggggctaacagaggagaagccccatgacagcagcgaacctggcggcagcgcaaaagatg

SEQ ID NO: 133683 - DNA, 103 bp, Artificial Sequence
  Synthetic Polynucleotide
taatacgactcactataggggtgaggccacagaaggcatccccgctgctgaacagaggagacagcagatgggatgccttaacctggcggcagcgcaaaagatg

SEQ ID NO: 133684 - DNA, 103 bp, Artificial Sequence
  Synthetic Polynucleotide
taatacgactcactatagggtcaggatgtggtgaggccacagaaggcatcaacagaggagagatgccatgtgtggcctcaacctggcggcagcgcaaaagatg

SEQ ID NO: 133685 - DNA, 103 bp, Artificial Sequence
  Synthetic Polynucleotide
taatacgactcactatagggttcttgagggtcaggatgtggtgaggccacaacagaggagagtggccatgccacatcctaacctggcggcagcgcaaaagatg

SEQ ID NO: 133686 - DNA, 103 bp, Artificial Sequence
  Synthetic Polynucleotide
taatacgactcactataggggctgcttctgttcttgagggtcaggatgtgaacagaggagacacatcatgaccctcaagaacctggcggcagcgcaaaagatg

SEQ ID NO: 133687 - DNA, 103 bp, Artificial Sequence
  Synthetic Polynucleotide
taatacgactcactatagggagagttatttgctgcttctgttcttgagggaacagaggagaccctcaatgacagaagcaaacctggcggcagcgcaaaagatg

SEQ ID NO: 133688 - DNA, 103 bp, Artificial Sequence
  Synthetic Polynucleotide
taatacgactcactatagggagtcggctgtagagttatttgctgcttctgaacagaggagacagaagatgcaaataactaacctggcggcagcgcaaaagatg

SEQ ID NO: 133689 - DNA, 103 bp, Artificial Sequence
  Synthetic Polynucleotide
taatacgactcactataggggggcatccattgaactgttttttaatttggaacagaggagaccaaatatgaaaacagttaacctggcggcagcgcaaaagatg

SEQ ID NO: 133690 - DNA, 103 bp, Artificial Sequence
  Synthetic Polynucleotide
taatacgactcactataggggcaagcctggagtcggctgtagagttatttaacagaggagaaaataaatgtacagccgaaacctggcggcagcgcaaaagatg

SEQ ID NO: 133691 - DNA, 103 bp, Artificial Sequence
  Synthetic Polynucleotide
taatacgactcactatagggtggggagaaggcaagcctggagtcggctgtaacagaggagaacagccatgtccaggcttaacctggcggcagcgcaaaagatg

SEQ ID NO: 133692 - DNA, 103 bp, Artificial Sequence
  Synthetic Polynucleotide
taatacgactcactatagggcaaatgagtgtggggagaaggcaagcctggaacagaggagaccaggcatgccttctcccaacctggcggcagcgcaaaagatg

SEQ ID NO: 133693 - DNA, 103 bp, Artificial Sequence
  Synthetic Polynucleotide
taatacgactcactatagggggtggctaaacaaatgagtgtggggagaagaacagaggagacttctcatgacactcattaacctggcggcagcgcaaaagatg

SEQ ID NO: 133694 - DNA, 103 bp, Artificial Sequence
  Synthetic Polynucleotide
taatacgactcactatagggtgcaaaggaaggtggctaaacaaatgagtgaacagaggagacactcaatggtttagccaaacctggcggcagcgcaaaagatg

SEQ ID NO: 133695 - DNA, 103 bp, Artificial Sequence
  Synthetic Polynucleotide
taatacgactcactatagggctgctgggaatgcaaaggaaggtggctaaaaacagaggagatttagcatgcttcctttgaacctggcggcagcgcaaaagatg

SEQ ID NO: 133696 - DNA, 103 bp, Artificial Sequence
  Synthetic Polynucleotide
taatacgactcactatagggtcctcgattgctgctgggaatgcaaaggaaaacagaggagattccttatgattcccagcaacctggcggcagcgcaaaagatg

SEQ ID NO: 133697 - DNA, 103 bp, Artificial Sequence
  Synthetic Polynucleotide
taatacgactcactatagggttataaggtgtcctcgattgctgctgggaaaacagaggagattcccaatggcaatcgagaacctggcggcagcgcaaaagatg

SEQ ID NO: 133698 - DNA, 103 bp, Artificial Sequence
  Synthetic Polynucleotide
taatacgactcactatagggtggaaccatattataaggtgtcctcgattgaacagaggagacaatcgatgacaccttataacctggcggcagcgcaaaagatg

SEQ ID NO: 133699 - DNA, 103 bp, Artificial Sequence
  Synthetic Polynucleotide
taatacgactcactatagggtccccccaactggaaccatattataaggtgaacagaggagacaccttatgatatggttcaacctggcggcagcgcaaaagatg

SEQ ID NO: 133700 - DNA, 103 bp, Artificial Sequence
  Synthetic Polynucleotide
taatacgactcactataggggtctgatttggggcatccattgaactgtttaacagaggagaaaacagatgaatggatgcaacctggcggcagcgcaaaagatg

SEQ ID NO: 133701 - DNA, 103 bp, Artificial Sequence
  Synthetic Polynucleotide
taatacgactcactatagggaccacatggatccccccaactggaaccataaacagaggagatatggtatgagttgggggaacctggcggcagcgcaaaagatg

SEQ ID NO: 133702 - DNA, 103 bp, Artificial Sequence
  Synthetic Polynucleotide
taatacgactcactataggggccagcaggtaccacatggatccccccaacaacagaggagagttgggatgatccatgtgaacctggcggcagcgcaaaagatg

SEQ ID NO: 133703 - DNA, 103 bp, Artificial Sequence
  Synthetic Polynucleotide
taatacgactcactatagggagtatgtgaggccagcaggtaccacatggaaacagaggagatccatgatgtacctgctgaacctggcggcagcgcaaaagatg

SEQ ID NO: 133704 - DNA, 103 bp, Artificial Sequence
  Synthetic Polynucleotide
taatacgactcactatagggacaaacgtggagtatgtgaggccagcaggtaacagaggagaacctgcatgcctcacataaacctggcggcagcgcaaaagatg

SEQ ID NO: 133705 - DNA, 103 bp, Artificial Sequence
  Synthetic Polynucleotide
taatacgactcactatagggctgaaggggcacaaacgtggagtatgtgagaacagaggagactcacaatgtccacgtttaacctggcggcagcgcaaaagatg

SEQ ID NO: 133706 - DNA, 103 bp, Artificial Sequence
  Synthetic Polynucleotide
taatacgactcactatagggctggtccagcctgaaggggcacaaacgtggaacagaggagaccacgtatgtgccccttcaacctggcggcagcgcaaaagatg

SEQ ID NO: 133707 - DNA, 103 bp, Artificial Sequence
  Synthetic Polynucleotide
taatacgactcactataggggtgagctgcactggtccagcctgaaggggcaacagaggagagcccctatgggctggaccaacctggcggcagcgcaaaagatg

SEQ ID NO: 133708 - DNA, 103 bp, Artificial Sequence
  Synthetic Polynucleotide
taatacgactcactatagggagcagggatcgtgagctgcactggtccagcaacagaggagagctggaatggtgcagctcaacctggcggcagcgcaaaagatg

SEQ ID NO: 133709 - DNA, 103 bp, Artificial Sequence
  Synthetic Polynucleotide
taatacgactcactatagggcgacactgacagcagggatcgtgagctgcaaacagaggagatgcagcatgcgatccctgaacctggcggcagcgcaaaagatg

SEQ ID NO: 133710 - DNA, 103 bp, Artificial Sequence
  Synthetic Polynucleotide
taatacgactcactataggggttctgtgaacgacactgacagcagggatcaacagaggagagatcccatgtgtcagtgtaacctggcggcagcgcaaaagatg

SEQ ID NO: 133711 - DNA, 103 bp, Artificial Sequence
  Synthetic Polynucleotide
taatacgactcactatagggttcctgtgaagtctgatttggggcatccataacagaggagaatggatatgccaaatcagaacctggcggcagcgcaaaagatg

SEQ ID NO: 133712 - DNA, 103 bp, Artificial Sequence
  Synthetic Polynucleotide
taatacgactcactatagggagtacccaaagttctgtgaacgacactgacaacagaggagagtcagtatggttcacagaaacctggcggcagcgcaaaagatg

SEQ ID NO: 133713 - DNA, 103 bp, Artificial Sequence
  Synthetic Polynucleotide
taatacgactcactatagggtattcctatgagtacccaaagttctgtgaaaacagaggagattcacaatgctttgggtaaacctggcggcagcgcaaaagatg

SEQ ID NO: 133714 - DNA, 103 bp, Artificial Sequence
  Synthetic Polynucleotide
taatacgactcactatagggtctgtgaccgtattcctatgagtacccaaaaacagaggagatttgggatgtcataggaaaacctggcggcagcgcaaaagatg

SEQ ID NO: 133715 - DNA, 103 bp, Artificial Sequence
  Synthetic Polynucleotide
taatacgactcactataggggccagacacttctgtgaccgtattcctatgaacagaggagacataggatgacggtcacaaacctggcggcagcgcaaaagatg

SEQ ID NO: 133716 - DNA, 103 bp, Artificial Sequence
  Synthetic Polynucleotide
taatacgactcactatagggggtttgtagtgccagacacttctgtgaccgaacagaggagacggtcaatgaagtgtctgaacctggcggcagcgcaaaagatg

SEQ ID NO: 133717 - DNA, 103 bp, Artificial Sequence
  Synthetic Polynucleotide
taatacgactcactatagggactccagcagggtttgtagtgccagacactaacagaggagaagtgtcatgcactacaaaaacctggcggcagcgcaaaagatg

SEQ ID NO: 133718 - DNA, 103 bp, Artificial Sequence
  Synthetic Polynucleotide
taatacgactcactatagggtaattcagccactccagcagggtttgtagtaacagaggagaactacaatgcctgctggaaacctggcggcagcgcaaaagatg

SEQ ID NO: 133719 - DNA, 103 bp, Artificial Sequence
  Synthetic Polynucleotide
taatacgactcactatagggcaacactgcttaattcagccactccagcagaacagaggagactgctgatgtggctgaataacctggcggcagcgcaaaagatg

SEQ ID NO: 133720 - DNA, 103 bp, Artificial Sequence
  Synthetic Polynucleotide
taatacgactcactatagggatacatggcacaacactgcttaattcagccaacagaggagaggctgaatgaagcagtgtaacctggcggcagcgcaaaagatg

SEQ ID NO: 133721 - DNA, 103 bp, Artificial Sequence
  Synthetic Polynucleotide
taatacgactcactataggggccgataggaatacatggcacaacactgctaacagaggagaagcagtatggtgccatgtaacctggcggcagcgcaaaagatg

SEQ ID NO: 133722 - DNA, 103 bp, Artificial Sequence
  Synthetic Polynucleotide
taatacgactcactatagggcagcaaccaattcctgtgaagtctgatttgaacagaggagacaaatcatgcttcacaggaacctggcggcagcgcaaaagatg

SEQ ID NO: 133723 - DNA, 103 bp, Artificial Sequence
  Synthetic Polynucleotide
taatacgactcactatagggcgcggatttggccgataggaatacatggcaaacagaggagatgccatatgttcctatcgaacctggcggcagcgcaaaagatg

SEQ ID NO: 133724 - DNA, 103 bp, Artificial Sequence
  Synthetic Polynucleotide
taatacgactcactatagggaggcctggcacgcggatttggccgataggaaacagaggagatcctatatgccaaatccgaacctggcggcagcgcaaaagatg

SEQ ID NO: 133725 - DNA, 103 bp, Artificial Sequence
  Synthetic Polynucleotide
taatacgactcactatagggtaggttctgaaggcctggcacgcggatttgaacagaggagacaaatcatggtgccaggcaacctggcggcagcgcaaaagatg

SEQ ID NO: 133726 - DNA, 103 bp, Artificial Sequence
  Synthetic Polynucleotide
taatacgactcactatagggctggggtacttaggttctgaaggcctggcaaacagaggagatgccagatgttcagaaccaacctggcggcagcgcaaaagatg

SEQ ID NO: 133727 - DNA, 103 bp, Artificial Sequence
  Synthetic Polynucleotide
taatacgactcactataggggactgcaagcctggggtacttaggttctgaaacagaggagatcagaaatgaagtaccccaacctggcggcagcgcaaaagatg

SEQ ID NO: 133728 - DNA, 103 bp, Artificial Sequence
  Synthetic Polynucleotide
taatacgactcactatagggcgaggggagtgactgcaagcctggggtactaacagaggagaagtaccatgggcttgcagaacctggcggcagcgcaaaagatg

SEQ ID NO: 133729 - DNA, 103 bp, Artificial Sequence
  Synthetic Polynucleotide
taatacgactcactatagggccatgcttaacgaggggagtgactgcaagcaacagaggagagcttgcatgcactcccctaacctggcggcagcgcaaaagatg

SEQ ID NO: 133730 - DNA, 103 bp, Artificial Sequence
  Synthetic Polynucleotide
taatacgactcactatagggttgacggtttccatgcttaacgaggggagtaacagaggagaactcccatggttaagcataacctggcggcagcgcaaaagatg

SEQ ID NO: 133731 - DNA, 103 bp, Artificial Sequence
  Synthetic Polynucleotide
taatacgactcactataggggcctacaatattgacggtttccatgcttaaaacagaggagattaagcatggaaaccgtcaacctggcggcagcgcaaaagatg

SEQ ID NO: 133732 - DNA, 103 bp, Artificial Sequence
  Synthetic Polynucleotide
taatacgactcactatagggtattggctaggcctacaatattgacggtttaacagaggagaaaaccgatgatattgtagaacctggcggcagcgcaaaagatg

SEQ ID NO: 133733 - DNA, 103 bp, Artificial Sequence
  Synthetic Polynucleotide
taatacgactcactataggggactgtgattcagcaaccaattcctgtgaaaacagaggagattcacaatgattggttgcaacctggcggcagcgcaaaagatg

SEQ ID NO: 133734 - DNA, 103 bp, Artificial Sequence
  Synthetic Polynucleotide
taatacgactcactataggggccatatttgtattggctaggcctacaataaacagaggagatattgtatgcctagccaaaacctggcggcagcgcaaaagatg

SEQ ID NO: 133735 - DNA, 103 bp, Artificial Sequence
  Synthetic Polynucleotide
taatacgactcactataggggacttgtggggccatatttgtattggctagaacagaggagactagccatgacaaatatgaacctggcggcagcgcaaaagatg

SEQ ID NO: 133736 - DNA, 103 bp, Artificial Sequence
  Synthetic Polynucleotide
taatacgactcactatagggctggtggatggacttgtggggccatatttgaacagaggagacaaataatgccccacaagaacctggcggcagcgcaaaagatg

SEQ ID NO: 133737 - DNA, 103 bp, Artificial Sequence
  Synthetic Polynucleotide
taatacgactcactatagggagagccagtcctggtggatggacttgtgggaacagaggagacccacaatgccatccaccaacctggcggcagcgcaaaagatg

SEQ ID NO: 133738 - DNA, 103 bp, Artificial Sequence
  Synthetic Polynucleotide
taatacgactcactataggggacagcattcagagccagtcctggtggatgaacagaggagacatccaatgggactggctaacctggcggcagcgcaaaagatg

SEQ ID NO: 133739 - DNA, 103 bp, Artificial Sequence
  Synthetic Polynucleotide
taatacgactcactatagggcctgcagtccgacagcattcagagccagtcaacagaggagagactggatgtgaatgctgaacctggcggcagcgcaaaagatg

SEQ ID NO: 133740 - DNA, 103 bp, Artificial Sequence
  Synthetic Polynucleotide
taatacgactcactataggggcagtcagaacctgcagtccgacagcattcaacagaggagagaatgcatgcggactgcaaacctggcggcagcgcaaaagatg

SEQ ID NO: 133741 - DNA, 103 bp, Artificial Sequence
  Synthetic Polynucleotide
taatacgactcactatagggtgaagggtttgcagtcagaacctgcagtccaacagaggagaggactgatggttctgactaacctggcggcagcgcaaaagatg

SEQ ID NO: 133742 - DNA, 103 bp, Artificial Sequence
  Synthetic Polynucleotide
taatacgactcactatagggtgctttgtgatgaagggtttgcagtcagaaaacagaggagattctgaatgcaaacccttaacctggcggcagcgcaaaagatg

SEQ ID NO: 133743 - DNA, 103 bp, Artificial Sequence
  Synthetic Polynucleotide
taatacgactcactatagggggggcggggctgctttgtgatgaagggtttaacagaggagaaaacccatgatcacaaagaacctggcggcagcgcaaaagatg

SEQ ID NO: 133744 - DNA, 103 bp, Artificial Sequence
  Synthetic Polynucleotide
taatacgactcactatagggggtacaagaagactgtgattcagcaaccaaaacagaggagattggttatggaatcacagaacctggcggcagcgcaaaagatg

SEQ ID NO: 133745 - DNA, 103 bp, Artificial Sequence
  Synthetic Polynucleotide
taatacgactcactataggggtgtgcctgaggggcggggctgctttgtgaaacagaggagatcacaaatgagccccgccaacctggcggcagcgcaaaagatg

SEQ ID NO: 133746 - DNA, 103 bp, Artificial Sequence
  Synthetic Polynucleotide
taatacgactcactataggggacctggaatgtgtgcctgaggggcggggcaacagaggagagccccgatgctcaggcacaacctggcggcagcgcaaaagatg

SEQ ID NO: 133747 - DNA, 103 bp, Artificial Sequence
  Synthetic Polynucleotide
taatacgactcactatagggaagatctggagacctggaatgtgtgcctgaaacagaggagatcaggcatgcattccaggaacctggcggcagcgcaaaagatg

SEQ ID NO: 133748 - DNA, 103 bp, Artificial Sequence
  Synthetic Polynucleotide
taatacgactcactatagggtgctatgttcaagatctggagacctggaataacagaggagaattccaatgctccagatcaacctggcggcagcgcaaaagatg

SEQ ID NO: 133749 - DNA, 103 bp, Artificial Sequence
  Synthetic Polynucleotide
taatacgactcactatagggaggtgggcaatgctatgttcaagatctggaaacagaggagatccagaatgtgaacatagaacctggcggcagcgcaaaagatg

SEQ ID NO: 133750 - DNA, 103 bp, Artificial Sequence
  Synthetic Polynucleotide
taatacgactcactataggggaggggattaaggtgggcaatgctatgttcaacagaggagagaacatatgattgcccacaacctggcggcagcgcaaaagatg

SEQ ID NO: 133751 - DNA, 103 bp, Artificial Sequence
  Synthetic Polynucleotide
taatacgactcactatagggttgactgactgaggggattaaggtgggcaaaacagaggagattgcccatgttaatccccaacctggcggcagcgcaaaagatg

SEQ ID NO: 133752 - DNA, 103 bp, Artificial Sequence
  Synthetic Polynucleotide
taatacgactcactatagggcaacggctacttgactgactgaggggattaaacagaggagataatccatgcagtcagtcaacctggcggcagcgcaaaagatg

SEQ ID NO: 133753 - DNA, 103 bp, Artificial Sequence
  Synthetic Polynucleotide
taatacgactcactatagggccctgtgcatcaacggctacttgactgactaacagaggagaagtcagatgagtagccgtaacctggcggcagcgcaaaagatg

SEQ ID NO: 133754 - DNA, 103 bp, Artificial Sequence
  Synthetic Polynucleotide
taatacgactcactatagggttctggagctccctgtgcatcaacggctacaacagaggagagtagccatggatgcacagaacctggcggcagcgcaaaagatg

SEQ ID NO: 133755 - DNA, 103 bp, Artificial Sequence
  Synthetic Polynucleotide
taatacgactcactatagggctgtgtatgaggtacaagaagactgtgattaacagaggagaaatcacatgcttcttgtaaacctggcggcagcgcaaaagatg

SEQ ID NO: 133756 - DNA, 103 bp, Artificial Sequence
  Synthetic Polynucleotide
taatacgactcactatagggaagctggcatttctggagctccctgtgcataacagaggagaatgcacatggagctccagaacctggcggcagcgcaaaagatg

SEQ ID NO: 133757 - DNA, 103 bp, Artificial Sequence
  Synthetic Polynucleotide
taatacgactcactatagggttgctttgggaagctggcatttctggagctaacagaggagaagctccatgaatgccagcaacctggcggcagcgcaaaagatg

SEQ ID NO: 133758 - DNA, 103 bp, Artificial Sequence
  Synthetic Polynucleotide
taatacgactcactatagggctcgcatgctttgctttgggaagctggcataacagaggagaatgccaatgtcccaaagcaacctggcggcagcgcaaaagatg

SEQ ID NO: 133759 - DNA, 103 bp, Artificial Sequence
  Synthetic Polynucleotide
taatacgactcactatagggtgggttgtgtctcgcatgctttgctttgggaacagaggagacccaaaatgaagcatgcgaacctggcggcagcgcaaaagatg

SEQ ID NO: 133760 - DNA, 103 bp, Artificial Sequence
  Synthetic Polynucleotide
taatacgactcactataggggaagtctgcttgggttgtgtctcgcatgctaacagaggagaagcatgatggacacaaccaacctggcggcagcgcaaaagatg

SEQ ID NO: 133761 - DNA, 103 bp, Artificial Sequence
  Synthetic Polynucleotide
taatacgactcactataggggctggctacagaagtctgcttgggttgtgtaacagaggagaacacaaatgaagcagactaacctggcggcagcgcaaaagatg

SEQ ID NO: 133762 - DNA, 103 bp, Artificial Sequence
  Synthetic Polynucleotide
taatacgactcactatagggcctggtttgcgctggctacagaagtctgctaacagaggagaagcagaatgctgtagccaaacctggcggcagcgcaaaagatg

SEQ ID NO: 133763 - DNA, 103 bp, Artificial Sequence
  Synthetic Polynucleotide
taatacgactcactataggggtcctgctgacctggtttgcgctggctacaaacagaggagatgtagcatgcgcaaaccaaacctggcggcagcgcaaaagatg

SEQ ID NO: 133764 - DNA, 103 bp, Artificial Sequence
  Synthetic Polynucleotide
taatacgactcactatagggaggagactcggtcctgctgacctggtttgcaacagaggagagcaaacatggtcagcaggaacctggcggcagcgcaaaagatg

SEQ ID NO: 133765 - DNA, 103 bp, Artificial Sequence
  Synthetic Polynucleotide
taatacgactcactataggggtaacccctgaggagactcggtcctgctgaaacagaggagatcagcaatgccgagtctcaacctggcggcagcgcaaaagatg

SEQ ID NO: 133766 - DNA, 103 bp, Artificial Sequence
  Synthetic Polynucleotide
taatacgactcactataggggacatatggactgtgtatgaggtacaagaaaacagaggagattcttgatgctcatacacaacctggcggcagcgcaaaagatg

SEQ ID NO: 133767 - DNA, 103 bp, Artificial Sequence
  Synthetic Polynucleotide
taatacgactcactatagggtggactgtaggtaacccctgaggagactcgaacagaggagacgagtcatgtcaggggttaacctggcggcagcgcaaaagatg

SEQ ID NO: 133768 - DNA, 103 bp, Artificial Sequence
  Synthetic Polynucleotide
taatacgactcactatagggattttcccgctggactgtaggtaacccctgaacagaggagacaggggatgcctacagtcaacctggcggcagcgcaaaagatg

SEQ ID NO: 133769 - DNA, 103 bp, Artificial Sequence
  Synthetic Polynucleotide
taatacgactcactatagggctttttttgcattttcccgctggactgtagaacagaggagactacagatgagcgggaaaaacctggcggcagcgcaaaagatg

SEQ ID NO: 133770 - DNA, 103 bp, Artificial Sequence
  Synthetic Polynucleotide
taatacgactcactatagggggattcagaactttttttgcattttcccgcaacagaggagagcgggaatgtgcaaaaaaaacctggcggcagcgcaaaagatg

SEQ ID NO: 133771 - DNA, 103 bp, Artificial Sequence
  Synthetic Polynucleotide
taatacgactcactatagggaggggcaggtggattcagaactttttttgcaacagaggagagcaaaaatggttctgaataacctggcggcagcgcaaaagatg

SEQ ID NO: 133772 - DNA, 103 bp, Artificial Sequence
  Synthetic Polynucleotide
taatacgactcactatagggggtcacctgcaggggcaggtggattcagaaaacagaggagattctgaatgcacctgcccaacctggcggcagcgcaaaagatg

SEQ ID NO: 133773 - DNA, 103 bp, Artificial Sequence
  Synthetic Polynucleotide
taatacgactcactatagggagccttgcatggtcacctgcaggggcaggtaacagaggagaacctgcatgtgcaggtgaaacctggcggcagcgcaaaagatg

SEQ ID NO: 133774 - DNA, 103 bp, Artificial Sequence
  Synthetic Polynucleotide
taatacgactcactatagggcaggccatcaagccttgcatggtcacctgcaacagaggagagcaggtatgcatgcaaggaacctggcggcagcgcaaaagatg

SEQ ID NO: 133775 - DNA, 103 bp, Artificial Sequence
  Synthetic Polynucleotide
taatacgactcactatagggccattttactcaggccatcaagccttgcataacagaggagaatgcaaatgttgatggccaacctggcggcagcgcaaaagatg

SEQ ID NO: 133776 - DNA, 103 bp, Artificial Sequence
  Synthetic Polynucleotide
taatacgactcactatagggttctctgtgtccattttactcaggccatcaaacagaggagatgatggatggagtaaaataacctggcggcagcgcaaaagatg

SEQ ID NO: 133777 - DNA, 103 bp, Artificial Sequence
  Synthetic Polynucleotide
taatacgactcactatagggctgagcagcagacatatggactgtgtatgaaacagaggagatcatacatggtccatatgaacctggcggcagcgcaaaagatg

SEQ ID NO: 133778 - DNA, 103 bp, Artificial Sequence
  Synthetic Polynucleotide
taatacgactcactatagggcgaggcagccttctctgtgtccattttactaacagaggagaagtaaaatggacacagagaacctggcggcagcgcaaaagatg

SEQ ID NO: 133779 - DNA, 103 bp, Artificial Sequence
  Synthetic Polynucleotide
taatacgactcactatagggcgtgatttgccgaggcagccttctctgtgtaacagaggagaacacagatgaggctgcctaacctggcggcagcgcaaaagatg

SEQ ID NO: 133780 - DNA, 103 bp, Artificial Sequence
  Synthetic Polynucleotide
taatacgactcactatagggttgggcttcacgtgatttgccgaggcagccaacagaggagaggctgcatgggcaaatcaaacctggcggcagcgcaaaagatg

SEQ ID NO: 133781 - DNA, 103 bp, Artificial Sequence
  Synthetic Polynucleotide
taatacgactcactataggggagttcaggcttgggcttcacgtgatttgcaacagaggagagcaaatatggtgaagcccaacctggcggcagcgcaaaagatg

SEQ ID NO: 133782 - DNA, 103 bp, Artificial Sequence
  Synthetic Polynucleotide
taatacgactcactataggggtatggaagtgagttcaggcttgggcttcaaacagaggagatgaagcatgagcctgaacaacctggcggcagcgcaaaagatg

SEQ ID NO: 133783 - DNA, 103 bp, Artificial Sequence
  Synthetic Polynucleotide
taatacgactcactatagggggttggccctgtatggaagtgagttcaggcaacagaggagagcctgaatgcacttccataacctggcggcagcgcaaaagatg

SEQ ID NO: 133784 - DNA, 103 bp, Artificial Sequence
  Synthetic Polynucleotide
taatacgactcactatagggcgtggacgctggttggccctgtatggaagtaacagaggagaacttccatgcagggccaaaacctggcggcagcgcaaaagatg

SEQ ID NO: 133785 - DNA, 103 bp, Artificial Sequence
  Synthetic Polynucleotide
taatacgactcactataggggaggttgtgacgtggacgctggttggccctaacagaggagaagggccatgcagcgtccaaacctggcggcagcgcaaaagatg

SEQ ID NO: 133786 - DNA, 103 bp, Artificial Sequence
  Synthetic Polynucleotide
taatacgactcactataggggccttcagcagaggttgtgacgtggacgctaacagaggagaagcgtcatggtcacaaccaacctggcggcagcgcaaaagatg

SEQ ID NO: 133787 - DNA, 103 bp, Artificial Sequence
  Synthetic Polynucleotide
taatacgactcactatagggttcagaatgtgccttcagcagaggttgtgaaacagaggagatcacaaatgctgctgaagaacctggcggcagcgcaaaagatg

SEQ ID NO: 133788 - DNA, 103 bp, Artificial Sequence
  Synthetic Polynucleotide
taatacgactcactatagggagatttctttttttgaaacttctgccccataacagaggagaatggggatgaagtttcaaaacctggcggcagcgcaaaagatg

SEQ ID NO: 133789 - DNA, 103 bp, Artificial Sequence
  Synthetic Polynucleotide
taatacgactcactataggggctcattcttctgagcagcagacatatggaaacagaggagatccataatgctgctgctcaacctggcggcagcgcaaaagatg

SEQ ID NO: 133790 - DNA, 103 bp, Artificial Sequence
  Synthetic Polynucleotide
taatacgactcactatagggttgtaaaaacttcagaatgtgccttcagcaaacagaggagatgctgaatgcacattctgaacctggcggcagcgcaaaagatg

SEQ ID NO: 133791 - DNA, 103 bp, Artificial Sequence
  Synthetic Polynucleotide
taatacgactcactatagggcctgagggctttgtaaaaacttcagaatgtaacagaggagaacattcatgagtttttacaacctggcggcagcgcaaaagatg

SEQ ID NO: 133792 - DNA, 103 bp, Artificial Sequence
  Synthetic Polynucleotide
taatacgactcactatagggagtctgctggcctgagggctttgtaaaaacaacagaggagagtttttatgaagccctcaaacctggcggcagcgcaaaagatg

SEQ ID NO: 133793 - DNA, 103 bp, Artificial Sequence
  Synthetic Polynucleotide
taatacgactcactatagggctggagagagagtctgctggcctgagggctaacagaggagaagccctatggccagcagaaacctggcggcagcgcaaaagatg

SEQ ID NO: 133794 - DNA, 103 bp, Artificial Sequence
  Synthetic Polynucleotide
taatacgactcactatagggacctgtctgtctggagagagagtctgctggaacagaggagaccagcaatgtctctctccaacctggcggcagcgcaaaagatg

SEQ ID NO: 133795 - DNA, 103 bp, Artificial Sequence
  Synthetic Polynucleotide
taatacgactcactataggggggcctgggaacctgtctgtctggagagagaacagaggagactctctatggacagacagaacctggcggcagcgcaaaagatg

SEQ ID NO: 133796 - DNA, 103 bp, Artificial Sequence
  Synthetic Polynucleotide
taatacgactcactataggggtagtgctgtgggcctgggaacctgtctgtaacagaggagaacagacatgttcccaggcaacctggcggcagcgcaaaagatg

SEQ ID NO: 133797 - DNA, 103 bp, Artificial Sequence
  Synthetic Polynucleotide
taatacgactcactatagggtgcctccgcggtagtgctgtgggcctgggaaacagaggagatcccagatgcacagcactaacctggcggcagcgcaaaagatg

SEQ ID NO: 133798 - DNA, 103 bp, Artificial Sequence
  Synthetic Polynucleotide
taatacgactcactatagggcacagtgggctgcctccgcggtagtgctgtaacagaggagaacagcaatgccgcggaggaacctggcggcagcgcaaaagatg

SEQ ID NO: 133799 - DNA, 103 bp, Artificial Sequence
  Synthetic Polynucleotide
taatacgactcactatagggcgctgaagtgcacagtgggctgcctccgcgaacagaggagacgcggaatgagcccactgaacctggcggcagcgcaaaagatg

SEQ ID NO: 133800 - DNA, 103 bp, Artificial Sequence
  Synthetic Polynucleotide
taatacgactcactatagggattgccccttgctcattcttctgagcagcaaacagaggagatgctgcatggaagaatgaaacctggcggcagcgcaaaagatg

SEQ ID NO: 133801 - DNA, 103 bp, Artificial Sequence
  Synthetic Polynucleotide
taatacgactcactatagggctgctcacgtcgctgaagtgcacagtgggcaacagaggagagcccacatggcacttcagaacctggcggcagcgcaaaagatg

SEQ ID NO: 133802 - DNA, 103 bp, Artificial Sequence
  Synthetic Polynucleotide
taatacgactcactataggggtcatcatcgctgctcacgtcgctgaagtgaacagaggagacacttcatggacgtgagcaacctggcggcagcgcaaaagatg

SEQ ID NO: 133803 - DNA, 103 bp, Artificial Sequence
  Synthetic Polynucleotide
taatacgactcactataggggcctgtcctcgtcatcatcgctgctcacgtaacagaggagaacgtgaatggcgatgatgaacctggcggcagcgcaaaagatg

SEQ ID NO: 133804 - DNA, 103 bp, Artificial Sequence
  Synthetic Polynucleotide
taatacgactcactataggggctatcacaagcctgtcctcgtcatcatcgaacagaggagacgatgaatgcgaggacagaacctggcggcagcgcaaaagatg

SEQ ID NO: 133805 - DNA, 103 bp, Artificial Sequence
  Synthetic Polynucleotide
taatacgactcactatagggagctgactgcattgccccttgctcattcttaacagaggagaaagaatatgcaaggggcaaacctggcggcagcgcaaaagatg

SEQ ID NO: 133806 - DNA, 103 bp, Artificial Sequence
  Synthetic Polynucleotide
taatacgactcactatagggacaaatgagaagctgactgcattgccccttaacagaggagaaaggggatgtgcagtcagaacctggcggcagcgcaaaagatg

SEQ ID NO: 133807 - DNA, 103 bp, Artificial Sequence
  Synthetic Polynucleotide
taatacgactcactatagggtgttgatgatacaaatgagaagctgactgcaacagaggagagcagtcatgttctcatttaacctggcggcagcgcaaaagatg

SEQ ID NO: 133808 - DNA, 103 bp, Artificial Sequence
  Synthetic Polynucleotide
taatacgactcactatagggaaagtgttcatgttgatgatacaaatgagaaacagaggagatctcatatgtatcatcaaaacctggcggcagcgcaaaagatg

SEQ ID NO: 133809 - DNA, 103 bp, Artificial Sequence
  Synthetic Polynucleotide
taatacgactcactatagggatttgggaacaaagtgttcatgttgatgataacagaggagaatcatcatgatgaacactaacctggcggcagcgcaaaagatg

SEQ ID NO: 133810 - DNA, 103 bp, Artificial Sequence
  Synthetic Polynucleotide
taatacgactcactatagggtgttggttggatttgggaacaaagtgttcaaacagaggagatgaacaatgtgttcccaaaacctggcggcagcgcaaaagatg

SEQ ID NO: 133811 - DNA, 103 bp, Artificial Sequence
  Synthetic Polynucleotide
taatacgactcactatagggctgttgattatgttggttggatttgggaacaacagaggagagttcccatgtccaaccaaaacctggcggcagcgcaaaagatg

SEQ ID NO: 133812 - DNA, 103 bp, Artificial Sequence
  Synthetic Polynucleotide
taatacgactcactatagggaccccggaagctgttgattatgttggttggaacagaggagaccaaccatgataatcaacaacctggcggcagcgcaaaagatg

SEQ ID NO: 133813 - DNA, 103 bp, Artificial Sequence
  Synthetic Polynucleotide
taatacgactcactatagggccagcctgtaagatttctttttttgaaactaacagaggagaagtttcatgaaaagaaataacctggcggcagcgcaaaagatg

SEQ ID NO: 133814 - DNA, 103 bp, Artificial Sequence
  Synthetic Polynucleotide
taatacgactcactatagggaaacctgaacaccccggaagctgttgattaaacagaggagataatcaatggcttccgggaacctggcggcagcgcaaaagatg

SEQ ID NO: 133815 - DNA, 103 bp, Artificial Sequence
  Synthetic Polynucleotide
taatacgactcactatagggtgatcctgtgaaacctgaacaccccggaagaacagaggagacttccgatgtgttcaggtaacctggcggcagcgcaaaagatg

SEQ ID NO: 133816 - DNA, 103 bp, Artificial Sequence
  Synthetic Polynucleotide
taatacgactcactataggggatttgtcagtgatcctgtgaaacctgaacaacagaggagagttcagatgtcacaggataacctggcggcagcgcaaaagatg

SEQ ID NO: 133817 - DNA, 103 bp, Artificial Sequence
  Synthetic Polynucleotide
taatacgactcactatagggtgattttgcagatttgtcagtgatcctgtgaacagaggagacacaggatgactgacaaaaacctggcggcagcgcaaaagatg

SEQ ID NO: 133818 - DNA, 103 bp, Artificial Sequence
  Synthetic Polynucleotide
taatacgactcactatagggggcattctcttgattttgcagatttgtcagaacagaggagactgacaatgctgcaaaataacctggcggcagcgcaaaagatg

SEQ ID NO: 133819 - DNA, 103 bp, Artificial Sequence
  Synthetic Polynucleotide
taatacgactcactataggggttcaagtttggcattctcttgattttgcaaacagaggagatgcaaaatgaagagaatgaacctggcggcagcgcaaaagatg

SEQ ID NO: 133820 - DNA, 103 bp, Artificial Sequence
  Synthetic Polynucleotide
taatacgactcactatagggttataaacctgttcaagtttggcattctctaacagaggagaagagaaatgcaaacttgaaacctggcggcagcgcaaaagatg

SEQ ID NO: 133821 - DNA, 103 bp, Artificial Sequence
  Synthetic Polynucleotide
taatacgactcactatagggcactgctatattataaacctgttcaagtttaacagaggagaaaacttatgcaggtttataacctggcggcagcgcaaaagatg

SEQ ID NO: 133822 - DNA, 103 bp, Artificial Sequence
  Synthetic Polynucleotide
taatacgactcactatagggcagatgatgtcactgctatattataaacctaacagaggagaaggtttatgatatagcagaacctggcggcagcgcaaaagatg

SEQ ID NO: 133823 - DNA, 103 bp, Artificial Sequence
  Synthetic Polynucleotide
taatacgactcactataggggttaggcctacagatgatgtcactgctataaacagaggagatatagcatggacatcatcaacctggcggcagcgcaaaagatg

SEQ ID NO: 133824 - DNA, 103 bp, Artificial Sequence
  Synthetic Polynucleotide
taatacgactcactatagggcagggggagcggtcgggacattttctccataacagaggagaatggagatgatgtcccgaaacctggcggcagcgcaaaagatg

SEQ ID NO: 133825 - DNA, 103 bp, Artificial Sequence
  Synthetic Polynucleotide
taatacgactcactatagggaaatgcgtcttcgtggtgaagggggagcttaacagaggagaaagctcatgcttcaccacaacctggcggcagcgcaaaagatg

SEQ ID NO: 133826 - DNA, 103 bp, Artificial Sequence
  Synthetic Polynucleotide
taatacgactcactatagggtatctttactaaatgcgtcttcgtggtgaaaacagaggagattcaccatgaagacgcataacctggcggcagcgcaaaagatg

SEQ ID NO: 133827 - DNA, 103 bp, Artificial Sequence
  Synthetic Polynucleotide
taatacgactcactatagggtccttgtctttatctttactaaatgcgtctaacagaggagaagacgcatgtagtaaagaaacctggcggcagcgcaaaagatg

SEQ ID NO: 133828 - DNA, 103 bp, Artificial Sequence
  Synthetic Polynucleotide
taatacgactcactatagggcagcttcttttccttgtctttatctttactaacagaggagaagtaaaatgaaagacaagaacctggcggcagcgcaaaagatg

SEQ ID NO: 133829 - DNA, 103 bp, Artificial Sequence
  Synthetic Polynucleotide
taatacgactcactatagggtctcatcatccagcttcttttccttgtcttaacagaggagaaagacaatgaaaagaagcaacctggcggcagcgcaaaagatg

SEQ ID NO: 133830 - DNA, 103 bp, Artificial Sequence
  Synthetic Polynucleotide
taatacgactcactataggggggctgttactctcatcatccagcttctttaacagaggagaaaagaaatgggatgatgaaacctggcggcagcgcaaaagatg

SEQ ID NO: 133831 - DNA, 103 bp, Artificial Sequence
  Synthetic Polynucleotide
taatacgactcactatagggggggaccgtcgggctgttactctcatcatcaacagaggagagatgatatgagtaacagcaacctggcggcagcgcaaaagatg

SEQ ID NO: 133832 - DNA, 103 bp, Artificial Sequence
  Synthetic Polynucleotide
taatacgactcactatagggatgccgactgggggaccgtcgggctgttacaacagaggagagtaacaatgcgacggtccaacctggcggcagcgcaaaagatg

SEQ ID NO: 133833 - DNA, 103 bp, Artificial Sequence
  Synthetic Polynucleotide
taatacgactcactatagggggccccaggaatgccgactgggggaccgtcaacagaggagagacggtatgccagtcggcaacctggcggcagcgcaaaagatg

SEQ ID NO: 133834 - DNA, 103 bp, Artificial Sequence
  Synthetic Polynucleotide
taatacgactcactatagggccataaggtaggccccaggaatgccgactgaacagaggagacagtcgatgttcctggggaacctggcggcagcgcaaaagatg

SEQ ID NO: 133835 - DNA, 103 bp, Artificial Sequence
  Synthetic Polynucleotide
taatacgactcactatagggaggtgggattcagggggagcggtcgggacaaacagaggagatgtcccatgcgctcccccaacctggcggcagcgcaaaagatg

SEQ ID NO: 133836 - DNA, 103 bp, Artificial Sequence
  Synthetic Polynucleotide
taatacgactcactataggggggttttgtcccataaggtaggccccaggaaacagaggagatcctggatgctaccttataacctggcggcagcgcaaaagatg

SEQ ID NO: 133837 - DNA, 103 bp, Artificial Sequence
  Synthetic Polynucleotide
taatacgactcactatagggtcatagggaagggttttgtcccataaggtaaacagaggagataccttatgggacaaaacaacctggcggcagcgcaaaagatg

SEQ ID NO: 133838 - DNA, 103 bp, Artificial Sequence
  Synthetic Polynucleotide
taatacgactcactatagggagtatctccgtcatagggaagggttttgtcaacagaggagagacaaaatgcttccctataacctggcggcagcgcaaaagatg

SEQ ID NO: 133839 - DNA, 103 bp, Artificial Sequence
  Synthetic Polynucleotide
taatacgactcactatagggccaactggaaagtatctccgtcatagggaaaacagaggagattccctatgacggagataaacctggcggcagcgcaaaagatg

SEQ ID NO: 133840 - DNA, 103 bp, Artificial Sequence
  Synthetic Polynucleotide
taatacgactcactatagggtccatgtattccaactggaaagtatctccgaacagaggagacggagaatgtttccagttaacctggcggcagcgcaaaagatg

SEQ ID NO: 133841 - DNA, 103 bp, Artificial Sequence
  Synthetic Polynucleotide
taatacgactcactatagggctcctccaggtccatgtattccaactggaaaacagaggagattccagatggaatacatgaacctggcggcagcgcaaaagatg

SEQ ID NO: 133842 - DNA, 103 bp, Artificial Sequence
  Synthetic Polynucleotide
taatacgactcactatagggctgacaaaaactcctccaggtccatgtattaacagaggagaaatacaatgacctggaggaacctggcggcagcgcaaaagatg

SEQ ID NO: 133843 - DNA, 103 bp, Artificial Sequence
  Synthetic Polynucleotide
taatacgactcactatagggatgccattttctgacaaaaactcctccaggaacagaggagacctggaatggtttttgtcaacctggcggcagcgcaaaagatg

SEQ ID NO: 133844 - DNA, 103 bp, Artificial Sequence
  Synthetic Polynucleotide
taatacgactcactataggggctggggggaatgccattttctgacaaaaaaacagaggagatttttgatggaaaatggcaacctggcggcagcgcaaaagatg

SEQ ID NO: 133845 - DNA, 103 bp, Artificial Sequence
  Synthetic Polynucleotide
taatacgactcactataggggctgagatgggctggggggaatgccattttaacagaggagaaaaatgatgttccccccaaacctggcggcagcgcaaaagatg

SEQ ID NO: 133846 - DNA, 103 bp, Artificial Sequence
  Synthetic Polynucleotide
taatacgactcactatagggggcgggataaaggtgggattcagggggagcaacagaggagagctcccatggaatcccacaacctggcggcagcgcaaaagatg

SEQ ID NO: 133847 - DNA, 103 bp, Artificial Sequence
  Synthetic Polynucleotide
taatacgactcactatagggctgtggtcatgctgagatgggctggggggaaacagaggagatcccccatgcccatctcaaacctggcggcagcgcaaaagatg

SEQ ID NO: 133848 - DNA, 103 bp, Artificial Sequence
  Synthetic Polynucleotide
taatacgactcactatagggagggtgagggctgtggtcatgctgagatggaacagaggagaccatctatgcatgaccacaacctggcggcagcgcaaaagatg

SEQ ID NO: 133849 - DNA, 103 bp, Artificial Sequence
  Synthetic Polynucleotide
taatacgactcactataggggcagcccaggagggtgagggctgtggtcataacagaggagaatgaccatggccctcaccaacctggcggcagcgcaaaagatg

SEQ ID NO: 133850 - DNA, 103 bp, Artificial Sequence
  Synthetic Polynucleotide
taatacgactcactataggggaagctggctgcagcccaggagggtgagggaacagaggagaccctcaatgtcctgggctaacctggcggcagcgcaaaagatg

SEQ ID NO: 133851 - DNA, 103 bp, Artificial Sequence
  Synthetic Polynucleotide
taatacgactcactatagggggcagccgaggaagctggctgcagcccaggaacagaggagacctgggatgcagccagctaacctggcggcagcgcaaaagatg

SEQ ID NO: 133852 - DNA, 103 bp, Artificial Sequence
  Synthetic Polynucleotide
taatacgactcactatagggtgaccgagggggcagccgaggaagctggctaacagaggagaagccagatgcctcggctgaacctggcggcagcgcaaaagatg

SEQ ID NO: 133853 - DNA, 103 bp, Artificial Sequence
  Synthetic Polynucleotide
taatacgactcactatagggctgaggtccatgaccgagggggcagccgagaacagaggagactcggcatgcccctcggtaacctggcggcagcgcaaaagatg

SEQ ID NO: 133854 - DNA, 103 bp, Artificial Sequence
  Synthetic Polynucleotide
taatacgactcactatagggggcccggctgctgaggtccatgaccgagggaacagaggagaccctcgatgatggacctcaacctggcggcagcgcaaaagatg

SEQ ID NO: 133855 - DNA, 103 bp, Artificial Sequence
  Synthetic Polynucleotide
taatacgactcactatagggggggtgcagaggcccggctgctgaggtccaaacagaggagatggaccatggcagccgggaacctggcggcagcgcaaaagatg

SEQ ID NO: 133856 - DNA, 103 bp, Artificial Sequence
  Synthetic Polynucleotide
taatacgactcactatagggccagggtgaaggggtgcagaggcccggctgaacagaggagacagccgatgctctgcaccaacctggcggcagcgcaaaagatg

SEQ ID NO: 133857 - DNA, 103 bp, Artificial Sequence
  Synthetic Polynucleotide
taatacgactcactataggggccgtagggaggcgggataaaggtgggattaacagaggagaaatcccatgtttatcccgaacctggcggcagcgcaaaagatg

SEQ ID NO: 133858 - DNA, 103 bp, Artificial Sequence
  Synthetic Polynucleotide
taatacgactcactatagggagatgggatgccagggtgaaggggtgcagaaacagaggagatctgcaatgcttcaccctaacctggcggcagcgcaaaagatg

SEQ ID NO: 133859 - DNA, 103 bp, Artificial Sequence
  Synthetic Polynucleotide
taatacgactcactatagggtacagttcggagatgggatgccagggtgaaaacagaggagattcaccatggcatcccataacctggcggcagcgcaaaagatg

SEQ ID NO: 133860 - DNA, 103 bp, Artificial Sequence
  Synthetic Polynucleotide
taatacgactcactataggggggctctgcatacagttcggagatgggatgaacagaggagacatcccatgtccgaactgaacctggcggcagcgcaaaagatg

SEQ ID NO: 133861 - DNA, 103 bp, Artificial Sequence
  Synthetic Polynucleotide
taatacgactcactatagggtggtctgatggggctctgcatacagttcggaacagaggagaccgaacatgatgcagagcaacctggcggcagcgcaaaagatg

SEQ ID NO: 133862 - DNA, 103 bp, Artificial Sequence
  Synthetic Polynucleotide
taatacgactcactatagggacagctgacctggtctgatggggctctgcaaacagaggagatgcagaatgccatcagacaacctggcggcagcgcaaaagatg

SEQ ID NO: 133863 - DNA, 103 bp, Artificial Sequence
  Synthetic Polynucleotide
taatacgactcactatagggtttgctggcaacagctgacctggtctgatgaacagaggagacatcagatgaggtcagctaacctggcggcagcgcaaaagatg

SEQ ID NO: 133864 - DNA, 103 bp, Artificial Sequence
  Synthetic Polynucleotide
taatacgactcactatagggtgtattgcggtttgctggcaacagctgaccaacagaggagaggtcagatgttgccagcaaacctggcggcagcgcaaaagatg

SEQ ID NO: 133865 - DNA, 103 bp, Artificial Sequence
  Synthetic Polynucleotide
taatacgactcactatagggtgggacttggtgtattgcggtttgctggcaaacagaggagatgccagatgaccgcaataaacctggcggcagcgcaaaagatg

SEQ ID NO: 133866 - DNA, 103 bp, Artificial Sequence
  Synthetic Polynucleotide
taatacgactcactatagggtcaggatcaatgggacttggtgtattgcggaacagaggagaccgcaaatgaccaagtccaacctggcggcagcgcaaaagatg

SEQ ID NO: 133867 - DNA, 103 bp, Artificial Sequence
  Synthetic Polynucleotide
taatacgactcactatagggctggatggtgtcaggatcaatgggacttggaacagaggagaccaagtatgattgatcctaacctggcggcagcgcaaaagatg

SEQ ID NO: 133868 - DNA, 103 bp, Artificial Sequence
  Synthetic Polynucleotide
taatacgactcactatagggacctgagcacgccgtagggaggcgggataaaacagaggagattatccatgctccctacgaacctggcggcagcgcaaaagatg

SEQ ID NO: 133869 - DNA, 103 bp, Artificial Sequence
  Synthetic Polynucleotide
taatacgactcactatagggccactgggacctggatggtgtcaggatcaaaacagaggagattgatcatgacaccatccaacctggcggcagcgcaaaagatg

SEQ ID NO: 133870 - DNA, 103 bp, Artificial Sequence
  Synthetic Polynucleotide
taatacgactcactatagggggctcataacccactgggacctggatggtgaacagaggagacaccatatgggtcccagtaacctggcggcagcgcaaaagatg

SEQ ID NO: 133871 - DNA, 103 bp, Artificial Sequence
  Synthetic Polynucleotide
taatacgactcactatagggtgctgggtctggctcataacccactgggacaacagaggagagtcccaatgggttatgagaacctggcggcagcgcaaaagatg

SEQ ID NO: 133872 - DNA, 103 bp, Artificial Sequence
  Synthetic Polynucleotide
taatacgactcactataggggggcaagatctgctgggtctggctcataacaacagaggagagttatgatgcagacccagaacctggcggcagcgcaaaagatg

SEQ ID NO: 133873 - DNA, 103 bp, Artificial Sequence
  Synthetic Polynucleotide
taatacgactcactatagggatgctggaaagggcaagatctgctgggtctaacagaggagaagacccatgagatcttgcaacctggcggcagcgcaaaagatg

SEQ ID NO: 133874 - DNA, 103 bp, Artificial Sequence
  Synthetic Polynucleotide
taatacgactcactatagggctggccagggatgctggaaagggcaagatcaacagaggagagatcttatgctttccagcaacctggcggcagcgcaaaagatg

SEQ ID NO: 133875 - DNA, 103 bp, Artificial Sequence
  Synthetic Polynucleotide
taatacgactcactatagggcaaacatttcctggccagggatgctggaaaaacagaggagatttccaatgtccctggccaacctggcggcagcgcaaaagatg

SEQ ID NO: 133876 - DNA, 103 bp, Artificial Sequence
  Synthetic Polynucleotide
taatacgactcactatagggttgcgagggtcaaacatttcctggccagggaacagaggagaccctggatgggaaatgttaacctggcggcagcgcaaaagatg

SEQ ID NO: 133877 - DNA, 103 bp, Artificial Sequence
  Synthetic Polynucleotide
taatacgactcactataggggaacttgcgtttgcgagggtcaaacatttcaacagaggagagaaatgatggaccctcgcaacctggcggcagcgcaaaagatg

SEQ ID NO: 133878 - DNA, 103 bp, Artificial Sequence
  Synthetic Polynucleotide
taatacgactcactatagggcttcctcagagaacttgcgtttgcgagggtaacagaggagaaccctcatgaacgcaagtaacctggcggcagcgcaaaagatg

SEQ ID NO: 133879 - DNA, 103 bp, Artificial Sequence
  Synthetic Polynucleotide
taatacgactcactatagggtccagcagggacctgagcacgccgtagggaaacagaggagatccctaatgcgtgctcagaacctggcggcagcgcaaaagatg

SEQ ID NO: 133880 - DNA, 103 bp, Artificial Sequence
  Synthetic Polynucleotide
taatacgactcactatagggggcttcagttcttcctcagagaacttgcgtaacagaggagaacgcaaatgctctgaggaaacctggcggcagcgcaaaagatg

SEQ ID NO: 133881 - DNA, 103 bp, Artificial Sequence
  Synthetic Polynucleotide
taatacgactcactatagggcatgggctgtggcttcagttcttcctcagaaacagaggagatctgagatggaactgaagaacctggcggcagcgcaaaagatg

SEQ ID NO: 133882 - DNA, 103 bp, Artificial Sequence
  Synthetic Polynucleotide
taatacgactcactatagggctttcttgatcatgggctgtggcttcagttaacagaggagaaactgaatgcacagcccaaacctggcggcagcgcaaaagatg

SEQ ID NO: 133883 - DNA, 103 bp, Artificial Sequence
  Synthetic Polynucleotide
taatacgactcactatagggactttgcgagctttcttgatcatgggctgtaacagaggagaacagccatggatcaagaaaacctggcggcagcgcaaaagatg

SEQ ID NO: 133884 - DNA, 103 bp, Artificial Sequence
  Synthetic Polynucleotide
taatacgactcactatagggagggatgaagactttgcgagctttcttgataacagaggagaatcaagatggctcgcaaaaacctggcggcagcgcaaaagatg

SEQ ID NO: 133885 - DNA, 103 bp, Artificial Sequence
  Synthetic Polynucleotide
taatacgactcactatagggtcaggtcatcagggatgaagactttgcgagaacagaggagactcgcaatgtcttcatccaacctggcggcagcgcaaaagatg

SEQ ID NO: 133886 - DNA, 103 bp, Artificial Sequence
  Synthetic Polynucleotide
taatacgactcactatagggttgtcatccttcaggtcatcagggatgaagaacagaggagacttcatatgtgatgacctaacctggcggcagcgcaaaagatg

SEQ ID NO: 133887 - DNA, 103 bp, Artificial Sequence
  Synthetic Polynucleotide
taatacgactcactatagggtgcccagtacttgtcatccttcaggtcatcaacagaggagagatgacatgaaggatgacaacctggcggcagcgcaaaagatg

SEQ ID NO: 133888 - DNA, 103 bp, Artificial Sequence
  Synthetic Polynucleotide
taatacgactcactatagggttctgcgccttgcccagtacttgtcatcctaacagaggagaaggatgatgagtactgggaacctggcggcagcgcaaaagatg

SEQ ID NO: 133889 - DNA, 103 bp, Artificial Sequence
  Synthetic Polynucleotide
taatacgactcactatagggatgttgttctttctgcgccttgcccagtacaacagaggagagtactgatgaaggcgcagaacctggcggcagcgcaaaagatg

SEQ ID NO: 133890 - DNA, 103 bp, Artificial Sequence
  Synthetic Polynucleotide
taatacgactcactatagggcagcgggttctccagcagggacctgagcacaacagaggagagtgctcatgtccctgctgaacctggcggcagcgcaaaagatg

SEQ ID NO: 133891 - DNA, 103 bp, Artificial Sequence
  Synthetic Polynucleotide
taatacgactcactatagggcttggctgccatgttgttctttctgcgcctaacagaggagaaggcgcatgaagaacaacaacctggcggcagcgcaaaagatg

SEQ ID NO: 133892 - DNA, 103 bp, Artificial Sequence
  Synthetic Polynucleotide
taatacgactcactatagggcgcgggagcgcttggctgccatgttgttctaacagaggagaagaacaatgtggcagccaaacctggcggcagcgcaaaagatg

SEQ ID NO: 133893 - DNA, 103 bp, Artificial Sequence
  Synthetic Polynucleotide
taatacgactcactatagggctccgggcgtcgcgggagcgcttggctgccaacagaggagaggcagcatggcgctcccgaacctggcggcagcgcaaaagatg

SEQ ID NO: 133894 - DNA, 103 bp, Artificial Sequence
  Synthetic Polynucleotide
taatacgactcactatagggctctttcagcctccgggcgtcgcgggagcgaacagaggagacgctccatggacgcccggaacctggcggcagcgcaaaagatg

SEQ ID NO: 133895 - DNA, 103 bp, Artificial Sequence
  Synthetic Polynucleotide
taatacgactcactatagggcgatctggttctctttcagcctccgggcgtaacagaggagaacgcccatgggctgaaagaacctggcggcagcgcaaaagatg

SEQ ID NO: 133896 - DNA, 103 bp, Artificial Sequence
  Synthetic Polynucleotide
taatacgactcactataggggcccggatggcgatctggttctctttcagcaacagaggagagctgaaatggaaccagataacctggcggcagcgcaaaagatg

SEQ ID NO: 133897 - DNA, 103 bp, Artificial Sequence
  Synthetic Polynucleotide
taatacgactcactatagggcaggaacgaggcccggatggcgatctggttaacagaggagaaaccagatggccatccggaacctggcggcagcgcaaaagatg

SEQ ID NO: 133898 - DNA, 103 bp, Artificial Sequence
  Synthetic Polynucleotide
taatacgactcactatagggtctccttctccaggaacgaggcccggatggaacagaggagaccatccatgcctcgttccaacctggcggcagcgcaaaagatg

SEQ ID NO: 133899 - DNA, 103 bp, Artificial Sequence
  Synthetic Polynucleotide
taatacgactcactatagggagggccgagttctccttctccaggaacgagaacagaggagactcgttatgggagaaggaaacctggcggcagcgcaaaagatg

SEQ ID NO: 133900 - DNA, 103 bp, Artificial Sequence
  Synthetic Polynucleotide
taatacgactcactatagggctcctggcggagggccgagttctccttctcaacagaggagagagaagatgaactcggccaacctggcggcagcgcaaaagatg

SEQ ID NO: 133901 - DNA, 103 bp, Artificial Sequence
  Synthetic Polynucleotide
taatacgactcactataggggggggagcttcagcgggttctccagcagggaacagaggagaccctgcatgagaacccgcaacctggcggcagcgcaaaagatg

SEQ ID NO: 133902 - DNA, 103 bp, Artificial Sequence
  Synthetic Polynucleotide
taatacgactcactatagggagtcagccacctcctggcggagggccgagtaacagaggagaactcggatgtccgccaggaacctggcggcagcgcaaaagatg

SEQ ID NO: 133903 - DNA, 103 bp, Artificial Sequence
  Synthetic Polynucleotide
taatacgactcactatagggtccttcctcaagtcagccacctcctggcggaacagaggagaccgccaatgggtggctgaaacctggcggcagcgcaaaagatg

SEQ ID NO: 133904 - DNA, 103 bp, Artificial Sequence
  Synthetic Polynucleotide
taatacgactcactatagggtttgcccagctccttcctcaagtcagccacaacagaggagagtggctatgttgaggaagaacctggcggcagcgcaaaagatg

SEQ ID NO: 133905 - DNA, 103 bp, Artificial Sequence
  Synthetic Polynucleotide
taatacgactcactatagggtgttcttgcatttgcccagctccttcctcaaacagaggagatgaggaatgagctgggcaaacctggcggcagcgcaaaagatg

SEQ ID NO: 133906 - DNA, 103 bp, Artificial Sequence
  Synthetic Polynucleotide
taatacgactcactatagggttggcaagtatgttcttgcatttgcccagcaacagaggagagctgggatgatgcaagaaaacctggcggcagcgcaaaagatg

SEQ ID NO: 133907 - DNA, 103 bp, Artificial Sequence
  Synthetic Polynucleotide
taatacgactcactatagggggcctcatacttggcaagtatgttcttgcaaacagaggagatgcaagatgatacttgccaacctggcggcagcgcaaaagatg

SEQ ID NO: 133908 - DNA, 103 bp, Artificial Sequence
  Synthetic Polynucleotide
taatacgactcactataggggcccgtgcctggcctcatacttggcaagtaaacagaggagatacttgatgagtatgaggaacctggcggcagcgcaaaagatg

SEQ ID NO: 133909 - DNA, 103 bp, Artificial Sequence
  Synthetic Polynucleotide
taatacgactcactatagggtcgtggtgaagggggagcttcagcgggttcaacagaggagagaacccatggaagctcccaacctggcggcagcgcaaaagatg

SEQ ID NO: 133910 - DNA, 103 bp, Artificial Sequence
  Synthetic Polynucleotide
taatacgactcactatagggaactggatccctcttgaacatccaggacataacagaggagaatgtccatgatgttcaagaacctggcggcagcgcaaaagatg

SEQ ID NO: 133911 - DNA, 103 bp, Artificial Sequence
  Synthetic Polynucleotide
taatacgactcactatagggttggaattcaaaacgtggaaagaaagttggaacagaggagaccaactatgtttccacgtaacctggcggcagcgcaaaagatg

SEQ ID NO: 133912 - DNA, 103 bp, Artificial Sequence
  Synthetic Polynucleotide
taatacgactcactatagggtttcatagagtcatcgttaacattatattcaacagaggagagaatatatggttaacgataacctggcggcagcgcaaaagatg

SEQ ID NO: 133913 - DNA, 103 bp, Artificial Sequence
  Synthetic Polynucleotide
taatacgactcactatagggttcctccaagtttcatagagtcatcgttaaaacagaggagattaacgatgactctatgaaacctggcggcagcgcaaaagatg

SEQ ID NO: 133914 - DNA, 103 bp, Artificial Sequence
  Synthetic Polynucleotide
taatacgactcactatagggctggtattgtttcctccaagtttcatagagaacagaggagactctatatgacttggaggaacctggcggcagcgcaaaagatg

SEQ ID NO: 133915 - DNA, 103 bp, Artificial Sequence
  Synthetic Polynucleotide
taatacgactcactatagggtgccttttcactggtattgtttcctccaagaacagaggagacttggaatgaacaataccaacctggcggcagcgcaaaagatg

SEQ ID NO: 133916 - DNA, 103 bp, Artificial Sequence
  Synthetic Polynucleotide
taatacgactcactatagggttagtccatctgccttttcactggtattgtaacagaggagaacaataatggtgaaaaggaacctggcggcagcgcaaaagatg

SEQ ID NO: 133917 - DNA, 103 bp, Artificial Sequence
  Synthetic Polynucleotide
taatacgactcactataggggcgtctttgcttagtccatctgccttttcaaacagaggagatgaaaaatgagatggactaacctggcggcagcgcaaaagatg

SEQ ID NO: 133918 - DNA, 103 bp, Artificial Sequence
  Synthetic Polynucleotide
taatacgactcactatagggacatctagatgcgtctttgcttagtccatcaacagaggagagatggaatgagcaaagacaacctggcggcagcgcaaaagatg

SEQ ID NO: 133919 - DNA, 103 bp, Artificial Sequence
  Synthetic Polynucleotide
taatacgactcactataggggttgttcactacatctagatgcgtctttgcaacagaggagagcaaagatgcatctagataacctggcggcagcgcaaaagatg

SEQ ID NO: 133920 - DNA, 103 bp, Artificial Sequence
  Synthetic Polynucleotide
taatacgactcactataggggaaatactgggttgttcactacatctagataacagaggagaatctagatgtagtgaacaaacctggcggcagcgcaaaagatg

SEQ ID NO: 133921 - DNA, 103 bp, Artificial Sequence
  Synthetic Polynucleotide
taatacgactcactatagggcttgatatctgaaatactgggttgttcactaacagaggagaagtgaaatgcccagtattaacctggcggcagcgcaaaagatg

SEQ ID NO: 133922 - DNA, 103 bp, Artificial Sequence
  Synthetic Polynucleotide
taatacgactcactatagggggataacatcttggaattcaaaacgtggaaaacagaggagattccacatgttgaattccaacctggcggcagcgcaaaagatg

SEQ ID NO: 133923 - DNA, 103 bp, Artificial Sequence
  Synthetic Polynucleotide
taatacgactcactatagggtactcttctccttgatatctgaaatactggaacagaggagaccagtaatgcagatatcaaacctggcggcagcgcaaaagatg

SEQ ID NO: 133924 - DNA, 103 bp, Artificial Sequence
  Synthetic Polynucleotide
taatacgactcactatagggatgcgaaacttactcttctccttgatatctaacagaggagaagatatatgggagaagagaacctggcggcagcgcaaaagatg

SEQ ID NO: 133925 - DNA, 103 bp, Artificial Sequence
  Synthetic Polynucleotide
taatacgactcactatagggcaattctgacatgcgaaacttactcttctcaacagaggagagagaagatgaagtttcgcaacctggcggcagcgcaaaagatg

SEQ ID NO: 133926 - DNA, 103 bp, Artificial Sequence
  Synthetic Polynucleotide
taatacgactcactataggggggagctagacaattctgacatgcgaaactaacagaggagaagtttcatgtgtcagaataacctggcggcagcgcaaaagatg

SEQ ID NO: 133927 - DNA, 103 bp, Artificial Sequence
  Synthetic Polynucleotide
taatacgactcactatagggcttttggggcgggagctagacaattctgacaacagaggagagtcagaatggtctagctcaacctggcggcagcgcaaaagatg

SEQ ID NO: 133928 - DNA, 103 bp, Artificial Sequence
  Synthetic Polynucleotide
taatacgactcactatagggagtttttcttcttttggggcgggagctagaaacagaggagatctagcatgcgccccaaaaacctggcggcagcgcaaaagatg

SEQ ID NO: 133929 - DNA, 103 bp, Artificial Sequence
  Synthetic Polynucleotide
taatacgactcactatagggactggacagcagtttttcttcttttggggcaacagaggagagccccaatggaagaaaaaaacctggcggcagcgcaaaagatg

SEQ ID NO: 133930 - DNA, 103 bp, Artificial Sequence
  Synthetic Polynucleotide
taatacgactcactatagggctttctatgtactggacagcagtttttcttaacagaggagaaagaaaatgtgctgtccaaacctggcggcagcgcaaaagatg

SEQ ID NO: 133931 - DNA, 103 bp, Artificial Sequence
  Synthetic Polynucleotide
taatacgactcactatagggtgaatcactgctttctatgtactggacagcaacagaggagagctgtcatgtacatagaaaacctggcggcagcgcaaaagatg

SEQ ID NO: 133932 - DNA, 103 bp, Artificial Sequence
  Synthetic Polynucleotide
taatacgactcactatagggcaatttcctctgaatcactgctttctatgtaacagaggagaacatagatggcagtgattaacctggcggcagcgcaaaagatg

SEQ ID NO: 133933 - DNA, 103 bp, Artificial Sequence
  Synthetic Polynucleotide
taatacgactcactatagggtcatctggagggataacatcttggaattcaaacagaggagatgaattatgagatgttataacctggcggcagcgcaaaagatg

SEQ ID NO: 133934 - DNA, 103 bp, Artificial Sequence
  Synthetic Polynucleotide
taatacgactcactatagggtcacttgtttcaatttcctctgaatcactgaacagaggagacagtgaatgagaggaaataacctggcggcagcgcaaaagatg

SEQ ID NO: 133935 - DNA, 103 bp, Artificial Sequence
  Synthetic Polynucleotide
taatacgactcactatagggctgcggcaattcacttgtttcaatttcctcaacagaggagagaggaaatggaaacaagtaacctggcggcagcgcaaaagatg

SEQ ID NO: 133936 - DNA, 103 bp, Artificial Sequence
  Synthetic Polynucleotide
taatacgactcactatagggctttcattttctgcggcaattcacttgtttaacagaggagaaaacaaatgaattgccgcaacctggcggcagcgcaaaagatg

SEQ ID NO: 133937 - DNA, 103 bp, Artificial Sequence
  Synthetic Polynucleotide
taatacgactcactatagggttcagtttgcctttcattttctgcggcaataacagaggagaattgccatggaaaatgaaaacctggcggcagcgcaaaagatg

SEQ ID NO: 133938 - DNA, 103 bp, Artificial Sequence
  Synthetic Polynucleotide
taatacgactcactatagggctgtacatttttcagtttgcctttcattttaacagaggagaaaaatgatgggcaaactgaacctggcggcagcgcaaaagatg

SEQ ID NO: 133939 - DNA, 103 bp, Artificial Sequence
  Synthetic Polynucleotide
taatacgactcactatagggtagtttcagactgtacatttttcagtttgcaacagaggagagcaaacatgaaaatgtacaacctggcggcagcgcaaaagatg

SEQ ID NO: 133940 - DNA, 103 bp, Artificial Sequence
  Synthetic Polynucleotide
taatacgactcactataggggccctgcctttagtttcagactgtacatttaacagaggagaaaatgtatggtctgaaacaacctggcggcagcgcaaaagatg

SEQ ID NO: 133941 - DNA, 103 bp, Artificial Sequence
  Synthetic Polynucleotide
taatacgactcactatagggtcctgctttcgccctgcctttagtttcagaaacagaggagatctgaaatgaaaggcaggaacctggcggcagcgcaaaagatg

SEQ ID NO: 133942 - DNA, 103 bp, Artificial Sequence
  Synthetic Polynucleotide
taatacgactcactatagggccttagaagatcctgctttcgccctgccttaacagaggagaaaggcaatgcgaaagcagaacctggcggcagcgcaaaagatg

SEQ ID NO: 133943 - DNA, 103 bp, Artificial Sequence
  Synthetic Polynucleotide
taatacgactcactatagggtcttctataaccttagaagatcctgctttcaacagaggagagaaagcatgatcttctaaaacctggcggcagcgcaaaagatg

SEQ ID NO: 133944 - DNA, 103 bp, Artificial Sequence
  Synthetic Polynucleotide
taatacgactcactatagggagttagaaagtcatctggagggataacatcaacagaggagagatgttatgcctccagataacctggcggcagcgcaaaagatg

SEQ ID NO: 133945 - DNA, 103 bp, Artificial Sequence
  Synthetic Polynucleotide
taatacgactcactatagggaaatgccacatcttctataaccttagaagaaacagaggagatcttctatggttatagaaaacctggcggcagcgcaaaagatg

SEQ ID NO: 133946 - DNA, 103 bp, Artificial Sequence
  Synthetic Polynucleotide
taatacgactcactatagggatgcacatgcaaatgccacatcttctataaaacagaggagattatagatgatgtggcataacctggcggcagcgcaaaagatg

SEQ ID NO: 133947 - DNA, 103 bp, Artificial Sequence
  Synthetic Polynucleotide
taatacgactcactataggggatgaagttaatgcacatgcaaatgccacaaacagaggagatgtggcatgtgcatgtgcaacctggcggcagcgcaaaagatg

SEQ ID NO: 133948 - DNA, 103 bp, Artificial Sequence
  Synthetic Polynucleotide
taatacgactcactatagggtgtaggaacagatgaagttaatgcacatgcaacagaggagagcatgtatgttaacttcaaacctggcggcagcgcaaaagatg

SEQ ID NO: 133949 - DNA, 103 bp, Artificial Sequence
  Synthetic Polynucleotide
taatacgactcactatagggtcttttttgttgtaggaacagatgaagttaaacagaggagataacttatgctgttcctaaacctggcggcagcgcaaaagatg

SEQ ID NO: 133950 - DNA, 103 bp, Artificial Sequence
  Synthetic Polynucleotide
taatacgactcactatagggttcaacattttcttttttgttgtaggaacaaacagaggagatgttccatgaacaaaaaaaacctggcggcagcgcaaaagatg

SEQ ID NO: 133951 - DNA, 103 bp, Artificial Sequence
  Synthetic Polynucleotide
taatacgactcactatagggagctccctttttcaacattttcttttttgtaacagaggagaacaaaaatgaaaatgttgaacctggcggcagcgcaaaagatg

SEQ ID NO: 133952 - DNA, 103 bp, Artificial Sequence
  Synthetic Polynucleotide
taatacgactcactatagggccactgcacaagctccctttttcaacatttaacagaggagaaaatgtatgaaaagggagaacctggcggcagcgcaaaagatg

SEQ ID NO: 133953 - DNA, 103 bp, Artificial Sequence
  Synthetic Polynucleotide
taatacgactcactatagggtttgacccctccactgcacaagctccctttaacagaggagaaaagggatgttgtgcagtaacctggcggcagcgcaaaagatg

SEQ ID NO: 133954 - DNA, 103 bp, Artificial Sequence
  Synthetic Polynucleotide
taatacgactcactatagggatcagttttctttgacccctccactgcacaaacagaggagatgtgcaatggaggggtcaaacctggcggcagcgcaaaagatg

SEQ ID NO: 133955 - DNA, 103 bp, Artificial Sequence
  Synthetic Polynucleotide
taatacgactcactatagggcttcatcactagttagaaagtcatctggagaacagaggagactccagatgactttctaaaacctggcggcagcgcaaaagatg

SEQ ID NO: 133956 - DNA, 103 bp, Artificial Sequence
  Synthetic Polynucleotide
taatacgactcactatagggtctcctcaacatcagttttctttgacccctaacagaggagaaggggtatgagaaaactgaacctggcggcagcgcaaaagatg

SEQ ID NO: 133957 - DNA, 103 bp, Artificial Sequence
  Synthetic Polynucleotide
taatacgactcactataggggttcttggtctctcctcaacatcagttttcaacagaggagagaaaacatgtgttgaggaaacctggcggcagcgcaaaagatg

SEQ ID NO: 133958 - DNA, 103 bp, Artificial Sequence
  Synthetic Polynucleotide
taatacgactcactataggggatcagtgttgttcttggtctctcctcaacaacagaggagagttgagatgagaccaagaaacctggcggcagcgcaaaagatg

SEQ ID NO: 133959 - DNA, 103 bp, Artificial Sequence
  Synthetic Polynucleotide
taatacgactcactataggggcggacagatgatcagtgttgttcttggtcaacagaggagagaccaaatgcaacactgaaacctggcggcagcgcaaaagatg

SEQ ID NO: 133960 - DNA, 103 bp, Artificial Sequence
  Synthetic Polynucleotide
taatacgactcactatagggaacacagaaagcggacagatgatcagtgttaacagaggagaaacactatgcatctgtccaacctggcggcagcgcaaaagatg

SEQ ID NO: 133961 - DNA, 103 bp, Artificial Sequence
  Synthetic Polynucleotide
taatacgactcactatagggccagttgcttaacacagaaagcggacagataacagaggagaatctgtatgctttctgtgaacctggcggcagcgcaaaagatg

SEQ ID NO: 133962 - DNA, 103 bp, Artificial Sequence
  Synthetic Polynucleotide
taatacgactcactatagggactggtcaatccagttgcttaacacagaaaaacagaggagatttctgatgtaagcaactaacctggcggcagcgcaaaagatg

SEQ ID NO: 133963 - DNA, 103 bp, Artificial Sequence
  Synthetic Polynucleotide
taatacgactcactatagggtgttgtccaaactggtcaatccagttgcttaacagaggagaaagcaaatggattgaccaaacctggcggcagcgcaaaagatg

SEQ ID NO: 133964 - DNA, 103 bp, Artificial Sequence
  Synthetic Polynucleotide
taatacgactcactatagggtgattttatatgttgtccaaactggtcaataacagaggagaattgacatgtttggacaaaacctggcggcagcgcaaaagatg

SEQ ID NO: 133965 - DNA, 103 bp, Artificial Sequence
  Synthetic Polynucleotide
taatacgactcactatagggagtgtacatctgattttatatgttgtccaaaacagaggagattggacatgatataaaataacctggcggcagcgcaaaagatg

SEQ ID NO: 133966 - DNA, 103 bp, Artificial Sequence
  Synthetic Polynucleotide
taatacgactcactataggggaatctacttcttcatcactagttagaaagaacagaggagactttctatgtagtgatgaaacctggcggcagcgcaaaagatg

SEQ ID NO: 133967 - DNA, 103 bp, Artificial Sequence
  Synthetic Polynucleotide
taatacgactcactatagggtaaaaattcaagtgtacatctgattttataaacagaggagatataaaatgagatgtacaaacctggcggcagcgcaaaagatg

SEQ ID NO: 133968 - DNA, 103 bp, Artificial Sequence
  Synthetic Polynucleotide
taatacgactcactatagggataataaacataaaaattcaagtgtacatcaacagaggagagatgtaatgttgaattttaacctggcggcagcgcaaaagatg

SEQ ID NO: 133969 - DNA, 103 bp, Artificial Sequence
  Synthetic Polynucleotide
taatacgactcactataggggatcaggaccataataaacataaaaattcaaacagaggagatgaattatgatgtttattaacctggcggcagcgcaaaagatg

SEQ ID NO: 133970 - DNA, 103 bp, Artificial Sequence
  Synthetic Polynucleotide
taatacgactcactatagggtctctaatacgatcaggaccataataaacaaacagaggagatgtttaatgtggtcctgaaacctggcggcagcgcaaaagatg

SEQ ID NO: 133971 - DNA, 103 bp, Artificial Sequence
  Synthetic Polynucleotide
taatacgactcactatagggtaaggccggttctctaatacgatcaggaccaacagaggagaggtcctatgcgtattagaaacctggcggcagcgcaaaagatg

SEQ ID NO: 133972 - DNA, 103 bp, Artificial Sequence
  Synthetic Polynucleotide
taatacgactcactataggggttttgaaagtaaggccggttctctaatacaacagaggagagtattaatgaaccggcctaacctggcggcagcgcaaaagatg

SEQ ID NO: 133973 - DNA, 103 bp, Artificial Sequence
  Synthetic Polynucleotide
taatacgactcactatagggacaatatcctgttttgaaagtaaggccggtaacagaggagaaccggcatgactttcaaaaacctggcggcagcgcaaaagatg

SEQ ID NO: 133974 - DNA, 103 bp, Artificial Sequence
  Synthetic Polynucleotide
taatacgactcactatagggcgtagtcaaaacaatatcctgttttgaaagaacagaggagactttcaatgcaggatattaacctggcggcagcgcaaaagatg

SEQ ID NO: 133975 - DNA, 103 bp, Artificial Sequence
  Synthetic Polynucleotide
taatacgactcactatagggaaatattatacgtagtcaaaacaatatcctaacagaggagaaggataatgttttgactaaacctggcggcagcgcaaaagatg

SEQ ID NO: 133976 - DNA, 103 bp, Artificial Sequence
  Synthetic Polynucleotide
taatacgactcactatagggtcatgagttaaaatattatacgtagtcaaaaacagaggagatttgacatggtataatataacctggcggcagcgcaaaagatg

SEQ ID NO: 133977 - DNA, 103 bp, Artificial Sequence
  Synthetic Polynucleotide
taatacgactcactatagggaaataaaacggaatctacttcttcatcactaacagaggagaagtgatatggaagtagataacctggcggcagcgcaaaagatg

SEQ ID NO: 133978 - DNA, 103 bp, Artificial Sequence
  Synthetic Polynucleotide
taatacgactcactatagggagttccatagtcatgagttaaaatattataaacagaggagatataatatgttaactcataacctggcggcagcgcaaaagatg

SEQ ID NO: 133979 - DNA, 103 bp, Artificial Sequence
  Synthetic Polynucleotide
taatacgactcactatagggtatctcctttagttccatagtcatgagttaaacagaggagataactcatgactatggaaaacctggcggcagcgcaaaagatg

SEQ ID NO: 133980 - DNA, 103 bp, Artificial Sequence
  Synthetic Polynucleotide
taatacgactcactatagggtgtaatggactatctcctttagttccatagaacagaggagactatggatgtaaaggagaaacctggcggcagcgcaaaagatg

SEQ ID NO: 133981 - DNA, 103 bp, Artificial Sequence
  Synthetic Polynucleotide
taatacgactcactatagggccttatgctatgtaatggactatctcctttaacagaggagaaaaggaatgagtccattaaacctggcggcagcgcaaaagatg

SEQ ID NO: 133982 - DNA, 103 bp, Artificial Sequence
  Synthetic Polynucleotide
taatacgactcactatagggctcttagccaccttatgctatgtaatggacaacagaggagagtccatatgatagcataaaacctggcggcagcgcaaaagatg

SEQ ID NO: 133983 - DNA, 103 bp, Artificial Sequence
  Synthetic Polynucleotide
taatacgactcactatagggtccaggatcactcttagccaccttatgctaaacagaggagatagcatatggtggctaagaacctggcggcagcgcaaaagatg

SEQ ID NO: 133984 - DNA, 103 bp, Artificial Sequence
  Synthetic Polynucleotide
taatacgactcactatagggatgtccttcatccaggatcactcttagccaaacagaggagatggctaatggtgatcctgaacctggcggcagcgcaaaagatg

SEQ ID NO: 133985 - DNA, 103 bp, Artificial Sequence
  Synthetic Polynucleotide
taatacgactcactatagggttcgtatggcatgtccttcatccaggatcaaacagaggagatgatccatgatgaaggacaacctggcggcagcgcaaaagatg

SEQ ID NO: 133986 - DNA, 103 bp, Artificial Sequence
  Synthetic Polynucleotide
taatacgactcactataggggcatttggatttcgtatggcatgtccttcaaacagaggagatgaaggatgtgccatacgaacctggcggcagcgcaaaagatg

SEQ ID NO: 133987 - DNA, 103 bp, Artificial Sequence
  Synthetic Polynucleotide
taatacgactcactatagggtgtctgctgagcatttggatttcgtatggcaacagaggagagccataatgaatccaaataacctggcggcagcgcaaaagatg

SEQ ID NO: 133988 - DNA, 103 bp, Artificial Sequence
  Synthetic Polynucleotide
taatacgactcactatagggtcaaacttccaaataaaacggaatctacttaacagaggagaaagtagatgccgttttataacctggcggcagcgcaaaagatg

SEQ ID NO: 133989 - DNA, 103 bp, Artificial Sequence
  Synthetic Polynucleotide
taatacgactcactataggggtacagcttttgtctgctgagcatttggataacagaggagaatccaaatgctcagcagaaacctggcggcagcgcaaaagatg

SEQ ID NO: 133990 - DNA, 103 bp, Artificial Sequence
  Synthetic Polynucleotide
taatacgactcactatagggtctaagtcaagtacagcttttgtctgctgaaacagaggagatcagcaatgaaaagctgtaacctggcggcagcgcaaaagatg

SEQ ID NO: 133991 - DNA, 103 bp, Artificial Sequence
  Synthetic Polynucleotide
taatacgactcactatagggtctttctgattctaagtcaagtacagctttaacagaggagaaaagctatgcttgacttaaacctggcggcagcgcaaaagatg

SEQ ID NO: 133992 - DNA, 103 bp, Artificial Sequence
  Synthetic Polynucleotide
taatacgactcactatagggaaacccatcttctttctgattctaagtcaaaacagaggagattgactatgaatcagaaaaacctggcggcagcgcaaaagatg

SEQ ID NO: 133993 - DNA, 103 bp, Artificial Sequence
  Synthetic Polynucleotide
taatacgactcactataggggtacctgtcaaaacccatcttctttctgataacagaggagaatcagaatgaagatgggtaacctggcggcagcgcaaaagatg

SEQ ID NO: 133994 - DNA, 103 bp, Artificial Sequence
  Synthetic Polynucleotide
taatacgactcactatagggctggattggagtacctgtcaaaacccatctaacagaggagaagatggatgttgacaggtaacctggcggcagcgcaaaagatg

SEQ ID NO: 133995 - DNA, 103 bp, Artificial Sequence
  Synthetic Polynucleotide
taatacgactcactatagggttaaagaattctggattggagtacctgtcaaacagaggagatgacagatgctccaatccaacctggcggcagcgcaaaagatg

SEQ ID NO: 133996 - DNA, 103 bp, Artificial Sequence
  Synthetic Polynucleotide
taatacgactcactatagggcacaagtcctttaaagaattctggattggaaacagaggagatccaatatggaattctttaacctggcggcagcgcaaaagatg

SEQ ID NO: 133997 - DNA, 103 bp, Artificial Sequence
  Synthetic Polynucleotide
taatacgactcactatagggaagaagagaccacaagtcctttaaagaattaacagaggagaaattctatgaaggacttgaacctggcggcagcgcaaaagatg

SEQ ID NO: 133998 - DNA, 103 bp, Artificial Sequence
  Synthetic Polynucleotide
taatacgactcactatagggttaaaaaggaaagaagagaccacaagtcctaacagaggagaaggactatgggtctcttcaacctggcggcagcgcaaaagatg

SEQ ID NO: 133999 - DNA, 103 bp, Artificial Sequence
  Synthetic Polynucleotide
taatacgactcactatagggacatgacctctcaaacttccaaataaaacgaacagaggagacgttttatgtggaagtttaacctggcggcagcgcaaaagatg

SEQ ID NO: 134000 - DNA, 103 bp, Artificial Sequence
  Synthetic Polynucleotide
taatacgactcactatagggggtttaagttttaaaaaggaaagaagagacaacagaggagagtctctatgttcctttttaacctggcggcagcgcaaaagatg

SEQ ID NO: 134001 - DNA, 103 bp, Artificial Sequence
  Synthetic Polynucleotide
taatacgactcactatagggatcaataaatggtttaagttttaaaaaggaaacagaggagatcctttatgaaacttaaaaacctggcggcagcgcaaaagatg

SEQ ID NO: 134002 - DNA, 103 bp, Artificial Sequence
  Synthetic Polynucleotide
taatacgactcactatagggaccattctctatcaataaatggtttaagttaacagaggagaaacttaatgcatttattgaacctggcggcagcgcaaaagatg

SEQ ID NO: 134003 - DNA, 103 bp, Artificial Sequence
  Synthetic Polynucleotide
taatacgactcactataggggttctatgccaccattctctatcaataaataacagaggagaatttatatgtagagaatgaacctggcggcagcgcaaaagatg

SEQ ID NO: 134004 - DNA, 103 bp, Artificial Sequence
  Synthetic Polynucleotide
taatacgactcactatagggacgctgtattgttctatgccaccattctctaacagaggagaagagaaatgtggcatagaaacctggcggcagcgcaaaagatg

SEQ ID NO: 134005 - DNA, 103 bp, Artificial Sequence
  Synthetic Polynucleotide
taatacgactcactatagggttgtgacaggacgctgtattgttctatgccaacagaggagaggcataatgcaatacagcaacctggcggcagcgcaaaagatg

SEQ ID NO: 134006 - DNA, 103 bp, Artificial Sequence
  Synthetic Polynucleotide
taatacgactcactatagggtcatctcccattgtgacaggacgctgtattaacagaggagaaatacaatgtcctgtcacaacctggcggcagcgcaaaagatg

SEQ ID NO: 134007 - DNA, 103 bp, Artificial Sequence
  Synthetic Polynucleotide
taatacgactcactatagggaagtcctccttcatctcccattgtgacaggaacagaggagacctgtcatgatgggagataacctggcggcagcgcaaaagatg

SEQ ID NO: 134008 - DNA, 103 bp, Artificial Sequence
  Synthetic Polynucleotide
taatacgactcactataggggtaaacgcctaagtcctccttcatctcccaaacagaggagatgggagatgaaggaggacaacctggcggcagcgcaaaagatg

SEQ ID NO: 134009 - DNA, 103 bp, Artificial Sequence
  Synthetic Polynucleotide
taatacgactcactatagggattagggactgtaaacgcctaagtcctcctaacagaggagaaggaggatgtaggcgtttaacctggcggcagcgcaaaagatg

SEQ ID NO: 134010 - DNA, 103 bp, Artificial Sequence
  Synthetic Polynucleotide
taatacgactcactatagggtagtccaaccacatgacctctcaaacttccaacagaggagaggaagtatgagaggtcataacctggcggcagcgcaaaagatg

SEQ ID NO: 134011 - DNA, 103 bp, Artificial Sequence
  Synthetic Polynucleotide
taatacgactcactatagggaatatttttaattagggactgtaaacgcctaacagaggagaaggcgtatgcagtccctaaacctggcggcagcgcaaaagatg

SEQ ID NO: 134012 - DNA, 103 bp, Artificial Sequence
  Synthetic Polynucleotide
taatacgactcactatagggttctaagtgtaatatttttaattagggactaacagaggagaagtcccatgttaaaaataaacctggcggcagcgcaaaagatg

SEQ ID NO: 134013 - DNA, 103 bp, Artificial Sequence
  Synthetic Polynucleotide
taatacgactcactataggggtctttgttcttctaagtgtaatatttttaaacagaggagataaaaaatgtacacttagaacctggcggcagcgcaaaagatg

SEQ ID NO: 134014 - DNA, 103 bp, Artificial Sequence
  Synthetic Polynucleotide
taatacgactcactatagggaattttgcttgtctttgttcttctaagtgtaacagaggagaacacttatgagaacaaagaacctggcggcagcgcaaaagatg

SEQ ID NO: 134015 - DNA, 103 bp, Artificial Sequence
  Synthetic Polynucleotide
taatacgactcactataggggttttcctttaattttgcttgtctttgttcaacagaggagagaacaaatgcaagcaaaaaacctggcggcagcgcaaaagatg

SEQ ID NO: 134016 - DNA, 103 bp, Artificial Sequence
  Synthetic Polynucleotide
taatacgactcactatagggtccaaaacaggttttcctttaattttgcttaacagaggagaaagcaaatgtaaaggaaaaacctggcggcagcgcaaaagatg

SEQ ID NO: 134017 - DNA, 103 bp, Artificial Sequence
  Synthetic Polynucleotide
taatacgactcactatagggttctggtaactccaaaacaggttttcctttaacagaggagaaaaggaatgcctgttttgaacctggcggcagcgcaaaagatg

SEQ ID NO: 134018 - DNA, 103 bp, Artificial Sequence
  Synthetic Polynucleotide
taatacgactcactatagggatactttacgttctggtaactccaaaacagaacagaggagactgtttatgagttaccagaacctggcggcagcgcaaaagatg

SEQ ID NO: 134019 - DNA, 103 bp, Artificial Sequence
  Synthetic Polynucleotide
taatacgactcactatagggtgctgaataaatactttacgttctggtaacaacagaggagagttaccatgacgtaaagtaacctggcggcagcgcaaaagatg

SEQ ID NO: 134020 - DNA, 103 bp, Artificial Sequence
  Synthetic Polynucleotide
taatacgactcactatagggaagtgtaatgtgctgaataaatactttacgaacagaggagacgtaaaatgtttattcagaacctggcggcagcgcaaaagatg

SEQ ID NO: 134021 - DNA, 103 bp, Artificial Sequence
  Synthetic Polynucleotide
taatacgactcactatagggagtacttccaaactggatccctcttgaacaaacagaggagatgttcaatggggatccagaacctggcggcagcgcaaaagatg

SEQ ID NO: 134022 - DNA, 103 bp, Artificial Sequence
  Synthetic Polynucleotide
taatacgactcactatagggtgtaatagcgtagtccaaccacatgacctcaacagaggagagaggtcatgtggttggacaacctggcggcagcgcaaaagatg

SEQ ID NO: 134023 - DNA, 103 bp, Artificial Sequence
  Synthetic Polynucleotide
taatacgactcactatagggcttcatctgaaagtgtaatgtgctgaataaaacagaggagattattcatgacattacacaacctggcggcagcgcaaaagatg

SEQ ID NO: 134024 - DNA, 103 bp, Artificial Sequence
  Synthetic Polynucleotide
taatacgactcactatagggatctttctctcttcatctgaaagtgtaatgaacagaggagacattacatgttcagatgaaacctggcggcagcgcaaaagatg

SEQ ID NO: 134025 - DNA, 103 bp, Artificial Sequence
  Synthetic Polynucleotide
taatacgactcactatagggagactgataaatctttctctcttcatctgaaacagaggagatcagatatggagagaaagaacctggcggcagcgcaaaagatg

SEQ ID NO: 134026 - DNA, 103 bp, Artificial Sequence
  Synthetic Polynucleotide
taatacgactcactatagggcatttttcacagactgataaatctttctctaacagaggagaagagaaatgtttatcagtaacctggcggcagcgcaaaagatg

SEQ ID NO: 134027 - DNA, 103 bp, Artificial Sequence
  Synthetic Polynucleotide
taatacgactcactataggggctctgccttcatttttcacagactgataaaacagaggagattatcaatgtgtgaaaaaaacctggcggcagcgcaaaagatg

SEQ ID NO: 134028 - DNA, 103 bp, Artificial Sequence
  Synthetic Polynucleotide
taatacgactcactatagggtccaatagtggctctgccttcatttttcacaacagaggagagtgaaaatggaaggcagaaacctggcggcagcgcaaaagatg

SEQ ID NO: 134029 - DNA, 103 bp, Artificial Sequence
  Synthetic Polynucleotide
taatacgactcactatagggtaaaataccttccaatagtggctctgccttaacagaggagaaaggcaatgccactattgaacctggcggcagcgcaaaagatg

SEQ ID NO: 134030 - DNA, 103 bp, Artificial Sequence
  Synthetic Polynucleotide
taatacgactcactataggggtcccttcattaaaataccttccaatagtgaacagaggagacactatatgaaggtatttaacctggcggcagcgcaaaagatg

SEQ ID NO: 134031 - DNA, 103 bp, Artificial Sequence
  Synthetic Polynucleotide
taatacgactcactatagggtgccaggacagtcccttcattaaaatacctaacagaggagaaggtatatgaatgaagggaacctggcggcagcgcaaaagatg

SEQ ID NO: 134032 - DNA, 103 bp, Artificial Sequence
  Synthetic Polynucleotide
taatacgactcactatagggctgcataatgtgccaggacagtcccttcataacagaggagaatgaagatgctgtcctggaacctggcggcagcgcaaaagatg

SEQ ID NO: 134033 - DNA, 103 bp, Artificial Sequence
  Synthetic Polynucleotide
taatacgactcactatagggactactcccgtgtaatagcgtagtccaaccaacagaggagaggttggatgacgctattaaacctggcggcagcgcaaaagatg

SEQ ID NO: 134034 - DNA, 103 bp, Artificial Sequence
  Synthetic Polynucleotide
taatacgactcactatagggcccaggacatctgcataatgtgccaggacaaacagaggagatgtcctatgacattatgcaacctggcggcagcgcaaaagatg

SEQ ID NO: 134035 - DNA, 103 bp, Artificial Sequence
  Synthetic Polynucleotide
taatacgactcactatagggaagcaaaagacccaggacatctgcataatgaacagaggagacattatatggatgtcctgaacctggcggcagcgcaaaagatg

SEQ ID NO: 134036 - DNA, 103 bp, Artificial Sequence
  Synthetic Polynucleotide
taatacgactcactataggggccgcagtctaagcaaaagacccaggacataacagaggagaatgtccatggtcttttgcaacctggcggcagcgcaaaagatg

SEQ ID NO: 134037 - DNA, 103 bp, Artificial Sequence
  Synthetic Polynucleotide
taatacgactcactatagggcaacaaatttgccgcagtctaagcaaaagaaacagaggagatcttttatgtagactgcgaacctggcggcagcgcaaaagatg

SEQ ID NO: 134038 - DNA, 103 bp, Artificial Sequence
  Synthetic Polynucleotide
taatacgactcactataggggtaagtatggcaacaaatttgccgcagtctaacagaggagaagactgatgcaaatttgtaacctggcggcagcgcaaaagatg

SEQ ID NO: 134039 - DNA, 103 bp, Artificial Sequence
  Synthetic Polynucleotide
taatacgactcactatagggttgtaagaaggtaagtatggcaacaaatttaacagaggagaaaatttatggccatacttaacctggcggcagcgcaaaagatg

SEQ ID NO: 134040 - DNA, 103 bp, Artificial Sequence
  Synthetic Polynucleotide
taatacgactcactataggggacactgcatttgtaagaaggtaagtatggaacagaggagaccatacatgccttcttacaacctggcggcagcgcaaaagatg

SEQ ID NO: 134041 - DNA, 103 bp, Artificial Sequence
  Synthetic Polynucleotide
taatacgactcactataggggccattggaagacactgcatttgtaagaagaacagaggagacttcttatgaatgcagtgaacctggcggcagcgcaaaagatg

SEQ ID NO: 134042 - DNA, 103 bp, Artificial Sequence
  Synthetic Polynucleotide
taatacgactcactatagggttcctgaggggccattggaagacactgcataacagaggagaatgcagatgcttccaatgaacctggcggcagcgcaaaagatg

SEQ ID NO: 134043 - DNA, 103 bp, Artificial Sequence
  Synthetic Polynucleotide
taatacgactcactatagggggtgtatcatttcctgaggggccattggaaaacagaggagattccaaatgcccctcaggaacctggcggcagcgcaaaagatg

SEQ ID NO: 134044 - DNA, 103 bp, Artificial Sequence
  Synthetic Polynucleotide
taatacgactcactatagggattattattaactactcccgtgtaatagcgaacagaggagacgctatatgacgggagtaaacctggcggcagcgcaaaagatg

SEQ ID NO: 134045 - DNA, 103 bp, Artificial Sequence
  Synthetic Polynucleotide
taatacgactcactatagggcagttcttcaggtgtatcatttcctgagggaacagaggagaccctcaatgaatgatacaaacctggcggcagcgcaaaagatg

SEQ ID NO: 134046 - DNA, 103 bp, Artificial Sequence
  Synthetic Polynucleotide
taatacgactcactatagggacttctttctcagttcttcaggtgtatcataacagaggagaatgataatgctgaagaacaacctggcggcagcgcaaaagatg

SEQ ID NO: 134047 - DNA, 103 bp, Artificial Sequence
  Synthetic Polynucleotide
taatacgactcactatagggttccttattaacttctttctcagttcttcaaacagaggagatgaagaatggagaaagaaaacctggcggcagcgcaaaagatg

SEQ ID NO: 134048 - DNA, 103 bp, Artificial Sequence
  Synthetic Polynucleotide
taatacgactcactatagggtaacttcatcttccttattaacttctttctaacagaggagaagaaagatgttaataaggaacctggcggcagcgcaaaagatg

SEQ ID NO: 134049 - DNA, 103 bp, Artificial Sequence
  Synthetic Polynucleotide
taatacgactcactatagggagctcagaattaacttcatcttccttattaaacagaggagataataaatgagatgaagtaacctggcggcagcgcaaaagatg

SEQ ID NO: 134050 - DNA, 103 bp, Artificial Sequence
  Synthetic Polynucleotide
taatacgactcactatagggtctgaacctgagctcagaattaacttcatcaacagaggagagatgaaatgaattctgagaacctggcggcagcgcaaaagatg

SEQ ID NO: 134051 - DNA, 103 bp, Artificial Sequence
  Synthetic Polynucleotide
taatacgactcactatagggacattcctcatctgaacctgagctcagaataacagaggagaattctgatgtcaggttcaaacctggcggcagcgcaaaagatg

SEQ ID NO: 134052 - DNA, 103 bp, Artificial Sequence
  Synthetic Polynucleotide
taatacgactcactatagggggcaaattgcacattcctcatctgaacctgaacagaggagacaggttatgatgaggaataacctggcggcagcgcaaaagatg

SEQ ID NO: 134053 - DNA, 103 bp, Artificial Sequence
  Synthetic Polynucleotide
taatacgactcactatagggaaagaatccaggcaaattgcacattcctcaaacagaggagatgaggaatgtgcaatttgaacctggcggcagcgcaaaagatg

SEQ ID NO: 134054 - DNA, 103 bp, Artificial Sequence
  Synthetic Polynucleotide
taatacgactcactatagggaggaactgttaaagaatccaggcaaattgcaacagaggagagcaattatgctggattctaacctggcggcagcgcaaaagatg

SEQ ID NO: 134055 - DNA, 103 bp, Artificial Sequence
  Synthetic Polynucleotide
taatacgactcactatagggcaaccatttcattattattaactactcccgaacagaggagacgggagatgttaataataaacctggcggcagcgcaaaagatg

SEQ ID NO: 134056 - DNA, 103 bp, Artificial Sequence
  Synthetic Polynucleotide
taatacgactcactataggggtgttatcacaggaactgttaaagaatccaaacagaggagatggattatgtaacagttcaacctggcggcagcgcaaaagatg

SEQ ID NO: 134057 - DNA, 103 bp, Artificial Sequence
  Synthetic Polynucleotide
taatacgactcactatagggtgtgcacaatgtgttatcacaggaactgttaacagaggagaaacagtatgtgtgataacaacctggcggcagcgcaaaagatg

SEQ ID NO: 134058 - DNA, 103 bp, Artificial Sequence
  Synthetic Polynucleotide
taatacgactcactatagggacaaaatacatgtgcacaatgtgttatcacaacagaggagagtgataatgcattgtgcaaacctggcggcagcgcaaaagatg

SEQ ID NO: 134059 - DNA, 103 bp, Artificial Sequence
  Synthetic Polynucleotide
taatacgactcactatagggtacagggtttacaaaatacatgtgcacaataacagaggagaattgtgatgatgtattttaacctggcggcagcgcaaaagatg

SEQ ID NO: 134060 - DNA, 103 bp, Artificial Sequence
  Synthetic Polynucleotide
taatacgactcactatagggacttggcaaatacagggtttacaaaatacaaacagaggagatgtattatgtaaaccctgaacctggcggcagcgcaaaagatg

SEQ ID NO: 134061 - DNA, 103 bp, Artificial Sequence
  Synthetic Polynucleotide
taatacgactcactatagggattctgaatgacttggcaaatacagggtttaacagaggagaaaacccatgatttgccaaaacctggcggcagcgcaaaagatg

SEQ ID NO: 134062 - DNA, 103 bp, Artificial Sequence
  Synthetic Polynucleotide
taatacgactcactataggggtggctgctcattctgaatgacttggcaaaaacagaggagatttgccatgtcattcagaaacctggcggcagcgcaaaagatg

SEQ ID NO: 134063 - DNA, 103 bp, Artificial Sequence
  Synthetic Polynucleotide
taatacgactcactatagggcatttagcatgtggctgctcattctgaatgaacagaggagacattcaatgtgagcagccaacctggcggcagcgcaaaagatg

SEQ ID NO: 134064 - DNA, 103 bp, Artificial Sequence
  Synthetic Polynucleotide
taatacgactcactataggggcataaagggcatttagcatgtggctgctcaacagaggagagagcagatgcatgctaaaaacctggcggcagcgcaaaagatg

SEQ ID NO: 134065 - DNA, 103 bp, Artificial Sequence
  Synthetic Polynucleotide
taatacgactcactatagggtatcatttctgcataaagggcatttagcataacagaggagaatgctaatggccctttataacctggcggcagcgcaaaagatg

SEQ ID NO: 134066 - DNA, 103 bp, Artificial Sequence
  Synthetic Polynucleotide
taatacgactcactatagggcgttgtaatgcaaccatttcattattattaaacagaggagataataaatgtgaaatggtaacctggcggcagcgcaaaagatg

SEQ ID NO: 134067 - DNA, 103 bp, Artificial Sequence
  Synthetic Polynucleotide
taatacgactcactatagggtcttcatgtatatcatttctgcataaagggaacagaggagaccctttatgcagaaatgaaacctggcggcagcgcaaaagatg

SEQ ID NO: 134068 - DNA, 103 bp, Artificial Sequence
  Synthetic Polynucleotide
taatacgactcactatagggtaataaattatcttcatgtatatcatttctaacagaggagaagaaatatgatacatgaaaacctggcggcagcgcaaaagatg

SEQ ID NO: 134069 - DNA, 103 bp, Artificial Sequence
  Synthetic Polynucleotide
taatacgactcactataggggaggacattctaataaattatcttcatgtaaacagaggagatacatgatgataatttataacctggcggcagcgcaaaagatg

SEQ ID NO: 134070 - DNA, 103 bp, Artificial Sequence
  Synthetic Polynucleotide
taatacgactcactatagggaattcttctggaggacattctaataaattaaacagaggagataatttatgagaatgtccaacctggcggcagcgcaaaagatg

SEQ ID NO: 134071 - DNA, 103 bp, Artificial Sequence
  Synthetic Polynucleotide
taatacgactcactataggggtcacgtgctaattcttctggaggacattcaacagaggagagaatgtatgccagaagaaaacctggcggcagcgcaaaagatg

SEQ ID NO: 134072 - DNA, 103 bp, Artificial Sequence
  Synthetic Polynucleotide
taatacgactcactatagggttttctcactgtcacgtgctaattcttctgaacagaggagacagaagatgtagcacgtgaacctggcggcagcgcaaaagatg

SEQ ID NO: 134073 - DNA, 103 bp, Artificial Sequence
  Synthetic Polynucleotide
taatacgactcactatagggatatcagactttttctcactgtcacgtgctaacagaggagaagcacgatgcagtgagaaaacctggcggcagcgcaaaagatg

SEQ ID NO: 134074 - DNA, 103 bp, Artificial Sequence
  Synthetic Polynucleotide
taatacgactcactatagggtgtccattccatatcagactttttctcactaacagaggagaagtgagatgaagtctgataacctggcggcagcgcaaaagatg

SEQ ID NO: 134075 - DNA, 103 bp, Artificial Sequence
  Synthetic Polynucleotide
taatacgactcactatagggttgaactggatgtccattccatatcagactaacagaggagaagtctgatgtggaatggaaacctggcggcagcgcaaaagatg

SEQ ID NO: 134076 - DNA, 103 bp, Artificial Sequence
  Synthetic Polynucleotide
taatacgactcactataggggcattaatctttgaactggatgtccattccaacagaggagaggaatgatgatccagttcaacctggcggcagcgcaaaagatg

SEQ ID NO: 134077 - DNA, 103 bp, Artificial Sequence
  Synthetic Polynucleotide
taatacgactcactatagggattaggatctcgttgtaatgcaaccatttcaacagaggagagaaatgatggcattacaaaacctggcggcagcgcaaaagatg

SEQ ID NO: 134078 - DNA, 103 bp, Artificial Sequence
  Synthetic Polynucleotide
taatacgactcactataggggtgcattagcgcattaatctttgaactggaaacagaggagatccagtatgaagattaataacctggcggcagcgcaaaagatg

SEQ ID NO: 134079 - DNA, 103 bp, Artificial Sequence
  Synthetic Polynucleotide
taatacgactcactatagggcagtcaatgcgtgcattagcgcattaatctaacagaggagaagattaatgcgctaatgcaacctggcggcagcgcaaaagatg

SEQ ID NO: 134080 - DNA, 103 bp, Artificial Sequence
  Synthetic Polynucleotide
taatacgactcactatagggtttcttaagtcagtcaatgcgtgcattagcaacagaggagagctaatatgcgcattgacaacctggcggcagcgcaaaagatg

SEQ ID NO: 134081 - DNA, 103 bp, Artificial Sequence
  Synthetic Polynucleotide
taatacgactcactataggggggattcttctttcttaagtcagtcaatgcaacagaggagagcattgatggacttaagaaacctggcggcagcgcaaaagatg

SEQ ID NO: 134082 - DNA, 103 bp, Artificial Sequence
  Synthetic Polynucleotide
taatacgactcactatagggtttttatgttgggattcttctttcttaagtaacagaggagaacttaaatgagaagaatcaacctggcggcagcgcaaaagatg

SEQ ID NO: 134083 - DNA, 103 bp, Artificial Sequence
  Synthetic Polynucleotide
taatacgactcactatagggacaaccaaactttttatgttgggattcttcaacagaggagagaagaaatgcaacataaaaacctggcggcagcgcaaaagatg

SEQ ID NO: 134084 - DNA, 103 bp, Artificial Sequence
  Synthetic Polynucleotide
taatacgactcactatagggaaactgagaaacaaccaaactttttatgttaacagaggagaaacataatgagtttggttaacctggcggcagcgcaaaagatg

SEQ ID NO: 134085 - DNA, 103 bp, Artificial Sequence
  Synthetic Polynucleotide
taatacgactcactatagggggaatgttgtaaactgagaaacaaccaaacaacagaggagagtttggatgtttctcagtaacctggcggcagcgcaaaagatg

SEQ ID NO: 134086 - DNA, 103 bp, Artificial Sequence
  Synthetic Polynucleotide
taatacgactcactatagggattaaagacaggaatgttgtaaactgagaaaacagaggagattctcaatgtacaacattaacctggcggcagcgcaaaagatg

SEQ ID NO: 134087 - DNA, 103 bp, Artificial Sequence
  Synthetic Polynucleotide
taatacgactcactatagggtggtatttctattaaagacaggaatgttgtaacagaggagaacaacaatgctgtctttaaacctggcggcagcgcaaaagatg

SEQ ID NO: 134088 - DNA, 103 bp, Artificial Sequence
  Synthetic Polynucleotide
taatacgactcactatagggcataagggttattaggatctcgttgtaatgaacagaggagacattacatggagatcctaaacctggcggcagcgcaaaagatg

SEQ ID NO: 134089 - DNA, 103 bp, Artificial Sequence
  Synthetic Polynucleotide
taatacgactcactatagggaggctttaagtggtatttctattaaagacaaacagaggagatgtcttatgtagaaatacaacctggcggcagcgcaaaagatg

SEQ ID NO: 134090 - DNA, 103 bp, Artificial Sequence
  Synthetic Polynucleotide
taatacgactcactatagggacaaatccagaggctttaagtggtatttctaacagaggagaagaaatatgacttaaagcaacctggcggcagcgcaaaagatg

SEQ ID NO: 134091 - DNA, 103 bp, Artificial Sequence
  Synthetic Polynucleotide
taatacgactcactatagggacgagtaaacacaaatccagaggctttaagaacagaggagacttaaaatgtctggatttaacctggcggcagcgcaaaagatg

SEQ ID NO: 134092 - DNA, 103 bp, Artificial Sequence
  Synthetic Polynucleotide
taatacgactcactatagggaaccatccaaacgagtaaacacaaatccagaacagaggagactggatatgtgtttactcaacctggcggcagcgcaaaagatg

SEQ ID NO: 134093 - DNA, 103 bp, Artificial Sequence
  Synthetic Polynucleotide
taatacgactcactatagggtgggccatggaaccatccaaacgagtaaacaacagaggagagtttacatgtttggatggaacctggcggcagcgcaaaagatg

SEQ ID NO: 134094 - DNA, 103 bp, Artificial Sequence
  Synthetic Polynucleotide
taatacgactcactatagggtcttttcttttgggccatggaaccatccaaaacagaggagattggatatgtccatggccaacctggcggcagcgcaaaagatg

SEQ ID NO: 134095 - DNA, 103 bp, Artificial Sequence
  Synthetic Polynucleotide
taatacgactcactatagggttgattcaactcttttcttttgggccatggaacagaggagaccatggatgaaaagaaaaaacctggcggcagcgcaaaagatg

SEQ ID NO: 134096 - DNA, 103 bp, Artificial Sequence
  Synthetic Polynucleotide
taatacgactcactatagggaaacactgaattgattcaactcttttctttaacagaggagaaaagaaatgagttgaatcaacctggcggcagcgcaaaagatg

SEQ ID NO: 134097 - DNA, 103 bp, Artificial Sequence
  Synthetic Polynucleotide
taatacgactcactatagggagtgttttgaaaacactgaattgattcaacaacagaggagagttgaaatgattcagtgtaacctggcggcagcgcaaaagatg

SEQ ID NO: 134098 - DNA, 103 bp, Artificial Sequence
  Synthetic Polynucleotide
taatacgactcactatagggatcctgcttcagtgttttgaaaacactgaaaacagaggagattcagtatgttcaaaacaaacctggcggcagcgcaaaagatg

SEQ ID NO: 134099 - DNA, 103 bp, Artificial Sequence
  Synthetic Polynucleotide
taatacgactcactataggggcattcttatcataagggttattaggatctaacagaggagaagatccatgtaacccttaaacctggcggcagcgcaaaagatg

SEQ ID NO: 134100 - DNA, 103 bp, Artificial Sequence
  Synthetic Polynucleotide
taatacgactcactatagggatagttggagatcctgcttcagtgttttgaaacagaggagatcaaaaatgtgaagcaggaacctggcggcagcgcaaaagatg

SEQ ID NO: 134101 - DNA, 103 bp, Artificial Sequence
  Synthetic Polynucleotide
taatacgactcactatagggcagaagcattatagttggagatcctgcttcaacagaggagagaagcaatgtctccaactaacctggcggcagcgcaaaagatg

SEQ ID NO: 134102 - DNA, 103 bp, Artificial Sequence
  Synthetic Polynucleotide
taatacgactcactatagggcttttaaggacagaagcattatagttggagaacagaggagactccaaatgtaatgcttcaacctggcggcagcgcaaaagatg

SEQ ID NO: 134103 - DNA, 103 bp, Artificial Sequence
  Synthetic Polynucleotide
taatacgactcactatagggactccacctgcttttaaggacagaagcattaacagaggagaaatgctatggtccttaaaaacctggcggcagcgcaaaagatg

SEQ ID NO: 134104 - DNA, 103 bp, Artificial Sequence
  Synthetic Polynucleotide
taatacgactcactatagggattcaaaccaactccacctgcttttaaggaaacagaggagatccttaatggcaggtggaaacctggcggcagcgcaaaagatg

SEQ ID NO: 134105 - DNA, 103 bp, Artificial Sequence
  Synthetic Polynucleotide
taatacgactcactatagggctgcagacagattcaaaccaactccacctgaacagaggagacaggtgatgttggtttgaaacctggcggcagcgcaaaagatg

SEQ ID NO: 134106 - DNA, 103 bp, Artificial Sequence
  Synthetic Polynucleotide
taatacgactcactatagggactcgagaagctgcagacagattcaaaccaaacagaggagatggtttatgtctgtctgcaacctggcggcagcgcaaaagatg

SEQ ID NO: 134107 - DNA, 103 bp, Artificial Sequence
  Synthetic Polynucleotide
taatacgactcactatagggcattaaaaacactcgagaagctgcagacagaacagaggagactgtctatggcttctcgaaacctggcggcagcgcaaaagatg

SEQ ID NO: 134108 - DNA, 103 bp, Artificial Sequence
  Synthetic Polynucleotide
taatacgactcactatagggaggctggatccattaaaaacactcgagaagaacagaggagacttctcatgtgtttttaaaacctggcggcagcgcaaaagatg

SEQ ID NO: 134109 - DNA, 103 bp, Artificial Sequence
  Synthetic Polynucleotide
taatacgactcactataggggcaggattccaggctggatccattaaaaacaacagaggagagtttttatgggatccagcaacctggcggcagcgcaaaagatg

SEQ ID NO: 134110 - DNA, 103 bp, Artificial Sequence
  Synthetic Polynucleotide
taatacgactcactatagggtactttaattgcattcttatcataagggttaacagaggagaaaccctatggataagaataacctggcggcagcgcaaaagatg

SEQ ID NO: 134111 - DNA, 103 bp, Artificial Sequence
  Synthetic Polynucleotide
taatacgactcactatagggatcttcagcagcaggattccaggctggatcaacagaggagagatccaatgtggaatcctaacctggcggcagcgcaaaagatg

SEQ ID NO: 134112 - DNA, 103 bp, Artificial Sequence
  Synthetic Polynucleotide
taatacgactcactatagggcaaagcactgatcttcagcagcaggattccaacagaggagaggaatcatgctgctgaagaacctggcggcagcgcaaaagatg

SEQ ID NO: 134113 - DNA, 103 bp, Artificial Sequence
  Synthetic Polynucleotide
taatacgactcactatagggtggcatctgtcaaagcactgatcttcagcaaacagaggagatgctgaatgtcagtgcttaacctggcggcagcgcaaaagatg

SEQ ID NO: 134114 - DNA, 103 bp, Artificial Sequence
  Synthetic Polynucleotide
taatacgactcactatagggaccaagtctatggcatctgtcaaagcactgaacagaggagacagtgcatggacagatgcaacctggcggcagcgcaaaagatg

SEQ ID NO: 134115 - DNA, 103 bp, Artificial Sequence
  Synthetic Polynucleotide
taatacgactcactatagggcttgcttctgaccaagtctatggcatctgtaacagaggagaacagatatgatagacttgaacctggcggcagcgcaaaagatg

SEQ ID NO: 134116 - DNA, 103 bp, Artificial Sequence
  Synthetic Polynucleotide
taatacgactcactatagggatgataacttcttgcttctgaccaagtctaaacagaggagatagactatgtcagaagcaaacctggcggcagcgcaaaagatg

SEQ ID NO: 134117 - DNA, 103 bp, Artificial Sequence
  Synthetic Polynucleotide
taatacgactcactataggggaattttgtgatgataacttcttgcttctgaacagaggagacagaagatggaagttatcaacctggcggcagcgcaaaagatg

SEQ ID NO: 134118 - DNA, 103 bp, Artificial Sequence
  Synthetic Polynucleotide
taatacgactcactatagggcctttacaatgaattttgtgatgataacttaacagaggagaaagttaatgtcacaaaataacctggcggcagcgcaaaagatg

SEQ ID NO: 134119 - DNA, 103 bp, Artificial Sequence
  Synthetic Polynucleotide
taatacgactcactatagggtcaacagagtcctttacaatgaattttgtgaacagaggagacacaaaatgcattgtaaaaacctggcggcagcgcaaaagatg

SEQ ID NO: 134120 - DNA, 103 bp, Artificial Sequence
  Synthetic Polynucleotide
taatacgactcactatagggcatattttcttcaacagagtcctttacaataacagaggagaattgtaatggactctgttaacctggcggcagcgcaaaagatg

SEQ ID NO: 134121 - DNA, 103 bp, Artificial Sequence
  Synthetic Polynucleotide
taatacgactcactatagggtcacattgtttactttaattgcattcttataacagaggagaataagaatgcaattaaagaacctggcggcagcgcaaaagatg

SEQ ID NO: 134122 - DNA, 103 bp, Artificial Sequence
  Synthetic Polynucleotide
taatacgactcactataggggtattttcagcatattttcttcaacagagtaacagaggagaactctgatgaagaaaataaacctggcggcagcgcaaaagatg

SEQ ID NO: 134123 - DNA, 103 bp, Artificial Sequence
  Synthetic Polynucleotide
taatacgactcactatagggtttttgttttgtattttcagcatattttctaacagaggagaagaaaaatggctgaaaataacctggcggcagcgcaaaagatg

SEQ ID NO: 134124 - DNA, 103 bp, Artificial Sequence
  Synthetic Polynucleotide
taatacgactcactatagggaagttctctctttttgttttgtattttcagaacagaggagactgaaaatgcaaaacaaaaacctggcggcagcgcaaaagatg

SEQ ID NO: 134125 - DNA, 103 bp, Artificial Sequence
  Synthetic Polynucleotide
taatacgactcactatagggctcctgctgcaagttctctctttttgttttaacagaggagaaaaacaatgagagagaacaacctggcggcagcgcaaaagatg

SEQ ID NO: 134126 - DNA, 103 bp, Artificial Sequence
  Synthetic Polynucleotide
taatacgactcactataggggttccaaaggctcctgctgcaagttctctcaacagaggagagagagaatgtgcagcaggaacctggcggcagcgcaaaagatg

SEQ ID NO: 134127 - DNA, 103 bp, Artificial Sequence
  Synthetic Polynucleotide
taatacgactcactatagggtggttttttagttccaaaggctcctgctgcaacagaggagagcagcaatggcctttggaaacctggcggcagcgcaaaagatg

SEQ ID NO: 134128 - DNA, 103 bp, Artificial Sequence
  Synthetic Polynucleotide
taatacgactcactatagggcgtcagcatttggttttttagttccaaaggaacagaggagacctttgatgctaaaaaacaacctggcggcagcgcaaaagatg

SEQ ID NO: 134129 - DNA, 103 bp, Artificial Sequence
  Synthetic Polynucleotide
taatacgactcactatagggtgtttcatttcgtcagcatttggttttttaaacagaggagataaaaaatgaaatgctgaaacctggcggcagcgcaaaagatg

SEQ ID NO: 134130 - DNA, 103 bp, Artificial Sequence
  Synthetic Polynucleotide
taatacgactcactatagggaattttggcttgtttcatttcgtcagcattaacagaggagaaatgctatggaaatgaaaaacctggcggcagcgcaaaagatg

SEQ ID NO: 134131 - DNA, 103 bp, Artificial Sequence
  Synthetic Polynucleotide
taatacgactcactatagggtgatttcattaattttggcttgtttcatttaacagaggagaaaatgaatgaagccaaaaaacctggcggcagcgcaaaagatg

SEQ ID NO: 134132 - DNA, 103 bp, Artificial Sequence
  Synthetic Polynucleotide
taatacgactcactatagggacagtctgcaagtacttccaaactggatccaacagaggagaggatccatgttggaagtaaacctggcggcagcgcaaaagatg

SEQ ID NO: 134133 - DNA, 103 bp, Artificial Sequence
  Synthetic Polynucleotide
taatacgactcactatagggtgatttccattcacattgtttactttaattaacagaggagaaattaaatgaaacaatgtaacctggcggcagcgcaaaagatg

SEQ ID NO: 134134 - DNA, 103 bp, Artificial Sequence
  Synthetic Polynucleotide
taatacgactcactatagggattaatgttctgatttcattaattttggctaacagaggagaagccaaatgtaatgaaataacctggcggcagcgcaaaagatg

SEQ ID NO: 134135 - DNA, 103 bp, Artificial Sequence
  Synthetic Polynucleotide
taatacgactcactatagggttataagtcaattaatgttctgatttcattaacagaggagaaatgaaatgagaacattaaacctggcggcagcgcaaaagatg

SEQ ID NO: 134136 - DNA, 103 bp, Artificial Sequence
  Synthetic Polynucleotide
taatacgactcactatagggatggccaacttgatttccattcacattgttaacagaggagaaacaatatgaatggaaataacctggcggcagcgcaaaagatg

SEQ ID NO: 134137 - DNA, 103 bp, Artificial Sequence
  Synthetic Polynucleotide
taatacgactcactatagggctttctttaaatggccaacttgatttccataacagaggagaatggaaatgaagttggccaacctggcggcagcgcaaaagatg

SEQ ID NO: 134138 - DNA, 103 bp, Artificial Sequence
  Synthetic Polynucleotide
taatacgactcactatagggcctgcaagctctttctttaaatggccaactaacagaggagaagttggatgtttaaagaaaacctggcggcagcgcaaaagatg

SEQ ID NO: 134139 - DNA, 103 bp, Artificial Sequence
  Synthetic Polynucleotide
taatacgactcactatagggggccaaagcacctgcaagctctttctttaaaacagaggagattaaagatggagcttgcaaacctggcggcagcgcaaaagatg

SEQ ID NO: 134140 - DNA, 103 bp, Artificial Sequence
  Synthetic Polynucleotide
taatacgactcactatagggccatgatataggccaaagcacctgcaagctaacagaggagaagcttgatggtgctttggaacctggcggcagcgcaaaagatg

SEQ ID NO: 134141 - DNA, 103 bp, Artificial Sequence
  Synthetic Polynucleotide
taatacgactcactatagggaatttgttgtccatgatataggccaaagcaaacagaggagatgctttatgctatatcataacctggcggcagcgcaaaagatg

SEQ ID NO: 134142 - DNA, 103 bp, Artificial Sequence
  Synthetic Polynucleotide
taatacgactcactatagggaatttgtgccaatttgttgtccatgatataaacagaggagatatatcatggacaacaaaaacctggcggcagcgcaaaagatg

SEQ ID NO: 134143 - DNA, 103 bp, Artificial Sequence
  Synthetic Polynucleotide
taatacgactcactatagggctaccccttcaatttgtgccaatttgttgtaacagaggagaacaacaatgtggcacaaaaacctggcggcagcgcaaaagatg

SEQ ID NO: 134144 - DNA, 103 bp, Artificial Sequence
  Synthetic Polynucleotide
taatacgactcactatagggccaaaaggaactaccccttcaatttgtgccaacagaggagaggcacaatgtgaaggggtaacctggcggcagcgcaaaagatg

SEQ ID NO: 134145 - DNA, 103 bp, Artificial Sequence
  Synthetic Polynucleotide
taatacgactcactatagggtccatactggacagtctgcaagtacttccaaacagaggagatggaagatgttgcagactaacctggcggcagcgcaaaagatg

SEQ ID NO: 134146 - DNA, 103 bp, Artificial Sequence
  Synthetic Polynucleotide
taatacgactcactatagggattgtttgcaccaaaaggaactaccccttcaacagaggagagaagggatggttccttttaacctggcggcagcgcaaaagatg

SEQ ID NO: 134147 - DNA, 103 bp, Artificial Sequence
  Synthetic Polynucleotide
taatacgactcactatagggtggtaaaagcattgtttgcaccaaaaggaaaacagaggagattccttatggtgcaaacaaacctggcggcagcgcaaaagatg

SEQ ID NO: 134148 - DNA, 103 bp, Artificial Sequence
  Synthetic Polynucleotide
taatacgactcactatagggtgcagaggcatggtaaaagcattgtttgcaaacagaggagatgcaaaatgtgcttttacaacctggcggcagcgcaaaagatg

SEQ ID NO: 134149 - DNA, 103 bp, Artificial Sequence
  Synthetic Polynucleotide
taatacgactcactatagggaaaagtcatatgcagaggcatggtaaaagcaacagaggagagcttttatgatgcctctgaacctggcggcagcgcaaaagatg

SEQ ID NO: 134150 - DNA, 103 bp, Artificial Sequence
  Synthetic Polynucleotide
taatacgactcactatagggcttttccccaaaaagtcatatgcagaggcaaacagaggagatgcctcatgatatgacttaacctggcggcagcgcaaaagatg

SEQ ID NO: 134151 - DNA, 103 bp, Artificial Sequence
  Synthetic Polynucleotide
taatacgactcactatagggctattttcttcttttccccaaaaagtcataaacagaggagatatgacatgttggggaaaaacctggcggcagcgcaaaagatg

SEQ ID NO: 134152 - DNA, 103 bp, Artificial Sequence
  Synthetic Polynucleotide
taatacgactcactatagggaaccgcttttctattttcttcttttccccaaacagaggagatggggaatggaagaaaataacctggcggcagcgcaaaagatg

SEQ ID NO: 134153 - DNA, 103 bp, Artificial Sequence
  Synthetic Polynucleotide
taatacgactcactatagggactgatctgaaaccgcttttctattttcttaacagaggagaaagaaaatggaaaagcggaacctggcggcagcgcaaaagatg

SEQ ID NO: 134154 - DNA, 103 bp, Artificial Sequence
  Synthetic Polynucleotide
taatacgactcactatagggtgtttcttcaactgatctgaaaccgcttttaacagaggagaaaaagcatgttcagatcaaacctggcggcagcgcaaaagatg

SEQ ID NO: 134155 - DNA, 103 bp, Artificial Sequence
  Synthetic Polynucleotide
taatacgactcactatagggtttaaatccatgtttcttcaactgatctgaaacagaggagatcagatatgttgaagaaaaacctggcggcagcgcaaaagatg

SEQ ID NO: 134156 - DNA, 103 bp, Artificial Sequence
  Synthetic Polynucleotide
taatacgactcactatagggttccatgaactccatactggacagtctgcaaacagaggagatgcagaatgtccagtatgaacctggcggcagcgcaaaagatg

SEQ ID NO: 134157 - DNA, 103 bp, Artificial Sequence
  Synthetic Polynucleotide
taatacgactcactatagggcaggacccaatttaaatccatgtttcttcaaacagaggagatgaagaatgatggatttaaacctggcggcagcgcaaaagatg

SEQ ID NO: 134158 - DNA, 103 bp, Artificial Sequence
  Synthetic Polynucleotide
taatacgactcactataggggtttttggtgcaggacccaatttaaatccaaacagaggagatggattatgattgggtccaacctggcggcagcgcaaaagatg

SEQ ID NO: 134159 - DNA, 103 bp, Artificial Sequence
  Synthetic Polynucleotide
taatacgactcactataggggaatcctaaagtttttggtgcaggacccaaaacagaggagattgggtatggcaccaaaaaacctggcggcagcgcaaaagatg

SEQ ID NO: 134160 - DNA, 103 bp, Artificial Sequence
  Synthetic Polynucleotide
taatacgactcactatagggtttccaaattgaatcctaaagtttttggtgaacagaggagacaccaaatgctttaggataacctggcggcagcgcaaaagatg

SEQ ID NO: 134161 - DNA, 103 bp, Artificial Sequence
  Synthetic Polynucleotide
taatacgactcactatagggccccaaccactttccaaattgaatcctaaaaacagaggagatttaggatgcaatttggaaacctggcggcagcgcaaaagatg

SEQ ID NO: 134162 - DNA, 103 bp, Artificial Sequence
  Synthetic Polynucleotide
taatacgactcactatagggtcttccagagccccaaccactttccaaattaacagaggagaaatttgatgagtggttggaacctggcggcagcgcaaaagatg

SEQ ID NO: 134163 - DNA, 103 bp, Artificial Sequence
  Synthetic Polynucleotide
taatacgactcactatagggttggtccagctcttccagagccccaaccacaacagaggagagtggttatggctctggaaaacctggcggcagcgcaaaagatg

SEQ ID NO: 134164 - DNA, 103 bp, Artificial Sequence
  Synthetic Polynucleotide
taatacgactcactatagggatactatagcttggtccagctcttccagagaacagaggagactctggatgagctggaccaacctggcggcagcgcaaaagatg

SEQ ID NO: 134165 - DNA, 103 bp, Artificial Sequence
  Synthetic Polynucleotide
taatacgactcactatagggatgcactggcatactatagcttggtccagcaacagaggagagctggaatgagctatagtaacctggcggcagcgcaaaagatg

SEQ ID NO: 134166 - DNA, 103 bp, Artificial Sequence
  Synthetic Polynucleotide
taatacgactcactataggggtactgcagcatgcactggcatactatagcaacagaggagagctataatgtgccagtgcaacctggcggcagcgcaaaagatg

SEQ ID NO: 134167 - DNA, 103 bp, Artificial Sequence
  Synthetic Polynucleotide
taatacgactcactatagggcgtggaaaatttccatgaactccatactggaacagaggagaccagtaatgagttcatggaacctggcggcagcgcaaaagatg

SEQ ID NO: 134168 - DNA, 103 bp, Artificial Sequence
  Synthetic Polynucleotide
taatacgactcactataggggttgtcatctgtactgcagcatgcactggcaacagaggagagccagtatgtgctgcagtaacctggcggcagcgcaaaagatg

SEQ ID NO: 134169 - DNA, 103 bp, Artificial Sequence
  Synthetic Polynucleotide
taatacgactcactatagggaagctgttcagttgtcatctgtactgcagcaacagaggagagctgcaatgcagatgacaaacctggcggcagcgcaaaagatg

SEQ ID NO: 134170 - DNA, 103 bp, Artificial Sequence
  Synthetic Polynucleotide
taatacgactcactatagggattctgttttaagctgttcagttgtcatctaacagaggagaagatgaatgctgaacagcaacctggcggcagcgcaaaagatg

SEQ ID NO: 134171 - DNA, 103 bp, Artificial Sequence
  Synthetic Polynucleotide
taatacgactcactatagggaatttgtcaaattctgttttaagctgttcaaacagaggagatgaacaatgtaaaacagaaacctggcggcagcgcaaaagatg

SEQ ID NO: 134172 - DNA, 103 bp, Artificial Sequence
  Synthetic Polynucleotide
taatacgactcactatagggatcttcaaacaatttgtcaaattctgttttaacagaggagaaaaacaatgtttgacaaaaacctggcggcagcgcaaaagatg

SEQ ID NO: 134173 - DNA, 103 bp, Artificial Sequence
  Synthetic Polynucleotide
taatacgactcactatagggcttcttttaaatcttcaaacaatttgtcaaaacagaggagattgacaatgtgtttgaagaacctggcggcagcgcaaaagatg

SEQ ID NO: 134174 - DNA, 103 bp, Artificial Sequence
  Synthetic Polynucleotide
taatacgactcactataggggttttatcatcttcttttaaatcttcaaacaacagaggagagtttgaatgtttaaaagaaacctggcggcagcgcaaaagatg

SEQ ID NO: 134175 - DNA, 103 bp, Artificial Sequence
  Synthetic Polynucleotide
taatacgactcactatagggcatttcatgggttttatcatcttcttttaaaacagaggagattaaaaatggatgataaaaacctggcggcagcgcaaaagatg

SEQ ID NO: 134176 - DNA, 103 bp, Artificial Sequence
  Synthetic Polynucleotide
taatacgactcactatagggcagctggttccatttcatgggttttatcataacagaggagaatgataatgcccatgaaaaacctggcggcagcgcaaaagatg

SEQ ID NO: 134177 - DNA, 103 bp, Artificial Sequence
  Synthetic Polynucleotide
taatacgactcactatagggtcaatagcctcagctggttccatttcatggaacagaggagaccatgaatgggaaccagcaacctggcggcagcgcaaaagatg

SEQ ID NO: 134178 - DNA, 103 bp, Artificial Sequence
  Synthetic Polynucleotide
taatacgactcactatagggatatgagaggcgtggaaaatttccatgaacaacagaggagagttcatatgaattttccaaacctggcggcagcgcaaaagatg

SEQ ID NO: 134179 - DNA, 103 bp, Artificial Sequence
  Synthetic Polynucleotide
taatacgactcactatagggcagtggtgtttcaatagcctcagctggttcaacagaggagagaaccaatggaggctattaacctggcggcagcgcaaaagatg

SEQ ID NO: 134180 - DNA, 103 bp, Artificial Sequence
  Synthetic Polynucleotide
taatacgactcactataggggatgtggaagcagtggtgtttcaatagcctaacagaggagaaggctaatgaaacaccacaacctggcggcagcgcaaaagatg

SEQ ID NO: 134181 - DNA, 103 bp, Artificial Sequence
  Synthetic Polynucleotide
taatacgactcactataggggcttgtttttgatgtggaagcagtggtgttaacagaggagaaacaccatggcttccacaaacctggcggcagcgcaaaagatg

SEQ ID NO: 134182 - DNA, 103 bp, Artificial Sequence
  Synthetic Polynucleotide
taatacgactcactatagggccaagctagagcttgtttttgatgtggaagaacagaggagacttccaatgcaaaaacaaaacctggcggcagcgcaaaagatg

SEQ ID NO: 134183 - DNA, 103 bp, Artificial Sequence
  Synthetic Polynucleotide
taatacgactcactataggggtgacaccatccaagctagagcttgtttttaacagaggagaaaaaacatgctctagcttaacctggcggcagcgcaaaagatg

SEQ ID NO: 134184 - DNA, 103 bp, Artificial Sequence
  Synthetic Polynucleotide
taatacgactcactatagggctattttcccgtgacaccatccaagctagaaacagaggagatctagcatggatggtgtcaacctggcggcagcgcaaaagatg

SEQ ID NO: 134185 - DNA, 103 bp, Artificial Sequence
  Synthetic Polynucleotide
taatacgactcactatagggaagttctttgctattttcccgtgacaccataacagaggagaatggtgatgcgggaaaataacctggcggcagcgcaaaagatg

SEQ ID NO: 134186 - DNA, 103 bp, Artificial Sequence
  Synthetic Polynucleotide
taatacgactcactatagggagaatggtggaagttctttgctattttcccaacagaggagagggaaaatggcaaagaacaacctggcggcagcgcaaaagatg

SEQ ID NO: 134187 - DNA, 103 bp, Artificial Sequence
  Synthetic Polynucleotide
taatacgactcactatagggcgctgttcccagaatggtggaagttctttgaacagaggagacaaagaatgtccaccattaacctggcggcagcgcaaaagatg

SEQ ID NO: 134188 - DNA, 103 bp, Artificial Sequence
  Synthetic Polynucleotide
taatacgactcactatagggtaagtcatttcgctgttcccagaatggtggaacagaggagaccaccaatgtgggaacagaacctggcggcagcgcaaaagatg

SEQ ID NO: 134189 - DNA, 103 bp, Artificial Sequence
  Synthetic Polynucleotide
taatacgactcactatagggagaaagttggatatgagaggcgtggaaaataacagaggagaattttcatggcctctcataacctggcggcagcgcaaaagatg

SEQ ID NO: 134190 - DNA, 103 bp, Artificial Sequence
  Synthetic Polynucleotide
taatacgactcactatagggtgttatagtataagtcatttcgctgttcccaacagaggagagggaacatggaaatgactaacctggcggcagcgcaaaagatg

SEQ ID NO: 134191 - DNA, 103 bp, Artificial Sequence
  Synthetic Polynucleotide
taatacgactcactatagggtttgttattgtgttatagtataagtcatttaacagaggagaaaatgaatgatactataaaacctggcggcagcgcaaaagatg

SEQ ID NO: 134192 - DNA, 103 bp, Artificial Sequence
  Synthetic Polynucleotide
taatacgactcactatagggctcagaaaaatttgttattgtgttatagtaaacagaggagatactatatgacaataacaaacctggcggcagcgcaaaagatg

SEQ ID NO: 134193 - DNA, 103 bp, Artificial Sequence
  Synthetic Polynucleotide
taatacgactcactataggggtcggtccttctcagaaaaatttgttattgaacagaggagacaataaatgatttttctgaacctggcggcagcgcaaaagatg

SEQ ID NO: 134194 - DNA, 103 bp, Artificial Sequence
  Synthetic Polynucleotide
taatacgactcactatagggacattttctggtcggtccttctcagaaaaaaacagaggagatttttcatggaaggaccgaacctggcggcagcgcaaaagatg

SEQ ID NO: 134195 - DNA, 103 bp, Artificial Sequence
  Synthetic Polynucleotide
taatacgactcactatagggtcctccatggacattttctggtcggtccttaacagaggagaaaggacatgccagaaaataacctggcggcagcgcaaaagatg

SEQ ID NO: 134196 - DNA, 103 bp, Artificial Sequence
  Synthetic Polynucleotide
taatacgactcactatagggcagctaaaattcctccatggacattttctgaacagaggagacagaaaatgtccatggagaacctggcggcagcgcaaaagatg

SEQ ID NO: 134197 - DNA, 103 bp, Artificial Sequence
  Synthetic Polynucleotide
taatacgactcactatagggcccatatcatcagctaaaattcctccatggaacagaggagaccatggatgaattttagcaacctggcggcagcgcaaaagatg

SEQ ID NO: 134198 - DNA, 103 bp, Artificial Sequence
  Synthetic Polynucleotide
taatacgactcactatagggtttacccaaacccatatcatcagctaaaataacagaggagaattttaatggatgatatgaacctggcggcagcgcaaaagatg

SEQ ID NO: 134199 - DNA, 103 bp, Artificial Sequence
  Synthetic Polynucleotide
taatacgactcactatagggccgtaagagttttacccaaacccatatcataacagaggagaatgataatggtttgggtaaacctggcggcagcgcaaaagatg

SEQ ID NO: 134200 - DNA, 103 bp, Artificial Sequence
  Synthetic Polynucleotide
taatacgactcactatagggaaacgtggaaagaaagttggatatgagaggaacagaggagacctctcatgtccaactttaacctggcggcagcgcaaaagatg

SEQ ID NO: 134201 - DNA, 103 bp, Artificial Sequence
  Synthetic Polynucleotide
taatacgactcactatagggactgcaatggccgtaagagttttacccaaaaacagaggagatttgggatgaactcttacaacctggcggcagcgcaaaagatg

SEQ ID NO: 134202 - DNA, 103 bp, Artificial Sequence
  Synthetic Polynucleotide
taatacgactcactatagggggtaaggattactgcaatggccgtaagagtaacagaggagaactcttatggccattgcaaacctggcggcagcgcaaaagatg

SEQ ID NO: 134203 - DNA, 103 bp, Artificial Sequence
  Synthetic Polynucleotide
taatacgactcactatagggcatggaagttggtaaggattactgcaatggaacagaggagaccattgatgtaatccttaaacctggcggcagcgcaaaagatg

SEQ ID NO: 134204 - DNA, 103 bp, Artificial Sequence
  Synthetic Polynucleotide
taatacgactcactatagggggtctgccatcatggaagttggtaaggattaacagaggagaaatcctatgcaacttccaaacctggcggcagcgcaaaagatg

SEQ ID NO: 134205 - DNA, 103 bp, Artificial Sequence
  Synthetic Polynucleotide
taatacgactcactatagggaataggaagaggtctgccatcatggaagttaacagaggagaaacttcatggatggcagaaacctggcggcagcgcaaaagatg

SEQ ID NO: 134206 - DNA, 103 bp, Artificial Sequence
  Synthetic Polynucleotide
taatacgactcactatagggtaactctttcaataggaagaggtctgccataacagaggagaatggcaatgctcttcctaaacctggcggcagcgcaaaagatg

SEQ ID NO: 134207 - DNA, 103 bp, Artificial Sequence
  Synthetic Polynucleotide
taatacgactcactatagggagattctttttaactctttcaataggaagaaacagaggagatcttccatgtgaaagagtaacctggcggcagcgcaaaagatg

SEQ ID NO: 134208 - DNA, 103 bp, Artificial Sequence
  Synthetic Polynucleotide
taatacgactcactatagggcttcttcagtagattctttttaactctttcaacagaggagagaaagaatgaaaaagaataacctggcggcagcgcaaaagatg

SEQ ID NO: 134209 - DNA, 103 bp, Artificial Sequence
  Synthetic Polynucleotide
taatacgactcactatagggcattatattccttcttcagtagattcttttaacagaggagaaaaagaatgtactgaagaaacctggcggcagcgcaaaagatg

SEQ ID NO: 134210 - DNA, 103 bp, Artificial Sequence
  Synthetic Polynucleotide
taatacgactcactatagggtcatcgttaacattatattccttcttcagtaacagaggagaactgaaatgggaatataaaacctggcggcagcgcaaaagatg

SEQ ID NO: 134211 - DNA, 103 bp, Artificial Sequence
  Synthetic Polynucleotide
taatacgactcactatagggctggctggacttcgagctcgactcactcataacagaggagaatgagtatgtcgagctcgaacctggcggcagcgcaaaagatg

SEQ ID NO: 134212 - DNA, 103 bp, Artificial Sequence
  Synthetic Polynucleotide
taatacgactcactatagggcacttcgctgggctccttcggaggctgcttaacagaggagaaagcagatgccgaaggagaacctggcggcagcgcaaaagatg

SEQ ID NO: 134213 - DNA, 103 bp, Artificial Sequence
  Synthetic Polynucleotide
taatacgactcactatagggtaggtgttggcacttcgctgggctccttcgaacagaggagacgaaggatgccagcgaagaacctggcggcagcgcaaaagatg

SEQ ID NO: 134214 - DNA, 103 bp, Artificial Sequence
  Synthetic Polynucleotide
taatacgactcactatagggcgaggtctcttaggtgttggcacttcgctgaacagaggagacagcgaatggccaacaccaacctggcggcagcgcaaaagatg

SEQ ID NO: 134215 - DNA, 103 bp, Artificial Sequence
  Synthetic Polynucleotide
taatacgactcactatagggtggtcggccccgaggtctcttaggtgttggaacagaggagaccaacaatgaagagacctaacctggcggcagcgcaaaagatg

SEQ ID NO: 134216 - DNA, 103 bp, Artificial Sequence
  Synthetic Polynucleotide
taatacgactcactatagggtgcttccctttggtcggccccgaggtctctaacagaggagaagagacatgggggccgacaacctggcggcagcgcaaaagatg

SEQ ID NO: 134217 - DNA, 103 bp, Artificial Sequence
  Synthetic Polynucleotide
taatacgactcactatagggcccttgtttttgcttccctttggtcggcccaacagaggagagggccgatgaaagggaagaacctggcggcagcgcaaaagatg

SEQ ID NO: 134218 - DNA, 103 bp, Artificial Sequence
  Synthetic Polynucleotide
taatacgactcactatagggcttggcagcacccttgtttttgcttcccttaacagaggagaaagggaatgaaaaacaagaacctggcggcagcgcaaaagatg

SEQ ID NO: 134219 - DNA, 103 bp, Artificial Sequence
  Synthetic Polynucleotide
taatacgactcactatagggttttccgggtcttggcagcacccttgttttaacagaggagaaaaacaatggtgctgccaaacctggcggcagcgcaaaagatg

SEQ ID NO: 134220 - DNA, 103 bp, Artificial Sequence
  Synthetic Polynucleotide
taatacgactcactataggggttgtggtggttttccgggtcttggcagcaaacagaggagatgctgcatggacccggaaaacctggcggcagcgcaaaagatg

SEQ ID NO: 134221 - DNA, 103 bp, Artificial Sequence
  Synthetic Polynucleotide
taatacgactcactatagggccttcctggagttgtggtggttttccgggtaacagaggagaacccggatgaccaccacaaacctggcggcagcgcaaaagatg

SEQ ID NO: 134222 - DNA, 103 bp, Artificial Sequence
  Synthetic Polynucleotide
taatacgactcactatagggaggccaagggctggctggacttcgagctcgaacagaggagacgagctatgagtccagccaacctggcggcagcgcaaaagatg

SEQ ID NO: 134223 - DNA, 103 bp, Artificial Sequence
  Synthetic Polynucleotide
taatacgactcactatagggcccttggtttccttcctggagttgtggtggaacagaggagaccaccaatgctccaggaaaacctggcggcagcgcaaaagatg

SEQ ID NO: 134224 - DNA, 103 bp, Artificial Sequence
  Synthetic Polynucleotide
taatacgactcactatagggttgggtctgccccttggtttccttcctggaaacagaggagatccaggatggaaaccaagaacctggcggcagcgcaaaagatg

SEQ ID NO: 134225 - DNA, 103 bp, Artificial Sequence
  Synthetic Polynucleotide
taatacgactcactatagggctccagttttttgggtctgccccttggtttaacagaggagaaaaccaatgggcagacccaacctggcggcagcgcaaaagatg

SEQ ID NO: 134226 - DNA, 103 bp, Artificial Sequence
  Synthetic Polynucleotide
taatacgactcactatagggcttcctccttctccagttttttgggtctgcaacagaggagagcagacatgaaaaactggaacctggcggcagcgcaaaagatg

SEQ ID NO: 134227 - DNA, 103 bp, Artificial Sequence
  Synthetic Polynucleotide
taatacgactcactatagggatgccctcctcttcctccttctccagttttaacagaggagaaaaactatggaaggaggaaacctggcggcagcgcaaaagatg

SEQ ID NO: 134228 - DNA, 103 bp, Artificial Sequence
  Synthetic Polynucleotide
taatacgactcactatagggctcctgcgagatgccctcctcttcctccttaacagaggagaaaggagatggaggagggcaacctggcggcagcgcaaaagatg

SEQ ID NO: 134229 - DNA, 103 bp, Artificial Sequence
  Synthetic Polynucleotide
taatacgactcactatagggcctccgaggactcctgcgagatgccctcctaacagaggagaaggaggatgtctcgcaggaacctggcggcagcgcaaaagatg

SEQ ID NO: 134230 - DNA, 103 bp, Artificial Sequence
  Synthetic Polynucleotide
taatacgactcactatagggcactgctcctcctccgaggactcctgcgagaacagaggagactcgcaatggtcctcggaaacctggcggcagcgcaaaagatg

SEQ ID NO: 134231 - DNA, 103 bp, Artificial Sequence
  Synthetic Polynucleotide
taatacgactcactatagggtcctgcttggaggccaagggctggctggacaacagaggagagtccagatggcccttggcaacctggcggcagcgcaaaagatg

SEQ ID NO: 134232 - DNA, 103 bp, Artificial Sequence
  Synthetic Polynucleotide
taatacgactcactataggggccgtccttttcctgcttggaggccaagggaacagaggagacccttgatgtccaagcagaacctggcggcagcgcaaaagatg

SEQ ID NO: 134233 - DNA, 103 bp, Artificial Sequence
  Synthetic Polynucleotide
taatacgactcactataggggcttctcagtgccgtccttttcctgcttggaacagaggagaccaagcatgaaaaggacgaacctggcggcagcgcaaaagatg

SEQ ID NO: 134234 - DNA, 103 bp, Artificial Sequence
  Synthetic Polynucleotide
taatacgactcactatagggccccggccccgcttctcagtgccgtcctttaacagaggagaaaaggaatgcactgagaaaacctggcggcagcgcaaaagatg

SEQ ID NO: 134235 - DNA, 103 bp, Artificial Sequence
  Synthetic Polynucleotide
taatacgactcactataggggcgcggcctgccccggccccgcttctcagtaacagaggagaactgagatgcggggccggaacctggcggcagcgcaaaagatg

SEQ ID NO: 134236 - DNA, 103 bp, Artificial Sequence
  Synthetic Polynucleotide
taatacgactcactataggggaggctgcttgcgcggcctgccccggccccaacagaggagaggggccatggcaggccgcaacctggcggcagcgcaaaagatg

SEQ ID NO: 134237 - DNA, 103 bp, Artificial Sequence
  Synthetic Polynucleotide
taatacgactcactatagggggctccttcggaggctgcttgcgcggcctgaacagaggagacaggccatgcaagcagccaacctggcggcagcgcaaaagatg

SEQ ID NO: 134238 - DNA, 103 bp, Artificial Sequence
  Synthetic Polynucleotide
taatacgactcactatagggctgccccgcgccctcaccgcgtgcgctcataacagaggagaatgagcatgcgcggtgagaacctggcggcagcgcaaaagatg

SEQ ID NO: 134239 - DNA, 103 bp, Artificial Sequence
  Synthetic Polynucleotide
taatacgactcactatagggggttggttcttgctgctgcttcctggggcgaacagaggagacgccccatgaagcagcagaacctggcggcagcgcaaaagatg

SEQ ID NO: 134240 - DNA, 103 bp, Artificial Sequence
  Synthetic Polynucleotide
taatacgactcactatagggagggctcaccggttggttcttgctgctgctaacagaggagaagcagcatgaagaaccaaaacctggcggcagcgcaaaagatg

SEQ ID NO: 134241 - DNA, 103 bp, Artificial Sequence
  Synthetic Polynucleotide
taatacgactcactatagggctcttaggagagggctcaccggttggttctaacagaggagaagaaccatgcggtgagccaacctggcggcagcgcaaaagatg

SEQ ID NO: 134242 - DNA, 103 bp, Artificial Sequence
  Synthetic Polynucleotide
taatacgactcactatagggtcccctgggtctcttaggagagggctcaccaacagaggagaggtgagatgtctcctaagaacctggcggcagcgcaaaagatg

SEQ ID NO: 134243 - DNA, 103 bp, Artificial Sequence
  Synthetic Polynucleotide
taatacgactcactatagggctttgggtcttcccctgggtctcttaggagaacagaggagactcctaatggacccagggaacctggcggcagcgcaaaagatg

SEQ ID NO: 134244 - DNA, 103 bp, Artificial Sequence
  Synthetic Polynucleotide
taatacgactcactatagggtttttgctgcctttgggtcttcccctgggtaacagaggagaacccagatgaagacccaaaacctggcggcagcgcaaaagatg

SEQ ID NO: 134245 - DNA, 103 bp, Artificial Sequence
  Synthetic Polynucleotide
taatacgactcactataggggggactcttgtttttgctgcctttgggtctaacagaggagaagacccatgggcagcaaaaacctggcggcagcgcaaaagatg

SEQ ID NO: 134246 - DNA, 103 bp, Artificial Sequence
  Synthetic Polynucleotide
taatacgactcactatagggctgctttagagggactcttgtttttgctgcaacagaggagagcagcaatgacaagagtcaacctggcggcagcgcaaaagatg

SEQ ID NO: 134247 - DNA, 103 bp, Artificial Sequence
  Synthetic Polynucleotide
taatacgactcactatagggttcttttgagctgctttagagggactcttgaacagaggagacaagagatgctctaaagcaacctggcggcagcgcaaaagatg

SEQ ID NO: 134248 - DNA, 103 bp, Artificial Sequence
  Synthetic Polynucleotide
taatacgactcactatagggggcttctgctttcttttgagctgctttagaaacagaggagatctaaaatggctcaaaagaacctggcggcagcgcaaaagatg

SEQ ID NO: 134249 - DNA, 103 bp, Artificial Sequence
  Synthetic Polynucleotide
taatacgactcactatagggaagtggacggctgccccgcgccctcaccgcaacagaggagagcggtgatggcgcggggcaacctggcggcagcgcaaaagatg

SEQ ID NO: 134250 - DNA, 103 bp, Artificial Sequence
  Synthetic Polynucleotide
taatacgactcactatagggtttctccagtggcttctgctttcttttgagaacagaggagactcaaaatgaagcagaagaacctggcggcagcgcaaaagatg

SEQ ID NO: 134251 - DNA, 103 bp, Artificial Sequence
  Synthetic Polynucleotide
taatacgactcactatagggcttggccgtttttctccagtggcttctgctaacagaggagaagcagaatgcactggagaaacctggcggcagcgcaaaagatg

SEQ ID NO: 134252 - DNA, 103 bp, Artificial Sequence
  Synthetic Polynucleotide
taatacgactcactatagggaggtctgcctcttggccgtttttctccagtaacagaggagaactggaatgaaacggccaaacctggcggcagcgcaaaagatg

SEQ ID NO: 134253 - DNA, 103 bp, Artificial Sequence
  Synthetic Polynucleotide
taatacgactcactatagggcccatttcctaggtctgcctcttggccgttaacagaggagaaacggcatggaggcagacaacctggcggcagcgcaaaagatg

SEQ ID NO: 134254 - DNA, 103 bp, Artificial Sequence
  Synthetic Polynucleotide
taatacgactcactatagggagtagattgtcccatttcctaggtctgcctaacagaggagaaggcagatgtaggaaatgaacctggcggcagcgcaaaagatg

SEQ ID NO: 134255 - DNA, 103 bp, Artificial Sequence
  Synthetic Polynucleotide
taatacgactcactatagggggttcttggtagtagattgtcccatttcctaacagaggagaaggaaaatggacaatctaaacctggcggcagcgcaaaagatg

SEQ ID NO: 134256 - DNA, 103 bp, Artificial Sequence
  Synthetic Polynucleotide
taatacgactcactatagggtcttggagctggttcttggtagtagattgtaacagaggagaacaatcatgtaccaagaaaacctggcggcagcgcaaaagatg

SEQ ID NO: 134257 - DNA, 103 bp, Artificial Sequence
  Synthetic Polynucleotide
taatacgactcactataggggatgttttcttcttggagctggttcttggtaacagaggagaaccaagatgcagctccaaaacctggcggcagcgcaaaagatg

SEQ ID NO: 134258 - DNA, 103 bp, Artificial Sequence
  Synthetic Polynucleotide
taatacgactcactataggggtttcccagagatgttttcttcttggagctaacagaggagaagctccatgaagaaaacaaacctggcggcagcgcaaaagatg

SEQ ID NO: 134259 - DNA, 103 bp, Artificial Sequence
  Synthetic Polynucleotide
taatacgactcactatagggttttggtactgtttcccagagatgttttctaacagaggagaagaaaaatgctctgggaaaacctggcggcagcgcaaaagatg

SEQ ID NO: 134260 - DNA, 103 bp, Artificial Sequence
  Synthetic Polynucleotide
taatacgactcactatagggccctgggctgaagtggacggctgccccgcgaacagaggagacgcgggatggccgtccacaacctggcggcagcgcaaaagatg

SEQ ID NO: 134261 - DNA, 103 bp, Artificial Sequence
  Synthetic Polynucleotide
taatacgactcactatagggcagtgactccttttggtactgtttcccagaaacagaggagatctgggatgcagtaccaaaacctggcggcagcgcaaaagatg

SEQ ID NO: 134262 - DNA, 103 bp, Artificial Sequence
  Synthetic Polynucleotide
taatacgactcactatagggggcaggttgtccctgggctgaagtggacggaacagaggagaccgtccatgtcagcccagaacctggcggcagcgcaaaagatg

SEQ ID NO: 134263 - DNA, 103 bp, Artificial Sequence
  Synthetic Polynucleotide
taatacgactcactataggggcgctggggcggcaggttgtccctgggctgaacagaggagacagcccatggacaacctgaacctggcggcagcgcaaaagatg

SEQ ID NO: 134264 - DNA, 103 bp, Artificial Sequence
  Synthetic Polynucleotide
taatacgactcactatagggctcttctgaggcgctggggcggcaggttgtaacagaggagaacaaccatgcgccccagcaacctggcggcagcgcaaaagatg

SEQ ID NO: 134265 - DNA, 103 bp, Artificial Sequence
  Synthetic Polynucleotide
taatacgactcactataggggccgcgtcctctcttctgaggcgctggggcaacagaggagagccccaatgcctcagaagaacctggcggcagcgcaaaagatg

SEQ ID NO: 134266 - DNA, 103 bp, Artificial Sequence
  Synthetic Polynucleotide
taatacgactcactatagggtcctggggcggccgcgtcctctcttctgagaacagaggagactcagaatggaggacgcgaacctggcggcagcgcaaaagatg

SEQ ID NO: 134267 - DNA, 103 bp, Artificial Sequence
  Synthetic Polynucleotide
taatacgactcactatagggtgctgctgcttcctggggcggccgcgtcctaacagaggagaaggacgatgccgccccagaacctggcggcagcgcaaaagatg

SEQ ID NO: 134268 - DNA, 103 bp, Artificial Sequence
  Synthetic Polynucleotide
taatacgactcactatagggtctcggcttcttaggatctcctttgcccataacagaggagaatgggcatgggagatcctaacctggcggcagcgcaaaagatg

SEQ ID NO: 134269 - DNA, 103 bp, Artificial Sequence
  Synthetic Polynucleotide
taatacgactcactatagggctctgagaagttgactgaagcatctgggtgaacagaggagacacccaatggcttcagtcaacctggcggcagcgcaaaagatg

SEQ ID NO: 134270 - DNA, 103 bp, Artificial Sequence
  Synthetic Polynucleotide
taatacgactcactatagggtcttagaaaactctgagaagttgactgaagaacagaggagacttcagatgacttctcagaacctggcggcagcgcaaaagatg

SEQ ID NO: 134271 - DNA, 103 bp, Artificial Sequence
  Synthetic Polynucleotide
taatacgactcactatagggtctgagcacttcttagaaaactctgagaagaacagaggagacttctcatggttttctaaaacctggcggcagcgcaaaagatg

SEQ ID NO: 134272 - DNA, 103 bp, Artificial Sequence
  Synthetic Polynucleotide
taatacgactcactatagggcttccacctctctgagcacttcttagaaaaaacagaggagattttctatgaagtgctcaaacctggcggcagcgcaaaagatg

SEQ ID NO: 134273 - DNA, 103 bp, Artificial Sequence
  Synthetic Polynucleotide
taatacgactcactatagggcagacatggtcttccacctctctgagcactaacagaggagaagtgctatgagaggtggaaacctggcggcagcgcaaaagatg

SEQ ID NO: 134274 - DNA, 103 bp, Artificial Sequence
  Synthetic Polynucleotide
taatacgactcactatagggttctctttagcagacatggtcttccacctcaacagaggagagaggtgatggaccatgtcaacctggcggcagcgcaaaagatg

SEQ ID NO: 134275 - DNA, 103 bp, Artificial Sequence
  Synthetic Polynucleotide
taatacgactcactatagggaaattttcctttctctttagcagacatggtaacagaggagaaccatgatggctaaagagaacctggcggcagcgcaaaagatg

SEQ ID NO: 134276 - DNA, 103 bp, Artificial Sequence
  Synthetic Polynucleotide
taatacgactcactatagggccatatcttcaaattttcctttctctttagaacagaggagactaaagatgaaggaaaataacctggcggcagcgcaaaagatg

SEQ ID NO: 134277 - DNA, 103 bp, Artificial Sequence
  Synthetic Polynucleotide
taatacgactcactatagggtccgcttttgccatatcttcaaattttcctaacagaggagaaggaaaatgtgaagatataacctggcggcagcgcaaaagatg

SEQ ID NO: 134278 - DNA, 103 bp, Artificial Sequence
  Synthetic Polynucleotide
taatacgactcactatagggacgggccttgtccgcttttgccatatcttcaacagaggagagaagatatggcaaaagcgaacctggcggcagcgcaaaagatg

SEQ ID NO: 134279 - DNA, 103 bp, Artificial Sequence
  Synthetic Polynucleotide
taatacgactcactatagggacattttgcctctcggcttcttaggatctcaacagaggagagagatcatgagaagccgaaacctggcggcagcgcaaaagatg

SEQ ID NO: 134280 - DNA, 103 bp, Artificial Sequence
  Synthetic Polynucleotide
taatacgactcactatagggctctttcataacgggccttgtccgcttttgaacagaggagacaaaagatgacaaggcccaacctggcggcagcgcaaaagatg

SEQ ID NO: 134281 - DNA, 103 bp, Artificial Sequence
  Synthetic Polynucleotide
taatacgactcactataggggttttcatttctctttcataacgggccttgaacagaggagacaaggcatgttatgaaagaacctggcggcagcgcaaaagatg

SEQ ID NO: 134282 - DNA, 103 bp, Artificial Sequence
  Synthetic Polynucleotide
taatacgactcactatagggagggatataggttttcatttctctttcataaacagaggagatatgaaatggaaatgaaaaacctggcggcagcgcaaaagatg

SEQ ID NO: 134283 - DNA, 103 bp, Artificial Sequence
  Synthetic Polynucleotide
taatacgactcactatagggcccctttgggagggatataggttttcatttaacagaggagaaaatgaatgcctatatccaacctggcggcagcgcaaaagatg

SEQ ID NO: 134284 - DNA, 103 bp, Artificial Sequence
  Synthetic Polynucleotide
taatacgactcactatagggttttttgtctcccctttgggagggatatagaacagaggagactatatatgtcccaaaggaacctggcggcagcgcaaaagatg

SEQ ID NO: 134285 - DNA, 103 bp, Artificial Sequence
  Synthetic Polynucleotide
taatacgactcactatagggcttgaacttcttttttgtctcccctttgggaacagaggagacccaaaatggagacaaaaaacctggcggcagcgcaaaagatg

SEQ ID NO: 134286 - DNA, 103 bp, Artificial Sequence
  Synthetic Polynucleotide
taatacgactcactatagggcattgggatccttgaacttcttttttgtctaacagaggagaagacaaatgagaagttcaaacctggcggcagcgcaaaagatg

SEQ ID NO: 134287 - DNA, 103 bp, Artificial Sequence
  Synthetic Polynucleotide
taatacgactcactatagggctcttgggtgcattgggatccttgaacttcaacagaggagagaagttatgggatcccaaaacctggcggcagcgcaaaagatg

SEQ ID NO: 134288 - DNA, 103 bp, Artificial Sequence
  Synthetic Polynucleotide
taatacgactcactatagggcgaaggaggcctcttgggtgcattgggatcaacagaggagagatcccatggcacccaagaacctggcggcagcgcaaaagatg

SEQ ID NO: 134289 - DNA, 103 bp, Artificial Sequence
  Synthetic Polynucleotide
taatacgactcactatagggggaagaaggccgaaggaggcctcttgggtgaacagaggagacacccaatgggcctccttaacctggcggcagcgcaaaagatg

SEQ ID NO: 134290 - DNA, 103 bp, Artificial Sequence
  Synthetic Polynucleotide
taatacgactcactataggggcatatgatgacattttgcctctcggcttcaacagaggagagaagccatgaggcaaaataacctggcggcagcgcaaaagatg

SEQ ID NO: 134291 - DNA, 103 bp, Artificial Sequence
  Synthetic Polynucleotide
taatacgactcactataggggagcagaagaggaagaaggccgaaggaggcaacagaggagagcctccatgggccttcttaacctggcggcagcgcaaaagatg

SEQ ID NO: 134292 - DNA, 103 bp, Artificial Sequence
  Synthetic Polynucleotide
taatacgactcactataggggcgatactcagagcagaagaggaagaaggcaacagaggagagccttcatgctcttctgcaacctggcggcagcgcaaaagatg

SEQ ID NO: 134293 - DNA, 103 bp, Artificial Sequence
  Synthetic Polynucleotide
taatacgactcactatagggtgatttttgggcgatactcagagcagaagaaacagaggagatcttctatgctgagtatcaacctggcggcagcgcaaaagatg

SEQ ID NO: 134294 - DNA, 103 bp, Artificial Sequence
  Synthetic Polynucleotide
taatacgactcactatagggtgttctcctttgatttttgggcgatactcaaacagaggagatgagtaatgcccaaaaataacctggcggcagcgcaaaagatg

SEQ ID NO: 134295 - DNA, 103 bp, Artificial Sequence
  Synthetic Polynucleotide
taatacgactcactatagggcaggccaggatgttctcctttgatttttggaacagaggagaccaaaaatgaaaggagaaaacctggcggcagcgcaaaagatg

SEQ ID NO: 134296 - DNA, 103 bp, Artificial Sequence
  Synthetic Polynucleotide
taatacgactcactatagggcaccaatggacaggccaggatgttctccttaacagaggagaaaggagatgatcctggccaacctggcggcagcgcaaaagatg

SEQ ID NO: 134297 - DNA, 103 bp, Artificial Sequence
  Synthetic Polynucleotide
taatacgactcactatagggttcgcaacatcaccaatggacaggccaggaaacagaggagatcctggatggtccattggaacctggcggcagcgcaaaagatg

SEQ ID NO: 134298 - DNA, 103 bp, Artificial Sequence
  Synthetic Polynucleotide
taatacgactcactatagggtcccagtttcttcgcaacatcaccaatggaaacagaggagatccattatggatgttgcgaacctggcggcagcgcaaaagatg

SEQ ID NO: 134299 - DNA, 103 bp, Artificial Sequence
  Synthetic Polynucleotide
taatacgactcactatagggtccacatctctcccagtttcttcgcaacataacagaggagaatgttgatgagaaactggaacctggcggcagcgcaaaagatg

SEQ ID NO: 134300 - DNA, 103 bp, Artificial Sequence
  Synthetic Polynucleotide
taatacgactcactataggggcagtgttattccacatctctcccagtttcaacagaggagagaaactatgagagatgtgaacctggcggcagcgcaaaagatg

SEQ ID NO: 134301 - DNA, 103 bp, Artificial Sequence
  Synthetic Polynucleotide
taatacgactcactatagggcacaaaaaatgcatatgatgacattttgccaacagaggagaggcaaaatgtcatcatataacctggcggcagcgcaaaagatg

SEQ ID NO: 134302 - DNA, 103 bp, Artificial Sequence
  Synthetic Polynucleotide
taatacgactcactataggggtcatctgcagcagtgttattccacatctcaacagaggagagagatgatgaataacactaacctggcggcagcgcaaaagatg

SEQ ID NO: 134303 - DNA, 103 bp, Artificial Sequence
  Synthetic Polynucleotide
taatacgactcactatagggaaggctgcttgtcatctgcagcagtgttataacagaggagaataacaatgctgcagatgaacctggcggcagcgcaaaagatg

SEQ ID NO: 134304 - DNA, 103 bp, Artificial Sequence
  Synthetic Polynucleotide
taatacgactcactatagggttcttttcataaggctgcttgtcatctgcaaacagaggagatgcagaatgcaagcagccaacctggcggcagcgcaaaagatg

SEQ ID NO: 134305 - DNA, 103 bp, Artificial Sequence
  Synthetic Polynucleotide
taatacgactcactatagggcttcgcagccttcttttcataaggctgcttaacagaggagaaagcagatgtatgaaaagaacctggcggcagcgcaaaagatg

SEQ ID NO: 134306 - DNA, 103 bp, Artificial Sequence
  Synthetic Polynucleotide
taatacgactcactatagggtttccttcagcttcgcagccttcttttcataacagaggagaatgaaaatgaggctgcgaaacctggcggcagcgcaaaagatg

SEQ ID NO: 134307 - DNA, 103 bp, Artificial Sequence
  Synthetic Polynucleotide
taatacgactcactatagggttttcatatttttccttcagcttcgcagccaacagaggagaggctgcatggctgaaggaaacctggcggcagcgcaaaagatg

SEQ ID NO: 134308 - DNA, 103 bp, Artificial Sequence
  Synthetic Polynucleotide
taatacgactcactatagggagcaatatccttttcatatttttccttcagaacagaggagactgaagatgaaatatgaaaacctggcggcagcgcaaaagatg

SEQ ID NO: 134309 - DNA, 103 bp, Artificial Sequence
  Synthetic Polynucleotide
taatacgactcactatagggctcgatatgcagcaatatccttttcatattaacagaggagaaatatgatgaggatattgaacctggcggcagcgcaaaagatg

SEQ ID NO: 134310 - DNA, 103 bp, Artificial Sequence
  Synthetic Polynucleotide
taatacgactcactatagggtttcctttagctcgatatgcagcaatatccaacagaggagaggatatatgtgcatatcgaacctggcggcagcgcaaaagatg

SEQ ID NO: 134311 - DNA, 103 bp, Artificial Sequence
  Synthetic Polynucleotide
taatacgactcactatagggtgcatcaggctttcctttagctcgatatgcaacagaggagagcatatatggctaaaggaaacctggcggcagcgcaaaagatg

SEQ ID NO: 134312 - DNA, 103 bp, Artificial Sequence
  Synthetic Polynucleotide
taatacgactcactataggggacaagtttgcacaaaaaatgcatatgatgaacagaggagacatcatatgcattttttgaacctggcggcagcgcaaaagatg

SEQ ID NO: 134313 - DNA, 103 bp, Artificial Sequence
  Synthetic Polynucleotide
taatacgactcactatagggccttttttgctgcatcaggctttcctttagaacagaggagactaaagatgagcctgatgaacctggcggcagcgcaaaagatg

SEQ ID NO: 134314 - DNA, 103 bp, Artificial Sequence
  Synthetic Polynucleotide
taatacgactcactatagggttgacaactcccttttttgctgcatcaggcaacagaggagagcctgaatgagcaaaaaaaacctggcggcagcgcaaaagatg

SEQ ID NO: 134315 - DNA, 103 bp, Artificial Sequence
  Synthetic Polynucleotide
taatacgactcactatagggtttttcagccttgacaactcccttttttgcaacagaggagagcaaaaatgggagttgtcaacctggcggcagcgcaaaagatg

SEQ ID NO: 134316 - DNA, 103 bp, Artificial Sequence
  Synthetic Polynucleotide
taatacgactcactatagggttttcttgcttttttcagccttgacaactcaacagaggagagagttgatgaggctgaaaaacctggcggcagcgcaaaagatg

SEQ ID NO: 134317 - DNA, 103 bp, Artificial Sequence
  Synthetic Polynucleotide
taatacgactcactatagggtcttccttctttttcttgcttttttcagccaacagaggagaggctgaatgaagcaagaaaacctggcggcagcgcaaaagatg

SEQ ID NO: 134318 - DNA, 103 bp, Artificial Sequence
  Synthetic Polynucleotide
taatacgactcactatagggatcttcctcctcttccttctttttcttgctaacagaggagaagcaagatgaagaaggaaaacctggcggcagcgcaaaagatg

SEQ ID NO: 134319 - DNA, 103 bp, Artificial Sequence
  Synthetic Polynucleotide
taatacgactcactatagggcatcttcctcatcttcctcctcttccttctaacagaggagaagaaggatgaggaggaagaacctggcggcagcgcaaaagatg

SEQ ID NO: 134320 - DNA, 103 bp, Artificial Sequence
  Synthetic Polynucleotide
taatacgactcactatagggtcatcctcttcatcttcctcatcttcctccaacagaggagaggaggaatgtgaggaagaaacctggcggcagcgcaaaagatg

SEQ ID NO: 134321 - DNA, 103 bp, Artificial Sequence
  Synthetic Polynucleotide
taatacgactcactatagggctcctcctcctcatcctcttcatcttcctcaacagaggagagaggaaatggaagaggataacctggcggcagcgcaaaagatg

SEQ ID NO: 134322 - DNA, 103 bp, Artificial Sequence
  Synthetic Polynucleotide
taatacgactcactatagggcttcatcttcctcctcctcctcatcctcttaacagaggagaaagaggatgaggaggaggaacctggcggcagcgcaaaagatg

SEQ ID NO: 134323 - DNA, 103 bp, Artificial Sequence
  Synthetic Polynucleotide
taatacgactcactatagggtgctcctcccgacaagtttgcacaaaaaataacagaggagaatttttatggcaaacttgaacctggcggcagcgcaaaagatg

SEQ ID NO: 134324 - DNA, 103 bp, Artificial Sequence
  Synthetic Polynucleotide
taatacgactcactatagggtcttcatcttcttcatcttcctcctcctccaacagaggagaggaggaatgggaagatgaaacctggcggcagcgcaaaagatg

SEQ ID NO: 134325 - DNA, 103 bp, Artificial Sequence
  Synthetic Polynucleotide
taatacgactcactatagggttcttcttcatcttcatcttcttcatcttcaacagaggagagaagatatggaagatgaaaacctggcggcagcgcaaaagatg

SEQ ID NO: 134326 - DNA, 103 bp, Artificial Sequence
  Synthetic Polynucleotide
taatacgactcactatagggcatcatcatcttcttcttcatcttcatcttaacagaggagaaagatgatgatgaagaagaacctggcggcagcgcaaaagatg

SEQ ID NO: 134327 - DNA, 103 bp, Artificial Sequence
  Synthetic Polynucleotide
taatacgactcactatagggcttcttcttatgctcctcccgacaagtttgaacagaggagacaaactatgcgggaggagaacctggcggcagcgcaaaagatg

SEQ ID NO: 134328 - DNA, 103 bp, Artificial Sequence
  Synthetic Polynucleotide
taatacgactcactatagggcatctgggtgcttcttcttatgctcctcccaacagaggagagggaggatgataagaagaaacctggcggcagcgcaaaagatg

SEQ ID NO: 134329 - DNA, 103 bp, Artificial Sequence
  Synthetic Polynucleotide
taatacgactcactatagggttgactgaagcatctgggtgcttcttcttaaacagaggagataagaaatggcacccagaaacctggcggcagcgcaaaagatg

SEQ ID NO: 134330 - DNA, 103 bp, Artificial Sequence
  Synthetic Polynucleotide
taatacgactcactatagggccgcggcttgttggggtctcctttacccataacagaggagaatgggtatgggagaccccaacctggcggcagcgcaaaagatg

SEQ ID NO: 134331 - DNA, 103 bp, Artificial Sequence
  Synthetic Polynucleotide
taatacgactcactatagggttccgcgaaattgacggaagagtccgggtgaacagaggagacacccgatgtcttccgtcaacctggcggcagcgcaaaagatg

SEQ ID NO: 134332 - DNA, 103 bp, Artificial Sequence
  Synthetic Polynucleotide
taatacgactcactatagggtcttggagaattccgcgaaattgacggaagaacagaggagacttccgatgatttcgcggaacctggcggcagcgcaaaagatg

SEQ ID NO: 134333 - DNA, 103 bp, Artificial Sequence
  Synthetic Polynucleotide
taatacgactcactatagggtccgaacacttcttggagaattccgcgaaaaacagaggagatttcgcatgattctccaaaacctggcggcagcgcaaaagatg

SEQ ID NO: 134334 - DNA, 103 bp, Artificial Sequence
  Synthetic Polynucleotide
taatacgactcactatagggcttccatctctccgaacacttcttggagaaaacagaggagattctccatgaagtgttcgaacctggcggcagcgcaaaagatg

SEQ ID NO: 134335 - DNA, 103 bp, Artificial Sequence
  Synthetic Polynucleotide
taatacgactcactatagggcagacatggtcttccatctctccgaacactaacagaggagaagtgttatgagagatggaaacctggcggcagcgcaaaagatg

SEQ ID NO: 134336 - DNA, 103 bp, Artificial Sequence
  Synthetic Polynucleotide
taatacgactcactatagggttctcctttgcagacatggtcttccatctcaacagaggagagagatgatggaccatgtcaacctggcggcagcgcaaaagatg

SEQ ID NO: 134337 - DNA, 103 bp, Artificial Sequence
  Synthetic Polynucleotide
taatacgactcactatagggaaacttcgacttctcctttgcagacatggtaacagaggagaaccatgatggcaaaggagaacctggcggcagcgcaaaagatg

SEQ ID NO: 134338 - DNA, 103 bp, Artificial Sequence
  Synthetic Polynucleotide
taatacgactcactatagggccatatcttcaaacttcgacttctcctttgaacagaggagacaaaggatgagtcgaagtaacctggcggcagcgcaaaagatg

SEQ ID NO: 134339 - DNA, 103 bp, Artificial Sequence
  Synthetic Polynucleotide
taatacgactcactatagggtcactttttgccatatcttcaaacttcgacaacagaggagagtcgaaatgtgaagatataacctggcggcagcgcaaaagatg

SEQ ID NO: 134340 - DNA, 103 bp, Artificial Sequence
  Synthetic Polynucleotide
taatacgactcactataggggcgagctttgtcactttttgccatatcttcaacagaggagagaagatatggcaaaaagtaacctggcggcagcgcaaaagatg

SEQ ID NO: 134341 - DNA, 103 bp, Artificial Sequence
  Synthetic Polynucleotide
taatacgactcactatagggacattttgccccgcggcttgttggggtctcaacagaggagagagaccatgacaagccgcaacctggcggcagcgcaaaagatg

SEQ ID NO: 134342 - DNA, 103 bp, Artificial Sequence
  Synthetic Polynucleotide
taatacgactcactatagggccctgtcatagcgagctttgtcactttttgaacagaggagacaaaaaatgacaaagctcaacctggcggcagcgcaaaagatg

SEQ ID NO: 134343 - DNA, 103 bp, Artificial Sequence
  Synthetic Polynucleotide
taatacgactcactatagggtttttcatctccctgtcatagcgagctttgaacagaggagacaaagcatgctatgacagaacctggcggcagcgcaaaagatg

SEQ ID NO: 134344 - DNA, 103 bp, Artificial Sequence
  Synthetic Polynucleotide
taatacgactcactatagggaggaacgtaatttttcatctccctgtcataaacagaggagatatgacatggagatgaaaaacctggcggcagcgcaaaagatg

SEQ ID NO: 134345 - DNA, 103 bp, Artificial Sequence
  Synthetic Polynucleotide
taatacgactcactatagggcacctttgggaggaacgtaatttttcatctaacagaggagaagatgaatgattacgttcaacctggcggcagcgcaaaagatg

SEQ ID NO: 134346 - DNA, 103 bp, Artificial Sequence
  Synthetic Polynucleotide
taatacgactcactatagggcccttcttatcacctttgggaggaacgtaaaacagaggagattacgtatgtcccaaaggaacctggcggcagcgcaaaagatg

SEQ ID NO: 134347 - DNA, 103 bp, Artificial Sequence
  Synthetic Polynucleotide
taatacgactcactatagggctttttcttccccttcttatcacctttgggaacagaggagacccaaaatggataagaagaacctggcggcagcgcaaaagatg

SEQ ID NO: 134348 - DNA, 103 bp, Artificial Sequence
  Synthetic Polynucleotide
taatacgactcactatagggcattggggtcctttttcttccccttcttataacagaggagaataagaatgggaagaaaaaacctggcggcagcgcaaaagatg

SEQ ID NO: 134349 - DNA, 103 bp, Artificial Sequence
  Synthetic Polynucleotide
taatacgactcactatagggcttttaggagcattggggtcctttttcttcaacagaggagagaagaaatgggaccccaaaacctggcggcagcgcaaaagatg

SEQ ID NO: 134350 - DNA, 103 bp, Artificial Sequence
  Synthetic Polynucleotide
taatacgactcactatagggagatggtggccttttaggagcattggggtcaacagaggagagaccccatggctcctaaaaacctggcggcagcgcaaaagatg

SEQ ID NO: 134351 - DNA, 103 bp, Artificial Sequence
  Synthetic Polynucleotide
taatacgactcactatagggggaagaaggcagatggtggccttttaggagaacagaggagactcctaatgggccaccataacctggcggcagcgcaaaagatg

SEQ ID NO: 134352 - DNA, 103 bp, Artificial Sequence
  Synthetic Polynucleotide
taatacgactcactataggggcgtacgaggacattttgccccgcggcttgaacagaggagacaagccatggggcaaaataacctggcggcagcgcaaaagatg

SEQ ID NO: 134353 - DNA, 103 bp, Artificial Sequence
  Synthetic Polynucleotide
taatacgactcactataggggagcaaaacaggaagaaggcagatggtggcaacagaggagagccaccatgtgccttcttaacctggcggcagcgcaaaagatg

SEQ ID NO: 134354 - DNA, 103 bp, Artificial Sequence
  Synthetic Polynucleotide
taatacgactcactataggggcgatgttcagagcaaaacaggaagaaggcaacagaggagagccttcatgctgttttgcaacctggcggcagcgcaaaagatg

SEQ ID NO: 134355 - DNA, 103 bp, Artificial Sequence
  Synthetic Polynucleotide
taatacgactcactatagggtgatctttgggcgatgttcagagcaaaacaaacagaggagatgttttatgctgaacatcaacctggcggcagcgcaaaagatg

SEQ ID NO: 134356 - DNA, 103 bp, Artificial Sequence
  Synthetic Polynucleotide
taatacgactcactatagggtgttcacttttgatctttgggcgatgttcaaacagaggagatgaacaatgcccaaagataacctggcggcagcgcaaaagatg

SEQ ID NO: 134357 - DNA, 103 bp, Artificial Sequence
  Synthetic Polynucleotide
taatacgactcactatagggtaggccagggtgttcacttttgatctttggaacagaggagaccaaagatgaaaagtgaaaacctggcggcagcgcaaaagatg

SEQ ID NO: 134358 - DNA, 103 bp, Artificial Sequence
  Synthetic Polynucleotide
taatacgactcactatagggccccaatggataggccagggtgttcactttaacagaggagaaaagtgatgaccctggccaacctggcggcagcgcaaaagatg

SEQ ID NO: 134359 - DNA, 103 bp, Artificial Sequence
  Synthetic Polynucleotide
taatacgactcactatagggtttgcagtatccccaatggataggccagggaacagaggagaccctggatgatccattggaacctggcggcagcgcaaaagatg

SEQ ID NO: 134360 - DNA, 103 bp, Artificial Sequence
  Synthetic Polynucleotide
taatacgactcactatagggacccaatttctttgcagtatccccaatggaaacagaggagatccattatggatactgcaaacctggcggcagcgcaaaagatg

SEQ ID NO: 134361 - DNA, 103 bp, Artificial Sequence
  Synthetic Polynucleotide
taatacgactcactatagggaccacatttcacccaatttctttgcagtataacagaggagaatactgatgagaaattggaacctggcggcagcgcaaaagatg

SEQ ID NO: 134362 - DNA, 103 bp, Artificial Sequence
  Synthetic Polynucleotide
taatacgactcactataggggactgctcagaccacatttcacccaatttcaacagaggagagaaattatgtgaaatgtgaacctggcggcagcgcaaaagatg

SEQ ID NO: 134363 - DNA, 103 bp, Artificial Sequence
  Synthetic Polynucleotide
taatacgactcactatagggcacgaagaaggcgtacgaggacattttgccaacagaggagaggcaaaatgtcctcgtacaacctggcggcagcgcaaaagatg

SEQ ID NO: 134364 - DNA, 103 bp, Artificial Sequence
  Synthetic Polynucleotide
taatacgactcactatagggatctttggctgactgctcagaccacatttcaacagaggagagaaatgatgtctgagcagaacctggcggcagcgcaaaagatg

SEQ ID NO: 134365 - DNA, 103 bp, Artificial Sequence
  Synthetic Polynucleotide
taatacgactcactatagggatggttgtttatctttggctgactgctcagaacagaggagactgagcatgcagccaaagaacctggcggcagcgcaaaagatg

SEQ ID NO: 134366 - DNA, 103 bp, Artificial Sequence
  Synthetic Polynucleotide
taatacgactcactatagggttctgttcatatggttgtttatctttggctaacagaggagaagccaaatgtaaacaaccaacctggcggcagcgcaaaagatg

SEQ ID NO: 134367 - DNA, 103 bp, Artificial Sequence
  Synthetic Polynucleotide
taatacgactcactatagggcttagctgctttctgttcatatggttgtttaacagaggagaaaacaaatgtatgaacagaacctggcggcagcgcaaaagatg

SEQ ID NO: 134368 - DNA, 103 bp, Artificial Sequence
  Synthetic Polynucleotide
taatacgactcactatagggtctcctttagcttagctgctttctgttcataacagaggagaatgaacatgaagcagctaaacctggcggcagcgcaaaagatg

SEQ ID NO: 134369 - DNA, 103 bp, Artificial Sequence
  Synthetic Polynucleotide
taatacgactcactatagggttttcatatttctcctttagcttagctgctaacagaggagaagcagcatggctaaaggaaacctggcggcagcgcaaaagatg

SEQ ID NO: 134370 - DNA, 103 bp, Artificial Sequence
  Synthetic Polynucleotide
taatacgactcactatagggagcaatatccttttcatatttctcctttagaacagaggagactaaagatgaaatatgaaaacctggcggcagcgcaaaagatg

SEQ ID NO: 134371 - DNA, 103 bp, Artificial Sequence
  Synthetic Polynucleotide
taatacgactcactatagggcacgatatgcagcaatatccttttcatattaacagaggagaaatatgatgaggatattgaacctggcggcagcgcaaaagatg

SEQ ID NO: 134372 - DNA, 103 bp, Artificial Sequence
  Synthetic Polynucleotide
taatacgactcactatagggttgcccttggcacgatatgcagcaatatccaacagaggagaggatatatgtgcatatcgaacctggcggcagcgcaaaagatg

SEQ ID NO: 134373 - DNA, 103 bp, Artificial Sequence
  Synthetic Polynucleotide
taatacgactcactatagggtgcttcacttttgcccttggcacgatatgcaacagaggagagcatatatggccaagggcaacctggcggcagcgcaaaagatg

SEQ ID NO: 134374 - DNA, 103 bp, Artificial Sequence
  Synthetic Polynucleotide
taatacgactcactatagggggcaggtctgcacgaagaaggcgtacgaggaacagaggagacctcgtatgccttcttcgaacctggcggcagcgcaaaagatg

SEQ ID NO: 134375 - DNA, 103 bp, Artificial Sequence
  Synthetic Polynucleotide
taatacgactcactatagggccttctttcctgcttcacttttgcccttggaacagaggagaccaaggatgaaagtgaagaacctggcggcagcgcaaaagatg

SEQ ID NO: 134376 - DNA, 103 bp, Artificial Sequence
  Synthetic Polynucleotide
taatacgactcactatagggctgccagggcccttctttcctgcttcacttaacagaggagaaagtgaatgaggaaagaaaacctggcggcagcgcaaaagatg

SEQ ID NO: 134377 - DNA, 103 bp, Artificial Sequence
  Synthetic Polynucleotide
taatacgactcactataggggcctgttggcctgccagggcccttctttccaacagaggagaggaaagatgggccctggcaacctggcggcagcgcaaaagatg

SEQ ID NO: 134378 - DNA, 103 bp, Artificial Sequence
  Synthetic Polynucleotide
taatacgactcactatagggtcttctttgagcctgttggcctgccagggcaacagaggagagccctgatgggccaacagaacctggcggcagcgcaaaagatg

SEQ ID NO: 134379 - DNA, 103 bp, Artificial Sequence
  Synthetic Polynucleotide
taatacgactcactatagggggttcgttcttcttctttgagcctgttggcaacagaggagagccaacatgctcaaagaaaacctggcggcagcgcaaaagatg

SEQ ID NO: 134380 - DNA, 103 bp, Artificial Sequence
  Synthetic Polynucleotide
taatacgactcactatagggctcatcttctggttcgttcttcttctttgaaacagaggagatcaaagatgaagaacgaaaacctggcggcagcgcaaaagatg

SEQ ID NO: 134381 - DNA, 103 bp, Artificial Sequence
  Synthetic Polynucleotide
taatacgactcactatagggcctcctcctcctcatcttctggttcgttctaacagaggagaagaacgatgcagaagatgaacctggcggcagcgcaaaagatg

SEQ ID NO: 134382 - DNA, 103 bp, Artificial Sequence
  Synthetic Polynucleotide
taatacgactcactatagggtcttcttcctcctcctcctcctcatcttctaacagaggagaagaagaatgggaggaggaaacctggcggcagcgcaaaagatg

SEQ ID NO: 134383 - DNA, 103 bp, Artificial Sequence
  Synthetic Polynucleotide
taatacgactcactatagggatcttcatcttcttcttcctcctcctcctcaacagaggagagaggagatggaggaagaaaacctggcggcagcgcaaaagatg

SEQ ID NO: 134384 - DNA, 103 bp, Artificial Sequence
  Synthetic Polynucleotide
taatacgactcactatagggcttcctcctcatcttcatcttcttcttcctaacagaggagaaggaagatgaagatgaagaacctggcggcagcgcaaaagatg

SEQ ID NO: 134385 - DNA, 103 bp, Artificial Sequence
  Synthetic Polynucleotide
taatacgactcactatagggtgctcttcccggcaggtctgcacgaagaagaacagaggagacttcttatggcagacctgaacctggcggcagcgcaaaagatg

SEQ ID NO: 134386 - DNA, 103 bp, Artificial Sequence
  Synthetic Polynucleotide
taatacgactcactatagggtcttcatcctcttcctcctcatcttcatctaacagaggagaagatgaatgtgaggaggaaacctggcggcagcgcaaaagatg

SEQ ID NO: 134387 - DNA, 103 bp, Artificial Sequence
  Synthetic Polynucleotide
taatacgactcactatagggttattcttcatcttcatcctcttcctcctcaacagaggagagaggagatggaggatgaaaacctggcggcagcgcaaaagatg

SEQ ID NO: 134388 - DNA, 103 bp, Artificial Sequence
  Synthetic Polynucleotide
taatacgactcactatagggtttcttcttgtgctcttcccggcaggtctgaacagaggagacagaccatgcgggaagagaacctggcggcagcgcaaaagatg

SEQ ID NO: 134389 - DNA, 103 bp, Artificial Sequence
  Synthetic Polynucleotide
taatacgactcactatagggagtccgggtgtttcttcttgtgctcttcccaacagaggagagggaagatgacaagaagaaacctggcggcagcgcaaaagatg

SEQ ID NO: 134390 - DNA, 103 bp, Artificial Sequence
  Synthetic Polynucleotide
taatacgactcactatagggttgacggaagagtccgggtgtttcttcttgaacagaggagacaagaaatgacacccggaaacctggcggcagcgcaaaagatg

SEQ ID NO: 134391 - DNA, 103 bp, Artificial Sequence
  Synthetic Polynucleotide
taatacgactcactataggggcgcccgggctccgtcagctcgtcaggcataacagaggagaatgcctatggagctgacgaacctggcggcagcgcaaaagatg

SEQ ID NO: 134392 - DNA, 103 bp, Artificial Sequence
  Synthetic Polynucleotide
taatacgactcactataggggccgtcgccctgggtcgcgcgccctgcgccaacagaggagaggcgcaatgcgcgcgaccaacctggcggcagcgcaaaagatg

SEQ ID NO: 134393 - DNA, 103 bp, Artificial Sequence
  Synthetic Polynucleotide
taatacgactcactatagggcagaaagggcacggaggcggcggccgggaaaacagaggagattcccgatggccgcctccaacctggcggcagcgcaaaagatg

SEQ ID NO: 134394 - DNA, 103 bp, Artificial Sequence
  Synthetic Polynucleotide
taatacgactcactatagggtctgcgcccgcagaaagggcacggaggcggaacagaggagaccgcctatgtgccctttcaacctggcggcagcgcaaaagatg

SEQ ID NO: 134395 - DNA, 103 bp, Artificial Sequence
  Synthetic Polynucleotide
taatacgactcactatagggaggccaggcatctgcgcccgcagaaagggcaacagaggagagcccttatggcgggcgcaaacctggcggcagcgcaaaagatg

SEQ ID NO: 134396 - DNA, 103 bp, Artificial Sequence
  Synthetic Polynucleotide
taatacgactcactatagggcctcccggctgccgtcgccctgggtcgcgcaacagaggagagcgcgaatgagggcgacgaacctggcggcagcgcaaaagatg

SEQ ID NO: 134397 - DNA, 103 bp, Artificial Sequence
  Synthetic Polynucleotide
taatacgactcactatagggtcctcctcgtcctcccggctgccgtcgcccaacagaggagagggcgaatgcagccgggaaacctggcggcagcgcaaaagatg

SEQ ID NO: 134398 - DNA, 103 bp, Artificial Sequence
  Synthetic Polynucleotide
taatacgactcactataggggtcgtcgtcctcctcctcgtcctcccggctaacagaggagaagccggatggacgaggagaacctggcggcagcgcaaaagatg

SEQ ID NO: 134399 - DNA, 103 bp, Artificial Sequence
  Synthetic Polynucleotide
taatacgactcactatagggcttcggggtcgtcgtcgtcctcctcctcgtaacagaggagaacgaggatgaggacgacgaacctggcggcagcgcaaaagatg

SEQ ID NO: 134400 - DNA, 103 bp, Artificial Sequence
  Synthetic Polynucleotide
taatacgactcactataggggcgtcctcgtcttcggggtcgtcgtcgtccaacagaggagaggacgaatgcgaccccgaaacctggcggcagcgcaaaagatg

SEQ ID NO: 134401 - DNA, 103 bp, Artificial Sequence
  Synthetic Polynucleotide
taatacgactcactatagggcgcctgctcggcgtcctcgtcttcggggtcaacagaggagagaccccatggacgaggacaacctggcggcagcgcaaaagatg

SEQ ID NO: 134402 - DNA, 103 bp, Artificial Sequence
  Synthetic Polynucleotide
taatacgactcactataggggtcgccgccgcgcctgctcggcgtcctcgtaacagaggagaacgaggatgccgagcaggaacctggcggcagcgcaaaagatg

SEQ ID NO: 134403 - DNA, 103 bp, Artificial Sequence
  Synthetic Polynucleotide
taatacgactcactatagggcgctgtagccgtcgccgccgcgcctgctcgaacagaggagacgagcaatggcggcggcgaacctggcggcagcgcaaaagatg

SEQ ID NO: 134404 - DNA, 103 bp, Artificial Sequence
  Synthetic Polynucleotide
taatacgactcactatagggctgtcgccgccgctgtagccgtcgccgccgaacagaggagacggcggatgcggctacagaacctggcggcagcgcaaaagatg

SEQ ID NO: 134405 - DNA, 103 bp, Artificial Sequence
  Synthetic Polynucleotide
taatacgactcactatagggccggcgtggcgcgcccgggctccgtcagctaacagaggagaagctgaatgagcccgggcaacctggcggcagcgcaaaagatg

SEQ ID NO: 134406 - DNA, 103 bp, Artificial Sequence
  Synthetic Polynucleotide
taatacgactcactatagggccgcgagcaactgtcgccgccgctgtagccaacagaggagaggctacatgggcggcgacaacctggcggcagcgcaaaagatg

SEQ ID NO: 134407 - DNA, 103 bp, Artificial Sequence
  Synthetic Polynucleotide
taatacgactcactatagggggcccggtgcccgcgagcaactgtcgccgcaacagaggagagcggcgatggttgctcgcaacctggcggcagcgcaaaagatg

SEQ ID NO: 134408 - DNA, 103 bp, Artificial Sequence
  Synthetic Polynucleotide
taatacgactcactatagggctccccgccgggcccggtgcccgcgagcaaaacagaggagattgctcatgggcaccgggaacctggcggcagcgcaaaagatg

SEQ ID NO: 134409 - DNA, 103 bp, Artificial Sequence
  Synthetic Polynucleotide
taatacgactcactataggggggcccgcgcctccccgccgggcccggtgcaacagaggagagcaccgatgccggcggggaacctggcggcagcgcaaaagatg

SEQ ID NO: 134410 - DNA, 103 bp, Artificial Sequence
  Synthetic Polynucleotide
taatacgactcactatagggagcagcgcacgggcccgcgcctccccgccgaacagaggagacggcggatgggcgcgggcaacctggcggcagcgcaaaagatg

SEQ ID NO: 134411 - DNA, 103 bp, Artificial Sequence
  Synthetic Polynucleotide
taatacgactcactataggggcccggcccgagcagcgcacgggcccgcgcaacagaggagagcgcggatgcgtgcgctgaacctggcggcagcgcaaaagatg

SEQ ID NO: 134412 - DNA, 103 bp, Artificial Sequence
  Synthetic Polynucleotide
taatacgactcactatagggggcccagcgcgcccggcccgagcagcgcacaacagaggagagtgcgcatgtcgggccggaacctggcggcagcgcaaaagatg

SEQ ID NO: 134413 - DNA, 103 bp, Artificial Sequence
  Synthetic Polynucleotide
taatacgactcactatagggcgaggaccgaggcccagcgcgcccggcccgaacagaggagacgggccatgcgcgctgggaacctggcggcagcgcaaaagatg

SEQ ID NO: 134414 - DNA, 103 bp, Artificial Sequence
  Synthetic Polynucleotide
taatacgactcactatagggggggggcggccgaggaccgaggcccagcgcaacagaggagagcgctgatgctcggtcctaacctggcggcagcgcaaaagatg

SEQ ID NO: 134415 - DNA, 103 bp, Artificial Sequence
  Synthetic Polynucleotide
taatacgactcactataggggcccgggaccggggggcggccgaggaccgaaacagaggagatcggtcatgggccgccccaacctggcggcagcgcaaaagatg

SEQ ID NO: 134416 - DNA, 103 bp, Artificial Sequence
  Synthetic Polynucleotide
taatacgactcactataggggaggcgcgggccggcgtggcgcgcccgggcaacagaggagagcccggatgcgccacgccaacctggcggcagcgcaaaagatg

SEQ ID NO: 134417 - DNA, 103 bp, Artificial Sequence
  Synthetic Polynucleotide
taatacgactcactataggggcgaagggcggcccgggaccggggggcggcaacagaggagagccgccatgcggtcccggaacctggcggcagcgcaaaagatg

SEQ ID NO: 134418 - DNA, 103 bp, Artificial Sequence
  Synthetic Polynucleotide
taatacgactcactataggggcagcccagagcgaagggcggcccgggaccaacagaggagaggtcccatgccgcccttcaacctggcggcagcgcaaaagatg

SEQ ID NO: 134419 - DNA, 103 bp, Artificial Sequence
  Synthetic Polynucleotide
taatacgactcactatagggctgcgcctccgcagcccagagcgaagggcgaacagaggagacgccctatgctctgggctaacctggcggcagcgcaaaagatg

SEQ ID NO: 134420 - DNA, 103 bp, Artificial Sequence
  Synthetic Polynucleotide
taatacgactcactatagggtaccagcgcgctgcgcctccgcagcccagaaacagaggagatctgggatgcggaggcgcaacctggcggcagcgcaaaagatg

SEQ ID NO: 134421 - DNA, 103 bp, Artificial Sequence
  Synthetic Polynucleotide
taatacgactcactatagggcgcccgtgggtaccagcgcgctgcgcctccaacagaggagaggaggcatggcgcgctggaacctggcggcagcgcaaaagatg

SEQ ID NO: 134422 - DNA, 103 bp, Artificial Sequence
  Synthetic Polynucleotide
taatacgactcactatagggagccaccgtgcgcccgtgggtaccagcgcgaacagaggagacgcgctatgacccacgggaacctggcggcagcgcaaaagatg

SEQ ID NO: 134423 - DNA, 103 bp, Artificial Sequence
  Synthetic Polynucleotide
taatacgactcactatagggccgcctccatagccaccgtgcgcccgtgggaacagaggagacccacgatggcacggtggaacctggcggcagcgcaaaagatg

SEQ ID NO: 134424 - DNA, 103 bp, Artificial Sequence
  Synthetic Polynucleotide
taatacgactcactatagggaggactgaggccgcctccatagccaccgtgaacagaggagacacggtatgtatggaggcaacctggcggcagcgcaaaagatg

SEQ ID NO: 134425 - DNA, 103 bp, Artificial Sequence
  Synthetic Polynucleotide
taatacgactcactatagggcgctggtgtcaggactgaggccgcctccataacagaggagaatggagatggcctcagtcaacctggcggcagcgcaaaagatg

SEQ ID NO: 134426 - DNA, 103 bp, Artificial Sequence
  Synthetic Polynucleotide
taatacgactcactataggggagtcccggtcgctggtgtcaggactgaggaacagaggagacctcagatgtgacaccagaacctggcggcagcgcaaaagatg

SEQ ID NO: 134427 - DNA, 103 bp, Artificial Sequence
  Synthetic Polynucleotide
taatacgactcactataggggaggaaggaggaggcgcgggccggcgtggcaacagaggagagccacgatggcccgcgccaacctggcggcagcgcaaaagatg

SEQ ID NO: 134428 - DNA, 103 bp, Artificial Sequence
  Synthetic Polynucleotide
taatacgactcactatagggcgtctccggtgagtcccggtcgctggtgtcaacagaggagagacaccatggaccgggacaacctggcggcagcgcaaaagatg

SEQ ID NO: 134429 - DNA, 103 bp, Artificial Sequence
  Synthetic Polynucleotide
taatacgactcactatagggtctcctcgcccgtctccggtgagtcccggtaacagaggagaaccgggatgcaccggagaaacctggcggcagcgcaaaagatg

SEQ ID NO: 134430 - DNA, 103 bp, Artificial Sequence
  Synthetic Polynucleotide
taatacgactcactataggggcacggcccatctcctcgcccgtctccggtaacagaggagaaccggaatggggcgaggaaacctggcggcagcgcaaaagatg

SEQ ID NO: 134431 - DNA, 103 bp, Artificial Sequence
  Synthetic Polynucleotide
taatacgactcactatagggggcgccctccgcacggcccatctcctcgccaacagaggagaggcgagatgatgggccgtaacctggcggcagcgcaaaagatg

SEQ ID NO: 134432 - DNA, 103 bp, Artificial Sequence
  Synthetic Polynucleotide
taatacgactcactatagggctcgcggccaggcgccctccgcacggcccaaacagaggagatgggccatgcggagggcgaacctggcggcagcgcaaaagatg

SEQ ID NO: 134433 - DNA, 103 bp, Artificial Sequence
  Synthetic Polynucleotide
taatacgactcactatagggggcccggggcctcgcggccaggcgccctccaacagaggagaggagggatgctggccgcgaacctggcggcagcgcaaaagatg

SEQ ID NO: 134434 - DNA, 103 bp, Artificial Sequence
  Synthetic Polynucleotide
taatacgactcactatagggcaccgctcccggcccggggcctcgcggccaaacagaggagatggccgatgggccccgggaacctggcggcagcgcaaaagatg

SEQ ID NO: 134435 - DNA, 103 bp, Artificial Sequence
  Synthetic Polynucleotide
taatacgactcactatagggcctcccgctgcaccgctcccggcccggggcaacagaggagagccccgatgcgggagcggaacctggcggcagcgcaaaagatg

SEQ ID NO: 134436 - DNA, 103 bp, Artificial Sequence
  Synthetic Polynucleotide
taatacgactcactatagggagctccgctgcctcccgctgcaccgctcccaacagaggagagggagcatggcagcgggaaacctggcggcagcgcaaaagatg

SEQ ID NO: 134437 - DNA, 103 bp, Artificial Sequence
  Synthetic Polynucleotide
taatacgactcactatagggacgcgccgccagctccgctgcctcccgctgaacagaggagacagcggatggcagcggagaacctggcggcagcgcaaaagatg

SEQ ID NO: 134438 - DNA, 103 bp, Artificial Sequence
  Synthetic Polynucleotide
taatacgactcactatagggggttctcgatgaggaaggaggaggcgcgggaacagaggagacccgcgatgcctccttccaacctggcggcagcgcaaaagatg

SEQ ID NO: 134439 - DNA, 103 bp, Artificial Sequence
  Synthetic Polynucleotide
taatacgactcactatagggccgccgggccacgcgccgccagctccgctgaacagaggagacagcggatgtggcggcgcaacctggcggcagcgcaaaagatg

SEQ ID NO: 134440 - DNA, 103 bp, Artificial Sequence
  Synthetic Polynucleotide
taatacgactcactatagggtccgtgccggccgccgggccacgcgccgccaacagaggagaggcggcatgtggcccggcaacctggcggcagcgcaaaagatg

SEQ ID NO: 134441 - DNA, 103 bp, Artificial Sequence
  Synthetic Polynucleotide
taatacgactcactatagggcgacgcctcctccgtgccggccgccgggccaacagaggagaggcccgatggccggcacgaacctggcggcagcgcaaaagatg

SEQ ID NO: 134442 - DNA, 103 bp, Artificial Sequence
  Synthetic Polynucleotide
taatacgactcactatagggcggccagctccgacgcctcctccgtgccggaacagaggagaccggcaatgaggaggcgtaacctggcggcagcgcaaaagatg

SEQ ID NO: 134443 - DNA, 103 bp, Artificial Sequence
  Synthetic Polynucleotide
taatacgactcactataggggcagggacctcggccagctccgacgcctccaacagaggagaggaggcatgggagctggcaacctggcggcagcgcaaaagatg

SEQ ID NO: 134444 - DNA, 103 bp, Artificial Sequence
  Synthetic Polynucleotide
taatacgactcactatagggcccagccgccgcagggacctcggccagctcaacagaggagagagctgatggaggtccctaacctggcggcagcgcaaaagatg

SEQ ID NO: 134445 - DNA, 103 bp, Artificial Sequence
  Synthetic Polynucleotide
taatacgactcactatagggcgcgtgtctccccagccgccgcagggacctaacagaggagaaggtccatgcggcggctgaacctggcggcagcgcaaaagatg

SEQ ID NO: 134446 - DNA, 103 bp, Artificial Sequence
  Synthetic Polynucleotide
taatacgactcactatagggccaacgccgccgcgtgtctccccagccgccaacagaggagaggcggcatgggagacacgaacctggcggcagcgcaaaagatg

SEQ ID NO: 134447 - DNA, 103 bp, Artificial Sequence
  Synthetic Polynucleotide
taatacgactcactataggggccgcccacgccaacgccgccgcgtgtctcaacagaggagagagacaatgggcggcgttaacctggcggcagcgcaaaagatg

SEQ ID NO: 134448 - DNA, 103 bp, Artificial Sequence
  Synthetic Polynucleotide
taatacgactcactatagggtctttcggccgccgcccacgccaacgccgcaacagaggagagcggcgatggcgtgggcgaacctggcggcagcgcaaaagatg

SEQ ID NO: 134449 - DNA, 103 bp, Artificial Sequence
  Synthetic Polynucleotide
taatacgactcactataggggccgccagcaggttctcgatgaggaaggagaacagaggagactccttatgcatcgagaaaacctggcggcagcgcaaaagatg

SEQ ID NO: 134450 - DNA, 103 bp, Artificial Sequence
  Synthetic Polynucleotide
taatacgactcactatagggcgcgtcttcttctttcggccgccgcccacgaacagaggagacgtgggatgcggccgaaaaacctggcggcagcgcaaaagatg

SEQ ID NO: 134451 - DNA, 103 bp, Artificial Sequence
  Synthetic Polynucleotide
taatacgactcactataggggaagactgtgcgcgtcttcttctttcggccaacagaggagaggccgaatgaagaagacgaacctggcggcagcgcaaaagatg

SEQ ID NO: 134452 - DNA, 103 bp, Artificial Sequence
  Synthetic Polynucleotide
taatacgactcactatagggggctgcgggagaagactgtgcgcgtcttctaacagaggagaagaagaatggcacagtctaacctggcggcagcgcaaaagatg

SEQ ID NO: 134453 - DNA, 103 bp, Artificial Sequence
  Synthetic Polynucleotide
taatacgactcactatagggtggaagacctggctgcgggagaagactgtgaacagaggagacacagtatgctcccgcagaacctggcggcagcgcaaaagatg

SEQ ID NO: 134454 - DNA, 103 bp, Artificial Sequence
  Synthetic Polynucleotide
taatacgactcactatagggggattccagctggaagacctggctgcgggaaacagaggagatcccgcatgcaggtcttcaacctggcggcagcgcaaaagatg

SEQ ID NO: 134455 - DNA, 103 bp, Artificial Sequence
  Synthetic Polynucleotide
taatacgactcactatagggggtcgaaggtggattccagctggaagacctaacagaggagaaggtctatgagctggaataacctggcggcagcgcaaaagatg

SEQ ID NO: 134456 - DNA, 103 bp, Artificial Sequence
  Synthetic Polynucleotide
taatacgactcactatagggtagcgcttcaggtcgaaggtggattccagcaacagaggagagctggaatgcaccttcgaaacctggcggcagcgcaaaagatg

SEQ ID NO: 134457 - DNA, 103 bp, Artificial Sequence
  Synthetic Polynucleotide
taatacgactcactataggggctgctcaggtagcgcttcaggtcgaaggtaacagaggagaaccttcatgctgaagcgcaacctggcggcagcgcaaaagatg

SEQ ID NO: 134458 - DNA, 103 bp, Artificial Sequence
  Synthetic Polynucleotide
taatacgactcactatagggcgcgctcggcgctgctcaggtagcgcttcaaacagaggagatgaagcatgacctgagcaaacctggcggcagcgcaaaagatg

SEQ ID NO: 134459 - DNA, 103 bp, Artificial Sequence
  Synthetic Polynucleotide
taatacgactcactataggggccaggccggcgcgctcggcgctgctcaggaacagaggagacctgagatgcgccgagcgaacctggcggcagcgcaaaagatg

SEQ ID NO: 134460 - DNA, 103 bp, Artificial Sequence
  Synthetic Polynucleotide
taatacgactcactatagggcttggcctcggccgccagcaggttctcgataacagaggagaatcgagatgctgctggcgaacctggcggcagcgcaaaagatg

SEQ ID NO: 134461 - DNA, 103 bp, Artificial Sequence
  Synthetic Polynucleotide
taatacgactcactatagggcagggaggcggccaggccggcgcgctcggcaacagaggagagccgagatggccggcctgaacctggcggcagcgcaaaagatg

SEQ ID NO: 134462 - DNA, 103 bp, Artificial Sequence
  Synthetic Polynucleotide
taatacgactcactatagggcggtgagctgcagggaggcggccaggccggaacagaggagaccggccatgccgcctcccaacctggcggcagcgcaaaagatg

SEQ ID NO: 134463 - DNA, 103 bp, Artificial Sequence
  Synthetic Polynucleotide
taatacgactcactatagggacctgcgtctcggtgagctgcagggaggcgaacagaggagacgcctcatggcagctcacaacctggcggcagcgcaaaagatg

SEQ ID NO: 134464 - DNA, 103 bp, Artificial Sequence
  Synthetic Polynucleotide
taatacgactcactatagggccagatcttaacctgcgtctcggtgagctgaacagaggagacagctcatggagacgcagaacctggcggcagcgcaaaagatg

SEQ ID NO: 134465 - DNA, 103 bp, Artificial Sequence
  Synthetic Polynucleotide
taatacgactcactatagggggttctggaaccagatcttaacctgcgtctaacagaggagaagacgcatgttaagatctaacctggcggcagcgcaaaagatg

SEQ ID NO: 134466 - DNA, 103 bp, Artificial Sequence
  Synthetic Polynucleotide
taatacgactcactatagggttgttgcggcggttctggaaccagatcttaaacagaggagataagatatggttccagaaaacctggcggcagcgcaaaagatg

SEQ ID NO: 134467 - DNA, 103 bp, Artificial Sequence
  Synthetic Polynucleotide
taatacgactcactatagggccgcttccacttgttgcggcggttctggaaaacagaggagattccagatgcgccgcaacaacctggcggcagcgcaaaagatg

SEQ ID NO: 134468 - DNA, 103 bp, Artificial Sequence
  Synthetic Polynucleotide
taatacgactcactatagggctgccagctgccgcttccacttgttgcggcaacagaggagagccgcaatgagtggaagcaacctggcggcagcgcaaaagatg

SEQ ID NO: 134469 - DNA, 103 bp, Artificial Sequence
  Synthetic Polynucleotide
taatacgactcactatagggtccagctcggctgccagctgccgcttccacaacagaggagagtggaaatggcagctggcaacctggcggcagcgcaaaagatg

SEQ ID NO: 134470 - DNA, 103 bp, Artificial Sequence
  Synthetic Polynucleotide
taatacgactcactataggggctggccgcctccagctcggctgccagctgaacagaggagacagctgatggccgagctgaacctggcggcagcgcaaaagatg

SEQ ID NO: 134471 - DNA, 103 bp, Artificial Sequence
  Synthetic Polynucleotide
taatacgactcactataggggccctgcgcccttggcctcggccgccagcaaacagaggagatgctggatgccgaggccaaacctggcggcagcgcaaaagatg

SEQ ID NO: 134472 - DNA, 103 bp, Artificial Sequence
  Synthetic Polynucleotide
taatacgactcactataggggcggggacaggctggccgcctccagctcggaacagaggagaccgagcatgaggcggccaaacctggcggcagcgcaaaagatg

SEQ ID NO: 134473 - DNA, 103 bp, Artificial Sequence
  Synthetic Polynucleotide
taatacgactcactatagggtgcgctcccggcggggacaggctggccgccaacagaggagaggcggcatgcctgtccccaacctggcggcagcgcaaaagatg

SEQ ID NO: 134474 - DNA, 103 bp, Artificial Sequence
  Synthetic Polynucleotide
taatacgactcactataggggaccaggcgctgcgctcccggcggggacagaacagaggagactgtccatgccgggagcgaacctggcggcagcgcaaaagatg

SEQ ID NO: 134475 - DNA, 103 bp, Artificial Sequence
  Synthetic Polynucleotide
taatacgactcactatagggccggcacgcggaccaggcgctgcgctcccgaacagaggagacgggagatgagcgcctggaacctggcggcagcgcaaaagatg

SEQ ID NO: 134476 - DNA, 103 bp, Artificial Sequence
  Synthetic Polynucleotide
taatacgactcactatagggtggtagagcaccggcacgcggaccaggcgcaacagaggagagcgcctatgccgcgtgccaacctggcggcagcgcaaaagatg

SEQ ID NO: 134477 - DNA, 103 bp, Artificial Sequence
  Synthetic Polynucleotide
taatacgactcactatagggggggctttcgtggtagagcaccggcacgcgaacagaggagacgcgtgatggtgctctacaacctggcggcagcgcaaaagatg

SEQ ID NO: 134478 - DNA, 103 bp, Artificial Sequence
  Synthetic Polynucleotide
taatacgactcactatagggctgcggccggggggctttcgtggtagagcaaacagaggagatgctctatgacgaaagccaacctggcggcagcgcaaaagatg

SEQ ID NO: 134479 - DNA, 103 bp, Artificial Sequence
  Synthetic Polynucleotide
taatacgactcactatagggccagcggcggctgcggccggggggctttcgaacagaggagacgaaagatgcccggccgcaacctggcggcagcgcaaaagatg

SEQ ID NO: 134480 - DNA, 103 bp, Artificial Sequence
  Synthetic Polynucleotide
taatacgactcactatagggggccgggggcccagcggcggctgcggccggaacagaggagaccggccatggccgccgctaacctggcggcagcgcaaaagatg

SEQ ID NO: 134481 - DNA, 103 bp, Artificial Sequence
  Synthetic Polynucleotide
taatacgactcactatagggagggcagggtggccgggggcccagcggcggaacagaggagaccgccgatgggcccccggaacctggcggcagcgcaaaagatg

SEQ ID NO: 134482 - DNA, 103 bp, Artificial Sequence
  Synthetic Polynucleotide
taatacgactcactatagggtgggtcgcgcgccctgcgcccttggcctcgaacagaggagacgaggcatggggcgcaggaacctggcggcagcgcaaaagatg

SEQ ID NO: 134483 - DNA, 103 bp, Artificial Sequence
  Synthetic Polynucleotide
taatacgactcactataggggccagcgggaagggcagggtggccgggggcaacagaggagagcccccatgcaccctgccaacctggcggcagcgcaaaagatg

SEQ ID NO: 134484 - DNA, 103 bp, Artificial Sequence
  Synthetic Polynucleotide
taatacgactcactatagggcgcggcgggcgccagcgggaagggcagggtaacagaggagaaccctgatgttcccgctgaacctggcggcagcgcaaaagatg

SEQ ID NO: 134485 - DNA, 103 bp, Artificial Sequence
  Synthetic Polynucleotide
taatacgactcactataggggcggcgcgggcgcggcgggcgccagcgggaaacagaggagatcccgcatgcgcccgccgaacctggcggcagcgcaaaagatg

SEQ ID NO: 134486 - DNA, 103 bp, Artificial Sequence
  Synthetic Polynucleotide
taatacgactcactatagggagcggtgggggcggcgcgggcgcggcgggcaacagaggagagcccgcatggcccgcgccaacctggcggcagcgcaaaagatg

SEQ ID NO: 134487 - DNA, 103 bp, Artificial Sequence
  Synthetic Polynucleotide
taatacgactcactataggggaagccgagcagcggtgggggcggcgcgggaacagaggagacccgcgatgcccccaccgaacctggcggcagcgcaaaagatg

SEQ ID NO: 134488 - DNA, 103 bp, Artificial Sequence
  Synthetic Polynucleotide
taatacgactcactataggggggccccggagaagccgagcagcggtggggaacagaggagaccccacatgtgctcggctaacctggcggcagcgcaaaagatg

SEQ ID NO: 134489 - DNA, 103 bp, Artificial Sequence
  Synthetic Polynucleotide
taatacgactcactataggggggtaggcgagggccccggagaagccgagcaacagaggagagctcggatgctccggggcaacctggcggcagcgcaaaagatg

SEQ ID NO: 134490 - DNA, 103 bp, Artificial Sequence
  Synthetic Polynucleotide
taatacgactcactatagggggcggccagcgggtaggcgagggccccggaaacagaggagatccgggatgctcgcctacaacctggcggcagcgcaaaagatg

SEQ ID NO: 134491 - DNA, 103 bp, Artificial Sequence
  Synthetic Polynucleotide
taatacgactcactatagggcggccgggaaggcggccagcgggtaggcgaaacagaggagatcgcctatgcgctggccgaacctggcggcagcgcaaaagatg

SEQ ID NO: 134492 - DNA, 103 bp, Artificial Sequence
  Synthetic Polynucleotide
taatacgactcactatagggacggaggcggcggccgggaaggcggccagcaacagaggagagctggcatgcttcccggcaacctggcggcagcgcaaaagatg

SEQ ID NO: 134493 - DNA, 103 bp, Artificial Sequence
  Synthetic Polynucleotide
taatacgactcactataggggccggcagcgtccggcccgggttccggcataacagaggagaatgccgatgcccgggccgaacctggcggcagcgcaaaagatg

SEQ ID NO: 134494 - DNA, 103 bp, Artificial Sequence
  Synthetic Polynucleotide
taatacgactcactataggggtctccgttgagcaggttcttgatggagaaaacagaggagattctccatgaagaacctgaacctggcggcagcgcaaaagatg

SEQ ID NO: 134495 - DNA, 103 bp, Artificial Sequence
  Synthetic Polynucleotide
taatacgactcactatagggggggtgcgggaaggtgagcagcggctggctaacagaggagaagccagatgctgctcaccaacctggcggcagcgcaaaagatg

SEQ ID NO: 134496 - DNA, 103 bp, Artificial Sequence
  Synthetic Polynucleotide
taatacgactcactatagggagtagtagacggggtgcgggaaggtgagcaaacagaggagatgctcaatgtcccgcaccaacctggcggcagcgcaaaagatg

SEQ ID NO: 134497 - DNA, 103 bp, Artificial Sequence
  Synthetic Polynucleotide
taatacgactcactatagggaccgggtgcgagtagtagacggggtgcgggaacagaggagacccgcaatgcgtctactaaacctggcggcagcgcaaaagatg

SEQ ID NO: 134498 - DNA, 103 bp, Artificial Sequence
  Synthetic Polynucleotide
taatacgactcactatagggggaagagaccaccgggtgcgagtagtagacaacagaggagagtctacatgtcgcacccgaacctggcggcagcgcaaaagatg

SEQ ID NO: 134499 - DNA, 103 bp, Artificial Sequence
  Synthetic Polynucleotide
taatacgactcactataggggcagcggcacggaagagaccaccgggtgcgaacagaggagacgcaccatgtggtctcttaacctggcggcagcgcaaaagatg

SEQ ID NO: 134500 - DNA, 103 bp, Artificial Sequence
  Synthetic Polynucleotide
taatacgactcactatagggaccggccgtagcagcggcacggaagagaccaacagaggagaggtctcatgcgtgccgctaacctggcggcagcgcaaaagatg

SEQ ID NO: 134501 - DNA, 103 bp, Artificial Sequence
  Synthetic Polynucleotide
taatacgactcactataggggccggtggtggtctccgttgagcaggttctaacagaggagaagaaccatgtcaacggagaacctggcggcagcgcaaaagatg

SEQ ID NO: 134502 - DNA, 103 bp, Artificial Sequence
  Synthetic Polynucleotide
taatacgactcactatagggttagggggcggccggtggtggtctccgttgaacagaggagacaacggatgccaccaccgaacctggcggcagcgcaaaagatg

SEQ ID NO: 134503 - DNA, 103 bp, Artificial Sequence
  Synthetic Polynucleotide
taatacgactcactatagggcggctgaggcttagggggcggccggtggtgaacagaggagacaccacatgccgccccctaacctggcggcagcgcaaaagatg

SEQ ID NO: 134504 - DNA, 103 bp, Artificial Sequence
  Synthetic Polynucleotide
taatacgactcactatagggtccgtgggggcggctgaggcttagggggcgaacagaggagacgccccatgagcctcagcaacctggcggcagcgcaaaagatg

SEQ ID NO: 134505 - DNA, 103 bp, Artificial Sequence
  Synthetic Polynucleotide
taatacgactcactataggggcgaagagcgtccgtgggggcggctgaggcaacagaggagagcctcaatggcccccacgaacctggcggcagcgcaaaagatg

SEQ ID NO: 134506 - DNA, 103 bp, Artificial Sequence
  Synthetic Polynucleotide
taatacgactcactatagggcgaggctggcgcgaagagcgtccgtgggggaacagaggagacccccaatgacgctcttcaacctggcggcagcgcaaaagatg

SEQ ID NO: 134507 - DNA, 103 bp, Artificial Sequence
  Synthetic Polynucleotide
taatacgactcactatagggcggcggcagccgaggctggcgcgaagagcgaacagaggagacgctctatgcgccagcctaacctggcggcagcgcaaaagatg

SEQ ID NO: 134508 - DNA, 103 bp, Artificial Sequence
  Synthetic Polynucleotide
taatacgactcactataggggcggcggcggcggcggcagccgaggctggcaacagaggagagccagcatgggctgccgcaacctggcggcagcgcaaaagatg

SEQ ID NO: 134509 - DNA, 103 bp, Artificial Sequence
  Synthetic Polynucleotide
taatacgactcactatagggggcagcggcagcggcggcggcggcggcagcaacagaggagagctgccatggccgccgccaacctggcggcagcgcaaaagatg

SEQ ID NO: 134510 - DNA, 103 bp, Artificial Sequence
  Synthetic Polynucleotide
taatacgactcactatagggcgctggcggtgccggcagcgtccggcccggaacagaggagaccgggcatgacgctgccgaacctggcggcagcgcaaaagatg

SEQ ID NO: 134511 - DNA, 103 bp, Artificial Sequence
  Synthetic Polynucleotide
taatacgactcactatagggtggccgccgcggcagcggcagcggcggcggaacagaggagaccgccgatgctgccgctgaacctggcggcagcgcaaaagatg

SEQ ID NO: 134512 - DNA, 103 bp, Artificial Sequence
  Synthetic Polynucleotide
taatacgactcactatagggagggcccccttggccgccgcggcagcggcaaacagaggagatgccgcatgcgcggcggcaacctggcggcagcgcaaaagatg

SEQ ID NO: 134513 - DNA, 103 bp, Artificial Sequence
  Synthetic Polynucleotide
taatacgactcactatagggggcgccctccagggcccccttggccgccgcaacagaggagagcggcgatgaagggggccaacctggcggcagcgcaaaagatg

SEQ ID NO: 134514 - DNA, 103 bp, Artificial Sequence
  Synthetic Polynucleotide
taatacgactcactatagggcgaagcccgcggcgccctccagggccccctaacagaggagaagggggatgtggagggcgaacctggcggcagcgcaaaagatg

SEQ ID NO: 134515 - DNA, 103 bp, Artificial Sequence
  Synthetic Polynucleotide
taatacgactcactatagggtgcgagagcgcgaagcccgcggcgccctccaacagaggagaggagggatgcgcgggcttaacctggcggcagcgcaaaagatg

SEQ ID NO: 134516 - DNA, 103 bp, Artificial Sequence
  Synthetic Polynucleotide
taatacgactcactataggggtcgcccacctgcgagagcgcgaagcccgcaacagaggagagcgggcatggcgctctcgaacctggcggcagcgcaaaagatg

SEQ ID NO: 134517 - DNA, 103 bp, Artificial Sequence
  Synthetic Polynucleotide
taatacgactcactatagggggaaagccaggtcgcccacctgcgagagcgaacagaggagacgctctatgaggtgggcgaacctggcggcagcgcaaaagatg

SEQ ID NO: 134518 - DNA, 103 bp, Artificial Sequence
  Synthetic Polynucleotide
taatacgactcactatagggtcaaagcgagggaaagccaggtcgcccaccaacagaggagaggtgggatgcctggctttaacctggcggcagcgcaaaagatg

SEQ ID NO: 134519 - DNA, 103 bp, Artificial Sequence
  Synthetic Polynucleotide
taatacgactcactatagggcgccgggatctcaaagcgagggaaagccagaacagaggagactggctatgcctcgctttaacctggcggcagcgcaaaagatg

SEQ ID NO: 134520 - DNA, 103 bp, Artificial Sequence
  Synthetic Polynucleotide
taatacgactcactatagggcaaacctctgcgccgggatctcaaagcgagaacagaggagactcgctatgagatcccggaacctggcggcagcgcaaaagatg

SEQ ID NO: 134521 - DNA, 103 bp, Artificial Sequence
  Synthetic Polynucleotide
taatacgactcactatagggtggggctgtgcgctggcggtgccggcagcgaacagaggagacgctgcatgcaccgccagaacctggcggcagcgcaaaagatg

SEQ ID NO: 134522 - DNA, 103 bp, Artificial Sequence
  Synthetic Polynucleotide
taatacgactcactataggggcgggcagggcaaacctctgcgccgggatcaacagaggagagatcccatggcagaggttaacctggcggcagcgcaaaagatg

SEQ ID NO: 134523 - DNA, 103 bp, Artificial Sequence
  Synthetic Polynucleotide
taatacgactcactatagggcaggtagtgcgcgggcagggcaaacctctgaacagaggagacagaggatggccctgcccaacctggcggcagcgcaaaagatg

SEQ ID NO: 134524 - DNA, 103 bp, Artificial Sequence
  Synthetic Polynucleotide
taatacgactcactataggggggagcgctccaggtagtgcgcgggcagggaacagaggagaccctgcatgcgcactaccaacctggcggcagcgcaaaagatg

SEQ ID NO: 134525 - DNA, 103 bp, Artificial Sequence
  Synthetic Polynucleotide
taatacgactcactatagggcaccaggctggggagcgctccaggtagtgcaacagaggagagcactaatgggagcgctcaacctggcggcagcgcaaaagatg

SEQ ID NO: 134526 - DNA, 103 bp, Artificial Sequence
  Synthetic Polynucleotide
taatacgactcactataggggtaggggtaccaccaggctggggagcgctcaacagaggagagagcgcatgccagcctggaacctggcggcagcgcaaaagatg

SEQ ID NO: 134527 - DNA, 103 bp, Artificial Sequence
  Synthetic Polynucleotide
taatacgactcactataggggggtcagggtgtaggggtaccaccaggctgaacagaggagacagcctatgggtacccctaacctggcggcagcgcaaaagatg

SEQ ID NO: 134528 - DNA, 103 bp, Artificial Sequence
  Synthetic Polynucleotide
taatacgactcactatagggccgccggcgggggtcagggtgtaggggtacaacagaggagagtacccatgcaccctgacaacctggcggcagcgcaaaagatg

SEQ ID NO: 134529 - DNA, 103 bp, Artificial Sequence
  Synthetic Polynucleotide
taatacgactcactatagggcgggaggtggccgccggcgggggtcagggtaacagaggagaaccctgatgcccgccggcaacctggcggcagcgcaaaagatg

SEQ ID NO: 134530 - DNA, 103 bp, Artificial Sequence
  Synthetic Polynucleotide
taatacgactcactatagggcttcaggtcgcgggaggtggccgccggcggaacagaggagaccgccgatggccacctccaacctggcggcagcgcaaaagatg

SEQ ID NO: 134531 - DNA, 103 bp, Artificial Sequence
  Synthetic Polynucleotide
taatacgactcactatagggttctccgaggcttcaggtcgcgggaggtggaacagaggagaccacctatggcgacctgaaacctggcggcagcgcaaaagatg

SEQ ID NO: 134532 - DNA, 103 bp, Artificial Sequence
  Synthetic Polynucleotide
taatacgactcactatagggcggcggcggttggggctgtgcgctggcggtaacagaggagaaccgccatggcacagcccaacctggcggcagcgcaaaagatg

SEQ ID NO: 134533 - DNA, 103 bp, Artificial Sequence
  Synthetic Polynucleotide
taatacgactcactatagggcagcaaggccttctccgaggcttcaggtcgaacagaggagacgacctatggcctcggagaacctggcggcagcgcaaaagatg

SEQ ID NO: 134534 - DNA, 103 bp, Artificial Sequence
  Synthetic Polynucleotide
taatacgactcactatagggaggagtctctcagcaaggccttctccgaggaacagaggagacctcggatgaggccttgcaacctggcggcagcgcaaaagatg

SEQ ID NO: 134535 - DNA, 103 bp, Artificial Sequence
  Synthetic Polynucleotide
taatacgactcactataggggaggcgggggaggagtctctcagcaaggccaacagaggagaggccttatggagagactcaacctggcggcagcgcaaaagatg

SEQ ID NO: 134536 - DNA, 103 bp, Artificial Sequence
  Synthetic Polynucleotide
taatacgactcactataggggtctgtgccggaggcgggggaggagtctctaacagaggagaagagacatgtcccccgccaacctggcggcagcgcaaaagatg

SEQ ID NO: 134537 - DNA, 103 bp, Artificial Sequence
  Synthetic Polynucleotide
taatacgactcactataggggagagtcgcggtctgtgccggaggcgggggaacagaggagacccccgatgccggcacagaacctggcggcagcgcaaaagatg

SEQ ID NO: 134538 - DNA, 103 bp, Artificial Sequence
  Synthetic Polynucleotide
taatacgactcactatagggagtggctccggagagtcgcggtctgtgccgaacagaggagacggcacatgccgcgactcaacctggcggcagcgcaaaagatg

SEQ ID NO: 134539 - DNA, 103 bp, Artificial Sequence
  Synthetic Polynucleotide
taatacgactcactatagggggccttgagcagtggctccggagagtcgcgaacagaggagacgcgacatgccggagccaaacctggcggcagcgcaaaagatg

SEQ ID NO: 134540 - DNA, 103 bp, Artificial Sequence
  Synthetic Polynucleotide
taatacgactcactataggggatcggggtcggccttgagcagtggctccgaacagaggagacggagcatgtgctcaaggaacctggcggcagcgcaaaagatg

SEQ ID NO: 134541 - DNA, 103 bp, Artificial Sequence
  Synthetic Polynucleotide
taatacgactcactatagggagctccttgtgatcggggtcggccttgagcaacagaggagagctcaaatgcgaccccgaaacctggcggcagcgcaaaagatg

SEQ ID NO: 134542 - DNA, 103 bp, Artificial Sequence
  Synthetic Polynucleotide
taatacgactcactatagggcttggagtccagctccttgtgatcggggtcaacagaggagagaccccatgcacaaggagaacctggcggcagcgcaaaagatg

SEQ ID NO: 134543 - DNA, 103 bp, Artificial Sequence
  Synthetic Polynucleotide
taatacgactcactataggggtggggggggcggcggcggttggggctgtgaacagaggagacacagcatgaaccgccgcaacctggcggcagcgcaaaagatg

SEQ ID NO: 134544 - DNA, 103 bp, Artificial Sequence
  Synthetic Polynucleotide
taatacgactcactatagggcgtccgggctcttggagtccagctccttgtaacagaggagaacaaggatgtggactccaaacctggcggcagcgcaaaagatg

SEQ ID NO: 134545 - DNA, 103 bp, Artificial Sequence
  Synthetic Polynucleotide
taatacgactcactatagggagaatgatctcgtccgggctcttggagtccaacagaggagaggactcatggagcccggaaacctggcggcagcgcaaaagatg

SEQ ID NO: 134546 - DNA, 103 bp, Artificial Sequence
  Synthetic Polynucleotide
taatacgactcactataggggctctcctccagaatgatctcgtccgggctaacagaggagaagcccgatggagatcattaacctggcggcagcgcaaaagatg

SEQ ID NO: 134547 - DNA, 103 bp, Artificial Sequence
  Synthetic Polynucleotide
taatacgactcactatagggcctcggagtcgctctcctccagaatgatctaacagaggagaagatcaatgtggaggagaaacctggcggcagcgcaaaagatg

SEQ ID NO: 134548 - DNA, 103 bp, Artificial Sequence
  Synthetic Polynucleotide
taatacgactcactatagggtttttgctttcctcggagtcgctctcctccaacagaggagaggaggaatgcgactccgaaacctggcggcagcgcaaaagatg

SEQ ID NO: 134549 - DNA, 103 bp, Artificial Sequence
  Synthetic Polynucleotide
taatacgactcactatagggttcgccttcctttttgctttcctcggagtcaacagaggagagactccatggaaagcaaaaacctggcggcagcgcaaaagatg

SEQ ID NO: 134550 - DNA, 103 bp, Artificial Sequence
  Synthetic Polynucleotide
taatacgactcactatagggctggcgccgcttcgccttcctttttgctttaacagaggagaaaagcaatgaggaaggcgaacctggcggcagcgcaaaagatg

SEQ ID NO: 134551 - DNA, 103 bp, Artificial Sequence
  Synthetic Polynucleotide
taatacgactcactatagggccggccgcgcctggcgccgcttcgccttccaacagaggagaggaaggatgagcggcgccaacctggcggcagcgcaaaagatg

SEQ ID NO: 134552 - DNA, 103 bp, Artificial Sequence
  Synthetic Polynucleotide
taatacgactcactatagggtacgctcgccccggccgcgcctggcgccgcaacagaggagagcggcgatgggcgcggccaacctggcggcagcgcaaaagatg

SEQ ID NO: 134553 - DNA, 103 bp, Artificial Sequence
  Synthetic Polynucleotide
taatacgactcactatagggccgccgcccctacgctcgccccggccgcgcaacagaggagagcgcggatggggcgagcgaacctggcggcagcgcaaaagatg

SEQ ID NO: 134554 - DNA, 103 bp, Artificial Sequence
  Synthetic Polynucleotide
taatacgactcactatagggttgggagcgggtggggggggcggcggcggtaacagaggagaaccgccatggccccccccaacctggcggcagcgcaaaagatg

SEQ ID NO: 134555 - DNA, 103 bp, Artificial Sequence
  Synthetic Polynucleotide
taatacgactcactatagggggagtggccgccgccgcccctacgctcgccaacagaggagaggcgagatgaggggcggcaacctggcggcagcgcaaaagatg

SEQ ID NO: 134556 - DNA, 103 bp, Artificial Sequence
  Synthetic Polynucleotide
taatacgactcactatagggttctgcgcccggagtggccgccgccgccccaacagaggagaggggcgatggcggccactaacctggcggcagcgcaaaagatg

SEQ ID NO: 134557 - DNA, 103 bp, Artificial Sequence
  Synthetic Polynucleotide
taatacgactcactatagggtcttccagtcttctgcgcccggagtggccgaacagaggagacggccaatgcgggcgcagaacctggcggcagcgcaaaagatg

SEQ ID NO: 134558 - DNA, 103 bp, Artificial Sequence
  Synthetic Polynucleotide
taatacgactcactatagggtcagcgcccttcttccagtcttctgcgcccaacagaggagagggcgcatgagactggaaaacctggcggcagcgcaaaagatg

SEQ ID NO: 134559 - DNA, 103 bp, Artificial Sequence
  Synthetic Polynucleotide
taatacgactcactatagggctctggactttcagcgcccttcttccagtcaacagaggagagactggatgaagggcgctaacctggcggcagcgcaaaagatg

SEQ ID NO: 134560 - DNA, 103 bp, Artificial Sequence
  Synthetic Polynucleotide
taatacgactcactatagggccggcttcttctctggactttcagcgccctaacagaggagaagggcgatgaaagtccagaacctggcggcagcgcaaaagatg

SEQ ID NO: 134561 - DNA, 103 bp, Artificial Sequence
  Synthetic Polynucleotide
taatacgactcactatagggttgcggcacgccggcttcttctctggacttaacagaggagaaagtccatggaagaagccaacctggcggcagcgcaaaagatg

SEQ ID NO: 134562 - DNA, 103 bp, Artificial Sequence
  Synthetic Polynucleotide
taatacgactcactatagggcgtcttcttcttgcggcacgccggcttcttaacagaggagaaagaagatggcgtgccgcaacctggcggcagcgcaaaagatg

SEQ ID NO: 134563 - DNA, 103 bp, Artificial Sequence
  Synthetic Polynucleotide
taatacgactcactatagggagactgtgcgcgtcttcttcttgcggcacgaacagaggagacgtgccatgagaagaagaaacctggcggcagcgcaaaagatg

SEQ ID NO: 134564 - DNA, 103 bp, Artificial Sequence
  Synthetic Polynucleotide
taatacgactcactatagggctgcgcgagaagactgtgcgcgtcttcttcaacagaggagagaagaaatggcgcacagtaacctggcggcagcgcaaaagatg

SEQ ID NO: 134565 - DNA, 103 bp, Artificial Sequence
  Synthetic Polynucleotide
taatacgactcactatagggcggggactccttgggagcgggtggggggggaacagaggagaccccccatgcccgctcccaacctggcggcagcgcaaaagatg

SEQ ID NO: 134566 - DNA, 103 bp, Artificial Sequence
  Synthetic Polynucleotide
taatacgactcactataggggaagacctggctgcgcgagaagactgtgcgaacagaggagacgcacaatgttctcgcgcaacctggcggcagcgcaaaagatg

SEQ ID NO: 134567 - DNA, 103 bp, Artificial Sequence
  Synthetic Polynucleotide
taatacgactcactatagggactcgagctggaagacctggctgcgcgagaaacagaggagatctcgcatggccaggtctaacctggcggcagcgcaaaagatg

SEQ ID NO: 134568 - DNA, 103 bp, Artificial Sequence
  Synthetic Polynucleotide
taatacgactcactatagggtcgaaggtggactcgagctggaagacctggaacagaggagaccaggtatgccagctcgaaacctggcggcagcgcaaaagatg

SEQ ID NO: 134569 - DNA, 103 bp, Artificial Sequence
  Synthetic Polynucleotide
taatacgactcactataggggcgcttcatgtcgaaggtggactcgagctgaacagaggagacagctcatgtccaccttcaacctggcggcagcgcaaaagatg

SEQ ID NO: 134570 - DNA, 103 bp, Artificial Sequence
  Synthetic Polynucleotide
taatacgactcactatagggtgctcagatagcgcttcatgtcgaaggtggaacagaggagaccacctatgacatgaagcaacctggcggcagcgcaaaagatg

SEQ ID NO: 134571 - DNA, 103 bp, Artificial Sequence
  Synthetic Polynucleotide
taatacgactcactatagggcgctccgagctgctcagatagcgcttcatgaacagaggagacatgaaatgctatctgagaacctggcggcagcgcaaaagatg

SEQ ID NO: 134572 - DNA, 103 bp, Artificial Sequence
  Synthetic Polynucleotide
taatacgactcactatagggcaggccggctcgctccgagctgctcagataaacagaggagatatctgatgagctcggagaacctggcggcagcgcaaaagatg

SEQ ID NO: 134573 - DNA, 103 bp, Artificial Sequence
  Synthetic Polynucleotide
taatacgactcactataggggggacgcggccaggccggctcgctccgagcaacagaggagagctcggatggagccggccaacctggcggcagcgcaaaagatg

SEQ ID NO: 134574 - DNA, 103 bp, Artificial Sequence
  Synthetic Polynucleotide
taatacgactcactataggggtgaggtgcagggacgcggccaggccggctaacagaggagaagccggatgggccgcgtcaacctggcggcagcgcaaaagatg

SEQ ID NO: 134575 - DNA, 103 bp, Artificial Sequence
  Synthetic Polynucleotide
taatacgactcactatagggctgcgtctcggtgaggtgcagggacgcggcaacagaggagagccgcgatgctgcacctcaacctggcggcagcgcaaaagatg

SEQ ID NO: 134576 - DNA, 103 bp, Artificial Sequence
  Synthetic Polynucleotide
taatacgactcactatagggtgatggagaacggggactccttgggagcggaacagaggagaccgctcatgaggagtcccaacctggcggcagcgcaaaagatg

SEQ ID NO: 134577 - DNA, 103 bp, Artificial Sequence
  Synthetic Polynucleotide
taatacgactcactatagggagatcttgacctgcgtctcggtgaggtgcaaacagaggagatgcaccatgccgagacgcaacctggcggcagcgcaaaagatg

SEQ ID NO: 134578 - DNA, 103 bp, Artificial Sequence
  Synthetic Polynucleotide
taatacgactcactatagggttctggaaccagatcttgacctgcgtctcgaacagaggagacgagacatgggtcaagataacctggcggcagcgcaaaagatg

SEQ ID NO: 134579 - DNA, 103 bp, Artificial Sequence
  Synthetic Polynucleotide
taatacgactcactataggggttgcggcggttctggaaccagatcttgacaacagaggagagtcaagatgtggttccagaacctggcggcagcgcaaaagatg

SEQ ID NO: 134580 - DNA, 103 bp, Artificial Sequence
  Synthetic Polynucleotide
taatacgactcactataggggcttccacttgttgcggcggttctggaaccaacagaggagaggttccatgaccgccgcaaacctggcggcagcgcaaaagatg

SEQ ID NO: 134581 - DNA, 103 bp, Artificial Sequence
  Synthetic Polynucleotide
taatacgactcactataggggccagctgccgcttccacttgttgcggcggaacagaggagaccgccgatgcaagtggaaaacctggcggcagcgcaaaagatg

SEQ ID NO: 134582 - DNA, 103 bp, Artificial Sequence
  Synthetic Polynucleotide
taatacgactcactatagggcagctccgccgccagctgccgcttccacttaacagaggagaaagtggatgcggcagctgaacctggcggcagcgcaaaagatg

SEQ ID NO: 134583 - DNA, 103 bp, Artificial Sequence
  Synthetic Polynucleotide
taatacgactcactatagggtggccgcctccagctccgccgccagctgccaacagaggagaggcagcatgcggcggagcaacctggcggcagcgcaaaagatg

SEQ ID NO: 134584 - DNA, 103 bp, Artificial Sequence
  Synthetic Polynucleotide
taatacgactcactatagggtggctcaggttggccgcctccagctccgccaacagaggagaggcggaatgggaggcggcaacctggcggcagcgcaaaagatg

SEQ ID NO: 134585 - DNA, 103 bp, Artificial Sequence
  Synthetic Polynucleotide
taatacgactcactatagggcgccgcggcatggctcaggttggccgcctcaacagaggagagaggcgatgaacctgagcaacctggcggcagcgcaaaagatg

SEQ ID NO: 134586 - DNA, 103 bp, Artificial Sequence
  Synthetic Polynucleotide
taatacgactcactatagggcgatgcgctgcgccgcggcatggctcaggtaacagaggagaacctgaatgatgccgcggaacctggcggcagcgcaaaagatg

SEQ ID NO: 134587 - DNA, 103 bp, Artificial Sequence
  Synthetic Polynucleotide
taatacgactcactatagggagcaggttcttgatggagaacggggactccaacagaggagaggagtcatggttctccataacctggcggcagcgcaaaagatg

SEQ ID NO: 134588 - DNA, 103 bp, Artificial Sequence
  Synthetic Polynucleotide
taatacgactcactatagggggcacccgcacgatgcgctgcgccgcggcaaacagaggagatgccgcatggcagcgcataacctggcggcagcgcaaaagatg

SEQ ID NO: 134589 - DNA, 103 bp, Artificial Sequence
  Synthetic Polynucleotide
taatacgactcactataggggtagaggatgggcacccgcacgatgcgctgaacagaggagacagcgcatggtgcgggtgaacctggcggcagcgcaaaagatg

SEQ ID NO: 134590 - DNA, 103 bp, Artificial Sequence
  Synthetic Polynucleotide
taatacgactcactatagggagttctcgtggtagaggatgggcacccgcaaacagaggagatgcgggatgccatcctctaacctggcggcagcgcaaaagatg

SEQ ID NO: 134591 - DNA, 103 bp, Artificial Sequence
  Synthetic Polynucleotide
taatacgactcactatagggtcggccgccgagttctcgtggtagaggatgaacagaggagacatcctatgccacgagaaaacctggcggcagcgcaaaagatg

SEQ ID NO: 134592 - DNA, 103 bp, Artificial Sequence
  Synthetic Polynucleotide
taatacgactcactatagggcgccgcgccctcggccgccgagttctcgtgaacagaggagacacgagatgtcggcggccaacctggcggcagcgcaaaagatg

SEQ ID NO: 134593 - DNA, 103 bp, Artificial Sequence
  Synthetic Polynucleotide
taatacgactcactatagggcggctgcagccgccgcgccctcggccgccgaacagaggagacggcggatgagggcgcggaacctggcggcagcgcaaaagatg

SEQ ID NO: 134594 - DNA, 103 bp, Artificial Sequence
  Synthetic Polynucleotide
taatacgactcactatagggggggcccccgcggctgcagccgccgcgcccaacagaggagagggcgcatgggctgcagcaacctggcggcagcgcaaaagatg

SEQ ID NO: 134595 - DNA, 103 bp, Artificial Sequence
  Synthetic Polynucleotide
taatacgactcactataggggactggcaccggggcccccgcggctgcagcaacagaggagagctgcaatggcgggggccaacctggcggcagcgcaaaagatg

SEQ ID NO: 134596 - DNA, 103 bp, Artificial Sequence
  Synthetic Polynucleotide
taatacgactcactataggggcggctggctgactggcaccggggcccccgaacagaggagacgggggatgcggtgccagaacctggcggcagcgcaaaagatg

SEQ ID NO: 134597 - DNA, 103 bp, Artificial Sequence
  Synthetic Polynucleotide
taatacgactcactatagggaaggtgagcagcggctggctgactggcaccaacagaggagaggtgccatgcagccagccaacctggcggcagcgcaaaagatg

SEQ ID NO: 134598 - DNA, 103 bp, Artificial Sequence
  Synthetic Polynucleotide
taatacgactcactatagggcgtctgcagctggctcagtttagaaaccataacagaggagaatggttatgaaactgagcaacctggcggcagcgcaaaagatg

SEQ ID NO: 134599 - DNA, 103 bp, Artificial Sequence
  Synthetic Polynucleotide
taatacgactcactatagggtccagccaggaggtagggccccggctcaccaacagaggagaggtgagatggggccctacaacctggcggcagcgcaaaagatg

SEQ ID NO: 134600 - DNA, 103 bp, Artificial Sequence
  Synthetic Polynucleotide
taatacgactcactataggggggggccttctccagccaggaggtagggccaacagaggagaggccctatgtcctggctgaacctggcggcagcgcaaaagatg

SEQ ID NO: 134601 - DNA, 103 bp, Artificial Sequence
  Synthetic Polynucleotide
taatacgactcactatagggcccttgtccagggggccttctccagccaggaacagaggagacctggcatgagaaggcccaacctggcggcagcgcaaaagatg

SEQ ID NO: 134602 - DNA, 103 bp, Artificial Sequence
  Synthetic Polynucleotide
taatacgactcactataggggcaggactcccccttgtccagggggccttcaacagaggagagaaggcatgctggacaagaacctggcggcagcgcaaaagatg

SEQ ID NO: 134603 - DNA, 103 bp, Artificial Sequence
  Synthetic Polynucleotide
taatacgactcactataggggaccgccgccgcaggactcccccttgtccaaacagaggagatggacaatggggagtcctaacctggcggcagcgcaaaagatg

SEQ ID NO: 134604 - DNA, 103 bp, Artificial Sequence
  Synthetic Polynucleotide
taatacgactcactatagggagctcccctcgaccgccgccgcaggactccaacagaggagaggagtcatgcggcggcggaacctggcggcagcgcaaaagatg

SEQ ID NO: 134605 - DNA, 103 bp, Artificial Sequence
  Synthetic Polynucleotide
taatacgactcactatagggcagctcagccagctcccctcgaccgccgccaacagaggagaggcggcatgcgaggggagaacctggcggcagcgcaaaagatg

SEQ ID NO: 134606 - DNA, 103 bp, Artificial Sequence
  Synthetic Polynucleotide
taatacgactcactataggggcccattgggcagctcagccagctcccctcaacagaggagagaggggatgtggctgagcaacctggcggcagcgcaaaagatg

SEQ ID NO: 134607 - DNA, 103 bp, Artificial Sequence
  Synthetic Polynucleotide
taatacgactcactataggggtctcccccagcccattgggcagctcagccaacagaggagaggctgaatggcccaatggaacctggcggcagcgcaaaagatg

SEQ ID NO: 134608 - DNA, 103 bp, Artificial Sequence
  Synthetic Polynucleotide
taatacgactcactatagggggagccccgagtctcccccagcccattgggaacagaggagacccaatatgctgggggagaacctggcggcagcgcaaaagatg

SEQ ID NO: 134609 - DNA, 103 bp, Artificial Sequence
  Synthetic Polynucleotide
taatacgactcactatagggccaggagctccgtctgcagctggctcagttaacagaggagaaactgaatgagctgcagaaacctggcggcagcgcaaaagatg

SEQ ID NO: 134610 - DNA, 103 bp, Artificial Sequence
  Synthetic Polynucleotide
taatacgactcactatagggtctcgtcctcggagccccgagtctcccccaaacagaggagatgggggatgctcggggctaacctggcggcagcgcaaaagatg

SEQ ID NO: 134611 - DNA, 103 bp, Artificial Sequence
  Synthetic Polynucleotide
taatacgactcactatagggtcgtcgtccgtctcgtcctcggagccccgaaacagaggagatcggggatgcgaggacgaaacctggcggcagcgcaaaagatg

SEQ ID NO: 134612 - DNA, 103 bp, Artificial Sequence
  Synthetic Polynucleotide
taatacgactcactataggggtcttccccatcgtcgtccgtctcgtcctcaacagaggagagaggacatgacggacgacaacctggcggcagcgcaaaagatg

SEQ ID NO: 134613 - DNA, 103 bp, Artificial Sequence
  Synthetic Polynucleotide
taatacgactcactataggggtggcgtgaagtcttccccatcgtcgtccgaacagaggagacggacgatgatggggaagaacctggcggcagcgcaaaagatg

SEQ ID NO: 134614 - DNA, 103 bp, Artificial Sequence
  Synthetic Polynucleotide
taatacgactcactatagggttgaggatgggtggcgtgaagtcttccccaaacagaggagatggggaatgcttcacgccaacctggcggcagcgcaaaagatg

SEQ ID NO: 134615 - DNA, 103 bp, Artificial Sequence
  Synthetic Polynucleotide
taatacgactcactatagggctccagctctttgaggatgggtggcgtgaaaacagaggagattcacgatgcccatcctcaacctggcggcagcgcaaaagatg

SEQ ID NO: 134616 - DNA, 103 bp, Artificial Sequence
  Synthetic Polynucleotide
taatacgactcactatagggggctgaggttctccagctctttgaggatggaacagaggagaccatccatgaagagctggaacctggcggcagcgcaaaagatg

SEQ ID NO: 134617 - DNA, 103 bp, Artificial Sequence
  Synthetic Polynucleotide
taatacgactcactataggggcctcctcagggctgaggttctccagctctaacagaggagaagagctatggaacctcagaacctggcggcagcgcaaaagatg

SEQ ID NO: 134618 - DNA, 103 bp, Artificial Sequence
  Synthetic Polynucleotide
taatacgactcactatagggctggtgggccgcctcctcagggctgaggttaacagaggagaaacctcatgcctgaggagaacctggcggcagcgcaaaagatg

SEQ ID NO: 134619 - DNA, 103 bp, Artificial Sequence
  Synthetic Polynucleotide
taatacgactcactatagggccacggctttctggtgggccgcctcctcagaacagaggagactgaggatgcggcccaccaacctggcggcagcgcaaaagatg

SEQ ID NO: 134620 - DNA, 103 bp, Artificial Sequence
  Synthetic Polynucleotide
taatacgactcactatagggagcagggccgccaggagctccgtctgcagcaacagaggagagctgcaatgggagctcctaacctggcggcagcgcaaaagatg

SEQ ID NO: 134621 - DNA, 103 bp, Artificial Sequence
  Synthetic Polynucleotide
taatacgactcactatagggagggtctccaccacggctttctggtgggccaacagaggagaggcccaatggaaagccgtaacctggcggcagcgcaaaagatg

SEQ ID NO: 134622 - DNA, 103 bp, Artificial Sequence
  Synthetic Polynucleotide
taatacgactcactatagggctcctgcagaagggtctccaccacggctttaacagaggagaaaagccatggtggagaccaacctggcggcagcgcaaaagatg

SEQ ID NO: 134623 - DNA, 103 bp, Artificial Sequence
  Synthetic Polynucleotide
taatacgactcactataggggccacgggtcctcctgcagaagggtctccaaacagaggagatggagaatgttctgcaggaacctggcggcagcgcaaaagatg

SEQ ID NO: 134624 - DNA, 103 bp, Artificial Sequence
  Synthetic Polynucleotide
taatacgactcactatagggttcgccacacgccacgggtcctcctgcagaaacagaggagatctgcaatgggacccgtgaacctggcggcagcgcaaaagatg

SEQ ID NO: 134625 - DNA, 103 bp, Artificial Sequence
  Synthetic Polynucleotide
taatacgactcactatagggcttgaccatcttcgccacacgccacgggtcaacagaggagagacccgatgcgtgtggcgaacctggcggcagcgcaaaagatg

SEQ ID NO: 134626 - DNA, 103 bp, Artificial Sequence
  Synthetic Polynucleotide
taatacgactcactataggggcaggtaggacttgaccatcttcgccacacaacagaggagagtgtggatgagatggtcaaacctggcggcagcgcaaaagatg

SEQ ID NO: 134627 - DNA, 103 bp, Artificial Sequence
  Synthetic Polynucleotide
taatacgactcactatagggttgtgctgctgcaggtaggacttgaccatcaacagaggagagatggtatggtcctacctaacctggcggcagcgcaaaagatg

SEQ ID NO: 134628 - DNA, 103 bp, Artificial Sequence
  Synthetic Polynucleotide
taatacgactcactatagggctgtgggatgttgtgctgctgcaggtaggaaacagaggagatcctacatgcagcagcacaacctggcggcagcgcaaaagatg

SEQ ID NO: 134629 - DNA, 103 bp, Artificial Sequence
  Synthetic Polynucleotide
taatacgactcactatagggccacctcccgctgtgggatgttgtgctgctaacagaggagaagcagcatgacatcccacaacctggcggcagcgcaaaagatg

SEQ ID NO: 134630 - DNA, 103 bp, Artificial Sequence
  Synthetic Polynucleotide
taatacgactcactataggggtggtatcgaccacctcccgctgtgggatgaacagaggagacatcccatggcgggaggtaacctggcggcagcgcaaaagatg

SEQ ID NO: 134631 - DNA, 103 bp, Artificial Sequence
  Synthetic Polynucleotide
taatacgactcactatagggccctgactcgagcagggccgccaggagctcaacagaggagagagctcatggcggccctgaacctggcggcagcgcaaaagatg

SEQ ID NO: 134632 - DNA, 103 bp, Artificial Sequence
  Synthetic Polynucleotide
taatacgactcactataggggttgaggccagtggtatcgaccacctcccgaacagaggagacgggagatggtcgataccaacctggcggcagcgcaaaagatg

SEQ ID NO: 134633 - DNA, 103 bp, Artificial Sequence
  Synthetic Polynucleotide
taatacgactcactatagggggtgggactggttgaggccagtggtatcgaaacagaggagatcgataatgctggcctcaaacctggcggcagcgcaaaagatg

SEQ ID NO: 134634 - DNA, 103 bp, Artificial Sequence
  Synthetic Polynucleotide
taatacgactcactatagggtgttgggacaggtgggactggttgaggccaaacagaggagatggcctatgccagtcccaaacctggcggcagcgcaaaagatg

SEQ ID NO: 134635 - DNA, 103 bp, Artificial Sequence
  Synthetic Polynucleotide
taatacgactcactatagggcttgttgaggtgttgggacaggtgggactgaacagaggagacagtccatgctgtcccaaaacctggcggcagcgcaaaagatg

SEQ ID NO: 134636 - DNA, 103 bp, Artificial Sequence
  Synthetic Polynucleotide
taatacgactcactatagggtgggagtgcccttgttgaggtgttgggacaaacagaggagatgtcccatgacctcaacaaacctggcggcagcgcaaaagatg

SEQ ID NO: 134637 - DNA, 103 bp, Artificial Sequence
  Synthetic Polynucleotide
taatacgactcactatagggtgcgtcttcatgggagtgcccttgttgaggaacagaggagacctcaaatggggcactccaacctggcggcagcgcaaaagatg

SEQ ID NO: 134638 - DNA, 103 bp, Artificial Sequence
  Synthetic Polynucleotide
taatacgactcactatagggggcccgcttctgcgtcttcatgggagtgccaacagaggagaggcactatgatgaagacgaacctggcggcagcgcaaaagatg

SEQ ID NO: 134639 - DNA, 103 bp, Artificial Sequence
  Synthetic Polynucleotide
taatacgactcactatagggtgtacagggcggcccgcttctgcgtcttcaaacagaggagatgaagaatgagaagcgggaacctggcggcagcgcaaaagatg

SEQ ID NO: 134640 - DNA, 103 bp, Artificial Sequence
  Synthetic Polynucleotide
taatacgactcactatagggacgtaccaggtgtacagggcggcccgcttcaacagaggagagaagcgatgcgccctgtaaacctggcggcagcgcaaaagatg

SEQ ID NO: 134641 - DNA, 103 bp, Artificial Sequence
  Synthetic Polynucleotide
taatacgactcactatagggctgcttgcggacgtaccaggtgtacagggcaacagaggagagccctgatgacctggtacaacctggcggcagcgcaaaagatg

SEQ ID NO: 134642 - DNA, 103 bp, Artificial Sequence
  Synthetic Polynucleotide
taatacgactcactatagggctttgctcagccctgactcgagcagggccgaacagaggagacggcccatgtcgagtcagaacctggcggcagcgcaaaagatg

SEQ ID NO: 134643 - DNA, 103 bp, Artificial Sequence
  Synthetic Polynucleotide
taatacgactcactatagggccacctctcgctgcttgcggacgtaccaggaacagaggagacctggtatgtccgcaagcaacctggcggcagcgcaaaagatg

SEQ ID NO: 134644 - DNA, 103 bp, Artificial Sequence
  Synthetic Polynucleotide
taatacgactcactatagggcgccgctgcgccacctctcgctgcttgcggaacagaggagaccgcaaatggcgagaggtaacctggcggcagcgcaaaagatg

SEQ ID NO: 134645 - DNA, 103 bp, Artificial Sequence
  Synthetic Polynucleotide
taatacgactcactatagggggatgcattccgccgctgcgccacctctcgaacagaggagacgagagatggcgcagcggaacctggcggcagcgcaaaagatg

SEQ ID NO: 134646 - DNA, 103 bp, Artificial Sequence
  Synthetic Polynucleotide
taatacgactcactatagggacccctctctggatgcattccgccgctgcgaacagaggagacgcagcatgggaatgcataacctggcggcagcgcaaaagatg

SEQ ID NO: 134647 - DNA, 103 bp, Artificial Sequence
  Synthetic Polynucleotide
taatacgactcactatagggtgatggggacacccctctctggatgcattcaacagaggagagaatgcatgcagagagggaacctggcggcagcgcaaaagatg

SEQ ID NO: 134648 - DNA, 103 bp, Artificial Sequence
  Synthetic Polynucleotide
taatacgactcactatagggcctgtgcctgtgatggggacacccctctctaacagaggagaagagagatgtgtccccataacctggcggcagcgcaaaagatg

SEQ ID NO: 134649 - DNA, 103 bp, Artificial Sequence
  Synthetic Polynucleotide
taatacgactcactataggggagcccagcccctgtgcctgtgatggggacaacagaggagagtccccatgacaggcacaaacctggcggcagcgcaaaagatg

SEQ ID NO: 134650 - DNA, 103 bp, Artificial Sequence
  Synthetic Polynucleotide
taatacgactcactataggggacgaggttggagcccagcccctgtgcctgaacagaggagacaggcaatggggctgggcaacctggcggcagcgcaaaagatg

SEQ ID NO: 134651 - DNA, 103 bp, Artificial Sequence
  Synthetic Polynucleotide
taatacgactcactataggggcacctccgtgacgaggttggagcccagccaacagaggagaggctggatgccaacctcgaacctggcggcagcgcaaaagatg

SEQ ID NO: 134652 - DNA, 103 bp, Artificial Sequence
  Synthetic Polynucleotide
taatacgactcactatagggttgtagacacgcacctccgtgacgaggttgaacagaggagacaacctatgcacggaggtaacctggcggcagcgcaaaagatg

SEQ ID NO: 134653 - DNA, 103 bp, Artificial Sequence
  Synthetic Polynucleotide
taatacgactcactatagggatcagtgcctctttgctcagccctgactcgaacagaggagacgagtcatggctgagcaaaacctggcggcagcgcaaaagatg

SEQ ID NO: 134654 - DNA, 103 bp, Artificial Sequence
  Synthetic Polynucleotide
taatacgactcactatagggggcaaaccagttgtagacacgcacctccgtaacagaggagaacggagatgcgtgtctacaacctggcggcagcgcaaaagatg

SEQ ID NO: 134655 - DNA, 103 bp, Artificial Sequence
  Synthetic Polynucleotide
taatacgactcactatagggtgcgccggttggcaaaccagttgtagacacaacagaggagagtgtctatgactggtttgaacctggcggcagcgcaaaagatg

SEQ ID NO: 134656 - DNA, 103 bp, Artificial Sequence
  Synthetic Polynucleotide
taatacgactcactataggggcttcttctttgcgccggttggcaaaccagaacagaggagactggttatgcaaccggcgaacctggcggcagcgcaaaagatg

SEQ ID NO: 134657 - DNA, 103 bp, Artificial Sequence
  Synthetic Polynucleotide
taatacgactcactataggggtgccggaaggcttcttctttgcgccggttaacagaggagaaaccggatgaaagaagaaaacctggcggcagcgcaaaagatg

SEQ ID NO: 134658 - DNA, 103 bp, Artificial Sequence
  Synthetic Polynucleotide
taatacgactcactatagggtggccagcttgtgccggaaggcttcttcttaacagaggagaaagaagatgccttccggcaacctggcggcagcgcaaaagatg

SEQ ID NO: 134659 - DNA, 103 bp, Artificial Sequence
  Synthetic Polynucleotide
taatacgactcactatagggtacgtgtccatggccagcttgtgccggaagaacagaggagacttccgatgcaagctggcaacctggcggcagcgcaaaagatg

SEQ ID NO: 134660 - DNA, 103 bp, Artificial Sequence
  Synthetic Polynucleotide
taatacgactcactataggggggcccgctgtacgtgtccatggccagcttaacagaggagaaagctgatgatggacacgaacctggcggcagcgcaaaagatg

SEQ ID NO: 134661 - DNA, 103 bp, Artificial Sequence
  Synthetic Polynucleotide
taatacgactcactataggggccctggggggggcccgctgtacgtgtccaaacagaggagatggacaatgacagcgggcaacctggcggcagcgcaaaagatg

SEQ ID NO: 134662 - DNA, 103 bp, Artificial Sequence
  Synthetic Polynucleotide
taatacgactcactatagggcccgggcctggccctggggggggcccgctgaacagaggagacagcggatgccccccaggaacctggcggcagcgcaaaagatg

SEQ ID NO: 134663 - DNA, 103 bp, Artificial Sequence
  Synthetic Polynucleotide
taatacgactcactatagggcagcgcaggtcccgggcctggccctgggggaacagaggagacccccaatgccaggcccgaacctggcggcagcgcaaaagatg

SEQ ID NO: 134664 - DNA, 103 bp, Artificial Sequence
  Synthetic Polynucleotide
taatacgactcactatagggcagtgcctggatcagtgcctctttgctcagaacagaggagactgagcatggaggcactgaacctggcggcagcgcaaaagatg

SEQ ID NO: 134665 - DNA, 103 bp, Artificial Sequence
  Synthetic Polynucleotide
taatacgactcactatagggtgtgagcgggcagcgcaggtcccgggcctgaacagaggagacaggccatggacctgcgcaacctggcggcagcgcaaaagatg

SEQ ID NO: 134666 - DNA, 103 bp, Artificial Sequence
  Synthetic Polynucleotide
taatacgactcactatagggccaggggagctgtgagcgggcagcgcaggtaacagaggagaacctgcatggcccgctcaaacctggcggcagcgcaaaagatg

SEQ ID NO: 134667 - DNA, 103 bp, Artificial Sequence
  Synthetic Polynucleotide
taatacgactcactatagggtggaggcaggccaggggagctgtgagcgggaacagaggagacccgctatgagctcccctaacctggcggcagcgcaaaagatg

SEQ ID NO: 134668 - DNA, 103 bp, Artificial Sequence
  Synthetic Polynucleotide
taatacgactcactatagggagagggcaggtggaggcaggccaggggagcaacagaggagagctcccatggcctgcctcaacctggcggcagcgcaaaagatg

SEQ ID NO: 134669 - DNA, 103 bp, Artificial Sequence
  Synthetic Polynucleotide
taatacgactcactatagggttactgggggagagggcaggtggaggcaggaacagaggagacctgccatgacctgccctaacctggcggcagcgcaaaagatg

SEQ ID NO: 134670 - DNA, 103 bp, Artificial Sequence
  Synthetic Polynucleotide
taatacgactcactatagggaccgtggaccttactgggggagagggcaggaacagaggagacctgccatgtcccccagtaacctggcggcagcgcaaaagatg

SEQ ID NO: 134671 - DNA, 103 bp, Artificial Sequence
  Synthetic Polynucleotide
taatacgactcactatagggcatagcgcacaccgtggaccttactgggggaacagaggagacccccaatgaggtccacgaacctggcggcagcgcaaaagatg

SEQ ID NO: 134672 - DNA, 103 bp, Artificial Sequence
  Synthetic Polynucleotide
taatacgactcactataggggcaggctgtccatagcgcacaccgtggaccaacagaggagaggtccaatgtgtgcgctaaacctggcggcagcgcaaaagatg

SEQ ID NO: 134673 - DNA, 103 bp, Artificial Sequence
  Synthetic Polynucleotide
taatacgactcactatagggctcactggtcgcaggctgtccatagcgcacaacagaggagagtgcgcatgggacagcctaacctggcggcagcgcaaaagatg

SEQ ID NO: 134674 - DNA, 103 bp, Artificial Sequence
  Synthetic Polynucleotide
taatacgactcactatagggcttctgcagtctcactggtcgcaggctgtcaacagaggagagacagcatgcgaccagtgaacctggcggcagcgcaaaagatg

SEQ ID NO: 134675 - DNA, 103 bp, Artificial Sequence
  Synthetic Polynucleotide
taatacgactcactatagggccggctcacccagtgcctggatcagtgcctaacagaggagaaggcacatgtccaggcacaacctggcggcagcgcaaaagatg

SEQ ID NO: 134676 - DNA, 103 bp, Artificial Sequence
  Synthetic Polynucleotide
taatacgactcactatagggcttgagggtacttctgcagtctcactggtcaacagaggagagaccagatggactgcagaaacctggcggcagcgcaaaagatg

SEQ ID NO: 134677 - DNA, 103 bp, Artificial Sequence
  Synthetic Polynucleotide
taatacgactcactatagggaccgccgctgcttgagggtacttctgcagtaacagaggagaactgcaatggtaccctcaaacctggcggcagcgcaaaagatg

SEQ ID NO: 134678 - DNA, 103 bp, Artificial Sequence
  Synthetic Polynucleotide
taatacgactcactatagggaggtagggccccggctcacccagtgcctggaacagaggagaccaggcatggggtgagccaacctggcggcagcgcaaaagatg

SEQ ID NO: 134679 - DNA, 103 bp, Artificial Sequence
  Synthetic Polynucleotide
taatacgactcactatagggttgctggagcgacgtgagcttggacaccataacagaggagaatggtgatgaagctcacgaacctggcggcagcgcaaaagatg

SEQ ID NO: 134680 - DNA, 103 bp, Artificial Sequence
  Synthetic Polynucleotide
taatacgactcactatagggcccgaagttcggggatggcagcaactcctcaacagaggagagaggagatgctgccatccaacctggcggcagcgcaaaagatg

SEQ ID NO: 134681 - DNA, 103 bp, Artificial Sequence
  Synthetic Polynucleotide
taatacgactcactataggggctgggctggtggtggggggagccgtgggaaacagaggagatcccacatgtccccccacaacctggcggcagcgcaaaagatg

SEQ ID NO: 134682 - DNA, 103 bp, Artificial Sequence
  Synthetic Polynucleotide
taatacgactcactataggggaggagaggagctgggctggtggtggggggaacagaggagaccccccatgaccagcccaaacctggcggcagcgcaaaagatg

SEQ ID NO: 134683 - DNA, 103 bp, Artificial Sequence
  Synthetic Polynucleotide
taatacgactcactatagggagcttgtttggaggagaggagctgggctggaacagaggagaccagccatgctcctctccaacctggcggcagcgcaaaagatg

SEQ ID NO: 134684 - DNA, 103 bp, Artificial Sequence
  Synthetic Polynucleotide
taatacgactcactatagggcactcctgacagcttgtttggaggagaggaaacagaggagatcctctatgccaaacaagaacctggcggcagcgcaaaagatg

SEQ ID NO: 134685 - DNA, 103 bp, Artificial Sequence
  Synthetic Polynucleotide
taatacgactcactatagggggctgtagcgcactcctgacagcttgtttgaacagaggagacaaacaatgtgtcaggagaacctggcggcagcgcaaaagatg

SEQ ID NO: 134686 - DNA, 103 bp, Artificial Sequence
  Synthetic Polynucleotide
taatacgactcactatagggtttccctgctggctgtagcgcactcctgacaacagaggagagtcaggatggcgctacagaacctggcggcagcgcaaaagatg

SEQ ID NO: 134687 - DNA, 103 bp, Artificial Sequence
  Synthetic Polynucleotide
taatacgactcactataggggatctcattgtttccctgctggctgtagcgaacagaggagacgctacatgcagcagggaaacctggcggcagcgcaaaagatg

SEQ ID NO: 134688 - DNA, 103 bp, Artificial Sequence
  Synthetic Polynucleotide
taatacgactcactatagggaggaggaagtgatctcattgtttccctgctaacagaggagaagcaggatgacaatgagaaacctggcggcagcgcaaaagatg

SEQ ID NO: 134689 - DNA, 103 bp, Artificial Sequence
  Synthetic Polynucleotide
taatacgactcactatagggctgattgttgaggaggaagtgatctcattgaacagaggagacaatgaatgcacttcctcaacctggcggcagcgcaaaagatg

SEQ ID NO: 134690 - DNA, 103 bp, Artificial Sequence
  Synthetic Polynucleotide
taatacgactcactataggggccatggtgactgattgttgaggaggaagtaacagaggagaacttccatgtcaacaatcaacctggcggcagcgcaaaagatg

SEQ ID NO: 134691 - DNA, 103 bp, Artificial Sequence
  Synthetic Polynucleotide
taatacgactcactatagggccagcttcaccccgaagttcggggatggcaaacagaggagatgccatatgcgaacttcgaacctggcggcagcgcaaaagatg

SEQ ID NO: 134692 - DNA, 103 bp, Artificial Sequence
  Synthetic Polynucleotide
taatacgactcactatagggtggcgctgttgccatggtgactgattgttgaacagaggagacaacaaatggtcaccatgaacctggcggcagcgcaaaagatg

SEQ ID NO: 134693 - DNA, 103 bp, Artificial Sequence
  Synthetic Polynucleotide
taatacgactcactatagggctggtcaccatggcgctgttgccatggtgaaacagaggagatcaccaatgcaacagcgcaacctggcggcagcgcaaaagatg

SEQ ID NO: 134694 - DNA, 103 bp, Artificial Sequence
  Synthetic Polynucleotide
taatacgactcactatagggaaccgactggctggtcaccatggcgctgttaacagaggagaaacagcatgatggtgaccaacctggcggcagcgcaaaagatg

SEQ ID NO: 134695 - DNA, 103 bp, Artificial Sequence
  Synthetic Polynucleotide
taatacgactcactatagggcttgctgtaaaaccgactggctggtcaccaaacagaggagatggtgaatggccagtcggaacctggcggcagcgcaaaagatg

SEQ ID NO: 134696 - DNA, 103 bp, Artificial Sequence
  Synthetic Polynucleotide
taatacgactcactataggggctggggagacttgctgtaaaaccgactggaacagaggagaccagtcatgtttacagcaaacctggcggcagcgcaaaagatg

SEQ ID NO: 134697 - DNA, 103 bp, Artificial Sequence
  Synthetic Polynucleotide
taatacgactcactataggggtccaggctggctggggagacttgctgtaaaacagaggagattacagatggtctccccaaacctggcggcagcgcaaaagatg

SEQ ID NO: 134698 - DNA, 103 bp, Artificial Sequence
  Synthetic Polynucleotide
taatacgactcactatagggtgtggcctgggtccaggctggctggggagaaacagaggagatctcccatgccagcctggaacctggcggcagcgcaaaagatg

SEQ ID NO: 134699 - DNA, 103 bp, Artificial Sequence
  Synthetic Polynucleotide
taatacgactcactataggggagaggagattgtggcctgggtccaggctgaacagaggagacagcctatgcccaggccaaacctggcggcagcgcaaaagatg

SEQ ID NO: 134700 - DNA, 103 bp, Artificial Sequence
  Synthetic Polynucleotide
taatacgactcactatagggaccatcaggtgagaggagattgtggcctggaacagaggagaccaggcatgaatctcctcaacctggcggcagcgcaaaagatg

SEQ ID NO: 134701 - DNA, 103 bp, Artificial Sequence
  Synthetic Polynucleotide
taatacgactcactatagggagatcattttaccatcaggtgagaggagataacagaggagaatctccatgcacctgatgaacctggcggcagcgcaaaagatg

SEQ ID NO: 134702 - DNA, 103 bp, Artificial Sequence
  Synthetic Polynucleotide
taatacgactcactatagggggcagcgtctccagcttcaccccgaagttcaacagaggagagaacttatgggtgaagctaacctggcggcagcgcaaaagatg

SEQ ID NO: 134703 - DNA, 103 bp, Artificial Sequence
  Synthetic Polynucleotide
taatacgactcactatagggcctgagactgagatcattttaccatcaggtaacagaggagaacctgaatgtaaaatgataacctggcggcagcgcaaaagatg

SEQ ID NO: 134704 - DNA, 103 bp, Artificial Sequence
  Synthetic Polynucleotide
taatacgactcactatagggcaaacctcctcctgagactgagatcattttaacagaggagaaaaatgatgtcagtctcaaacctggcggcagcgcaaaagatg

SEQ ID NO: 134705 - DNA, 103 bp, Artificial Sequence
  Synthetic Polynucleotide
taatacgactcactatagggtgactgggggcaaacctcctcctgagactgaacagaggagacagtctatggaggaggttaacctggcggcagcgcaaaagatg

SEQ ID NO: 134706 - DNA, 103 bp, Artificial Sequence
  Synthetic Polynucleotide
taatacgactcactataggggtcaaggtgctgactgggggcaaacctcctaacagaggagaaggaggatggcccccagtaacctggcggcagcgcaaaagatg

SEQ ID NO: 134707 - DNA, 103 bp, Artificial Sequence
  Synthetic Polynucleotide
taatacgactcactataggggtggatattcgtcaaggtgctgactgggggaacagaggagacccccaatgagcaccttgaacctggcggcagcgcaaaagatg

SEQ ID NO: 134708 - DNA, 103 bp, Artificial Sequence
  Synthetic Polynucleotide
taatacgactcactataggggggagaggctgtggatattcgtcaaggtgcaacagaggagagcacctatgcgaatatccaacctggcggcagcgcaaaagatg

SEQ ID NO: 134709 - DNA, 103 bp, Artificial Sequence
  Synthetic Polynucleotide
taatacgactcactatagggggattatggtgggagaggctgtggatattcaacagaggagagaatatatgcagcctctcaacctggcggcagcgcaaaagatg

SEQ ID NO: 134710 - DNA, 103 bp, Artificial Sequence
  Synthetic Polynucleotide
taatacgactcactatagggagattgctggggattatggtgggagaggctaacagaggagaagcctcatgcaccataataacctggcggcagcgcaaaagatg

SEQ ID NO: 134711 - DNA, 103 bp, Artificial Sequence
  Synthetic Polynucleotide
taatacgactcactatagggtgaggttttgagattgctggggattatggtaacagaggagaaccataatgcccagcaataacctggcggcagcgcaaaagatg

SEQ ID NO: 134712 - DNA, 103 bp, Artificial Sequence
  Synthetic Polynucleotide
taatacgactcactatagggggtgtcatgatgaggttttgagattgctggaacagaggagaccagcaatgtcaaaacctaacctggcggcagcgcaaaagatg

SEQ ID NO: 134713 - DNA, 103 bp, Artificial Sequence
  Synthetic Polynucleotide
taatacgactcactatagggaggggacaggggcagcgtctccagcttcacaacagaggagagtgaagatggagacgctgaacctggcggcagcgcaaaagatg

SEQ ID NO: 134714 - DNA, 103 bp, Artificial Sequence
  Synthetic Polynucleotide
taatacgactcactatagggtccagagaggggtgtcatgatgaggttttgaacagaggagacaaaacatgatcatgacaaacctggcggcagcgcaaaagatg

SEQ ID NO: 134715 - DNA, 103 bp, Artificial Sequence
  Synthetic Polynucleotide
taatacgactcactatagggttgccatgactccagagaggggtgtcatgaaacagaggagatcatgaatgccctctctgaacctggcggcagcgcaaaagatg

SEQ ID NO: 134716 - DNA, 103 bp, Artificial Sequence
  Synthetic Polynucleotide
taatacgactcactatagggctttgtgcaattgccatgactccagagaggaacagaggagacctctcatgagtcatggcaacctggcggcagcgcaaaagatg

SEQ ID NO: 134717 - DNA, 103 bp, Artificial Sequence
  Synthetic Polynucleotide
taatacgactcactatagggggtgttgaggctttgtgcaattgccatgacaacagaggagagtcatgatgattgcacaaaacctggcggcagcgcaaaagatg

SEQ ID NO: 134718 - DNA, 103 bp, Artificial Sequence
  Synthetic Polynucleotide
taatacgactcactataggggtgcttgggaggtgttgaggctttgtgcaaaacagaggagattgcacatggcctcaacaaacctggcggcagcgcaaaagatg

SEQ ID NO: 134719 - DNA, 103 bp, Artificial Sequence
  Synthetic Polynucleotide
taatacgactcactataggggggacactctgtgcttgggaggtgttgaggaacagaggagacctcaaatgctcccaagcaacctggcggcagcgcaaaagatg

SEQ ID NO: 134720 - DNA, 103 bp, Artificial Sequence
  Synthetic Polynucleotide
taatacgactcactataggggttgatgacagggacactctgtgcttgggaaacagaggagatcccaaatgcagagtgtcaacctggcggcagcgcaaaagatg

SEQ ID NO: 134721 - DNA, 103 bp, Artificial Sequence
  Synthetic Polynucleotide
taatacgactcactatagggcggccacactgttgatgacagggacactctaacagaggagaagagtgatgctgtcatcaaacctggcggcagcgcaaaagatg

SEQ ID NO: 134722 - DNA, 103 bp, Artificial Sequence
  Synthetic Polynucleotide
taatacgactcactataggggccaggctgccggccacactgttgatgacaaacagaggagatgtcatatgcagtgtggcaacctggcggcagcgcaaaagatg

SEQ ID NO: 134723 - DNA, 103 bp, Artificial Sequence
  Synthetic Polynucleotide
taatacgactcactatagggctgcagggctgccaggctgccggccacactaacagaggagaagtgtgatgggcagcctgaacctggcggcagcgcaaaagatg

SEQ ID NO: 134724 - DNA, 103 bp, Artificial Sequence
  Synthetic Polynucleotide
taatacgactcactatagggccccgctgccaggggacaggggcagcgtctaacagaggagaagacgcatgccctgtcccaacctggcggcagcgcaaaagatg

SEQ ID NO: 134725 - DNA, 103 bp, Artificial Sequence
  Synthetic Polynucleotide
taatacgactcactatagggactggacgggctgcagggctgccaggctgcaacagaggagagcagccatgcagccctgcaacctggcggcagcgcaaaagatg

SEQ ID NO: 134726 - DNA, 103 bp, Artificial Sequence
  Synthetic Polynucleotide
taatacgactcactatagggtgctgggagaactggacgggctgcagggctaacagaggagaagccctatggcccgtccaaacctggcggcagcgcaaaagatg

SEQ ID NO: 134727 - DNA, 103 bp, Artificial Sequence
  Synthetic Polynucleotide
taatacgactcactataggggctgtgcagctgctgggagaactggacgggaacagaggagacccgtcatgttctcccagaacctggcggcagcgcaaaagatg

SEQ ID NO: 134728 - DNA, 103 bp, Artificial Sequence
  Synthetic Polynucleotide
taatacgactcactataggggctggtgagggctgtgcagctgctgggagaaacagaggagatctcccatgagctgcacaaacctggcggcagcgcaaaagatg

SEQ ID NO: 134729 - DNA, 103 bp, Artificial Sequence
  Synthetic Polynucleotide
taatacgactcactatagggatgaggggctgctggtgagggctgtgcagcaacagaggagagctgcaatgccctcaccaaacctggcggcagcgcaaaagatg

SEQ ID NO: 134730 - DNA, 103 bp, Artificial Sequence
  Synthetic Polynucleotide
taatacgactcactataggggctctgctgcatgaggggctgctggtgaggaacagaggagacctcacatgcagcccctcaacctggcggcagcgcaaaagatg

SEQ ID NO: 134731 - DNA, 103 bp, Artificial Sequence
  Synthetic Polynucleotide
taatacgactcactatagggggctgcctgggctctgctgcatgaggggctaacagaggagaagccccatgtgcagcagaaacctggcggcagcgcaaaagatg

SEQ ID NO: 134732 - DNA, 103 bp, Artificial Sequence
  Synthetic Polynucleotide
taatacgactcactatagggtgggccatgtggctgcctgggctctgctgcaacagaggagagcagcaatgcccaggcagaacctggcggcagcgcaaaagatg

SEQ ID NO: 134733 - DNA, 103 bp, Artificial Sequence
  Synthetic Polynucleotide
taatacgactcactataggggaagggctgctgggccatgtggctgcctggaacagaggagaccaggcatgcacatggccaacctggcggcagcgcaaaagatg

SEQ ID NO: 134734 - DNA, 103 bp, Artificial Sequence
  Synthetic Polynucleotide
taatacgactcactatagggcagctgccatgaagggctgctgggccatgtaacagaggagaacatggatgagcagccctaacctggcggcagcgcaaaagatg

SEQ ID NO: 134735 - DNA, 103 bp, Artificial Sequence
  Synthetic Polynucleotide
taatacgactcactatagggtcgggctcggccccgctgccaggggacaggaacagaggagacctgtcatgtggcagcggaacctggcggcagcgcaaaagatg

SEQ ID NO: 134736 - DNA, 103 bp, Artificial Sequence
  Synthetic Polynucleotide
taatacgactcactatagggagctgagtcacagctgccatgaagggctgcaacagaggagagcagccatgcatggcagcaacctggcggcagcgcaaaagatg

SEQ ID NO: 134737 - DNA, 103 bp, Artificial Sequence
  Synthetic Polynucleotide
taatacgactcactatagggtgagttctgcagctgagtcacagctgccataacagaggagaatggcaatggtgactcagaacctggcggcagcgcaaaagatg

SEQ ID NO: 134738 - DNA, 103 bp, Artificial Sequence
  Synthetic Polynucleotide
taatacgactcactatagggcgtacatgtgtgagttctgcagctgagtcaaacagaggagatgactcatgtgcagaactaacctggcggcagcgcaaaagatg

SEQ ID NO: 134739 - DNA, 103 bp, Artificial Sequence
  Synthetic Polynucleotide
taatacgactcactatagggtgcttgtgtgcgtacatgtgtgagttctgcaacagaggagagcagaaatgacacatgtaaacctggcggcagcgcaaaagatg

SEQ ID NO: 134740 - DNA, 103 bp, Artificial Sequence
  Synthetic Polynucleotide
taatacgactcactatagggggggggttcctgcttgtgtgcgtacatgtgaacagaggagacacatgatggcacacaagaacctggcggcagcgcaaaagatg

SEQ ID NO: 134741 - DNA, 103 bp, Artificial Sequence
  Synthetic Polynucleotide
taatacgactcactataggggggaatactgggggggttcctgcttgtgtgaacagaggagacacacaatgaggaaccccaacctggcggcagcgcaaaagatg

SEQ ID NO: 134742 - DNA, 103 bp, Artificial Sequence
  Synthetic Polynucleotide
taatacgactcactatagggcgggaggtgtgggaatactgggggggttccaacagaggagaggaaccatgccagtattcaacctggcggcagcgcaaaagatg

SEQ ID NO: 134743 - DNA, 103 bp, Artificial Sequence
  Synthetic Polynucleotide
taatacgactcactatagggagatggaaaccgggaggtgtgggaatactgaacagaggagacagtatatgcacacctccaacctggcggcagcgcaaaagatg

SEQ ID NO: 134744 - DNA, 103 bp, Artificial Sequence
  Synthetic Polynucleotide
taatacgactcactatagggccaccattgcagatggaaaccgggaggtgtaacagaggagaacacctatgggtttccataacctggcggcagcgcaaaagatg

SEQ ID NO: 134745 - DNA, 103 bp, Artificial Sequence
  Synthetic Polynucleotide
taatacgactcactataggggtatctgtgaccaccattgcagatggaaacaacagaggagagtttccatgtgcaatggtaacctggcggcagcgcaaaagatg

SEQ ID NO: 134746 - DNA, 103 bp, Artificial Sequence
  Synthetic Polynucleotide
taatacgactcactatagggcggcttggtgtcgggctcggccccgctgccaacagaggagaggcagcatggccgagcccaacctggcggcagcgcaaaagatg

SEQ ID NO: 134747 - DNA, 103 bp, Artificial Sequence
  Synthetic Polynucleotide
taatacgactcactataggggatgctgctggtatctgtgaccaccattgcaacagaggagagcaatgatggtcacagataacctggcggcagcgcaaaagatg

SEQ ID NO: 134748 - DNA, 103 bp, Artificial Sequence
  Synthetic Polynucleotide
taatacgactcactatagggtgagtgtactgatgctgctggtatctgtgaaacagaggagatcacagatgccagcagcaaacctggcggcagcgcaaaagatg

SEQ ID NO: 134749 - DNA, 103 bp, Artificial Sequence
  Synthetic Polynucleotide
taatacgactcactataggggacatgttggtgagtgtactgatgctgctgaacagaggagacagcagatgcagtacactaacctggcggcagcgcaaaagatg

SEQ ID NO: 134750 - DNA, 103 bp, Artificial Sequence
  Synthetic Polynucleotide
taatacgactcactatagggtttacttgaagacatgttggtgagtgtactaacagaggagaagtacaatgaccaacatgaacctggcggcagcgcaaaagatg

SEQ ID NO: 134751 - DNA, 103 bp, Artificial Sequence
  Synthetic Polynucleotide
taatacgactcactataggggaggacactgtttacttgaagacatgttggaacagaggagaccaacaatgcttcaagtaaacctggcggcagcgcaaaagatg

SEQ ID NO: 134752 - DNA, 103 bp, Artificial Sequence
  Synthetic Polynucleotide
taatacgactcactatagggcaggcttgtagaggacactgtttacttgaaaacagaggagattcaagatgacagtgtccaacctggcggcagcgcaaaagatg

SEQ ID NO: 134753 - DNA, 103 bp, Artificial Sequence
  Synthetic Polynucleotide
taatacgactcactatagggtatggaagaccggcttggtgtcgggctcggaacagaggagaccgagcatgacaccaagcaacctggcggcagcgcaaaagatg

SEQ ID NO: 134754 - DNA, 103 bp, Artificial Sequence
  Synthetic Polynucleotide
taatacgactcactatagggttggtgagagtatggaagaccggcttggtgaacagaggagacaccaaatgggtcttccaaacctggcggcagcgcaaaagatg

SEQ ID NO: 134755 - DNA, 103 bp, Artificial Sequence
  Synthetic Polynucleotide
taatacgactcactatagggggcgtggccgttggtgagagtatggaagacaacagaggagagtcttcatgactctcaccaacctggcggcagcgcaaaagatg

SEQ ID NO: 134756 - DNA, 103 bp, Artificial Sequence
  Synthetic Polynucleotide
taatacgactcactatagggtcaggagttcttgctggagcgacgtgagctaacagaggagaagctcaatgcgctccagcaacctggcggcagcgcaaaagatg

SEQ ID NO: 134757 - DNA, 103 bp, Artificial Sequence
  Synthetic Polynucleotide
taatacgactcactatagggagcggcccttggcgtggccgttggtgagagaacagaggagactctcaatgacggccacgaacctggcggcagcgcaaaagatg

SEQ ID NO: 134758 - DNA, 103 bp, Artificial Sequence
  Synthetic Polynucleotide
taatacgactcactatagggtcgccggacaagcggcccttggcgtggccgaacagaggagacggccaatgcaagggccgaacctggcggcagcgcaaaagatg

SEQ ID NO: 134759 - DNA, 103 bp, Artificial Sequence
  Synthetic Polynucleotide
taatacgactcactatagggggagccctcgtcgccggacaagcggcccttaacagaggagaaagggcatgttgtccggcaacctggcggcagcgcaaaagatg

SEQ ID NO: 134760 - DNA, 103 bp, Artificial Sequence
  Synthetic Polynucleotide
taatacgactcactatagggcgccgtcctcggagccctcgtcgccggacaaacagaggagatgtccgatgacgagggctaacctggcggcagcgcaaaagatg

SEQ ID NO: 134761 - DNA, 103 bp, Artificial Sequence
  Synthetic Polynucleotide
taatacgactcactatagggtcatagtcgtcgccgtcctcggagccctcgaacagaggagacgagggatgcgaggacggaacctggcggcagcgcaaaagatg

SEQ ID NO: 134762 - DNA, 103 bp, Artificial Sequence
  Synthetic Polynucleotide
taatacgactcactataggggggaggtgtgtcatagtcgtcgccgtcctcaacagaggagagaggacatggacgactataacctggcggcagcgcaaaagatg

SEQ ID NO: 134763 - DNA, 103 bp, Artificial Sequence
  Synthetic Polynucleotide
taatacgactcactatagggccttgaggatgggaggtgtgtcatagtcgtaacagaggagaacgactatgacacacctcaacctggcggcagcgcaaaagatg

SEQ ID NO: 134764 - DNA, 103 bp, Artificial Sequence
  Synthetic Polynucleotide
taatacgactcactataggggcctgcagctccttgaggatgggaggtgtgaacagaggagacacaccatgcatcctcaaaacctggcggcagcgcaaaagatg

SEQ ID NO: 134765 - DNA, 103 bp, Artificial Sequence
  Synthetic Polynucleotide
taatacgactcactatagggggtgttgagcgcctgcagctccttgaggataacagaggagaatcctcatggagctgcagaacctggcggcagcgcaaaagatg

SEQ ID NO: 134766 - DNA, 103 bp, Artificial Sequence
  Synthetic Polynucleotide
taatacgactcactatagggccgcctcctcggtgttgagcgcctgcagctaacagaggagaagctgcatgcgctcaacaaacctggcggcagcgcaaaagatg

SEQ ID NO: 134767 - DNA, 103 bp, Artificial Sequence
  Synthetic Polynucleotide
taatacgactcactatagggagcagggcgctcaggagttcttgctggagcaacagaggagagctccaatgagaactcctaacctggcggcagcgcaaaagatg

SEQ ID NO: 134768 - DNA, 103 bp, Artificial Sequence
  Synthetic Polynucleotide
taatacgactcactatagggcgctgctccgccgcctcctcggtgttgagcaacagaggagagctcaaatgcgaggaggcaacctggcggcagcgcaaaagatg

SEQ ID NO: 134769 - DNA, 103 bp, Artificial Sequence
  Synthetic Polynucleotide
taatacgactcactatagggcacctccgcccgctgctccgccgcctcctcaacagaggagagaggagatggcggagcagaacctggcggcagcgcaaaagatg

SEQ ID NO: 134770 - DNA, 103 bp, Artificial Sequence
  Synthetic Polynucleotide
taatacgactcactataggggcatccggtccacctccgcccgctgctccgaacagaggagacggagcatggggcggaggaacctggcggcagcgcaaaagatg

SEQ ID NO: 134771 - DNA, 103 bp, Artificial Sequence
  Synthetic Polynucleotide
taatacgactcactatagggtcctcactgagcatccggtccacctccgccaacagaggagaggcggaatgggaccggataacctggcggcagcgcaaaagatg

SEQ ID NO: 134772 - DNA, 103 bp, Artificial Sequence
  Synthetic Polynucleotide
taatacgactcactatagggcctccaagggtcctcactgagcatccggtcaacagaggagagaccggatgctcagtgagaacctggcggcagcgcaaaagatg

SEQ ID NO: 134773 - DNA, 103 bp, Artificial Sequence
  Synthetic Polynucleotide
taatacgactcactatagggttttagcagccctccaagggtcctcactgaaacagaggagatcagtgatgacccttggaaacctggcggcagcgcaaaagatg

SEQ ID NO: 134774 - DNA, 103 bp, Artificial Sequence
  Synthetic Polynucleotide
taatacgactcactatagggcccttgatcattttagcagccctccaagggaacagaggagacccttgatgggctgctaaaacctggcggcagcgcaaaagatg

SEQ ID NO: 134775 - DNA, 103 bp, Artificial Sequence
  Synthetic Polynucleotide
taatacgactcactatagggctgcatgtaacccttgatcattttagcagcaacagaggagagctgctatgatgatcaagaacctggcggcagcgcaaaagatg

SEQ ID NO: 134776 - DNA, 103 bp, Artificial Sequence
  Synthetic Polynucleotide
taatacgactcactatagggtgttgtgttgctgcatgtaacccttgatcaaacagaggagatgatcaatggttacatgcaacctggcggcagcgcaaaagatg

SEQ ID NO: 134777 - DNA, 103 bp, Artificial Sequence
  Synthetic Polynucleotide
taatacgactcactatagggctctgggggatgttgtgttgctgcatgtaaaacagaggagattacatatggcaacacaaaacctggcggcagcgcaaaagatg

SEQ ID NO: 134778 - DNA, 103 bp, Artificial Sequence
  Synthetic Polynucleotide
taatacgactcactatagggcccggagctcagcagggcgctcaggagttcaacagaggagagaactcatgagcgccctgaacctggcggcagcgcaaaagatg

SEQ ID NO: 134779 - DNA, 103 bp, Artificial Sequence
  Synthetic Polynucleotide
taatacgactcactataggggaccacctccctctgggggatgttgtgttgaacagaggagacaacacatgatcccccagaacctggcggcagcgcaaaagatg

SEQ ID NO: 134780 - DNA, 103 bp, Artificial Sequence
  Synthetic Polynucleotide
taatacgactcactatagggcggtgacatcgaccacctccctctgggggaaacagaggagatcccccatggggaggtggaacctggcggcagcgcaaaagatg

SEQ ID NO: 134781 - DNA, 103 bp, Artificial Sequence
  Synthetic Polynucleotide
taatacgactcactatagggtggttcaggccggtgacatcgaccacctccaacagaggagaggaggtatgcgatgtcacaacctggcggcagcgcaaaagatg

SEQ ID NO: 134782 - DNA, 103 bp, Artificial Sequence
  Synthetic Polynucleotide
taatacgactcactataggggaggtgcgactggttcaggccggtgacatcaacagaggagagatgtcatgggcctgaacaacctggcggcagcgcaaaagatg

SEQ ID NO: 134783 - DNA, 103 bp, Artificial Sequence
  Synthetic Polynucleotide
taatacgactcactataggggatgctgggagaggtgcgactggttcaggcaacagaggagagcctgaatgagtcgcaccaacctggcggcagcgcaaaagatg

SEQ ID NO: 134784 - DNA, 103 bp, Artificial Sequence
  Synthetic Polynucleotide
taatacgactcactatagggcccttgttgagatgctgggagaggtgcgacaacagaggagagtcgcaatgctcccagcaaacctggcggcagcgcaaaagatg

SEQ ID NO: 134785 - DNA, 103 bp, Artificial Sequence
  Synthetic Polynucleotide
taatacgactcactatagggcataggggtgcccttgttgagatgctgggaaacagaggagatcccagatgctcaacaagaacctggcggcagcgcaaaagatg

SEQ ID NO: 134786 - DNA, 103 bp, Artificial Sequence
  Synthetic Polynucleotide
taatacgactcactatagggtctgggtcttcataggggtgcccttgttgaaacagaggagatcaacaatggcacccctaaacctggcggcagcgcaaaagatg

SEQ ID NO: 134787 - DNA, 103 bp, Artificial Sequence
  Synthetic Polynucleotide
taatacgactcactataggggcggcacgcttctgggtcttcataggggtgaacagaggagacaccccatggaagacccaaacctggcggcagcgcaaaagatg

SEQ ID NO: 134788 - DNA, 103 bp, Artificial Sequence
  Synthetic Polynucleotide
taatacgactcactatagggggtgtacagagcggcacgcttctgggtcttaacagaggagaaagaccatgaagcgtgccaacctggcggcagcgcaaaagatg

SEQ ID NO: 134789 - DNA, 103 bp, Artificial Sequence
  Synthetic Polynucleotide
taatacgactcactatagggccttggtgaccccggagctcagcagggcgcaacagaggagagcgcccatgtgagctccgaacctggcggcagcgcaaaagatg

SEQ ID NO: 134790 - DNA, 103 bp, Artificial Sequence
  Synthetic Polynucleotide
taatacgactcactatagggtgacgtaccaggtgtacagagcggcacgctaacagaggagaagcgtgatgctctgtacaaacctggcggcagcgcaaaagatg

SEQ ID NO: 134791 - DNA, 103 bp, Artificial Sequence
  Synthetic Polynucleotide
taatacgactcactatagggcgttgctttctgacgtaccaggtgtacagaaacagaggagatctgtaatgctggtacgtaacctggcggcagcgcaaaagatg

SEQ ID NO: 134792 - DNA, 103 bp, Artificial Sequence
  Synthetic Polynucleotide
taatacgactcactataggggaggatctctcgttgctttctgacgtaccaaacagaggagatggtacatgagaaagcaaaacctggcggcagcgcaaaagatg

SEQ ID NO: 134793 - DNA, 103 bp, Artificial Sequence
  Synthetic Polynucleotide
taatacgactcactatagggtgaattgtcggaggatctctcgttgctttcaacagaggagagaaagcatggagagatccaacctggcggcagcgcaaaagatg

SEQ ID NO: 134794 - DNA, 103 bp, Artificial Sequence
  Synthetic Polynucleotide
taatacgactcactatagggactgtctggttgaattgtcggaggatctctaacagaggagaagagatatgccgacaattaacctggcggcagcgcaaaagatg

SEQ ID NO: 134795 - DNA, 103 bp, Artificial Sequence
  Synthetic Polynucleotide
taatacgactcactatagggagaactctggactgtctggttgaattgtcgaacagaggagacgacaaatgaaccagacaaacctggcggcagcgcaaaagatg

SEQ ID NO: 134796 - DNA, 103 bp, Artificial Sequence
  Synthetic Polynucleotide
taatacgactcactatagggtcatatttccagaactctggactgtctggtaacagaggagaaccagaatgtccagagttaacctggcggcagcgcaaaagatg

SEQ ID NO: 134797 - DNA, 103 bp, Artificial Sequence
  Synthetic Polynucleotide
taatacgactcactatagggcttttgtctgtcatatttccagaactctggaacagaggagaccagagatgtggaaatataacctggcggcagcgcaaaagatg

SEQ ID NO: 134798 - DNA, 103 bp, Artificial Sequence
  Synthetic Polynucleotide
taatacgactcactatagggatcctgactgcttttgtctgtcatatttccaacagaggagaggaaatatgacagacaaaaacctggcggcagcgcaaaagatg

SEQ ID NO: 134799 - DNA, 103 bp, Artificial Sequence
  Synthetic Polynucleotide
taatacgactcactatagggacagcagctgatcctgactgcttttgtctgaacagaggagacagacaatggcagtcaggaacctggcggcagcgcaaaagatg

SEQ ID NO: 134800 - DNA, 103 bp, Artificial Sequence
  Synthetic Polynucleotide
taatacgactcactatagggaccagcacctccttggtgaccccggagctcaacagaggagagagctcatgggtcaccaaaacctggcggcagcgcaaaagatg

SEQ ID NO: 134801 - DNA, 103 bp, Artificial Sequence
  Synthetic Polynucleotide
taatacgactcactatagggggaaagagaaacagcagctgatcctgactgaacagaggagacagtcaatgtcagctgctaacctggcggcagcgcaaaagatg

SEQ ID NO: 134802 - DNA, 103 bp, Artificial Sequence
  Synthetic Polynucleotide
taatacgactcactatagggactgaactctggaaagagaaacagcagctgaacagaggagacagctgatgtttctctttaacctggcggcagcgcaaaagatg

SEQ ID NO: 134803 - DNA, 103 bp, Artificial Sequence
  Synthetic Polynucleotide
taatacgactcactatagggggctctgttgactgaactctggaaagagaaaacagaggagattctctatgcagagttcaaacctggcggcagcgcaaaagatg

SEQ ID NO: 134804 - DNA, 103 bp, Artificial Sequence
  Synthetic Polynucleotide
taatacgactcactatagggccaggcccatggctctgttgactgaactctaacagaggagaagagttatgtcaacagagaacctggcggcagcgcaaaagatg

SEQ ID NO: 134805 - DNA, 103 bp, Artificial Sequence
  Synthetic Polynucleotide
taatacgactcactatagggatcggactgcccaggcccatggctctgttgaacagaggagacaacagatgcatgggcctaacctggcggcagcgcaaaagatg

SEQ ID NO: 134806 - DNA, 103 bp, Artificial Sequence
  Synthetic Polynucleotide
taatacgactcactatagggagcaggcatcatcggactgcccaggcccataacagaggagaatgggcatgggcagtccgaacctggcggcagcgcaaaagatg

SEQ ID NO: 134807 - DNA, 103 bp, Artificial Sequence
  Synthetic Polynucleotide
taatacgactcactataggggtgggctcagagcaggcatcatcggactgcaacagaggagagcagtcatgtgatgcctgaacctggcggcagcgcaaaagatg

SEQ ID NO: 134808 - DNA, 103 bp, Artificial Sequence
  Synthetic Polynucleotide
taatacgactcactatagggcttcttgttggtgggctcagagcaggcatcaacagaggagagatgccatgtctgagcccaacctggcggcagcgcaaaagatg

SEQ ID NO: 134809 - DNA, 103 bp, Artificial Sequence
  Synthetic Polynucleotide
taatacgactcactatagggtgcggcgcatcttcttgttggtgggctcagaacagaggagactgagcatgccaacaagaaacctggcggcagcgcaaaagatg

SEQ ID NO: 134810 - DNA, 103 bp, Artificial Sequence
  Synthetic Polynucleotide
taatacgactcactatagggttgaaccggttgcggcgcatcttcttgttgaacagaggagacaacaaatggatgcgccgaacctggcggcagcgcaaaagatg

SEQ ID NO: 134811 - DNA, 103 bp, Artificial Sequence
  Synthetic Polynucleotide
taatacgactcactatagggcaaggcctgaaccagcacctccttggtgacaacagaggagagtcaccatggaggtgctgaacctggcggcagcgcaaaagatg

SEQ ID NO: 134812 - DNA, 103 bp, Artificial Sequence
  Synthetic Polynucleotide
taatacgactcactataggggggcccccatttgaaccggttgcggcgcataacagaggagaatgcgcatgaaccggttcaacctggcggcagcgcaaaagatg

SEQ ID NO: 134813 - DNA, 103 bp, Artificial Sequence
  Synthetic Polynucleotide
taatacgactcactataggggctgggacgcgggcccccatttgaaccggtaacagaggagaaccggtatgaatgggggcaacctggcggcagcgcaaaagatg

SEQ ID NO: 134814 - DNA, 103 bp, Artificial Sequence
  Synthetic Polynucleotide
taatacgactcactatagggtacaagatttgctgggacgcgggcccccataacagaggagaatggggatgcgcgtcccaaacctggcggcagcgcaaaagatg

SEQ ID NO: 134815 - DNA, 103 bp, Artificial Sequence
  Synthetic Polynucleotide
taatacgactcactataggggtaggcctggtacaagatttgctgggacgcaacagaggagagcgtccatgcaaatcttgaacctggcggcagcgcaaaagatg

SEQ ID NO: 134816 - DNA, 103 bp, Artificial Sequence
  Synthetic Polynucleotide
taatacgactcactatagggtttgccgatcgtaggcctggtacaagatttaacagaggagaaaatctatgaccaggcctaacctggcggcagcgcaaaagatg

SEQ ID NO: 134817 - DNA, 103 bp, Artificial Sequence
  Synthetic Polynucleotide
taatacgactcactatagggctggggttcttttgccgatcgtaggcctggaacagaggagaccaggcatgcgatcggcaaacctggcggcagcgcaaaagatg

SEQ ID NO: 134818 - DNA, 103 bp, Artificial Sequence
  Synthetic Polynucleotide
taatacgactcactatagggctcttccttgctggggttcttttgccgatcaacagaggagagatcggatgaagaaccccaacctggcggcagcgcaaaagatg

SEQ ID NO: 134819 - DNA, 103 bp, Artificial Sequence
  Synthetic Polynucleotide
taatacgactcactatagggaggcctctctctcttccttgctggggttctaacagaggagaagaaccatggcaaggaagaacctggcggcagcgcaaaagatg

SEQ ID NO: 134820 - DNA, 103 bp, Artificial Sequence
  Synthetic Polynucleotide
taatacgactcactatagggtcctccactaaggcctctctctcttccttgaacagaggagacaaggaatggagagaggcaacctggcggcagcgcaaaagatg

SEQ ID NO: 134821 - DNA, 103 bp, Artificial Sequence
  Synthetic Polynucleotide
taatacgactcactatagggcctgttgcattcctccactaaggcctctctaacagaggagaagagagatgttagtggagaacctggcggcagcgcaaaagatg

SEQ ID NO: 134822 - DNA, 103 bp, Artificial Sequence
  Synthetic Polynucleotide
taatacgactcactataggggcaactcctccaaggcctgaaccagcacctaacagaggagaaggtgcatgttcaggcctaacctggcggcagcgcaaaagatg

SEQ ID NO: 134823 - DNA, 103 bp, Artificial Sequence
  Synthetic Polynucleotide
taatacgactcactatagggaacattctgccctgttgcattcctccactaaacagaggagatagtggatgaatgcaacaaacctggcggcagcgcaaaagatg

SEQ ID NO: 134824 - DNA, 103 bp, Artificial Sequence
  Synthetic Polynucleotide
taatacgactcactatagggcctcgctgcaaacattctgccctgttgcataacagaggagaatgcaaatgggcagaatgaacctggcggcagcgcaaaagatg

SEQ ID NO: 134825 - DNA, 103 bp, Artificial Sequence
  Synthetic Polynucleotide
taatacgactcactataggggggggacacccctcgctgcaaacattctgcaacagaggagagcagaaatgttgcagcgaaacctggcggcagcgcaaaagatg

SEQ ID NO: 134826 - DNA, 103 bp, Artificial Sequence
  Synthetic Polynucleotide
taatacgactcactataggggggctttggagggggacacccctcgctgcaaacagaggagatgcagcatggggtgtcccaacctggcggcagcgcaaaagatg

SEQ ID NO: 134827 - DNA, 103 bp, Artificial Sequence
  Synthetic Polynucleotide
taatacgactcactatagggcccaggccgtgggctttggagggggacaccaacagaggagaggtgtcatgctccaaagcaacctggcggcagcgcaaaagatg

SEQ ID NO: 134828 - DNA, 103 bp, Artificial Sequence
  Synthetic Polynucleotide
taatacgactcactatagggcaagttggagcccaggccgtgggctttggaaacagaggagatccaaaatgcacggcctgaacctggcggcagcgcaaaagatg

SEQ ID NO: 134829 - DNA, 103 bp, Artificial Sequence
  Synthetic Polynucleotide
taatacgactcactatagggcctcagtgaccaagttggagcccaggccgtaacagaggagaacggccatggctccaactaacctggcggcagcgcaaaagatg

SEQ ID NO: 134830 - DNA, 103 bp, Artificial Sequence
  Synthetic Polynucleotide
taatacgactcactatagggtagacacggacctcagtgaccaagttggagaacagaggagactccaaatgggtcactgaaacctggcggcagcgcaaaagatg

SEQ ID NO: 134831 - DNA, 103 bp, Artificial Sequence
  Synthetic Polynucleotide
taatacgactcactatagggaaaccagttgtagacacggacctcagtgacaacagaggagagtcactatggtccgtgtcaacctggcggcagcgcaaaagatg

SEQ ID NO: 134832 - DNA, 103 bp, Artificial Sequence
  Synthetic Polynucleotide
taatacgactcactatagggtgcggtttgcaaaccagttgtagacacggaaacagaggagatccgtgatgacaactggtaacctggcggcagcgcaaaagatg

SEQ ID NO: 134833 - DNA, 103 bp, Artificial Sequence
  Synthetic Polynucleotide
taatacgactcactatagggggggatggcagcaactcctccaaggcctgaaacagaggagatcaggcatgggaggagttaacctggcggcagcgcaaaagatg

SEQ ID NO: 134834 - DNA, 103 bp, Artificial Sequence
  Synthetic Polynucleotide
taatacgactcactatagggtcctccttcctgcggtttgcaaaccagttgaacagaggagacaactgatgtgcaaaccgaacctggcggcagcgcaaaagatg

SEQ ID NO: 134835 - DNA, 103 bp, Artificial Sequence
  Synthetic Polynucleotide
taatacgactcactatagggccggaatgcctcctccttcctgcggtttgcaacagaggagagcaaacatgaggaaggagaacctggcggcagcgcaaaagatg

SEQ ID NO: 134836 - DNA, 103 bp, Artificial Sequence
  Synthetic Polynucleotide
taatacgactcactatagggccagcttttgccggaatgcctcctccttccaacagaggagaggaaggatgaggcattccaacctggcggcagcgcaaaagatg

SEQ ID NO: 134837 - DNA, 103 bp, Artificial Sequence
  Synthetic Polynucleotide
taatacgactcactataggggcgtccatggccagcttttgccggaatgccaacagaggagaggcattatggcaaaagctaacctggcggcagcgcaaaagatg

SEQ ID NO: 134838 - DNA, 103 bp, Artificial Sequence
  Synthetic Polynucleotide
taatacgactcactatagggggagctataggcgtccatggccagcttttgaacagaggagacaaaagatggccatggacaacctggcggcagcgcaaaagatg

SEQ ID NO: 134839 - DNA, 103 bp, Artificial Sequence
  Synthetic Polynucleotide
taatacgactcactataggggagtctggttggagctataggcgtccatggaacagaggagaccatggatgcctatagctaacctggcggcagcgcaaaagatg

SEQ ID NO: 134840 - DNA, 103 bp, Artificial Sequence
  Synthetic Polynucleotide
taatacgactcactatagggttcaggctgtgagtctggttggagctatagaacagaggagactatagatgcaaccagacaacctggcggcagcgcaaaagatg

SEQ ID NO: 134841 - DNA, 103 bp, Artificial Sequence
  Synthetic Polynucleotide
taatacgactcactataggggagcagagggttcaggctgtgagtctggttaacagaggagaaaccagatgcacagcctgaacctggcggcagcgcaaaagatg

SEQ ID NO: 134842 - DNA, 103 bp, Artificial Sequence
  Synthetic Polynucleotide
taatacgactcactatagggagccgtgggagagcagagggttcaggctgtaacagaggagaacagccatgaccctctgcaacctggcggcagcgcaaaagatg

SEQ ID NO: 134843 - DNA, 103 bp, Artificial Sequence
  Synthetic Polynucleotide
taatacgactcactatagggtggtggggggagccgtgggagagcagagggaacagaggagaccctctatgctcccacggaacctggcggcagcgcaaaagatg

SEQ ID NO: 134844 - DNA, 103 bp, Artificial Sequence
  Synthetic Polynucleotide
taatacgactcactatagggagccccgaggggcgcgttcacgctgaccataacagaggagaatggtcatggtgaacgcgaacctggcggcagcgcaaaagatg

SEQ ID NO: 134845 - DNA, 103 bp, Artificial Sequence
  Synthetic Polynucleotide
taatacgactcactataggggatggcacacagggcgctgacacccaggctaacagaggagaagcctgatggtcagcgccaacctggcggcagcgcaaaagatg

SEQ ID NO: 134846 - DNA, 103 bp, Artificial Sequence
  Synthetic Polynucleotide
taatacgactcactataggggccgaagagcttgatgaactggatctgctcaacagaggagagagcagatgcagttcatcaacctggcggcagcgcaaaagatg

SEQ ID NO: 134847 - DNA, 103 bp, Artificial Sequence
  Synthetic Polynucleotide
taatacgactcactatagggtcttggccatgccgaagagcttgatgaactaacagaggagaagttcaatgagctcttcgaacctggcggcagcgcaaaagatg

SEQ ID NO: 134848 - DNA, 103 bp, Artificial Sequence
  Synthetic Polynucleotide
taatacgactcactatagggaggttgtcaatcttggccatgccgaagagcaacagaggagagctcttatgcatggccaaaacctggcggcagcgcaaaagatg

SEQ ID NO: 134849 - DNA, 103 bp, Artificial Sequence
  Synthetic Polynucleotide
taatacgactcactatagggctcctgcaacaggttgtcaatcttggccataacagaggagaatggccatgattgacaacaacctggcggcagcgcaaaagatg

SEQ ID NO: 134850 - DNA, 103 bp, Artificial Sequence
  Synthetic Polynucleotide
taatacgactcactatagggccagcagcatctcctgcaacaggttgtcaaaacagaggagattgacaatgtgttgcaggaacctggcggcagcgcaaaagatg

SEQ ID NO: 134851 - DNA, 103 bp, Artificial Sequence
  Synthetic Polynucleotide
taatacgactcactatagggggggaccctcccagcagcatctcctgcaacaacagaggagagttgcaatggatgctgctaacctggcggcagcgcaaaagatg

SEQ ID NO: 134852 - DNA, 103 bp, Artificial Sequence
  Synthetic Polynucleotide
taatacgactcactatagggtgcatcgctgggggaccctcccagcagcataacagaggagaatgctgatgggagggtccaacctggcggcagcgcaaaagatg

SEQ ID NO: 134853 - DNA, 103 bp, Artificial Sequence
  Synthetic Polynucleotide
taatacgactcactataggggggcatggggtgcatcgctgggggaccctcaacagaggagagagggtatgccagcgatgaacctggcggcagcgcaaaagatg

SEQ ID NO: 134854 - DNA, 103 bp, Artificial Sequence
  Synthetic Polynucleotide
taatacgactcactatagggagggggtggtgggcatggggtgcatcgctgaacagaggagacagcgaatgaccccatgcaacctggcggcagcgcaaaagatg

SEQ ID NO: 134855 - DNA, 103 bp, Artificial Sequence
  Synthetic Polynucleotide
taatacgactcactataggggtgagggtgcagggggtggtgggcatggggaacagaggagaccccatatgcaccaccccaacctggcggcagcgcaaaagatg

SEQ ID NO: 134856 - DNA, 103 bp, Artificial Sequence
  Synthetic Polynucleotide
taatacgactcactatagggggtccccgcagatggcacacagggcgctgaaacagaggagatcagcgatgtgtgtgccaaacctggcggcagcgcaaaagatg

SEQ ID NO: 134857 - DNA, 103 bp, Artificial Sequence
  Synthetic Polynucleotide
taatacgactcactatagggcctgcatcaggtgagggtgcagggggtggtaacagaggagaaccaccatgtgcaccctcaacctggcggcagcgcaaaagatg

SEQ ID NO: 134858 - DNA, 103 bp, Artificial Sequence
  Synthetic Polynucleotide
taatacgactcactatagggcccatatgttcctgcatcaggtgagggtgcaacagaggagagcacccatgcctgatgcaaacctggcggcagcgcaaaagatg

SEQ ID NO: 134859 - DNA, 103 bp, Artificial Sequence
  Synthetic Polynucleotide
taatacgactcactataggggacgttggttcccatatgttcctgcatcagaacagaggagactgatgatggaacatatgaacctggcggcagcgcaaaagatg

SEQ ID NO: 134860 - DNA, 103 bp, Artificial Sequence
  Synthetic Polynucleotide
taatacgactcactatagggtggcaacgatgacgttggttcccatatgttaacagaggagaaacataatggaaccaacgaacctggcggcagcgcaaaagatg

SEQ ID NO: 134861 - DNA, 103 bp, Artificial Sequence
  Synthetic Polynucleotide
taatacgactcactatagggggcattgtgttggcaacgatgacgttggttaacagaggagaaaccaaatgcatcgttgcaacctggcggcagcgcaaaagatg

SEQ ID NO: 134862 - DNA, 103 bp, Artificial Sequence
  Synthetic Polynucleotide
taatacgactcactataggggaggtgagtgggcattgtgttggcaacgataacagaggagaatcgttatgaacacaatgaacctggcggcagcgcaaaagatg

SEQ ID NO: 134863 - DNA, 103 bp, Artificial Sequence
  Synthetic Polynucleotide
taatacgactcactataggggtccgttgctgaggtgagtgggcattgtgtaacagaggagaacacaaatgccactcaccaacctggcggcagcgcaaaagatg

SEQ ID NO: 134864 - DNA, 103 bp, Artificial Sequence
  Synthetic Polynucleotide
taatacgactcactatagggtcacacatctgtccgttgctgaggtgagtgaacagaggagacactcaatgcagcaacggaacctggcggcagcgcaaaagatg

SEQ ID NO: 134865 - DNA, 103 bp, Artificial Sequence
  Synthetic Polynucleotide
taatacgactcactatagggtcggggccactcacacatctgtccgttgctaacagaggagaagcaacatgcagatgtgtaacctggcggcagcgcaaaagatg

SEQ ID NO: 134866 - DNA, 103 bp, Artificial Sequence
  Synthetic Polynucleotide
taatacgactcactataggggtcccctgggtcggggccactcacacatctaacagaggagaagatgtatgagtggccccaacctggcggcagcgcaaaagatg

SEQ ID NO: 134867 - DNA, 103 bp, Artificial Sequence
  Synthetic Polynucleotide
taatacgactcactatagggcccgtggcccggtccccgcagatggcacacaacagaggagagtgtgcatgctgcggggaaacctggcggcagcgcaaaagatg

SEQ ID NO: 134868 - DNA, 103 bp, Artificial Sequence
  Synthetic Polynucleotide
taatacgactcactataggggtggctgcctgtcccctgggtcggggccacaacagaggagagtggccatgacccaggggaacctggcggcagcgcaaaagatg

SEQ ID NO: 134869 - DNA, 103 bp, Artificial Sequence
  Synthetic Polynucleotide
taatacgactcactatagggggtctcaggggtggctgcctgtcccctgggaacagaggagacccaggatgcaggcagccaacctggcggcagcgcaaaagatg

SEQ ID NO: 134870 - DNA, 103 bp, Artificial Sequence
  Synthetic Polynucleotide
taatacgactcactatagggagggctgtggggtctcaggggtggctgcctaacagaggagaaggcagatgcccctgagaaacctggcggcagcgcaaaagatg

SEQ ID NO: 134871 - DNA, 103 bp, Artificial Sequence
  Synthetic Polynucleotide
taatacgactcactatagggcctggcggtgagggctgtggggtctcagggaacagaggagaccctgaatgcccacagccaacctggcggcagcgcaaaagatg

SEQ ID NO: 134872 - DNA, 103 bp, Artificial Sequence
  Synthetic Polynucleotide
taatacgactcactatagggccctgagccacctggcggtgagggctgtggaacagaggagaccacagatgtcaccgccaaacctggcggcagcgcaaaagatg

SEQ ID NO: 134873 - DNA, 103 bp, Artificial Sequence
  Synthetic Polynucleotide
taatacgactcactatagggagggctcagaccctgagccacctggcggtgaacagaggagacaccgcatggtggctcagaacctggcggcagcgcaaaagatg

SEQ ID NO: 134874 - DNA, 103 bp, Artificial Sequence
  Synthetic Polynucleotide
taatacgactcactatagggaggagcttatagggctcagaccctgagccaaacagaggagatggctcatggtctgagccaacctggcggcagcgcaaaagatg

SEQ ID NO: 134875 - DNA, 103 bp, Artificial Sequence
  Synthetic Polynucleotide
taatacgactcactatagggggctcccggcaggagcttatagggctcagaaacagaggagatctgagatgtataagctcaacctggcggcagcgcaaaagatg

SEQ ID NO: 134876 - DNA, 103 bp, Artificial Sequence
  Synthetic Polynucleotide
taatacgactcactatagggttgtggcgacggctcccggcaggagcttataacagaggagaataagcatgtgccgggagaacctggcggcagcgcaaaagatg

SEQ ID NO: 134877 - DNA, 103 bp, Artificial Sequence
  Synthetic Polynucleotide
taatacgactcactatagggggcttgacgattgtggcgacggctcccggcaacagaggagagccgggatgcgtcgccacaacctggcggcagcgcaaaagatg

SEQ ID NO: 134878 - DNA, 103 bp, Artificial Sequence
  Synthetic Polynucleotide
taatacgactcactataggggtagtgtttgcccgtggcccggtccccgcaaacagaggagatgcgggatgcgggccacgaacctggcggcagcgcaaaagatg

SEQ ID NO: 134879 - DNA, 103 bp, Artificial Sequence
  Synthetic Polynucleotide
taatacgactcactatagggggcagagaggggcttgacgattgtggcgacaacagaggagagtcgccatgatcgtcaagaacctggcggcagcgcaaaagatg

SEQ ID NO: 134880 - DNA, 103 bp, Artificial Sequence
  Synthetic Polynucleotide
taatacgactcactataggggctgggggatggcagagaggggcttgacgaaacagaggagatcgtcaatgccctctctgaacctggcggcagcgcaaaagatg

SEQ ID NO: 134881 - DNA, 103 bp, Artificial Sequence
  Synthetic Polynucleotide
taatacgactcactataggggtgatggtcggctgggggatggcagagaggaacagaggagacctctcatgcatcccccaaacctggcggcagcgcaaaagatg

SEQ ID NO: 134882 - DNA, 103 bp, Artificial Sequence
  Synthetic Polynucleotide
taatacgactcactatagggttcctgcttggtgatggtcggctgggggataacagaggagaatccccatgccgaccatcaacctggcggcagcgcaaaagatg

SEQ ID NO: 134883 - DNA, 103 bp, Artificial Sequence
  Synthetic Polynucleotide
taatacgactcactatagggtcgaggcaccgtagtgtttgcccgtggcccaacagaggagagggccaatggcaaacactaacctggcggcagcgcaaaagatg

SEQ ID NO: 134884 - DNA, 103 bp, Artificial Sequence
  Synthetic Polynucleotide
taatacgactcactatagggccgtcacagctcgaggcaccgtagtgtttgaacagaggagacaaacaatgcggtgcctcaacctggcggcagcgcaaaagatg

SEQ ID NO: 134885 - DNA, 103 bp, Artificial Sequence
  Synthetic Polynucleotide
taatacgactcactataggggcccttgcagccgtcacagctcgaggcaccaacagaggagaggtgccatgagctgtgacaacctggcggcagcgcaaaagatg

SEQ ID NO: 134886 - DNA, 103 bp, Artificial Sequence
  Synthetic Polynucleotide
taatacgactcactatagggtccggaagaagcccttgcagccgtcacagcaacagaggagagctgtgatggctgcaaggaacctggcggcagcgcaaaagatg

SEQ ID NO: 134887 - DNA, 103 bp, Artificial Sequence
  Synthetic Polynucleotide
taatacgactcactatagggcgcacgctcctccggaagaagcccttgcagaacagaggagactgcaaatgcttcttccgaacctggcggcagcgcaaaagatg

SEQ ID NO: 134888 - DNA, 103 bp, Artificial Sequence
  Synthetic Polynucleotide
taatacgactcactataggggtggttcttccgcacgctcctccggaagaaaacagaggagattcttcatgaggagcgtgaacctggcggcagcgcaaaagatg

SEQ ID NO: 134889 - DNA, 103 bp, Artificial Sequence
  Synthetic Polynucleotide
taatacgactcactatagggtctccactggagccccgaggggcgcgttcaaacagaggagatgaacgatgccctcggggaacctggcggcagcgcaaaagatg

SEQ ID NO: 134890 - DNA, 103 bp, Artificial Sequence
  Synthetic Polynucleotide
taatacgactcactatagggaggagtacatgtggttcttccgcacgctccaacagaggagaggagcgatgggaagaaccaacctggcggcagcgcaaaagatg

SEQ ID NO: 134891 - DNA, 103 bp, Artificial Sequence
  Synthetic Polynucleotide
taatacgactcactatagggctaaatctgcaggagtacatgtggttcttcaacagaggagagaagaaatgcatgtactcaacctggcggcagcgcaaaagatg

SEQ ID NO: 134892 - DNA, 103 bp, Artificial Sequence
  Synthetic Polynucleotide
taatacgactcactataggggcactgccggctaaatctgcaggagtacataacagaggagaatgtacatgtgcagatttaacctggcggcagcgcaaaagatg

SEQ ID NO: 134893 - DNA, 103 bp, Artificial Sequence
  Synthetic Polynucleotide
taatacgactcactatagggtgtccaccacgcactgccggctaaatctgcaacagaggagagcagatatggccggcagtaacctggcggcagcgcaaaagatg

SEQ ID NO: 134894 - DNA, 103 bp, Artificial Sequence
  Synthetic Polynucleotide
taatacgactcactatagggctcttgtctttgtccaccacgcactgccggaacagaggagaccggcaatgcgtggtggaaacctggcggcagcgcaaaagatg

SEQ ID NO: 134895 - DNA, 103 bp, Artificial Sequence
  Synthetic Polynucleotide
taatacgactcactataggggcactggttcctcttgtctttgtccaccacaacagaggagagtggtgatgaaagacaagaacctggcggcagcgcaaaagatg

SEQ ID NO: 134896 - DNA, 103 bp, Artificial Sequence
  Synthetic Polynucleotide
taatacgactcactatagggtgcagtagcggcactggttcctcttgtcttaacagaggagaaagacaatgggaaccagtaacctggcggcagcgcaaaagatg

SEQ ID NO: 134897 - DNA, 103 bp, Artificial Sequence
  Synthetic Polynucleotide
taatacgactcactatagggttcttgagcctgcagtagcggcactggttcaacagaggagagaaccaatgccgctactgaacctggcggcagcgcaaaagatg

SEQ ID NO: 134898 - DNA, 103 bp, Artificial Sequence
  Synthetic Polynucleotide
taatacgactcactatagggccggaagcatttcttgagcctgcagtagcgaacagaggagacgctacatgaggctcaagaacctggcggcagcgcaaaagatg

SEQ ID NO: 134899 - DNA, 103 bp, Artificial Sequence
  Synthetic Polynucleotide
taatacgactcactatagggtcatgccagcccggaagcatttcttgagccaacagaggagaggctcaatgaatgcttccaacctggcggcagcgcaaaagatg

SEQ ID NO: 134900 - DNA, 103 bp, Artificial Sequence
  Synthetic Polynucleotide
taatacgactcactatagggtcgtaagaactctccactggagccccgaggaacagaggagacctcggatgtccagtggaaacctggcggcagcgcaaaagatg

SEQ ID NO: 134901 - DNA, 103 bp, Artificial Sequence
  Synthetic Polynucleotide
taatacgactcactataggggcttccttcttcatgccagcccggaagcataacagaggagaatgcttatgggctggcataacctggcggcagcgcaaaagatg

SEQ ID NO: 134902 - DNA, 103 bp, Artificial Sequence
  Synthetic Polynucleotide
taatacgactcactatagggattctggacggcttccttcttcatgccagcaacagaggagagctggcatgaagaaggaaaacctggcggcagcgcaaaagatg

SEQ ID NO: 134903 - DNA, 103 bp, Artificial Sequence
  Synthetic Polynucleotide
taatacgactcactatagggggtcccgctcattctggacggcttccttctaacagaggagaagaaggatgccgtccagaaacctggcggcagcgcaaaagatg

SEQ ID NO: 134904 - DNA, 103 bp, Artificial Sequence
  Synthetic Polynucleotide
taatacgactcactataggggtgctgatccggtcccgctcattctggacgaacagaggagacgtccaatgtgagcgggaaacctggcggcagcgcaaaagatg

SEQ ID NO: 134905 - DNA, 103 bp, Artificial Sequence
  Synthetic Polynucleotide
taatacgactcactatagggtgaccttcgagtgctgatccggtcccgctcaacagaggagagagcggatgcggatcagcaacctggcggcagcgcaaaagatg

SEQ ID NO: 134906 - DNA, 103 bp, Artificial Sequence
  Synthetic Polynucleotide
taatacgactcactatagggcctcatagcttgaccttcgagtgctgatccaacagaggagaggatcaatgctcgaaggtaacctggcggcagcgcaaaagatg

SEQ ID NO: 134907 - DNA, 103 bp, Artificial Sequence
  Synthetic Polynucleotide
taatacgactcactatagggaggctgctgtcctcatagcttgaccttcgaaacagaggagatcgaagatgaagctatgaaacctggcggcagcgcaaaagatg

SEQ ID NO: 134908 - DNA, 103 bp, Artificial Sequence
  Synthetic Polynucleotide
taatacgactcactataggggatggagggcaggctgctgtcctcatagctaacagaggagaagctatatggacagcagcaacctggcggcagcgcaaaagatg

SEQ ID NO: 134909 - DNA, 103 bp, Artificial Sequence
  Synthetic Polynucleotide
taatacgactcactatagggggagcgcattgatggagggcaggctgctgtaacagaggagaacagcaatgtgccctccaaacctggcggcagcgcaaaagatg

SEQ ID NO: 134910 - DNA, 103 bp, Artificial Sequence
  Synthetic Polynucleotide
taatacgactcactatagggtccgcctgcaggagcgcattgatggagggcaacagaggagagccctcatgcaatgcgctaacctggcggcagcgcaaaagatg

SEQ ID NO: 134911 - DNA, 103 bp, Artificial Sequence
  Synthetic Polynucleotide
taatacgactcactatagggtggggacgtgtcgtaagaactctccactggaacagaggagaccagtgatgagttcttacaacctggcggcagcgcaaaagatg

SEQ ID NO: 134912 - DNA, 103 bp, Artificial Sequence
  Synthetic Polynucleotide
taatacgactcactatagggggacaggacctccgcctgcaggagcgcattaacagaggagaaatgcgatgctgcaggcgaacctggcggcagcgcaaaagatg

SEQ ID NO: 134913 - DNA, 103 bp, Artificial Sequence
  Synthetic Polynucleotide
taatacgactcactatagggtgatctgtcgggacaggacctccgcctgcaaacagaggagatgcaggatgaggtcctgtaacctggcggcagcgcaaaagatg

SEQ ID NO: 134914 - DNA, 103 bp, Artificial Sequence
  Synthetic Polynucleotide
taatacgactcactatagggacgggggaggtgatctgtcgggacaggaccaacagaggagaggtcctatgccgacagataacctggcggcagcgcaaaagatg

SEQ ID NO: 134915 - DNA, 103 bp, Artificial Sequence
  Synthetic Polynucleotide
taatacgactcactataggggatcccggagacgggggaggtgatctgtcgaacagaggagacgacagatgacctcccccaacctggcggcagcgcaaaagatg

SEQ ID NO: 134916 - DNA, 103 bp, Artificial Sequence
  Synthetic Polynucleotide
taatacgactcactatagggtgtcgccgttgatcccggagacgggggaggaacagaggagacctcccatgtctccgggaaacctggcggcagcgcaaaagatg

SEQ ID NO: 134917 - DNA, 103 bp, Artificial Sequence
  Synthetic Polynucleotide
taatacgactcactatagggttcgcccgaatgtcgccgttgatcccggagaacagaggagactccggatgcaacggcgaaacctggcggcagcgcaaaagatg

SEQ ID NO: 134918 - DNA, 103 bp, Artificial Sequence
  Synthetic Polynucleotide
taatacgactcactatagggggcaatcttcttcgcccgaatgtcgccgttaacagaggagaaacggcatgattcgggcgaacctggcggcagcgcaaaagatg

SEQ ID NO: 134919 - DNA, 103 bp, Artificial Sequence
  Synthetic Polynucleotide
taatacgactcactatagggctgcgatgctggcaatcttcttcgcccgaaaacagaggagattcgggatgagaagattgaacctggcggcagcgcaaaagatg

SEQ ID NO: 134920 - DNA, 103 bp, Artificial Sequence
  Synthetic Polynucleotide
taatacgactcactatagggtcacacacatctgcgatgctggcaatcttcaacagaggagagaagatatgcagcatcgcaacctggcggcagcgcaaaagatg

SEQ ID NO: 134921 - DNA, 103 bp, Artificial Sequence
  Synthetic Polynucleotide
taatacgactcactatagggcttcatggactcacacacatctgcgatgctaacagaggagaagcatcatggatgtgtgtaacctggcggcagcgcaaaagatg

SEQ ID NO: 134922 - DNA, 103 bp, Artificial Sequence
  Synthetic Polynucleotide
taatacgactcactatagggtgccttctgatggggacgtgtcgtaagaacaacagaggagagttcttatgacacgtcccaacctggcggcagcgcaaaagatg

SEQ ID NO: 134923 - DNA, 103 bp, Artificial Sequence
  Synthetic Polynucleotide
taatacgactcactataggggcagctgctccttcatggactcacacacataacagaggagaatgtgtatgagtccatgaaacctggcggcagcgcaaaagatg

SEQ ID NO: 134924 - DNA, 103 bp, Artificial Sequence
  Synthetic Polynucleotide
taatacgactcactatagggacgagaaccagcagctgctccttcatggacaacagaggagagtccatatgggagcagctaacctggcggcagcgcaaaagatg

SEQ ID NO: 134925 - DNA, 103 bp, Artificial Sequence
  Synthetic Polynucleotide
taatacgactcactatagggggcccactcaacgagaaccagcagctgctcaacagaggagagagcagatgctggttctcaacctggcggcagcgcaaaagatg

SEQ ID NO: 134926 - DNA, 103 bp, Artificial Sequence
  Synthetic Polynucleotide
taatacgactcactatagggggatgtacttggcccactcaacgagaaccaaacagaggagatggttcatgttgagtgggaacctggcggcagcgcaaaagatg

SEQ ID NO: 134927 - DNA, 103 bp, Artificial Sequence
  Synthetic Polynucleotide
taatacgactcactatagggcagaaagctgggatgtacttggcccactcaaacagaggagatgagtgatgcaagtacataacctggcggcagcgcaaaagatg

SEQ ID NO: 134928 - DNA, 103 bp, Artificial Sequence
  Synthetic Polynucleotide
taatacgactcactatagggggggagctcgcagaaagctgggatgtacttaacagaggagaaagtacatgccagctttcaacctggcggcagcgcaaaagatg

SEQ ID NO: 134929 - DNA, 103 bp, Artificial Sequence
  Synthetic Polynucleotide
taatacgactcactatagggggtcgtccagggggagctcgcagaaagctgaacagaggagacagcttatggcgagctccaacctggcggcagcgcaaaagatg

SEQ ID NO: 134930 - DNA, 103 bp, Artificial Sequence
  Synthetic Polynucleotide
taatacgactcactatagggagggccacctggtcgtccagggggagctcgaacagaggagacgagctatgcctggacgaaacctggcggcagcgcaaaagatg

SEQ ID NO: 134931 - DNA, 103 bp, Artificial Sequence
  Synthetic Polynucleotide
taatacgactcactatagggggctctgagcagggccacctggtcgtccagaacagaggagactggacatgcaggtggccaacctggcggcagcgcaaaagatg

SEQ ID NO: 134932 - DNA, 103 bp, Artificial Sequence
  Synthetic Polynucleotide
taatacgactcactatagggcgccagcatgggctctgagcagggccacctaacagaggagaaggtggatgtgctcagagaacctggcggcagcgcaaaagatg

SEQ ID NO: 134933 - DNA, 103 bp, Artificial Sequence
  Synthetic Polynucleotide
taatacgactcactatagggttgaggttggtgccttctgatggggacgtgaacagaggagacacgtcatgatcagaaggaacctggcggcagcgcaaaagatg

SEQ ID NO: 134934 - DNA, 103 bp, Artificial Sequence
  Synthetic Polynucleotide
taatacgactcactatagggagcaggtgctcgccagcatgggctctgagcaacagaggagagctcagatgccatgctggaacctggcggcagcgcaaaagatg

SEQ ID NO: 134935 - DNA, 103 bp, Artificial Sequence
  Synthetic Polynucleotide
taatacgactcactatagggggctccgagcagcaggtgctcgccagcatgaacagaggagacatgctatggagcacctgaacctggcggcagcgcaaaagatg

SEQ ID NO: 134936 - DNA, 103 bp, Artificial Sequence
  Synthetic Polynucleotide
taatacgactcactatagggatctcttggtggctccgagcagcaggtgctaacagaggagaagcaccatgtgctcggagaacctggcggcagcgcaaaagatg

SEQ ID NO: 134937 - DNA, 103 bp, Artificial Sequence
  Synthetic Polynucleotide
taatacgactcactatagggaacaccatggatctcttggtggctccgagcaacagaggagagctcggatgcaccaagagaacctggcggcagcgcaaaagatg

SEQ ID NO: 134938 - DNA, 103 bp, Artificial Sequence
  Synthetic Polynucleotide
taatacgactcactatagggcacgtccttgaacaccatggatctcttggtaacagaggagaaccaagatgtccatggtgaacctggcggcagcgcaaaagatg

SEQ ID NO: 134939 - DNA, 103 bp, Artificial Sequence
  Synthetic Polynucleotide
taatacgactcactatagggctaggagcagcacgtccttgaacaccatggaacagaggagaccatggatgtcaaggacgaacctggcggcagcgcaaaagatg

SEQ ID NO: 134940 - DNA, 103 bp, Artificial Sequence
  Synthetic Polynucleotide
taatacgactcactatagggtagtcattgcctaggagcagcacgtccttgaacagaggagacaaggaatggctgctcctaacctggcggcagcgcaaaagatg

SEQ ID NO: 134941 - DNA, 103 bp, Artificial Sequence
  Synthetic Polynucleotide
taatacgactcactatagggagggacaatgtagtcattgcctaggagcagaacagaggagactgctcatgggcaatgacaacctggcggcagcgcaaaagatg

SEQ ID NO: 134942 - DNA, 103 bp, Artificial Sequence
  Synthetic Polynucleotide
taatacgactcactatagggggcagtgccgagggacaatgtagtcattgcaacagaggagagcaatgatgacattgtccaacctggcggcagcgcaaaagatg

SEQ ID NO: 134943 - DNA, 103 bp, Artificial Sequence
  Synthetic Polynucleotide
taatacgactcactataggggccagctccgggcagtgccgagggacaatgaacagaggagacattgtatgtcggcactgaacctggcggcagcgcaaaagatg

SEQ ID NO: 134944 - DNA, 103 bp, Artificial Sequence
  Synthetic Polynucleotide
taatacgactcactataggggttgggcgcgttgaggttggtgccttctgaaacagaggagatcagaaatgaccaacctcaacctggcggcagcgcaaaagatg

SEQ ID NO: 134945 - DNA, 103 bp, Artificial Sequence
  Synthetic Polynucleotide
taatacgactcactataggggctcatctccgccagctccgggcagtgccgaacagaggagacggcacatgccggagctgaacctggcggcagcgcaaaagatg

SEQ ID NO: 134946 - DNA, 103 bp, Artificial Sequence
  Synthetic Polynucleotide
taatacgactcactatagggtggacacccggctcatctccgccagctccgaacagaggagacggagcatgcggagatgaaacctggcggcagcgcaaaagatg

SEQ ID NO: 134947 - DNA, 103 bp, Artificial Sequence
  Synthetic Polynucleotide
taatacgactcactatagggaggatgcgtatggacacccggctcatctccaacagaggagaggagatatgccgggtgtcaacctggcggcagcgcaaaagatg

SEQ ID NO: 134948 - DNA, 103 bp, Artificial Sequence
  Synthetic Polynucleotide
taatacgactcactatagggcagctcgtcaaggatgcgtatggacacccgaacagaggagacgggtgatgatacgcatcaacctggcggcagcgcaaaagatg

SEQ ID NO: 134949 - DNA, 103 bp, Artificial Sequence
  Synthetic Polynucleotide
taatacgactcactatagggagggcagcaccagctcgtcaaggatgcgtaaacagaggagatacgcaatgttgacgagcaacctggcggcagcgcaaaagatg

SEQ ID NO: 134950 - DNA, 103 bp, Artificial Sequence
  Synthetic Polynucleotide
taatacgactcactatagggagctcctggaagggcagcaccagctcgtcaaacagaggagatgacgaatgggtgctgccaacctggcggcagcgcaaaagatg

SEQ ID NO: 134951 - DNA, 103 bp, Artificial Sequence
  Synthetic Polynucleotide
taatacgactcactatagggatcgatctgcagctcctggaagggcagcacaacagaggagagtgctgatgttccaggagaacctggcggcagcgcaaaagatg

SEQ ID NO: 134952 - DNA, 103 bp, Artificial Sequence
  Synthetic Polynucleotide
taatacgactcactatagggactcattgtcatcgatctgcagctcctggaaacagaggagatccaggatgtgcagatcgaacctggcggcagcgcaaaagatg

SEQ ID NO: 134953 - DNA, 103 bp, Artificial Sequence
  Synthetic Polynucleotide
taatacgactcactatagggaggtaggcatactcattgtcatcgatctgcaacagaggagagcagatatgtgacaatgaaacctggcggcagcgcaaaagatg

SEQ ID NO: 134954 - DNA, 103 bp, Artificial Sequence
  Synthetic Polynucleotide
taatacgactcactataggggatggctttgaggtaggcatactcattgtcaacagaggagagacaatatgtatgcctacaacctggcggcagcgcaaaagatg

SEQ ID NO: 134955 - DNA, 103 bp, Artificial Sequence
  Synthetic Polynucleotide
taatacgactcactatagggcacccaggctgttgggcgcgttgaggttggaacagaggagaccaaccatgacgcgcccaaacctggcggcagcgcaaaagatg

SEQ ID NO: 134956 - DNA, 103 bp, Artificial Sequence
  Synthetic Polynucleotide
taatacgactcactatagggcaaagaagatgatggctttgaggtaggcataacagaggagaatgcctatgtcaaagccaaacctggcggcagcgcaaaagatg

SEQ ID NO: 134957 - DNA, 103 bp, Artificial Sequence
  Synthetic Polynucleotide
taatacgactcactataggggcatctgggtcaaagaagatgatggctttgaacagaggagacaaagcatgcatcttcttaacctggcggcagcgcaaaagatg

SEQ ID NO: 134958 - DNA, 103 bp, Artificial Sequence
  Synthetic Polynucleotide
taatacgactcactatagggcagccccttggcatctgggtcaaagaagataacagaggagaatcttcatggacccagataacctggcggcagcgcaaaagatg

SEQ ID NO: 134959 - DNA, 103 bp, Artificial Sequence
  Synthetic Polynucleotide
taatacgactcactatagggctggatcgctcagccccttggcatctgggtaacagaggagaacccagatgccaaggggcaacctggcggcagcgcaaaagatg

SEQ ID NO: 134960 - DNA, 103 bp, Artificial Sequence
  Synthetic Polynucleotide
taatacgactcactatagggttgatcttccctggatcgctcagccccttgaacagaggagacaagggatggagcgatccaacctggcggcagcgcaaaagatg

SEQ ID NO: 134961 - DNA, 103 bp, Artificial Sequence
  Synthetic Polynucleotide
taatacgactcactatagggacgcagccgcttgatcttccctggatcgctaacagaggagaagcgatatggggaagatcaacctggcggcagcgcaaaagatg

SEQ ID NO: 134962 - DNA, 103 bp, Artificial Sequence
  Synthetic Polynucleotide
taatacgactcactataggggcacctgggaacgcagccgcttgatcttccaacagaggagaggaagaatgagcggctgcaacctggcggcagcgcaaaagatg

SEQ ID NO: 134963 - DNA, 103 bp, Artificial Sequence
  Synthetic Polynucleotide
taatacgactcactatagggaagctcacctgcacctgggaacgcagccgcaacagaggagagcggctatgttcccaggtaacctggcggcagcgcaaaagatg

SEQ ID NO: 134964 - DNA, 103 bp, Artificial Sequence
  Synthetic Polynucleotide
taatacgactcactataggggtagtcctccaagctcacctgcacctgggaaacagaggagatcccagatgcaggtgagcaacctggcggcagcgcaaaagatg

SEQ ID NO: 134965 - DNA, 103 bp, Artificial Sequence
  Synthetic Polynucleotide
taatacgactcactatagggggtcgttgatgtagtcctccaagctcacctaacagaggagaaggtgaatgtggaggactaacctggcggcagcgcaaaagatg

SEQ ID NO: 134966 - DNA, 103 bp, Artificial Sequence
  Synthetic Polynucleotide
taatacgactcactatagggagggcgctgacacccaggctgttgggcgcgaacagaggagacgcgccatgcagcctgggaacctggcggcagcgcaaaagatg

SEQ ID NO: 134967 - DNA, 103 bp, Artificial Sequence
  Synthetic Polynucleotide
taatacgactcactatagggtcatactggcggtcgttgatgtagtcctccaacagaggagaggaggaatgcatcaacgaaacctggcggcagcgcaaaagatg

SEQ ID NO: 134968 - DNA, 103 bp, Artificial Sequence
  Synthetic Polynucleotide
taatacgactcactataggggccacgcgagtcatactggcggtcgttgataacagaggagaatcaacatgcgccagtataacctggcggcagcgcaaaagatg

SEQ ID NO: 134969 - DNA, 103 bp, Artificial Sequence
  Synthetic Polynucleotide
taatacgactcactatagggctccaaagcggccacgcgagtcatactggcaacagaggagagccagtatgactcgcgtgaacctggcggcagcgcaaaagatg

SEQ ID NO: 134970 - DNA, 103 bp, Artificial Sequence
  Synthetic Polynucleotide
taatacgactcactatagggagcagcagctctccaaagcggccacgcgagaacagaggagactcgcgatgccgctttggaacctggcggcagcgcaaaagatg

SEQ ID NO: 134971 - DNA, 103 bp, Artificial Sequence
  Synthetic Polynucleotide
taatacgactcactataggggggcagcagcagcagcagctctccaaagcgaacagaggagacgctttatggagctgctgaacctggcggcagcgcaaaagatg

SEQ ID NO: 134972 - DNA, 103 bp, Artificial Sequence
  Synthetic Polynucleotide
taatacgactcactatagggtctgcaaggtgggcagcagcagcagcagctaacagaggagaagctgcatgtgctgctgcaacctggcggcagcgcaaaagatg

SEQ ID NO: 134973 - DNA, 103 bp, Artificial Sequence
  Synthetic Polynucleotide
taatacgactcactatagggcaggtgatgctctgcaaggtgggcagcagcaacagaggagagctgctatgcaccttgcaaacctggcggcagcgcaaaagatg

SEQ ID NO: 134974 - DNA, 103 bp, Artificial Sequence
  Synthetic Polynucleotide
taatacgactcactataggggatcatctgccaggtgatgctctgcaaggtaacagaggagaaccttgatgagcatcaccaacctggcggcagcgcaaaagatg

SEQ ID NO: 134975 - DNA, 103 bp, Artificial Sequence
  Synthetic Polynucleotide
taatacgactcactatagggggatctgctcgatcatctgccaggtgatgcaacagaggagagcatcaatgggcagatgaaacctggcggcagcgcaaaagatg

SEQ ID NO: 134976 - DNA, 103 bp, Artificial Sequence
  Synthetic Polynucleotide
taatacgactcactatagggttgatgaactggatctgctcgatcatctgcaacagaggagagcagatatgcgagcagataacctggcggcagcgcaaaagatg

SEQ ID NO: 134977 - DNA, 103 bp, Artificial Sequence
  Synthetic Polynucleotide
taatacgactcactatagggacagttgacaccgttgtctgtggtattcataacagaggagaatgaatatgacagacaacaacctggcggcagcgcaaaagatg

SEQ ID NO: 134978 - DNA, 103 bp, Artificial Sequence
  Synthetic Polynucleotide
taatacgactcactatagggaatgctgcgtctgaagaaacccttgcacccaacagaggagagggtgcatgggtttcttcaacctggcggcagcgcaaaagatg

SEQ ID NO: 134979 - DNA, 103 bp, Artificial Sequence
  Synthetic Polynucleotide
taatacgactcactatagggcattggatgatggagatgactgccatcattaacagaggagaaatgatatgagtcatctcaacctggcggcagcgcaaaagatg

SEQ ID NO: 134980 - DNA, 103 bp, Artificial Sequence
  Synthetic Polynucleotide
taatacgactcactatagggaatgtggatgcattggatgatggagatgacaacagaggagagtcatcatgatcatccaaaacctggcggcagcgcaaaagatg

SEQ ID NO: 134981 - DNA, 103 bp, Artificial Sequence
  Synthetic Polynucleotide
taatacgactcactatagggtcttgagacaaatgtggatgcattggatgaaacagaggagatcatccatggcatccacaaacctggcggcagcgcaaaagatg

SEQ ID NO: 134982 - DNA, 103 bp, Artificial Sequence
  Synthetic Polynucleotide
taatacgactcactatagggagttaatgggtcttgagacaaatgtggatgaacagaggagacatccaatgttgtctcaaaacctggcggcagcgcaaaagatg

SEQ ID NO: 134983 - DNA, 103 bp, Artificial Sequence
  Synthetic Polynucleotide
taatacgactcactatagggtagtttgtccagttaatgggtcttgagacaaacagaggagatgtctcatgacccattaaaacctggcggcagcgcaaaagatg

SEQ ID NO: 134984 - DNA, 103 bp, Artificial Sequence
  Synthetic Polynucleotide
taatacgactcactatagggcctaaaagtatagtttgtccagttaatgggaacagaggagacccattatgtggacaaacaacctggcggcagcgcaaaagatg

SEQ ID NO: 134985 - DNA, 103 bp, Artificial Sequence
  Synthetic Polynucleotide
taatacgactcactatagggtgacatgggacctaaaagtatagtttgtccaacagaggagaggacaaatgatacttttaaacctggcggcagcgcaaaagatg

SEQ ID NO: 134986 - DNA, 103 bp, Artificial Sequence
  Synthetic Polynucleotide
taatacgactcactataggggaaccagtgttgacatgggacctaaaagtaaacagaggagatactttatggtcccatgtaacctggcggcagcgcaaaagatg

SEQ ID NO: 134987 - DNA, 103 bp, Artificial Sequence
  Synthetic Polynucleotide
taatacgactcactatagggtggtctgcatgaaccagtgttgacatgggaaacagaggagatcccatatgaacactggtaacctggcggcagcgcaaaagatg

SEQ ID NO: 134988 - DNA, 103 bp, Artificial Sequence
  Synthetic Polynucleotide
taatacgactcactatagggagttgagatctggtctgcatgaaccagtgtaacagaggagaacactgatgcatgcagacaacctggcggcagcgcaaaagatg

SEQ ID NO: 134989 - DNA, 103 bp, Artificial Sequence
  Synthetic Polynucleotide
taatacgactcactataggggactcttacgaatgctgcgtctgaagaaacaacagaggagagtttctatggacgcagcaaacctggcggcagcgcaaaagatg

SEQ ID NO: 134990 - DNA, 103 bp, Artificial Sequence
  Synthetic Polynucleotide
taatacgactcactataggggggtttcaggagttgagatctggtctgcataacagaggagaatgcagatgagatctcaaaacctggcggcagcgcaaaagatg

SEQ ID NO: 134991 - DNA, 103 bp, Artificial Sequence
  Synthetic Polynucleotide
taatacgactcactataggggaagggagtggggtttcaggagttgagatcaacagaggagagatctcatgtcctgaaacaacctggcggcagcgcaaaagatg

SEQ ID NO: 134992 - DNA, 103 bp, Artificial Sequence
  Synthetic Polynucleotide
taatacgactcactatagggttgtggtggggaagggagtggggtttcaggaacagaggagacctgaaatgccactccctaacctggcggcagcgcaaaagatg

SEQ ID NO: 134993 - DNA, 103 bp, Artificial Sequence
  Synthetic Polynucleotide
taatacgactcactataggggcccagagccttgtggtggggaagggagtgaacagaggagacactccatgccccaccacaacctggcggcagcgcaaaagatg

SEQ ID NO: 134994 - DNA, 103 bp, Artificial Sequence
  Synthetic Polynucleotide
taatacgactcactatagggtactgttcttgcccagagccttgtggtgggaacagaggagacccaccatgaggctctggaacctggcggcagcgcaaaagatg

SEQ ID NO: 134995 - DNA, 103 bp, Artificial Sequence
  Synthetic Polynucleotide
taatacgactcactatagggagctattttgtactgttcttgcccagagccaacagaggagaggctctatgcaagaacagaacctggcggcagcgcaaaagatg

SEQ ID NO: 134996 - DNA, 103 bp, Artificial Sequence
  Synthetic Polynucleotide
taatacgactcactatagggcttggtttgcagctattttgtactgttcttaacagaggagaaagaacatgacaaaatagaacctggcggcagcgcaaaagatg

SEQ ID NO: 134997 - DNA, 103 bp, Artificial Sequence
  Synthetic Polynucleotide
taatacgactcactatagggatgactgatgcttggtttgcagctattttgaacagaggagacaaaatatgtgcaaaccaaacctggcggcagcgcaaaagatg

SEQ ID NO: 134998 - DNA, 103 bp, Artificial Sequence
  Synthetic Polynucleotide
taatacgactcactatagggctggtgtgaaatgactgatgcttggtttgcaacagaggagagcaaacatggcatcagtcaacctggcggcagcgcaaaagatg

SEQ ID NO: 134999 - DNA, 103 bp, Artificial Sequence
  Synthetic Polynucleotide
taatacgactcactatagggtggagagatgctggtgtgaaatgactgatgaacagaggagacatcagatgtttcacaccaacctggcggcagcgcaaaagatg

SEQ ID NO: 135000 - DNA, 103 bp, Artificial Sequence
  Synthetic Polynucleotide
taatacgactcactataggggaataaacgtgactcttacgaatgctgcgtaacagaggagaacgcagatgtcgtaagagaacctggcggcagcgcaaaagatg

SEQ ID NO: 135001 - DNA, 103 bp, Artificial Sequence
  Synthetic Polynucleotide
taatacgactcactatagggtgcttttgtttggagagatgctggtgtgaaaacagaggagattcacaatggcatctctcaacctggcggcagcgcaaaagatg

SEQ ID NO: 135002 - DNA, 103 bp, Artificial Sequence
  Synthetic Polynucleotide
taatacgactcactataggggaacctgcaagaataaacgtgactcttacgaacagaggagacgtaagatgcacgtttataacctggcggcagcgcaaaagatg

SEQ ID NO: 135003 - DNA, 103 bp, Artificial Sequence
  Synthetic Polynucleotide
taatacgactcactatagggattgccgactgaacctgcaagaataaacgtaacagaggagaacgtttatgcttgcaggtaacctggcggcagcgcaaaagatg

SEQ ID NO: 135004 - DNA, 103 bp, Artificial Sequence
  Synthetic Polynucleotide
taatacgactcactatagggtcaacaacacattgccgactgaacctgcaaaacagaggagattgcagatgcagtcggcaaacctggcggcagcgcaaaagatg

SEQ ID NO: 135005 - DNA, 103 bp, Artificial Sequence
  Synthetic Polynucleotide
taatacgactcactatagggtttgtccttgtcaacaacacattgccgactaacagaggagaagtcggatgtgtgttgttaacctggcggcagcgcaaaagatg

SEQ ID NO: 135006 - DNA, 103 bp, Artificial Sequence
  Synthetic Polynucleotide
taatacgactcactatagggattgattccttttgtccttgtcaacaacacaacagaggagagtgttgatgacaaggacaaacctggcggcagcgcaaaagatg

SEQ ID NO: 135007 - DNA, 103 bp, Artificial Sequence
  Synthetic Polynucleotide
taatacgactcactatagggcaatatctacattgattccttttgtccttgaacagaggagacaaggaatgaaggaatcaaacctggcggcagcgcaaaagatg

SEQ ID NO: 135008 - DNA, 103 bp, Artificial Sequence
  Synthetic Polynucleotide
taatacgactcactatagggtcttaatcgacaatatctacattgattcctaacagaggagaaggaatatgtgtagatataacctggcggcagcgcaaaagatg

SEQ ID NO: 135009 - DNA, 103 bp, Artificial Sequence
  Synthetic Polynucleotide
taatacgactcactatagggtagcacacagacagttgacaccgttgtctgaacagaggagacagacaatggtgtcaactaacctggcggcagcgcaaaagatg

SEQ ID NO: 135010 - DNA, 103 bp, Artificial Sequence
  Synthetic Polynucleotide
taatacgactcactatagggtaaaacactttcttaatcgacaatatctacaacagaggagagtagatatggtcgattaaaacctggcggcagcgcaaaagatg

SEQ ID NO: 135011 - DNA, 103 bp, Artificial Sequence
  Synthetic Polynucleotide
taatacgactcactatagggattcccgctctaaaacactttcttaatcgaaacagaggagatcgattatgaaagtgtttaacctggcggcagcgcaaaagatg

SEQ ID NO: 135012 - DNA, 103 bp, Artificial Sequence
  Synthetic Polynucleotide
taatacgactcactatagggttcttttttcattcccgctctaaaacacttaacagaggagaaagtgtatgagagcgggaaacctggcggcagcgcaaaagatg

SEQ ID NO: 135013 - DNA, 103 bp, Artificial Sequence
  Synthetic Polynucleotide
taatacgactcactatagggtttgtacagcttcttttttcattcccgctcaacagaggagagagcggatgtgaaaaaagaacctggcggcagcgcaaaagatg

SEQ ID NO: 135014 - DNA, 103 bp, Artificial Sequence
  Synthetic Polynucleotide
taatacgactcactatagggtcacgttcattttgtacagcttcttttttcaacagaggagagaaaaaatgagctgtacaaacctggcggcagcgcaaaagatg

SEQ ID NO: 135015 - DNA, 103 bp, Artificial Sequence
  Synthetic Polynucleotide
taatacgactcactataggggcttattctgtcacgttcattttgtacagcaacagaggagagctgtaatgaatgaacgtaacctggcggcagcgcaaaagatg

SEQ ID NO: 135016 - DNA, 103 bp, Artificial Sequence
  Synthetic Polynucleotide
taatacgactcactatagggttcttctggtgcttattctgtcacgttcataacagaggagaatgaacatgacagaataaaacctggcggcagcgcaaaagatg

SEQ ID NO: 135017 - DNA, 103 bp, Artificial Sequence
  Synthetic Polynucleotide
taatacgactcactatagggtcaaatgtgcttcttctggtgcttattctgaacagaggagacagaatatgcaccagaagaacctggcggcagcgcaaaagatg

SEQ ID NO: 135018 - DNA, 103 bp, Artificial Sequence
  Synthetic Polynucleotide
taatacgactcactataggggttgctgccatcaaatgtgcttcttctggtaacagaggagaaccagaatgagcacatttaacctggcggcagcgcaaaagatg

SEQ ID NO: 135019 - DNA, 103 bp, Artificial Sequence
  Synthetic Polynucleotide
taatacgactcactatagggtggaggggatgttgctgccatcaaatgtgcaacagaggagagcacatatgatggcagcaaacctggcggcagcgcaaaagatg

SEQ ID NO: 135020 - DNA, 103 bp, Artificial Sequence
  Synthetic Polynucleotide
taatacgactcactatagggtccccacagatagcacacagacagttgacaaacagaggagatgtcaaatgtctgtgtgcaacctggcggcagcgcaaaagatg

SEQ ID NO: 135021 - DNA, 103 bp, Artificial Sequence
  Synthetic Polynucleotide
taatacgactcactatagggagtgtgttaatggaggggatgttgctgccaaacagaggagatggcagatgcatcccctcaacctggcggcagcgcaaaagatg

SEQ ID NO: 135022 - DNA, 103 bp, Artificial Sequence
  Synthetic Polynucleotide
taatacgactcactatagggagcttgtgccagtgtgttaatggaggggataacagaggagaatccccatgattaacacaaacctggcggcagcgcaaaagatg

SEQ ID NO: 135023 - DNA, 103 bp, Artificial Sequence
  Synthetic Polynucleotide
taatacgactcactatagggaccgaacttcagcttgtgccagtgtgttaaaacagaggagattaacaatgtggcacaagaacctggcggcagcgcaaaagatg

SEQ ID NO: 135024 - DNA, 103 bp, Artificial Sequence
  Synthetic Polynucleotide
taatacgactcactatagggatctggcgagaccgaacttcagcttgtgccaacagaggagaggcacaatgtgaagttcgaacctggcggcagcgcaaaagatg

SEQ ID NO: 135025 - DNA, 103 bp, Artificial Sequence
  Synthetic Polynucleotide
taatacgactcactatagggtgagactgagatctggcgagaccgaacttcaacagaggagagaagttatgtctcgccagaacctggcggcagcgcaaaagatg

SEQ ID NO: 135026 - DNA, 103 bp, Artificial Sequence
  Synthetic Polynucleotide
taatacgactcactatagggacccagggcttgagactgagatctggcgagaacagaggagactcgccatgtctcagtctaacctggcggcagcgcaaaagatg

SEQ ID NO: 135027 - DNA, 103 bp, Artificial Sequence
  Synthetic Polynucleotide
taatacgactcactatagggtcagtgcttgacccagggcttgagactgagaacagaggagactcagtatgaagccctggaacctggcggcagcgcaaaagatg

SEQ ID NO: 135028 - DNA, 103 bp, Artificial Sequence
  Synthetic Polynucleotide
taatacgactcactatagggaacgtttatgtcagtgcttgacccagggctaacagaggagaagccctatgtcaagcactaacctggcggcagcgcaaaagatg

SEQ ID NO: 135029 - DNA, 103 bp, Artificial Sequence
  Synthetic Polynucleotide
taatacgactcactatagggcaattttcttaacgtttatgtcagtgcttgaacagaggagacaagcaatgacataaacgaacctggcggcagcgcaaaagatg

SEQ ID NO: 135030 - DNA, 103 bp, Artificial Sequence
  Synthetic Polynucleotide
taatacgactcactatagggccaatacttgcaattttcttaacgtttatgaacagaggagacataaaatgtaagaaaataacctggcggcagcgcaaaagatg

SEQ ID NO: 135031 - DNA, 103 bp, Artificial Sequence
  Synthetic Polynucleotide
taatacgactcactatagggtgttgctctgtccccacagatagcacacagaacagaggagactgtgtatgatctgtgggaacctggcggcagcgcaaaagatg

SEQ ID NO: 135032 - DNA, 103 bp, Artificial Sequence
  Synthetic Polynucleotide
taatacgactcactatagggacagacatcaccaatacttgcaattttcttaacagaggagaaagaaaatggcaagtattaacctggcggcagcgcaaaagatg

SEQ ID NO: 135033 - DNA, 103 bp, Artificial Sequence
  Synthetic Polynucleotide
taatacgactcactatagggtcatagattcacagacatcaccaatacttgaacagaggagacaagtaatggtgatgtctaacctggcggcagcgcaaaagatg

SEQ ID NO: 135034 - DNA, 103 bp, Artificial Sequence
  Synthetic Polynucleotide
taatacgactcactatagggagctgctgtttcatagattcacagacatcaaacagaggagatgatgtatgtgaatctataacctggcggcagcgcaaaagatg

SEQ ID NO: 135035 - DNA, 103 bp, Artificial Sequence
  Synthetic Polynucleotide
taatacgactcactatagggcaagactaagagctgctgtttcatagattcaacagaggagagaatctatgaaacagcagaacctggcggcagcgcaaaagatg

SEQ ID NO: 135036 - DNA, 103 bp, Artificial Sequence
  Synthetic Polynucleotide
taatacgactcactatagggcccattccaccaagactaagagctgctgttaacagaggagaaacagcatgtcttagtctaacctggcggcagcgcaaaagatg

SEQ ID NO: 135037 - DNA, 103 bp, Artificial Sequence
  Synthetic Polynucleotide
taatacgactcactatagggatatatttagcccattccaccaagactaagaacagaggagacttagtatgggtggaatgaacctggcggcagcgcaaaagatg

SEQ ID NO: 135038 - DNA, 103 bp, Artificial Sequence
  Synthetic Polynucleotide
taatacgactcactataggggaaggcaggaatatatttagcccattccacaacagaggagagtggaaatggctaaatataacctggcggcagcgcaaaagatg

SEQ ID NO: 135039 - DNA, 103 bp, Artificial Sequence
  Synthetic Polynucleotide
taatacgactcactataggggtaattcacagaaggcaggaatatatttagaacagaggagactaaatatgttcctgcctaacctggcggcagcgcaaaagatg

SEQ ID NO: 135040 - DNA, 103 bp, Artificial Sequence
  Synthetic Polynucleotide
taatacgactcactatagggtcatccaatggtaattcacagaaggcaggaaacagaggagatcctgcatgctgtgaattaacctggcggcagcgcaaaagatg

SEQ ID NO: 135041 - DNA, 103 bp, Artificial Sequence
  Synthetic Polynucleotide
taatacgactcactatagggtgccacctgatcatccaatggtaattcacaaacagaggagatgtgaaatgccattggataacctggcggcagcgcaaaagatg

SEQ ID NO: 135042 - DNA, 103 bp, Artificial Sequence
  Synthetic Polynucleotide
taatacgactcactatagggagtgttttcctgttgctctgtccccacagaaacagaggagatctgtgatgacagagcaaaacctggcggcagcgcaaaagatg

SEQ ID NO: 135043 - DNA, 103 bp, Artificial Sequence
  Synthetic Polynucleotide
taatacgactcactatagggctctcaacagtgccacctgatcatccaatgaacagaggagacattggatgatcaggtggaacctggcggcagcgcaaaagatg

SEQ ID NO: 135044 - DNA, 103 bp, Artificial Sequence
  Synthetic Polynucleotide
taatacgactcactatagggcctgcgtgagctctcaacagtgccacctgaaacagaggagatcaggtatgactgttgagaacctggcggcagcgcaaaagatg

SEQ ID NO: 135045 - DNA, 103 bp, Artificial Sequence
  Synthetic Polynucleotide
taatacgactcactatagggtaagtgctcccctgcgtgagctctcaacagaacagaggagactgttgatggctcacgcaaacctggcggcagcgcaaaagatg

SEQ ID NO: 135046 - DNA, 103 bp, Artificial Sequence
  Synthetic Polynucleotide
taatacgactcactatagggctccaagcagtaagtgctcccctgcgtgagaacagaggagactcacgatggggagcactaacctggcggcagcgcaaaagatg

SEQ ID NO: 135047 - DNA, 103 bp, Artificial Sequence
  Synthetic Polynucleotide
taatacgactcactatagggctctttgtagctccaagcagtaagtgctccaacagaggagaggagcaatgactgcttggaacctggcggcagcgcaaaagatg

SEQ ID NO: 135048 - DNA, 103 bp, Artificial Sequence
  Synthetic Polynucleotide
taatacgactcactatagggcatcatggatctctttgtagctccaagcagaacagaggagactgcttatggctacaaagaacctggcggcagcgcaaaagatg

SEQ ID NO: 135049 - DNA, 103 bp, Artificial Sequence
  Synthetic Polynucleotide
taatacgactcactatagggtatctttatacatcatggatctctttgtagaacagaggagactacaaatggatccatgaaacctggcggcagcgcaaaagatg

SEQ ID NO: 135050 - DNA, 103 bp, Artificial Sequence
  Synthetic Polynucleotide
taatacgactcactatagggaaaagcaaaatatctttatacatcatggataacagaggagaatccatatggtataaagaaacctggcggcagcgcaaaagatg

SEQ ID NO: 135051 - DNA, 103 bp, Artificial Sequence
  Synthetic Polynucleotide
taatacgactcactataggggttgtttcccaaaagcaaaatatctttataaacagaggagatataaaatgattttgcttaacctggcggcagcgcaaaagatg

SEQ ID NO: 135052 - DNA, 103 bp, Artificial Sequence
  Synthetic Polynucleotide
taatacgactcactataggggaataacatagttgtttcccaaaagcaaaaaacagaggagattttgcatgtgggaaacaaacctggcggcagcgcaaaagatg

SEQ ID NO: 135053 - DNA, 103 bp, Artificial Sequence
  Synthetic Polynucleotide
taatacgactcactataggggatgccccatagtgttttcctgttgctctgaacagaggagacagagcatgaggaaaacaaacctggcggcagcgcaaaagatg

SEQ ID NO: 135054 - DNA, 103 bp, Artificial Sequence
  Synthetic Polynucleotide
taatacgactcactatagggctgttgcggtgaataacatagttgtttcccaacagaggagagggaaaatgctatgttataacctggcggcagcgcaaaagatg

SEQ ID NO: 135055 - DNA, 103 bp, Artificial Sequence
  Synthetic Polynucleotide
taatacgactcactatagggaacttcacagctgttgcggtgaataacataaacagaggagatatgttatgcaccgcaacaacctggcggcagcgcaaaagatg

SEQ ID NO: 135056 - DNA, 103 bp, Artificial Sequence
  Synthetic Polynucleotide
taatacgactcactatagggggctaatctcaacttcacagctgttgcggtaacagaggagaaccgcaatggctgtgaagaacctggcggcagcgcaaaagatg

SEQ ID NO: 135057 - DNA, 103 bp, Artificial Sequence
  Synthetic Polynucleotide
taatacgactcactatagggttggccacacggctaatctcaacttcacagaacagaggagactgtgaatgtgagattagaacctggcggcagcgcaaaagatg

SEQ ID NO: 135058 - DNA, 103 bp, Artificial Sequence
  Synthetic Polynucleotide
taatacgactcactatagggtagaacacgattggccacacggctaatctcaacagaggagagagattatgcgtgtggccaacctggcggcagcgcaaaagatg

SEQ ID NO: 135059 - DNA, 103 bp, Artificial Sequence
  Synthetic Polynucleotide
taatacgactcactatagggccagctcatctagaacacgattggccacacaacagaggagagtgtggatgatcgtgttcaacctggcggcagcgcaaaagatg

SEQ ID NO: 135060 - DNA, 103 bp, Artificial Sequence
  Synthetic Polynucleotide
taatacgactcactatagggaatggtctaaccagctcatctagaacacgaaacagaggagatcgtgtatgagatgagctaacctggcggcagcgcaaaagatg

SEQ ID NO: 135061 - DNA, 103 bp, Artificial Sequence
  Synthetic Polynucleotide
taatacgactcactataggggatttcttgaaatggtctaaccagctcatcaacagaggagagatgagatggttagaccaaacctggcggcagcgcaaaagatg

SEQ ID NO: 135062 - DNA, 103 bp, Artificial Sequence
  Synthetic Polynucleotide
taatacgactcactatagggcatcaatctggatttcttgaaatggtctaaaacagaggagattagacatgttcaagaaaaacctggcggcagcgcaaaagatg

SEQ ID NO: 135063 - DNA, 103 bp, Artificial Sequence
  Synthetic Polynucleotide
taatacgactcactatagggtactcattgtcatcaatctggatttcttgaaacagaggagatcaagaatgccagattgaaacctggcggcagcgcaaaagatg

SEQ ID NO: 135064 - DNA, 103 bp, Artificial Sequence
  Synthetic Polynucleotide
taatacgactcactatagggatcacagctggatgccccatagtgttttccaacagaggagaggaaaaatgtatggggcaaacctggcggcagcgcaaaagatg

SEQ ID NO: 135065 - DNA, 103 bp, Artificial Sequence
  Synthetic Polynucleotide
taatacgactcactatagggtaaacaagcatactcattgtcatcaatctgaacagaggagacagattatggacaatgagaacctggcggcagcgcaaaagatg

SEQ ID NO: 135066 - DNA, 103 bp, Artificial Sequence
  Synthetic Polynucleotide
taatacgactcactatagggcaattgcctttaaacaagcatactcattgtaacagaggagaacaatgatgatgcttgttaacctggcggcagcgcaaaagatg

SEQ ID NO: 135067 - DNA, 103 bp, Artificial Sequence
  Synthetic Polynucleotide
taatacgactcactatagggtcaaaaaatacaattgcctttaaacaagcaaacagaggagatgcttgatgaaaggcaataacctggcggcagcgcaaaagatg

SEQ ID NO: 135068 - DNA, 103 bp, Artificial Sequence
  Synthetic Polynucleotide
taatacgactcactatagggtgcatctggatcaaaaaatacaattgccttaacagaggagaaaggcaatggtattttttaacctggcggcagcgcaaaagatg

SEQ ID NO: 135069 - DNA, 103 bp, Artificial Sequence
  Synthetic Polynucleotide
taatacgactcactatagggttagcccttttgcatctggatcaaaaaataaacagaggagatattttatgatccagatgaacctggcggcagcgcaaaagatg

SEQ ID NO: 135070 - DNA, 103 bp, Artificial Sequence
  Synthetic Polynucleotide
taatacgactcactatagggactggatcgcttagcccttttgcatctggaaacagaggagatccagaatgaaaagggctaacctggcggcagcgcaaaagatg

SEQ ID NO: 135071 - DNA, 103 bp, Artificial Sequence
  Synthetic Polynucleotide
taatacgactcactatagggcttaatttttactggatcgcttagccctttaacagaggagaaaagggatgagcgatccaaacctggcggcagcgcaaaagatg

SEQ ID NO: 135072 - DNA, 103 bp, Artificial Sequence
  Synthetic Polynucleotide
taatacgactcactatagggacctcatgttcttaatttttactggatcgcaacagaggagagcgatcatgtaaaaattaaacctggcggcagcgcaaaagatg

SEQ ID NO: 135073 - DNA, 103 bp, Artificial Sequence
  Synthetic Polynucleotide
taatacgactcactatagggtgcacttggaacctcatgttcttaatttttaacagaggagaaaaaatatggaacatgagaacctggcggcagcgcaaaagatg

SEQ ID NO: 135074 - DNA, 103 bp, Artificial Sequence
  Synthetic Polynucleotide
taatacgactcactatagggcaaaccgatctgcacttggaacctcatgttaacagaggagaaacatgatgttccaagtgaacctggcggcagcgcaaaagatg

SEQ ID NO: 135075 - DNA, 103 bp, Artificial Sequence
  Synthetic Polynucleotide
taatacgactcactatagggccttgcacccatcacagctggatgccccataacagaggagaatggggatgccagctgtgaacctggcggcagcgcaaaagatg

SEQ ID NO: 135076 - DNA, 103 bp, Artificial Sequence
  Synthetic Polynucleotide
taatacgactcactatagggtgtagtcctccaaaccgatctgcacttggaaacagaggagatccaagatgagatcggttaacctggcggcagcgcaaaagatg

SEQ ID NO: 135077 - DNA, 103 bp, Artificial Sequence
  Synthetic Polynucleotide
taatacgactcactatagggcgatcattgatgtagtcctccaaaccgatcaacagaggagagatcggatgggaggactaaacctggcggcagcgcaaaagatg

SEQ ID NO: 135078 - DNA, 103 bp, Artificial Sequence
  Synthetic Polynucleotide
taatacgactcactataggggtcatactgccgatcattgatgtagtcctcaacagaggagagaggacatgatcaatgataacctggcggcagcgcaaaagatg

SEQ ID NO: 135079 - DNA, 103 bp, Artificial Sequence
  Synthetic Polynucleotide
taatacgactcactatagggtcccccgggagtcatactgccgatcattgaaacagaggagatcaatgatgggcagtatgaacctggcggcagcgcaaaagatg

SEQ ID NO: 135080 - DNA, 103 bp, Artificial Sequence
  Synthetic Polynucleotide
taatacgactcactatagggtctccaaacctcccccgggagtcatactgcaacagaggagagcagtaatgctcccggggaacctggcggcagcgcaaaagatg

SEQ ID NO: 135081 - DNA, 103 bp, Artificial Sequence
  Synthetic Polynucleotide
taatacgactcactatagggcagaagcaactctccaaacctcccccgggaaacagaggagatcccggatgaggtttggaaacctggcggcagcgcaaaagatg

SEQ ID NO: 135082 - DNA, 103 bp, Artificial Sequence
  Synthetic Polynucleotide
taatacgactcactatagggtgggcaggagcagaagcaactctccaaaccaacagaggagaggtttgatgagttgcttcaacctggcggcagcgcaaaagatg

SEQ ID NO: 135083 - DNA, 103 bp, Artificial Sequence
  Synthetic Polynucleotide
taatacgactcactatagggctctgcagtgtgggcaggagcagaagcaacaacagaggagagttgctatggctcctgccaacctggcggcagcgcaaaagatg

SEQ ID NO: 135084 - DNA, 103 bp, Artificial Sequence
  Synthetic Polynucleotide
taatacgactcactatagggccacgtgatgctctgcagtgtgggcaggagaacagaggagactcctgatgacactgcagaacctggcggcagcgcaaaagatg

SEQ ID NO: 135085 - DNA, 103 bp, Artificial Sequence
  Synthetic Polynucleotide
taatacgactcactatagggcaatcatttgccacgtgatgctctgcagtgaacagaggagacactgcatggcatcacgtaacctggcggcagcgcaaaagatg

SEQ ID NO: 135086 - DNA, 103 bp, Artificial Sequence
  Synthetic Polynucleotide
taatacgactcactatagggctgaagaaacccttgcacccatcacagctgaacagaggagacagctgatgtgggtgcaaaacctggcggcagcgcaaaagatg

SEQ ID NO: 135087 - DNA, 103 bp, Artificial Sequence
  Synthetic Polynucleotide
taatacgactcactatagggtgtatttgctcaatcatttgccacgtgatgaacagaggagacatcacatggcaaatgataacctggcggcagcgcaaaagatg

SEQ ID NO: 135088 - DNA, 103 bp, Artificial Sequence
  Synthetic Polynucleotide
taatacgactcactatagggtttaacaaactgtatttgctcaatcatttgaacagaggagacaaatgatggagcaaataaacctggcggcagcgcaaaagatg

SEQ ID NO: 135089 - DNA, 103 bp, Artificial Sequence
  Synthetic Polynucleotide
taatacgactcactatagggtcccaaaaagtttaacaaactgtatttgctaacagaggagaagcaaaatgagtttgttaaacctggcggcagcgcaaaagatg

SEQ ID NO: 135090 - DNA, 103 bp, Artificial Sequence
  Synthetic Polynucleotide
taatacgactcactatagggattttaaccatcccaaaaagtttaacaaacaacagaggagagtttgtatgactttttggaacctggcggcagcgcaaaagatg

SEQ ID NO: 135091 - DNA, 103 bp, Artificial Sequence
  Synthetic Polynucleotide
taatacgactcactatagggtagattgtcaattttaaccatcccaaaaagaacagaggagactttttatgatggttaaaaacctggcggcagcgcaaaagatg

SEQ ID NO: 135092 - DNA, 103 bp, Artificial Sequence
  Synthetic Polynucleotide
taatacgactcactatagggtttcctgaagtagattgtcaattttaaccaaacagaggagatggttaatgttgacaatcaacctggcggcagcgcaaaagatg

SEQ ID NO: 135093 - DNA, 103 bp, Artificial Sequence
  Synthetic Polynucleotide
taatacgactcactatagggcctaatagcatttcctgaagtagattgtcaaacagaggagatgacaaatgacttcaggaaacctggcggcagcgcaaaagatg

SEQ ID NO: 135094 - DNA, 103 bp, Artificial Sequence
  Synthetic Polynucleotide
taatacgactcactatagggggaagccccacctaatagcatttcctgaagaacagaggagacttcagatgatgctattaaacctggcggcagcgcaaaagatg

SEQ ID NO: 135095 - DNA, 103 bp, Artificial Sequence
  Synthetic Polynucleotide
taatacgactcactatagggtgccatcattggaagccccacctaatagcaaacagaggagatgctatatggtggggcttaacctggcggcagcgcaaaagatg

SEQ ID NO: 135096 - DNA, 103 bp, Artificial Sequence
  Synthetic Polynucleotide
taatacgactcactatagggtggagatgactgccatcattggaagccccaaacagaggagatggggcatgcaatgatggaacctggcggcagcgcaaaagatg

SEQ ID NO: 135097 - DNA, 103 bp, Artificial Sequence
  Synthetic Polynucleotide
taatacgactcactatagggatctgtcttgttggtaacgttgctggccataacagaggagaatggccatgaacgttaccaacctggcggcagcgcaaaagatg

SEQ ID NO: 135098 - DNA, 103 bp, Artificial Sequence
  Synthetic Polynucleotide
taatacgactcactatagggatacttcgaaaagattgcctccacatcagaaacagaggagatctgatatggaggcaatcaacctggcggcagcgcaaaagatg

SEQ ID NO: 135099 - DNA, 103 bp, Artificial Sequence
  Synthetic Polynucleotide
taatacgactcactatagggcaattttgccatacttcgaaaagattgcctaacagaggagaaggcaaatgtttcgaagtaacctggcggcagcgcaaaagatg

SEQ ID NO: 135100 - DNA, 103 bp, Artificial Sequence
  Synthetic Polynucleotide
taatacgactcactataggggagcagcccacaattttgccatacttcgaaaacagaggagattcgaaatgtggcaaaataacctggcggcagcgcaaaagatg

SEQ ID NO: 135101 - DNA, 103 bp, Artificial Sequence
  Synthetic Polynucleotide
taatacgactcactatagggcttatgaacagagcagcccacaattttgccaacagaggagaggcaaaatggtgggctgcaacctggcggcagcgcaaaagatg

SEQ ID NO: 135102 - DNA, 103 bp, Artificial Sequence
  Synthetic Polynucleotide
taatacgactcactatagggaggcaaagcccttatgaacagagcagcccaaacagaggagatgggctatgctgttcataaacctggcggcagcgcaaaagatg

SEQ ID NO: 135103 - DNA, 103 bp, Artificial Sequence
  Synthetic Polynucleotide
taatacgactcactatagggtactgaacgaaggcaaagcccttatgaacaaacagaggagatgttcaatggggctttgcaacctggcggcagcgcaaaagatg

SEQ ID NO: 135104 - DNA, 103 bp, Artificial Sequence
  Synthetic Polynucleotide
taatacgactcactatagggctcattaacatactgaacgaaggcaaagccaacagaggagaggctttatgttcgttcagaacctggcggcagcgcaaaagatg

SEQ ID NO: 135105 - DNA, 103 bp, Artificial Sequence
  Synthetic Polynucleotide
taatacgactcactataggggggcatttctctcattaacatactgaacgaaacagaggagatcgttcatgatgttaatgaacctggcggcagcgcaaaagatg

SEQ ID NO: 135106 - DNA, 103 bp, Artificial Sequence
  Synthetic Polynucleotide
taatacgactcactatagggacagcagcccgggcatttctctcattaacaaacagaggagatgttaaatggagaaatgcaacctggcggcagcgcaaaagatg

SEQ ID NO: 135107 - DNA, 103 bp, Artificial Sequence
  Synthetic Polynucleotide
taatacgactcactatagggctctcctgctacagcagcccgggcatttctaacagaggagaagaaatatgcgggctgctaacctggcggcagcgcaaaagatg

SEQ ID NO: 135108 - DNA, 103 bp, Artificial Sequence
  Synthetic Polynucleotide
taatacgactcactatagggtggagcgaggatctgtcttgttggtaacgtaacagaggagaacgttaatgacaagacagaacctggcggcagcgcaaaagatg

SEQ ID NO: 135109 - DNA, 103 bp, Artificial Sequence
  Synthetic Polynucleotide
taatacgactcactatagggttctgccatcctctcctgctacagcagcccaacagaggagagggctgatgtagcaggagaacctggcggcagcgcaaaagatg

SEQ ID NO: 135110 - DNA, 103 bp, Artificial Sequence
  Synthetic Polynucleotide
taatacgactcactatagggccagcaatcattctgccatcctctcctgctaacagaggagaagcaggatgggatggcagaacctggcggcagcgcaaaagatg

SEQ ID NO: 135111 - DNA, 103 bp, Artificial Sequence
  Synthetic Polynucleotide
taatacgactcactatagggtaaaacctggccagcaatcattctgccatcaacagaggagagatggcatgatgattgctaacctggcggcagcgcaaaagatg

SEQ ID NO: 135112 - DNA, 103 bp, Artificial Sequence
  Synthetic Polynucleotide
taatacgactcactatagggggttaatatctaaaacctggccagcaatcaaacagaggagatgattgatggccaggtttaacctggcggcagcgcaaaagatg

SEQ ID NO: 135113 - DNA, 103 bp, Artificial Sequence
  Synthetic Polynucleotide
taatacgactcactatagggtctgcagccaggttaatatctaaaacctggaacagaggagaccaggtatgagatattaaaacctggcggcagcgcaaaagatg

SEQ ID NO: 135114 - DNA, 103 bp, Artificial Sequence
  Synthetic Polynucleotide
taatacgactcactatagggcacttttggctctgcagccaggttaatatcaacagaggagagatattatgctggctgcaaacctggcggcagcgcaaaagatg

SEQ ID NO: 135115 - DNA, 103 bp, Artificial Sequence
  Synthetic Polynucleotide
taatacgactcactatagggttcctcggttcacttttggctctgcagccaaacagaggagatggctgatgagccaaaagaacctggcggcagcgcaaaagatg

SEQ ID NO: 135116 - DNA, 103 bp, Artificial Sequence
  Synthetic Polynucleotide
taatacgactcactatagggacacctgcttttcctcggttcacttttggcaacagaggagagccaaaatggaaccgaggaacctggcggcagcgcaaaagatg

SEQ ID NO: 135117 - DNA, 103 bp, Artificial Sequence
  Synthetic Polynucleotide
taatacgactcactatagggagatcgtttcacacctgcttttcctcggttaacagaggagaaaccgaatgaaagcaggtaacctggcggcagcgcaaaagatg

SEQ ID NO: 135118 - DNA, 103 bp, Artificial Sequence
  Synthetic Polynucleotide
taatacgactcactatagggtctccgctgcagatcgtttcacacctgcttaacagaggagaaagcagatgtgaaacgataacctggcggcagcgcaaaagatg

SEQ ID NO: 135119 - DNA, 103 bp, Artificial Sequence
  Synthetic Polynucleotide
taatacgactcactatagggcgggagttcatggagcgaggatctgtcttgaacagaggagacaagacatgtcctcgctcaacctggcggcagcgcaaaagatg

SEQ ID NO: 135120 - DNA, 103 bp, Artificial Sequence
  Synthetic Polynucleotide
taatacgactcactataggggacccgtacatctccgctgcagatcgtttcaacagaggagagaaacgatgtgcagcggaaacctggcggcagcgcaaaagatg

SEQ ID NO: 135121 - DNA, 103 bp, Artificial Sequence
  Synthetic Polynucleotide
taatacgactcactatagggttctgttactgacccgtacatctccgctgcaacagaggagagcagcgatgatgtacgggaacctggcggcagcgcaaaagatg

SEQ ID NO: 135122 - DNA, 103 bp, Artificial Sequence
  Synthetic Polynucleotide
taatacgactcactataggggagaagggtgttctgttactgacccgtacaaacagaggagatgtacgatgcagtaacagaacctggcggcagcgcaaaagatg

SEQ ID NO: 135123 - DNA, 103 bp, Artificial Sequence
  Synthetic Polynucleotide
taatacgactcactatagggagaggggacggagaagggtgttctgttactaacagaggagaagtaacatgacacccttcaacctggcggcagcgcaaaagatg

SEQ ID NO: 135124 - DNA, 103 bp, Artificial Sequence
  Synthetic Polynucleotide
taatacgactcactatagggggagctgagtagaggggacggagaagggtgaacagaggagacaccctatgccgtcccctaacctggcggcagcgcaaaagatg

SEQ ID NO: 135125 - DNA, 103 bp, Artificial Sequence
  Synthetic Polynucleotide
taatacgactcactatagggagtcaaaagaggagctgagtagaggggacgaacagaggagacgtcccatgtactcagctaacctggcggcagcgcaaaagatg

SEQ ID NO: 135126 - DNA, 103 bp, Artificial Sequence
  Synthetic Polynucleotide
taatacgactcactatagggtcatagtccaagtcaaaagaggagctgagtaacagaggagaactcagatgctcttttgaaacctggcggcagcgcaaaagatg

SEQ ID NO: 135127 - DNA, 103 bp, Artificial Sequence
  Synthetic Polynucleotide
taatacgactcactatagggccgttgaaagtcatagtccaagtcaaaagaaacagaggagatcttttatgttggactataacctggcggcagcgcaaaagatg

SEQ ID NO: 135128 - DNA, 103 bp, Artificial Sequence
  Synthetic Polynucleotide
taatacgactcactatagggcataatagtcccgttgaaagtcatagtccaaacagaggagatggactatgactttcaacaacctggcggcagcgcaaaagatg

SEQ ID NO: 135129 - DNA, 103 bp, Artificial Sequence
  Synthetic Polynucleotide
taatacgactcactatagggtacatcctatcataatagtcccgttgaaagaacagaggagactttcaatgggactattaaacctggcggcagcgcaaaagatg

SEQ ID NO: 135130 - DNA, 103 bp, Artificial Sequence
  Synthetic Polynucleotide
taatacgactcactatagggaatgaatacacgggagttcatggagcgaggaacagaggagacctcgcatgatgaactccaacctggcggcagcgcaaaagatg

SEQ ID NO: 135131 - DNA, 103 bp, Artificial Sequence
  Synthetic Polynucleotide
taatacgactcactatagggtgggtaactgtacatcctatcataatagtcaacagaggagagactatatggataggatgaacctggcggcagcgcaaaagatg

SEQ ID NO: 135132 - DNA, 103 bp, Artificial Sequence
  Synthetic Polynucleotide
taatacgactcactataggggtacacgtgctgggtaactgtacatcctataacagaggagaataggaatgacagttaccaacctggcggcagcgcaaaagatg

SEQ ID NO: 135133 - DNA, 103 bp, Artificial Sequence
  Synthetic Polynucleotide
taatacgactcactatagggggaggaggaggtacacgtgctgggtaactgaacagaggagacagttaatgagcacgtgtaacctggcggcagcgcaaaagatg

SEQ ID NO: 135134 - DNA, 103 bp, Artificial Sequence
  Synthetic Polynucleotide
taatacgactcactatagggagcaataggaggaggaggaggtacacgtgcaacagaggagagcacgtatgcctcctcctaacctggcggcagcgcaaaagatg

SEQ ID NO: 135135 - DNA, 103 bp, Artificial Sequence
  Synthetic Polynucleotide
taatacgactcactatagggctacagcccgagcaataggaggaggaggagaacagaggagactcctcatgctcctattgaacctggcggcagcgcaaaagatg

SEQ ID NO: 135136 - DNA, 103 bp, Artificial Sequence
  Synthetic Polynucleotide
taatacgactcactatagggttcgagggcactacagcccgagcaataggaaacagaggagatcctatatgtcgggctgtaacctggcggcagcgcaaaagatg

SEQ ID NO: 135137 - DNA, 103 bp, Artificial Sequence
  Synthetic Polynucleotide
taatacgactcactatagggacgctgacgtttcgagggcactacagcccgaacagaggagacgggctatggtgccctcgaacctggcggcagcgcaaaagatg

SEQ ID NO: 135138 - DNA, 103 bp, Artificial Sequence
  Synthetic Polynucleotide
taatacgactcactatagggttcctgatacacgctgacgtttcgagggcaaacagaggagatgccctatgaacgtcagcaacctggcggcagcgcaaaagatg

SEQ ID NO: 135139 - DNA, 103 bp, Artificial Sequence
  Synthetic Polynucleotide
taatacgactcactatagggcgtgaagtgtttcctgatacacgctgacgtaacagaggagaacgtcaatgtgtatcaggaacctggcggcagcgcaaaagatg

SEQ ID NO: 135140 - DNA, 103 bp, Artificial Sequence
  Synthetic Polynucleotide
taatacgactcactatagggtttgccccttcgtgaagtgtttcctgatacaacagaggagagtatcaatgaacacttcaaacctggcggcagcgcaaaagatg

SEQ ID NO: 135141 - DNA, 103 bp, Artificial Sequence
  Synthetic Polynucleotide
taatacgactcactatagggtgagattcccaatgaatacacgggagttcaaacagaggagatgaactatggtgtattcaaacctggcggcagcgcaaaagatg

SEQ ID NO: 135142 - DNA, 103 bp, Artificial Sequence
  Synthetic Polynucleotide
taatacgactcactatagggtgaagccacttttgccccttcgtgaagtgtaacagaggagaacacttatggaaggggcaaacctggcggcagcgcaaaagatg

SEQ ID NO: 135143 - DNA, 103 bp, Artificial Sequence
  Synthetic Polynucleotide
taatacgactcactatagggctcttagaattgaagccacttttgccccttaacagaggagaaaggggatgaagtggcttaacctggcggcagcgcaaaagatg

SEQ ID NO: 135144 - DNA, 103 bp, Artificial Sequence
  Synthetic Polynucleotide
taatacgactcactatagggccgctgtccactcttagaattgaagccactaacagaggagaagtggcatgaattctaagaacctggcggcagcgcaaaagatg

SEQ ID NO: 135145 - DNA, 103 bp, Artificial Sequence
  Synthetic Polynucleotide
taatacgactcactatagggtggaagatccccgctgtccactcttagaataacagaggagaattctaatggtggacagcaacctggcggcagcgcaaaagatg

SEQ ID NO: 135146 - DNA, 103 bp, Artificial Sequence
  Synthetic Polynucleotide
taatacgactcactatagggtttccagacttggaagatccccgctgtccaaacagaggagatggacaatggggatcttcaacctggcggcagcgcaaaagatg

SEQ ID NO: 135147 - DNA, 103 bp, Artificial Sequence
  Synthetic Polynucleotide
taatacgactcactatagggtcctttcaactttccagacttggaagatccaacagaggagaggatctatgaagtctggaaacctggcggcagcgcaaaagatg

SEQ ID NO: 135148 - DNA, 103 bp, Artificial Sequence
  Synthetic Polynucleotide
taatacgactcactataggggaaggtcatctcctttcaactttccagactaacagaggagaagtctgatgagttgaaagaacctggcggcagcgcaaaagatg

SEQ ID NO: 135149 - DNA, 103 bp, Artificial Sequence
  Synthetic Polynucleotide
taatacgactcactatagggttaatggcctgaaggtcatctcctttcaacaacagaggagagttgaaatgagatgacctaacctggcggcagcgcaaaagatg

SEQ ID NO: 135150 - DNA, 103 bp, Artificial Sequence
  Synthetic Polynucleotide
taatacgactcactatagggcagctccttcttaatggcctgaaggtcatcaacagaggagagatgacatgcaggccattaacctggcggcagcgcaaaagatg

SEQ ID NO: 135151 - DNA, 103 bp, Artificial Sequence
  Synthetic Polynucleotide
taatacgactcactatagggttatctgggtcagctccttcttaatggcctaacagaggagaaggccaatgagaaggagcaacctggcggcagcgcaaaagatg

SEQ ID NO: 135152 - DNA, 103 bp, Artificial Sequence
  Synthetic Polynucleotide
taatacgactcactatagggacaagagtgttgagattcccaatgaatacaaacagaggagatgtattatgtgggaatctaacctggcggcagcgcaaaagatg

SEQ ID NO: 135153 - DNA, 103 bp, Artificial Sequence
  Synthetic Polynucleotide
taatacgactcactatagggactttttgttttatctgggtcagctccttcaacagaggagagaaggaatggacccagataacctggcggcagcgcaaaagatg

SEQ ID NO: 135154 - DNA, 103 bp, Artificial Sequence
  Synthetic Polynucleotide
taatacgactcactataggggagagaatccactttttgttttatctgggtaacagaggagaacccagatgaaacaaaaaaacctggcggcagcgcaaaagatg

SEQ ID NO: 135155 - DNA, 103 bp, Artificial Sequence
  Synthetic Polynucleotide
taatacgactcactatagggggttttccaggagagaatccactttttgttaacagaggagaaacaaaatgtggattctcaacctggcggcagcgcaaaagatg

SEQ ID NO: 135156 - DNA, 103 bp, Artificial Sequence
  Synthetic Polynucleotide
taatacgactcactatagggattttttccaggttttccaggagagaatccaacagaggagaggattcatgcctggaaaaaacctggcggcagcgcaaaagatg

SEQ ID NO: 135157 - DNA, 103 bp, Artificial Sequence
  Synthetic Polynucleotide
taatacgactcactatagggttccttttcaattttttccaggttttccagaacagaggagactggaaatgctggaaaaaaacctggcggcagcgcaaaagatg

SEQ ID NO: 135158 - DNA, 103 bp, Artificial Sequence
  Synthetic Polynucleotide
taatacgactcactataggggtttgctctgttccttttcaattttttccaaacagaggagatggaaaatgttgaaaaggaacctggcggcagcgcaaaagatg

SEQ ID NO: 135159 - DNA, 103 bp, Artificial Sequence
  Synthetic Polynucleotide
taatacgactcactatagggtctactgcttgtttgctctgttccttttcaaacagaggagatgaaaaatgacagagcaaaacctggcggcagcgcaaaagatg

SEQ ID NO: 135160 - DNA, 103 bp, Artificial Sequence
  Synthetic Polynucleotide
taatacgactcactatagggattcttcatctctactgcttgtttgctctgaacagaggagacagagcatgcaagcagtaaacctggcggcagcgcaaaagatg

SEQ ID NO: 135161 - DNA, 103 bp, Artificial Sequence
  Synthetic Polynucleotide
taatacgactcactatagggctgacttatcattcttcatctctactgcttaacagaggagaaagcagatgagatgaagaaacctggcggcagcgcaaaagatg

SEQ ID NO: 135162 - DNA, 103 bp, Artificial Sequence
  Synthetic Polynucleotide
taatacgactcactatagggtgctcctcttctgacttatcattcttcatcaacagaggagagatgaaatgtgataagtcaacctggcggcagcgcaaaagatg

SEQ ID NO: 135163 - DNA, 103 bp, Artificial Sequence
  Synthetic Polynucleotide
taatacgactcactatagggtttcttgaccacaagagtgttgagattcccaacagaggagagggaatatgaacactcttaacctggcggcagcgcaaaagatg

SEQ ID NO: 135164 - DNA, 103 bp, Artificial Sequence
  Synthetic Polynucleotide
taatacgactcactataggggctgctgctctgctcctcttctgacttatcaacagaggagagataagatggaagaggagaacctggcggcagcgcaaaagatg

SEQ ID NO: 135165 - DNA, 103 bp, Artificial Sequence
  Synthetic Polynucleotide
taatacgactcactatagggtcttcacggagctgctgctctgctcctcttaacagaggagaaagaggatgagagcagcaaacctggcggcagcgcaaaagatg

SEQ ID NO: 135166 - DNA, 103 bp, Artificial Sequence
  Synthetic Polynucleotide
taatacgactcactataggggtctcatctttcttcacggagctgctgctcaacagaggagagagcagatgctccgtgaaaacctggcggcagcgcaaaagatg

SEQ ID NO: 135167 - DNA, 103 bp, Artificial Sequence
  Synthetic Polynucleotide
taatacgactcactatagggcttcacattagtctcatctttcttcacggaaacagaggagatccgtgatgaaagatgagaacctggcggcagcgcaaaagatg

SEQ ID NO: 135168 - DNA, 103 bp, Artificial Sequence
  Synthetic Polynucleotide
taatacgactcactatagggcagactccatcttcacattagtctcatcttaacagaggagaaagatgatgctaatgtgaaacctggcggcagcgcaaaagatg

SEQ ID NO: 135169 - DNA, 103 bp, Artificial Sequence
  Synthetic Polynucleotide
taatacgactcactataggggcacccccctcagactccatcttcacattaaacagaggagataatgtatggatggagtcaacctggcggcagcgcaaaagatg

SEQ ID NO: 135170 - DNA, 103 bp, Artificial Sequence
  Synthetic Polynucleotide
taatacgactcactatagggagagtcatctgcacccccctcagactccataacagaggagaatggagatggaggggggtaacctggcggcagcgcaaaagatg

SEQ ID NO: 135171 - DNA, 103 bp, Artificial Sequence
  Synthetic Polynucleotide
taatacgactcactatagggcctcctcagcagagtcatctgcacccccctaacagaggagaagggggatgcagatgactaacctggcggcagcgcaaaagatg

SEQ ID NO: 135172 - DNA, 103 bp, Artificial Sequence
  Synthetic Polynucleotide
taatacgactcactatagggagtaggtccccctcctcagcagagtcatctaacagaggagaagatgaatgtgctgaggaaacctggcggcagcgcaaaagatg

SEQ ID NO: 135173 - DNA, 103 bp, Artificial Sequence
  Synthetic Polynucleotide
taatacgactcactatagggatcatcatccagtaggtccccctcctcagcaacagaggagagctgagatgggggacctaaacctggcggcagcgcaaaagatg

SEQ ID NO: 135174 - DNA, 103 bp, Artificial Sequence
  Synthetic Polynucleotide
taatacgactcactatagggccacatcagatttcttgaccacaagagtgtaacagaggagaacactcatgtggtcaagaaacctggcggcagcgcaaaagatg

SEQ ID NO: 135175 - DNA, 103 bp, Artificial Sequence
  Synthetic Polynucleotide
taatacgactcactatagggcttcattatcatcatcatccagtaggtcccaacagaggagagggaccatgtggatgatgaacctggcggcagcgcaaaagatg

SEQ ID NO: 135176 - DNA, 103 bp, Artificial Sequence
  Synthetic Polynucleotide
taatacgactcactatagggtccccccgatcttcattatcatcatcatccaacagaggagaggatgaatgtgataatgaaacctggcggcagcgcaaaagatg

SEQ ID NO: 135177 - DNA, 103 bp, Artificial Sequence
  Synthetic Polynucleotide
taatacgactcactatagggcagctggtcatccccccgatcttcattatcaacagaggagagataatatggatcgggggaacctggcggcagcgcaaaagatg

SEQ ID NO: 135178 - DNA, 103 bp, Artificial Sequence
  Synthetic Polynucleotide
taatacgactcactatagggtgatcaactccagctggtcatccccccgataacagaggagaatcgggatgatgaccagcaacctggcggcagcgcaaaagatg

SEQ ID NO: 135179 - DNA, 103 bp, Artificial Sequence
  Synthetic Polynucleotide
taatacgactcactatagggtcatcatccttgatcaactccagctggtcaaacagaggagatgaccaatgggagttgataacctggcggcagcgcaaaagatg

SEQ ID NO: 135180 - DNA, 103 bp, Artificial Sequence
  Synthetic Polynucleotide
taatacgactcactatagggagcctctttttcatcatccttgatcaactcaacagaggagagagttgatgaaggatgataacctggcggcagcgcaaaagatg

SEQ ID NO: 135181 - DNA, 103 bp, Artificial Sequence
  Synthetic Polynucleotide
taatacgactcactatagggctccttcctcagcctctttttcatcatcctaacagaggagaaggatgatgaaaaagaggaacctggcggcagcgcaaaagatg

SEQ ID NO: 135182 - DNA, 103 bp, Artificial Sequence
  Synthetic Polynucleotide
taatacgactcactatagggctgtcatcctctccttcctcagcctcttttaacagaggagaaaaagaatgtgaggaaggaacctggcggcagcgcaaaagatg

SEQ ID NO: 135183 - DNA, 103 bp, Artificial Sequence
  Synthetic Polynucleotide
taatacgactcactatagggggcgctgtctctgtcatcctctccttcctcaacagaggagagaggaaatggaggatgacaacctggcggcagcgcaaaagatg

SEQ ID NO: 135184 - DNA, 103 bp, Artificial Sequence
  Synthetic Polynucleotide
taatacgactcactatagggcctcgccattggcgctgtctctgtcatcctaacagaggagaaggatgatggagacagcgaacctggcggcagcgcaaaagatg

SEQ ID NO: 135185 - DNA, 103 bp, Artificial Sequence
  Synthetic Polynucleotide
taatacgactcactatagggaagattgcctccacatcagatttcttgaccaacagaggagaggtcaaatgatctgatgtaacctggcggcagcgcaaaagatg

SEQ ID NO: 135186 - DNA, 103 bp, Artificial Sequence
  Synthetic Polynucleotide
taatacgactcactatagggtaagagtcatcctcgccattggcgctgtctaacagaggagaagacagatgcaatggcgaaacctggcggcagcgcaaaagatg

SEQ ID NO: 135187 - DNA, 103 bp, Artificial Sequence
  Synthetic Polynucleotide
taatacgactcactataggggaaggtttcttctggctgttcagtttccataacagaggagaatggaaatggaacagccaaacctggcggcagcgcaaaagatg

SEQ ID NO: 135188 - DNA, 103 bp, Artificial Sequence
  Synthetic Polynucleotide
taatacgactcactatagggatcagtgtttctagatcttttaaatgcttgaacagaggagacaagcaatgaaaagatctaacctggcggcagcgcaaaagatg

SEQ ID NO: 135189 - DNA, 103 bp, Artificial Sequence
  Synthetic Polynucleotide
taatacgactcactatagggactgaaaccaaccatgccgtcgtaacggtcaacagaggagagaccgtatggacggcatgaacctggcggcagcgcaaaagatg

SEQ ID NO: 135190 - DNA, 103 bp, Artificial Sequence
  Synthetic Polynucleotide
taatacgactcactatagggtttcatcagcactgaaaccaaccatgccgtaacagaggagaacggcaatgttggtttcaaacctggcggcagcgcaaaagatg

SEQ ID NO: 135191 - DNA, 103 bp, Artificial Sequence
  Synthetic Polynucleotide
taatacgactcactataggggagtcccaagtttcatcagcactgaaaccaaacagaggagatggtttatgtgctgatgaaacctggcggcagcgcaaaagatg

SEQ ID NO: 135192 - DNA, 103 bp, Artificial Sequence
  Synthetic Polynucleotide
taatacgactcactatagggatctattgcagagtcccaagtttcatcagcaacagaggagagctgatatgacttgggacaacctggcggcagcgcaaaagatg

SEQ ID NO: 135193 - DNA, 103 bp, Artificial Sequence
  Synthetic Polynucleotide
taatacgactcactatagggggctccatgtatctattgcagagtcccaagaacagaggagacttgggatgctgcaatagaacctggcggcagcgcaaaagatg

SEQ ID NO: 135194 - DNA, 103 bp, Artificial Sequence
  Synthetic Polynucleotide
taatacgactcactatagggcattctgatgggctccatgtatctattgcaaacagaggagatgcaatatgtacatggagaacctggcggcagcgcaaaagatg

SEQ ID NO: 135195 - DNA, 103 bp, Artificial Sequence
  Synthetic Polynucleotide
taatacgactcactatagggagccatctgccattctgatgggctccatgtaacagaggagaacatggatgccatcagaaaacctggcggcagcgcaaaagatg

SEQ ID NO: 135196 - DNA, 103 bp, Artificial Sequence
  Synthetic Polynucleotide
taatacgactcactataggggtggttcataagccatctgccattctgatgaacagaggagacatcagatgggcagatggaacctggcggcagcgcaaaagatg

SEQ ID NO: 135197 - DNA, 103 bp, Artificial Sequence
  Synthetic Polynucleotide
taatacgactcactataggggagccaccctgtggttcataagccatctgcaacagaggagagcagatatgttatgaaccaacctggcggcagcgcaaaagatg

SEQ ID NO: 135198 - DNA, 103 bp, Artificial Sequence
  Synthetic Polynucleotide
taatacgactcactatagggatcatatccggagccaccctgtggttcataaacagaggagatatgaaatgcagggtggcaacctggcggcagcgcaaaagatg

SEQ ID NO: 135199 - DNA, 103 bp, Artificial Sequence
  Synthetic Polynucleotide
taatacgactcactatagggcaaccatctcatcagtgtttctagatctttaacagaggagaaaagatatggaaacactgaacctggcggcagcgcaaaagatg

SEQ ID NO: 135200 - DNA, 103 bp, Artificial Sequence
  Synthetic Polynucleotide
taatacgactcactatagggcataggaataatcatatccggagccaccctaacagaggagaagggtgatgccggatatgaacctggcggcagcgcaaaagatg

SEQ ID NO: 135201 - DNA, 103 bp, Artificial Sequence
  Synthetic Polynucleotide
taatacgactcactatagggcgaccccctgcataggaataatcatatccgaacagaggagacggataatgttattcctaaacctggcggcagcgcaaaagatg

SEQ ID NO: 135202 - DNA, 103 bp, Artificial Sequence
  Synthetic Polynucleotide
taatacgactcactatagggatatgagccacgaccccctgcataggaataaacagaggagatattccatggcagggggtaacctggcggcagcgcaaaagatg

SEQ ID NO: 135203 - DNA, 103 bp, Artificial Sequence
  Synthetic Polynucleotide
taatacgactcactatagggcaagatcaccatatgagccacgaccccctgaacagaggagacaggggatggtggctcataacctggcggcagcgcaaaagatg

SEQ ID NO: 135204 - DNA, 103 bp, Artificial Sequence
  Synthetic Polynucleotide
taatacgactcactatagggataggtccaccaagatcaccatatgagccaaacagaggagatggctcatgtggtgatctaacctggcggcagcgcaaaagatg

SEQ ID NO: 135205 - DNA, 103 bp, Artificial Sequence
  Synthetic Polynucleotide
taatacgactcactatagggtgtagtaataataggtccaccaagatcaccaacagaggagaggtgatatgggtggacctaacctggcggcagcgcaaaagatg

SEQ ID NO: 135206 - DNA, 103 bp, Artificial Sequence
  Synthetic Polynucleotide
taatacgactcactatagggtagttacttgtgtagtaataataggtccacaacagaggagagtggacatgttattactaaacctggcggcagcgcaaaagatg

SEQ ID NO: 135207 - DNA, 103 bp, Artificial Sequence
  Synthetic Polynucleotide
taatacgactcactatagggtctttgggaatagttacttgtgtagtaataaacagaggagatattacatgacaagtaacaacctggcggcagcgcaaaagatg

SEQ ID NO: 135208 - DNA, 103 bp, Artificial Sequence
  Synthetic Polynucleotide
taatacgactcactatagggtccagccaaatctttgggaatagttacttgaacagaggagacaagtaatgattcccaaaaacctggcggcagcgcaaaagatg

SEQ ID NO: 135209 - DNA, 103 bp, Artificial Sequence
  Synthetic Polynucleotide
taatacgactcactatagggcaataatagatccagccaaatctttgggaaaacagaggagattcccaatgatttggctgaacctggcggcagcgcaaaagatg

SEQ ID NO: 135210 - DNA, 103 bp, Artificial Sequence
  Synthetic Polynucleotide
taatacgactcactatagggatgcgtaattcaaccatctcatcagtgtttaacagaggagaaaacacatgtgagatggtaacctggcggcagcgcaaaagatg

SEQ ID NO: 135211 - DNA, 103 bp, Artificial Sequence
  Synthetic Polynucleotide
taatacgactcactatagggccacctttgccaataatagatccagccaaaaacagaggagatttggcatgatctattataacctggcggcagcgcaaaagatg

SEQ ID NO: 135212 - DNA, 103 bp, Artificial Sequence
  Synthetic Polynucleotide
taatacgactcactatagggaatccgctgaccacctttgccaataatagaaacagaggagatctattatgggcaaaggtaacctggcggcagcgcaaaagatg

SEQ ID NO: 135213 - DNA, 103 bp, Artificial Sequence
  Synthetic Polynucleotide
taatacgactcactatagggggatttgtttaatccgctgaccacctttgcaacagaggagagcaaagatggtcagcggaaacctggcggcagcgcaaaagatg

SEQ ID NO: 135214 - DNA, 103 bp, Artificial Sequence
  Synthetic Polynucleotide
taatacgactcactataggggactcatgacggatttgtttaatccgctgaaacagaggagatcagcgatgtaaacaaataacctggcggcagcgcaaaagatg

SEQ ID NO: 135215 - DNA, 103 bp, Artificial Sequence
  Synthetic Polynucleotide
taatacgactcactatagggcgaagctcccgactcatgacggatttgtttaacagaggagaaaacaaatgcgtcatgagaacctggcggcagcgcaaaagatg

SEQ ID NO: 135216 - DNA, 103 bp, Artificial Sequence
  Synthetic Polynucleotide
taatacgactcactatagggcaattttgatcgaagctcccgactcatgacaacagaggagagtcatgatgcgggagcttaacctggcggcagcgcaaaagatg

SEQ ID NO: 135217 - DNA, 103 bp, Artificial Sequence
  Synthetic Polynucleotide
taatacgactcactatagggaaaggctcatcaattttgatcgaagctcccaacagaggagagggagcatggatcaaaataacctggcggcagcgcaaaagatg

SEQ ID NO: 135218 - DNA, 103 bp, Artificial Sequence
  Synthetic Polynucleotide
taatacgactcactatagggggatccttctaaaggctcatcaattttgataacagaggagaatcaaaatggatgagcctaacctggcggcagcgcaaaagatg

SEQ ID NO: 135219 - DNA, 103 bp, Artificial Sequence
  Synthetic Polynucleotide
taatacgactcactatagggtccgatcttcggatccttctaaaggctcataacagaggagaatgagcatgtagaaggataacctggcggcagcgcaaaagatg

SEQ ID NO: 135220 - DNA, 103 bp, Artificial Sequence
  Synthetic Polynucleotide
taatacgactcactatagggatggtaatgatccgatcttcggatccttctaacagaggagaagaaggatgcgaagatcgaacctggcggcagcgcaaaagatg

SEQ ID NO: 135221 - DNA, 103 bp, Artificial Sequence
  Synthetic Polynucleotide
taatacgactcactatagggctgaagcagaatgcgtaattcaaccatctcaacagaggagagagatgatggaattacgcaacctggcggcagcgcaaaagatg

SEQ ID NO: 135222 - DNA, 103 bp, Artificial Sequence
  Synthetic Polynucleotide
taatacgactcactatagggtgttcctgtaatggtaatgatccgatcttcaacagaggagagaagatatgatcattaccaacctggcggcagcgcaaaagatg

SEQ ID NO: 135223 - DNA, 103 bp, Artificial Sequence
  Synthetic Polynucleotide
taatacgactcactatagggtctggtcctgtgttcctgtaatggtaatgaaacagaggagatcattaatgttacaggaaaacctggcggcagcgcaaaagatg

SEQ ID NO: 135224 - DNA, 103 bp, Artificial Sequence
  Synthetic Polynucleotide
taatacgactcactataggggcattctgtatctggtcctgtgttcctgtaaacagaggagatacaggatgacaggaccaaacctggcggcagcgcaaaagatg

SEQ ID NO: 135225 - DNA, 103 bp, Artificial Sequence
  Synthetic Polynucleotide
taatacgactcactatagggcaaatactgtgcattctgtatctggtcctgaacagaggagacaggacatgatacagaataacctggcggcagcgcaaaagatg

SEQ ID NO: 135226 - DNA, 103 bp, Artificial Sequence
  Synthetic Polynucleotide
taatacgactcactatagggtgttctgcagcaaatactgtgcattctgtaaacagaggagatacagaatgcacagtattaacctggcggcagcgcaaaagatg

SEQ ID NO: 135227 - DNA, 103 bp, Artificial Sequence
  Synthetic Polynucleotide
taatacgactcactatagggtgcttcacactgttctgcagcaaatactgtaacagaggagaacagtaatggctgcagaaaacctggcggcagcgcaaaagatg

SEQ ID NO: 135228 - DNA, 103 bp, Artificial Sequence
  Synthetic Polynucleotide
taatacgactcactatagggtccagaatactgcttcacactgttctgcagaacagaggagactgcagatgagtgtgaagaacctggcggcagcgcaaaagatg

SEQ ID NO: 135229 - DNA, 103 bp, Artificial Sequence
  Synthetic Polynucleotide
taatacgactcactatagggagaaaaactttccagaatactgcttcacacaacagaggagagtgtgaatgagtattctgaacctggcggcagcgcaaaagatg

SEQ ID NO: 135230 - DNA, 103 bp, Artificial Sequence
  Synthetic Polynucleotide
taatacgactcactatagggcattcttgctctgaagcagaatgcgtaattaacagaggagaaattacatgttctgcttcaacctggcggcagcgcaaaagatg

SEQ ID NO: 135231 - DNA, 103 bp, Artificial Sequence
  Synthetic Polynucleotide
taatacgactcactatagggactgccccagcattcttgctctgaagcagaaacagaggagatctgctatggagcaagaaaacctggcggcagcgcaaaagatg

SEQ ID NO: 135232 - DNA, 103 bp, Artificial Sequence
  Synthetic Polynucleotide
taatacgactcactatagggttttccaatcactgccccagcattcttgctaacagaggagaagcaagatggctggggcaaacctggcggcagcgcaaaagatg

SEQ ID NO: 135233 - DNA, 103 bp, Artificial Sequence
  Synthetic Polynucleotide
taatacgactcactatagggtcttgcctccttttccaatcactgccccagaacagaggagactggggatgtgattggaaaacctggcggcagcgcaaaagatg

SEQ ID NO: 135234 - DNA, 103 bp, Artificial Sequence
  Synthetic Polynucleotide
taatacgactcactataggggccttaatattcttgcctccttttccaatcaacagaggagagattggatgaggaggcaaaacctggcggcagcgcaaaagatg

SEQ ID NO: 135235 - DNA, 103 bp, Artificial Sequence
  Synthetic Polynucleotide
taatacgactcactatagggtgtacggagagccttaatattcttgcctccaacagaggagaggaggcatgaatattaagaacctggcggcagcgcaaaagatg

SEQ ID NO: 135236 - DNA, 103 bp, Artificial Sequence
  Synthetic Polynucleotide
taatacgactcactatagggcagtgttagggaaggtttcttctggctgttaacagaggagaaacagcatgaagaaacctaacctggcggcagcgcaaaagatg

SEQ ID NO: 135237 - DNA, 103 bp, Artificial Sequence
  Synthetic Polynucleotide
taatacgactcactatagggcattgtagtctgtacggagagccttaatataacagaggagaatattaatgctctccgtaaacctggcggcagcgcaaaagatg

SEQ ID NO: 135238 - DNA, 103 bp, Artificial Sequence
  Synthetic Polynucleotide
taatacgactcactataggggaaacactggcattgtagtctgtacggagaaacagaggagatctccgatgagactacaaaacctggcggcagcgcaaaagatg

SEQ ID NO: 135239 - DNA, 103 bp, Artificial Sequence
  Synthetic Polynucleotide
taatacgactcactataggggtctgggactgaaacactggcattgtagtcaacagaggagagactacatggccagtgttaacctggcggcagcgcaaaagatg

SEQ ID NO: 135240 - DNA, 103 bp, Artificial Sequence
  Synthetic Polynucleotide
taatacgactcactatagggggccactgctgtctgggactgaaacactggaacagaggagaccagtgatgcagtcccagaacctggcggcagcgcaaaagatg

SEQ ID NO: 135241 - DNA, 103 bp, Artificial Sequence
  Synthetic Polynucleotide
taatacgactcactatagggatgcgctcggggccactgctgtctgggactaacagaggagaagtcccatgcagcagtggaacctggcggcagcgcaaaagatg

SEQ ID NO: 135242 - DNA, 103 bp, Artificial Sequence
  Synthetic Polynucleotide
taatacgactcactataggggatactcaatatgcgctcggggccactgctaacagaggagaagcagtatgcccgagcgcaacctggcggcagcgcaaaagatg

SEQ ID NO: 135243 - DNA, 103 bp, Artificial Sequence
  Synthetic Polynucleotide
taatacgactcactatagggtatcagcactgatactcaatatgcgctcggaacagaggagaccgagcatgtattgagtaaacctggcggcagcgcaaaagatg

SEQ ID NO: 135244 - DNA, 103 bp, Artificial Sequence
  Synthetic Polynucleotide
taatacgactcactatagggattgtttcaatatcagcactgatactcaataacagaggagaattgagatgcagtgctgaaacctggcggcagcgcaaaagatg

SEQ ID NO: 135245 - DNA, 103 bp, Artificial Sequence
  Synthetic Polynucleotide
taatacgactcactatagggaatttctccaattgtttcaatatcagcactaacagaggagaagtgctatgattgaaacaaacctggcggcagcgcaaaagatg

SEQ ID NO: 135246 - DNA, 103 bp, Artificial Sequence
  Synthetic Polynucleotide
taatacgactcactatagggttttcttcagaatttctccaattgtttcaaaacagaggagattgaaaatgttggagaaaaacctggcggcagcgcaaaagatg

SEQ ID NO: 135247 - DNA, 103 bp, Artificial Sequence
  Synthetic Polynucleotide
taatacgactcactatagggccattggtttcagtgttagggaaggtttctaacagaggagaagaaacatgccctaacacaacctggcggcagcgcaaaagatg

SEQ ID NO: 135248 - DNA, 103 bp, Artificial Sequence
  Synthetic Polynucleotide
taatacgactcactataggggtagggatgattttcttcagaatttctccaaacagaggagatggagaatgtctgaagaaaacctggcggcagcgcaaaagatg

SEQ ID NO: 135249 - DNA, 103 bp, Artificial Sequence
  Synthetic Polynucleotide
taatacgactcactatagggctcttccaaggtagggatgattttcttcagaacagaggagactgaagatgatcatccctaacctggcggcagcgcaaaagatg

SEQ ID NO: 135250 - DNA, 103 bp, Artificial Sequence
  Synthetic Polynucleotide
taatacgactcactatagggactgcaggccctcttccaaggtagggatgaaacagaggagatcatccatgccttggaagaacctggcggcagcgcaaaagatg

SEQ ID NO: 135251 - DNA, 103 bp, Artificial Sequence
  Synthetic Polynucleotide
taatacgactcactatagggggtgatggcaactgcaggccctcttccaagaacagaggagacttggaatggggcctgcaaacctggcggcagcgcaaaagatg

SEQ ID NO: 135252 - DNA, 103 bp, Artificial Sequence
  Synthetic Polynucleotide
taatacgactcactatagggggttgcagtgggtgatggcaactgcaggccaacagaggagaggcctgatgttgccatcaaacctggcggcagcgcaaaagatg

SEQ ID NO: 135253 - DNA, 103 bp, Artificial Sequence
  Synthetic Polynucleotide
taatacgactcactatagggggagctggctggttgcagtgggtgatggcaaacagaggagatgccatatgccactgcaaaacctggcggcagcgcaaaagatg

SEQ ID NO: 135254 - DNA, 103 bp, Artificial Sequence
  Synthetic Polynucleotide
taatacgactcactataggggattcgagcgggagctggctggttgcagtgaacagaggagacactgcatgcagccagctaacctggcggcagcgcaaaagatg

SEQ ID NO: 135255 - DNA, 103 bp, Artificial Sequence
  Synthetic Polynucleotide
taatacgactcactatagggcacagcatcagattcgagcgggagctggctaacagaggagaagccagatgccgctcgaaaacctggcggcagcgcaaaagatg

SEQ ID NO: 135256 - DNA, 103 bp, Artificial Sequence
  Synthetic Polynucleotide
taatacgactcactatagggttaagcattccacagcatcagattcgagcgaacagaggagacgctcgatgctgatgctgaacctggcggcagcgcaaaagatg

SEQ ID NO: 135257 - DNA, 103 bp, Artificial Sequence
  Synthetic Polynucleotide
taatacgactcactatagggtgttggtaatttaagcattccacagcatcaaacagaggagatgatgcatgggaatgcttaacctggcggcagcgcaaaagatg

SEQ ID NO: 135258 - DNA, 103 bp, Artificial Sequence
  Synthetic Polynucleotide
taatacgactcactatagggaccaaattcaccattggtttcagtgttaggaacagaggagacctaacatggaaaccaataacctggcggcagcgcaaaagatg

SEQ ID NO: 135259 - DNA, 103 bp, Artificial Sequence
  Synthetic Polynucleotide
taatacgactcactatagggtcctttatagtgttggtaatttaagcattcaacagaggagagaatgcatgaattaccaaaacctggcggcagcgcaaaagatg

SEQ ID NO: 135260 - DNA, 103 bp, Artificial Sequence
  Synthetic Polynucleotide
taatacgactcactatagggcaaagtcacttcctttatagtgttggtaataacagaggagaattaccatgactataaagaacctggcggcagcgcaaaagatg

SEQ ID NO: 135261 - DNA, 103 bp, Artificial Sequence
  Synthetic Polynucleotide
taatacgactcactatagggaactcgcagtcaaagtcacttcctttatagaacagaggagactataaatgaagtgacttaacctggcggcagcgcaaaagatg

SEQ ID NO: 135262 - DNA, 103 bp, Artificial Sequence
  Synthetic Polynucleotide
taatacgactcactatagggcaacagcctcaactcgcagtcaaagtcactaacagaggagaagtgacatggactgcgagaacctggcggcagcgcaaaagatg

SEQ ID NO: 135263 - DNA, 103 bp, Artificial Sequence
  Synthetic Polynucleotide
taatacgactcactatagggtctgatgaatcaacagcctcaactcgcagtaacagaggagaactgcgatgtgaggctgtaacctggcggcagcgcaaaagatg

SEQ ID NO: 135264 - DNA, 103 bp, Artificial Sequence
  Synthetic Polynucleotide
taatacgactcactatagggcctgctagactctgatgaatcaacagcctcaacagaggagagaggctatggattcatcaaacctggcggcagcgcaaaagatg

SEQ ID NO: 135265 - DNA, 103 bp, Artificial Sequence
  Synthetic Polynucleotide
taatacgactcactatagggaataattcctcctgctagactctgatgaataacagaggagaattcatatgagtctagcaaacctggcggcagcgcaaaagatg

SEQ ID NO: 135266 - DNA, 103 bp, Artificial Sequence
  Synthetic Polynucleotide
taatacgactcactatagggctttgaccccaataattcctcctgctagacaacagaggagagtctagatggaggaattaaacctggcggcagcgcaaaagatg

SEQ ID NO: 135267 - DNA, 103 bp, Artificial Sequence
  Synthetic Polynucleotide
taatacgactcactatagggattttagcacctttgaccccaataattcctaacagaggagaaggaatatgtggggtcaaaacctggcggcagcgcaaaagatg

SEQ ID NO: 135268 - DNA, 103 bp, Artificial Sequence
  Synthetic Polynucleotide
taatacgactcactatagggaagttctttgattttagcacctttgaccccaacagaggagaggggtcatgggtgctaaaaacctggcggcagcgcaaaagatg

SEQ ID NO: 135269 - DNA, 103 bp, Artificial Sequence
  Synthetic Polynucleotide
taatacgactcactatagggcagggcgtttaccaaattcaccattggtttaacagaggagaaaaccaatggtgaatttgaacctggcggcagcgcaaaagatg

SEQ ID NO: 135270 - DNA, 103 bp, Artificial Sequence
  Synthetic Polynucleotide
taatacgactcactatagggtgttctctcgaagttctttgattttagcacaacagaggagagtgctaatgtcaaagaacaacctggcggcagcgcaaaagatg

SEQ ID NO: 135271 - DNA, 103 bp, Artificial Sequence
  Synthetic Polynucleotide
taatacgactcactataggggtggtttgagtgttctctcgaagttctttgaacagaggagacaaagaatgtcgagagaaaacctggcggcagcgcaaaagatg

SEQ ID NO: 135272 - DNA, 103 bp, Artificial Sequence
  Synthetic Polynucleotide
taatacgactcactatagggaagcttgatggtggtttgagtgttctctcgaacagaggagacgagagatgactcaaaccaacctggcggcagcgcaaaagatg

SEQ ID NO: 135273 - DNA, 103 bp, Artificial Sequence
  Synthetic Polynucleotide
taatacgactcactatagggattcctggaaaagcttgatggtggtttgagaacagaggagactcaaaatgccatcaagcaacctggcggcagcgcaaaagatg

SEQ ID NO: 135274 - DNA, 103 bp, Artificial Sequence
  Synthetic Polynucleotide
taatacgactcactatagggtgaggacagcattcctggaaaagcttgatgaacagaggagacatcaaatgtttccaggaaacctggcggcagcgcaaaagatg

SEQ ID NO: 135275 - DNA, 103 bp, Artificial Sequence
  Synthetic Polynucleotide
taatacgactcactataggggtcagtggaatgaggacagcattcctggaaaacagaggagattccagatgtgctgtcctaacctggcggcagcgcaaaagatg

SEQ ID NO: 135276 - DNA, 103 bp, Artificial Sequence
  Synthetic Polynucleotide
taatacgactcactataggggaacaactctgtcagtggaatgaggacagcaacagaggagagctgtcatgattccactgaacctggcggcagcgcaaaagatg

SEQ ID NO: 135277 - DNA, 103 bp, Artificial Sequence
  Synthetic Polynucleotide
taatacgactcactatagggcctccaataagaacaactctgtcagtggaaaacagaggagattccacatgcagagttgtaacctggcggcagcgcaaaagatg

SEQ ID NO: 135278 - DNA, 103 bp, Artificial Sequence
  Synthetic Polynucleotide
taatacgactcactatagggatcgggttttcctccaataagaacaactctaacagaggagaagagttatgcttattggaaacctggcggcagcgcaaaagatg

SEQ ID NO: 135279 - DNA, 103 bp, Artificial Sequence
  Synthetic Polynucleotide
taatacgactcactatagggctacaaccctatcgggttttcctccaataaaacagaggagattattgatggaaaacccgaacctggcggcagcgcaaaagatg

SEQ ID NO: 135280 - DNA, 103 bp, Artificial Sequence
  Synthetic Polynucleotide
taatacgactcactatagggatatcttctgcagggcgtttaccaaattcaaacagaggagatgaattatgtaaacgcccaacctggcggcagcgcaaaagatg

SEQ ID NO: 135281 - DNA, 103 bp, Artificial Sequence
  Synthetic Polynucleotide
taatacgactcactatagggtttatgcactctacaaccctatcgggttttaacagaggagaaaaaccatgtagggttgtaacctggcggcagcgcaaaagatg

SEQ ID NO: 135282 - DNA, 103 bp, Artificial Sequence
  Synthetic Polynucleotide
taatacgactcactatagggaaggatgatctttatgcactctacaaccctaacagaggagaagggttatggagtgcataaacctggcggcagcgcaaaagatg

SEQ ID NO: 135283 - DNA, 103 bp, Artificial Sequence
  Synthetic Polynucleotide
taatacgactcactatagggatataagatcaaggatgatctttatgcactaacagaggagaagtgcaatgagatcatccaacctggcggcagcgcaaaagatg

SEQ ID NO: 135284 - DNA, 103 bp, Artificial Sequence
  Synthetic Polynucleotide
taatacgactcactatagggggagactcagatataagatcaaggatgatcaacagaggagagatcatatgtgatcttataacctggcggcagcgcaaaagatg

SEQ ID NO: 135285 - DNA, 103 bp, Artificial Sequence
  Synthetic Polynucleotide
taatacgactcactatagggtcctttgatgggagactcagatataagatcaacagaggagagatcttatgtctgagtctaacctggcggcagcgcaaaagatg

SEQ ID NO: 135286 - DNA, 103 bp, Artificial Sequence
  Synthetic Polynucleotide
taatacgactcactataggggctgtgcacgtcctttgatgggagactcagaacagaggagactgagtatgccatcaaagaacctggcggcagcgcaaaagatg

SEQ ID NO: 135287 - DNA, 103 bp, Artificial Sequence
  Synthetic Polynucleotide
taatacgactcactatagggggatcataaggctgtgcacgtcctttgatgaacagaggagacatcaaatgacgtgcacaaacctggcggcagcgcaaaagatg

SEQ ID NO: 135288 - DNA, 103 bp, Artificial Sequence
  Synthetic Polynucleotide
taatacgactcactataggggtaaaaattgggatcataaggctgtgcacgaacagaggagacgtgcaatgccttatgataacctggcggcagcgcaaaagatg

SEQ ID NO: 135289 - DNA, 103 bp, Artificial Sequence
  Synthetic Polynucleotide
taatacgactcactatagggaggtttcatcgtaaaaattgggatcataagaacagaggagacttatgatgccaatttttaacctggcggcagcgcaaaagatg

SEQ ID NO: 135290 - DNA, 103 bp, Artificial Sequence
  Synthetic Polynucleotide
taatacgactcactatagggccataatcataggtttcatcgtaaaaattgaacagaggagacaatttatgcgatgaaacaacctggcggcagcgcaaaagatg

SEQ ID NO: 135291 - DNA, 103 bp, Artificial Sequence
  Synthetic Polynucleotide
taatacgactcactatagggttcctcttccatatcttctgcagggcgtttaacagaggagaaaacgcatggcagaagataacctggcggcagcgcaaaagatg

SEQ ID NO: 135292 - DNA, 103 bp, Artificial Sequence
  Synthetic Polynucleotide
taatacgactcactatagggtgtaaaaccaccataatcataggtttcatcaacagaggagagatgaaatgtatgattataacctggcggcagcgcaaaagatg

SEQ ID NO: 135293 - DNA, 103 bp, Artificial Sequence
  Synthetic Polynucleotide
taatacgactcactatagggcaaacatcattgtaaaaccaccataatcataacagaggagaatgattatggtggttttaaacctggcggcagcgcaaaagatg

SEQ ID NO: 135294 - DNA, 103 bp, Artificial Sequence
  Synthetic Polynucleotide
taatacgactcactatagggcgacggtcatcaaacatcattgtaaaaccaaacagaggagatggtttatgaatgatgttaacctggcggcagcgcaaaagatg

SEQ ID NO: 135295 - DNA, 103 bp, Artificial Sequence
  Synthetic Polynucleotide
taatacgactcactatagggtgggcgtccgcgacggtcatcaaacatcataacagaggagaatgatgatggatgaccgtaacctggcggcagcgcaaaagatg

SEQ ID NO: 135296 - DNA, 103 bp, Artificial Sequence
  Synthetic Polynucleotide
taatacgactcactataggggaaatcccactgggcgtccgcgacggtcataacagaggagaatgaccatggcggacgccaacctggcggcagcgcaaaagatg

SEQ ID NO: 135297 - DNA, 103 bp, Artificial Sequence
  Synthetic Polynucleotide
taatacgactcactatagggccccgcatgggaaatcccactgggcgtccgaacagaggagacggacgatgagtgggattaacctggcggcagcgcaaaagatg

SEQ ID NO: 135298 - DNA, 103 bp, Artificial Sequence
  Synthetic Polynucleotide
taatacgactcactatagggaccacctcttccccgcatgggaaatcccacaacagaggagagtgggaatgcccatgcggaacctggcggcagcgcaaaagatg

SEQ ID NO: 135299 - DNA, 103 bp, Artificial Sequence
  Synthetic Polynucleotide
taatacgactcactatagggttctgtcaaaaccacctcttccccgcatggaacagaggagaccatgcatggaagaggtgaacctggcggcagcgcaaaagatg

SEQ ID NO: 135300 - DNA, 103 bp, Artificial Sequence
  Synthetic Polynucleotide
taatacgactcactatagggccaggaggcattctgtcaaaaccacctcttaacagaggagaaagaggatgttttgacagaacctggcggcagcgcaaaagatg

SEQ ID NO: 135301 - DNA, 103 bp, Artificial Sequence
  Synthetic Polynucleotide
taatacgactcactatagggcccaccccgaccaggaggcattctgtcaaaaacagaggagatttgacatgatgcctcctaacctggcggcagcgcaaaagatg

SEQ ID NO: 135302 - DNA, 103 bp, Artificial Sequence
  Synthetic Polynucleotide
taatacgactcactatagggtaaatgcttgttcctcttccatatcttctgaacagaggagacagaagatgtggaagaggaacctggcggcagcgcaaaagatg

SEQ ID NO: 135303 - DNA, 103 bp, Artificial Sequence
  Synthetic Polynucleotide
taatacgactcactataggggcatgggacgcccaccccgaccaggaggcaaacagaggagatgcctcatggtcggggtgaacctggcggcagcgcaaaagatg

SEQ ID NO: 135304 - DNA, 103 bp, Artificial Sequence
  Synthetic Polynucleotide
taatacgactcactatagggctagatggaggcatgggacgcccaccccgaaacagaggagatcggggatggcgtcccataacctggcggcagcgcaaaagatg

SEQ ID NO: 135305 - DNA, 103 bp, Artificial Sequence
  Synthetic Polynucleotide
taatacgactcactatagggataatctcttctagatggaggcatgggacgaacagaggagacgtcccatgcctccatctaacctggcggcagcgcaaaagatg

SEQ ID NO: 135306 - DNA, 103 bp, Artificial Sequence
  Synthetic Polynucleotide
taatacgactcactatagggtcatatcatcataatctcttctagatggagaacagaggagactccatatggaagagattaacctggcggcagcgcaaaagatg

SEQ ID NO: 135307 - DNA, 103 bp, Artificial Sequence
  Synthetic Polynucleotide
taatacgactcactatagggcgacgagggctcatatcatcataatctcttaacagaggagaaagagaatgtgatgatataacctggcggcagcgcaaaagatg

SEQ ID NO: 135308 - DNA, 103 bp, Artificial Sequence
  Synthetic Polynucleotide
taatacgactcactatagggaggtggtcctcgacgagggctcatatcatcaacagaggagagatgatatgagccctcgtaacctggcggcagcgcaaaagatg

SEQ ID NO: 135309 - DNA, 103 bp, Artificial Sequence
  Synthetic Polynucleotide
taatacgactcactataggggaggagggggaggtggtcctcgacgagggcaacagaggagagccctcatggaggaccacaacctggcggcagcgcaaaagatg

SEQ ID NO: 135310 - DNA, 103 bp, Artificial Sequence
  Synthetic Polynucleotide
taatacgactcactatagggcctcgtccgggaggagggggaggtggtcctaacagaggagaaggaccatgtccccctccaacctggcggcagcgcaaaagatg

SEQ ID NO: 135311 - DNA, 103 bp, Artificial Sequence
  Synthetic Polynucleotide
taatacgactcactatagggaccccggccgcctcgtccgggaggagggggaacagaggagaccccctatgcccggacgaaacctggcggcagcgcaaaagatg

SEQ ID NO: 135312 - DNA, 103 bp, Artificial Sequence
  Synthetic Polynucleotide
taatacgactcactatagggctctgctaccaccccggccgcctcgtccggaacagaggagaccggacatggcggccgggaacctggcggcagcgcaaaagatg

SEQ ID NO: 135313 - DNA, 103 bp, Artificial Sequence
  Synthetic Polynucleotide
taatacgactcactatagggctagatcttttaaatgcttgttcctcttccaacagaggagaggaagaatgacaagcattaacctggcggcagcgcaaaagatg

SEQ ID NO: 135314 - DNA, 103 bp, Artificial Sequence
  Synthetic Polynucleotide
taatacgactcactatagggagattccgagctctgctaccaccccggccgaacagaggagacggccgatgtggtagcagaacctggcggcagcgcaaaagatg

SEQ ID NO: 135315 - DNA, 103 bp, Artificial Sequence
  Synthetic Polynucleotide
taatacgactcactatagggaggaagaggaagattccgagctctgctaccaacagaggagaggtagcatggctcggaataacctggcggcagcgcaaaagatg

SEQ ID NO: 135316 - DNA, 103 bp, Artificial Sequence
  Synthetic Polynucleotide
taatacgactcactataggggtggtggtggaggaagaggaagattccgagaacagaggagactcggaatgttcctcttcaacctggcggcagcgcaaaagatg

SEQ ID NO: 135317 - DNA, 103 bp, Artificial Sequence
  Synthetic Polynucleotide
taatacgactcactatagggcctctaggtggtggtggtggaggaagaggaaacagaggagatcctctatgtccaccaccaacctggcggcagcgcaaaagatg

SEQ ID NO: 135318 - DNA, 103 bp, Artificial Sequence
  Synthetic Polynucleotide
taatacgactcactataggggaggtctccccctctaggtggtggtggtggaacagaggagaccaccaatgccacctagaaacctggcggcagcgcaaaagatg

SEQ ID NO: 135319 - DNA, 103 bp, Artificial Sequence
  Synthetic Polynucleotide
taatacgactcactatagggcataggccatgaggtctccccctctaggtgaacagaggagacacctaatgggggagaccaacctggcggcagcgcaaaagatg

SEQ ID NO: 135320 - DNA, 103 bp, Artificial Sequence
  Synthetic Polynucleotide
taatacgactcactatagggcctcttctgtcataggccatgaggtctcccaacagaggagagggagaatgcatggcctaaacctggcggcagcgcaaaagatg

SEQ ID NO: 135321 - DNA, 103 bp, Artificial Sequence
  Synthetic Polynucleotide
taatacgactcactatagggtccaggtctccctcttctgtcataggccataacagaggagaatggccatggacagaagaaacctggcggcagcgcaaaagatg

SEQ ID NO: 135322 - DNA, 103 bp, Artificial Sequence
  Synthetic Polynucleotide
taatacgactcactatagggcgtaacggtctccaggtctccctcttctgtaacagaggagaacagaaatgggagacctgaacctggcggcagcgcaaaagatg

SEQ ID NO: 135323 - DNA, 103 bp, Artificial Sequence
  Synthetic Polynucleotide
taatacgactcactatagggaccatgccgtcgtaacggtctccaggtctcaacagaggagagagaccatgagaccgttaaacctggcggcagcgcaaaagatg

SEQ ID NO: 135324 - DNA, 103 bp, Artificial Sequence
  Synthetic Polynucleotide
taatacgactcactatagggctccgcccggggcagcagcctccgcgacataacagaggagaatgtcgatgaggctgctgaacctggcggcagcgcaaaagatg

SEQ ID NO: 135325 - DNA, 103 bp, Artificial Sequence
  Synthetic Polynucleotide
taatacgactcactataggggccgcccgccgccgccatcttcaccatcgcaacagaggagagcgatgatgaagatggcgaacctggcggcagcgcaaaagatg

SEQ ID NO: 135326 - DNA, 103 bp, Artificial Sequence
  Synthetic Polynucleotide
taatacgactcactataggggtagtgaggtggggggggcccgtagccctcaacagaggagagagggcatggggccccccaacctggcggcagcgcaaaagatg

SEQ ID NO: 135327 - DNA, 103 bp, Artificial Sequence
  Synthetic Polynucleotide
taatacgactcactatagggttctcccttcgtagtgaggtggggggggccaacagaggagaggccccatgcacctcactaacctggcggcagcgcaaaagatg

SEQ ID NO: 135328 - DNA, 103 bp, Artificial Sequence
  Synthetic Polynucleotide
taatacgactcactatagggggacccatccttctcccttcgtagtgaggtaacagaggagaacctcaatgcgaagggagaacctggcggcagcgcaaaagatg

SEQ ID NO: 135329 - DNA, 103 bp, Artificial Sequence
  Synthetic Polynucleotide
taatacgactcactatagggccccactggtggacccatccttctcccttcaacagaggagagaagggatgaggatgggtaacctggcggcagcgcaaaagatg

SEQ ID NO: 135330 - DNA, 103 bp, Artificial Sequence
  Synthetic Polynucleotide
taatacgactcactataggggacggtgaccccccactggtggacccatccaacagaggagaggatggatgcaccagtggaacctggcggcagcgcaaaagatg

SEQ ID NO: 135331 - DNA, 103 bp, Artificial Sequence
  Synthetic Polynucleotide
taatacgactcactatagggcttgggccccgacggtgaccccccactggtaacagaggagaaccagtatggggtcaccgaacctggcggcagcgcaaaagatg

SEQ ID NO: 135332 - DNA, 103 bp, Artificial Sequence
  Synthetic Polynucleotide
taatacgactcactataggggccgtagcgacttgggccccgacggtgaccaacagaggagaggtcacatgcggggcccaaacctggcggcagcgcaaaagatg

SEQ ID NO: 135333 - DNA, 103 bp, Artificial Sequence
  Synthetic Polynucleotide
taatacgactcactatagggcatactgggggccgtagcgacttgggccccaacagaggagaggggccatggtcgctacgaacctggcggcagcgcaaaagatg

SEQ ID NO: 135334 - DNA, 103 bp, Artificial Sequence
  Synthetic Polynucleotide
taatacgactcactatagggggggggtgcccatactgggggccgtagcgaaacagaggagatcgctaatgcccccagtaaacctggcggcagcgcaaaagatg

SEQ ID NO: 135335 - DNA, 103 bp, Artificial Sequence
  Synthetic Polynucleotide
taatacgactcactataggggggagggggtggggggtgcccatactggggaacagaggagaccccagatggggcaccccaacctggcggcagcgcaaaagatg

SEQ ID NO: 135336 - DNA, 103 bp, Artificial Sequence
  Synthetic Polynucleotide
taatacgactcactatagggcgccgcctccgccgcccgccgccgccatctaacagaggagaagatggatgcggcgggcgaacctggcggcagcgcaaaagatg

SEQ ID NO: 135337 - DNA, 103 bp, Artificial Sequence
  Synthetic Polynucleotide
taatacgactcactatagggcgggtggtgggggagggggtggggggtgccaacagaggagaggcaccatgcaccccctcaacctggcggcagcgcaaaagatg

SEQ ID NO: 135338 - DNA, 103 bp, Artificial Sequence
  Synthetic Polynucleotide
taatacgactcactataggggggccatactcgggtggtgggggagggggtaacagaggagaacccccatgcccaccaccaacctggcggcagcgcaaaagatg

SEQ ID NO: 135339 - DNA, 103 bp, Artificial Sequence
  Synthetic Polynucleotide
taatacgactcactataggggtcggcgtgagggccatactcgggtggtggaacagaggagaccaccaatggagtatggcaacctggcggcagcgcaaaagatg

SEQ ID NO: 135340 - DNA, 103 bp, Artificial Sequence
  Synthetic Polynucleotide
taatacgactcactataggggcacagggctgtcggcgtgagggccatactaacagaggagaagtatgatgctcacgccgaacctggcggcagcgcaaaagatg

SEQ ID NO: 135341 - DNA, 103 bp, Artificial Sequence
  Synthetic Polynucleotide
taatacgactcactatagggtagaccatgagcacagggctgtcggcgtgaaacagaggagatcacgcatgcagccctgtaacctggcggcagcgcaaaagatg

SEQ ID NO: 135342 - DNA, 103 bp, Artificial Sequence
  Synthetic Polynucleotide
taatacgactcactatagggatccaagccatagaccatgagcacagggctaacagaggagaagccctatgctcatggtcaacctggcggcagcgcaaaagatg

SEQ ID NO: 135343 - DNA, 103 bp, Artificial Sequence
  Synthetic Polynucleotide
taatacgactcactatagggtcttagattgatccaagccatagaccatgaaacagaggagatcatggatgatggcttggaacctggcggcagcgcaaaagatg

SEQ ID NO: 135344 - DNA, 103 bp, Artificial Sequence
  Synthetic Polynucleotide
taatacgactcactatagggtcacagttcatcttagattgatccaagccaaacagaggagatggcttatgtcaatctaaaacctggcggcagcgcaaaagatg

SEQ ID NO: 135345 - DNA, 103 bp, Artificial Sequence
  Synthetic Polynucleotide
taatacgactcactataggggaagactcggtcacagttcatcttagattgaacagaggagacaatctatgatgaactgtaacctggcggcagcgcaaaagatg

SEQ ID NO: 135346 - DNA, 103 bp, Artificial Sequence
  Synthetic Polynucleotide
taatacgactcactatagggagaagacattgaagactcggtcacagttcaaacagaggagatgaactatgaccgagtctaacctggcggcagcgcaaaagatg

SEQ ID NO: 135347 - DNA, 103 bp, Artificial Sequence
  Synthetic Polynucleotide
taatacgactcactatagggtagcggccaccgccgcctccgccgcccgccaacagaggagaggcgggatgcggaggcggaacctggcggcagcgcaaaagatg

SEQ ID NO: 135348 - DNA, 103 bp, Artificial Sequence
  Synthetic Polynucleotide
taatacgactcactatagggccatataagcagaagacattgaagactcggaacagaggagaccgagtatgcaatgtcttaacctggcggcagcgcaaaagatg

SEQ ID NO: 135349 - DNA, 103 bp, Artificial Sequence
  Synthetic Polynucleotide
taatacgactcactatagggctccacattgccatataagcagaagacattaacagaggagaaatgtcatgtgcttatataacctggcggcagcgcaaaagatg

SEQ ID NO: 135350 - DNA, 103 bp, Artificial Sequence
  Synthetic Polynucleotide
taatacgactcactatagggatttcaccttctccacattgccatataagcaacagaggagagcttatatggcaatgtggaacctggcggcagcgcaaaagatg

SEQ ID NO: 135351 - DNA, 103 bp, Artificial Sequence
  Synthetic Polynucleotide
taatacgactcactatagggcttttcatgaatttcaccttctccacattgaacagaggagacaatgtatggaaggtgaaaacctggcggcagcgcaaaagatg

SEQ ID NO: 135352 - DNA, 103 bp, Artificial Sequence
  Synthetic Polynucleotide
taatacgactcactatagggccccggcttgcttttcatgaatttcaccttaacagaggagaaaggtgatgttcatgaaaaacctggcggcagcgcaaaagatg

SEQ ID NO: 135353 - DNA, 103 bp, Artificial Sequence
  Synthetic Polynucleotide
taatacgactcactatagggccatggcggcccccggcttgcttttcatgaaacagaggagatcatgaatggcaagccggaacctggcggcagcgcaaaagatg

SEQ ID NO: 135354 - DNA, 103 bp, Artificial Sequence
  Synthetic Polynucleotide
taatacgactcactataggggccatctccaccatggcggcccccggcttgaacagaggagacaagccatgggccgccataacctggcggcagcgcaaaagatg

SEQ ID NO: 135355 - DNA, 103 bp, Artificial Sequence
  Synthetic Polynucleotide
taatacgactcactataggggtagccatcagccatctccaccatggcggcaacagaggagagccgccatggtggagatgaacctggcggcagcgcaaaagatg

SEQ ID NO: 135356 - DNA, 103 bp, Artificial Sequence
  Synthetic Polynucleotide
taatacgactcactatagggggtctacagcgtagccatcagccatctccaaacagaggagatggagaatgctgatggctaacctggcggcagcgcaaaagatg

SEQ ID NO: 135357 - DNA, 103 bp, Artificial Sequence
  Synthetic Polynucleotide
taatacgactcactataggggtaatggcccggtctacagcgtagccatcaaacagaggagatgatggatgcgctgtagaaacctggcggcagcgcaaaagatg

SEQ ID NO: 135358 - DNA, 103 bp, Artificial Sequence
  Synthetic Polynucleotide
taatacgactcactataggggccgccgtagtagcggccaccgccgcctccaacagaggagaggaggcatgggtggccgcaacctggcggcagcgcaaaagatg

SEQ ID NO: 135359 - DNA, 103 bp, Artificial Sequence
  Synthetic Polynucleotide
taatacgactcactataggggttgaggtgggtaatggcccggtctacagcaacagaggagagctgtaatgcgggccattaacctggcggcagcgcaaaagatg

SEQ ID NO: 135360 - DNA, 103 bp, Artificial Sequence
  Synthetic Polynucleotide
taatacgactcactatagggtgaagttgttgttgaggtgggtaatggcccaacagaggagagggccaatgcccacctcaaacctggcggcagcgcaaaagatg

SEQ ID NO: 135361 - DNA, 103 bp, Artificial Sequence
  Synthetic Polynucleotide
taatacgactcactatagggtgcccaaacatgaagttgttgttgaggtggaacagaggagaccacctatgcaacaacttaacctggcggcagcgcaaaagatg

SEQ ID NO: 135362 - DNA, 103 bp, Artificial Sequence
  Synthetic Polynucleotide
taatacgactcactatagggattcagcttctgcccaaacatgaagttgttaacagaggagaaacaacatgatgtttgggaacctggcggcagcgcaaaagatg

SEQ ID NO: 135363 - DNA, 103 bp, Artificial Sequence
  Synthetic Polynucleotide
taatacgactcactatagggagacacagacattcagcttctgcccaaacaaacagaggagatgtttgatgagaagctgaaacctggcggcagcgcaaaagatg

SEQ ID NO: 135364 - DNA, 103 bp, Artificial Sequence
  Synthetic Polynucleotide
taatacgactcactatagggggctgcttggagacacagacattcagcttcaacagaggagagaagctatgtgtctgtgtaacctggcggcagcgcaaaagatg

SEQ ID NO: 135365 - DNA, 103 bp, Artificial Sequence
  Synthetic Polynucleotide
taatacgactcactatagggcatgatggctggctgcttggagacacagacaacagaggagagtctgtatgtccaagcagaacctggcggcagcgcaaaagatg

SEQ ID NO: 135366 - DNA, 103 bp, Artificial Sequence
  Synthetic Polynucleotide
taatacgactcactatagggactgaccaggcatgatggctggctgcttggaacagaggagaccaagcatgcagccatcaaacctggcggcagcgcaaaagatg

SEQ ID NO: 135367 - DNA, 103 bp, Artificial Sequence
  Synthetic Polynucleotide
taatacgactcactatagggaacccgtatgactgaccaggcatgatggctaacagaggagaagccatatggcctggtcaaacctggcggcagcgcaaaagatg

SEQ ID NO: 135368 - DNA, 103 bp, Artificial Sequence
  Synthetic Polynucleotide
taatacgactcactatagggcccgtcttccaacccgtatgactgaccaggaacagaggagacctggtatgtcatacgggaacctggcggcagcgcaaaagatg

SEQ ID NO: 135369 - DNA, 103 bp, Artificial Sequence
  Synthetic Polynucleotide
taatacgactcactatagggcctcactgccgccgccgtagtagcggccacaacagaggagagtggccatgactacggcgaacctggcggcagcgcaaaagatg

SEQ ID NO: 135370 - DNA, 103 bp, Artificial Sequence
  Synthetic Polynucleotide
taatacgactcactatagggaactgcaagacccgtcttccaacccgtatgaacagaggagacatacgatgtggaagacgaacctggcggcagcgcaaaagatg

SEQ ID NO: 135371 - DNA, 103 bp, Artificial Sequence
  Synthetic Polynucleotide
taatacgactcactatagggaagtctttgtaactgcaagacccgtcttccaacagaggagaggaagaatggtcttgcagaacctggcggcagcgcaaaagatg

SEQ ID NO: 135372 - DNA, 103 bp, Artificial Sequence
  Synthetic Polynucleotide
taatacgactcactatagggggattcactgaagtctttgtaactgcaagaaacagaggagatcttgcatgtacaaagacaacctggcggcagcgcaaaagatg

SEQ ID NO: 135373 - DNA, 103 bp, Artificial Sequence
  Synthetic Polynucleotide
taatacgactcactataggggattgttccgggattcactgaagtctttgtaacagaggagaacaaagatgtcagtgaataacctggcggcagcgcaaaagatg

SEQ ID NO: 135374 - DNA, 103 bp, Artificial Sequence
  Synthetic Polynucleotide
taatacgactcactataggggtggagaaccgattgttccgggattcactgaacagaggagacagtgaatgccggaacaaaacctggcggcagcgcaaaagatg

SEQ ID NO: 135375 - DNA, 103 bp, Artificial Sequence
  Synthetic Polynucleotide
taatacgactcactatagggctgctctggggtggagaaccgattgttccgaacagaggagacggaacatgcggttctccaacctggcggcagcgcaaaagatg

SEQ ID NO: 135376 - DNA, 103 bp, Artificial Sequence
  Synthetic Polynucleotide
taatacgactcactatagggtcttggctgcctgctctggggtggagaaccaacagaggagaggttctatgccccagagcaacctggcggcagcgcaaaagatg

SEQ ID NO: 135377 - DNA, 103 bp, Artificial Sequence
  Synthetic Polynucleotide
taatacgactcactatagggtggatgcggttcttggctgcctgctctgggaacagaggagacccagaatgggcagccaaaacctggcggcagcgcaaaagatg

SEQ ID NO: 135378 - DNA, 103 bp, Artificial Sequence
  Synthetic Polynucleotide
taatacgactcactataggggctggggtgctggatgcggttcttggctgcaacagaggagagcagccatgaaccgcatcaacctggcggcagcgcaaaagatg

SEQ ID NO: 135379 - DNA, 103 bp, Artificial Sequence
  Synthetic Polynucleotide
taatacgactcactataggggcagcacgttgctggggtgctggatgcggtaacagaggagaaccgcaatgagcaccccaaacctggcggcagcgcaaaagatg

SEQ ID NO: 135380 - DNA, 103 bp, Artificial Sequence
  Synthetic Polynucleotide
taatacgactcactataggggcccggccgccctcactgccgccgccgtagaacagaggagactacggatgcggcagtgaaacctggcggcagcgcaaaagatg

SEQ ID NO: 135381 - DNA, 103 bp, Artificial Sequence
  Synthetic Polynucleotide
taatacgactcactatagggttgaagaagtgcagcacgttgctggggtgcaacagaggagagcacccatgcaacgtgctaacctggcggcagcgcaaaagatg

SEQ ID NO: 135382 - DNA, 103 bp, Artificial Sequence
  Synthetic Polynucleotide
taatacgactcactatagggcagcggggcgttgaagaagtgcagcacgttaacagaggagaaacgtgatgcacttcttcaacctggcggcagcgcaaaagatg

SEQ ID NO: 135383 - DNA, 103 bp, Artificial Sequence
  Synthetic Polynucleotide
taatacgactcactatagggcggtcacctccagcggggcgttgaagaagtaacagaggagaacttctatgacgccccgcaacctggcggcagcgcaaaagatg

SEQ ID NO: 135384 - DNA, 103 bp, Artificial Sequence
  Synthetic Polynucleotide
taatacgactcactatagggaagttctcctcggtcacctccagcggggcgaacagaggagacgccccatgggaggtgacaacctggcggcagcgcaaaagatg

SEQ ID NO: 135385 - DNA, 103 bp, Artificial Sequence
  Synthetic Polynucleotide
taatacgactcactataggggatctcaaagaagttctcctcggtcacctcaacagaggagagaggtgatggaggagaacaacctggcggcagcgcaaaagatg

SEQ ID NO: 135386 - DNA, 103 bp, Artificial Sequence
  Synthetic Polynucleotide
taatacgactcactataggggctcatcgcagatctcaaagaagttctcctaacagaggagaaggagaatgtctttgagaaacctggcggcagcgcaaaagatg

SEQ ID NO: 135387 - DNA, 103 bp, Artificial Sequence
  Synthetic Polynucleotide
taatacgactcactatagggttcactcccagctcatcgcagatctcaaagaacagaggagactttgaatgctgcgatgaaacctggcggcagcgcaaaagatg

SEQ ID NO: 135388 - DNA, 103 bp, Artificial Sequence
  Synthetic Polynucleotide
taatacgactcactatagggagatggccgcttcactcccagctcatcgcaaacagaggagatgcgatatgctgggagtgaacctggcggcagcgcaaaagatg

SEQ ID NO: 135389 - DNA, 103 bp, Artificial Sequence
  Synthetic Polynucleotide
taatacgactcactatagggctttcacagaagatggccgcttcactcccaaacagaggagatgggagatgagcggccataacctggcggcagcgcaaaagatg

SEQ ID NO: 135390 - DNA, 103 bp, Artificial Sequence
  Synthetic Polynucleotide
taatacgactcactatagggcctgagaatactttcacagaagatggccgcaacagaggagagcggccatgttctgtgaaaacctggcggcagcgcaaaagatg

SEQ ID NO: 135391 - DNA, 103 bp, Artificial Sequence
  Synthetic Polynucleotide
taatacgactcactatagggccgcttaggggcccggccgccctcactgccaacagaggagaggcagtatgggcggccggaacctggcggcagcgcaaaagatg

SEQ ID NO: 135392 - DNA, 103 bp, Artificial Sequence
  Synthetic Polynucleotide
taatacgactcactatagggctcacttttgcctgagaatactttcacagaaacagaggagatctgtgatggtattctcaaacctggcggcagcgcaaaagatg

SEQ ID NO: 135393 - DNA, 103 bp, Artificial Sequence
  Synthetic Polynucleotide
taatacgactcactatagggaggagctgcgctcacttttgcctgagaataaacagaggagatattctatggcaaaagtgaacctggcggcagcgcaaaagatg

SEQ ID NO: 135394 - DNA, 103 bp, Artificial Sequence
  Synthetic Polynucleotide
taatacgactcactatagggagcagtccagaggagctgcgctcacttttgaacagaggagacaaaagatggcgcagctcaacctggcggcagcgcaaaagatg

SEQ ID NO: 135395 - DNA, 103 bp, Artificial Sequence
  Synthetic Polynucleotide
taatacgactcactatagggttcccactccagcagtccagaggagctgcgaacagaggagacgcagcatgtctggactgaacctggcggcagcgcaaaagatg

SEQ ID NO: 135396 - DNA, 103 bp, Artificial Sequence
  Synthetic Polynucleotide
taatacgactcactatagggcgctcttggattcccactccagcagtccagaacagaggagactggacatgtggagtgggaacctggcggcagcgcaaaagatg

SEQ ID NO: 135397 - DNA, 103 bp, Artificial Sequence
  Synthetic Polynucleotide
taatacgactcactatagggtccagggcatcgctcttggattcccactccaacagaggagaggagtgatgatccaagagaacctggcggcagcgcaaaagatg

SEQ ID NO: 135398 - DNA, 103 bp, Artificial Sequence
  Synthetic Polynucleotide
taatacgactcactataggggcccagagtctccagggcatcgctcttggaaacagaggagatccaagatggatgccctgaacctggcggcagcgcaaaagatg

SEQ ID NO: 135399 - DNA, 103 bp, Artificial Sequence
  Synthetic Polynucleotide
taatacgactcactatagggggttcaggaagcccagagtctccagggcataacagaggagaatgcccatgagactctggaacctggcggcagcgcaaaagatg

SEQ ID NO: 135400 - DNA, 103 bp, Artificial Sequence
  Synthetic Polynucleotide
taatacgactcactatagggatctggtaatggttcaggaagcccagagtcaacagaggagagactctatgcttcctgaaaacctggcggcagcgcaaaagatg

SEQ ID NO: 135401 - DNA, 103 bp, Artificial Sequence
  Synthetic Polynucleotide
taatacgactcactatagggtgggtttttcatctggtaatggttcaggaaaacagaggagattcctgatgcattaccagaacctggcggcagcgcaaaagatg

SEQ ID NO: 135402 - DNA, 103 bp, Artificial Sequence
  Synthetic Polynucleotide
taatacgactcactatagggcagtcttgagccgcttaggggcccggccgcaacagaggagagcggccatgcccctaagcaacctggcggcagcgcaaaagatg

SEQ ID NO: 135403 - DNA, 103 bp, Artificial Sequence
  Synthetic Polynucleotide
taatacgactcactatagggatggaccatttgggtttttcatctggtaataacagaggagaattaccatgtgaaaaaccaacctggcggcagcgcaaaagatg

SEQ ID NO: 135404 - DNA, 103 bp, Artificial Sequence
  Synthetic Polynucleotide
taatacgactcactataggggtgtaagggtatggaccatttgggtttttcaacagaggagagaaaaaatgaaatggtccaacctggcggcagcgcaaaagatg

SEQ ID NO: 135405 - DNA, 103 bp, Artificial Sequence
  Synthetic Polynucleotide
taatacgactcactatagggcaacttcagagtgtaagggtatggaccattaacagaggagaaatggtatgtacccttacaacctggcggcagcgcaaaagatg

SEQ ID NO: 135406 - DNA, 103 bp, Artificial Sequence
  Synthetic Polynucleotide
taatacgactcactatagggtggagaaacacaacttcagagtgtaagggtaacagaggagaacccttatgctctgaagtaacctggcggcagcgcaaaagatg

SEQ ID NO: 135407 - DNA, 103 bp, Artificial Sequence
  Synthetic Polynucleotide
taatacgactcactatagggtgctgagcagtggagaaacacaacttcagaaacagaggagatctgaaatggtgtttctcaacctggcggcagcgcaaaagatg

SEQ ID NO: 135408 - DNA, 103 bp, Artificial Sequence
  Synthetic Polynucleotide
taatacgactcactatagggttaggaggcgtgctgagcagtggagaaacaaacagaggagatgtttcatgactgctcagaacctggcggcagcgcaaaagatg

SEQ ID NO: 135409 - DNA, 103 bp, Artificial Sequence
  Synthetic Polynucleotide
taatacgactcactatagggccggcgttgtcagtcttgagccgcttagggaacagaggagaccctaaatggctcaagacaacctggcggcagcgcaaaagatg

SEQ ID NO: 135410 - DNA, 103 bp, Artificial Sequence
  Synthetic Polynucleotide
taatacgactcactataggggtgctggtcgccggcgttgtcagtcttgagaacagaggagactcaagatggacaacgccaacctggcggcagcgcaaaagatg

SEQ ID NO: 135411 - DNA, 103 bp, Artificial Sequence
  Synthetic Polynucleotide
taatacgactcactataggggacgccgcttctccgcccggggcagcagccaacagaggagaggctgcatgcccgggcggaacctggcggcagcgcaaaagatg

SEQ ID NO: 135412 - DNA, 103 bp, Artificial Sequence
  Synthetic Polynucleotide
taatacgactcactatagggcgccgcctccgtgctggtcgccggcgttgtaacagaggagaacaacgatggcgaccagcaacctggcggcagcgcaaaagatg

SEQ ID NO: 135413 - DNA, 103 bp, Artificial Sequence
  Synthetic Polynucleotide
taatacgactcactatagggccgccaccgccgccgcctccgtgctggtcgaacagaggagacgaccaatgcggaggcggaacctggcggcagcgcaaaagatg

SEQ ID NO: 135414 - DNA, 103 bp, Artificial Sequence
  Synthetic Polynucleotide
taatacgactcactatagggggctcctccaccgccaccgccgccgcctccaacagaggagaggaggcatgggcggtggcaacctggcggcagcgcaaaagatg

SEQ ID NO: 135415 - DNA, 103 bp, Artificial Sequence
  Synthetic Polynucleotide
taatacgactcactatagggccgccgccccggctcctccaccgccaccgcaacagaggagagcggtgatggtggaggagaacctggcggcagcgcaaaagatg

SEQ ID NO: 135416 - DNA, 103 bp, Artificial Sequence
  Synthetic Polynucleotide
taatacgactcactatagggccgccgccgcccgccgccccggctcctccaaacagaggagatggaggatgcggggcggcaacctggcggcagcgcaaaagatg

SEQ ID NO: 135417 - DNA, 103 bp, Artificial Sequence
  Synthetic Polynucleotide
taatacgactcactatagggctccccaccgccgccgccgcccgccgccccaacagaggagaggggcgatgggcggcggcaacctggcggcagcgcaaaagatg

SEQ ID NO: 135418 - DNA, 103 bp, Artificial Sequence
  Synthetic Polynucleotide
taatacgactcactatagggcatcgtagttctccccaccgccgccgccgcaacagaggagagcggcgatggcggtggggaacctggcggcagcgcaaaagatg

SEQ ID NO: 135419 - DNA, 103 bp, Artificial Sequence
  Synthetic Polynucleotide
taatacgactcactatagggttgtgcgggtcatcgtagttctccccaccgaacagaggagacggtggatggaactacgaaacctggcggcagcgcaaaagatg

SEQ ID NO: 135420 - DNA, 103 bp, Artificial Sequence
  Synthetic Polynucleotide
taatacgactcactatagggggcaggggttttgtgcgggtcatcgtagttaacagaggagaaactacatggacccgcacaacctggcggcagcgcaaaagatg

SEQ ID NO: 135421 - DNA, 103 bp, Artificial Sequence
  Synthetic Polynucleotide
taatacgactcactatagggcaactggggaggcaggggttttgtgcgggtaacagaggagaacccgcatgaaacccctgaacctggcggcagcgcaaaagatg

SEQ ID NO: 135422 - DNA, 103 bp, Artificial Sequence
  Synthetic Polynucleotide
taatacgactcactatagggtccagccgccgacgccgcttctccgcccggaacagaggagaccgggcatggaagcggcgaacctggcggcagcgcaaaagatg

SEQ ID NO: 135423 - DNA, 103 bp, Artificial Sequence
  Synthetic Polynucleotide
taatacgactcactatagggctgatgtggacaactggggaggcaggggttaacagaggagaaaccccatgctccccagtaacctggcggcagcgcaaaagatg

SEQ ID NO: 135424 - DNA, 103 bp, Artificial Sequence
  Synthetic Polynucleotide
taatacgactcactatagggaatcaggcccctgatgtggacaactggggaaacagaggagatccccaatggtccacatcaacctggcggcagcgcaaaagatg

SEQ ID NO: 135425 - DNA, 103 bp, Artificial Sequence
  Synthetic Polynucleotide
taatacgactcactatagggccacaccgtcaatcaggcccctgatgtggaaacagaggagatccacaatgggggcctgaaacctggcggcagcgcaaaagatg

SEQ ID NO: 135426 - DNA, 103 bp, Artificial Sequence
  Synthetic Polynucleotide
taatacgactcactatagggtctgcttccaccacaccgtcaatcaggcccaacagaggagagggcctatgtgacggtgtaacctggcggcagcgcaaaagatg

SEQ ID NO: 135427 - DNA, 103 bp, Artificial Sequence
  Synthetic Polynucleotide
taatacgactcactatagggctccacaaggtctgcttccaccacaccgtcaacagaggagagacggtatggtggaagcaaacctggcggcagcgcaaaagatg

SEQ ID NO: 135428 - DNA, 103 bp, Artificial Sequence
  Synthetic Polynucleotide
taatacgactcactatagggcctgcaaggcctccacaaggtctgcttccaaacagaggagatggaagatgaccttgtggaacctggcggcagcgcaaaagatg

SEQ ID NO: 135429 - DNA, 103 bp, Artificial Sequence
  Synthetic Polynucleotide
taatacgactcactatagggggtccaaactcctgcaaggcctccacaaggaacagaggagaccttgtatgggccttgcaaacctggcggcagcgcaaaagatg

SEQ ID NO: 135430 - DNA, 103 bp, Artificial Sequence
  Synthetic Polynucleotide
taatacgactcactatagggatagctgatgggtccaaactcctgcaaggcaacagaggagagccttgatggagtttggaaacctggcggcagcgcaaaagatg

SEQ ID NO: 135431 - DNA, 103 bp, Artificial Sequence
  Synthetic Polynucleotide
taatacgactcactatagggttaccaccacatagctgatgggtccaaactaacagaggagaagtttgatgccatcagctaacctggcggcagcgcaaaagatg

SEQ ID NO: 135432 - DNA, 103 bp, Artificial Sequence
  Synthetic Polynucleotide
taatacgactcactatagggtttttaggcattaccaccacatagctgatgaacagaggagacatcagatgtgtggtggtaacctggcggcagcgcaaaagatg

SEQ ID NO: 135433 - DNA, 103 bp, Artificial Sequence
  Synthetic Polynucleotide
taatacgactcactatagggctgcctctgctccagccgccgacgccgcttaacagaggagaaagcggatgcggcggctgaacctggcggcagcgcaaaagatg

SEQ ID NO: 135434 - DNA, 103 bp, Artificial Sequence
  Synthetic Polynucleotide
taatacgactcactatagggtgcttgtctctttttaggcattaccaccacaacagaggagagtggtgatgatgcctaaaaacctggcggcagcgcaaaagatg

SEQ ID NO: 135435 - DNA, 103 bp, Artificial Sequence
  Synthetic Polynucleotide
taatacgactcactatagggactccaccagtgcttgtctctttttaggcaaacagaggagatgcctaatgagagacaagaacctggcggcagcgcaaaagatg

SEQ ID NO: 135436 - DNA, 103 bp, Artificial Sequence
  Synthetic Polynucleotide
taatacgactcactatagggacatcttcaaactccaccagtgcttgtctcaacagaggagagagacaatgactggtggaaacctggcggcagcgcaaaagatg

SEQ ID NO: 135437 - DNA, 103 bp, Artificial Sequence
  Synthetic Polynucleotide
taatacgactcactatagggagcccccaacacatcttcaaactccaccagaacagaggagactggtgatgtttgaagataacctggcggcagcgcaaaagatg

SEQ ID NO: 135438 - DNA, 103 bp, Artificial Sequence
  Synthetic Polynucleotide
taatacgactcactatagggctgcgttgcaagcccccaacacatcttcaaaacagaggagattgaagatgtgttgggggaacctggcggcagcgcaaaagatg

SEQ ID NO: 135439 - DNA, 103 bp, Artificial Sequence
  Synthetic Polynucleotide
taatacgactcactataggggcgtagttcactgcgttgcaagcccccaacaacagaggagagttgggatgttgcaacgcaacctggcggcagcgcaaaagatg

SEQ ID NO: 135440 - DNA, 103 bp, Artificial Sequence
  Synthetic Polynucleotide
taatacgactcactataggggttgtcggctgcgtagttcactgcgttgcaaacagaggagatgcaacatggtgaactacaacctggcggcagcgcaaaagatg

SEQ ID NO: 135441 - DNA, 103 bp, Artificial Sequence
  Synthetic Polynucleotide
taatacgactcactatagggtgtatatttggttgtcggctgcgtagttcaaacagaggagatgaactatgcagccgacaaacctggcggcagcgcaaaagatg

SEQ ID NO: 135442 - DNA, 103 bp, Artificial Sequence
  Synthetic Polynucleotide
taatacgactcactatagggtgaccagcaatgtatatttggttgtcggctaacagaggagaagccgaatgccaaatataaacctggcggcagcgcaaaagatg

SEQ ID NO: 135443 - DNA, 103 bp, Artificial Sequence
  Synthetic Polynucleotide
taatacgactcactatagggaaaagctgggtgaccagcaatgtatatttgaacagaggagacaaataatgattgctggtaacctggcggcagcgcaaaagatg

SEQ ID NO: 135444 - DNA, 103 bp, Artificial Sequence
  Synthetic Polynucleotide
taatacgactcactatagggcgtccggctgctgcctctgctccagccgccaacagaggagaggcggcatgagcagaggcaacctggcggcagcgcaaaagatg

SEQ ID NO: 135445 - DNA, 103 bp, Artificial Sequence
  Synthetic Polynucleotide
taatacgactcactatagggagtagttgacaaaagctgggtgaccagcaaaacagaggagattgctgatgacccagcttaacctggcggcagcgcaaaagatg

SEQ ID NO: 135446 - DNA, 103 bp, Artificial Sequence
  Synthetic Polynucleotide
taatacgactcactatagggtggctggtagagtagttgacaaaagctgggaacagaggagacccagcatgtgtcaactaaacctggcggcagcgcaaaagatg

SEQ ID NO: 135447 - DNA, 103 bp, Artificial Sequence
  Synthetic Polynucleotide
taatacgactcactatagggggagatcttctggctggtagagtagttgacaacagaggagagtcaacatgtctaccagcaacctggcggcagcgcaaaagatg

SEQ ID NO: 135448 - DNA, 103 bp, Artificial Sequence
  Synthetic Polynucleotide
taatacgactcactatagggccccagggcgggagatcttctggctggtagaacagaggagactaccaatgagaagatctaacctggcggcagcgcaaaagatg

SEQ ID NO: 135449 - DNA, 103 bp, Artificial Sequence
  Synthetic Polynucleotide
taatacgactcactatagggtcatccgagtccccagggcgggagatcttcaacagaggagagaagatatgccgccctggaacctggcggcagcgcaaaagatg

SEQ ID NO: 135450 - DNA, 103 bp, Artificial Sequence
  Synthetic Polynucleotide
taatacgactcactataggggctccgggagtcatccgagtccccagggcgaacagaggagacgccctatggactcggataacctggcggcagcgcaaaagatg

SEQ ID NO: 135451 - DNA, 103 bp, Artificial Sequence
  Synthetic Polynucleotide
taatacgactcactatagggcactgttcacgctccgggagtcatccgagtaacagaggagaactcggatgactcccggaaacctggcggcagcgcaaaagatg

SEQ ID NO: 135452 - DNA, 103 bp, Artificial Sequence
  Synthetic Polynucleotide
taatacgactcactatagggaagagaagcacactgttcacgctccgggagaacagaggagactcccgatgcgtgaacagaacctggcggcagcgcaaaagatg

SEQ ID NO: 135453 - DNA, 103 bp, Artificial Sequence
  Synthetic Polynucleotide
taatacgactcactatagggcaggatggtaaagagaagcacactgttcacaacagaggagagtgaacatggtgcttctcaacctggcggcagcgcaaaagatg

SEQ ID NO: 135454 - DNA, 103 bp, Artificial Sequence
  Synthetic Polynucleotide
taatacgactcactatagggaaatggggttcaggatggtaaagagaagcaaacagaggagatgcttcatgttaccatccaacctggcggcagcgcaaaagatg

SEQ ID NO: 135455 - DNA, 103 bp, Artificial Sequence
  Synthetic Polynucleotide
taatacgactcactatagggctccgctgctcgtccggctgctgcctctgcaacagaggagagcagagatggcagccggaaacctggcggcagcgcaaaagatg

SEQ ID NO: 135456 - DNA, 103 bp, Artificial Sequence
  Synthetic Polynucleotide
taatacgactcactataggggtgatcgaataaatggggttcaggatggtaaacagaggagataccatatggaaccccataacctggcggcagcgcaaaagatg

SEQ ID NO: 135457 - DNA, 103 bp, Artificial Sequence
  Synthetic Polynucleotide
taatacgactcactatagggaacatccgtggtgatcgaataaatggggttaacagaggagaaaccccatgtattcgatcaacctggcggcagcgcaaaagatg

SEQ ID NO: 135458 - DNA, 103 bp, Artificial Sequence
  Synthetic Polynucleotide
taatacgactcactatagggtagtgtaaagaacatccgtggtgatcgaataacagaggagaattcgaatgccacggatgaacctggcggcagcgcaaaagatg

SEQ ID NO: 135459 - DNA, 103 bp, Artificial Sequence
  Synthetic Polynucleotide
taatacgactcactatagggggattacagatagtgtaaagaacatccgtgaacagaggagacacggaatgtctttacacaacctggcggcagcgcaaaagatg

SEQ ID NO: 135460 - DNA, 103 bp, Artificial Sequence
  Synthetic Polynucleotide
taatacgactcactatagggagggccacaaggattacagatagtgtaaagaacagaggagactttacatgatctgtaataacctggcggcagcgcaaaagatg

SEQ ID NO: 135461 - DNA, 103 bp, Artificial Sequence
  Synthetic Polynucleotide
taatacgactcactatagggttctctggacagggccacaaggattacagaaacagaggagatctgtaatgcttgtggccaacctggcggcagcgcaaaagatg

SEQ ID NO: 135462 - DNA, 103 bp, Artificial Sequence
  Synthetic Polynucleotide
taatacgactcactatagggaaaatgacaattctctggacagggccacaaaacagaggagattgtggatgtgtccagagaacctggcggcagcgcaaaagatg

SEQ ID NO: 135463 - DNA, 103 bp, Artificial Sequence
  Synthetic Polynucleotide
taatacgactcactatagggattcttcctgaaaatgacaattctctggacaacagaggagagtccagatgattgtcattaacctggcggcagcgcaaaagatg

SEQ ID NO: 135464 - DNA, 103 bp, Artificial Sequence
  Synthetic Polynucleotide
taatacgactcactatagggcctgaactccattcttcctgaaaatgacaaaacagaggagattgtcaatgtcaggaagaaacctggcggcagcgcaaaagatg

SEQ ID NO: 135465 - DNA, 103 bp, Artificial Sequence
  Synthetic Polynucleotide
taatacgactcactatagggtccaccatcgcctgaactccattcttcctgaacagaggagacaggaaatgtggagttcaaacctggcggcagcgcaaaagatg

SEQ ID NO: 135466 - DNA, 103 bp, Artificial Sequence
  Synthetic Polynucleotide
taatacgactcactatagggtcccgaccgcctccgctgctcgtccggctgaacagaggagacagccgatggagcagcggaacctggcggcagcgcaaaagatg

SEQ ID NO: 135467 - DNA, 103 bp, Artificial Sequence
  Synthetic Polynucleotide
taatacgactcactatagggtgagtcaaattccaccatcgcctgaactccaacagaggagaggagttatggcgatggtgaacctggcggcagcgcaaaagatg

SEQ ID NO: 135468 - DNA, 103 bp, Artificial Sequence
  Synthetic Polynucleotide
taatacgactcactatagggcactttgaactgagtcaaattccaccatcgaacagaggagacgatggatgaatttgactaacctggcggcagcgcaaaagatg

SEQ ID NO: 135469 - DNA, 103 bp, Artificial Sequence
  Synthetic Polynucleotide
taatacgactcactataggggcccgctgggcactttgaactgagtcaaataacagaggagaatttgaatgagttcaaagaacctggcggcagcgcaaaagatg

SEQ ID NO: 135470 - DNA, 103 bp, Artificial Sequence
  Synthetic Polynucleotide
taatacgactcactatagggagaggccttggcccgctgggcactttgaacaacagaggagagttcaaatggcccagcggaacctggcggcagcgcaaaagatg

SEQ ID NO: 135471 - DNA, 103 bp, Artificial Sequence
  Synthetic Polynucleotide
taatacgactcactatagggccccattgagagaggccttggcccgctgggaacagaggagacccagcatgccaaggcctaacctggcggcagcgcaaaagatg

SEQ ID NO: 135472 - DNA, 103 bp, Artificial Sequence
  Synthetic Polynucleotide
taatacgactcactatagggtagatatcagccccattgagagaggccttgaacagaggagacaaggcatgtctcaatggaacctggcggcagcgcaaaagatg

SEQ ID NO: 135473 - DNA, 103 bp, Artificial Sequence
  Synthetic Polynucleotide
taatacgactcactatagggacagccagaatagatatcagccccattgagaacagaggagactcaatatggctgatatcaacctggcggcagcgcaaaagatg

SEQ ID NO: 135474 - DNA, 103 bp, Artificial Sequence
  Synthetic Polynucleotide
taatacgactcactatagggtcagagtgcaacagccagaatagatatcagaacagaggagactgataatgattctggctaacctggcggcagcgcaaaagatg

SEQ ID NO: 135475 - DNA, 103 bp, Artificial Sequence
  Synthetic Polynucleotide
taatacgactcactatagggtattcgatcttcagagtgcaacagccagaaaacagaggagattctggatgttgcactctaacctggcggcagcgcaaaagatg

SEQ ID NO: 135476 - DNA, 103 bp, Artificial Sequence
  Synthetic Polynucleotide
taatacgactcactatagggaggctttgcgtattcgatcttcagagtgcaaacagaggagatgcactatgaagatcgaaaacctggcggcagcgcaaaagatg

SEQ ID NO: 135477 - DNA, 103 bp, Artificial Sequence
  Synthetic Polynucleotide
taatacgactcactatagggtcaccatcgctcccgaccgcctccgctgctaacagaggagaagcagcatgggcggtcggaacctggcggcagcgcaaaagatg

SEQ ID NO: 135478 - DNA, 103 bp, Artificial Sequence
  Synthetic Polynucleotide
taatacgactcactatagggtcaagcgtgtaggctttgcgtattcgatctaacagaggagaagatcgatgacgcaaagcaacctggcggcagcgcaaaagatg

SEQ ID NO: 135479 - DNA, 103 bp, Artificial Sequence
  Synthetic Polynucleotide
taatacgactcactatagggttgaacacattcaagcgtgtaggctttgcgaacagaggagacgcaaaatgtacacgcttaacctggcggcagcgcaaaagatg

SEQ ID NO: 135480 - DNA, 103 bp, Artificial Sequence
  Synthetic Polynucleotide
taatacgactcactatagggctgatcattcttgaacacattcaagcgtgtaacagaggagaacacgcatgaatgtgttcaacctggcggcagcgcaaaagatg

SEQ ID NO: 135481 - DNA, 103 bp, Artificial Sequence
  Synthetic Polynucleotide
taatacgactcactatagggcccaagtatcctgatcattcttgaacacataacagaggagaatgtgtatgagaatgatcaacctggcggcagcgcaaaagatg

SEQ ID NO: 135482 - DNA, 103 bp, Artificial Sequence
  Synthetic Polynucleotide
taatacgactcactatagggtttgtgtagtcccaagtatcctgatcattcaacagaggagagaatgaatgggatacttgaacctggcggcagcgcaaaagatg

SEQ ID NO: 135483 - DNA, 103 bp, Artificial Sequence
  Synthetic Polynucleotide
taatacgactcactataggggagattggggtttgtgtagtcccaagtatcaacagaggagagatactatggactacacaaacctggcggcagcgcaaaagatg

SEQ ID NO: 135484 - DNA, 103 bp, Artificial Sequence
  Synthetic Polynucleotide
taatacgactcactatagggcttgtccactgagattggggtttgtgtagtaacagaggagaactacaatgaccccaatcaacctggcggcagcgcaaaagatg

SEQ ID NO: 135485 - DNA, 103 bp, Artificial Sequence
  Synthetic Polynucleotide
taatacgactcactatagggccagggtcaccttgtccactgagattggggaacagaggagaccccaaatgcagtggacaaacctggcggcagcgcaaaagatg

SEQ ID NO: 135486 - DNA, 103 bp, Artificial Sequence
  Synthetic Polynucleotide
taatacgactcactatagggggggttgctgccagggtcaccttgtccactaacagaggagaagtggaatgggtgaccctaacctggcggcagcgcaaaagatg

SEQ ID NO: 135487 - DNA, 103 bp, Artificial Sequence
  Synthetic Polynucleotide
taatacgactcactatagggggcgtttgttggggttgctgccagggtcacaacagaggagagtgaccatggcagcaaccaacctggcggcagcgcaaaagatg

SEQ ID NO: 135488 - DNA, 103 bp, Artificial Sequence
  Synthetic Polynucleotide
taatacgactcactataggggccgccatcttcaccatcgctcccgaccgcaacagaggagagcggtcatgagcgatggtaacctggcggcagcgcaaaagatg

SEQ ID NO: 135489 - DNA, 103 bp, Artificial Sequence
  Synthetic Polynucleotide
taatacgactcactatagggggctgcctctggcgtttgttggggttgctgaacagaggagacagcaaatgcaacaaacgaacctggcggcagcgcaaaagatg

SEQ ID NO: 135490 - DNA, 103 bp, Artificial Sequence
  Synthetic Polynucleotide
taatacgactcactatagggcaggagagggggctgcctctggcgtttgttaacagaggagaaacaaaatgcagaggcagaacctggcggcagcgcaaaagatg

SEQ ID NO: 135491 - DNA, 103 bp, Artificial Sequence
  Synthetic Polynucleotide
taatacgactcactatagggggtgatctcccaggagagggggctgcctctaacagaggagaagaggcatgcccctctccaacctggcggcagcgcaaaagatg

SEQ ID NO: 135492 - DNA, 103 bp, Artificial Sequence
  Synthetic Polynucleotide
taatacgactcactatagggtattctgcggggtgatctcccaggagagggaacagaggagaccctctatggggagatcaaacctggcggcagcgcaaaagatg

SEQ ID NO: 135493 - DNA, 103 bp, Artificial Sequence
  Synthetic Polynucleotide
taatacgactcactataggggggccctccatattctgcggggtgatctccaacagaggagaggagatatgcccgcagaaaacctggcggcagcgcaaaagatg

SEQ ID NO: 135494 - DNA, 103 bp, Artificial Sequence
  Synthetic Polynucleotide
taatacgactcactatagggacccaccgtggggccctccatattctgcggaacagaggagaccgcagatgatggagggcaacctggcggcagcgcaaaagatg

SEQ ID NO: 135495 - DNA, 103 bp, Artificial Sequence
  Synthetic Polynucleotide
taatacgactcactatagggtggctgtggtacccaccgtggggccctccaaacagaggagatggaggatgccacggtggaacctggcggcagcgcaaaagatg

SEQ ID NO: 135496 - DNA, 103 bp, Artificial Sequence
  Synthetic Polynucleotide
taatacgactcactatagggatcatggtaatggctgtggtacccaccgtgaacagaggagacacggtatgtaccacagcaacctggcggcagcgcaaaagatg

SEQ ID NO: 135497 - DNA, 103 bp, Artificial Sequence
  Synthetic Polynucleotide
taatacgactcactatagggcgtagccctcatcatggtaatggctgtggtaacagaggagaaccacaatgattaccatgaacctggcggcagcgcaaaagatg

SEQ ID NO: 135498 - DNA, 103 bp, Artificial Sequence
  Synthetic Polynucleotide
taatacgactcactatagggggggggggcccgtagccctcatcatggtaaaacagaggagattaccaatgtgagggctaaacctggcggcagcgcaaaagatg

SEQ ID NO: 135499 - DNA, 103 bp, Artificial Sequence
  Synthetic Polynucleotide
taatacgactcactatagggcttttttacattaacaggcgaggaactcataacagaggagaatgagtatgtcgcctgttaacctggcggcagcgcaaaagatg

SEQ ID NO: 135500 - DNA, 103 bp, Artificial Sequence
  Synthetic Polynucleotide
taatacgactcactatagggagcctggagtcgctccatgagctcggccttaacagaggagaaaggccatgctcatggagaacctggcggcagcgcaaaagatg

SEQ ID NO: 135501 - DNA, 103 bp, Artificial Sequence
  Synthetic Polynucleotide
taatacgactcactatagggaaccttcatctcaaaacacactttgcctttaacagaggagaaaaggcatggtgtgttttaacctggcggcagcgcaaaagatg

SEQ ID NO: 135502 - DNA, 103 bp, Artificial Sequence
  Synthetic Polynucleotide
taatacgactcactatagggtcttctctgtaaccttcatctcaaaacacaaacagaggagatgtgttatgagatgaaggaacctggcggcagcgcaaaagatg

SEQ ID NO: 135503 - DNA, 103 bp, Artificial Sequence
  Synthetic Polynucleotide
taatacgactcactatagggcttactgggatcttctctgtaaccttcatcaacagaggagagatgaaatgtacagagaaaacctggcggcagcgcaaaagatg

SEQ ID NO: 135504 - DNA, 103 bp, Artificial Sequence
  Synthetic Polynucleotide
taatacgactcactatagggatataaatgccttactgggatcttctctgtaacagaggagaacagagatgatcccagtaaacctggcggcagcgcaaaagatg

SEQ ID NO: 135505 - DNA, 103 bp, Artificial Sequence
  Synthetic Polynucleotide
taatacgactcactatagggtatcttttgtatataaatgccttactgggaaacagaggagatcccagatgggcatttataacctggcggcagcgcaaaagatg

SEQ ID NO: 135506 - DNA, 103 bp, Artificial Sequence
  Synthetic Polynucleotide
taatacgactcactatagggtgtatgtcaatatcttttgtatataaatgcaacagaggagagcatttatgtacaaaagaaacctggcggcagcgcaaaagatg

SEQ ID NO: 135507 - DNA, 103 bp, Artificial Sequence
  Synthetic Polynucleotide
taatacgactcactatagggacgaacttcatgtatgtcaatatcttttgtaacagaggagaacaaaaatgattgacataaacctggcggcagcgcaaaagatg

SEQ ID NO: 135508 - DNA, 103 bp, Artificial Sequence
  Synthetic Polynucleotide
taatacgactcactatagggaccagccaatacgaacttcatgtatgtcaaaacagaggagattgacaatgatgaagttcaacctggcggcagcgcaaaagatg

SEQ ID NO: 135509 - DNA, 103 bp, Artificial Sequence
  Synthetic Polynucleotide
taatacgactcactataggggtagttagtgaccagccaatacgaacttcaaacagaggagatgaagtatgtattggctgaacctggcggcagcgcaaaagatg

SEQ ID NO: 135510 - DNA, 103 bp, Artificial Sequence
  Synthetic Polynucleotide
taatacgactcactatagggcattccacttgtagttagtgaccagccaataacagaggagaattggcatgtcactaactaacctggcggcagcgcaaaagatg

SEQ ID NO: 135511 - DNA, 103 bp, Artificial Sequence
  Synthetic Polynucleotide
taatacgactcactatagggcgtccagcgcagcctggagtcgctccatgaaacagaggagatcatggatggactccaggaacctggcggcagcgcaaaagatg

SEQ ID NO: 135512 - DNA, 103 bp, Artificial Sequence
  Synthetic Polynucleotide
taatacgactcactatagggcaccaagtaacattccacttgtagttagtgaacagaggagacactaaatgcaagtggaaaacctggcggcagcgcaaaagatg

SEQ ID NO: 135513 - DNA, 103 bp, Artificial Sequence
  Synthetic Polynucleotide
taatacgactcactatagggaattcttcttcaccaagtaacattccacttaacagaggagaaagtggatggttacttggaacctggcggcagcgcaaaagatg

SEQ ID NO: 135514 - DNA, 103 bp, Artificial Sequence
  Synthetic Polynucleotide
taatacgactcactatagggcccataagaaaattcttcttcaccaagtaaaacagaggagattacttatggaagaagaaaacctggcggcagcgcaaaagatg

SEQ ID NO: 135515 - DNA, 103 bp, Artificial Sequence
  Synthetic Polynucleotide
taatacgactcactatagggttagagaatacccataagaaaattcttcttaacagaggagaaagaagatgtttcttatgaacctggcggcagcgcaaaagatg

SEQ ID NO: 135516 - DNA, 103 bp, Artificial Sequence
  Synthetic Polynucleotide
taatacgactcactatagggtttattccttttagagaatacccataagaaaacagaggagattcttaatggtattctctaacctggcggcagcgcaaaagatg

SEQ ID NO: 135517 - DNA, 103 bp, Artificial Sequence
  Synthetic Polynucleotide
taatacgactcactataggggttgcatgtttttattccttttagagaataaacagaggagatattctatgaaaggaataaacctggcggcagcgcaaaagatg

SEQ ID NO: 135518 - DNA, 103 bp, Artificial Sequence
  Synthetic Polynucleotide
taatacgactcactatagggcagtctcacagttgcatgtttttattccttaacagaggagaaaggaaatgaaacatgcaaacctggcggcagcgcaaaagatg

SEQ ID NO: 135519 - DNA, 103 bp, Artificial Sequence
  Synthetic Polynucleotide
taatacgactcactatagggccataatcttcagtctcacagttgcatgttaacagaggagaaacatgatgctgtgagacaacctggcggcagcgcaaaagatg

SEQ ID NO: 135520 - DNA, 103 bp, Artificial Sequence
  Synthetic Polynucleotide
taatacgactcactatagggaaacttttctccataatcttcagtctcacaaacagaggagatgtgagatggaagattataacctggcggcagcgcaaaagatg

SEQ ID NO: 135521 - DNA, 103 bp, Artificial Sequence
  Synthetic Polynucleotide
taatacgactcactatagggcattttcatcaaacttttctccataatcttaacagaggagaaagattatggagaaaagtaacctggcggcagcgcaaaagatg

SEQ ID NO: 135522 - DNA, 103 bp, Artificial Sequence
  Synthetic Polynucleotide
taatacgactcactataggggcctcctcgtcgtccagcgcagcctggagtaacagaggagaactccaatgtgcgctggaaacctggcggcagcgcaaaagatg

SEQ ID NO: 135523 - DNA, 103 bp, Artificial Sequence
  Synthetic Polynucleotide
taatacgactcactataggggtaatcacatcattttcatcaaacttttctaacagaggagaagaaaaatgtgatgaaaaaacctggcggcagcgcaaaagatg

SEQ ID NO: 135524 - DNA, 103 bp, Artificial Sequence
  Synthetic Polynucleotide
taatacgactcactatagggagcaaaacatgtaatcacatcattttcatcaacagaggagagatgaaatggatgtgattaacctggcggcagcgcaaaagatg

SEQ ID NO: 135525 - DNA, 103 bp, Artificial Sequence
  Synthetic Polynucleotide
taatacgactcactatagggtttcaaagttagcaaaacatgtaatcacataacagaggagaatgtgaatgcatgttttgaacctggcggcagcgcaaaagatg

SEQ ID NO: 135526 - DNA, 103 bp, Artificial Sequence
  Synthetic Polynucleotide
taatacgactcactatagggacttcatcactttcaaagttagcaaaacataacagaggagaatgtttatgtaactttgaaacctggcggcagcgcaaaagatg

SEQ ID NO: 135527 - DNA, 103 bp, Artificial Sequence
  Synthetic Polynucleotide
taatacgactcactatagggcgagagttctacttcatcactttcaaagttaacagaggagaaactttatgagtgatgaaaacctggcggcagcgcaaaagatg

SEQ ID NO: 135528 - DNA, 103 bp, Artificial Sequence
  Synthetic Polynucleotide
taatacgactcactatagggtcttagcatacgagagttctacttcatcacaacagaggagagtgatgatgtagaactctaacctggcggcagcgcaaaagatg

SEQ ID NO: 135529 - DNA, 103 bp, Artificial Sequence
  Synthetic Polynucleotide
taatacgactcactatagggtcttgtccattcttagcatacgagagttctaacagaggagaagaactatggtatgctaaaacctggcggcagcgcaaaagatg

SEQ ID NO: 135530 - DNA, 103 bp, Artificial Sequence
  Synthetic Polynucleotide
taatacgactcactatagggaacgccaagatcttgtccattcttagcataaacagaggagatatgctatgaatggacaaaacctggcggcagcgcaaaagatg

SEQ ID NO: 135531 - DNA, 103 bp, Artificial Sequence
  Synthetic Polynucleotide
taatacgactcactatagggttttgaaggcaacgccaagatcttgtccataacagaggagaatggacatgatcttggcgaacctggcggcagcgcaaaagatg

SEQ ID NO: 135532 - DNA, 103 bp, Artificial Sequence
  Synthetic Polynucleotide
taatacgactcactatagggtccttactgattttgaaggcaacgccaagaaacagaggagatcttggatgtgccttcaaaacctggcggcagcgcaaaagatg

SEQ ID NO: 135533 - DNA, 103 bp, Artificial Sequence
  Synthetic Polynucleotide
taatacgactcactataggggcggcccccggcctcctcgtcgtccagcgcaacagaggagagcgctgatggacgaggagaacctggcggcagcgcaaaagatg

SEQ ID NO: 135534 - DNA, 103 bp, Artificial Sequence
  Synthetic Polynucleotide
taatacgactcactatagggagcaagaacttccttactgattttgaaggcaacagaggagagccttcatgatcagtaagaacctggcggcagcgcaaaagatg

SEQ ID NO: 135535 - DNA, 103 bp, Artificial Sequence
  Synthetic Polynucleotide
taatacgactcactataggggtggccgtccagcaagaacttccttactgaaacagaggagatcagtaatgaagttcttgaacctggcggcagcgcaaaagatg

SEQ ID NO: 135536 - DNA, 103 bp, Artificial Sequence
  Synthetic Polynucleotide
taatacgactcactatagggtgcgggaacagtggccgtccagcaagaactaacagaggagaagttctatgtggacggccaacctggcggcagcgcaaaagatg

SEQ ID NO: 135537 - DNA, 103 bp, Artificial Sequence
  Synthetic Polynucleotide
taatacgactcactataggggcagagaacatgcgggaacagtggccgtccaacagaggagaggacggatgctgttcccgaacctggcggcagcgcaaaagatg

SEQ ID NO: 135538 - DNA, 103 bp, Artificial Sequence
  Synthetic Polynucleotide
taatacgactcactatagggcacagttgtggcagagaacatgcgggaacaaacagaggagatgttccatgatgttctctaacctggcggcagcgcaaaagatg

SEQ ID NO: 135539 - DNA, 103 bp, Artificial Sequence
  Synthetic Polynucleotide
taatacgactcactatagggaattcaactgcacagttgtggcagagaacaaacagaggagatgttctatgccacaactgaacctggcggcagcgcaaaagatg

SEQ ID NO: 135540 - DNA, 103 bp, Artificial Sequence
  Synthetic Polynucleotide
taatacgactcactatagggaccaaaattaaattcaactgcacagttgtgaacagaggagacacaacatggcagttgaaaacctggcggcagcgcaaaagatg

SEQ ID NO: 135541 - DNA, 103 bp, Artificial Sequence
  Synthetic Polynucleotide
taatacgactcactatagggtttccttctgaccaaaattaaattcaactgaacagaggagacagttgatgttaattttgaacctggcggcagcgcaaaagatg

SEQ ID NO: 135542 - DNA, 103 bp, Artificial Sequence
  Synthetic Polynucleotide
taatacgactcactatagggaaatatggcttttccttctgaccaaaattaaacagaggagataatttatgtcagaaggaaacctggcggcagcgcaaaagatg

SEQ ID NO: 135543 - DNA, 103 bp, Artificial Sequence
  Synthetic Polynucleotide
taatacgactcactatagggaggtattggaaaatatggcttttccttctgaacagaggagacagaagatgaagccatataacctggcggcagcgcaaaagatg

SEQ ID NO: 135544 - DNA, 103 bp, Artificial Sequence
  Synthetic Polynucleotide
taatacgactcactatagggccatggcggggcggcccccggcctcctcgtaacagaggagaacgaggatgccgggggccaacctggcggcagcgcaaaagatg

SEQ ID NO: 135545 - DNA, 103 bp, Artificial Sequence
  Synthetic Polynucleotide
taatacgactcactatagggtatactcttcaggtattggaaaatatggctaacagaggagaagccatatgttccaatacaacctggcggcagcgcaaaagatg

SEQ ID NO: 135546 - DNA, 103 bp, Artificial Sequence
  Synthetic Polynucleotide
taatacgactcactatagggtggatgaaagtatactcttcaggtattggaaacagaggagatccaatatgtgaagagtaaacctggcggcagcgcaaaagatg

SEQ ID NO: 135547 - DNA, 103 bp, Artificial Sequence
  Synthetic Polynucleotide
taatacgactcactatagggggggacgttctggatgaaagtatactcttcaacagaggagagaagagatgactttcatcaacctggcggcagcgcaaaagatg

SEQ ID NO: 135548 - DNA, 103 bp, Artificial Sequence
  Synthetic Polynucleotide
taatacgactcactataggggatcctctaaggggacgttctggatgaaagaacagaggagactttcaatgagaacgtccaacctggcggcagcgcaaaagatg

SEQ ID NO: 135549 - DNA, 103 bp, Artificial Sequence
  Synthetic Polynucleotide
taatacgactcactatagggcctctaactcgatcctctaaggggacgttcaacagaggagagaacgtatgcttagaggaaacctggcggcagcgcaaaagatg

SEQ ID NO: 135550 - DNA, 103 bp, Artificial Sequence
  Synthetic Polynucleotide
taatacgactcactatagggcccctttggtcctctaactcgatcctctaaaacagaggagattagagatgcgagttagaaacctggcggcagcgcaaaagatg

SEQ ID NO: 135551 - DNA, 103 bp, Artificial Sequence
  Synthetic Polynucleotide
taatacgactcactatagggtctcttcaggcccctttggtcctctaactcaacagaggagagagttaatggaccaaaggaacctggcggcagcgcaaaagatg

SEQ ID NO: 135552 - DNA, 103 bp, Artificial Sequence
  Synthetic Polynucleotide
taatacgactcactatagggcaatctttcttctcttcaggcccctttggtaacagaggagaaccaaaatggcctgaagaaacctggcggcagcgcaaaagatg

SEQ ID NO: 135553 - DNA, 103 bp, Artificial Sequence
  Synthetic Polynucleotide
taatacgactcactatagggcacaacttcacaatctttcttctcttcaggaacagaggagacctgaaatgaagaaagataacctggcggcagcgcaaaagatg

SEQ ID NO: 135554 - DNA, 103 bp, Artificial Sequence
  Synthetic Polynucleotide
taatacgactcactatagggcaatcatcatcacaacttcacaatctttctaacagaggagaagaaagatggtgaagttgaacctggcggcagcgcaaaagatg

SEQ ID NO: 135555 - DNA, 103 bp, Artificial Sequence
  Synthetic Polynucleotide
taatacgactcactatagggttcccgggctccatggcggggcggcccccgaacagaggagacgggggatgccccgccataacctggcggcagcgcaaaagatg

SEQ ID NO: 135556 - DNA, 103 bp, Artificial Sequence
  Synthetic Polynucleotide
taatacgactcactatagggcctggcaagccaatcatcatcacaacttcaaacagaggagatgaagtatggatgatgataacctggcggcagcgcaaaagatg

SEQ ID NO: 135557 - DNA, 103 bp, Artificial Sequence
  Synthetic Polynucleotide
taatacgactcactatagggttttccagctcctggcaagccaatcatcataacagaggagaatgatgatgggcttgccaaacctggcggcagcgcaaaagatg

SEQ ID NO: 135558 - DNA, 103 bp, Artificial Sequence
  Synthetic Polynucleotide
taatacgactcactatagggcccaggtagtttttccagctcctggcaagcaacagaggagagcttgcatggagctggaaaacctggcggcagcgcaaaagatg

SEQ ID NO: 135559 - DNA, 103 bp, Artificial Sequence
  Synthetic Polynucleotide
taatacgactcactatagggtgtttagtaacccaggtagtttttccagctaacagaggagaagctggatgaactacctgaacctggcggcagcgcaaaagatg

SEQ ID NO: 135560 - DNA, 103 bp, Artificial Sequence
  Synthetic Polynucleotide
taatacgactcactatagggttctgctgcatgtttagtaacccaggtagtaacagaggagaactaccatggttactaaaaacctggcggcagcgcaaaagatg

SEQ ID NO: 135561 - DNA, 103 bp, Artificial Sequence
  Synthetic Polynucleotide
taatacgactcactatagggtccctggattttctgctgcatgtttagtaaaacagaggagattactaatgatgcagcagaacctggcggcagcgcaaaagatg

SEQ ID NO: 135562 - DNA, 103 bp, Artificial Sequence
  Synthetic Polynucleotide
taatacgactcactatagggatgttatatttccctggattttctgctgcaaacagaggagatgcagcatgaaatccaggaacctggcggcagcgcaaaagatg

SEQ ID NO: 135563 - DNA, 103 bp, Artificial Sequence
  Synthetic Polynucleotide
taatacgactcactatagggtgtgccaagaatgttatatttccctggattaacagaggagaaatccaatgaaatataacaacctggcggcagcgcaaaagatg

SEQ ID NO: 135564 - DNA, 103 bp, Artificial Sequence
  Synthetic Polynucleotide
taatacgactcactatagggtaatagtatttgtgccaagaatgttatattaacagaggagaaatataatgttcttggcaaacctggcggcagcgcaaaagatg

SEQ ID NO: 135565 - DNA, 103 bp, Artificial Sequence
  Synthetic Polynucleotide
taatacgactcactatagggatcttatccataatagtatttgtgccaagaaacagaggagatcttggatgaaatactataacctggcggcagcgcaaaagatg

SEQ ID NO: 135566 - DNA, 103 bp, Artificial Sequence
  Synthetic Polynucleotide
taatacgactcactatagggtaggctgccgttcccgggctccatggcgggaacagaggagacccgccatggagcccgggaacctggcggcagcgcaaaagatg

SEQ ID NO: 135567 - DNA, 103 bp, Artificial Sequence
  Synthetic Polynucleotide
taatacgactcactatagggtgccaccatcatcttatccataatagtattaacagaggagaaatactatgatggataagaacctggcggcagcgcaaaagatg

SEQ ID NO: 135568 - DNA, 103 bp, Artificial Sequence
  Synthetic Polynucleotide
taatacgactcactatagggtcttaaaacctgccaccatcatcttatccaaacagaggagatggataatgtgatggtggaacctggcggcagcgcaaaagatg

SEQ ID NO: 135569 - DNA, 103 bp, Artificial Sequence
  Synthetic Polynucleotide
taatacgactcactataggggccatttgcttcttaaaacctgccaccatcaacagaggagagatggtatgaggttttaaaacctggcggcagcgcaaaagatg

SEQ ID NO: 135570 - DNA, 103 bp, Artificial Sequence
  Synthetic Polynucleotide
taatacgactcactatagggtccagtatctgccatttgcttcttaaaaccaacagaggagaggttttatgaagcaaatgaacctggcggcagcgcaaaagatg

SEQ ID NO: 135571 - DNA, 103 bp, Artificial Sequence
  Synthetic Polynucleotide
taatacgactcactatagggtgttcagttttccagtatctgccatttgctaacagaggagaagcaaaatgcagatactgaacctggcggcagcgcaaaagatg

SEQ ID NO: 135572 - DNA, 103 bp, Artificial Sequence
  Synthetic Polynucleotide
taatacgactcactatagggtgcaacagtgtgttcagttttccagtatctaacagaggagaagatacatgaaaactgaaaacctggcggcagcgcaaaagatg

SEQ ID NO: 135573 - DNA, 103 bp, Artificial Sequence
  Synthetic Polynucleotide
taatacgactcactataggggggggctctctgcaacagtgtgttcagtttaacagaggagaaaactgatgacactgttgaacctggcggcagcgcaaaagatg

SEQ ID NO: 135574 - DNA, 103 bp, Artificial Sequence
  Synthetic Polynucleotide
taatacgactcactatagggcaagacactggggggctctctgcaacagtgaacagaggagacactgtatgagagagcccaacctggcggcagcgcaaaagatg

SEQ ID NO: 135575 - DNA, 103 bp, Artificial Sequence
  Synthetic Polynucleotide
taatacgactcactatagggataaatttcccaagacactggggggctctcaacagaggagagagagcatgccagtgtctaacctggcggcagcgcaaaagatg

SEQ ID NO: 135576 - DNA, 103 bp, Artificial Sequence
  Synthetic Polynucleotide
taatacgactcactatagggagcaatctcaataaatttcccaagacactgaacagaggagacagtgtatggggaaatttaacctggcggcagcgcaaaagatg

SEQ ID NO: 135577 - DNA, 103 bp, Artificial Sequence
  Synthetic Polynucleotide
taatacgactcactatagggcgcccaggtctaggctgccgttcccgggctaacagaggagaagcccgatgacggcagccaacctggcggcagcgcaaaagatg

SEQ ID NO: 135578 - DNA, 103 bp, Artificial Sequence
  Synthetic Polynucleotide
taatacgactcactatagggtctttcgggcagcaatctcaataaatttccaacagaggagaggaaatatgttgagattgaacctggcggcagcgcaaaagatg

SEQ ID NO: 135579 - DNA, 103 bp, Artificial Sequence
  Synthetic Polynucleotide
taatacgactcactatagggaaatttcgcttctttcgggcagcaatctcaaacagaggagatgagatatgtgcccgaaaaacctggcggcagcgcaaaagatg

SEQ ID NO: 135580 - DNA, 103 bp, Artificial Sequence
  Synthetic Polynucleotide
taatacgactcactatagggatccagaataaaatttcgcttctttcgggcaacagaggagagcccgaatgaagcgaaataacctggcggcagcgcaaaagatg

SEQ ID NO: 135581 - DNA, 103 bp, Artificial Sequence
  Synthetic Polynucleotide
taatacgactcactatagggcatttgtctgatccagaataaaatttcgctaacagaggagaagcgaaatgttattctggaacctggcggcagcgcaaaagatg

SEQ ID NO: 135582 - DNA, 103 bp, Artificial Sequence
  Synthetic Polynucleotide
taatacgactcactataggggcagcagacacatttgtctgatccagaataaacagaggagatattctatgtcagacaaaaacctggcggcagcgcaaaagatg

SEQ ID NO: 135583 - DNA, 103 bp, Artificial Sequence
  Synthetic Polynucleotide
taatacgactcactatagggcctctgggcagcagcagacacatttgtctgaacagaggagacagacaatggtgtctgctaacctggcggcagcgcaaaagatg

SEQ ID NO: 135584 - DNA, 103 bp, Artificial Sequence
  Synthetic Polynucleotide
taatacgactcactatagggacatttttctcctctgggcagcagcagacaaacagaggagatgtctgatgctgcccagaaacctggcggcagcgcaaaagatg

SEQ ID NO: 135585 - DNA, 103 bp, Artificial Sequence
  Synthetic Polynucleotide
taatacgactcactataggggcaaacaggcacatttttctcctctgggcaaacagaggagatgcccaatggagaaaaataacctggcggcagcgcaaaagatg

SEQ ID NO: 135586 - DNA, 103 bp, Artificial Sequence
  Synthetic Polynucleotide
taatacgactcactatagggctggaagcctgcaaacaggcacatttttctaacagaggagaagaaaaatgtgcctgtttaacctggcggcagcgcaaaagatg

SEQ ID NO: 135587 - DNA, 103 bp, Artificial Sequence
  Synthetic Polynucleotide
taatacgactcactatagggcagcttttcgctggaagcctgcaaacaggcaacagaggagagcctgtatgcaggcttccaacctggcggcagcgcaaaagatg

SEQ ID NO: 135588 - DNA, 103 bp, Artificial Sequence
  Synthetic Polynucleotide
taatacgactcactataggggcggaatccccgcccaggtctaggctgccgaacagaggagacggcagatgagacctgggaacctggcggcagcgcaaaagatg

SEQ ID NO: 135589 - DNA, 103 bp, Artificial Sequence
  Synthetic Polynucleotide
taatacgactcactatagggcaaactacaacagcttttcgctggaagcctaacagaggagaaggcttatggcgaaaagcaacctggcggcagcgcaaaagatg

SEQ ID NO: 135590 - DNA, 103 bp, Artificial Sequence
  Synthetic Polynucleotide
taatacgactcactatagggatcttttgggcaaactacaacagcttttcgaacagaggagacgaaaaatggttgtagttaacctggcggcagcgcaaaagatg

SEQ ID NO: 135591 - DNA, 103 bp, Artificial Sequence
  Synthetic Polynucleotide
taatacgactcactatagggtatagtcttcatcttttgggcaaactacaaaacagaggagattgtagatggcccaaaagaacctggcggcagcgcaaaagatg

SEQ ID NO: 135592 - DNA, 103 bp, Artificial Sequence
  Synthetic Polynucleotide
taatacgactcactataggggttctttgcttatagtcttcatcttttgggaacagaggagacccaaaatgtgaagactaaacctggcggcagcgcaaaagatg

SEQ ID NO: 135593 - DNA, 103 bp, Artificial Sequence
  Synthetic Polynucleotide
taatacgactcactatagggtttcttctgtgttctttgcttatagtcttcaacagaggagagaagacatgaagcaaagaaacctggcggcagcgcaaaagatg

SEQ ID NO: 135594 - DNA, 103 bp, Artificial Sequence
  Synthetic Polynucleotide
taatacgactcactatagggctacttctgctttcttctgtgttctttgctaacagaggagaagcaaaatgcacagaagaaacctggcggcagcgcaaaagatg

SEQ ID NO: 135595 - DNA, 103 bp, Artificial Sequence
  Synthetic Polynucleotide
taatacgactcactatagggtctttcccctctacttctgctttcttctgtaacagaggagaacagaaatgagcagaagtaacctggcggcagcgcaaaagatg

SEQ ID NO: 135596 - DNA, 103 bp, Artificial Sequence
  Synthetic Polynucleotide
taatacgactcactatagggttctggtaggtctttcccctctacttctgcaacagaggagagcagaaatggaggggaaaaacctggcggcagcgcaaaagatg

SEQ ID NO: 135597 - DNA, 103 bp, Artificial Sequence
  Synthetic Polynucleotide
taatacgactcactatagggggaccgcatgttctggtaggtctttcccctaacagaggagaaggggaatgacctaccagaacctggcggcagcgcaaaagatg

SEQ ID NO: 135598 - DNA, 103 bp, Artificial Sequence
  Synthetic Polynucleotide
taatacgactcactatagggttcattttgaggaccgcatgttctggtaggaacagaggagacctaccatgacatgcggtaacctggcggcagcgcaaaagatg

SEQ ID NO: 135599 - DNA, 103 bp, Artificial Sequence
  Synthetic Polynucleotide
taatacgactcactatagggcgagcgcccagcggaatccccgcccaggtcaacagaggagagacctgatgggggattccaacctggcggcagcgcaaaagatg

SEQ ID NO: 135600 - DNA, 103 bp, Artificial Sequence
  Synthetic Polynucleotide
taatacgactcactatagggaaagtttcctttcattttgaggaccgcatgaacagaggagacatgcgatgctcaaaatgaacctggcggcagcgcaaaagatg

SEQ ID NO: 135601 - DNA, 103 bp, Artificial Sequence
  Synthetic Polynucleotide
taatacgactcactatagggctgggagggtaaagtttcctttcattttgaaacagaggagatcaaaaatgaaggaaactaacctggcggcagcgcaaaagatg

SEQ ID NO: 135602 - DNA, 103 bp, Artificial Sequence
  Synthetic Polynucleotide
taatacgactcactatagggtcagctacctctgggagggtaaagtttcctaacagaggagaaggaaaatgtaccctcccaacctggcggcagcgcaaaagatg

SEQ ID NO: 135603 - DNA, 103 bp, Artificial Sequence
  Synthetic Polynucleotide
taatacgactcactatagggatcaaagcactcagctacctctgggagggtaacagaggagaaccctcatggaggtagctaacctggcggcagcgcaaaagatg

SEQ ID NO: 135604 - DNA, 103 bp, Artificial Sequence
  Synthetic Polynucleotide
taatacgactcactatagggaggttatttcatcaaagcactcagctacctaacagaggagaaggtagatgagtgctttgaacctggcggcagcgcaaaagatg

SEQ ID NO: 135605 - DNA, 103 bp, Artificial Sequence
  Synthetic Polynucleotide
taatacgactcactatagggagttcaacataggttatttcatcaaagcacaacagaggagagtgcttatgtgaaataacaacctggcggcagcgcaaaagatg

SEQ ID NO: 135606 - DNA, 103 bp, Artificial Sequence
  Synthetic Polynucleotide
taatacgactcactatagggttccttctgaagttcaacataggttatttcaacagaggagagaaataatgtatgttgaaaacctggcggcagcgcaaaagatg

SEQ ID NO: 135607 - DNA, 103 bp, Artificial Sequence
  Synthetic Polynucleotide
taatacgactcactatagggtttgggcttcttccttctgaagttcaacataacagaggagaatgttgatgttcagaaggaacctggcggcagcgcaaaagatg

SEQ ID NO: 135608 - DNA, 103 bp, Artificial Sequence
  Synthetic Polynucleotide
taatacgactcactatagggtccaagagtttttgggcttcttccttctgaaacagaggagatcagaaatgagaagcccaaacctggcggcagcgcaaaagatg

SEQ ID NO: 135609 - DNA, 103 bp, Artificial Sequence
  Synthetic Polynucleotide
taatacgactcactatagggcttatattgctccaagagtttttgggcttcaacagaggagagaagccatgaaactcttgaacctggcggcagcgcaaaagatg

SEQ ID NO: 135610 - DNA, 103 bp, Artificial Sequence
  Synthetic Polynucleotide
taatacgactcactatagggacaccttcagcttttttacattaacaggcgaacagaggagacgcctgatgatgtaaaaaaacctggcggcagcgcaaaagatg

SEQ ID NO: 135611 - DNA, 103 bp, Artificial Sequence
  Synthetic Polynucleotide
taatacgactcactatagggggcctgctcccgagcgcccagcggaatcccaacagaggagagggattatgctgggcgctaacctggcggcagcgcaaaagatg

SEQ ID NO: 135612 - DNA, 103 bp, Artificial Sequence
  Synthetic Polynucleotide
taatacgactcactatagggtgctttcttccttatattgctccaagagttaacagaggagaaactctatgagcaatataaacctggcggcagcgcaaaagatg

SEQ ID NO: 135613 - DNA, 103 bp, Artificial Sequence
  Synthetic Polynucleotide
taatacgactcactatagggagagcctttttgctttcttccttatattgcaacagaggagagcaataatgggaagaaagaacctggcggcagcgcaaaagatg

SEQ ID NO: 135614 - DNA, 103 bp, Artificial Sequence
  Synthetic Polynucleotide
taatacgactcactatagggttctggtggaagagcctttttgctttcttcaacagaggagagaagaaatgaaaaaggctaacctggcggcagcgcaaaagatg

SEQ ID NO: 135615 - DNA, 103 bp, Artificial Sequence
  Synthetic Polynucleotide
taatacgactcactatagggtctgtttcttttctggtggaagagccttttaacagaggagaaaaaggatgttccaccagaacctggcggcagcgcaaaagatg

SEQ ID NO: 135616 - DNA, 103 bp, Artificial Sequence
  Synthetic Polynucleotide
taatacgactcactataggggagccagtgttctgtttcttttctggtggaaacagaggagatccaccatgaaagaaacaaacctggcggcagcgcaaaagatg

SEQ ID NO: 135617 - DNA, 103 bp, Artificial Sequence
  Synthetic Polynucleotide
taatacgactcactataggggcttttctttgagccagtgttctgtttcttaacagaggagaaagaaaatgaacactggcaacctggcggcagcgcaaaagatg

SEQ ID NO: 135618 - DNA, 103 bp, Artificial Sequence
  Synthetic Polynucleotide
taatacgactcactatagggtatttttattgcttttctttgagccagtgtaacagaggagaacactgatgcaaagaaaaaacctggcggcagcgcaaaagatg

SEQ ID NO: 135619 - DNA, 103 bp, Artificial Sequence
  Synthetic Polynucleotide
taatacgactcactatagggttgccactcttatttttattgcttttctttaacagaggagaaaagaaatgcaataaaaaaacctggcggcagcgcaaaagatg

SEQ ID NO: 135620 - DNA, 103 bp, Artificial Sequence
  Synthetic Polynucleotide
taatacgactcactatagggaaactggttcttgccactcttatttttattaacagaggagaaataaaatgaagagtggcaacctggcggcagcgcaaaagatg

SEQ ID NO: 135621 - DNA, 103 bp, Artificial Sequence
  Synthetic Polynucleotide
taatacgactcactatagggcacctctgttaaactggttcttgccactctaacagaggagaagagtgatgagaaccagtaacctggcggcagcgcaaaagatg

SEQ ID NO: 135622 - DNA, 103 bp, Artificial Sequence
  Synthetic Polynucleotide
taatacgactcactatagggtcctgctcgaggcctgctcccgagcgcccaaacagaggagatgggcgatggggagcaggaacctggcggcagcgcaaaagatg

SEQ ID NO: 135623 - DNA, 103 bp, Artificial Sequence
  Synthetic Polynucleotide
taatacgactcactatagggctatggccaccacctctgttaaactggttcaacagaggagagaaccaatgtaacagaggaacctggcggcagcgcaaaagatg

SEQ ID NO: 135624 - DNA, 103 bp, Artificial Sequence
  Synthetic Polynucleotide
taatacgactcactatagggtccacgtcctctatggccaccacctctgttaacagaggagaaacagaatgggtggccataacctggcggcagcgcaaaagatg

SEQ ID NO: 135625 - DNA, 103 bp, Artificial Sequence
  Synthetic Polynucleotide
taatacgactcactatagggtattgaatcctccacgtcctctatggccacaacagaggagagtggccatggaggacgtgaacctggcggcagcgcaaaagatg

SEQ ID NO: 135626 - DNA, 103 bp, Artificial Sequence
  Synthetic Polynucleotide
taatacgactcactatagggccaccacgcatattgaatcctccacgtcctaacagaggagaaggacgatgaggattcaaaacctggcggcagcgcaaaagatg

SEQ ID NO: 135627 - DNA, 103 bp, Artificial Sequence
  Synthetic Polynucleotide
taatacgactcactatagggtctgaaatttccaccacgcatattgaatccaacagaggagaggattcatgatgcgtggtaacctggcggcagcgcaaaagatg

SEQ ID NO: 135628 - DNA, 103 bp, Artificial Sequence
  Synthetic Polynucleotide
taatacgactcactataggggggctcctcctctgaaatttccaccacgcaaacagaggagatgcgtgatggaaatttcaaacctggcggcagcgcaaaagatg

SEQ ID NO: 135629 - DNA, 103 bp, Artificial Sequence
  Synthetic Polynucleotide
taatacgactcactatagggcgattcccaggggctcctcctctgaaatttaacagaggagaaaatttatgaggaggagcaacctggcggcagcgcaaaagatg

SEQ ID NO: 135630 - DNA, 103 bp, Artificial Sequence
  Synthetic Polynucleotide
taatacgactcactatagggatatccgccacgattcccaggggctcctccaacagaggagaggaggaatgcctgggaataacctggcggcagcgcaaaagatg

SEQ ID NO: 135631 - DNA, 103 bp, Artificial Sequence
  Synthetic Polynucleotide
taatacgactcactatagggccctcctattatatccgccacgattcccagaacagaggagactgggaatggtggcggataacctggcggcagcgcaaaagatg

SEQ ID NO: 135632 - DNA, 103 bp, Artificial Sequence
  Synthetic Polynucleotide
taatacgactcactatagggggcatgttgcccctcctattatatccgccaaacagaggagatggcggatgtaataggagaacctggcggcagcgcaaaagatg

SEQ ID NO: 135633 - DNA, 103 bp, Artificial Sequence
  Synthetic Polynucleotide
taatacgactcactatagggggccgcggcctcctgctcgaggcctgctccaacagaggagaggagcaatgctcgagcagaacctggcggcagcgcaaaagatg

SEQ ID NO: 135634 - DNA, 103 bp, Artificial Sequence
  Synthetic Polynucleotide
taatacgactcactatagggacctctctgtggcatgttgcccctcctattaacagaggagaaataggatgggcaacatgaacctggcggcagcgcaaaagatg

SEQ ID NO: 135635 - DNA, 103 bp, Artificial Sequence
  Synthetic Polynucleotide
taatacgactcactatagggcaccgccaccacctctctgtggcatgttgcaacagaggagagcaacaatgcacagagagaacctggcggcagcgcaaaagatg

SEQ ID NO: 135636 - DNA, 103 bp, Artificial Sequence
  Synthetic Polynucleotide
taatacgactcactatagggccacttcctccaccgccaccacctctctgtaacagaggagaacagagatgtggtggcggaacctggcggcagcgcaaaagatg

SEQ ID NO: 135637 - DNA, 103 bp, Artificial Sequence
  Synthetic Polynucleotide
taatacgactcactataggggccgattccaccacttcctccaccgccaccaacagaggagaggtggcatgggaggaagtaacctggcggcagcgcaaaagatg

SEQ ID NO: 135638 - DNA, 103 bp, Artificial Sequence
  Synthetic Polynucleotide
taatacgactcactatagggggtatggatagccgattccaccacttcctcaacagaggagagaggaaatggtggaatcgaacctggcggcagcgcaaaagatg

SEQ ID NO: 135639 - DNA, 103 bp, Artificial Sequence
  Synthetic Polynucleotide
taatacgactcactatagggggggcacgagggtatggatagccgattccaaacagaggagatggaatatgctatccataaacctggcggcagcgcaaaagatg

SEQ ID NO: 135640 - DNA, 103 bp, Artificial Sequence
  Synthetic Polynucleotide
taatacgactcactatagggaggaaaaacaggggcacgagggtatggataaacagaggagatatccaatgcctcgtgccaacctggcggcagcgcaaaagatg

SEQ ID NO: 135641 - DNA, 103 bp, Artificial Sequence
  Synthetic Polynucleotide
taatacgactcactatagggtaccacggccaggaaaaacaggggcacgagaacagaggagactcgtgatgctgtttttcaacctggcggcagcgcaaaagatg

SEQ ID NO: 135642 - DNA, 103 bp, Artificial Sequence
  Synthetic Polynucleotide
taatacgactcactatagggtttgagtaactaccacggccaggaaaaacaaacagaggagatgttttatgtggccgtggaacctggcggcagcgcaaaagatg

SEQ ID NO: 135643 - DNA, 103 bp, Artificial Sequence
  Synthetic Polynucleotide
taatacgactcactataggggttccctctgtttgagtaactaccacggccaacagaggagaggccgtatgagttactcaaacctggcggcagcgcaaaagatg

SEQ ID NO: 135644 - DNA, 103 bp, Artificial Sequence
  Synthetic Polynucleotide
taatacgactcactatagggcatcgccgccggccgcggcctcctgctcgaaacagaggagatcgagcatgaggccgcggaacctggcggcagcgcaaaagatg

SEQ ID NO: 135645 - DNA, 103 bp, Artificial Sequence
  Synthetic Polynucleotide
taatacgactcactatagggctctgttgtagttccctctgtttgagtaacaacagaggagagttactatgacagagggaaacctggcggcagcgcaaaagatg

SEQ ID NO: 135646 - DNA, 103 bp, Artificial Sequence
  Synthetic Polynucleotide
taatacgactcactatagggggcattccacctctgttgtagttccctctgaacagaggagacagaggatgctacaacagaacctggcggcagcgcaaaagatg

SEQ ID NO: 135647 - DNA, 103 bp, Artificial Sequence
  Synthetic Polynucleotide
taatacgactcactatagggccctctgttgggcattccacctctgttgtaaacagaggagatacaacatgggtggaatgaacctggcggcagcgcaaaagatg

SEQ ID NO: 135648 - DNA, 103 bp, Artificial Sequence
  Synthetic Polynucleotide
taatacgactcactatagggggttgtagttccctctgttgggcattccacaacagaggagagtggaaatgccaacagagaacctggcggcagcgcaaaagatg

SEQ ID NO: 135649 - DNA, 103 bp, Artificial Sequence
  Synthetic Polynucleotide
taatacgactcactatagggctgaagttctggttgtagttccctctgttgaacagaggagacaacagatggaactacaaaacctggcggcagcgcaaaagatg

SEQ ID NO: 135650 - DNA, 103 bp, Artificial Sequence
  Synthetic Polynucleotide
taatacgactcactatagggtcctcgtcctctgaagttctggttgtagttaacagaggagaaactacatgcagaacttcaacctggcggcagcgcaaaagatg

SEQ ID NO: 135651 - DNA, 103 bp, Artificial Sequence
  Synthetic Polynucleotide
taatacgactcactatagggcacgattgtttcctcgtcctctgaagttctaacagaggagaagaactatggaggacgagaacctggcggcagcgcaaaagatg

SEQ ID NO: 135652 - DNA, 103 bp, Artificial Sequence
  Synthetic Polynucleotide
taatacgactcactatagggtttttgtagccacgattgtttcctcgtcctaacagaggagaaggacgatgaaacaatcgaacctggcggcagcgcaaaagatg

SEQ ID NO: 135653 - DNA, 103 bp, Artificial Sequence
  Synthetic Polynucleotide
taatacgactcactatagggctgagattgatttttgtagccacgattgttaacagaggagaaacaatatgggctacaaaaacctggcggcagcgcaaaagatg

SEQ ID NO: 135654 - DNA, 103 bp, Artificial Sequence
  Synthetic Polynucleotide
taatacgactcactatagggggttgtagccctgagattgatttttgtagcaacagaggagagctacaatgatcaatctcaacctggcggcagcgcaaaagatg

SEQ ID NO: 135655 - DNA, 103 bp, Artificial Sequence
  Synthetic Polynucleotide
taatacgactcactatagggtcctcctcttcatcgccgccggccgcggccaacagaggagaggccgcatgcggcggcgaaacctggcggcagcgcaaaagatg

SEQ ID NO: 135656 - DNA, 103 bp, Artificial Sequence
  Synthetic Polynucleotide
taatacgactcactatagggtgctgccactggttgtagccctgagattgaaacagaggagatcaatcatggggctacaaaacctggcggcagcgcaaaagatg

SEQ ID NO: 135657 - DNA, 103 bp, Artificial Sequence
  Synthetic Polynucleotide
taatacgactcactataggggaattgaccctgctgccactggttgtagccaacagaggagaggctacatgcagtggcagaacctggcggcagcgcaaaagatg

SEQ ID NO: 135658 - DNA, 103 bp, Artificial Sequence
  Synthetic Polynucleotide
taatacgactcactatagggtctgaccccagaattgaccctgctgccactaacagaggagaagtggcatgagggtcaataacctggcggcagcgcaaaagatg

SEQ ID NO: 135659 - DNA, 103 bp, Artificial Sequence
  Synthetic Polynucleotide
taatacgactcactatagggctccatggcttctgaccccagaattgacccaacagaggagagggtcaatgctggggtcaaacctggcggcagcgcaaaagatg

SEQ ID NO: 135660 - DNA, 103 bp, Artificial Sequence
  Synthetic Polynucleotide
taatacgactcactatagggataatgctgactccatggcttctgaccccaaacagaggagatggggtatgaagccatggaacctggcggcagcgcaaaagatg

SEQ ID NO: 135661 - DNA, 103 bp, Artificial Sequence
  Synthetic Polynucleotide
taatacgactcactatagggatccttggtgataatgctgactccatggctaacagaggagaagccatatggtcagcattaacctggcggcagcgcaaaagatg

SEQ ID NO: 135662 - DNA, 103 bp, Artificial Sequence
  Synthetic Polynucleotide
taatacgactcactatagggttcctcttcctcctcctcttcatcgccgccaacagaggagaggcggcatggaagaggagaacctggcggcagcgcaaaagatg

SEQ ID NO: 135663 - DNA, 103 bp, Artificial Sequence
  Synthetic Polynucleotide
taatacgactcactatagggcctcctcctcttcctcttcctcctcctcttaacagaggagaaagaggatgaggaagaggaacctggcggcagcgcaaaagatg

SEQ ID NO: 135664 - DNA, 103 bp, Artificial Sequence
  Synthetic Polynucleotide
taatacgactcactataggggagattccttcctcctcctcttcctcttccaacagaggagaggaagaatgagaggaggaaacctggcggcagcgcaaaagatg

SEQ ID NO: 135665 - DNA, 103 bp, Artificial Sequence
  Synthetic Polynucleotide
taatacgactcactataggggtccagagcggagattccttcctcctcctcaacagaggagagaggagatggaaggaatcaacctggcggcagcgcaaaagatg

SEQ ID NO: 135666 - DNA, 103 bp, Artificial Sequence
  Synthetic Polynucleotide
taatacgactcactatagggtctggtcgccgtccagagcggagattccttaacagaggagaaaggaaatgccgctctggaacctggcggcagcgcaaaagatg

SEQ ID NO: 135667 - DNA, 103 bp, Artificial Sequence
  Synthetic Polynucleotide
taatacgactcactatagggttcagctccgacaccttcagcttttttacaaacagaggagatgtaaaatggctgaaggtaacctggcggcagcgcaaaagatg

SEQ ID NO: 135668 - DNA, 103 bp, Artificial Sequence
  Synthetic Polynucleotide
taatacgactcactatagggcctagctccatctggtcgccgtccagagcgaacagaggagacgctctatgcggcgaccaaacctggcggcagcgcaaaagatg

SEQ ID NO: 135669 - DNA, 103 bp, Artificial Sequence
  Synthetic Polynucleotide
taatacgactcactataggggttctcctctcctagctccatctggtcgccaacagaggagaggcgacatgatggagctaaacctggcggcagcgcaaaagatg

SEQ ID NO: 135670 - DNA, 103 bp, Artificial Sequence
  Synthetic Polynucleotide
taatacgactcactatagggccgcggccccgttctcctctcctagctccaaacagaggagatggagcatggagaggagaaacctggcggcagcgcaaaagatg

SEQ ID NO: 135671 - DNA, 103 bp, Artificial Sequence
  Synthetic Polynucleotide
taatacgactcactatagggtcggccgcccccgcggccccgttctcctctaacagaggagaagaggaatgcggggccgcaacctggcggcagcgcaaaagatg

SEQ ID NO: 135672 - DNA, 103 bp, Artificial Sequence
  Synthetic Polynucleotide
taatacgactcactatagggcgggcccgagtcggccgcccccgcggccccaacagaggagaggggccatgggggcggccaacctggcggcagcgcaaaagatg

SEQ ID NO: 135673 - DNA, 103 bp, Artificial Sequence
  Synthetic Polynucleotide
taatacgactcactatagggcctcctccatcgggcccgagtcggccgcccaacagaggagagggcggatgactcgggccaacctggcggcagcgcaaaagatg

SEQ ID NO: 135674 - DNA, 103 bp, Artificial Sequence
  Synthetic Polynucleotide
taatacgactcactataggggcggcctcctcctcctccatcgggcccgagaacagaggagactcgggatggatggaggaaacctggcggcagcgcaaaagatg

SEQ ID NO: 135675 - DNA, 103 bp, Artificial Sequence
  Synthetic Polynucleotide
taatacgactcactataggggtcttccgaggcggcctcctcctcctccataacagaggagaatggagatggaggaggccaacctggcggcagcgcaaaagatg

SEQ ID NO: 135676 - DNA, 103 bp, Artificial Sequence
  Synthetic Polynucleotide
taatacgactcactatagggcgccgttctcgtcttccgaggcggcctcctaacagaggagaaggaggatgcctcggaagaacctggcggcagcgcaaaagatg

SEQ ID NO: 135677 - DNA, 103 bp, Artificial Sequence
  Synthetic Polynucleotide
taatacgactcactatagggccctgatcgtcgccgttctcgtcttccgagaacagaggagactcggaatgcgagaacggaacctggcggcagcgcaaaagatg

SEQ ID NO: 135678 - DNA, 103 bp, Artificial Sequence
  Synthetic Polynucleotide
taatacgactcactataggggagctcctctttcagctccgacaccttcagaacagaggagactgaagatgtcggagctgaacctggcggcagcgcaaaagatg

SEQ ID NO: 135679 - DNA, 103 bp, Artificial Sequence
  Synthetic Polynucleotide
taatacgactcactatagggttcctggaaaccctgatcgtcgccgttctcaacagaggagagagaacatggacgatcagaacctggcggcagcgcaaaagatg

SEQ ID NO: 135680 - DNA, 103 bp, Artificial Sequence
  Synthetic Polynucleotide
taatacgactcactatagggcatcttccccttcctggaaaccctgatcgtaacagaggagaacgatcatggtttccaggaacctggcggcagcgcaaaagatg

SEQ ID NO: 135681 - DNA, 103 bp, Artificial Sequence
  Synthetic Polynucleotide
taatacgactcactatagggtccccgagctcatcttccccttcctggaaaaacagaggagatttccaatgaggggaagaaacctggcggcagcgcaaaagatg

SEQ ID NO: 135682 - DNA, 103 bp, Artificial Sequence
  Synthetic Polynucleotide
taatacgactcactatagggttcctcttcgtccccgagctcatcttccccaacagaggagaggggaaatggagctcgggaacctggcggcagcgcaaaagatg

SEQ ID NO: 135683 - DNA, 103 bp, Artificial Sequence
  Synthetic Polynucleotide
taatacgactcactatagggcgcccgcgccttcctcttcgtccccgagctaacagaggagaagctcgatgacgaagaggaacctggcggcagcgcaaaagatg

SEQ ID NO: 135684 - DNA, 103 bp, Artificial Sequence
  Synthetic Polynucleotide
taatacgactcactatagggccgttctcgtcgcccgcgccttcctcttcgaacagaggagacgaagaatgaggcgcgggaacctggcggcagcgcaaaagatg

SEQ ID NO: 135685 - DNA, 103 bp, Artificial Sequence
  Synthetic Polynucleotide
taatacgactcactatagggctccccgtgcccgttctcgtcgcccgcgccaacagaggagaggcgcgatggacgagaacaacctggcggcagcgcaaaagatg

SEQ ID NO: 135686 - DNA, 103 bp, Artificial Sequence
  Synthetic Polynucleotide
taatacgactcactataggggaggctgctgctccccgtgcccgttctcgtaacagaggagaacgagaatgggcacggggaacctggcggcagcgcaaaagatg

SEQ ID NO: 135687 - DNA, 103 bp, Artificial Sequence
  Synthetic Polynucleotide
taatacgactcactataggggccggcggttgaggctgctgctccccgtgcaacagaggagagcacggatggcagcagccaacctggcggcagcgcaaaagatg

SEQ ID NO: 135688 - DNA, 103 bp, Artificial Sequence
  Synthetic Polynucleotide
taatacgactcactatagggctgctgcgtcgccggcggttgaggctgctgaacagaggagacagcagatgcaaccgccgaacctggcggcagcgcaaaagatg

SEQ ID NO: 135689 - DNA, 103 bp, Artificial Sequence
  Synthetic Polynucleotide
taatacgactcactataggggtcgcttcttgagctcctctttcagctccgaacagaggagacggagcatgaagaggagcaacctggcggcagcgcaaaagatg

SEQ ID NO: 135690 - DNA, 103 bp, Artificial Sequence
  Synthetic Polynucleotide
taatacgactcactatagggggggctgttgctgctgcgtcgccggcggttaacagaggagaaaccgcatgcgacgcagcaacctggcggcagcgcaaaagatg

SEQ ID NO: 135691 - DNA, 103 bp, Artificial Sequence
  Synthetic Polynucleotide
taatacgactcactatagggcgctgctgttggggctgttgctgctgcgtcaacagaggagagacgcaatggcaacagccaacctggcggcagcgcaaaagatg

SEQ ID NO: 135692 - DNA, 103 bp, Artificial Sequence
  Synthetic Polynucleotide
taatacgactcactatagggggcggccccgcgctgctgttggggctgttgaacagaggagacaacagatgcaacagcagaacctggcggcagcgcaaaagatg

SEQ ID NO: 135693 - DNA, 103 bp, Artificial Sequence
  Synthetic Polynucleotide
taatacgactcactatagggcggcctccttggcggccccgcgctgctgttaacagaggagaaacagcatggcggggccgaacctggcggcagcgcaaaagatg

SEQ ID NO: 135694 - DNA, 103 bp, Artificial Sequence
  Synthetic Polynucleotide
taatacgactcactatagggctcttccccgcggcctccttggcggccccgaacagaggagacggggcatgcaaggaggcaacctggcggcagcgcaaaagatg

SEQ ID NO: 135695 - DNA, 103 bp, Artificial Sequence
  Synthetic Polynucleotide
taatacgactcactatagggggggccgctgctcttccccgcggcctccttaacagaggagaaaggagatggcggggaagaacctggcggcagcgcaaaagatg

SEQ ID NO: 135696 - DNA, 103 bp, Artificial Sequence
  Synthetic Polynucleotide
taatacgactcactatagggacagcgaggtggggccgctgctcttccccgaacagaggagacggggaatggcagcggccaacctggcggcagcgcaaaagatg

SEQ ID NO: 135697 - DNA, 103 bp, Artificial Sequence
  Synthetic Polynucleotide
taatacgactcactataggggtcaccgcgaacagcgaggtggggccgctgaacagaggagacagcggatgcacctcgctaacctggcggcagcgcaaaagatg

SEQ ID NO: 135698 - DNA, 103 bp, Artificial Sequence
  Synthetic Polynucleotide
taatacgactcactatagggcggcgccaccgtcaccgcgaacagcgaggtaacagaggagaacctcgatgttcgcggtgaacctggcggcagcgcaaaagatg

SEQ ID NO: 135699 - DNA, 103 bp, Artificial Sequence
  Synthetic Polynucleotide
taatacgactcactatagggtcgccccgggcggcgccaccgtcaccgcgaaacagaggagatcgcggatgcggtggcgcaacctggcggcagcgcaaaagatg

SEQ ID NO: 135700 - DNA, 103 bp, Artificial Sequence
  Synthetic Polynucleotide
taatacgactcactatagggtcagaaaggcgtcgcttcttgagctcctctaacagaggagaagaggaatgcaagaagcgaacctggcggcagcgcaaaagatg

SEQ ID NO: 135701 - DNA, 103 bp, Artificial Sequence
  Synthetic Polynucleotide
taatacgactcactatagggtggccctgcctcgccccgggcggcgccaccaacagaggagaggtggcatggcccggggcaacctggcggcagcgcaaaagatg

SEQ ID NO: 135702 - DNA, 103 bp, Artificial Sequence
  Synthetic Polynucleotide
taatacgactcactatagggcgcctgctgctggccctgcctcgccccgggaacagaggagacccgggatgaggcagggcaacctggcggcagcgcaaaagatg

SEQ ID NO: 135703 - DNA, 103 bp, Artificial Sequence
  Synthetic Polynucleotide
taatacgactcactatagggtcttacctcccgcctgctgctggccctgccaacagaggagaggcaggatgagcagcaggaacctggcggcagcgcaaaagatg

SEQ ID NO: 135704 - DNA, 103 bp, Artificial Sequence
  Synthetic Polynucleotide
taatacgactcactatagggtccgccttcttcttacctcccgcctgctgcaacagaggagagcagcaatggggaggtaaaacctggcggcagcgcaaaagatg

SEQ ID NO: 135705 - DNA, 103 bp, Artificial Sequence
  Synthetic Polynucleotide
taatacgactcactatagggtccgccgccttccgccttcttcttacctccaacagaggagaggaggtatgaagaaggcgaacctggcggcagcgcaaaagatg

SEQ ID NO: 135706 - DNA, 103 bp, Artificial Sequence
  Synthetic Polynucleotide
taatacgactcactataggggaccgccgcctccgccgccttccgccttctaacagaggagaagaaggatgaaggcggcgaacctggcggcagcgcaaaagatg

SEQ ID NO: 135707 - DNA, 103 bp, Artificial Sequence
  Synthetic Polynucleotide
taatacgactcactataggggccccggggcgaccgccgcctccgccgcctaacagaggagaaggcggatgaggcggcggaacctggcggcagcgcaaaagatg

SEQ ID NO: 135708 - DNA, 103 bp, Artificial Sequence
  Synthetic Polynucleotide
taatacgactcactatagggcgccgccggagccccggggcgaccgccgccaacagaggagaggcggcatgcgccccgggaacctggcggcagcgcaaaagatg

SEQ ID NO: 135709 - DNA, 103 bp, Artificial Sequence
  Synthetic Polynucleotide
taatacgactcactatagggtgccgtcccccgccgccggagccccggggcaacagaggagagccccgatgctccggcggaacctggcggcagcgcaaaagatg

SEQ ID NO: 135710 - DNA, 103 bp, Artificial Sequence
  Synthetic Polynucleotide
taatacgactcactatagggtgttctgttttgccgtcccccgccgccggaaacagaggagatccggcatggggggacggaacctggcggcagcgcaaaagatg

SEQ ID NO: 135711 - DNA, 103 bp, Artificial Sequence
  Synthetic Polynucleotide
taatacgactcactataggggagacccttgtcagaaaggcgtcgcttcttaacagaggagaaagaagatgcgcctttctaacctggcggcagcgcaaaagatg

SEQ ID NO: 135712 - DNA, 103 bp, Artificial Sequence
  Synthetic Polynucleotide
taatacgactcactatagggtccgcctttctgttctgttttgccgtccccaacagaggagaggggacatgaaaacagaaaacctggcggcagcgcaaaagatg

SEQ ID NO: 135713 - DNA, 103 bp, Artificial Sequence
  Synthetic Polynucleotide
taatacgactcactatagggtctttttatctccgcctttctgttctgtttaacagaggagaaaacagatgagaaaggcgaacctggcggcagcgcaaaagatg

SEQ ID NO: 135714 - DNA, 103 bp, Artificial Sequence
  Synthetic Polynucleotide
taatacgactcactatagggttaacacccctctttttatctccgcctttcaacagaggagagaaaggatgagataaaaaaacctggcggcagcgcaaaagatg

SEQ ID NO: 135715 - DNA, 103 bp, Artificial Sequence
  Synthetic Polynucleotide
taatacgactcactatagggtcgtggtcttttaacacccctctttttatcaacagaggagagataaaatgaggggtgttaacctggcggcagcgcaaaagatg

SEQ ID NO: 135716 - DNA, 103 bp, Artificial Sequence
  Synthetic Polynucleotide
taatacgactcactatagggcatgatcttctcgtggtcttttaacaccccaacagaggagaggggtgatgaaagaccacaacctggcggcagcgcaaaagatg

SEQ ID NO: 135717 - DNA, 103 bp, Artificial Sequence
  Synthetic Polynucleotide
taatacgactcactatagggtatccacggccatgatcttctcgtggtcttaacagaggagaaagaccatgagaagatcaaacctggcggcagcgcaaaagatg

SEQ ID NO: 135718 - DNA, 103 bp, Artificial Sequence
  Synthetic Polynucleotide
taatacgactcactataggggtactcaaaatatccacggccatgatcttcaacagaggagagaagatatgggccgtggaaacctggcggcagcgcaaaagatg

SEQ ID NO: 135719 - DNA, 103 bp, Artificial Sequence
  Synthetic Polynucleotide
taatacgactcactatagggtctcttcaatgtactcaaaatatccacggcaacagaggagagccgtgatgattttgagtaacctggcggcagcgcaaaagatg

SEQ ID NO: 135720 - DNA, 103 bp, Artificial Sequence
  Synthetic Polynucleotide
taatacgactcactatagggctatacttgttctcttcaatgtactcaaaaaacagaggagattttgaatgcattgaagaaacctggcggcagcgcaaaagatg

SEQ ID NO: 135721 - DNA, 103 bp, Artificial Sequence
  Synthetic Polynucleotide
taatacgactcactatagggtttggctctgctatacttgttctcttcaataacagaggagaattgaaatgaacaagtataacctggcggcagcgcaaaagatg

SEQ ID NO: 135722 - DNA, 103 bp, Artificial Sequence
  Synthetic Polynucleotide
taatacgactcactataggggctcggccttgagacccttgtcagaaaggcaacagaggagagcctttatgacaagggtcaacctggcggcagcgcaaaagatg

SEQ ID NO: 135723 - DNA, 103 bp, Artificial Sequence
  Synthetic Polynucleotide
taatacgactcactataggggctgaggagatttggctctgctatacttgtaacagaggagaacaagtatggcagagccaaacctggcggcagcgcaaaagatg

SEQ ID NO: 135724 - DNA, 103 bp, Artificial Sequence
  Synthetic Polynucleotide
taatacgactcactatagggtcaacaggtggctgaggagatttggctctgaacagaggagacagagcatgatctcctcaaacctggcggcagcgcaaaagatg

SEQ ID NO: 135725 - DNA, 103 bp, Artificial Sequence
  Synthetic Polynucleotide
taatacgactcactatagggatcttcttcttcaacaggtggctgaggagaaacagaggagatctcctatgccacctgttaacctggcggcagcgcaaaagatg

SEQ ID NO: 135726 - DNA, 103 bp, Artificial Sequence
  Synthetic Polynucleotide
taatacgactcactatagggcgaagtgttcatcttcttcttcaacaggtgaacagaggagacacctgatgaagaagaagaacctggcggcagcgcaaaagatg

SEQ ID NO: 135727 - DNA, 103 bp, Artificial Sequence
  Synthetic Polynucleotide
taatacgactcactatagggactgtgtcatcgaagtgttcatcttcttctaacagaggagaagaagaatgtgaacacttaacctggcggcagcgcaaaagatg

SEQ ID NO: 135728 - DNA, 103 bp, Artificial Sequence
  Synthetic Polynucleotide
taatacgactcactatagggaagacaaaccactgtgtcatcgaagtgttcaacagaggagagaacacatggatgacacaaacctggcggcagcgcaaaagatg

SEQ ID NO: 135729 - DNA, 103 bp, Artificial Sequence
  Synthetic Polynucleotide
taatacgactcactatagggtataagtatcaagacaaaccactgtgtcataacagaggagaatgacaatgtggtttgtcaacctggcggcagcgcaaaagatg

SEQ ID NO: 135730 - DNA, 103 bp, Artificial Sequence
  Synthetic Polynucleotide
taatacgactcactatagggagatcacaattataagtatcaagacaaaccaacagaggagaggtttgatgtgatacttaaacctggcggcagcgcaaaagatg

SEQ ID NO: 135731 - DNA, 103 bp, Artificial Sequence
  Synthetic Polynucleotide
taatacgactcactatagggtttaaaatgtagatcacaattataagtatcaacagaggagagatactatgaattgtgataacctggcggcagcgcaaaagatg

SEQ ID NO: 135732 - DNA, 103 bp, Artificial Sequence
  Synthetic Polynucleotide
taatacgactcactatagggctcttgatattttaaaatgtagatcacaataacagaggagaattgtgatgtacattttaaacctggcggcagcgcaaaagatg

SEQ ID NO: 135733 - DNA, 103 bp, Artificial Sequence
  Synthetic Polynucleotide
taatacgactcactatagggcgctccatgagctcggccttgagacccttgaacagaggagacaagggatgcaaggccgaaacctggcggcagcgcaaaagatg

SEQ ID NO: 135734 - DNA, 103 bp, Artificial Sequence
  Synthetic Polynucleotide
taatacgactcactatagggctgagacgatctcttgatattttaaaatgtaacagaggagaacatttatgaatatcaagaacctggcggcagcgcaaaagatg

SEQ ID NO: 135735 - DNA, 103 bp, Artificial Sequence
  Synthetic Polynucleotide
taatacgactcactatagggggaagaagcactgagacgatctcttgatataacagaggagaatatcaatggatcgtctcaacctggcggcagcgcaaaagatg

SEQ ID NO: 135736 - DNA, 103 bp, Artificial Sequence
  Synthetic Polynucleotide
taatacgactcactatagggccattgtaagggaagaagcactgagacgataacagaggagaatcgtcatggtgcttcttaacctggcggcagcgcaaaagatg

SEQ ID NO: 135737 - DNA, 103 bp, Artificial Sequence
  Synthetic Polynucleotide
taatacgactcactataggggcaaaactctccattgtaagggaagaagcaaacagaggagatgcttcatgccttacaataacctggcggcagcgcaaaagatg

SEQ ID NO: 135738 - DNA, 103 bp, Artificial Sequence
  Synthetic Polynucleotide
taatacgactcactatagggccaaagaaaagcaaaactctccattgtaagaacagaggagacttacaatggagagttttaacctggcggcagcgcaaaagatg

SEQ ID NO: 135739 - DNA, 103 bp, Artificial Sequence
  Synthetic Polynucleotide
taatacgactcactatagggttcctccagcccaaagaaaagcaaaactctaacagaggagaagagttatgcttttctttaacctggcggcagcgcaaaagatg

SEQ ID NO: 135740 - DNA, 103 bp, Artificial Sequence
  Synthetic Polynucleotide
taatacgactcactatagggtaggatgctcttcctccagcccaaagaaaaaacagaggagattttctatgggctggaggaacctggcggcagcgcaaaagatg

SEQ ID NO: 135741 - DNA, 103 bp, Artificial Sequence
  Synthetic Polynucleotide
taatacgactcactatagggtgacacaccataggatgctcttcctccagcaacagaggagagctggaatgagagcatccaacctggcggcagcgcaaaagatg

SEQ ID NO: 135742 - DNA, 103 bp, Artificial Sequence
  Synthetic Polynucleotide
taatacgactcactatagggctttgccttttgacacaccataggatgctcaacagaggagagagcatatgatggtgtgtaacctggcggcagcgcaaaagatg

SEQ ID NO: 135743 - DNA, 103 bp, Artificial Sequence
  Synthetic Polynucleotide
taatacgactcactatagggtcaaaacacactttgccttttgacacaccaaacagaggagatggtgtatgaaaaggcaaaacctggcggcagcgcaaaagatg

SEQ ID NO: 135744 - DNA, 103 bp, Artificial Sequence
  Synthetic Polynucleotide
taatacgactcactatagggagggagcagatagccctttctggctgacataacagaggagaatgtcaatgagaaagggcaacctggcggcagcgcaaaagatg

SEQ ID NO: 135745 - DNA, 103 bp, Artificial Sequence
  Synthetic Polynucleotide
taatacgactcactataggggcctctgcccgagctgatgagcgagtcgacaacagaggagagtcgacatgctcatcagcaacctggcggcagcgcaaaagatg

SEQ ID NO: 135746 - DNA, 103 bp, Artificial Sequence
  Synthetic Polynucleotide
taatacgactcactataggggcgcttcttccgaccactctttgccgtgagaacagaggagactcacgatgaagagtggtaacctggcggcagcgcaaaagatg

SEQ ID NO: 135747 - DNA, 103 bp, Artificial Sequence
  Synthetic Polynucleotide
taatacgactcactatagggtgtaggggcagcgcttcttccgaccactctaacagaggagaagagtgatgggaagaagcaacctggcggcagcgcaaaagatg

SEQ ID NO: 135748 - DNA, 103 bp, Artificial Sequence
  Synthetic Polynucleotide
taatacgactcactatagggtggtgcttcgtgtaggggcagcgcttcttcaacagaggagagaagaaatgctgcccctaaacctggcggcagcgcaaaagatg

SEQ ID NO: 135749 - DNA, 103 bp, Artificial Sequence
  Synthetic Polynucleotide
taatacgactcactatagggctccagtgtctggtgcttcgtgtaggggcaaacagaggagatgccccatgacgaagcacaacctggcggcagcgcaaaagatg

SEQ ID NO: 135750 - DNA, 103 bp, Artificial Sequence
  Synthetic Polynucleotide
taatacgactcactatagggccttctccagctccagtgtctggtgcttcgaacagaggagacgaagcatgagacactggaacctggcggcagcgcaaaagatg

SEQ ID NO: 135751 - DNA, 103 bp, Artificial Sequence
  Synthetic Polynucleotide
taatacgactcactatagggaacagaaactccttctccagctccagtgtcaacagaggagagacactatggctggagaaaacctggcggcagcgcaaaagatg

SEQ ID NO: 135752 - DNA, 103 bp, Artificial Sequence
  Synthetic Polynucleotide
taatacgactcactataggggtacatattgaacagaaactccttctccagaacagaggagactggagatggagtttctgaacctggcggcagcgcaaaagatg

SEQ ID NO: 135753 - DNA, 103 bp, Artificial Sequence
  Synthetic Polynucleotide
taatacgactcactatagggctcgagtaaggtacatattgaacagaaactaacagaggagaagtttcatgtcaatatgtaacctggcggcagcgcaaaagatg

SEQ ID NO: 135754 - DNA, 103 bp, Artificial Sequence
  Synthetic Polynucleotide
taatacgactcactatagggaggcgccgctctcgagtaaggtacatattgaacagaggagacaatatatgccttactcgaacctggcggcagcgcaaaagatg

SEQ ID NO: 135755 - DNA, 103 bp, Artificial Sequence
  Synthetic Polynucleotide
taatacgactcactataggggctaatctctaggcgccgctctcgagtaagaacagaggagacttactatggagcggcgcaacctggcggcagcgcaaaagatg

SEQ ID NO: 135756 - DNA, 103 bp, Artificial Sequence
  Synthetic Polynucleotide
taatacgactcactatagggcgcctgcctcgcctctgcccgagctgatgaaacagaggagatcatcaatgcgggcagagaacctggcggcagcgcaaaagatg

SEQ ID NO: 135757 - DNA, 103 bp, Artificial Sequence
  Synthetic Polynucleotide
taatacgactcactatagggggacgctgcggctaatctctaggcgccgctaacagaggagaagcggcatgtagagattaaacctggcggcagcgcaaaagatg

SEQ ID NO: 135758 - DNA, 103 bp, Artificial Sequence
  Synthetic Polynucleotide
taatacgactcactatagggtccgtgaggtggacgctgcggctaatctctaacagaggagaagagatatgccgcagcgtaacctggcggcagcgcaaaagatg

SEQ ID NO: 135759 - DNA, 103 bp, Artificial Sequence
  Synthetic Polynucleotide
taatacgactcactatagggcacttgtctgtccgtgaggtggacgctgcgaacagaggagacgcagcatgcacctcacgaacctggcggcagcgcaaaagatg

SEQ ID NO: 135760 - DNA, 103 bp, Artificial Sequence
  Synthetic Polynucleotide
taatacgactcactatagggaccagattttcacttgtctgtccgtgaggtaacagaggagaacctcaatgacagacaagaacctggcggcagcgcaaaagatg

SEQ ID NO: 135761 - DNA, 103 bp, Artificial Sequence
  Synthetic Polynucleotide
taatacgactcactatagggcggttctgaaaccagattttcacttgtctgaacagaggagacagacaatggaaaatctgaacctggcggcagcgcaaaagatg

SEQ ID NO: 135762 - DNA, 103 bp, Artificial Sequence
  Synthetic Polynucleotide
taatacgactcactatagggtttcatcctgcggttctgaaaccagattttaacagaggagaaaaatcatgtttcagaacaacctggcggcagcgcaaaagatg

SEQ ID NO: 135763 - DNA, 103 bp, Artificial Sequence
  Synthetic Polynucleotide
taatacgactcactatagggttttcttcagtttcatcctgcggttctgaaaacagaggagattcagaatggcaggatgaaacctggcggcagcgcaaaagatg

SEQ ID NO: 135764 - DNA, 103 bp, Artificial Sequence
  Synthetic Polynucleotide
taatacgactcactatagggtctcgattcattttcttcagtttcatcctgaacagaggagacaggatatgactgaagaaaacctggcggcagcgcaaaagatg

SEQ ID NO: 135765 - DNA, 103 bp, Artificial Sequence
  Synthetic Polynucleotide
taatacgactcactataggggatccggttttctcgattcattttcttcagaacagaggagactgaagatgatgaatcgaaacctggcggcagcgcaaaagatg

SEQ ID NO: 135766 - DNA, 103 bp, Artificial Sequence
  Synthetic Polynucleotide
taatacgactcactatagggtgagctcccggatccggttttctcgattcaaacagaggagatgaatcatgaaaaccggaaacctggcggcagcgcaaaagatg

SEQ ID NO: 135767 - DNA, 103 bp, Artificial Sequence
  Synthetic Polynucleotide
taatacgactcactatagggccaccaccgccgcctgcctcgcctctgcccaacagaggagagggcagatgcgaggcaggaacctggcggcagcgcaaaagatg

SEQ ID NO: 135768 - DNA, 103 bp, Artificial Sequence
  Synthetic Polynucleotide
taatacgactcactatagggaagttggctgtgagctcccggatccggtttaacagaggagaaaaccgatgccgggagctaacctggcggcagcgcaaaagatg

SEQ ID NO: 135769 - DNA, 103 bp, Artificial Sequence
  Synthetic Polynucleotide
taatacgactcactatagggggaaaaattaaagttggctgtgagctcccgaacagaggagacgggagatgacagccaacaacctggcggcagcgcaaaagatg

SEQ ID NO: 135770 - DNA, 103 bp, Artificial Sequence
  Synthetic Polynucleotide
taatacgactcactatagggccccgcgccaccaccaccgccgcctgcctcaacagaggagagaggcaatgggcggtggtaacctggcggcagcgcaaaagatg

SEQ ID NO: 135771 - DNA, 103 bp, Artificial Sequence
  Synthetic Polynucleotide
taatacgactcactatagggcgccgccgccccccgcgccaccaccaccgcaacagaggagagcggtgatggtggcgcggaacctggcggcagcgcaaaagatg

SEQ ID NO: 135772 - DNA, 103 bp, Artificial Sequence
  Synthetic Polynucleotide
taatacgactcactatagggtaaccgccaccgccgccgccccccgcgccaaacagaggagatggcgcatggggcggcggaacctggcggcagcgcaaaagatg

SEQ ID NO: 135773 - DNA, 103 bp, Artificial Sequence
  Synthetic Polynucleotide
taatacgactcactataggggtgggcgtagtaaccgccaccgccgccgccaacagaggagaggcggcatgggtggcggtaacctggcggcagcgcaaaagatg

SEQ ID NO: 135774 - DNA, 103 bp, Artificial Sequence
  Synthetic Polynucleotide
taatacgactcactatagggagaccccgccgtgggcgtagtaaccgccacaacagaggagagtggcgatgactacgcccaacctggcggcagcgcaaaagatg

SEQ ID NO: 135775 - DNA, 103 bp, Artificial Sequence
  Synthetic Polynucleotide
taatacgactcactatagggggcggcaggtagaccccgccgtgggcgtagaacagaggagactacgcatgcggcggggtaacctggcggcagcgcaaaagatg

SEQ ID NO: 135776 - DNA, 103 bp, Artificial Sequence
  Synthetic Polynucleotide
taatacgactcactataggggtcggcggcgggcggcaggtagaccccgccaacagaggagaggcgggatgtacctgccgaacctggcggcagcgcaaaagatg

SEQ ID NO: 135777 - DNA, 103 bp, Artificial Sequence
  Synthetic Polynucleotide
taatacgactcactatagggaatttggcgaagggagcagatagccctttcaacagaggagagaaaggatgatctgctccaacctggcggcagcgcaaaagatg

SEQ ID NO: 135778 - DNA, 103 bp, Artificial Sequence
  Synthetic Polynucleotide
taatacgactcactatagggcgtagggcaggtcggcggcgggcggcaggtaacagaggagaacctgcatgccgccgccgaacctggcggcagcgcaaaagatg

SEQ ID NO: 135779 - DNA, 103 bp, Artificial Sequence
  Synthetic Polynucleotide
taatacgactcactatagggctctgcagcccgtagggcaggtcggcggcgaacagaggagacgccgcatgcctgccctaaacctggcggcagcgcaaaagatg

SEQ ID NO: 135780 - DNA, 103 bp, Artificial Sequence
  Synthetic Polynucleotide
taatacgactcactataggggagcccgcagctctgcagcccgtagggcagaacagaggagactgcccatggggctgcagaacctggcggcagcgcaaaagatg

SEQ ID NO: 135781 - DNA, 103 bp, Artificial Sequence
  Synthetic Polynucleotide
taatacgactcactataggggcgtggggaagagcccgcagctctgcagccaacagaggagaggctgcatggctgcgggcaacctggcggcagcgcaaaagatg

SEQ ID NO: 135782 - DNA, 103 bp, Artificial Sequence
  Synthetic Polynucleotide
taatacgactcactatagggttgccgcccagcgtggggaagagcccgcagaacagaggagactgcggatgcttccccacaacctggcggcagcgcaaaagatg

SEQ ID NO: 135783 - DNA, 103 bp, Artificial Sequence
  Synthetic Polynucleotide
taatacgactcactatagggctcattgcgcttgccgcccagcgtggggaaaacagaggagattccccatgctgggcggcaacctggcggcagcgcaaaagatg

SEQ ID NO: 135784 - DNA, 103 bp, Artificial Sequence
  Synthetic Polynucleotide
taatacgactcactataggggcgacgctgcctcattgcgcttgccgcccaaacagaggagatgggcgatgagcgcaatgaacctggcggcagcgcaaaagatg

SEQ ID NO: 135785 - DNA, 103 bp, Artificial Sequence
  Synthetic Polynucleotide
taatacgactcactatagggccgctgcccggcgacgctgcctcattgcgcaacagaggagagcgcaaatgggcagcgtcaacctggcggcagcgcaaaagatg

SEQ ID NO: 135786 - DNA, 103 bp, Artificial Sequence
  Synthetic Polynucleotide
taatacgactcactataggggccaccgccaccgctgcccggcgacgctgcaacagaggagagcagcgatgccgggcagcaacctggcggcagcgcaaaagatg

SEQ ID NO: 135787 - DNA, 103 bp, Artificial Sequence
  Synthetic Polynucleotide
taatacgactcactatagggctagacccccgccaccgccaccgctgcccgaacagaggagacgggcaatggtggcggtgaacctggcggcagcgcaaaagatg

SEQ ID NO: 135788 - DNA, 103 bp, Artificial Sequence
  Synthetic Polynucleotide
taatacgactcactataggggttgtgggataatttggcgaagggagcagaaacagaggagatctgctatgttcgccaaaaacctggcggcagcgcaaaagatg

SEQ ID NO: 135789 - DNA, 103 bp, Artificial Sequence
  Synthetic Polynucleotide
taatacgactcactataggggccccgggacctagacccccgccaccgccaaacagaggagatggcggatgcgggggtctaacctggcggcagcgcaaaagatg

SEQ ID NO: 135790 - DNA, 103 bp, Artificial Sequence
  Synthetic Polynucleotide
taatacgactcactataggggtagccgtgcgccccgggacctagacccccaacagaggagagggggtatgggtcccgggaacctggcggcagcgcaaaagatg

SEQ ID NO: 135791 - DNA, 103 bp, Artificial Sequence
  Synthetic Polynucleotide
taatacgactcactataggggcgagggcccgtagccgtgcgccccgggacaacagaggagagtcccgatgcgcacggctaacctggcggcagcgcaaaagatg

SEQ ID NO: 135792 - DNA, 103 bp, Artificial Sequence
  Synthetic Polynucleotide
taatacgactcactatagggaggtctatgggcgagggcccgtagccgtgcaacagaggagagcacggatgcgggccctcaacctggcggcagcgcaaaagatg

SEQ ID NO: 135793 - DNA, 103 bp, Artificial Sequence
  Synthetic Polynucleotide
taatacgactcactataggggtctagccacaggtctatgggcgagggcccaacagaggagagggcccatgcccatagacaacctggcggcagcgcaaaagatg

SEQ ID NO: 135794 - DNA, 103 bp, Artificial Sequence
  Synthetic Polynucleotide
taatacgactcactatagggaccggggcgcgtctagccacaggtctatggaacagaggagaccatagatgtgtggctagaacctggcggcagcgcaaaagatg

SEQ ID NO: 135795 - DNA, 103 bp, Artificial Sequence
  Synthetic Polynucleotide
taatacgactcactatagggatccggcaagaccggggcgcgtctagccacaacagaggagagtggctatgcgcgccccgaacctggcggcagcgcaaaagatg

SEQ ID NO: 135796 - DNA, 103 bp, Artificial Sequence
  Synthetic Polynucleotide
taatacgactcactatagggaggcggctccatccggcaagaccggggcgcaacagaggagagcgcccatgtcttgccggaacctggcggcagcgcaaaagatg

SEQ ID NO: 135797 - DNA, 103 bp, Artificial Sequence
  Synthetic Polynucleotide
taatacgactcactataggggcggcccgtcaggcggctccatccggcaagaacagaggagacttgccatgtggagccgcaacctggcggcagcgcaaaagatg

SEQ ID NO: 135798 - DNA, 103 bp, Artificial Sequence
  Synthetic Polynucleotide
taatacgactcactatagggggcggcggcggcggcccgtcaggcggctccaacagaggagaggagccatgtgacgggccaacctggcggcagcgcaaaagatg

SEQ ID NO: 135799 - DNA, 103 bp, Artificial Sequence
  Synthetic Polynucleotide
taatacgactcactataggggcatgacattgttgtgggataatttggcgaaacagaggagatcgccaatgtatcccacaaacctggcggcagcgcaaaagatg

SEQ ID NO: 135800 - DNA, 103 bp, Artificial Sequence
  Synthetic Polynucleotide
taatacgactcactatagggctgctgctggggcggcggcggcggcccgtcaacagaggagagacgggatgccgccgccgaacctggcggcagcgcaaaagatg

SEQ ID NO: 135801 - DNA, 103 bp, Artificial Sequence
  Synthetic Polynucleotide
taatacgactcactatagggggggcggcggctgctgctggggcggcggcgaacagaggagacgccgcatgcccagcagcaacctggcggcagcgcaaaagatg

SEQ ID NO: 135802 - DNA, 103 bp, Artificial Sequence
  Synthetic Polynucleotide
taatacgactcactatagggggttgcggcgggggcggcggctgctgctggaacagaggagaccagcaatggccgccgccaacctggcggcagcgcaaaagatg

SEQ ID NO: 135803 - DNA, 103 bp, Artificial Sequence
  Synthetic Polynucleotide
taatacgactcactatagggtggctggggtggttgcggcgggggcggcggaacagaggagaccgccgatgccgccgcaaaacctggcggcagcgcaaaagatg

SEQ ID NO: 135804 - DNA, 103 bp, Artificial Sequence
  Synthetic Polynucleotide
taatacgactcactatagggcctgcggcgctggctggggtggttgcggcgaacagaggagacgccgcatgcaccccagcaacctggcggcagcgcaaaagatg

SEQ ID NO: 135805 - DNA, 103 bp, Artificial Sequence
  Synthetic Polynucleotide
taatacgactcactatagggcacgaggtggcctgcggcgctggctggggtaacagaggagaaccccaatgagcgccgcaaacctggcggcagcgcaaaagatg

SEQ ID NO: 135806 - DNA, 103 bp, Artificial Sequence
  Synthetic Polynucleotide
taatacgactcactatagggcgcgaaagagcacgaggtggcctgcggcgcaacagaggagagcgccgatggccacctcgaacctggcggcagcgcaaaagatg

SEQ ID NO: 135807 - DNA, 103 bp, Artificial Sequence
  Synthetic Polynucleotide
taatacgactcactatagggtgatgttctgcgcgaaagagcacgaggtggaacagaggagaccacctatggctctttcgaacctggcggcagcgcaaaagatg

SEQ ID NO: 135808 - DNA, 103 bp, Artificial Sequence
  Synthetic Polynucleotide
taatacgactcactatagggctctcttctttgatgttctgcgcgaaagagaacagaggagactctttatggcagaacataacctggcggcagcgcaaaagatg

SEQ ID NO: 135809 - DNA, 103 bp, Artificial Sequence
  Synthetic Polynucleotide
taatacgactcactataggggcagtaggagctctcttctttgatgttctgaacagaggagacagaacatgaaagaagagaacctggcggcagcgcaaaagatg

SEQ ID NO: 135810 - DNA, 103 bp, Artificial Sequence
  Synthetic Polynucleotide
taatacgactcactatagggggctctccgagcatgacattgttgtgggataacagaggagaatcccaatgcaatgtcataacctggcggcagcgcaaaagatg

SEQ ID NO: 135811 - DNA, 103 bp, Artificial Sequence
  Synthetic Polynucleotide
taatacgactcactatagggagtcgtagaggcagtaggagctctcttcttaacagaggagaaagaagatggctcctactaacctggcggcagcgcaaaagatg

SEQ ID NO: 135812 - DNA, 103 bp, Artificial Sequence
  Synthetic Polynucleotide
taatacgactcactatagggttgtccgccgagtcgtagaggcagtaggagaacagaggagactcctaatgcctctacgaaacctggcggcagcgcaaaagatg

SEQ ID NO: 135813 - DNA, 103 bp, Artificial Sequence
  Synthetic Polynucleotide
taatacgactcactatagggtttggggcatttgtccgccgagtcgtagagaacagaggagactctacatgtcggcggacaacctggcggcagcgcaaaagatg

SEQ ID NO: 135814 - DNA, 103 bp, Artificial Sequence
  Synthetic Polynucleotide
taatacgactcactatagggtggccgagactttggggcatttgtccgccgaacagaggagacggcggatgaatgccccaaacctggcggcagcgcaaaagatg

SEQ ID NO: 135815 - DNA, 103 bp, Artificial Sequence
  Synthetic Polynucleotide
taatacgactcactatagggtcggcggcggtggccgagactttggggcataacagaggagaatgcccatgagtctcggcaacctggcggcagcgcaaaagatg

SEQ ID NO: 135816 - DNA, 103 bp, Artificial Sequence
  Synthetic Polynucleotide
taatacgactcactataggggggagccagttcggcggcggtggccgagacaacagaggagagtctcgatgaccgccgccaacctggcggcagcgcaaaagatg

SEQ ID NO: 135817 - DNA, 103 bp, Artificial Sequence
  Synthetic Polynucleotide
taatacgactcactatagggcccgcgggaagggagccagttcggcggcggaacagaggagaccgccgatgaactggctcaacctggcggcagcgcaaaagatg

SEQ ID NO: 135818 - DNA, 103 bp, Artificial Sequence
  Synthetic Polynucleotide
taatacgactcactatagggggcggcgggccccgcgggaagggagccagtaacagaggagaactggcatgcttcccgcgaacctggcggcagcgcaaaagatg

SEQ ID NO: 135819 - DNA, 103 bp, Artificial Sequence
  Synthetic Polynucleotide
taatacgactcactataggggcagccgtcgggcggcgggccccgcgggaaaacagaggagattcccgatgggcccgccgaacctggcggcagcgcaaaagatg

SEQ ID NO: 135820 - DNA, 103 bp, Artificial Sequence
  Synthetic Polynucleotide
taatacgactcactatagggtgcccagggcgcagccgtcgggcggcgggcaacagaggagagcccgcatgccgacggctaacctggcggcagcgcaaaagatg

SEQ ID NO: 135821 - DNA, 103 bp, Artificial Sequence
  Synthetic Polynucleotide
taatacgactcactatagggttcgcggcggggctctccgagcatgacattaacagaggagaaatgtcatgctcggagagaacctggcggcagcgcaaaagatg

SEQ ID NO: 135822 - DNA, 103 bp, Artificial Sequence
  Synthetic Polynucleotide
taatacgactcactatagggccgctggaggtgcccagggcgcagccgtcgaacagaggagacgacggatgcgccctgggaacctggcggcagcgcaaaagatg

SEQ ID NO: 135823 - DNA, 103 bp, Artificial Sequence
  Synthetic Polynucleotide
taatacgactcactatagggcactggcaccccgctggaggtgcccagggcaacagaggagagccctgatgacctccagcaacctggcggcagcgcaaaagatg

SEQ ID NO: 135824 - DNA, 103 bp, Artificial Sequence
  Synthetic Polynucleotide
taatacgactcactatagggagtagccaggcactggcaccccgctggaggaacagaggagacctccaatggggtgccagaacctggcggcagcgcaaaagatg

SEQ ID NO: 135825 - DNA, 103 bp, Artificial Sequence
  Synthetic Polynucleotide
taatacgactcactataggggaaaggcggaagtagccaggcactggcaccaacagaggagaggtgccatggcctggctaaacctggcggcagcgcaaaagatg

SEQ ID NO: 135826 - DNA, 103 bp, Artificial Sequence
  Synthetic Polynucleotide
taatacgactcactataggggtaggcctgagaaaggcggaagtagccaggaacagaggagacctggcatgttccgccttaacctggcggcagcgcaaaagatg

SEQ ID NO: 135827 - DNA, 103 bp, Artificial Sequence
  Synthetic Polynucleotide
taatacgactcactatagggtggcggtgccgtaggcctgagaaaggcggaaacagaggagatccgccatgctcaggcctaacctggcggcagcgcaaaagatg

SEQ ID NO: 135828 - DNA, 103 bp, Artificial Sequence
  Synthetic Polynucleotide
taatacgactcactatagggccatagcccttggcggtgccgtaggcctgaaacagaggagatcaggcatgcggcaccgcaacctggcggcagcgcaaaagatg

SEQ ID NO: 135829 - DNA, 103 bp, Artificial Sequence
  Synthetic Polynucleotide
taatacgactcactataggggccgccgctgccatagcccttggcggtgccaacagaggagaggcaccatgaagggctataacctggcggcagcgcaaaagatg

SEQ ID NO: 135830 - DNA, 103 bp, Artificial Sequence
  Synthetic Polynucleotide
taatacgactcactataggggcgcgccgccgccgccgctgccatagccctaacagaggagaagggctatggcagcggcgaacctggcggcagcgcaaaagatg

SEQ ID NO: 135831 - DNA, 103 bp, Artificial Sequence
  Synthetic Polynucleotide
taatacgactcactatagggccgagttgctgcgcgccgccgccgccgctgaacagaggagacagcggatgcggcggcgcaacctggcggcagcgcaaaagatg

SEQ ID NO: 135832 - DNA, 103 bp, Artificial Sequence
  Synthetic Polynucleotide
taatacgactcactatagggcaaaaaagagttcgcggcggggctctccgaaacagaggagatcggagatgcccgccgcgaacctggcggcagcgcaaaagatg

SEQ ID NO: 135833 - DNA, 103 bp, Artificial Sequence
  Synthetic Polynucleotide
taatacgactcactatagggcgggccagccccgagttgctgcgcgccgccaacagaggagaggcggcatgcagcaactcaacctggcggcagcgcaaaagatg

SEQ ID NO: 135834 - DNA, 103 bp, Artificial Sequence
  Synthetic Polynucleotide
taatacgactcactataggggcgcggggaacgggccagccccgagttgctaacagaggagaagcaacatggggctggccaacctggcggcagcgcaaaagatg

SEQ ID NO: 135835 - DNA, 103 bp, Artificial Sequence
  Synthetic Polynucleotide
taatacgactcactatagggcccgggggctgcgcggggaacgggccagccaacagaggagaggctggatggttccccgcaacctggcggcagcgcaaaagatg

SEQ ID NO: 135836 - DNA, 103 bp, Artificial Sequence
  Synthetic Polynucleotide
taatacgactcactataggggaaaccgcgccccgggggctgcgcggggaaaacagaggagattccccatgcagcccccgaacctggcggcagcgcaaaagatg

SEQ ID NO: 135837 - DNA, 103 bp, Artificial Sequence
  Synthetic Polynucleotide
taatacgactcactataggggcgggagatcgaaaccgcgccccgggggctaacagaggagaagccccatgggcgcggttaacctggcggcagcgcaaaagatg

SEQ ID NO: 135838 - DNA, 103 bp, Artificial Sequence
  Synthetic Polynucleotide
taatacgactcactataggggctagcgcgggcgggagatcgaaaccgcgcaacagaggagagcgcggatgcgatctcccaacctggcggcagcgcaaaagatg

SEQ ID NO: 135839 - DNA, 103 bp, Artificial Sequence
  Synthetic Polynucleotide
taatacgactcactatagggcgagccggaggctagcgcgggcgggagatcaacagaggagagatctcatgcccgcgctaaacctggcggcagcgcaaaagatg

SEQ ID NO: 135840 - DNA, 103 bp, Artificial Sequence
  Synthetic Polynucleotide
taatacgactcactatagggccgcatcggccgagccggaggctagcgcggaacagaggagaccgcgcatgcctccggctaacctggcggcagcgcaaaagatg

SEQ ID NO: 135841 - DNA, 103 bp, Artificial Sequence
  Synthetic Polynucleotide
taatacgactcactatagggtccttccgggccgcatcggccgagccggagaacagaggagactccggatgggccgatgcaacctggcggcagcgcaaaagatg

SEQ ID NO: 135842 - DNA, 103 bp, Artificial Sequence
  Synthetic Polynucleotide
taatacgactcactataggggagggctcgctccttccgggccgcatcggcaacagaggagagccgatatggcccggaagaacctggcggcagcgcaaaagatg

SEQ ID NO: 135843 - DNA, 103 bp, Artificial Sequence
  Synthetic Polynucleotide
taatacgactcactataggggcgagtcgaccaaaaaagagttcgcggcggaacagaggagaccgccgatgactctttttaacctggcggcagcgcaaaagatg

SEQ ID NO: 135844 - DNA, 103 bp, Artificial Sequence
  Synthetic Polynucleotide
taatacgactcactataggggcggcgaatcgagggctcgctccttccgggaacagaggagacccggaatgagcgagcccaacctggcggcagcgcaaaagatg

SEQ ID NO: 135845 - DNA, 103 bp, Artificial Sequence
  Synthetic Polynucleotide
taatacgactcactataggggtggggggcggcggcgaatcgagggctcgcaacagaggagagcgagcatgcgattcgccaacctggcggcagcgcaaaagatg

SEQ ID NO: 135846 - DNA, 103 bp, Artificial Sequence
  Synthetic Polynucleotide
taatacgactcactataggggcaagccagcgtggggggcggcggcgaatcaacagaggagagattcgatgccgccccccaacctggcggcagcgcaaaagatg

SEQ ID NO: 135847 - DNA, 103 bp, Artificial Sequence
  Synthetic Polynucleotide
taatacgactcactatagggcgccgctgccgcaagccagcgtggggggcgaacagaggagacgccccatgcgctggcttaacctggcggcagcgcaaaagatg

SEQ ID NO: 135848 - DNA, 103 bp, Artificial Sequence
  Synthetic Polynucleotide
taatacgactcactatagggtgcgagcccccgccgctgccgcaagccagcaacagaggagagctggcatgcggcagcggaacctggcggcagcgcaaaagatg

SEQ ID NO: 135849 - DNA, 103 bp, Artificial Sequence
  Synthetic Polynucleotide
taatacgactcactatagggctcgtcgccctgcgagcccccgccgctgccaacagaggagaggcagcatggggggctcgaacctggcggcagcgcaaaagatg

SEQ ID NO: 135850 - DNA, 103 bp, Artificial Sequence
  Synthetic Polynucleotide
taatacgactcactatagggcgtgcgcctcctcgtcgccctgcgagccccaacagaggagaggggctatgagggcgacgaacctggcggcagcgcaaaagatg

SEQ ID NO: 135851 - DNA, 103 bp, Artificial Sequence
  Synthetic Polynucleotide
taatacgactcactataggggaggacgacgcgtgcgcctcctcgtcgcccaacagaggagagggcgaatgggaggcgcaaacctggcggcagcgcaaaagatg

SEQ ID NO: 135852 - DNA, 103 bp, Artificial Sequence
  Synthetic Polynucleotide
taatacgactcactatagggctccgcggccgaggacgacgcgtgcgcctcaacagaggagagaggcgatggcgtcgtccaacctggcggcagcgcaaaagatg

SEQ ID NO: 135853 - DNA, 103 bp, Artificial Sequence
  Synthetic Polynucleotide
taatacgactcactataggggggagagctcctccgcggccgaggacgacgaacagaggagacgtcgtatgcggccgcggaacctggcggcagcgcaaaagatg

SEQ ID NO: 135854 - DNA, 103 bp, Artificial Sequence
  Synthetic Polynucleotide
taatacgactcactataggggagctgatgagcgagtcgaccaaaaaagagaacagaggagactctttatgggtcgactcaacctggcggcagcgcaaaagatg

SEQ ID NO: 135855 - DNA, 103 bp, Artificial Sequence
  Synthetic Polynucleotide
taatacgactcactataggggaaggggccggggagagctcctccgcggccaacagaggagaggccgcatgggagctctcaacctggcggcagcgcaaaagatg

SEQ ID NO: 135856 - DNA, 103 bp, Artificial Sequence
  Synthetic Polynucleotide
taatacgactcactataggggctgctctcggaaggggccggggagagctcaacagaggagagagctcatgccggcccctaacctggcggcagcgcaaaagatg

SEQ ID NO: 135857 - DNA, 103 bp, Artificial Sequence
  Synthetic Polynucleotide
taatacgactcactataggggcgaggctttgctgctctcggaaggggccgaacagaggagacggcccatgccgagagcaaacctggcggcagcgcaaaagatg

SEQ ID NO: 135858 - DNA, 103 bp, Artificial Sequence
  Synthetic Polynucleotide
taatacgactcactatagggtccttctccggcgaggctttgctgctctcgaacagaggagacgagagatgcaaagcctcaacctggcggcagcgcaaaagatg

SEQ ID NO: 135859 - DNA, 103 bp, Artificial Sequence
  Synthetic Polynucleotide
taatacgactcactataggggcccagggaatccttctccggcgaggctttaacagaggagaaaagccatgccggagaagaacctggcggcagcgcaaaagatg

SEQ ID NO: 135860 - DNA, 103 bp, Artificial Sequence
  Synthetic Polynucleotide
taatacgactcactatagggctttggaattgcccagggaatccttctccgaacagaggagacggagaatgattccctggaacctggcggcagcgcaaaagatg

SEQ ID NO: 135861 - DNA, 103 bp, Artificial Sequence
  Synthetic Polynucleotide
taatacgactcactataggggcgttttcacctttggaattgcccagggaaaacagaggagattccctatgcaattccaaaacctggcggcagcgcaaaagatg

SEQ ID NO: 135862 - DNA, 103 bp, Artificial Sequence
  Synthetic Polynucleotide
taatacgactcactatagggccagttggctgcgttttcacctttggaattaacagaggagaaattccatgggtgaaaacaacctggcggcagcgcaaaagatg

SEQ ID NO: 135863 - DNA, 103 bp, Artificial Sequence
  Synthetic Polynucleotide
taatacgactcactatagggttgccgtgagccagttggctgcgttttcacaacagaggagagtgaaaatgcagccaactaacctggcggcagcgcaaaagatg

SEQ ID NO: 135864 - DNA, 103 bp, Artificial Sequence
  Synthetic Polynucleotide
taatacgactcactatagggcgaccactctttgccgtgagccagttggctaacagaggagaagccaaatggctcacggcaacctggcggcagcgcaaaagatg

SEQ ID NO: 135865 - DNA, 103 bp, Artificial Sequence
  Synthetic Polynucleotide
taatacgactcactatagggaccaatctctcgctcaaattcgtaattcataacagaggagaatgaatatggaatttgagaacctggcggcagcgcaaaagatg

SEQ ID NO: 135866 - DNA, 103 bp, Artificial Sequence
  Synthetic Polynucleotide
taatacgactcactatagggcgaggtcttgattgatgaactttgaaatgtaacagaggagaacatttatgagttcatcaaacctggcggcagcgcaaaagatg

SEQ ID NO: 135867 - DNA, 103 bp, Artificial Sequence
  Synthetic Polynucleotide
taatacgactcactatagggaactgcatctgaaagctgcaggcaggaatcaacagaggagagattccatgctgcagcttaacctggcggcagcgcaaaagatg

SEQ ID NO: 135868 - DNA, 103 bp, Artificial Sequence
  Synthetic Polynucleotide
taatacgactcactatagggaactgggtgaaactgcatctgaaagctgcaaacagaggagatgcagcatgcagatgcagaacctggcggcagcgcaaaagatg

SEQ ID NO: 135869 - DNA, 103 bp, Artificial Sequence
  Synthetic Polynucleotide
taatacgactcactataggggaacctggcaaactgggtgaaactgcatctaacagaggagaagatgcatgttcacccagaacctggcggcagcgcaaaagatg

SEQ ID NO: 135870 - DNA, 103 bp, Artificial Sequence
  Synthetic Polynucleotide
taatacgactcactatagggactgtcgagggaacctggcaaactgggtgaaacagaggagatcacccatgttgccaggtaacctggcggcagcgcaaaagatg

SEQ ID NO: 135871 - DNA, 103 bp, Artificial Sequence
  Synthetic Polynucleotide
taatacgactcactatagggtatctacgggactgtcgagggaacctggcaaacagaggagatgccagatgccctcgacaaacctggcggcagcgcaaaagatg

SEQ ID NO: 135872 - DNA, 103 bp, Artificial Sequence
  Synthetic Polynucleotide
taatacgactcactatagggtcagctgaaatatctacgggactgtcgaggaacagaggagacctcgaatgtcccgtagaaacctggcggcagcgcaaaagatg

SEQ ID NO: 135873 - DNA, 103 bp, Artificial Sequence
  Synthetic Polynucleotide
taatacgactcactataggggtctaagctgtcagctgaaatatctacgggaacagaggagacccgtaatgatttcagctaacctggcggcagcgcaaaagatg

SEQ ID NO: 135874 - DNA, 103 bp, Artificial Sequence
  Synthetic Polynucleotide
taatacgactcactatagggctgtaaaaaagtctaagctgtcagctgaaaaacagaggagatttcagatgacagcttagaacctggcggcagcgcaaaagatg

SEQ ID NO: 135875 - DNA, 103 bp, Artificial Sequence
  Synthetic Polynucleotide
taatacgactcactataggggtgagtgtgtctgtaaaaaagtctaagctgaacagaggagacagcttatgcttttttacaacctggcggcagcgcaaaagatg

SEQ ID NO: 135876 - DNA, 103 bp, Artificial Sequence
  Synthetic Polynucleotide
taatacgactcactataggggtcgattgtggtgagtgtgtctgtaaaaaaaacagaggagattttttatggacacactcaacctggcggcagcgcaaaagatg

SEQ ID NO: 135877 - DNA, 103 bp, Artificial Sequence
  Synthetic Polynucleotide
taatacgactcactataggggtgaaagcgtcgaggtcttgattgatgaacaacagaggagagttcatatgtcaagacctaacctggcggcagcgcaaaagatg

SEQ ID NO: 135878 - DNA, 103 bp, Artificial Sequence
  Synthetic Polynucleotide
taatacgactcactataggggatgctgcaagtcgattgtggtgagtgtgtaacagaggagaacacacatgccacaatcgaacctggcggcagcgcaaaagatg

SEQ ID NO: 135879 - DNA, 103 bp, Artificial Sequence
  Synthetic Polynucleotide
taatacgactcactatagggtagtaattcagatgctgcaagtcgattgtgaacagaggagacacaatatgcttgcagcaaacctggcggcagcgcaaaagatg

SEQ ID NO: 135880 - DNA, 103 bp, Artificial Sequence
  Synthetic Polynucleotide
taatacgactcactatagggagtgtcgagtgtgaaagcgtcgaggtcttgaacagaggagacaagacatggacgctttcaacctggcggcagcgcaaaagatg

SEQ ID NO: 135881 - DNA, 103 bp, Artificial Sequence
  Synthetic Polynucleotide
taatacgactcactatagggaggaggaatcagtgtcgagtgtgaaagcgtaacagaggagaacgcttatgcactcgacaaacctggcggcagcgcaaaagatg

SEQ ID NO: 135882 - DNA, 103 bp, Artificial Sequence
  Synthetic Polynucleotide
taatacgactcactataggggctcaaaaggaggaggaatcagtgtcgagtaacagaggagaactcgaatgtgattcctcaacctggcggcagcgcaaaagatg

SEQ ID NO: 135883 - DNA, 103 bp, Artificial Sequence
  Synthetic Polynucleotide
taatacgactcactatagggggaatggtctgctcaaaaggaggaggaatcaacagaggagagattccatgtccttttgaaacctggcggcagcgcaaaagatg

SEQ ID NO: 135884 - DNA, 103 bp, Artificial Sequence
  Synthetic Polynucleotide
taatacgactcactataggggttcaggctgggaatggtctgctcaaaaggaacagaggagaccttttatgcagaccattaacctggcggcagcgcaaaagatg

SEQ ID NO: 135885 - DNA, 103 bp, Artificial Sequence
  Synthetic Polynucleotide
taatacgactcactataggggactgccggggttcaggctgggaatggtctaacagaggagaagaccaatgccagcctgaaacctggcggcagcgcaaaagatg

SEQ ID NO: 135886 - DNA, 103 bp, Artificial Sequence
  Synthetic Polynucleotide
taatacgactcactatagggtggcgagggtgactgccggggttcaggctgaacagaggagacagcctatgccccggcagaacctggcggcagcgcaaaagatg

SEQ ID NO: 135887 - DNA, 103 bp, Artificial Sequence
  Synthetic Polynucleotide
taatacgactcactataggggccagcgccgtggcgagggtgactgccgggaacagaggagacccggcatgcaccctcgcaacctggcggcagcgcaaaagatg

SEQ ID NO: 135888 - DNA, 103 bp, Artificial Sequence
  Synthetic Polynucleotide
taatacgactcactatagggtattgataaaaccaatctctcgctcaaattaacagaggagaaatttgatggagagattgaacctggcggcagcgcaaaagatg

SEQ ID NO: 135889 - DNA, 103 bp, Artificial Sequence
  Synthetic Polynucleotide
taatacgactcactatagggtggggcggccgccagcgccgtggcgagggtaacagaggagaaccctcatgacggcgctgaacctggcggcagcgcaaaagatg

SEQ ID NO: 135890 - DNA, 103 bp, Artificial Sequence
  Synthetic Polynucleotide
taatacgactcactataggggggctcggcttggggcggccgccagcgccgaacagaggagacggcgcatgcggccgcccaacctggcggcagcgcaaaagatg

SEQ ID NO: 135891 - DNA, 103 bp, Artificial Sequence
  Synthetic Polynucleotide
taatacgactcactataggggctgcccgcggggctcggcttggggcggccaacagaggagaggccgcatgaagccgagcaacctggcggcagcgcaaaagatg

SEQ ID NO: 135892 - DNA, 103 bp, Artificial Sequence
  Synthetic Polynucleotide
taatacgactcactatagggggctgccgcggctgcccgcggggctcggctaacagaggagaagccgaatgccgcgggcaaacctggcggcagcgcaaaagatg

SEQ ID NO: 135893 - DNA, 103 bp, Artificial Sequence
  Synthetic Polynucleotide
taatacgactcactataggggcgggcaccgggctgccgcggctgcccgcgaacagaggagacgcgggatgccgcggcagaacctggcggcagcgcaaaagatg

SEQ ID NO: 135894 - DNA, 103 bp, Artificial Sequence
  Synthetic Polynucleotide
taatacgactcactatagggcagggcgccggcgggcaccgggctgccgcgaacagaggagacgcggcatgccggtgcccaacctggcggcagcgcaaaagatg

SEQ ID NO: 135895 - DNA, 103 bp, Artificial Sequence
  Synthetic Polynucleotide
taatacgactcactatagggcgggcggctgcagggcgccggcgggcaccgaacagaggagacggtgcatgccggcgcccaacctggcggcagcgcaaaagatg

SEQ ID NO: 135896 - DNA, 103 bp, Artificial Sequence
  Synthetic Polynucleotide
taatacgactcactatagggcaggggtactcgggcggctgcagggcgccgaacagaggagacggcgcatggcagccgccaacctggcggcagcgcaaaagatg

SEQ ID NO: 135897 - DNA, 103 bp, Artificial Sequence
  Synthetic Polynucleotide
taatacgactcactatagggctccttcatccaggggtactcgggcggctgaacagaggagacagccgatggagtaccccaacctggcggcagcgcaaaagatg

SEQ ID NO: 135898 - DNA, 103 bp, Artificial Sequence
  Synthetic Polynucleotide
taatacgactcactatagggccgccttcttctccttcatccaggggtactaacagaggagaagtaccatgggatgaaggaacctggcggcagcgcaaaagatg

SEQ ID NO: 135899 - DNA, 103 bp, Artificial Sequence
  Synthetic Polynucleotide
taatacgactcactataggggacggctggctattgataaaaccaatctctaacagaggagaagagatatgttttatcaaaacctggcggcagcgcaaaagatg

SEQ ID NO: 135900 - DNA, 103 bp, Artificial Sequence
  Synthetic Polynucleotide
taatacgactcactataggggttttcttggccgccttcttctccttcatcaacagaggagagatgaaatggaagaaggcaacctggcggcagcgcaaaagatg

SEQ ID NO: 135901 - DNA, 103 bp, Artificial Sequence
  Synthetic Polynucleotide
taatacgactcactatagggcagaagtgcggttttcttggccgccttcttaacagaggagaaagaagatggccaagaaaaacctggcggcagcgcaaaagatg

SEQ ID NO: 135902 - DNA, 103 bp, Artificial Sequence
  Synthetic Polynucleotide
taatacgactcactatagggcggcggccggcagaagtgcggttttcttggaacagaggagaccaagaatgccgcacttcaacctggcggcagcgcaaaagatg

SEQ ID NO: 135903 - DNA, 103 bp, Artificial Sequence
  Synthetic Polynucleotide
taatacgactcactataggggcggcggcggcggcggccggcagaagtgcgaacagaggagacgcactatggccggccgcaacctggcggcagcgcaaaagatg

SEQ ID NO: 135904 - DNA, 103 bp, Artificial Sequence
  Synthetic Polynucleotide
taatacgactcactatagggtgcggcggtggcggcggcggcggcggccggaacagaggagaccggccatggccgccgccaacctggcggcagcgcaaaagatg

SEQ ID NO: 135905 - DNA, 103 bp, Artificial Sequence
  Synthetic Polynucleotide
taatacgactcactatagggggccggtggctgcggcggtggcggcggcggaacagaggagaccgccgatgccaccgccgaacctggcggcagcgcaaaagatg

SEQ ID NO: 135906 - DNA, 103 bp, Artificial Sequence
  Synthetic Polynucleotide
taatacgactcactatagggaggcaagcagggccggtggctgcggcggtgaacagaggagacaccgcatgagccaccggaacctggcggcagcgcaaaagatg

SEQ ID NO: 135907 - DNA, 103 bp, Artificial Sequence
  Synthetic Polynucleotide
taatacgactcactatagggtttgtggctgaggcaagcagggccggtggcaacagaggagagccaccatgcctgcttgcaacctggcggcagcgcaaaagatg

SEQ ID NO: 135908 - DNA, 103 bp, Artificial Sequence
  Synthetic Polynucleotide
taatacgactcactatagggccagggattctttgtggctgaggcaagcagaacagaggagactgcttatgtcagccacaaacctggcggcagcgcaaaagatg

SEQ ID NO: 135909 - DNA, 103 bp, Artificial Sequence
  Synthetic Polynucleotide
taatacgactcactatagggtcggcgatttccagggattctttgtggctgaacagaggagacagccaatgagaatccctaacctggcggcagcgcaaaagatg

SEQ ID NO: 135910 - DNA, 103 bp, Artificial Sequence
  Synthetic Polynucleotide
taatacgactcactatagggctcagcgagcgacggctggctattgataaaaacagaggagatttatcatgagccagccgaacctggcggcagcgcaaaagatg

SEQ ID NO: 135911 - DNA, 103 bp, Artificial Sequence
  Synthetic Polynucleotide
taatacgactcactataggggccgctgccatcggcgatttccagggattcaacagaggagagaatccatggaaatcgccaacctggcggcagcgcaaaagatg

SEQ ID NO: 135912 - DNA, 103 bp, Artificial Sequence
  Synthetic Polynucleotide
taatacgactcactataggggcgatcccccgccgctgccatcggcgatttaacagaggagaaaatcgatgatggcagcgaacctggcggcagcgcaaaagatg

SEQ ID NO: 135913 - DNA, 103 bp, Artificial Sequence
  Synthetic Polynucleotide
taatacgactcactatagggctcaggcgccgcgatcccccgccgctgccaaacagaggagatggcagatgcgggggatcaacctggcggcagcgcaaaagatg

SEQ ID NO: 135914 - DNA, 103 bp, Artificial Sequence
  Synthetic Polynucleotide
taatacgactcactataggggtaagcagttctcaggcgccgcgatcccccaacagaggagagggggaatgcggcgcctgaacctggcggcagcgcaaaagatg

SEQ ID NO: 135915 - DNA, 103 bp, Artificial Sequence
  Synthetic Polynucleotide
taatacgactcactataggggtgtgttggtgtaagcagttctcaggcgccaacagaggagaggcgccatggaactgcttaacctggcggcagcgcaaaagatg

SEQ ID NO: 135916 - DNA, 103 bp, Artificial Sequence
  Synthetic Polynucleotide
taatacgactcactatagggtctagaagctgtgtgttggtgtaagcagttaacagaggagaaactgcatgcaccaacacaacctggcggcagcgcaaaagatg

SEQ ID NO: 135917 - DNA, 103 bp, Artificial Sequence
  Synthetic Polynucleotide
taatacgactcactatagggtttttccagctctagaagctgtgtgttggtaacagaggagaaccaacatgcagcttctaaacctggcggcagcgcaaaagatg

SEQ ID NO: 135918 - DNA, 103 bp, Artificial Sequence
  Synthetic Polynucleotide
taatacgactcactatagggaatgaaattctttttccagctctagaagctaacagaggagaagcttcatgagctggaaaaacctggcggcagcgcaaaagatg

SEQ ID NO: 135919 - DNA, 103 bp, Artificial Sequence
  Synthetic Polynucleotide
taatacgactcactatagggtacttgttgaaatgaaattctttttccagcaacagaggagagctggaatgagaatttcaaacctggcggcagcgcaaaagatg

SEQ ID NO: 135920 - DNA, 103 bp, Artificial Sequence
  Synthetic Polynucleotide
taatacgactcactatagggtctgcaaaggtacttgttgaaatgaaattcaacagaggagagaatttatgttcaacaagaacctggcggcagcgcaaaagatg

SEQ ID NO: 135921 - DNA, 103 bp, Artificial Sequence
  Synthetic Polynucleotide
taatacgactcactatagggatgtcaggcactcagcgagcgacggctggcaacagaggagagccagcatgcgctcgctgaacctggcggcagcgcaaaagatg

SEQ ID NO: 135922 - DNA, 103 bp, Artificial Sequence
  Synthetic Polynucleotide
taatacgactcactatagggcccttcggggtctgcaaaggtacttgttgaaacagaggagatcaacaatgacctttgcaaacctggcggcagcgcaaaagatg

SEQ ID NO: 135923 - DNA, 103 bp, Artificial Sequence
  Synthetic Polynucleotide
taatacgactcactataggggcaatctccacccttcggggtctgcaaaggaacagaggagacctttgatgaccccgaagaacctggcggcagcgcaaaagatg

SEQ ID NO: 135924 - DNA, 103 bp, Artificial Sequence
  Synthetic Polynucleotide
taatacgactcactatagggcagcagcgctgcaatctccacccttcggggaacagaggagaccccgaatggtggagattaacctggcggcagcgcaaaagatg

SEQ ID NO: 135925 - DNA, 103 bp, Artificial Sequence
  Synthetic Polynucleotide
taatacgactcactatagggcagtcaaatccagcagcgctgcaatctccaaacagaggagatggagaatgcagcgctgcaacctggcggcagcgcaaaagatg

SEQ ID NO: 135926 - DNA, 103 bp, Artificial Sequence
  Synthetic Polynucleotide
taatacgactcactatagggacttgtctctcagtcaaatccagcagcgctaacagaggagaagcgctatgggatttgacaacctggcggcagcgcaaaagatg

SEQ ID NO: 135927 - DNA, 103 bp, Artificial Sequence
  Synthetic Polynucleotide
taatacgactcactatagggccacactttcacttgtctctcagtcaaatcaacagaggagagatttgatggagagacaaaacctggcggcagcgcaaaagatg

SEQ ID NO: 135928 - DNA, 103 bp, Artificial Sequence
  Synthetic Polynucleotide
taatacgactcactatagggggttctgaaaccacactttcacttgtctctaacagaggagaagagacatgtgaaagtgtaacctggcggcagcgcaaaagatg

SEQ ID NO: 135929 - DNA, 103 bp, Artificial Sequence
  Synthetic Polynucleotide
taatacgactcactatagggttcatcctccggttctgaaaccacactttcaacagaggagagaaagtatggtttcagaaaacctggcggcagcgcaaaagatg

SEQ ID NO: 135930 - DNA, 103 bp, Artificial Sequence
  Synthetic Polynucleotide
taatacgactcactatagggcctcttgtgcttcatcctccggttctgaaaaacagaggagatttcagatgcggaggatgaacctggcggcagcgcaaaagatg

SEQ ID NO: 135931 - DNA, 103 bp, Artificial Sequence
  Synthetic Polynucleotide
taatacgactcactatagggactgggtctgcctcttgtgcttcatcctccaacagaggagaggaggaatgagcacaagaaacctggcggcagcgcaaaagatg

SEQ ID NO: 135932 - DNA, 103 bp, Artificial Sequence
  Synthetic Polynucleotide
taatacgactcactataggggggggaaaagatgtcaggcactcagcgagcaacagaggagagctcgcatggtgcctgacaacctggcggcagcgcaaaagatg

SEQ ID NO: 135933 - DNA, 103 bp, Artificial Sequence
  Synthetic Polynucleotide
taatacgactcactatagggttttccttgcactgggtctgcctcttgtgcaacagaggagagcacaaatggcagacccaaacctggcggcagcgcaaaagatg

SEQ ID NO: 135934 - DNA, 103 bp, Artificial Sequence
  Synthetic Polynucleotide
taatacgactcactataggggctgttttggttttccttgcactgggtctgaacagaggagacagaccatgtgcaaggaaaacctggcggcagcgcaaaagatg

SEQ ID NO: 135935 - DNA, 103 bp, Artificial Sequence
  Synthetic Polynucleotide
taatacgactcactatagggatttcccttcgctgttttggttttccttgcaacagaggagagcaaggatgaccaaaacaaacctggcggcagcgcaaaagatg

SEQ ID NO: 135936 - DNA, 103 bp, Artificial Sequence
  Synthetic Polynucleotide
taatacgactcactatagggaggcttttacatttcccttcgctgttttggaacagaggagaccaaaaatgcgaagggaaaacctggcggcagcgcaaaagatg

SEQ ID NO: 135937 - DNA, 103 bp, Artificial Sequence
  Synthetic Polynucleotide
taatacgactcactatagggggagtcctcaaggcttttacatttcccttcaacagaggagagaagggatgtgtaaaagcaacctggcggcagcgcaaaagatg

SEQ ID NO: 135938 - DNA, 103 bp, Artificial Sequence
  Synthetic Polynucleotide
taatacgactcactatagggctactttctcggagtcctcaaggcttttacaacagaggagagtaaaaatgttgaggactaacctggcggcagcgcaaaagatg

SEQ ID NO: 135939 - DNA, 103 bp, Artificial Sequence
  Synthetic Polynucleotide
taatacgactcactatagggtcgtcctcctctactttctcggagtcctcaaacagaggagatgaggaatgcgagaaagtaacctggcggcagcgcaaaagatg

SEQ ID NO: 135940 - DNA, 103 bp, Artificial Sequence
  Synthetic Polynucleotide
taatacgactcactatagggcttctcttcctcgtcctcctctactttctcaacagaggagagagaaaatggaggaggacaacctggcggcagcgcaaaagatg

SEQ ID NO: 135941 - DNA, 103 bp, Artificial Sequence
  Synthetic Polynucleotide
taatacgactcactatagggcaaagagcgtcttctcttcctcgtcctcctaacagaggagaaggaggatgaggaagagaaacctggcggcagcgcaaaagatg

SEQ ID NO: 135942 - DNA, 103 bp, Artificial Sequence
  Synthetic Polynucleotide
taatacgactcactatagggagggcttgctcaaagagcgtcttctcttccaacagaggagaggaagaatggacgctcttaacctggcggcagcgcaaaagatg

SEQ ID NO: 135943 - DNA, 103 bp, Artificial Sequence
  Synthetic Polynucleotide
taatacgactcactatagggatcagcgacagggggaaaagatgtcaggcaaacagaggagatgcctgatgtcttttcccaacctggcggcagcgcaaaagatg

SEQ ID NO: 135944 - DNA, 103 bp, Artificial Sequence
  Synthetic Polynucleotide
taatacgactcactatagggagagacgctaagggcttgctcaaagagcgtaacagaggagaacgctcatggagcaagccaacctggcggcagcgcaaaagatg

SEQ ID NO: 135945 - DNA, 103 bp, Artificial Sequence
  Synthetic Polynucleotide
taatacgactcactataggggaagggccccagagacgctaagggcttgctaacagaggagaagcaagatgttagcgtctaacctggcggcagcgcaaaagatg

SEQ ID NO: 135946 - DNA, 103 bp, Artificial Sequence
  Synthetic Polynucleotide
taatacgactcactatagggtccctctccagaagggccccagagacgctaaacagaggagatagcgtatgtggggccctaacctggcggcagcgcaaaagatg

SEQ ID NO: 135947 - DNA, 103 bp, Artificial Sequence
  Synthetic Polynucleotide
taatacgactcactatagggagtgtagccttccctctccagaagggccccaacagaggagaggggccatgctggagaggaacctggcggcagcgcaaaagatg

SEQ ID NO: 135948 - DNA, 103 bp, Artificial Sequence
  Synthetic Polynucleotide
taatacgactcactatagggtttgctgaaaagtgtagccttccctctccaaacagaggagatggagaatgaaggctacaaacctggcggcagcgcaaaagatg

SEQ ID NO: 135949 - DNA, 103 bp, Artificial Sequence
  Synthetic Polynucleotide
taatacgactcactataggggagagggcattttgctgaaaagtgtagcctaacagaggagaaggctaatgttttcagcaaacctggcggcagcgcaaaagatg

SEQ ID NO: 135950 - DNA, 103 bp, Artificial Sequence
  Synthetic Polynucleotide
taatacgactcactatagggctgctgctgagagagggcattttgctgaaaaacagaggagatttcagatgaatgccctcaacctggcggcagcgcaaaagatg

SEQ ID NO: 135951 - DNA, 103 bp, Artificial Sequence
  Synthetic Polynucleotide
taatacgactcactatagggcattgggagcctgctgctgagagagggcataacagaggagaatgcccatgctcagcagcaacctggcggcagcgcaaaagatg

SEQ ID NO: 135952 - DNA, 103 bp, Artificial Sequence
  Synthetic Polynucleotide
taatacgactcactatagggccattgtgtccattgggagcctgctgctgaaacagaggagatcagcaatgggctcccaaaacctggcggcagcgcaaaagatg

SEQ ID NO: 135953 - DNA, 103 bp, Artificial Sequence
  Synthetic Polynucleotide
taatacgactcactatagggttgggagtcgccattgtgtccattgggagcaacagaggagagctcccatgggacacaataacctggcggcagcgcaaaagatg

SEQ ID NO: 135954 - DNA, 103 bp, Artificial Sequence
  Synthetic Polynucleotide
taatacgactcactatagggtttgaaatgtatcagcgacagggggaaaagaacagaggagacttttcatgctgtcgctgaacctggcggcagcgcaaaagatg

SEQ ID NO: 135955 - DNA, 103 bp, Artificial Sequence
  Synthetic Polynucleotide
taatacgactcactatagggctgggaaactttgggagtcgccattgtgtcaacagaggagagacacaatggcgactcccaacctggcggcagcgcaaaagatg

SEQ ID NO: 135956 - DNA, 103 bp, Artificial Sequence
  Synthetic Polynucleotide
taatacgactcactatagggaaaggcgagactgggaaactttgggagtcgaacagaggagacgactcatgaagtttcccaacctggcggcagcgcaaaagatg

SEQ ID NO: 135957 - DNA, 103 bp, Artificial Sequence
  Synthetic Polynucleotide
taatacgactcactatagggattgctggttaaaggcgagactgggaaactaacagaggagaagtttcatggtctcgcctaacctggcggcagcgcaaaagatg

SEQ ID NO: 135958 - DNA, 103 bp, Artificial Sequence
  Synthetic Polynucleotide
taatacgactcactataggggatttttctcattgctggttaaaggcgagaaacagaggagatctcgcatgtaaccagcaaacctggcggcagcgcaaaagatg

SEQ ID NO: 135959 - DNA, 103 bp, Artificial Sequence
  Synthetic Polynucleotide
taatacgactcactatagggaaatgtttcagatttttctcattgctggttaacagaggagaaaccagatgtgagaaaaaaacctggcggcagcgcaaaagatg

SEQ ID NO: 135960 - DNA, 103 bp, Artificial Sequence
  Synthetic Polynucleotide
taatacgactcactatagggctggtgctgaaaatgtttcagatttttctcaacagaggagagagaaaatgctgaaacataacctggcggcagcgcaaaagatg

SEQ ID NO: 135961 - DNA, 103 bp, Artificial Sequence
  Synthetic Polynucleotide
taatacgactcactatagggcagtgggtgactggtgctgaaaatgtttcaaacagaggagatgaaacatgttcagcaccaacctggcggcagcgcaaaagatg

SEQ ID NO: 135962 - DNA, 103 bp, Artificial Sequence
  Synthetic Polynucleotide
taatacgactcactatagggcagttgggaacagtgggtgactggtgctgaaacagaggagatcagcaatggtcacccacaacctggcggcagcgcaaaagatg

SEQ ID NO: 135963 - DNA, 103 bp, Artificial Sequence
  Synthetic Polynucleotide
taatacgactcactatagggtgttgacaagcagttgggaacagtgggtgaaacagaggagatcacccatggttcccaacaacctggcggcagcgcaaaagatg

SEQ ID NO: 135964 - DNA, 103 bp, Artificial Sequence
  Synthetic Polynucleotide
taatacgactcactatagggtctggcccattgttgacaagcagttgggaaaacagaggagattcccaatggcttgtcaaaacctggcggcagcgcaaaagatg

SEQ ID NO: 135965 - DNA, 103 bp, Artificial Sequence
  Synthetic Polynucleotide
taatacgactcactatagggattgatgaactttgaaatgtatcagcgacaaacagaggagatgtcgcatgtacatttcaaacctggcggcagcgcaaaagatg

SEQ ID NO: 135966 - DNA, 103 bp, Artificial Sequence
  Synthetic Polynucleotide
taatacgactcactataggggctccacagttctggcccattgttgacaagaacagaggagacttgtcatgaatgggccaaacctggcggcagcgcaaaagatg

SEQ ID NO: 135967 - DNA, 103 bp, Artificial Sequence
  Synthetic Polynucleotide
taatacgactcactataggggtttaggccagctccacagttctggcccataacagaggagaatgggcatgaactgtggaaacctggcggcagcgcaaaagatg

SEQ ID NO: 135968 - DNA, 103 bp, Artificial Sequence
  Synthetic Polynucleotide
taatacgactcactataggggactgtcattgtttaggccagctccacagtaacagaggagaactgtgatgctggcctaaaacctggcggcagcgcaaaagatg

SEQ ID NO: 135969 - DNA, 103 bp, Artificial Sequence
  Synthetic Polynucleotide
taatacgactcactatagggagggcctcaggactgtcattgtttaggccaaacagaggagatggcctatgcaatgacagaacctggcggcagcgcaaaagatg

SEQ ID NO: 135970 - DNA, 103 bp, Artificial Sequence
  Synthetic Polynucleotide
taatacgactcactatagggggggacctcaagggcctcaggactgtcattaacagaggagaaatgacatgcctgaggccaacctggcggcagcgcaaaagatg

SEQ ID NO: 135971 - DNA, 103 bp, Artificial Sequence
  Synthetic Polynucleotide
taatacgactcactatagggcctgcaaagaggggacctcaagggcctcagaacagaggagactgaggatgttgaggtccaacctggcggcagcgcaaaagatg

SEQ ID NO: 135972 - DNA, 103 bp, Artificial Sequence
  Synthetic Polynucleotide
taatacgactcactatagggacgctaaagtcctgcaaagaggggacctcaaacagaggagatgaggtatgctctttgcaaacctggcggcagcgcaaaagatg

SEQ ID NO: 135973 - DNA, 103 bp, Artificial Sequence
  Synthetic Polynucleotide
taatacgactcactatagggtgtggagaaaacgctaaagtcctgcaaagaaacagaggagatctttgatggactttagcaacctggcggcagcgcaaaagatg

SEQ ID NO: 135974 - DNA, 103 bp, Artificial Sequence
  Synthetic Polynucleotide
taatacgactcactatagggggcaggaatctgtggagaaaacgctaaagtaacagaggagaactttaatgttttctccaaacctggcggcagcgcaaaagatg

SEQ ID NO: 135975 - DNA, 103 bp, Artificial Sequence
  Synthetic Polynucleotide
taatacgactcactataggggaaagctgcaggcaggaatctgtggagaaaaacagaggagatttctcatgagattcctgaacctggcggcagcgcaaaagatg

SEQ ID NO: 135976 - DNA, 103 bp, Artificial Sequence
  Synthetic Polynucleotide
taatacgactcactatagggcgagctgtcgtagtaggtcgctttttgcataacagaggagaatgcaaatggcgacctacaacctggcggcagcgcaaaagatg

SEQ ID NO: 135977 - DNA, 103 bp, Artificial Sequence
  Synthetic Polynucleotide
taatacgactcactataggggcccaaagcggcggacgccgggtacggctgaacagaggagacagccgatgccggcgtccaacctggcggcagcgcaaaagatg

SEQ ID NO: 135978 - DNA, 103 bp, Artificial Sequence
  Synthetic Polynucleotide
taatacgactcactataggggggggtgccccctgcgcccgcccctgccgcaacagaggagagcggcaatggcgggcgcaaacctggcggcagcgcaaaagatg

SEQ ID NO: 135979 - DNA, 103 bp, Artificial Sequence
  Synthetic Polynucleotide
taatacgactcactatagggggtcatagtcgggggtgccccctgcgcccgaacagaggagacgggcgatgggggcacccaacctggcggcagcgcaaaagatg

SEQ ID NO: 135980 - DNA, 103 bp, Artificial Sequence
  Synthetic Polynucleotide
taatacgactcactatagggtgagcgtgcgggtcatagtcgggggtgcccaacagaggagagggcacatgcgactatgaaacctggcggcagcgcaaaagatg

SEQ ID NO: 135981 - DNA, 103 bp, Artificial Sequence
  Synthetic Polynucleotide
taatacgactcactatagggctgcaggccatgagcgtgcgggtcatagtcaacagaggagagactatatgccgcacgctaacctggcggcagcgcaaaagatg

SEQ ID NO: 135982 - DNA, 103 bp, Artificial Sequence
  Synthetic Polynucleotide
taatacgactcactatagggtgccgttgccctgcaggccatgagcgtgcgaacagaggagacgcacgatgatggcctgcaacctggcggcagcgcaaaagatg

SEQ ID NO: 135983 - DNA, 103 bp, Artificial Sequence
  Synthetic Polynucleotide
taatacgactcactataggggtcccatagctgccgttgccctgcaggccaaacagaggagatggcctatggggcaacggaacctggcggcagcgcaaaagatg

SEQ ID NO: 135984 - DNA, 103 bp, Artificial Sequence
  Synthetic Polynucleotide
taatacgactcactatagggtatgtgtggggtcccatagctgccgttgccaacagaggagaggcaacatgagctatgggaacctggcggcagcgcaaaagatg

SEQ ID NO: 135985 - DNA, 103 bp, Artificial Sequence
  Synthetic Polynucleotide
taatacgactcactatagggggcttccctgtatgtgtggggtcccatagcaacagaggagagctatgatgccccacacaaacctggcggcagcgcaaaagatg

SEQ ID NO: 135986 - DNA, 103 bp, Artificial Sequence
  Synthetic Polynucleotide
taatacgactcactatagggacgaagacggggcttccctgtatgtgtgggaacagaggagacccacaatgacagggaagaacctggcggcagcgcaaaagatg

SEQ ID NO: 135987 - DNA, 103 bp, Artificial Sequence
  Synthetic Polynucleotide
taatacgactcactataggggctgccccccacgaagacggggcttccctgaacagaggagacagggaatgcccgtcttcaacctggcggcagcgcaaaagatg

SEQ ID NO: 135988 - DNA, 103 bp, Artificial Sequence
  Synthetic Polynucleotide
taatacgactcactatagggcgccgtcggcgcccaaagcggcggacgccgaacagaggagacggcgtatgccgctttggaacctggcggcagcgcaaaagatg

SEQ ID NO: 135989 - DNA, 103 bp, Artificial Sequence
  Synthetic Polynucleotide
taatacgactcactataggggctccacatagctgccccccacgaagacggaacagaggagaccgtctatgtggggggcaaacctggcggcagcgcaaaagatg

SEQ ID NO: 135990 - DNA, 103 bp, Artificial Sequence
  Synthetic Polynucleotide
taatacgactcactatagggttgctcatgggctccacatagctgccccccaacagaggagaggggggatgctatgtggaaacctggcggcagcgcaaaagatg

SEQ ID NO: 135991 - DNA, 103 bp, Artificial Sequence
  Synthetic Polynucleotide
taatacgactcactatagggtggcccggagttgctcatgggctccacataaacagaggagatatgtgatgcccatgagcaacctggcggcagcgcaaaagatg

SEQ ID NO: 135992 - DNA, 103 bp, Artificial Sequence
  Synthetic Polynucleotide
taatacgactcactatagggcaaagagggctggcccggagttgctcatggaacagaggagaccatgaatgactccgggcaacctggcggcagcgcaaaagatg

SEQ ID NO: 135993 - DNA, 103 bp, Artificial Sequence
  Synthetic Polynucleotide
taatacgactcactatagggtgagttagaccaaagagggctggcccggagaacagaggagactccggatgagccctcttaacctggcggcagcgcaaaagatg

SEQ ID NO: 135994 - DNA, 103 bp, Artificial Sequence
  Synthetic Polynucleotide
taatacgactcactataggggtgggggaggtgagttagaccaaagagggcaacagaggagagccctcatgggtctaactaacctggcggcagcgcaaaagatg

SEQ ID NO: 135995 - DNA, 103 bp, Artificial Sequence
  Synthetic Polynucleotide
taatacgactcactatagggccgaggcagcgtgggggaggtgagttagacaacagaggagagtctaaatgacctcccccaacctggcggcagcgcaaaagatg

SEQ ID NO: 135996 - DNA, 103 bp, Artificial Sequence
  Synthetic Polynucleotide
taatacgactcactatagggtccatggcgcccgaggcagcgtgggggaggaacagaggagacctcccatgcgctgcctcaacctggcggcagcgcaaaagatg

SEQ ID NO: 135997 - DNA, 103 bp, Artificial Sequence
  Synthetic Polynucleotide
taatacgactcactatagggacccccatagtccatggcgcccgaggcagcaacagaggagagctgccatgggcgccatgaacctggcggcagcgcaaaagatg

SEQ ID NO: 135998 - DNA, 103 bp, Artificial Sequence
  Synthetic Polynucleotide
taatacgactcactataggggcggcccggcacccccatagtccatggcgcaacagaggagagcgccaatgactatggggaacctggcggcagcgcaaaagatg

SEQ ID NO: 135999 - DNA, 103 bp, Artificial Sequence
  Synthetic Polynucleotide
taatacgactcactatagggcggtggtactcgccgtcggcgcccaaagcgaacagaggagacgctttatgcgccgacggaacctggcggcagcgcaaaagatg

SEQ ID NO: 136000 - DNA, 103 bp, Artificial Sequence
  Synthetic Polynucleotide
taatacgactcactatagggccgctgcccagcggcccggcacccccatagaacagaggagactatggatgtgccgggccaacctggcggcagcgcaaaagatg

SEQ ID NO: 136001 - DNA, 103 bp, Artificial Sequence
  Synthetic Polynucleotide
taatacgactcactataggggtggtggtggccgctgcccagcggcccggcaacagaggagagccgggatgctgggcagcaacctggcggcagcgcaaaagatg

SEQ ID NO: 136002 - DNA, 103 bp, Artificial Sequence
  Synthetic Polynucleotide
taatacgactcactataggggccccggcccgtggtggtggccgctgcccaaacagaggagatgggcaatggccaccaccaacctggcggcagcgcaaaagatg

SEQ ID NO: 136003 - DNA, 103 bp, Artificial Sequence
  Synthetic Polynucleotide
taatacgactcactatagggggctccccaggccccggcccgtggtggtggaacagaggagaccaccaatgcgggccgggaacctggcggcagcgcaaaagatg

SEQ ID NO: 136004 - DNA, 103 bp, Artificial Sequence
  Synthetic Polynucleotide
taatacgactcactatagggggtggggtgcggctccccaggccccggcccaacagaggagagggccgatgcctggggagaacctggcggcagcgcaaaagatg

SEQ ID NO: 136005 - DNA, 103 bp, Artificial Sequence
  Synthetic Polynucleotide
taatacgactcactatagggggtccgtgtaggtggggtgcggctccccagaacagaggagactggggatgcgcaccccaaacctggcggcagcgcaaaagatg

SEQ ID NO: 136006 - DNA, 103 bp, Artificial Sequence
  Synthetic Polynucleotide
taatacgactcactatagggtggccggtaaggtccgtgtaggtggggtgcaacagaggagagcacccatgctacacggaaacctggcggcagcgcaaaagatg

SEQ ID NO: 136007 - DNA, 103 bp, Artificial Sequence
  Synthetic Polynucleotide
taatacgactcactatagggagaaggatggtggccggtaaggtccgtgtaaacagaggagatacacgatgcttaccggcaacctggcggcagcgcaaaagatg

SEQ ID NO: 136008 - DNA, 103 bp, Artificial Sequence
  Synthetic Polynucleotide
taatacgactcactatagggttcttccctgagaaggatggtggccggtaaaacagaggagattaccgatgaccatccttaacctggcggcagcgcaaaagatg

SEQ ID NO: 136009 - DNA, 103 bp, Artificial Sequence
  Synthetic Polynucleotide
taatacgactcactataggggcttcctgaattcttccctgagaaggatggaacagaggagaccatccatgtcagggaagaacctggcggcagcgcaaaagatg

SEQ ID NO: 136010 - DNA, 103 bp, Artificial Sequence
  Synthetic Polynucleotide
taatacgactcactataggggcaggcgggtcggtggtactcgccgtcggcaacagaggagagccgacatggagtaccacaacctggcggcagcgcaaaagatg

SEQ ID NO: 136011 - DNA, 103 bp, Artificial Sequence
  Synthetic Polynucleotide
taatacgactcactataggggagcttgggtgcttcctgaattcttccctgaacagaggagacagggaatgattcaggaaaacctggcggcagcgcaaaagatg

SEQ ID NO: 136012 - DNA, 103 bp, Artificial Sequence
  Synthetic Polynucleotide
taatacgactcactatagggacaggtgggtgagcttgggtgcttcctgaaaacagaggagattcaggatgcacccaagcaacctggcggcagcgcaaaagatg

SEQ ID NO: 136013 - DNA, 103 bp, Artificial Sequence
  Synthetic Polynucleotide
taatacgactcactatagggactggagggagcaggcgggtcggtggtactaacagaggagaagtaccatggacccgcctaacctggcggcagcgcaaaagatg

SEQ ID NO: 136014 - DNA, 103 bp, Artificial Sequence
  Synthetic Polynucleotide
taatacgactcactatagggctggagggagactggagggagcaggcgggtaacagaggagaacccgcatgctccctccaaacctggcggcagcgcaaaagatg

SEQ ID NO: 136015 - DNA, 103 bp, Artificial Sequence
  Synthetic Polynucleotide
taatacgactcactataggggcccccggcgctggagggagactggagggaaacagaggagatccctcatgtctccctccaacctggcggcagcgcaaaagatg

SEQ ID NO: 136016 - DNA, 103 bp, Artificial Sequence
  Synthetic Polynucleotide
taatacgactcactatagggccttggggtggcccccggcgctggagggagaacagaggagactccctatggcgccggggaacctggcggcagcgcaaaagatg

SEQ ID NO: 136017 - DNA, 103 bp, Artificial Sequence
  Synthetic Polynucleotide
taatacgactcactatagggagttcgtgtgccttggggtggcccccggcgaacagaggagacgccggatgccaccccaaaacctggcggcagcgcaaaagatg

SEQ ID NO: 136018 - DNA, 103 bp, Artificial Sequence
  Synthetic Polynucleotide
taatacgactcactatagggcgcctcactcagttcgtgtgccttggggtgaacagaggagacaccccatggcacacgaaaacctggcggcagcgcaaaagatg

SEQ ID NO: 136019 - DNA, 103 bp, Artificial Sequence
  Synthetic Polynucleotide
taatacgactcactatagggcgtagatcgccgagctgtcgtagtaggtcgaacagaggagacgacctatgacgacagctaacctggcggcagcgcaaaagatg

SEQ ID NO: 136020 - DNA, 103 bp, Artificial Sequence
  Synthetic Polynucleotide
taatacgactcactatagggtgcgcaggcacgcctcactcagttcgtgtgaacagaggagacacacgatgtgagtgaggaacctggcggcagcgcaaaagatg

SEQ ID NO: 136021 - DNA, 103 bp, Artificial Sequence
  Synthetic Polynucleotide
taatacgactcactataggggcgctcagggtgcgcaggcacgcctcactcaacagaggagagagtgaatggtgcctgcgaacctggcggcagcgcaaaagatg

SEQ ID NO: 136022 - DNA, 103 bp, Artificial Sequence
  Synthetic Polynucleotide
taatacgactcactataggggctaggtggggcgctcagggtgcgcaggcaaacagaggagatgcctgatgaccctgagcaacctggcggcagcgcaaaagatg

SEQ ID NO: 136023 - DNA, 103 bp, Artificial Sequence
  Synthetic Polynucleotide
taatacgactcactatagggttggaggctggctaggtggggcgctcagggaacagaggagaccctgaatgccccacctaaacctggcggcagcgcaaaagatg

SEQ ID NO: 136024 - DNA, 103 bp, Artificial Sequence
  Synthetic Polynucleotide
taatacgactcactatagggtctcccaggcttggaggctggctaggtgggaacagaggagacccaccatgccagcctccaacctggcggcagcgcaaaagatg

SEQ ID NO: 136025 - DNA, 103 bp, Artificial Sequence
  Synthetic Polynucleotide
taatacgactcactatagggcaggggcggctctcccaggcttggaggctgaacagaggagacagcctatgagcctgggaaacctggcggcagcgcaaaagatg

SEQ ID NO: 136026 - DNA, 103 bp, Artificial Sequence
  Synthetic Polynucleotide
taatacgactcactataggggcggcgggtgcaggggcggctctcccaggcaacagaggagagcctggatgagccgccccaacctggcggcagcgcaaaagatg

SEQ ID NO: 136027 - DNA, 103 bp, Artificial Sequence
  Synthetic Polynucleotide
taatacgactcactataggggcctggggcggcggcgggtgcaggggcggcaacagaggagagccgccatggcacccgccaacctggcggcagcgcaaaagatg

SEQ ID NO: 136028 - DNA, 103 bp, Artificial Sequence
  Synthetic Polynucleotide
taatacgactcactatagggagggggcgcggcctggggcggcggcgggtgaacagaggagacacccgatgccgccccagaacctggcggcagcgcaaaagatg

SEQ ID NO: 136029 - DNA, 103 bp, Artificial Sequence
  Synthetic Polynucleotide
taatacgactcactataggggctgtggggcagggggcgcggcctggggcgaacagaggagacgccccatgccgcgccccaacctggcggcagcgcaaaagatg

SEQ ID NO: 136030 - DNA, 103 bp, Artificial Sequence
  Synthetic Polynucleotide
taatacgactcactataggggggtagccaccgtagatcgccgagctgtcgaacagaggagacgacagatgggcgatctaaacctggcggcagcgcaaaagatg

SEQ ID NO: 136031 - DNA, 103 bp, Artificial Sequence
  Synthetic Polynucleotide
taatacgactcactatagggggctgaggcggctgtggggcagggggcgcgaacagaggagacgcgccatgtgccccacaaacctggcggcagcgcaaaagatg

SEQ ID NO: 136032 - DNA, 103 bp, Artificial Sequence
  Synthetic Polynucleotide
taatacgactcactatagggctgaggtgcgggctgaggcggctgtggggcaacagaggagagccccaatgccgcctcagaacctggcggcagcgcaaaagatg

SEQ ID NO: 136033 - DNA, 103 bp, Artificial Sequence
  Synthetic Polynucleotide
taatacgactcactataggggtgcagggggctgaggtgcgggctgaggcgaacagaggagacgcctcatgccgcacctcaacctggcggcagcgcaaaagatg

SEQ ID NO: 136034 - DNA, 103 bp, Artificial Sequence
  Synthetic Polynucleotide
taatacgactcactataggggcaggggtaggtgcagggggctgaggtgcgaacagaggagacgcaccatggccccctgcaacctggcggcagcgcaaaagatg

SEQ ID NO: 136035 - DNA, 103 bp, Artificial Sequence
  Synthetic Polynucleotide
taatacgactcactatagggcgggggcgcggcaggggtaggtgcagggggaacagaggagaccccctatgcctacccctaacctggcggcagcgcaaaagatg

SEQ ID NO: 136036 - DNA, 103 bp, Artificial Sequence
  Synthetic Polynucleotide
taatacgactcactatagggaagagggaggcgggggcgcggcaggggtagaacagaggagactacccatgccgcgccccaacctggcggcagcgcaaaagatg

SEQ ID NO: 136037 - DNA, 103 bp, Artificial Sequence
  Synthetic Polynucleotide
taatacgactcactatagggggggaggcagaagagggaggcgggggcgcgaacagaggagacgcgccatggcctccctcaacctggcggcagcgcaaaagatg

SEQ ID NO: 136038 - DNA, 103 bp, Artificial Sequence
  Synthetic Polynucleotide
taatacgactcactatagggattctgaggaggggaggcagaagagggaggaacagaggagacctcccatgtctgcctccaacctggcggcagcgcaaaagatg

SEQ ID NO: 136039 - DNA, 103 bp, Artificial Sequence
  Synthetic Polynucleotide
taatacgactcactatagggtgttgctggcattctgaggaggggaggcagaacagaggagactgcctatgctcctcagaaacctggcggcagcgcaaaagatg

SEQ ID NO: 136040 - DNA, 103 bp, Artificial Sequence
  Synthetic Polynucleotide
taatacgactcactatagggggggtagggttgttgctggcattctgaggaaacagaggagatcctcaatgtgccagcaaaacctggcggcagcgcaaaagatg

SEQ ID NO: 136041 - DNA, 103 bp, Artificial Sequence
  Synthetic Polynucleotide
taatacgactcactatagggtgcctggtaggggtagccaccgtagatcgcaacagaggagagcgatcatgggtggctacaacctggcggcagcgcaaaagatg

SEQ ID NO: 136042 - DNA, 103 bp, Artificial Sequence
  Synthetic Polynucleotide
taatacgactcactatagggcgcgttggcaggggtagggttgttgctggcaacagaggagagccagcatgaaccctaccaacctggcggcagcgcaaaagatg

SEQ ID NO: 136043 - DNA, 103 bp, Artificial Sequence
  Synthetic Polynucleotide
taatacgactcactatagggggctcttggccgcgttggcaggggtagggtaacagaggagaaccctaatgctgccaacgaacctggcggcagcgcaaaagatg

SEQ ID NO: 136044 - DNA, 103 bp, Artificial Sequence
  Synthetic Polynucleotide
taatacgactcactatagggttgagcagggggctcttggccgcgttggcaaacagaggagatgccaaatgggccaagagaacctggcggcagcgcaaaagatg

SEQ ID NO: 136045 - DNA, 103 bp, Artificial Sequence
  Synthetic Polynucleotide
taatacgactcactatagggtgtgggtgagttgagcagggggctcttggcaacagaggagagccaagatgcccctgctcaacctggcggcagcgcaaaagatg

SEQ ID NO: 136046 - DNA, 103 bp, Artificial Sequence
  Synthetic Polynucleotide
taatacgactcactataggggtttggccactgtgggtgagttgagcagggaacagaggagaccctgcatgactcacccaaacctggcggcagcgcaaaagatg

SEQ ID NO: 136047 - DNA, 103 bp, Artificial Sequence
  Synthetic Polynucleotide
taatacgactcactataggggggaagatttgtttggccactgtgggtgagaacagaggagactcaccatgagtggccaaaacctggcggcagcgcaaaagatg

SEQ ID NO: 136048 - DNA, 103 bp, Artificial Sequence
  Synthetic Polynucleotide
taatacgactcactatagggtttcatccaggggaagatttgtttggccacaacagaggagagtggccatgcaaatcttcaacctggcggcagcgcaaaagatg

SEQ ID NO: 136049 - DNA, 103 bp, Artificial Sequence
  Synthetic Polynucleotide
taatacgactcactataggggtcgagactctttcatccaggggaagatttaacagaggagaaaatctatgcctggatgaaacctggcggcagcgcaaaagatg

SEQ ID NO: 136050 - DNA, 103 bp, Artificial Sequence
  Synthetic Polynucleotide
taatacgactcactatagggtttgtgttttgtcgagactctttcatccagaacagaggagactggatatgagagtctcgaacctggcggcagcgcaaaagatg

SEQ ID NO: 136051 - DNA, 103 bp, Artificial Sequence
  Synthetic Polynucleotide
taatacgactcactatagggggttttctgctttgtgttttgtcgagactcaacagaggagagagtctatgcaaaacacaaacctggcggcagcgcaaaagatg

SEQ ID NO: 136052 - DNA, 103 bp, Artificial Sequence
  Synthetic Polynucleotide
taatacgactcactatagggacccgttggctgcctggtaggggtagccacaacagaggagagtggctatgcctaccaggaacctggcggcagcgcaaaagatg

SEQ ID NO: 136053 - DNA, 103 bp, Artificial Sequence
  Synthetic Polynucleotide
taatacgactcactatagggtggagctgctggttttctgctttgtgttttaacagaggagaaaaacaatgagcagaaaaaacctggcggcagcgcaaaagatg

SEQ ID NO: 136054 - DNA, 103 bp, Artificial Sequence
  Synthetic Polynucleotide
taatacgactcactatagggtcgcctgagctggagctgctggttttctgcaacagaggagagcagaaatgcagcagctcaacctggcggcagcgcaaaagatg

SEQ ID NO: 136055 - DNA, 103 bp, Artificial Sequence
  Synthetic Polynucleotide
taatacgactcactatagggagcgcagctttcgcctgagctggagctgctaacagaggagaagcagcatgagctcaggcaacctggcggcagcgcaaaagatg

SEQ ID NO: 136056 - DNA, 103 bp, Artificial Sequence
  Synthetic Polynucleotide
taatacgactcactatagggtcttgtcgccagcgcagctttcgcctgagcaacagaggagagctcagatgaaagctgcgaacctggcggcagcgcaaaagatg

SEQ ID NO: 136057 - DNA, 103 bp, Artificial Sequence
  Synthetic Polynucleotide
taatacgactcactatagggcccggcgggctcttgtcgccagcgcagcttaacagaggagaaagctgatgtggcgacaaaacctggcggcagcgcaaaagatg

SEQ ID NO: 136058 - DNA, 103 bp, Artificial Sequence
  Synthetic Polynucleotide
taatacgactcactatagggcgaagcctgccccggcgggctcttgtcgccaacagaggagaggcgacatgagcccgccgaacctggcggcagcgcaaaagatg

SEQ ID NO: 136059 - DNA, 103 bp, Artificial Sequence
  Synthetic Polynucleotide
taatacgactcactatagggcgcgcttggacgaagcctgccccggcgggcaacagaggagagcccgcatgggcaggcttaacctggcggcagcgcaaaagatg

SEQ ID NO: 136060 - DNA, 103 bp, Artificial Sequence
  Synthetic Polynucleotide
taatacgactcactataggggccgtgcgcgcgcgcttggacgaagcctgcaacagaggagagcaggcatggtccaagcgaacctggcggcagcgcaaaagatg

SEQ ID NO: 136061 - DNA, 103 bp, Artificial Sequence
  Synthetic Polynucleotide
taatacgactcactataggggctcgtgtaggccgtgcgcgcgcgcttggaaacagaggagatccaagatggcgcgcacgaacctggcggcagcgcaaaagatg

SEQ ID NO: 136062 - DNA, 103 bp, Artificial Sequence
  Synthetic Polynucleotide
taatacgactcactatagggccagctgcgcgctcgtgtaggccgtgcgcgaacagaggagacgcgcaatgcctacacgaaacctggcggcagcgcaaaagatg

SEQ ID NO: 136063 - DNA, 103 bp, Artificial Sequence
  Synthetic Polynucleotide
taatacgactcactatagggttataagcgaacccgttggctgcctggtagaacagaggagactaccaatgagccaacggaacctggcggcagcgcaaaagatg

SEQ ID NO: 136064 - DNA, 103 bp, Artificial Sequence
  Synthetic Polynucleotide
taatacgactcactatagggtccagctccaccagctgcgcgctcgtgtagaacagaggagactacacatgcgcgcagctaacctggcggcagcgcaaaagatg

SEQ ID NO: 136065 - DNA, 103 bp, Artificial Sequence
  Synthetic Polynucleotide
taatacgactcactataggggaactctttctccagctccaccagctgcgcaacagaggagagcgcagatggtggagctgaacctggcggcagcgcaaaagatg

SEQ ID NO: 136066 - DNA, 103 bp, Artificial Sequence
  Synthetic Polynucleotide
taatacgactcactatagggggttgaagtggaactctttctccagctccaaacagaggagatggagcatgagaaagagtaacctggcggcagcgcaaaagatg

SEQ ID NO: 136067 - DNA, 103 bp, Artificial Sequence
  Synthetic Polynucleotide
taatacgactcactatagggcacaggtagcggttgaagtggaactctttcaacagaggagagaaagaatgccacttcaaaacctggcggcagcgcaaaagatg

SEQ ID NO: 136068 - DNA, 103 bp, Artificial Sequence
  Synthetic Polynucleotide
taatacgactcactataggggcgcggccggcacaggtagcggttgaagtgaacagaggagacacttcatgcgctacctgaacctggcggcagcgcaaaagatg

SEQ ID NO: 136069 - DNA, 103 bp, Artificial Sequence
  Synthetic Polynucleotide
taatacgactcactatagggtctccacccggcgcggccggcacaggtagcaacagaggagagctaccatggccggccgcaacctggcggcagcgcaaaagatg

SEQ ID NO: 136070 - DNA, 103 bp, Artificial Sequence
  Synthetic Polynucleotide
taatacgactcactatagggagattggccatctccacccggcgcggccggaacagaggagaccggccatgccgggtggaaacctggcggcagcgcaaaagatg

SEQ ID NO: 136071 - DNA, 103 bp, Artificial Sequence
  Synthetic Polynucleotide
taatacgactcactataggggaggttcagcagattggccatctccacccgaacagaggagacgggtgatgatggccaataacctggcggcagcgcaaaagatg

SEQ ID NO: 136072 - DNA, 103 bp, Artificial Sequence
  Synthetic Polynucleotide
taatacgactcactatagggggcgctcagtgaggttcagcagattggccaaacagaggagatggccaatgtgctgaaccaacctggcggcagcgcaaaagatg

SEQ ID NO: 136073 - DNA, 103 bp, Artificial Sequence
  Synthetic Polynucleotide
taatacgactcactatagggatcttgatctggcgctcagtgaggttcagcaacagaggagagctgaaatgcactgagcgaacctggcggcagcgcaaaagatg

SEQ ID NO: 136074 - DNA, 103 bp, Artificial Sequence
  Synthetic Polynucleotide
taatacgactcactatagggctgattggcattataagcgaacccgttggcaacagaggagagccaacatgttcgcttataacctggcggcagcgcaaaagatg

SEQ ID NO: 136075 - DNA, 103 bp, Artificial Sequence
  Synthetic Polynucleotide
taatacgactcactatagggctggaaccagatcttgatctggcgctcagtaacagaggagaactgagatgcagatcaagaacctggcggcagcgcaaaagatg

SEQ ID NO: 136076 - DNA, 103 bp, Artificial Sequence
  Synthetic Polynucleotide
taatacgactcactatagggtgcggcgattctggaaccagatcttgatctaacagaggagaagatcaatgtctggttccaacctggcggcagcgcaaaagatg

SEQ ID NO: 136077 - DNA, 103 bp, Artificial Sequence
  Synthetic Polynucleotide
taatacgactcactatagggttgtacttcatgcggcgattctggaaccagaacagaggagactggttatggaatcgccgaacctggcggcagcgcaaaagatg

SEQ ID NO: 136078 - DNA, 103 bp, Artificial Sequence
  Synthetic Polynucleotide
taatacgactcactatagggctgatcctttttgtacttcatgcggcgattaacagaggagaaatcgcatgatgaagtacaacctggcggcagcgcaaaagatg

SEQ ID NO: 136079 - DNA, 103 bp, Artificial Sequence
  Synthetic Polynucleotide
taatacgactcactatagggccttgcccttctgatcctttttgtacttcaaacagaggagatgaagtatgaaaaggatcaacctggcggcagcgcaaaagatg

SEQ ID NO: 136080 - DNA, 103 bp, Artificial Sequence
  Synthetic Polynucleotide
taatacgactcactataggggttagcatgcccttgcccttctgatcctttaacagaggagaaaaggaatggaagggcaaaacctggcggcagcgcaaaagatg

SEQ ID NO: 136081 - DNA, 103 bp, Artificial Sequence
  Synthetic Polynucleotide
taatacgactcactatagggccccgatgacgttagcatgcccttgcccttaacagaggagaaagggcatgggcatgctaaacctggcggcagcgcaaaagatg

SEQ ID NO: 136082 - DNA, 103 bp, Artificial Sequence
  Synthetic Polynucleotide
taatacgactcactataggggagactggccccccgatgacgttagcatgcaacagaggagagcatgcatgcgtcatcggaacctggcggcagcgcaaaagatg

SEQ ID NO: 136083 - DNA, 103 bp, Artificial Sequence
  Synthetic Polynucleotide
taatacgactcactatagggctgcgacttggagactggccccccgatgacaacagaggagagtcatcatggggccagtcaacctggcggcagcgcaaaagatg

SEQ ID NO: 136084 - DNA, 103 bp, Artificial Sequence
  Synthetic Polynucleotide
taatacgactcactataggggggcacggggctgcgacttggagactggccaacagaggagaggccagatgccaagtcgcaacctggcggcagcgcaaaagatg

SEQ ID NO: 136085 - DNA, 103 bp, Artificial Sequence
  Synthetic Polynucleotide
taatacgactcactatagggggtacggctgctgattggcattataagcgaaacagaggagatcgcttatgatgccaatcaacctggcggcagcgcaaaagatg

SEQ ID NO: 136086 - DNA, 103 bp, Artificial Sequence
  Synthetic Polynucleotide
taatacgactcactatagggcggctccggggggcacggggctgcgacttgaacagaggagacaagtcatggccccgtgcaacctggcggcagcgcaaaagatg

SEQ ID NO: 136087 - DNA, 103 bp, Artificial Sequence
  Synthetic Polynucleotide
taatacgactcactatagggagatagccaccggctccggggggcacggggaacagaggagaccccgtatgccccggagcaacctggcggcagcgcaaaagatg

SEQ ID NO: 136088 - DNA, 103 bp, Artificial Sequence
  Synthetic Polynucleotide
taatacgactcactatagggcatagagttcagatagccaccggctccgggaacagaggagacccggaatgggtggctataacctggcggcagcgcaaaagatg

SEQ ID NO: 136089 - DNA, 103 bp, Artificial Sequence
  Synthetic Polynucleotide
taatacgactcactatagggccagcgaatgcatagagttcagatagccacaacagaggagagtggctatgtgaactctaaacctggcggcagcgcaaaagatg

SEQ ID NO: 136090 - DNA, 103 bp, Artificial Sequence
  Synthetic Polynucleotide
taatacgactcactatagggacgctgttgaccagcgaatgcatagagttcaacagaggagagaactcatggcattcgctaacctggcggcagcgcaaaagatg

SEQ ID NO: 136091 - DNA, 103 bp, Artificial Sequence
  Synthetic Polynucleotide
taatacgactcactatagggctcatacgggacgctgttgaccagcgaatgaacagaggagacattcgatggtcaacagcaacctggcggcagcgcaaaagatg

SEQ ID NO: 136092 - DNA, 103 bp, Artificial Sequence
  Synthetic Polynucleotide
taatacgactcactataggggcgactggggctcatacgggacgctgttgaaacagaggagatcaacaatgtcccgtatgaacctggcggcagcgcaaaagatg

SEQ ID NO: 136093 - DNA, 103 bp, Artificial Sequence
  Synthetic Polynucleotide
taatacgactcactatagggaagggcgggggcgactggggctcatacgggaacagaggagacccgtaatggccccagtcaacctggcggcagcgcaaaagatg

SEQ ID NO: 136094 - DNA, 103 bp, Artificial Sequence
  Synthetic Polynucleotide
taatacgactcactataggggggcttggagaagggcgggggcgactggggaacagaggagaccccagatgcccccgcccaacctggcggcagcgcaaaagatg

SEQ ID NO: 136095 - DNA, 103 bp, Artificial Sequence
  Synthetic Polynucleotide
taatacgactcactatagggtaccctgggggggcttggagaagggcggggaacagaggagaccccgcatgtctccaagcaacctggcggcagcgcaaaagatg

SEQ ID NO: 136096 - DNA, 103 bp, Artificial Sequence
  Synthetic Polynucleotide
taatacgactcactataggggcggacgccgggtacggctgctgattggcaaacagaggagatgccaaatggcagccgtaaacctggcggcagcgcaaaagatg

SEQ ID NO: 136097 - DNA, 103 bp, Artificial Sequence
  Synthetic Polynucleotide
taatacgactcactatagggagcccgtaggtaccctgggggggcttggagaacagaggagactccaaatgcccccagggaacctggcggcagcgcaaaagatg

SEQ ID NO: 136098 - DNA, 103 bp, Artificial Sequence
  Synthetic Polynucleotide
taatacgactcactatagggggcggggggcagcccgtaggtaccctggggaacagaggagaccccagatgacctacgggaacctggcggcagcgcaaaagatg

SEQ ID NO: 136099 - DNA, 103 bp, Artificial Sequence
  Synthetic Polynucleotide
taatacgactcactatagggcagggtaggaggcggggggcagcccgtaggaacagaggagacctacgatgtgccccccgaacctggcggcagcgcaaaagatg

SEQ ID NO: 136100 - DNA, 103 bp, Artificial Sequence
  Synthetic Polynucleotide
taatacgactcactatagggggcagggacgcagggtaggaggcggggggcaacagaggagagcccccatgctcctacccaacctggcggcagcgcaaaagatg

SEQ ID NO: 136101 - DNA, 103 bp, Artificial Sequence
  Synthetic Polynucleotide
taatacgactcactatagggtgcgcagctgggcagggacgcagggtaggaaacagaggagatcctacatggcgtccctgaacctggcggcagcgcaaaagatg

SEQ ID NO: 136102 - DNA, 103 bp, Artificial Sequence
  Synthetic Polynucleotide
taatacgactcactataggggtggcgggggtgcgcagctgggcagggacgaacagaggagacgtcccatgccagctgcgaacctggcggcagcgcaaaagatg

SEQ ID NO: 136103 - DNA, 103 bp, Artificial Sequence
  Synthetic Polynucleotide
taatacgactcactatagggttctgtgggggtggcgggggtgcgcagctgaacagaggagacagctgatgacccccgccaacctggcggcagcgcaaaagatg

SEQ ID NO: 136104 - DNA, 103 bp, Artificial Sequence
  Synthetic Polynucleotide
taatacgactcactatagggcgtgtagcgcttctgtgggggtggcgggggaacagaggagacccccgatgcccccacagaacctggcggcagcgcaaaagatg

SEQ ID NO: 136105 - DNA, 103 bp, Artificial Sequence
  Synthetic Polynucleotide
taatacgactcactatagggcccctgccgccgtgtagcgcttctgtggggaacagaggagaccccacatgagcgctacaaacctggcggcagcgcaaaagatg

SEQ ID NO: 136106 - DNA, 103 bp, Artificial Sequence
  Synthetic Polynucleotide
taatacgactcactatagggcctgcgcccgcccctgccgccgtgtagcgcaacagaggagagcgctaatgggcggcaggaacctggcggcagcgcaaaagatg

SEQ ID NO: 136107 - DNA, 103 bp, Artificial Sequence
  Synthetic Polynucleotide
taatacgactcactatagggggagtttatcaaaaacgagctcatggtcataacagaggagaatgaccatgagctcgtttaacctggcggcagcgcaaaagatg

SEQ ID NO: 136108 - DNA, 103 bp, Artificial Sequence
  Synthetic Polynucleotide
taatacgactcactatagggggggcccccgcccgggccgccgtctgcgccaacagaggagaggcgcaatgggcggcccgaacctggcggcagcgcaaaagatg

SEQ ID NO: 136109 - DNA, 103 bp, Artificial Sequence
  Synthetic Polynucleotide
taatacgactcactataggggctggtagccggggcccccgcccgggccgcaacagaggagagcggccatggcgggggccaacctggcggcagcgcaaaagatg

SEQ ID NO: 136110 - DNA, 103 bp, Artificial Sequence
  Synthetic Polynucleotide
taatacgactcactataggggctgggggctgctggtagccggggcccccgaacagaggagacgggggatgcggctaccaaacctggcggcagcgcaaaagatg

SEQ ID NO: 136111 - DNA, 103 bp, Artificial Sequence
  Synthetic Polynucleotide
taatacgactcactatagggggtcgggggcgctgggggctgctggtagccaacagaggagaggctacatgcagcccccaaacctggcggcagcgcaaaagatg

SEQ ID NO: 136112 - DNA, 103 bp, Artificial Sequence
  Synthetic Polynucleotide
taatacgactcactataggggcaggtgctgggtcgggggcgctgggggctaacagaggagaagccccatgcgcccccgaaacctggcggcagcgcaaaagatg

SEQ ID NO: 136113 - DNA, 103 bp, Artificial Sequence
  Synthetic Polynucleotide
taatacgactcactatagggtgctgcagcggcaggtgctgggtcgggggcaacagaggagagcccccatgccagcacctaacctggcggcagcgcaaaagatg

SEQ ID NO: 136114 - DNA, 103 bp, Artificial Sequence
  Synthetic Polynucleotide
taatacgactcactataggggagctggggctgctgcagcggcaggtgctgaacagaggagacagcacatgccgctgcagaacctggcggcagcgcaaaagatg

SEQ ID NO: 136115 - DNA, 103 bp, Artificial Sequence
  Synthetic Polynucleotide
taatacgactcactatagggccgcgtgagggagctggggctgctgcagcgaacagaggagacgctgcatgagccccagcaacctggcggcagcgcaaaagatg

SEQ ID NO: 136116 - DNA, 103 bp, Artificial Sequence
  Synthetic Polynucleotide
taatacgactcactatagggcggccgccgcccgcgtgagggagctggggcaacagaggagagccccaatgccctcacgcaacctggcggcagcgcaaaagatg

SEQ ID NO: 136117 - DNA, 103 bp, Artificial Sequence
  Synthetic Polynucleotide
taatacgactcactatagggagtgggctctcggccgccgcccgcgtgaggaacagaggagacctcacatgggcggcggcaacctggcggcagcgcaaaagatg

SEQ ID NO: 136118 - DNA, 103 bp, Artificial Sequence
  Synthetic Polynucleotide
taatacgactcactatagggcgatgtagttggagtttatcaaaaacgagcaacagaggagagctcgtatgtgataaactaacctggcggcagcgcaaaagatg

SEQ ID NO: 136119 - DNA, 103 bp, Artificial Sequence
  Synthetic Polynucleotide
taatacgactcactatagggagtaggaggcagtgggctctcggccgccgcaacagaggagagcggcgatggagagcccaaacctggcggcagcgcaaaagatg

SEQ ID NO: 136120 - DNA, 103 bp, Artificial Sequence
  Synthetic Polynucleotide
taatacgactcactatagggcgcggcgcgtagtaggaggcagtgggctctaacagaggagaagagccatgtgcctcctaaacctggcggcagcgcaaaagatg

SEQ ID NO: 136121 - DNA, 103 bp, Artificial Sequence
  Synthetic Polynucleotide
taatacgactcactataggggcgggcggtccgcggcgcgtagtaggaggcaacagaggagagcctccatgtacgcgccgaacctggcggcagcgcaaaagatg

SEQ ID NO: 136122 - DNA, 103 bp, Artificial Sequence
  Synthetic Polynucleotide
taatacgactcactatagggaggcgggctcgcgggcggtccgcggcgcgtaacagaggagaacgcgcatgggaccgcccaacctggcggcagcgcaaaagatg

SEQ ID NO: 136123 - DNA, 103 bp, Artificial Sequence
  Synthetic Polynucleotide
taatacgactcactataggggcagcagggtaggcgggctcgcgggcggtcaacagaggagagaccgcatgcgagcccgcaacctggcggcagcgcaaaagatg

SEQ ID NO: 136124 - DNA, 103 bp, Artificial Sequence
  Synthetic Polynucleotide
taatacgactcactataggggtacagcgcggcagcagggtaggcgggctcaacagaggagagagcccatgtaccctgctaacctggcggcagcgcaaaagatg

SEQ ID NO: 136125 - DNA, 103 bp, Artificial Sequence
  Synthetic Polynucleotide
taatacgactcactatagggcatgcgcggggtacagcgcggcagcagggtaacagaggagaaccctgatgccgcgctgtaacctggcggcagcgcaaaagatg

SEQ ID NO: 136126 - DNA, 103 bp, Artificial Sequence
  Synthetic Polynucleotide
taatacgactcactatagggtccgcggccccatgcgcggggtacagcgcgaacagaggagacgcgctatgccccgcgcaaacctggcggcagcgcaaaagatg

SEQ ID NO: 136127 - DNA, 103 bp, Artificial Sequence
  Synthetic Polynucleotide
taatacgactcactataggggtaggcggtgtccgcggccccatgcgcgggaacagaggagacccgcgatgggggccgcgaacctggcggcagcgcaaaagatg

SEQ ID NO: 136128 - DNA, 103 bp, Artificial Sequence
  Synthetic Polynucleotide
taatacgactcactatagggagccataggggtaggcggtgtccgcggcccaacagaggagagggccgatgacaccgcctaacctggcggcagcgcaaaagatg

SEQ ID NO: 136129 - DNA, 103 bp, Artificial Sequence
  Synthetic Polynucleotide
taatacgactcactatagggaacttgggctcgatgtagttggagtttatcaacagaggagagataaaatgcaactacataacctggcggcagcgcaaaagatg

SEQ ID NO: 136130 - DNA, 103 bp, Artificial Sequence
  Synthetic Polynucleotide
taatacgactcactatagggccgccgcggtagccataggggtaggcggtgaacagaggagacaccgcatgcccctatggaacctggcggcagcgcaaaagatg

SEQ ID NO: 136131 - DNA, 103 bp, Artificial Sequence
  Synthetic Polynucleotide
taatacgactcactatagggggggctggcgccgccgcggtagccatagggaacagaggagaccctatatgtaccgcggcaacctggcggcagcgcaaaagatg

SEQ ID NO: 136132 - DNA, 103 bp, Artificial Sequence
  Synthetic Polynucleotide
taatacgactcactataggggcggccgcccggggctggcgccgccgcggtaacagaggagaaccgcgatggcgccagccaacctggcggcagcgcaaaagatg

SEQ ID NO: 136133 - DNA, 103 bp, Artificial Sequence
  Synthetic Polynucleotide
taatacgactcactatagggtcgggctggggcggccgcccggggctggcgaacagaggagacgccagatgcgggcggccaacctggcggcagcgcaaaagatg

SEQ ID NO: 136134 - DNA, 103 bp, Artificial Sequence
  Synthetic Polynucleotide
taatacgactcactatagggcgggggctgctcgggctggggcggccgcccaacagaggagagggcggatgccccagcccaacctggcggcagcgcaaaagatg

SEQ ID NO: 136135 - DNA, 103 bp, Artificial Sequence
  Synthetic Polynucleotide
taatacgactcactatagggtggcttgcgccgggggctgctcgggctgggaacagaggagacccagcatgagcagccccaacctggcggcagcgcaaaagatg

SEQ ID NO: 136136 - DNA, 103 bp, Artificial Sequence
  Synthetic Polynucleotide
taatacgactcactataggggctgggcccttggcttgcgccgggggctgcaacagaggagagcagccatgggcgcaagcaacctggcggcagcgcaaaagatg

SEQ ID NO: 136137 - DNA, 103 bp, Artificial Sequence
  Synthetic Polynucleotide
taatacgactcactatagggcaggccgtgcgctgggcccttggcttgcgcaacagaggagagcgcaaatgaagggcccaaacctggcggcagcgcaaaagatg

SEQ ID NO: 136138 - DNA, 103 bp, Artificial Sequence
  Synthetic Polynucleotide
taatacgactcactatagggggctcgcatgcaggccgtgcgctgggccctaacagaggagaagggccatgcgcacggccaacctggcggcagcgcaaaagatg

SEQ ID NO: 136139 - DNA, 103 bp, Artificial Sequence
  Synthetic Polynucleotide
taatacgactcactatagggtgcaggacgtggctcgcatgcaggccgtgcaacagaggagagcacggatggcatgcgagaacctggcggcagcgcaaaagatg

SEQ ID NO: 136140 - DNA, 103 bp, Artificial Sequence
  Synthetic Polynucleotide
taatacgactcactataggggaagggagggaacttgggctcgatgtagttaacagaggagaaactacatggagcccaagaacctggcggcagcgcaaaagatg

SEQ ID NO: 136141 - DNA, 103 bp, Artificial Sequence
  Synthetic Polynucleotide
taatacgactcactatagggcagctggggctgcaggacgtggctcgcatgaacagaggagacatgcgatgcacgtcctgaacctggcggcagcgcaaaagatg

SEQ ID NO: 136142 - DNA, 103 bp, Artificial Sequence
  Synthetic Polynucleotide
taatacgactcactatagggggggcggcggcagctggggctgcaggacgtaacagaggagaacgtccatgagccccagcaacctggcggcagcgcaaaagatg

SEQ ID NO: 136143 - DNA, 103 bp, Artificial Sequence
  Synthetic Polynucleotide
taatacgactcactatagggcgaggctgcaggggcggcggcagctggggcaacagaggagagccccaatggccgccgccaacctggcggcagcgcaaaagatg

SEQ ID NO: 136144 - DNA, 103 bp, Artificial Sequence
  Synthetic Polynucleotide
taatacgactcactataggggggcacggcgcgaggctgcaggggcggcggaacagaggagaccgccgatgctgcagcctaacctggcggcagcgcaaaagatg

SEQ ID NO: 136145 - DNA, 103 bp, Artificial Sequence
  Synthetic Polynucleotide
taatacgactcactataggggggccgctgggggcacggcgcgaggctgcaaacagaggagatgcagcatggcgccgtgcaacctggcggcagcgcaaaagatg

SEQ ID NO: 136146 - DNA, 103 bp, Artificial Sequence
  Synthetic Polynucleotide
taatacgactcactatagggcagcgccgcggggccgctgggggcacggcgaacagaggagacgccgtatgcccagcggcaacctggcggcagcgcaaaagatg

SEQ ID NO: 136147 - DNA, 103 bp, Artificial Sequence
  Synthetic Polynucleotide
taatacgactcactatagggggccgcctcgcagcgccgcggggccgctggaacagaggagaccagcgatgccgcggcgcaacctggcggcagcgcaaaagatg

SEQ ID NO: 136148 - DNA, 103 bp, Artificial Sequence
  Synthetic Polynucleotide
taatacgactcactataggggggtggcgggggccgcctcgcagcgccgcgaacagaggagacgcggcatggcgaggcggaacctggcggcagcgcaaaagatg

SEQ ID NO: 136149 - DNA, 103 bp, Artificial Sequence
  Synthetic Polynucleotide
taatacgactcactataggggggacgcctggggtggcgggggccgcctcgaacagaggagacgaggcatgccccgccacaacctggcggcagcgcaaaagatg

SEQ ID NO: 136150 - DNA, 103 bp, Artificial Sequence
  Synthetic Polynucleotide
taatacgactcactataggggccccctgccgggacgcctggggtggcgggaacagaggagacccgccatgccaggcgtcaacctggcggcagcgcaaaagatg

SEQ ID NO: 136151 - DNA, 103 bp, Artificial Sequence
  Synthetic Polynucleotide
taatacgactcactatagggcgtactcctcgaagggagggaacttgggctaacagaggagaagcccaatgtccctccctaacctggcggcagcgcaaaagatg

SEQ ID NO: 136152 - DNA, 103 bp, Artificial Sequence
  Synthetic Polynucleotide
taatacgactcactatagggcgggggcgctgccccctgccgggacgcctgaacagaggagacaggcgatgcggcaggggaacctggcggcagcgcaaaagatg

SEQ ID NO: 136153 - DNA, 103 bp, Artificial Sequence
  Synthetic Polynucleotide
taatacgactcactatagggagcgggcacgcgggggcgctgccccctgccaacagaggagaggcaggatgcagcgccccaacctggcggcagcgcaaaagatg

SEQ ID NO: 136154 - DNA, 103 bp, Artificial Sequence
  Synthetic Polynucleotide
taatacgactcactatagggggccaagagcagcgggcacgcgggggcgctaacagaggagaagcgccatggcgtgcccgaacctggcggcagcgcaaaagatg

SEQ ID NO: 136155 - DNA, 103 bp, Artificial Sequence
  Synthetic Polynucleotide
taatacgactcactatagggggctcttgtcggccaagagcagcgggcacgaacagaggagacgtgccatgtgctcttggaacctggcggcagcgcaaaagatg

SEQ ID NO: 136156 - DNA, 103 bp, Artificial Sequence
  Synthetic Polynucleotide
taatacgactcactatagggaggcccagcgggctcttgtcggccaagagcaacagaggagagctcttatgcgacaagagaacctggcggcagcgcaaaagatg

SEQ ID NO: 136157 - DNA, 103 bp, Artificial Sequence
  Synthetic Polynucleotide
taatacgactcactatagggcttgcccttcaggcccagcgggctcttgtcaacagaggagagacaagatgccgctgggcaacctggcggcagcgcaaaagatg

SEQ ID NO: 136158 - DNA, 103 bp, Artificial Sequence
  Synthetic Polynucleotide
taatacgactcactatagggccacgggctccttgcccttcaggcccagcgaacagaggagacgctggatgtgaagggcaaacctggcggcagcgcaaaagatg

SEQ ID NO: 136159 - DNA, 103 bp, Artificial Sequence
  Synthetic Polynucleotide
taatacgactcactatagggcaggggtacaccacgggctccttgcccttcaacagaggagagaagggatgggagcccgtaacctggcggcagcgcaaaagatg

SEQ ID NO: 136160 - DNA, 103 bp, Artificial Sequence
  Synthetic Polynucleotide
taatacgactcactatagggcttcttcatccaggggtacaccacgggctcaacagaggagagagcccatggtgtaccccaacctggcggcagcgcaaaagatg

SEQ ID NO: 136161 - DNA, 103 bp, Artificial Sequence
  Synthetic Polynucleotide
taatacgactcactatagggtgacatggatcttcttcatccaggggtacaaacagaggagatgtaccatgggatgaagaaacctggcggcagcgcaaaagatg

SEQ ID NO: 136162 - DNA, 103 bp, Artificial Sequence
  Synthetic Polynucleotide
taatacgactcactatagggctgtgctgcgcgtactcctcgaagggagggaacagaggagaccctccatgcgaggagtaaacctggcggcagcgcaaaagatg

SEQ ID NO: 136163 - DNA, 103 bp, Artificial Sequence
  Synthetic Polynucleotide
taatacgactcactatagggttaacggcgctgacatggatcttcttcatcaacagaggagagatgaaatggatccatgtaacctggcggcagcgcaaaagatg

SEQ ID NO: 136164 - DNA, 103 bp, Artificial Sequence
  Synthetic Polynucleotide
taatacgactcactatagggataactggggttaacggcgctgacatggataacagaggagaatccatatgagcgccgttaacctggcggcagcgcaaaagatg

SEQ ID NO: 136165 - DNA, 103 bp, Artificial Sequence
  Synthetic Polynucleotide
taatacgactcactatagggcccctccgttataactggggttaacggcgcaacagaggagagcgccgatgaccccagttaacctggcggcagcgcaaaagatg

SEQ ID NO: 136166 - DNA, 103 bp, Artificial Sequence
  Synthetic Polynucleotide
taatacgactcactatagggcgcttaggctcccctccgttataactggggaacagaggagaccccagatgtaacggaggaacctggcggcagcgcaaaagatg

SEQ ID NO: 136167 - DNA, 103 bp, Artificial Sequence
  Synthetic Polynucleotide
taatacgactcactatagggggttcgagagcgcttaggctcccctccgttaacagaggagaaacggaatggagcctaagaacctggcggcagcgcaaaagatg

SEQ ID NO: 136168 - DNA, 103 bp, Artificial Sequence
  Synthetic Polynucleotide
taatacgactcactataggggggtgtaggcggttcgagagcgcttaggctaacagaggagaagcctaatggctctcgaaaacctggcggcagcgcaaaagatg

SEQ ID NO: 136169 - DNA, 103 bp, Artificial Sequence
  Synthetic Polynucleotide
taatacgactcactatagggacctgctgccgggtgtaggcggttcgagagaacagaggagactctcgatgcgcctacacaacctggcggcagcgcaaaagatg

SEQ ID NO: 136170 - DNA, 103 bp, Artificial Sequence
  Synthetic Polynucleotide
taatacgactcactatagggcagctccaagacctgctgccgggtgtaggcaacagaggagagcctacatgcggcagcagaacctggcggcagcgcaaaagatg

SEQ ID NO: 136171 - DNA, 103 bp, Artificial Sequence
  Synthetic Polynucleotide
taatacgactcactatagggactccttctccagctccaagacctgctgccaacagaggagaggcagcatgtcttggagcaacctggcggcagcgcaaaagatg

SEQ ID NO: 136172 - DNA, 103 bp, Artificial Sequence
  Synthetic Polynucleotide
taatacgactcactatagggttgaagtggaactccttctccagctccaagaacagaggagacttggaatgggagaaggaaacctggcggcagcgcaaaagatg

SEQ ID NO: 136173 - DNA, 103 bp, Artificial Sequence
  Synthetic Polynucleotide
taatacgactcactataggggcccgagccgctgtgctgcgcgtactcctcaacagaggagagaggagatggcgcagcacaacctggcggcagcgcaaaagatg

SEQ ID NO: 136174 - DNA, 103 bp, Artificial Sequence
  Synthetic Polynucleotide
taatacgactcactatagggcaggtatcgattgaagtggaactccttctcaacagaggagagagaagatgttccacttcaacctggcggcagcgcaaaagatg

SEQ ID NO: 136175 - DNA, 103 bp, Artificial Sequence
  Synthetic Polynucleotide
taatacgactcactataggggccgccgggtcaggtatcgattgaagtggaaacagaggagatccactatgatcgataccaacctggcggcagcgcaaaagatg

SEQ ID NO: 136176 - DNA, 103 bp, Artificial Sequence
  Synthetic Polynucleotide
taatacgactcactatagggtcgatgcggcgccgccgggtcaggtatcgaaacagaggagatcgataatggacccggcgaacctggcggcagcgcaaaagatg

SEQ ID NO: 136177 - DNA, 103 bp, Artificial Sequence
  Synthetic Polynucleotide
taatacgactcactataggggtgggcgatctcgatgcggcgccgccgggtaacagaggagaacccggatgcgccgcatcaacctggcggcagcgcaaaagatg

SEQ ID NO: 136178 - DNA, 103 bp, Artificial Sequence
  Synthetic Polynucleotide
taatacgactcactatagggaacagagcgtgtgggcgatctcgatgcggcaacagaggagagccgcaatgagatcgcccaacctggcggcagcgcaaaagatg

SEQ ID NO: 136179 - DNA, 103 bp, Artificial Sequence
  Synthetic Polynucleotide
taatacgactcactatagggcgctcagacaaacagagcgtgtgggcgatcaacagaggagagatcgcatgcacgctctgaacctggcggcagcgcaaaagatg

SEQ ID NO: 136180 - DNA, 103 bp, Artificial Sequence
  Synthetic Polynucleotide
taatacgactcactatagggcttgacctggcgctcagacaaacagagcgtaacagaggagaacgctcatgttgtctgagaacctggcggcagcgcaaaagatg

SEQ ID NO: 136181 - DNA, 103 bp, Artificial Sequence
  Synthetic Polynucleotide
taatacgactcactataggggaaaccagatcttgacctggcgctcagacaaacagaggagatgtctgatggccaggtcaaacctggcggcagcgcaaaagatg

SEQ ID NO: 136182 - DNA, 103 bp, Artificial Sequence
  Synthetic Polynucleotide
taatacgactcactatagggctccggttctgaaaccagatcttgacctggaacagaggagaccaggtatggatctggttaacctggcggcagcgcaaaagatg

SEQ ID NO: 136183 - DNA, 103 bp, Artificial Sequence
  Synthetic Polynucleotide
taatacgactcactatagggccacttcatcctccggttctgaaaccagataacagaggagaatctggatgcagaaccggaacctggcggcagcgcaaaagatg

SEQ ID NO: 136184 - DNA, 103 bp, Artificial Sequence
  Synthetic Polynucleotide
taatacgactcactatagggcgtctgcgccgcccgagccgctgtgctgcgaacagaggagacgcagcatggcggctcggaacctggcggcagcgcaaaagatg

SEQ ID NO: 136185 - DNA, 103 bp, Artificial Sequence
  Synthetic Polynucleotide
taatacgactcactatagggggtctttcttccacttcatcctccggttctaacagaggagaagaaccatgggatgaagtaacctggcggcagcgcaaaagatg

SEQ ID NO: 136186 - DNA, 103 bp, Artificial Sequence
  Synthetic Polynucleotide
taatacgactcactatagggggcagtttgtggtctttcttccacttcatcaacagaggagagatgaaatggaagaaagaaacctggcggcagcgcaaaagatg

SEQ ID NO: 136187 - DNA, 103 bp, Artificial Sequence
  Synthetic Polynucleotide
taatacgactcactatagggcttggtgttgggcagtttgtggtctttcttaacagaggagaaagaaaatgcacaaactgaacctggcggcagcgcaaaagatg

SEQ ID NO: 136188 - DNA, 103 bp, Artificial Sequence
  Synthetic Polynucleotide
taatacgactcactatagggaggatcgcatcttggtgttgggcagtttgtaacagaggagaacaaacatgccaacaccaaacctggcggcagcgcaaaagatg

SEQ ID NO: 136189 - DNA, 103 bp, Artificial Sequence
  Synthetic Polynucleotide
taatacgactcactataggggccgaattggaggatcgcatcttggtgttgaacagaggagacaacacatggatgcgatcaacctggcggcagcgcaaaagatg

SEQ ID NO: 136190 - DNA, 103 bp, Artificial Sequence
  Synthetic Polynucleotide
taatacgactcactatagggagaggccgaggccgaattggaggatcgcataacagaggagaatgcgaatgtccaattcgaacctggcggcagcgcaaaagatg

SEQ ID NO: 136191 - DNA, 103 bp, Artificial Sequence
  Synthetic Polynucleotide
taatacgactcactataggggtgggccggcagaggccgaggccgaattggaacagaggagaccaattatgcctcggcctaacctggcggcagcgcaaaagatg

SEQ ID NO: 136192 - DNA, 103 bp, Artificial Sequence
  Synthetic Polynucleotide
taatacgactcactataggggctttccctggtgggccggcagaggccgagaacagaggagactcggcatgtgccggcccaacctggcggcagcgcaaaagatg

SEQ ID NO: 136193 - DNA, 103 bp, Artificial Sequence
  Synthetic Polynucleotide
taatacgactcactatagggctgagtttgtgctttccctggtgggccggcaacagaggagagccggcatgccagggaaaaacctggcggcagcgcaaaagatg

SEQ ID NO: 136194 - DNA, 103 bp, Artificial Sequence
  Synthetic Polynucleotide
taatacgactcactatagggggtgtgggctctgagtttgtgctttccctgaacagaggagacagggaatgcacaaactcaacctggcggcagcgcaaaagatg

SEQ ID NO: 136195 - DNA, 103 bp, Artificial Sequence
  Synthetic Polynucleotide
taatacgactcactatagggcccgggccgccgtctgcgccgcccgagccgaacagaggagacggctcatgcggcgcagaaacctggcggcagcgcaaaagatg

SEQ ID NO: 136196 - DNA, 103 bp, Artificial Sequence
  Synthetic Polynucleotide
taatacgactcactatagggtggggatggaggtgtgggctctgagtttgtaacagaggagaacaaacatggagcccacaaacctggcggcagcgcaaaagatg

SEQ ID NO: 136197 - DNA, 103 bp, Artificial Sequence
  Synthetic Polynucleotide
taatacgactcactatagggcgggtgggggtggggatggaggtgtgggctaacagaggagaagcccaatgctccatcccaacctggcggcagcgcaaaagatg

SEQ ID NO: 136198 - DNA, 103 bp, Artificial Sequence
  Synthetic Polynucleotide
taatacgactcactatagggtggaggtgctcgggtgggggtggggatggaaacagaggagatccatcatgacccccaccaacctggcggcagcgcaaaagatg

SEQ ID NO: 136199 - DNA, 103 bp, Artificial Sequence
  Synthetic Polynucleotide
taatacgactcactatagggggaacgggtgtggaggtgctcgggtgggggaacagaggagacccccaatggagcacctcaacctggcggcagcgcaaaagatg

SEQ ID NO: 136200 - DNA, 103 bp, Artificial Sequence
  Synthetic Polynucleotide
taatacgactcactatagggtatggaggagggaacgggtgtggaggtgctaacagaggagaagcaccatgacacccgttaacctggcggcagcgcaaaagatg

SEQ ID NO: 136201 - DNA, 103 bp, Artificial Sequence
  Synthetic Polynucleotide
taatacgactcactataggggcaaaatgagtttacaaaataagagctcataacagaggagaatgagcatgtattttgtaaacctggcggcagcgcaaaagatg

SEQ ID NO: 136202 - DNA, 103 bp, Artificial Sequence
  Synthetic Polynucleotide
taatacgactcactatagggcatgctcgccgagtccctgaattgctcgctaacagaggagaagcgagatgttcagggacaacctggcggcagcgcaaaagatg

SEQ ID NO: 136203 - DNA, 103 bp, Artificial Sequence
  Synthetic Polynucleotide
taatacgactcactatagggtgccggagtgcatgctcgccgagtccctgaaacagaggagatcagggatgcggcgagcaaacctggcggcagcgcaaaagatg

SEQ ID NO: 136204 - DNA, 103 bp, Artificial Sequence
  Synthetic Polynucleotide
taatacgactcactatagggtagccgtacctgccggagtgcatgctcgccaacagaggagaggcgagatggcactccggaacctggcggcagcgcaaaagatg

SEQ ID NO: 136205 - DNA, 103 bp, Artificial Sequence
  Synthetic Polynucleotide
taatacgactcactatagggattgtagccgtagccgtacctgccggagtgaacagaggagacactccatgaggtacggcaacctggcggcagcgcaaaagatg

SEQ ID NO: 136206 - DNA, 103 bp, Artificial Sequence
  Synthetic Polynucleotide
taatacgactcactataggggatccatgccattgtagccgtagccgtaccaacagaggagaggtacgatgacggctacaaacctggcggcagcgcaaaagatg

SEQ ID NO: 136207 - DNA, 103 bp, Artificial Sequence
  Synthetic Polynucleotide
taatacgactcactatagggccgacgctgagatccatgccattgtagccgaacagaggagacggctaatgtggcatggaaacctggcggcagcgcaaaagatg

SEQ ID NO: 136208 - DNA, 103 bp, Artificial Sequence
  Synthetic Polynucleotide
taatacgactcactataggggcccgagcggccgacgctgagatccatgccaacagaggagaggcatgatgctcagcgtcaacctggcggcagcgcaaaagatg

SEQ ID NO: 136209 - DNA, 103 bp, Artificial Sequence
  Synthetic Polynucleotide
taatacgactcactatagggagtggccggagcccgagcggccgacgctgaaacagaggagatcagcgatggccgctcggaacctggcggcagcgcaaaagatg

SEQ ID NO: 136210 - DNA, 103 bp, Artificial Sequence
  Synthetic Polynucleotide
taatacgactcactatagggccggagccaaagtggccggagcccgagcggaacagaggagaccgctcatgctccggccaaacctggcggcagcgcaaaagatg

SEQ ID NO: 136211 - DNA, 103 bp, Artificial Sequence
  Synthetic Polynucleotide
taatacgactcactatagggggcgcgctctccggagccaaagtggccggaaacagaggagatccggcatgtttggctccaacctggcggcagcgcaaaagatg

SEQ ID NO: 136212 - DNA, 103 bp, Artificial Sequence
  Synthetic Polynucleotide
taatacgactcactataggggatagcgaccgcaaaatgagtttacaaaataacagaggagaattttgatgactcattttaacctggcggcagcgcaaaagatg

SEQ ID NO: 136213 - DNA, 103 bp, Artificial Sequence
  Synthetic Polynucleotide
taatacgactcactatagggcgtagctgcgggcgcgctctccggagccaaaacagaggagattggctatggagagcgcgaacctggcggcagcgcaaaagatg

SEQ ID NO: 136214 - DNA, 103 bp, Artificial Sequence
  Synthetic Polynucleotide
taatacgactcactataggggcgctggcagcgtagctgcgggcgcgctctaacagaggagaagagcgatgccgcagctaaacctggcggcagcgcaaaagatg

SEQ ID NO: 136215 - DNA, 103 bp, Artificial Sequence
  Synthetic Polynucleotide
taatacgactcactatagggcgccgcgctggcgctggcagcgtagctgcgaacagaggagacgcagcatggctgccagcaacctggcggcagcgcaaaagatg

SEQ ID NO: 136216 - DNA, 103 bp, Artificial Sequence
  Synthetic Polynucleotide
taatacgactcactataggggctcggcgggcgccgcgctggcgctggcagaacagaggagactgccaatgccagcgcggaacctggcggcagcgcaaaagatg

SEQ ID NO: 136217 - DNA, 103 bp, Artificial Sequence
  Synthetic Polynucleotide
taatacgactcactatagggctgtacctgggctcggcgggcgccgcgctgaacagaggagacagcgcatggcccgccgaaacctggcggcagcgcaaaagatg

SEQ ID NO: 136218 - DNA, 103 bp, Artificial Sequence
  Synthetic Polynucleotide
taatacgactcactatagggggccggctggctgtacctgggctcggcgggaacagaggagacccgccatgcccaggtacaacctggcggcagcgcaaaagatg

SEQ ID NO: 136219 - DNA, 103 bp, Artificial Sequence
  Synthetic Polynucleotide
taatacgactcactataggggcgtggacgtggccggctggctgtacctggaacagaggagaccaggtatggccagccggaacctggcggcagcgcaaaagatg

SEQ ID NO: 136220 - DNA, 103 bp, Artificial Sequence
  Synthetic Polynucleotide
taatacgactcactatagggtgaggagagtgcgtggacgtggccggctggaacagaggagaccagccatgcacgtccacaacctggcggcagcgcaaaagatg

SEQ ID NO: 136221 - DNA, 103 bp, Artificial Sequence
  Synthetic Polynucleotide
taatacgactcactatagggcggatcgggctgaggagagtgcgtggacgtaacagaggagaacgtccatgcactctcctaacctggcggcagcgcaaaagatg

SEQ ID NO: 136222 - DNA, 103 bp, Artificial Sequence
  Synthetic Polynucleotide
taatacgactcactatagggagcagggcagcggatcgggctgaggagagtaacagaggagaactctcatgagcccgatcaacctggcggcagcgcaaaagatg

SEQ ID NO: 136223 - DNA, 103 bp, Artificial Sequence
  Synthetic Polynucleotide
taatacgactcactataggggggccatttggatagcgaccgcaaaatgagaacagaggagactcattatgcggtcgctaaacctggcggcagcgcaaaagatg

SEQ ID NO: 136224 - DNA, 103 bp, Artificial Sequence
  Synthetic Polynucleotide
taatacgactcactataggggccacggcggagcagggcagcggatcgggcaacagaggagagcccgaatggctgccctgaacctggcggcagcgcaaaagatg

SEQ ID NO: 136225 - DNA, 103 bp, Artificial Sequence
  Synthetic Polynucleotide
taatacgactcactataggggggcgagggggccacggcggagcagggcagaacagaggagactgcccatgtccgccgtgaacctggcggcagcgcaaaagatg

SEQ ID NO: 136226 - DNA, 103 bp, Artificial Sequence
  Synthetic Polynucleotide
taatacgactcactatagggtgtcgctgccgggcgagggggccacggcggaacagaggagaccgccgatgccccctcgcaacctggcggcagcgcaaaagatg

SEQ ID NO: 136227 - DNA, 103 bp, Artificial Sequence
  Synthetic Polynucleotide
taatacgactcactatagggccgtggtggctgtcgctgccgggcgaggggaacagaggagacccctcatgcggcagcgaaacctggcggcagcgcaaaagatg

SEQ ID NO: 136228 - DNA, 103 bp, Artificial Sequence
  Synthetic Polynucleotide
taatacgactcactataggggtttttcccgccgtggtggctgtcgctgccaacagaggagaggcagcatgagccaccacaacctggcggcagcgcaaaagatg

SEQ ID NO: 136229 - DNA, 103 bp, Artificial Sequence
  Synthetic Polynucleotide
taatacgactcactatagggtgcttagggagtttttcccgccgtggtggcaacagaggagagccaccatggcgggaaaaaacctggcggcagcgcaaaagatg

SEQ ID NO: 136230 - DNA, 103 bp, Artificial Sequence
  Synthetic Polynucleotide
taatacgactcactatagggccgctggagttgcttagggagtttttcccgaacagaggagacgggaaatgctccctaagaacctggcggcagcgcaaaagatg

SEQ ID NO: 136231 - DNA, 103 bp, Artificial Sequence
  Synthetic Polynucleotide
taatacgactcactatagggggccgaggcgccgctggagttgcttagggaaacagaggagatccctaatgaactccagcaacctggcggcagcgcaaaagatg

SEQ ID NO: 136232 - DNA, 103 bp, Artificial Sequence
  Synthetic Polynucleotide
taatacgactcactatagggtgccggcgtcggccgaggcgccgctggagtaacagaggagaactccaatggcgcctcggaacctggcggcagcgcaaaagatg

SEQ ID NO: 136233 - DNA, 103 bp, Artificial Sequence
  Synthetic Polynucleotide
taatacgactcactatagggatgtgggtgctgccggcgtcggccgaggcgaacagaggagacgcctcatgcgacgccggaacctggcggcagcgcaaaagatg

SEQ ID NO: 136234 - DNA, 103 bp, Artificial Sequence
  Synthetic Polynucleotide
taatacgactcactatagggctggtagtccgggccatttggatagcgaccaacagaggagaggtcgcatgccaaatggcaacctggcggcagcgcaaaagatg

SEQ ID NO: 136235 - DNA, 103 bp, Artificial Sequence
  Synthetic Polynucleotide
taatacgactcactatagggtctgctgctgatgtgggtgctgccggcgtcaacagaggagagacgccatgagcacccacaacctggcggcagcgcaaaagatg

SEQ ID NO: 136236 - DNA, 103 bp, Artificial Sequence
  Synthetic Polynucleotide
taatacgactcactatagggcaaccccctctctgctgctgatgtgggtgcaacagaggagagcacccatgtcagcagcaaacctggcggcagcgcaaaagatg

SEQ ID NO: 136237 - DNA, 103 bp, Artificial Sequence
  Synthetic Polynucleotide
taatacgactcactataggggacgccgtgccaaccccctctctgctgctgaacagaggagacagcagatgagagggggtaacctggcggcagcgcaaaagatg

SEQ ID NO: 136238 - DNA, 103 bp, Artificial Sequence
  Synthetic Polynucleotide
taatacgactcactatagggctcggctccggacgccgtgccaaccccctcaacagaggagagaggggatgggcacggcgaacctggcggcagcgcaaaagatg

SEQ ID NO: 136239 - DNA, 103 bp, Artificial Sequence
  Synthetic Polynucleotide
taatacgactcactataggggggcgtcctcctcggctccggacgccgtgcaacagaggagagcacggatgccggagccgaacctggcggcagcgcaaaagatg

SEQ ID NO: 136240 - DNA, 103 bp, Artificial Sequence
  Synthetic Polynucleotide
taatacgactcactatagggctgctggcaggggcgtcctcctcggctccgaacagaggagacggagcatgggaggacgcaacctggcggcagcgcaaaagatg

SEQ ID NO: 136241 - DNA, 103 bp, Artificial Sequence
  Synthetic Polynucleotide
taatacgactcactatagggcgcctgctcgctgctggcaggggcgtcctcaacagaggagagaggacatgcctgccagcaacctggcggcagcgcaaaagatg

SEQ ID NO: 136242 - DNA, 103 bp, Artificial Sequence
  Synthetic Polynucleotide
taatacgactcactatagggtctgcgcactcgcctgctcgctgctggcagaacagaggagactgccaatggcgagcaggaacctggcggcagcgcaaaagatg

SEQ ID NO: 136243 - DNA, 103 bp, Artificial Sequence
  Synthetic Polynucleotide
taatacgactcactatagggctcggctcgctctgcgcactcgcctgctcgaacagaggagacgagcaatggagtgcgcaaacctggcggcagcgcaaaagatg

SEQ ID NO: 136244 - DNA, 103 bp, Artificial Sequence
  Synthetic Polynucleotide
taatacgactcactatagggcggcgccgggctcggctcgctctgcgcactaacagaggagaagtgcgatgagcgagccgaacctggcggcagcgcaaaagatg

SEQ ID NO: 136245 - DNA, 103 bp, Artificial Sequence
  Synthetic Polynucleotide
taatacgactcactatagggaattatgcaactggtagtccgggccatttgaacagaggagacaaatgatgcggactaccaacctggcggcagcgcaaaagatg

SEQ ID NO: 136246 - DNA, 103 bp, Artificial Sequence
  Synthetic Polynucleotide
taatacgactcactataggggttgggcgggcggcgccgggctcggctcgcaacagaggagagcgagcatggcccggcgcaacctggcggcagcgcaaaagatg

SEQ ID NO: 136247 - DNA, 103 bp, Artificial Sequence
  Synthetic Polynucleotide
taatacgactcactatagggtagatctggggttgggcgggcggcgccgggaacagaggagacccggcatggcccgcccaaacctggcggcagcgcaaaagatg

SEQ ID NO: 136248 - DNA, 103 bp, Artificial Sequence
  Synthetic Polynucleotide
taatacgactcactatagggcatccaggggtagatctggggttgggcgggaacagaggagacccgccatgccccagatcaacctggcggcagcgcaaaagatg

SEQ ID NO: 136249 - DNA, 103 bp, Artificial Sequence
  Synthetic Polynucleotide
taatacgactcactataggggcagcttgcgcatccaggggtagatctgggaacagaggagacccagaatgacccctggaaacctggcggcagcgcaaaagatg

SEQ ID NO: 136250 - DNA, 103 bp, Artificial Sequence
  Synthetic Polynucleotide
taatacgactcactatagggtgacttatgtgcagcttgcgcatccaggggaacagaggagacccctgatggcgcaagctaacctggcggcagcgcaaaagatg

SEQ ID NO: 136251 - DNA, 103 bp, Artificial Sequence
  Synthetic Polynucleotide
taatacgactcactatagggtatgttgtcatgacttatgtgcagcttgcgaacagaggagacgcaagatgcacataagtaacctggcggcagcgcaaaagatg

SEQ ID NO: 136252 - DNA, 103 bp, Artificial Sequence
  Synthetic Polynucleotide
taatacgactcactatagggccgggccgcctatgttgtcatgacttatgtaacagaggagaacataaatgatgacaacaaacctggcggcagcgcaaaagatg

SEQ ID NO: 136253 - DNA, 103 bp, Artificial Sequence
  Synthetic Polynucleotide
taatacgactcactatagggcttttgccttccgggccgcctatgttgtcaaacagaggagatgacaaatgaggcggcccaacctggcggcagcgcaaaagatg

SEQ ID NO: 136254 - DNA, 103 bp, Artificial Sequence
  Synthetic Polynucleotide
taatacgactcactatagggcgtccgggcccttttgccttccgggccgccaacagaggagaggcggcatggaaggcaaaaacctggcggcagcgcaaaagatg

SEQ ID NO: 136255 - DNA, 103 bp, Artificial Sequence
  Synthetic Polynucleotide
taatacgactcactataggggcgtgtaggccgtccgggcccttttgccttaacagaggagaaaggcaatggggcccggaaacctggcggcagcgcaaaagatg

SEQ ID NO: 136256 - DNA, 103 bp, Artificial Sequence
  Synthetic Polynucleotide
taatacgactcactatagggtgatctccataattatgcaactggtagtccaacagaggagaggactaatggttgcataaaacctggcggcagcgcaaaagatg

SEQ ID NO: 136257 - DNA, 103 bp, Artificial Sequence
  Synthetic Polynucleotide
taatacgactcactataggggtctggtagcgcgtgtaggccgtccgggccaacagaggagaggcccgatgggcctacacaacctggcggcagcgcaaaagatg

SEQ ID NO: 136258 - DNA, 103 bp, Artificial Sequence
  Synthetic Polynucleotide
taatacgactcactatagggcagctccagggtctggtagcgcgtgtaggcaacagaggagagcctacatgcgctaccagaacctggcggcagcgcaaaagatg

SEQ ID NO: 136259 - DNA, 103 bp, Artificial Sequence
  Synthetic Polynucleotide
taatacgactcactatagggactccttctccagctccagggtctggtagcaacagaggagagctaccatgccctggagcaacctggcggcagcgcaaaagatg

SEQ ID NO: 136260 - DNA, 103 bp, Artificial Sequence
  Synthetic Polynucleotide
taatacgactcactatagggttgaagtggaactccttctccagctccaggaacagaggagacctggaatgggagaaggaaacctggcggcagcgcaaaagatg

SEQ ID NO: 136261 - DNA, 103 bp, Artificial Sequence
  Synthetic Polynucleotide
taatacgactcactatagggcaggtaacggttgaagtggaactccttctcaacagaggagagagaagatgttccacttcaacctggcggcagcgcaaaagatg

SEQ ID NO: 136262 - DNA, 103 bp, Artificial Sequence
  Synthetic Polynucleotide
taatacgactcactatagggttctgcgggtcaggtaacggttgaagtggaaacagaggagatccactatgaccgttaccaacctggcggcagcgcaaaagatg

SEQ ID NO: 136263 - DNA, 103 bp, Artificial Sequence
  Synthetic Polynucleotide
taatacgactcactatagggtcaatcctccttctgcgggtcaggtaacggaacagaggagaccgttaatggacccgcagaacctggcggcagcgcaaaagatg

SEQ ID NO: 136264 - DNA, 103 bp, Artificial Sequence
  Synthetic Polynucleotide
taatacgactcactatagggatgtgctatttcaatcctccttctgcgggtaacagaggagaacccgcatgaggaggattaacctggcggcagcgcaaaagatg

SEQ ID NO: 136265 - DNA, 103 bp, Artificial Sequence
  Synthetic Polynucleotide
taatacgactcactatagggggcaaagagcatgtgctatttcaatcctccaacagaggagaggaggaatgaaatagcacaacctggcggcagcgcaaaagatg

SEQ ID NO: 136266 - DNA, 103 bp, Artificial Sequence
  Synthetic Polynucleotide
taatacgactcactatagggctctcggagaggcaaagagcatgtgctattaacagaggagaaatagcatgtgctctttgaacctggcggcagcgcaaaagatg

SEQ ID NO: 136267 - DNA, 103 bp, Artificial Sequence
  Synthetic Polynucleotide
taatacgactcactatagggcacggaactatgatctccataattatgcaaaacagaggagattgcatatgtatggagataacctggcggcagcgcaaaagatg

SEQ ID NO: 136268 - DNA, 103 bp, Artificial Sequence
  Synthetic Polynucleotide
taatacgactcactatagggtttaatttgtctctcggagaggcaaagagcaacagaggagagctcttatgctctccgagaacctggcggcagcgcaaaagatg

SEQ ID NO: 136269 - DNA, 103 bp, Artificial Sequence
  Synthetic Polynucleotide
taatacgactcactatagggggaaccagattttaatttgtctctcggagaaacagaggagatctccgatggacaaattaaacctggcggcagcgcaaaagatg

SEQ ID NO: 136270 - DNA, 103 bp, Artificial Sequence
  Synthetic Polynucleotide
taatacgactcactatagggctccggttttggaaccagattttaatttgtaacagaggagaacaaatatgaatctggttaacctggcggcagcgcaaaagatg

SEQ ID NO: 136271 - DNA, 103 bp, Artificial Sequence
  Synthetic Polynucleotide
taatacgactcactatagggccacttcattctccggttttggaaccagataacagaggagaatctggatgcaaaaccggaacctggcggcagcgcaaaagatg

SEQ ID NO: 136272 - DNA, 103 bp, Artificial Sequence
  Synthetic Polynucleotide
taatacgactcactatagggtatcttttttccacttcattctccggttttaacagaggagaaaaaccatggaatgaagtaacctggcggcagcgcaaaagatg

SEQ ID NO: 136273 - DNA, 103 bp, Artificial Sequence
  Synthetic Polynucleotide
taatacgactcactatagggttcagcttattatcttttttccacttcattaacagaggagaaatgaaatggaaaaaagaaacctggcggcagcgcaaaagatg

SEQ ID NO: 136274 - DNA, 103 bp, Artificial Sequence
  Synthetic Polynucleotide
taatacgactcactataggggctcatgcttttcagcttattatcttttttaacagaggagaaaaaaaatgaataagctgaacctggcggcagcgcaaaagatg

SEQ ID NO: 136275 - DNA, 103 bp, Artificial Sequence
  Synthetic Polynucleotide
taatacgactcactatagggccgcggccatgctcatgcttttcagcttataacagaggagaataagcatgaaagcatgaaacctggcggcagcgcaaaagatg

SEQ ID NO: 136276 - DNA, 103 bp, Artificial Sequence
  Synthetic Polynucleotide
taatacgactcactataggggcccctcctgccgcggccatgctcatgcttaacagaggagaaagcatatgcatggccgcaacctggcggcagcgcaaaagatg

SEQ ID NO: 136277 - DNA, 103 bp, Artificial Sequence
  Synthetic Polynucleotide
taatacgactcactataggggggacggaaggcccctcctgccgcggccataacagaggagaatggccatggcaggagggaacctggcggcagcgcaaaagatg

SEQ ID NO: 136278 - DNA, 103 bp, Artificial Sequence
  Synthetic Polynucleotide
taatacgactcactatagggattgctcgctcacggaactatgatctccataacagaggagaatggagatgatagttccgaacctggcggcagcgcaaaagatg

SEQ ID NO: 136279 - DNA, 103 bp, Artificial Sequence
  Synthetic Polynucleotide
taatacgactcactataggggagtccctgaattgctcgctcacggaactaaacagaggagatagttcatggagcgagcaaacctggcggcagcgcaaaagatg

SEQ ID NO: 136280 - DNA, 103 bp, Artificial Sequence
  Synthetic Polynucleotide
taatacgactcactataggggaaagtgggattcacaaaataggaactcataacagaggagaatgagtatgtattttgtgaacctggcggcagcgcaaaagatg

SEQ ID NO: 136281 - DNA, 103 bp, Artificial Sequence
  Synthetic Polynucleotide
taatacgactcactatagggggccgggaagggcctcagcgcgtcatagccaacagaggagaggctatatggcgctgaggaacctggcggcagcgcaaaagatg

SEQ ID NO: 136282 - DNA, 103 bp, Artificial Sequence
  Synthetic Polynucleotide
taatacgactcactatagggccccgtacgaggccgggaagggcctcagcgaacagaggagacgctgaatgccttcccggaacctggcggcagcgcaaaagatg

SEQ ID NO: 136283 - DNA, 103 bp, Artificial Sequence
  Synthetic Polynucleotide
taatacgactcactatagggagactcgacgccccgtacgaggccgggaagaacagaggagacttcccatgctcgtacggaacctggcggcagcgcaaaagatg

SEQ ID NO: 136284 - DNA, 103 bp, Artificial Sequence
  Synthetic Polynucleotide
taatacgactcactatagggcttgtccgggagactcgacgccccgtacgaaacagaggagatcgtacatggcgtcgagtaacctggcggcagcgcaaaagatg

SEQ ID NO: 136285 - DNA, 103 bp, Artificial Sequence
  Synthetic Polynucleotide
taatacgactcactatagggaggtgtacgtcttgtccgggagactcgacgaacagaggagacgtcgaatgtcccggacaaacctggcggcagcgcaaaagatg

SEQ ID NO: 136286 - DNA, 103 bp, Artificial Sequence
  Synthetic Polynucleotide
taatacgactcactatagggaaacaaggtgaggtgtacgtcttgtccgggaacagaggagacccggaatggacgtacacaacctggcggcagcgcaaaagatg

SEQ ID NO: 136287 - DNA, 103 bp, Artificial Sequence
  Synthetic Polynucleotide
taatacgactcactatagggctgttggtagaaacaaggtgaggtgtacgtaacagaggagaacgtacatgtcaccttgtaacctggcggcagcgcaaaagatg

SEQ ID NO: 136288 - DNA, 103 bp, Artificial Sequence
  Synthetic Polynucleotide
taatacgactcactatagggccgagttggactgttggtagaaacaaggtgaacagaggagacaccttatgtctaccaacaacctggcggcagcgcaaaagatg

SEQ ID NO: 136289 - DNA, 103 bp, Artificial Sequence
  Synthetic Polynucleotide
taatacgactcactatagggcaggccaggaccgagttggactgttggtagaacagaggagactaccaatggtccaactcaacctggcggcagcgcaaaagatg

SEQ ID NO: 136290 - DNA, 103 bp, Artificial Sequence
  Synthetic Polynucleotide
taatacgactcactatagggcgcccggttgcaggccaggaccgagttggaaacagaggagatccaacatggtcctggccaacctggcggcagcgcaaaagatg

SEQ ID NO: 136291 - DNA, 103 bp, Artificial Sequence
  Synthetic Polynucleotide
taatacgactcactatagggggctcccggggaaagtgggattcacaaaataacagaggagaattttgatgatcccacttaacctggcggcagcgcaaaagatg

SEQ ID NO: 136292 - DNA, 103 bp, Artificial Sequence
  Synthetic Polynucleotide
taatacgactcactatagggactcgtaggacgcccggttgcaggccaggaaacagaggagatcctggatggcaaccgggaacctggcggcagcgcaaaagatg

SEQ ID NO: 136293 - DNA, 103 bp, Artificial Sequence
  Synthetic Polynucleotide
taatacgactcactataggggaggccccgtactcgtaggacgcccggttgaacagaggagacaaccgatggtcctacgaaacctggcggcagcgcaaaagatg

SEQ ID NO: 136294 - DNA, 103 bp, Artificial Sequence
  Synthetic Polynucleotide
taatacgactcactatagggatagaaacacgaggccccgtactcgtaggaaacagaggagatcctacatgtacggggccaacctggcggcagcgcaaaagatg

SEQ ID NO: 136295 - DNA, 103 bp, Artificial Sequence
  Synthetic Polynucleotide
taatacgactcactatagggccttatcagaatagaaacacgaggccccgtaacagaggagaacggggatgcgtgtttctaacctggcggcagcgcaaaagatg

SEQ ID NO: 136296 - DNA, 103 bp, Artificial Sequence
  Synthetic Polynucleotide
taatacgactcactatagggccactgaggtccttatcagaatagaaacacaacagaggagagtgtttatgttctgataaaacctggcggcagcgcaaaagatg

SEQ ID NO: 136297 - DNA, 103 bp, Artificial Sequence
  Synthetic Polynucleotide
taatacgactcactataggggggcgaggcgccactgaggtccttatcagaaacagaggagatctgatatggacctcagtaacctggcggcagcgcaaaagatg

SEQ ID NO: 136298 - DNA, 103 bp, Artificial Sequence
  Synthetic Polynucleotide
taatacgactcactatagggcactgcccgagggcgaggcgccactgaggtaacagaggagaacctcaatggcgcctcgcaacctggcggcagcgcaaaagatg

SEQ ID NO: 136299 - DNA, 103 bp, Artificial Sequence
  Synthetic Polynucleotide
taatacgactcactatagggctctgcttgccactgcccgagggcgaggcgaacagaggagacgcctcatgctcgggcagaacctggcggcagcgcaaaagatg

SEQ ID NO: 136300 - DNA, 103 bp, Artificial Sequence
  Synthetic Polynucleotide
taatacgactcactatagggcccggggcccctctgcttgccactgcccgaaacagaggagatcgggcatgggcaagcagaacctggcggcagcgcaaaagatg

SEQ ID NO: 136301 - DNA, 103 bp, Artificial Sequence
  Synthetic Polynucleotide
taatacgactcactataggggcaggtagtccccggggcccctctgcttgcaacagaggagagcaagcatgggggccccgaacctggcggcagcgcaaaagatg

SEQ ID NO: 136302 - DNA, 103 bp, Artificial Sequence
  Synthetic Polynucleotide
taatacgactcactatagggccgctgggaaggctcccggggaaagtgggaaacagaggagatcccacatgccccgggagaacctggcggcagcgcaaaagatg

SEQ ID NO: 136303 - DNA, 103 bp, Artificial Sequence
  Synthetic Polynucleotide
taatacgactcactatagggggagaaaagtgcaggtagtccccggggcccaacagaggagagggcccatgggactacctaacctggcggcagcgcaaaagatg

SEQ ID NO: 136304 - DNA, 103 bp, Artificial Sequence
  Synthetic Polynucleotide
taatacgactcactatagggctgctgctcgggagaaaagtgcaggtagtcaacagaggagagactacatgcacttttctaacctggcggcagcgcaaaagatg

SEQ ID NO: 136305 - DNA, 103 bp, Artificial Sequence
  Synthetic Polynucleotide
taatacgactcactatagggcgggtttgtactgctgctcgggagaaaagtaacagaggagaacttttatgccgagcagcaacctggcggcagcgcaaaagatg

SEQ ID NO: 136306 - DNA, 103 bp, Artificial Sequence
  Synthetic Polynucleotide
taatacgactcactatagggctgctgctgtcgggtttgtactgctgctcgaacagaggagacgagcaatggtacaaaccaacctggcggcagcgcaaaagatg

SEQ ID NO: 136307 - DNA, 103 bp, Artificial Sequence
  Synthetic Polynucleotide
taatacgactcactataggggccctgcccgctgctgctgtcgggtttgtaaacagaggagatacaaaatggacagcagcaacctggcggcagcgcaaaagatg

SEQ ID NO: 136308 - DNA, 103 bp, Artificial Sequence
  Synthetic Polynucleotide
taatacgactcactatagggggagtgctttgccctgcccgctgctgctgtaacagaggagaacagcaatggcgggcaggaacctggcggcagcgcaaaagatg

SEQ ID NO: 136309 - DNA, 103 bp, Artificial Sequence
  Synthetic Polynucleotide
taatacgactcactatagggccttcgtcatggagtgctttgccctgcccgaacagaggagacgggcaatgcaaagcactaacctggcggcagcgcaaaagatg

SEQ ID NO: 136310 - DNA, 103 bp, Artificial Sequence
  Synthetic Polynucleotide
taatacgactcactatagggccggtcggcgccttcgtcatggagtgctttaacagaggagaaaagcaatgcatgacgaaaacctggcggcagcgcaaaagatg

SEQ ID NO: 136311 - DNA, 103 bp, Artificial Sequence
  Synthetic Polynucleotide
taatacgactcactatagggtcgtgtacttccggtcggcgccttcgtcataacagaggagaatgacgatggcgccgaccaacctggcggcagcgcaaaagatg

SEQ ID NO: 136312 - DNA, 103 bp, Artificial Sequence
  Synthetic Polynucleotide
taatacgactcactatagggtaaaccgggctcgtgtacttccggtcggcgaacagaggagacgccgaatggaagtacacaacctggcggcagcgcaaaagatg

SEQ ID NO: 136313 - DNA, 103 bp, Artificial Sequence
  Synthetic Polynucleotide
taatacgactcactatagggggagtcctggccgctgggaaggctcccgggaacagaggagacccgggatgcttcccagcaacctggcggcagcgcaaaagatg

SEQ ID NO: 136314 - DNA, 103 bp, Artificial Sequence
  Synthetic Polynucleotide
taatacgactcactatagggcatccaagggtaaaccgggctcgtgtacttaacagaggagaaagtacatgagcccggttaacctggcggcagcgcaaaagatg

SEQ ID NO: 136315 - DNA, 103 bp, Artificial Sequence
  Synthetic Polynucleotide
taatacgactcactatagggtcatccgctgcatccaagggtaaaccgggcaacagaggagagcccggatgacccttggaaacctggcggcagcgcaaaagatg

SEQ ID NO: 136316 - DNA, 103 bp, Artificial Sequence
  Synthetic Polynucleotide
taatacgactcactataggggcgcaggagttcatccgctgcatccaagggaacagaggagacccttgatggcagcggataacctggcggcagcgcaaaagatg

SEQ ID NO: 136317 - DNA, 103 bp, Artificial Sequence
  Synthetic Polynucleotide
taatacgactcactatagggcacagcacccgcgcaggagttcatccgctgaacagaggagacagcggatgaactcctgcaacctggcggcagcgcaaaagatg

SEQ ID NO: 136318 - DNA, 103 bp, Artificial Sequence
  Synthetic Polynucleotide
taatacgactcactatagggggctcccatacacagcacccgcgcaggagtaacagaggagaactcctatgcgggtgctgaacctggcggcagcgcaaaagatg

SEQ ID NO: 136319 - DNA, 103 bp, Artificial Sequence
  Synthetic Polynucleotide
taatacgactcactatagggcggcgcccatggctcccatacacagcacccaacagaggagagggtgcatggtatgggagaacctggcggcagcgcaaaagatg

SEQ ID NO: 136320 - DNA, 103 bp, Artificial Sequence
  Synthetic Polynucleotide
taatacgactcactatagggctggcggcctcggcgcccatggctcccataaacagaggagatatgggatgcatgggcgcaacctggcggcagcgcaaaagatg

SEQ ID NO: 136321 - DNA, 103 bp, Artificial Sequence
  Synthetic Polynucleotide
taatacgactcactataggggcgtgtaggtctggcggcctcggcgcccataacagaggagaatgggcatggaggccgccaacctggcggcagcgcaaaagatg

SEQ ID NO: 136322 - DNA, 103 bp, Artificial Sequence
  Synthetic Polynucleotide
taatacgactcactataggggtctggtagcgcgtgtaggtctggcggcctaacagaggagaaggccgatggacctacacaacctggcggcagcgcaaaagatg

SEQ ID NO: 136323 - DNA, 103 bp, Artificial Sequence
  Synthetic Polynucleotide
taatacgactcactatagggcagctccagtgtctggtagcgcgtgtaggtaacagaggagaacctacatgcgctaccagaacctggcggcagcgcaaaagatg

SEQ ID NO: 136324 - DNA, 103 bp, Artificial Sequence
  Synthetic Polynucleotide
taatacgactcactatagggggcccaagaaggagtcctggccgctgggaaaacagaggagattcccaatggccaggactaacctggcggcagcgcaaaagatg

SEQ ID NO: 136325 - DNA, 103 bp, Artificial Sequence
  Synthetic Polynucleotide
taatacgactcactatagggactccttctccagctccagtgtctggtagcaacagaggagagctaccatgcactggagcaacctggcggcagcgcaaaagatg

SEQ ID NO: 136326 - DNA, 103 bp, Artificial Sequence
  Synthetic Polynucleotide
taatacgactcactatagggttgaagtggaactccttctccagctccagtaacagaggagaactggaatgggagaaggaaacctggcggcagcgcaaaagatg

SEQ ID NO: 136327 - DNA, 103 bp, Artificial Sequence
  Synthetic Polynucleotide
taatacgactcactatagggcaggtagcggttgaagtggaactccttctcaacagaggagagagaagatgttccacttcaacctggcggcagcgcaaaagatg

SEQ ID NO: 136328 - DNA, 103 bp, Artificial Sequence
  Synthetic Polynucleotide
taatacgactcactatagggggcgccgtgtcaggtagcggttgaagtggaaacagaggagatccactatgaccgctaccaacctggcggcagcgcaaaagatg

SEQ ID NO: 136329 - DNA, 103 bp, Artificial Sequence
  Synthetic Polynucleotide
taatacgactcactatagggtcgatgcggcggcgccgtgtcaggtagcggaacagaggagaccgctaatggacacggcgaacctggcggcagcgcaaaagatg

SEQ ID NO: 136330 - DNA, 103 bp, Artificial Sequence
  Synthetic Polynucleotide
taatacgactcactataggggttggcgatctcgatgcggcggcgccgtgtaacagaggagaacacggatgcgccgcatcaacctggcggcagcgcaaaagatg

SEQ ID NO: 136331 - DNA, 103 bp, Artificial Sequence
  Synthetic Polynucleotide
taatacgactcactatagggggcagagcgcgttggcgatctcgatgcggcaacagaggagagccgcaatgagatcgccaaacctggcggcagcgcaaaagatg

SEQ ID NO: 136332 - DNA, 103 bp, Artificial Sequence
  Synthetic Polynucleotide
taatacgactcactatagggcgctcggtgaggcagagcgcgttggcgatcaacagaggagagatcgcatgcgcgctctgaacctggcggcagcgcaaaagatg

SEQ ID NO: 136333 - DNA, 103 bp, Artificial Sequence
  Synthetic Polynucleotide
taatacgactcactatagggcttgatctggcgctcggtgaggcagagcgcaacagaggagagcgctcatgctcaccgagaacctggcggcagcgcaaaagatg

SEQ ID NO: 136334 - DNA, 103 bp, Artificial Sequence
  Synthetic Polynucleotide
taatacgactcactatagggggaaccagatcttgatctggcgctcggtgaaacagaggagatcaccgatggccagatcaaacctggcggcagcgcaaaagatg

SEQ ID NO: 136335 - DNA, 103 bp, Artificial Sequence
  Synthetic Polynucleotide
taatacgactcactatagggaggggcagctggcccaagaaggagtcctggaacagaggagaccaggaatgcttcttgggaacctggcggcagcgcaaaagatg

SEQ ID NO: 136336 - DNA, 103 bp, Artificial Sequence
  Synthetic Polynucleotide
taatacgactcactatagggcggcggttctggaaccagatcttgatctggaacagaggagaccagatatggatctggttaacctggcggcagcgcaaaagatg

SEQ ID NO: 136337 - DNA, 103 bp, Artificial Sequence
  Synthetic Polynucleotide
taatacgactcactatagggccacttcatgcggcggttctggaaccagataacagaggagaatctggatgcagaaccgcaacctggcggcagcgcaaaagatg

SEQ ID NO: 136338 - DNA, 103 bp, Artificial Sequence
  Synthetic Polynucleotide
taatacgactcactatagggtttcctttttccacttcatgcggcggttctaacagaggagaagaaccatggcatgaagtaacctggcggcagcgcaaaagatg

SEQ ID NO: 136339 - DNA, 103 bp, Artificial Sequence
  Synthetic Polynucleotide
taatacgactcactatagggatgagcttgttttcctttttccacttcatgaacagaggagacatgaaatggaaaaaggaaacctggcggcagcgcaaaagatg

SEQ ID NO: 136340 - DNA, 103 bp, Artificial Sequence
  Synthetic Polynucleotide
taatacgactcactatagggcgtggaattgatgagcttgttttcctttttaacagaggagaaaaaagatgaacaagctcaacctggcggcagcgcaaaagatg

SEQ ID NO: 136341 - DNA, 103 bp, Artificial Sequence
  Synthetic Polynucleotide
taatacgactcactatagggcgctgggctgcgtggaattgatgagcttgtaacagaggagaacaagcatgtcaattccaaacctggcggcagcgcaaaagatg

SEQ ID NO: 136342 - DNA, 103 bp, Artificial Sequence
  Synthetic Polynucleotide
taatacgactcactataggggagtcctccccgctgggctgcgtggaattgaacagaggagacaattcatggcagcccagaacctggcggcagcgcaaaagatg

SEQ ID NO: 136343 - DNA, 103 bp, Artificial Sequence
  Synthetic Polynucleotide
taatacgactcactatagggctttgcctctgagtcctccccgctgggctgaacagaggagacagcccatgggggaggacaacctggcggcagcgcaaaagatg

SEQ ID NO: 136344 - DNA, 103 bp, Artificial Sequence
  Synthetic Polynucleotide
taatacgactcactatagggactcgcccgcctttgcctctgagtcctcccaacagaggagagggaggatgcagaggcaaaacctggcggcagcgcaaaagatg

SEQ ID NO: 136345 - DNA, 103 bp, Artificial Sequence
  Synthetic Polynucleotide
taatacgactcactatagggagcctggtagaggggcagctggcccaagaaaacagaggagattcttgatgcagctgcccaacctggcggcagcgcaaaagatg

SEQ ID NO: 136346 - DNA, 103 bp, Artificial Sequence
  Synthetic Polynucleotide
taatacgactcactatagggcgtcatagccagcctggtagaggggcagctaacagaggagaagctgcatgtctaccaggaacctggcggcagcgcaaaagatg

SEQ ID NO: 136347 - DNA, 103 bp, Artificial Sequence
  Synthetic Polynucleotide
taatacgactcactatagggggcctcagcgcgtcatagccagcctggtagaacagaggagactaccaatgtggctatgaaacctggcggcagcgcaaaagatg

SEQ ID NO: 136348 - DNA, 103 bp, Artificial Sequence
  Synthetic Polynucleotide
taatacgactcactatagggaagcgcgttcacataatacgaagaactcataacagaggagaatgagtatgtcgtattataacctggcggcagcgcaaaagatg

SEQ ID NO: 136349 - DNA, 103 bp, Artificial Sequence
  Synthetic Polynucleotide
taatacgactcactataggggtagccgcttctctgtgagttgggagcaaaaacagaggagatttgctatgaactcacagaacctggcggcagcgcaaaagatg

SEQ ID NO: 136350 - DNA, 103 bp, Artificial Sequence
  Synthetic Polynucleotide
taatacgactcactatagggcgcccgccccgtagccgcttctctgtgagtaacagaggagaactcacatggaagcggctaacctggcggcagcgcaaaagatg

SEQ ID NO: 136351 - DNA, 103 bp, Artificial Sequence
  Synthetic Polynucleotide
taatacgactcactatagggaaggcgccggcgcccgccccgtagccgcttaacagaggagaaagcggatgcggggcgggaacctggcggcagcgcaaaagatg

SEQ ID NO: 136352 - DNA, 103 bp, Artificial Sequence
  Synthetic Polynucleotide
taatacgactcactatagggggtcgaggcgaaggcgccggcgcccgccccaacagaggagaggggcgatggccggcgccaacctggcggcagcgcaaaagatg

SEQ ID NO: 136353 - DNA, 103 bp, Artificial Sequence
  Synthetic Polynucleotide
taatacgactcactatagggagcccggaacggtcgaggcgaaggcgccggaacagaggagaccggcgatgtcgcctcgaaacctggcggcagcgcaaaagatg

SEQ ID NO: 136354 - DNA, 103 bp, Artificial Sequence
  Synthetic Polynucleotide
taatacgactcactatagggacattgtataagcccggaacggtcgaggcgaacagaggagacgcctcatgcgttccgggaacctggcggcagcgcaaaagatg

SEQ ID NO: 136355 - DNA, 103 bp, Artificial Sequence
  Synthetic Polynucleotide
taatacgactcactatagggggggctgttgacattgtataagcccggaacaacagaggagagttccgatgttatacaataacctggcggcagcgcaaaagatg

SEQ ID NO: 136356 - DNA, 103 bp, Artificial Sequence
  Synthetic Polynucleotide
taatacgactcactatagggtctgataaagggggctgttgacattgtataaacagaggagatatacaatgtcaacagccaacctggcggcagcgcaaaagatg

SEQ ID NO: 136357 - DNA, 103 bp, Artificial Sequence
  Synthetic Polynucleotide
taatacgactcactataggggcaaaggggctctgataaagggggctgttgaacagaggagacaacagatgcctttatcaaacctggcggcagcgcaaaagatg

SEQ ID NO: 136358 - DNA, 103 bp, Artificial Sequence
  Synthetic Polynucleotide
taatacgactcactataggggtagccggacgcaaaggggctctgataaagaacagaggagactttatatgagcccctttaacctggcggcagcgcaaaagatg

SEQ ID NO: 136359 - DNA, 103 bp, Artificial Sequence
  Synthetic Polynucleotide
taatacgactcactatagggatttgctaaaaagcgcgttcacataatacgaacagaggagacgtattatgtgaacgcgcaacctggcggcagcgcaaaagatg

SEQ ID NO: 136360 - DNA, 103 bp, Artificial Sequence
  Synthetic Polynucleotide
taatacgactcactatagggcgcccaggccgtagccggacgcaaaggggcaacagaggagagcccctatgcgtccggctaacctggcggcagcgcaaaagatg

SEQ ID NO: 136361 - DNA, 103 bp, Artificial Sequence
  Synthetic Polynucleotide
taatacgactcactatagggtaggcgtcggcgcccaggccgtagccggacaacagaggagagtccggatgcggcctgggaacctggcggcagcgcaaaagatg

SEQ ID NO: 136362 - DNA, 103 bp, Artificial Sequence
  Synthetic Polynucleotide
taatacgactcactatagggcaggttgccgtaggcgtcggcgcccaggccaacagaggagaggcctgatggccgacgccaacctggcggcagcgcaaaagatg

SEQ ID NO: 136363 - DNA, 103 bp, Artificial Sequence
  Synthetic Polynucleotide
taatacgactcactatagggaggcgcagggcaggttgccgtaggcgtcggaacagaggagaccgacgatgacggcaaccaacctggcggcagcgcaaaagatg

SEQ ID NO: 136364 - DNA, 103 bp, Artificial Sequence
  Synthetic Polynucleotide
taatacgactcactatagggtggtcgtaggaggcgcagggcaggttgccgaacagaggagacggcaaatggccctgcgcaacctggcggcagcgcaaaagatg

SEQ ID NO: 136365 - DNA, 103 bp, Artificial Sequence
  Synthetic Polynucleotide
taatacgactcactatagggggggatgttttggtcgtaggaggcgcagggaacagaggagaccctgcatgtcctacgacaacctggcggcagcgcaaaagatg

SEQ ID NO: 136366 - DNA, 103 bp, Artificial Sequence
  Synthetic Polynucleotide
taatacgactcactatagggtgcagagcccggggatgttttggtcgtaggaacagaggagacctacgatgaaaacatccaacctggcggcagcgcaaaagatg

SEQ ID NO: 136367 - DNA, 103 bp, Artificial Sequence
  Synthetic Polynucleotide
taatacgactcactataggggcgaggtcactgcagagcccggggatgtttaacagaggagaaaacatatgcgggctctgaacctggcggcagcgcaaaagatg

SEQ ID NO: 136368 - DNA, 103 bp, Artificial Sequence
  Synthetic Polynucleotide
taatacgactcactatagggggcgcctttggcgaggtcactgcagagcccaacagaggagagggctcatgagtgacctcaacctggcggcagcgcaaaagatg

SEQ ID NO: 136369 - DNA, 103 bp, Artificial Sequence
  Synthetic Polynucleotide
taatacgactcactatagggtcttgtcgcaggcgcctttggcgaggtcacaacagaggagagtgaccatgccaaaggcgaacctggcggcagcgcaaaagatg

SEQ ID NO: 136370 - DNA, 103 bp, Artificial Sequence
  Synthetic Polynucleotide
taatacgactcactatagggcccgccgtatatttgctaaaaagcgcgttcaacagaggagagaacgcatgttttagcaaaacctggcggcagcgcaaaagatg

SEQ ID NO: 136371 - DNA, 103 bp, Artificial Sequence
  Synthetic Polynucleotide
taatacgactcactatagggccctcgtccgtcttgtcgcaggcgcctttgaacagaggagacaaaggatgctgcgacaaaacctggcggcagcgcaaaagatg

SEQ ID NO: 136372 - DNA, 103 bp, Artificial Sequence
  Synthetic Polynucleotide
taatacgactcactatagggatgcagcgcgccctcgtccgtcttgtcgcaaacagaggagatgcgacatgacggacgagaacctggcggcagcgcaaaagatg

SEQ ID NO: 136373 - DNA, 103 bp, Artificial Sequence
  Synthetic Polynucleotide
taatacgactcactatagggcagccgcgccatgcagcgcgccctcgtccgaacagaggagacggacgatggcgcgctgcaacctggcggcagcgcaaaagatg

SEQ ID NO: 136374 - DNA, 103 bp, Artificial Sequence
  Synthetic Polynucleotide
taatacgactcactatagggaaattggcctcagccgcgccatgcagcgcgaacagaggagacgcgctatgtggcgcggcaacctggcggcagcgcaaaagatg

SEQ ID NO: 136375 - DNA, 103 bp, Artificial Sequence
  Synthetic Polynucleotide
taatacgactcactataggggtagatgcggaaattggcctcagccgcgccaacagaggagaggcgcgatggaggccaataacctggcggcagcgcaaaagatg

SEQ ID NO: 136376 - DNA, 103 bp, Artificial Sequence
  Synthetic Polynucleotide
taatacgactcactataggggcatccaggggtagatgcggaaattggcctaacagaggagaaggccaatgtccgcatctaacctggcggcagcgcaaaagatg

SEQ ID NO: 136377 - DNA, 103 bp, Artificial Sequence
  Synthetic Polynucleotide
taatacgactcactatagggcctgaagaccgcatccaggggtagatgcggaacagaggagaccgcatatgcccctggataacctggcggcagcgcaaaagatg

SEQ ID NO: 136378 - DNA, 103 bp, Artificial Sequence
  Synthetic Polynucleotide
taatacgactcactatagggcctgtcaggtcctgaagaccgcatccagggaacagaggagaccctggatgcggtcttcaaacctggcggcagcgcaaaagatg

SEQ ID NO: 136379 - DNA, 103 bp, Artificial Sequence
  Synthetic Polynucleotide
taatacgactcactatagggggccccgcttcctgtcaggtcctgaagaccaacagaggagaggtcttatggacctgacaaacctggcggcagcgcaaaagatg

SEQ ID NO: 136380 - DNA, 103 bp, Artificial Sequence
  Synthetic Polynucleotide
taatacgactcactatagggtaggtctggcggccccgcttcctgtcaggtaacagaggagaacctgaatggaagcggggaacctggcggcagcgcaaaagatg

SEQ ID NO: 136381 - DNA, 103 bp, Artificial Sequence
  Synthetic Polynucleotide
taatacgactcactatagggcagagaagcccccgccgtatatttgctaaaaacagaggagatttagcatgtatacggcgaacctggcggcagcgcaaaagatg

SEQ ID NO: 136382 - DNA, 103 bp, Artificial Sequence
  Synthetic Polynucleotide
taatacgactcactataggggtagcgcgtgtaggtctggcggccccgcttaacagaggagaaagcggatgcgccagaccaacctggcggcagcgcaaaagatg

SEQ ID NO: 136383 - DNA, 103 bp, Artificial Sequence
  Synthetic Polynucleotide
taatacgactcactatagggccagcgtctggtagcgcgtgtaggtctggcaacagaggagagccagaatgacacgcgctaacctggcggcagcgcaaaagatg

SEQ ID NO: 136384 - DNA, 103 bp, Artificial Sequence
  Synthetic Polynucleotide
taatacgactcactatagggttctccagctccagcgtctggtagcgcgtgaacagaggagacacgcgatgccagacgctaacctggcggcagcgcaaaagatg

SEQ ID NO: 136385 - DNA, 103 bp, Artificial Sequence
  Synthetic Polynucleotide
taatacgactcactataggggtggaactccttctccagctccagcgtctgaacagaggagacagacgatggagctggagaacctggcggcagcgcaaaagatg

SEQ ID NO: 136386 - DNA, 103 bp, Artificial Sequence
  Synthetic Polynucleotide
taatacgactcactatagggagcggttgaagtggaactccttctccagctaacagaggagaagctggatgaggagttccaacctggcggcagcgcaaaagatg

SEQ ID NO: 136387 - DNA, 103 bp, Artificial Sequence
  Synthetic Polynucleotide
taatacgactcactatagggcgcgtcaggtagcggttgaagtggaactccaacagaggagaggagttatgcttcaaccgaacctggcggcagcgcaaaagatg

SEQ ID NO: 136388 - DNA, 103 bp, Artificial Sequence
  Synthetic Polynucleotide
taatacgactcactataggggcggcggcgccgcgtcaggtagcggttgaaaacagaggagattcaacatgtacctgacgaacctggcggcagcgcaaaagatg

SEQ ID NO: 136389 - DNA, 103 bp, Artificial Sequence
  Synthetic Polynucleotide
taatacgactcactatagggcgatttcaatgcggcggcgccgcgtcaggtaacagaggagaacctgaatgggcgccgccaacctggcggcagcgcaaaagatg

SEQ ID NO: 136390 - DNA, 103 bp, Artificial Sequence
  Synthetic Polynucleotide
taatacgactcactatagggagcgcgtgggcgatttcaatgcggcggcgcaacagaggagagcgccgatgcattgaaataacctggcggcagcgcaaaagatg

SEQ ID NO: 136391 - DNA, 103 bp, Artificial Sequence
  Synthetic Polynucleotide
taatacgactcactatagggggtgaggcagagcgcgtgggcgatttcaataacagaggagaattgaaatggcccacgcgaacctggcggcagcgcaaaagatg

SEQ ID NO: 136392 - DNA, 103 bp, Artificial Sequence
  Synthetic Polynucleotide
taatacgactcactatagggcattttggaacagagaagcccccgccgtataacagaggagaatacggatggggcttctcaacctggcggcagcgcaaaagatg

SEQ ID NO: 136393 - DNA, 103 bp, Artificial Sequence
  Synthetic Polynucleotide
taatacgactcactatagggtctggcgctcggtgaggcagagcgcgtgggaacagaggagacccacgatgtctgcctcaaacctggcggcagcgcaaaagatg

SEQ ID NO: 136394 - DNA, 103 bp, Artificial Sequence
  Synthetic Polynucleotide
taatacgactcactatagggcagatcttaatctggcgctcggtgaggcagaacagaggagactgcctatgcgagcgccaaacctggcggcagcgcaaaagatg

SEQ ID NO: 136395 - DNA, 103 bp, Artificial Sequence
  Synthetic Polynucleotide
taatacgactcactataggggttctggaaccagatcttaatctggcgctcaacagaggagagagcgcatgattaagatcaacctggcggcagcgcaaaagatg

SEQ ID NO: 136396 - DNA, 103 bp, Artificial Sequence
  Synthetic Polynucleotide
taatacgactcactatagggtcatgcggcggttctggaaccagatcttaaaacagaggagattaagaatgggttccagaaacctggcggcagcgcaaaagatg

SEQ ID NO: 136397 - DNA, 103 bp, Artificial Sequence
  Synthetic Polynucleotide
taatacgactcactatagggttcttccacttcatgcggcggttctggaacaacagaggagagttccaatgccgccgcataacctggcggcagcgcaaaagatg

SEQ ID NO: 136398 - DNA, 103 bp, Artificial Sequence
  Synthetic Polynucleotide
taatacgactcactatagggcttatgctctttcttccacttcatgcggcgaacagaggagacgccgcatgaagtggaagaacctggcggcagcgcaaaagatg

SEQ ID NO: 136399 - DNA, 103 bp, Artificial Sequence
  Synthetic Polynucleotide
taatacgactcactataggggaccttcgtccttatgctctttcttccactaacagaggagaagtggaatgaagagcataaacctggcggcagcgcaaaagatg

SEQ ID NO: 136400 - DNA, 103 bp, Artificial Sequence
  Synthetic Polynucleotide
taatacgactcactataggggcggcagtcggaccttcgtccttatgctctaacagaggagaagagcaatgggacgaaggaacctggcggcagcgcaaaagatg

SEQ ID NO: 136401 - DNA, 103 bp, Artificial Sequence
  Synthetic Polynucleotide
taatacgactcactataggggggagctgcggcggcagtcggaccttcgtcaacagaggagagacgaaatgccgactgccaacctggcggcagcgcaaaagatg

SEQ ID NO: 136402 - DNA, 103 bp, Artificial Sequence
  Synthetic Polynucleotide
taatacgactcactatagggcggcgccctcgggagctgcggcggcagtcgaacagaggagacgactgatgccgcagctcaacctggcggcagcgcaaaagatg

SEQ ID NO: 136403 - DNA, 103 bp, Artificial Sequence
  Synthetic Polynucleotide
taatacgactcactataggggtcggctcggcattttggaacagagaagccaacagaggagaggcttcatggttccaaaaaacctggcggcagcgcaaaagatg

SEQ ID NO: 136404 - DNA, 103 bp, Artificial Sequence
  Synthetic Polynucleotide
taatacgactcactataggggcagagggcacggcgccctcgggagctgcgaacagaggagacgcagcatgcgagggcgcaacctggcggcagcgcaaaagatg

SEQ ID NO: 136405 - DNA, 103 bp, Artificial Sequence
  Synthetic Polynucleotide
taatacgactcactatagggagtggcggcggcagagggcacggcgccctcaacagaggagagagggcatggtgccctctaacctggcggcagcgcaaaagatg

SEQ ID NO: 136406 - DNA, 103 bp, Artificial Sequence
  Synthetic Polynucleotide
taatacgactcactatagggccgcggcagcagtggcggcggcagagggcaaacagaggagatgccctatgccgccgccaaacctggcggcagcgcaaaagatg

SEQ ID NO: 136407 - DNA, 103 bp, Artificial Sequence
  Synthetic Polynucleotide
taatacgactcactatagggtcggccttgtccgcggcagcagtggcggcgaacagaggagacgccgcatgtgctgccgcaacctggcggcagcgcaaaagatg

SEQ ID NO: 136408 - DNA, 103 bp, Artificial Sequence
  Synthetic Polynucleotide
taatacgactcactataggggtcctcctcgtcggccttgtccgcggcagcaacagaggagagctgccatggacaaggccaacctggcggcagcgcaaaagatg

SEQ ID NO: 136409 - DNA, 103 bp, Artificial Sequence
  Synthetic Polynucleotide
taatacgactcactatagggcttcatcatcgtcctcctcgtcggccttgtaacagaggagaacaaggatgacgaggaggaacctggcggcagcgcaaaagatg

SEQ ID NO: 136410 - DNA, 103 bp, Artificial Sequence
  Synthetic Polynucleotide
taatacgactcactatagggtcttcctcttcttcatcatcgtcctcctcgaacagaggagacgaggaatgcgatgatgaaacctggcggcagcgcaaaagatg

SEQ ID NO: 136411 - DNA, 103 bp, Artificial Sequence
  Synthetic Polynucleotide
taatacgactcactatagggttcctcctcgtcttcctcttcttcatcatcaacagaggagagatgatatggaagaggaaaacctggcggcagcgcaaaagatg

SEQ ID NO: 136412 - DNA, 103 bp, Artificial Sequence
  Synthetic Polynucleotide
taatacgactcactatagggggagcaagaagtcggctcggcattttggaaaacagaggagattccaaatggccgagccgaacctggcggcagcgcaaaagatg

SEQ ID NO: 136413 - DNA, 103 bp, Artificial Sequence
  Synthetic Polynucleotide
taatacgactcactatagggtgggagcaaaggagcaagaagtcggctcggaacagaggagaccgagcatgcttcttgctaacctggcggcagcgcaaaagatg

SEQ ID NO: 136414 - DNA, 103 bp, Artificial Sequence
  Synthetic Polynucleotide
taatacgactcactatagggctctgtgagttgggagcaaaggagcaagaaaacagaggagattcttgatgctttgctccaacctggcggcagcgcaaaagatg

SEQ ID NO: 136415 - DNA, 103 bp, Artificial Sequence
  Synthetic Polynucleotide
taatacgactcactataggggtagttgcccagggccccagtggtggccataacagaggagaatggccatgactggggccaacctggcggcagcgcaaaagatg

SEQ ID NO: 136416 - DNA, 103 bp, Artificial Sequence
  Synthetic Polynucleotide
taatacgactcactatagggccggggaggctggcccagggtccccggcgcaacagaggagagcgccgatgaccctgggcaacctggcggcagcgcaaaagatg

SEQ ID NO: 136417 - DNA, 103 bp, Artificial Sequence
  Synthetic Polynucleotide
taatacgactcactatagggtcgccgcctgccggggaggctggcccagggaacagaggagaccctggatgagcctccccaacctggcggcagcgcaaaagatg

SEQ ID NO: 136418 - DNA, 103 bp, Artificial Sequence
  Synthetic Polynucleotide
taatacgactcactatagggtcggccagcgtcgccgcctgccggggaggcaacagaggagagcctccatggcaggcggcaacctggcggcagcgcaaaagatg

SEQ ID NO: 136419 - DNA, 103 bp, Artificial Sequence
  Synthetic Polynucleotide
taatacgactcactataggggtcggggtgctcggccagcgtcgccgcctgaacagaggagacaggcgatgacgctggccaacctggcggcagcgcaaaagatg

SEQ ID NO: 136420 - DNA, 103 bp, Artificial Sequence
  Synthetic Polynucleotide
taatacgactcactatagggacgggctgaagtcggggtgctcggccagcgaacagaggagacgctggatgagcaccccgaacctggcggcagcgcaaaagatg

SEQ ID NO: 136421 - DNA, 103 bp, Artificial Sequence
  Synthetic Polynucleotide
taatacgactcactatagggtggaagctgcacgggctgaagtcggggtgcaacagaggagagcacccatgcttcagcccaacctggcggcagcgcaaaagatg

SEQ ID NO: 136422 - DNA, 103 bp, Artificial Sequence
  Synthetic Polynucleotide
taatacgactcactatagggcgccttggactggaagctgcacgggctgaaaacagaggagattcagcatgtgcagcttcaacctggcggcagcgcaaaagatg

SEQ ID NO: 136423 - DNA, 103 bp, Artificial Sequence
  Synthetic Polynucleotide
taatacgactcactatagggcaaacaccgtcgccttggactggaagctgcaacagaggagagcagctatgagtccaaggaacctggcggcagcgcaaaagatg

SEQ ID NO: 136424 - DNA, 103 bp, Artificial Sequence
  Synthetic Polynucleotide
taatacgactcactatagggcacgaggcgccaaacaccgtcgccttggacaacagaggagagtccaaatggacggtgttaacctggcggcagcgcaaaagatg

SEQ ID NO: 136425 - DNA, 103 bp, Artificial Sequence
  Synthetic Polynucleotide
taatacgactcactatagggcactgggttccacgaggcgccaaacaccgtaacagaggagaacggtgatgggcgcctcgaacctggcggcagcgcaaaagatg

SEQ ID NO: 136426 - DNA, 103 bp, Artificial Sequence
  Synthetic Polynucleotide
taatacgactcactatagggagtccacgtagtagttgcccagggccccagaacagaggagactggggatgtgggcaactaacctggcggcagcgcaaaagatg

SEQ ID NO: 136427 - DNA, 103 bp, Artificial Sequence
  Synthetic Polynucleotide
taatacgactcactatagggccgccgcgtgcactgggttccacgaggcgcaacagaggagagcgcctatgggaacccagaacctggcggcagcgcaaaagatg

SEQ ID NO: 136428 - DNA, 103 bp, Artificial Sequence
  Synthetic Polynucleotide
taatacgactcactataggggcgttggcgcccgccgcgtgcactgggttcaacagaggagagaacccatggcacgcggcaacctggcggcagcgcaaaagatg

SEQ ID NO: 136429 - DNA, 103 bp, Artificial Sequence
  Synthetic Polynucleotide
taatacgactcactatagggagcgggtacagcgttggcgcccgccgcgtgaacagaggagacacgcgatgggcgccaacaacctggcggcagcgcaaaagatg

SEQ ID NO: 136430 - DNA, 103 bp, Artificial Sequence
  Synthetic Polynucleotide
taatacgactcactatagggggtacaccgcagcgggtacagcgttggcgcaacagaggagagcgccaatgctgtacccgaacctggcggcagcgcaaaagatg

SEQ ID NO: 136431 - DNA, 103 bp, Artificial Sequence
  Synthetic Polynucleotide
taatacgactcactatagggtgatggtggtggtacaccgcagcgggtacaaacagaggagatgtaccatgtgcggtgtaaacctggcggcagcgcaaaagatg

SEQ ID NO: 136432 - DNA, 103 bp, Artificial Sequence
  Synthetic Polynucleotide
taatacgactcactatagggggggtggtggtgatggtggtggtacaccgcaacagaggagagcggtgatgcaccaccataacctggcggcagcgcaaaagatg

SEQ ID NO: 136433 - DNA, 103 bp, Artificial Sequence
  Synthetic Polynucleotide
taatacgactcactatagggggtgcacgtaggggtggtggtgatggtggtaacagaggagaaccaccatgaccaccaccaacctggcggcagcgcaaaagatg

SEQ ID NO: 136434 - DNA, 103 bp, Artificial Sequence
  Synthetic Polynucleotide
taatacgactcactatagggggcgcctgggggtgcacgtaggggtggtggaacagaggagaccaccaatgctacgtgcaaacctggcggcagcgcaaaagatg

SEQ ID NO: 136435 - DNA, 103 bp, Artificial Sequence
  Synthetic Polynucleotide
taatacgactcactatagggcgccgccacgggcgcctgggggtgcacgtaaacagaggagatacgtgatgccccaggcgaacctggcggcagcgcaaaagatg

SEQ ID NO: 136436 - DNA, 103 bp, Artificial Sequence
  Synthetic Polynucleotide
taatacgactcactatagggccggcgccgccgccgccacgggcgcctgggaacagaggagacccaggatgccgtggcggaacctggcggcagcgcaaaagatg

SEQ ID NO: 136437 - DNA, 103 bp, Artificial Sequence
  Synthetic Polynucleotide
taatacgactcactatagggagcaggaacgagtccacgtagtagttgcccaacagaggagagggcaaatgctacgtggaaacctggcggcagcgcaaaagatg

SEQ ID NO: 136438 - DNA, 103 bp, Artificial Sequence
  Synthetic Polynucleotide
taatacgactcactatagggtacctgccgtccggcgccgccgccgccacgaacagaggagacgtggcatgggcggcgccaacctggcggcagcgcaaaagatg

SEQ ID NO: 136439 - DNA, 103 bp, Artificial Sequence
  Synthetic Polynucleotide
taatacgactcactatagggggagcgcatgtacctgccgtccggcgccgcaacagaggagagcggcgatggacggcaggaacctggcggcagcgcaaaagatg

SEQ ID NO: 136440 - DNA, 103 bp, Artificial Sequence
  Synthetic Polynucleotide
taatacgactcactataggggctccagccaggagcgcatgtacctgccgtaacagaggagaacggcaatgacatgcgctaacctggcggcagcgcaaaagatg

SEQ ID NO: 136441 - DNA, 103 bp, Artificial Sequence
  Synthetic Polynucleotide
taatacgactcactatagggccgggcgtgggctccagccaggagcgcatgaacagaggagacatgcgatgctggctggaaacctggcggcagcgcaaaagatg

SEQ ID NO: 136442 - DNA, 103 bp, Artificial Sequence
  Synthetic Polynucleotide
taatacgactcactatagggggagagcgcaccgggcgtgggctccagccaaacagaggagatggctgatgcccacgcccaacctggcggcagcgcaaaagatg

SEQ ID NO: 136443 - DNA, 103 bp, Artificial Sequence
  Synthetic Polynucleotide
taatacgactcactatagggagcccgcgaaggagagcgcaccgggcgtggaacagaggagaccacgcatggtgcgctctaacctggcggcagcgcaaaagatg

SEQ ID NO: 136444 - DNA, 103 bp, Artificial Sequence
  Synthetic Polynucleotide
taatacgactcactatagggctggagggcaagcccgcgaaggagagcgcaaacagaggagatgcgctatgcttcgcgggaacctggcggcagcgcaaaagatg

SEQ ID NO: 136445 - DNA, 103 bp, Artificial Sequence
  Synthetic Polynucleotide
taatacgactcactatagggataaggccggctggagggcaagcccgcgaaaacagaggagattcgcgatgttgccctccaacctggcggcagcgcaaaagatg

SEQ ID NO: 136446 - DNA, 103 bp, Artificial Sequence
  Synthetic Polynucleotide
taatacgactcactataggggtttaatgccataaggccggctggagggcaaacagaggagatgccctatggccggccttaacctggcggcagcgcaaaagatg

SEQ ID NO: 136447 - DNA, 103 bp, Artificial Sequence
  Synthetic Polynucleotide
taatacgactcactatagggagcggttcaggtttaatgccataaggccggaacagaggagaccggccatgtggcattaaaacctggcggcagcgcaaaagatg

SEQ ID NO: 136448 - DNA, 103 bp, Artificial Sequence
  Synthetic Polynucleotide
taatacgactcactataggggtcggcgcccagcaggaacgagtccacgtaaacagaggagatacgtgatgtcgttcctgaacctggcggcagcgcaaaagatg

SEQ ID NO: 136449 - DNA, 103 bp, Artificial Sequence
  Synthetic Polynucleotide
taatacgactcactatagggtctggccgacagcggttcaggtttaatgccaacagaggagaggcattatgcctgaaccgaacctggcggcagcgcaaaagatg

SEQ ID NO: 136450 - DNA, 103 bp, Artificial Sequence
  Synthetic Polynucleotide
taatacgactcactatagggagtcaccccttctggccgacagcggttcagaacagaggagactgaacatgtgtcggccaaacctggcggcagcgcaaaagatg

SEQ ID NO: 136451 - DNA, 103 bp, Artificial Sequence
  Synthetic Polynucleotide
taatacgactcactatagggagcgtgggacagtcaccccttctggccgacaacagaggagagtcggcatgaaggggtgaaacctggcggcagcgcaaaagatg

SEQ ID NO: 136452 - DNA, 103 bp, Artificial Sequence
  Synthetic Polynucleotide
taatacgactcactataggggtgagtgtcaagcgtgggacagtcacccctaacagaggagaaggggtatgtgtcccacgaacctggcggcagcgcaaaagatg

SEQ ID NO: 136453 - DNA, 103 bp, Artificial Sequence
  Synthetic Polynucleotide
taatacgactcactataggggggacaaagtgtgagtgtcaagcgtgggacaacagaggagagtcccaatgttgacactcaacctggcggcagcgcaaaagatg

SEQ ID NO: 136454 - DNA, 103 bp, Artificial Sequence
  Synthetic Polynucleotide
taatacgactcactatagggtagtcagtcagggacaaagtgtgagtgtcaaacagaggagatgacacatgcactttgtcaacctggcggcagcgcaaaagatg

SEQ ID NO: 136455 - DNA, 103 bp, Artificial Sequence
  Synthetic Polynucleotide
taatacgactcactatagggaccacaagcatagtcagtcagggacaaagtaacagaggagaactttgatgctgactgacaacctggcggcagcgcaaaagatg

SEQ ID NO: 136456 - DNA, 103 bp, Artificial Sequence
  Synthetic Polynucleotide
taatacgactcactatagggctggaggagaaccacaagcatagtcagtcaaacagaggagatgactgatgatgcttgtgaacctggcggcagcgcaaaagatg

SEQ ID NO: 136457 - DNA, 103 bp, Artificial Sequence
  Synthetic Polynucleotide
taatacgactcactatagggtctctatcaactggaggagaaccacaagcaaacagaggagatgcttgatgttctcctccaacctggcggcagcgcaaaagatg

SEQ ID NO: 136458 - DNA, 103 bp, Artificial Sequence
  Synthetic Polynucleotide
taatacgactcactataggggggttgtttttctctatcaactggaggagaaacagaggagatctcctatggttgatagaaacctggcggcagcgcaaaagatg

SEQ ID NO: 136459 - DNA, 103 bp, Artificial Sequence
  Synthetic Polynucleotide
taatacgactcactatagggcatccgcggcgtcggcgcccagcaggaacgaacagaggagacgttccatgtgggcgccgaacctggcggcagcgcaaaagatg

SEQ ID NO: 136460 - DNA, 103 bp, Artificial Sequence
  Synthetic Polynucleotide
taatacgactcactatagggcgccttcgctgggttgtttttctctatcaaaacagaggagattgataatgaaaaacaacaacctggcggcagcgcaaaagatg

SEQ ID NO: 136461 - DNA, 103 bp, Artificial Sequence
  Synthetic Polynucleotide
taatacgactcactatagggtcagagaaggcgccttcgctgggttgttttaacagaggagaaaaacaatgcagcgaaggaacctggcggcagcgcaaaagatg

SEQ ID NO: 136462 - DNA, 103 bp, Artificial Sequence
  Synthetic Polynucleotide
taatacgactcactatagggagcattgttttcagagaaggcgccttcgctaacagaggagaagcgaaatggccttctctaacctggcggcagcgcaaaagatg

SEQ ID NO: 136463 - DNA, 103 bp, Artificial Sequence
  Synthetic Polynucleotide
taatacgactcactatagggtctcattctcagcattgttttcagagaaggaacagaggagaccttctatgaaaacaatgaacctggcggcagcgcaaaagatg

SEQ ID NO: 136464 - DNA, 103 bp, Artificial Sequence
  Synthetic Polynucleotide
taatacgactcactatagggtctccgccgctctcattctcagcattgtttaacagaggagaaaacaaatgtgagaatgaaacctggcggcagcgcaaaagatg

SEQ ID NO: 136465 - DNA, 103 bp, Artificial Sequence
  Synthetic Polynucleotide
taatacgactcactatagggggggggcttgtctccgccgctctcattctcaacagaggagagagaatatgagcggcggaaacctggcggcagcgcaaaagatg

SEQ ID NO: 136466 - DNA, 103 bp, Artificial Sequence
  Synthetic Polynucleotide
taatacgactcactatagggtgggatcgatggggggcttgtctccgccgcaacagaggagagcggcgatgacaagccccaacctggcggcagcgcaaaagatg

SEQ ID NO: 136467 - DNA, 103 bp, Artificial Sequence
  Synthetic Polynucleotide
taatacgactcactataggggctgggttattgggatcgatggggggcttgaacagaggagacaagccatgcatcgatccaacctggcggcagcgcaaaagatg

SEQ ID NO: 136468 - DNA, 103 bp, Artificial Sequence
  Synthetic Polynucleotide
taatacgactcactatagggccagttggctgctgggttattgggatcgataacagaggagaatcgatatgaataacccaaacctggcggcagcgcaaaagatg

SEQ ID NO: 136469 - DNA, 103 bp, Artificial Sequence
  Synthetic Polynucleotide
taatacgactcactataggggcgcatgaagccagttggctgctgggttataacagaggagaataaccatgcagccaactaacctggcggcagcgcaaaagatg

SEQ ID NO: 136470 - DNA, 103 bp, Artificial Sequence
  Synthetic Polynucleotide
taatacgactcactatagggacgctcagctcatccgcggcgtcggcgcccaacagaggagagggcgcatgcgccgcggaaacctggcggcagcgcaaaagatg

SEQ ID NO: 136471 - DNA, 103 bp, Artificial Sequence
  Synthetic Polynucleotide
taatacgactcactatagggcgagtggagcgcgcatgaagccagttggctaacagaggagaagccaaatggcttcatgcaacctggcggcagcgcaaaagatg

SEQ ID NO: 136472 - DNA, 103 bp, Artificial Sequence
  Synthetic Polynucleotide
taatacgactcactatagggccgctttttccgagtggagcgcgcatgaagaacagaggagacttcatatgcgctccactaacctggcggcagcgcaaaagatg

SEQ ID NO: 136473 - DNA, 103 bp, Artificial Sequence
  Synthetic Polynucleotide
taatacgactcactatagggtataggggcaccgctttttccgagtggagcaacagaggagagctccaatgggaaaaagcaacctggcggcagcgcaaaagatg

SEQ ID NO: 136474 - DNA, 103 bp, Artificial Sequence
  Synthetic Polynucleotide
taatacgactcactatagggtggtgttttgtataggggcaccgctttttcaacagaggagagaaaaaatggtgcccctaaacctggcggcagcgcaaaagatg

SEQ ID NO: 136475 - DNA, 103 bp, Artificial Sequence
  Synthetic Polynucleotide
taatacgactcactatagggttccagggtctggtgttttgtataggggcaaacagaggagatgccccatgacaaaacacaacctggcggcagcgcaaaagatg

SEQ ID NO: 136476 - DNA, 103 bp, Artificial Sequence
  Synthetic Polynucleotide
taatacgactcactatagggctttctccagttccagggtctggtgttttgaacagaggagacaaaacatgagaccctggaacctggcggcagcgcaaaagatg

SEQ ID NO: 136477 - DNA, 103 bp, Artificial Sequence
  Synthetic Polynucleotide
taatacgactcactatagggaacagaaactctttctccagttccagggtcaacagaggagagaccctatgactggagaaaacctggcggcagcgcaaaagatg

SEQ ID NO: 136478 - DNA, 103 bp, Artificial Sequence
  Synthetic Polynucleotide
taatacgactcactataggggtacatgttgaacagaaactctttctccagaacagaggagactggagatggagtttctgaacctggcggcagcgcaaaagatg

SEQ ID NO: 136479 - DNA, 103 bp, Artificial Sequence
  Synthetic Polynucleotide
taatacgactcactatagggccctggtgaggtacatgttgaacagaaactaacagaggagaagtttcatgtcaacatgtaacctggcggcagcgcaaaagatg

SEQ ID NO: 136480 - DNA, 103 bp, Artificial Sequence
  Synthetic Polynucleotide
taatacgactcactatagggtacctgcggtccctggtgaggtacatgttgaacagaggagacaacatatgcctcaccagaacctggcggcagcgcaaaagatg

SEQ ID NO: 136481 - DNA, 103 bp, Artificial Sequence
  Synthetic Polynucleotide
taatacgactcactatagggatagcggccaacgctcagctcatccgcggcaacagaggagagccgcgatggagctgagcaacctggcggcagcgcaaaagatg

SEQ ID NO: 136482 - DNA, 103 bp, Artificial Sequence
  Synthetic Polynucleotide
taatacgactcactatagggagccacctcgtacctgcggtccctggtgagaacagaggagactcaccatggaccgcaggaacctggcggcagcgcaaaagatg

SEQ ID NO: 136483 - DNA, 103 bp, Artificial Sequence
  Synthetic Polynucleotide
taatacgactcactatagggtgagcagtcgagccacctcgtacctgcggtaacagaggagaaccgcaatgacgaggtggaacctggcggcagcgcaaaagatg

SEQ ID NO: 136484 - DNA, 103 bp, Artificial Sequence
  Synthetic Polynucleotide
taatacgactcactatagggtcggtgaggttgagcagtcgagccacctcgaacagaggagacgaggtatgtcgactgctaacctggcggcagcgcaaaagatg

SEQ ID NO: 136485 - DNA, 103 bp, Artificial Sequence
  Synthetic Polynucleotide
taatacgactcactataggggacctgcctctcggtgaggttgagcagtcgaacagaggagacgactgatgaacctcaccaacctggcggcagcgcaaaagatg

SEQ ID NO: 136486 - DNA, 103 bp, Artificial Sequence
  Synthetic Polynucleotide
taatacgactcactatagggaccagatcttgacctgcctctcggtgaggtaacagaggagaacctcaatgagaggcaggaacctggcggcagcgcaaaagatg

SEQ ID NO: 136487 - DNA, 103 bp, Artificial Sequence
  Synthetic Polynucleotide
taatacgactcactatagggcggttctggaaccagatcttgacctgcctcaacagaggagagaggcaatgcaagatctgaacctggcggcagcgcaaaagatg

SEQ ID NO: 136488 - DNA, 103 bp, Artificial Sequence
  Synthetic Polynucleotide
taatacgactcactatagggtttcatcctgcggttctggaaccagatcttaacagaggagaaagatcatgttccagaacaacctggcggcagcgcaaaagatg

SEQ ID NO: 136489 - DNA, 103 bp, Artificial Sequence
  Synthetic Polynucleotide
taatacgactcactatagggttttcttcattttcatcctgcggttctggaaacagaggagatccagaatggcaggatgaaacctggcggcagcgcaaaagatg

SEQ ID NO: 136490 - DNA, 103 bp, Artificial Sequence
  Synthetic Polynucleotide
taatacgactcactatagggtctttgttgattttcttcattttcatcctgaacagaggagacaggatatgaatgaagaaaacctggcggcagcgcaaaagatg

SEQ ID NO: 136491 - DNA, 103 bp, Artificial Sequence
  Synthetic Polynucleotide
taatacgactcactatagggttttgctcggtctttgttgattttcttcataacagaggagaatgaagatgatcaacaaaaacctggcggcagcgcaaaagatg

SEQ ID NO: 136492 - DNA, 103 bp, Artificial Sequence
  Synthetic Polynucleotide
taatacgactcactatagggtccccggcgcatagcggccaacgctcagctaacagaggagaagctgaatgttggccgctaacctggcggcagcgcaaaagatg

SEQ ID NO: 136493 - DNA, 103 bp, Artificial Sequence
  Synthetic Polynucleotide
taatacgactcactatagggtggcccagggtccccggcgcatagcggccaaacagaggagatggccgatgtgcgccgggaacctggcggcagcgcaaaagatg

SEQ ID NO: 136494 - DNA, 103 bp, Artificial Sequence
  Synthetic Polynucleotide
taatacgactcactatagggtaagaaggagttcatcctattatagtccataacagaggagaatggacatgaataggatgaacctggcggcagcgcaaaagatg

SEQ ID NO: 136495 - DNA, 103 bp, Artificial Sequence
  Synthetic Polynucleotide
taatacgactcactataggggtcaaccgcctgagccgagcttgggggaaaaacagaggagatttcccatgagctcggctaacctggcggcagcgcaaaagatg

SEQ ID NO: 136496 - DNA, 103 bp, Artificial Sequence
  Synthetic Polynucleotide
taatacgactcactatagggttgcatagctgtcaaccgcctgagccgagcaacagaggagagctcggatgaggcggttgaacctggcggcagcgcaaaagatg

SEQ ID NO: 136497 - DNA, 103 bp, Artificial Sequence
  Synthetic Polynucleotide
taatacgactcactatagggcggccctcgcttgcatagctgtcaaccgccaacagaggagaggcggtatgcagctatgcaacctggcggcagcgcaaaagatg

SEQ ID NO: 136498 - DNA, 103 bp, Artificial Sequence
  Synthetic Polynucleotide
taatacgactcactatagggcccaccgtagcggccctcgcttgcatagctaacagaggagaagctatatgagcgagggcaacctggcggcagcgcaaaagatg

SEQ ID NO: 136499 - DNA, 103 bp, Artificial Sequence
  Synthetic Polynucleotide
taatacgactcactatagggtggacagccccccaccgtagcggccctcgcaacagaggagagcgaggatggctacggtgaacctggcggcagcgcaaaagatg

SEQ ID NO: 136500 - DNA, 103 bp, Artificial Sequence
  Synthetic Polynucleotide
taatacgactcactatagggaacgcagggctggacagccccccaccgtagaacagaggagactacggatgggggctgtcaacctggcggcagcgcaaaagatg

SEQ ID NO: 136501 - DNA, 103 bp, Artificial Sequence
  Synthetic Polynucleotide
taatacgactcactataggggttctgctgaaacgcagggctggacagcccaacagaggagagggctgatgagccctgcgaacctggcggcagcgcaaaagatg

SEQ ID NO: 136502 - DNA, 103 bp, Artificial Sequence
  Synthetic Polynucleotide
taatacgactcactataggggatagccggagttctgctgaaacgcagggcaacagaggagagccctgatgttcagcagaaacctggcggcagcgcaaaagatg

SEQ ID NO: 136503 - DNA, 103 bp, Artificial Sequence
  Synthetic Polynucleotide
taatacgactcactatagggtgctgggcgggatagccggagttctgctgaaacagaggagatcagcaatgctccggctaaacctggcggcagcgcaaaagatg

SEQ ID NO: 136504 - DNA, 103 bp, Artificial Sequence
  Synthetic Polynucleotide
taatacgactcactatagggcgaaggcggctgctgggcgggatagccggaaacagaggagatccggcatgcccgcccagaacctggcggcagcgcaaaagatg

SEQ ID NO: 136505 - DNA, 103 bp, Artificial Sequence
  Synthetic Polynucleotide
taatacgactcactataggggtgggtactctaagaaggagttcatcctataacagaggagaataggaatgactccttctaacctggcggcagcgcaaaagatg

SEQ ID NO: 136506 - DNA, 103 bp, Artificial Sequence
  Synthetic Polynucleotide
taatacgactcactatagggcccccagggtcgaaggcggctgctgggcggaacagaggagaccgcccatgagccgccttaacctggcggcagcgcaaaagatg

SEQ ID NO: 136507 - DNA, 103 bp, Artificial Sequence
  Synthetic Polynucleotide
taatacgactcactataggggggaagggcacccccagggtcgaaggcggcaacagaggagagccgccatggaccctgggaacctggcggcagcgcaaaagatg

SEQ ID NO: 136508 - DNA, 103 bp, Artificial Sequence
  Synthetic Polynucleotide
taatacgactcactatagggcgcggagctggggaagggcacccccagggtaacagaggagaaccctgatggtgcccttcaacctggcggcagcgcaaaagatg

SEQ ID NO: 136509 - DNA, 103 bp, Artificial Sequence
  Synthetic Polynucleotide
taatacgactcactatagggaccccgagggcgcggagctggggaagggcaaacagaggagatgccctatgccagctccgaacctggcggcagcgcaaaagatg

SEQ ID NO: 136510 - DNA, 103 bp, Artificial Sequence
  Synthetic Polynucleotide
taatacgactcactataggggcaggagcataccccgagggcgcggagctgaacagaggagacagctcatggccctcgggaacctggcggcagcgcaaaagatg

SEQ ID NO: 136511 - DNA, 103 bp, Artificial Sequence
  Synthetic Polynucleotide
taatacgactcactataggggctgcaggcggcaggagcataccccgagggaacagaggagaccctcgatgtatgctcctaacctggcggcagcgcaaaagatg

SEQ ID NO: 136512 - DNA, 103 bp, Artificial Sequence
  Synthetic Polynucleotide
taatacgactcactatagggcgtagctggggctgcaggcggcaggagcataacagaggagaatgctcatgccgcctgcaaacctggcggcagcgcaaaagatg

SEQ ID NO: 136513 - DNA, 103 bp, Artificial Sequence
  Synthetic Polynucleotide
taatacgactcactatagggtgagaaggcccgtagctggggctgcaggcgaacagaggagacgcctgatgccccagctaaacctggcggcagcgcaaaagatg

SEQ ID NO: 136514 - DNA, 103 bp, Artificial Sequence
  Synthetic Polynucleotide
taatacgactcactatagggagggtagtactgagaaggcccgtagctgggaacagaggagacccagcatggggccttctaacctggcggcagcgcaaaagatg

SEQ ID NO: 136515 - DNA, 103 bp, Artificial Sequence
  Synthetic Polynucleotide
taatacgactcactatagggattgacccagagggtagtactgagaaggccaacagaggagaggccttatgagtactaccaacctggcggcagcgcaaaagatg

SEQ ID NO: 136516 - DNA, 103 bp, Artificial Sequence
  Synthetic Polynucleotide
taatacgactcactatagggcggttacagagtgggtactctaagaaggagaacagaggagactccttatgagagtacccaacctggcggcagcgcaaaagatg

SEQ ID NO: 136517 - DNA, 103 bp, Artificial Sequence
  Synthetic Polynucleotide
taatacgactcactatagggtctccttctgattgacccagagggtagtacaacagaggagagtactaatgtctgggtcaaacctggcggcagcgcaaaagatg

SEQ ID NO: 136518 - DNA, 103 bp, Artificial Sequence
  Synthetic Polynucleotide
taatacgactcactatagggatagcctccgtctccttctgattgacccagaacagaggagactgggtatgtcagaaggaaacctggcggcagcgcaaaagatg

SEQ ID NO: 136519 - DNA, 103 bp, Artificial Sequence
  Synthetic Polynucleotide
taatacgactcactatagggagggatgaaaatagcctccgtctccttctgaacagaggagacagaagatgacggaggctaacctggcggcagcgcaaaagatg

SEQ ID NO: 136520 - DNA, 103 bp, Artificial Sequence
  Synthetic Polynucleotide
taatacgactcactatagggccgtagctcgagggatgaaaatagcctccgaacagaggagacggaggatgttttcatccaacctggcggcagcgcaaaagatg

SEQ ID NO: 136521 - DNA, 103 bp, Artificial Sequence
  Synthetic Polynucleotide
taatacgactcactatagggtagctgggccccgtagctcgagggatgaaaaacagaggagatttcatatgtcgagctacaacctggcggcagcgcaaaagatg

SEQ ID NO: 136522 - DNA, 103 bp, Artificial Sequence
  Synthetic Polynucleotide
taatacgactcactatagggacaagccccctagctgggccccgtagctcgaacagaggagacgagctatggggcccagcaacctggcggcagcgcaaaagatg

SEQ ID NO: 136523 - DNA, 103 bp, Artificial Sequence
  Synthetic Polynucleotide
taatacgactcactatagggtagccatcggacaagccccctagctgggccaacagaggagaggcccaatgagggggcttaacctggcggcagcgcaaaagatg
